United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 90

SEQ ID NO: 3206419 - RNA, 18 nt, Mycobacterium bovis subsp bovis AF2122/97
cugccaucccgaucccgg

SEQ ID NO: 3206420 - RNA, 18 nt, Mycobacterium bovis subsp bovis AF2122/97
cugccaucggcaccagcg

SEQ ID NO: 3206421 - RNA, 19 nt, Mycobacterium bovis subsp bovis AF2122/97
cugccaucggcaccagcgc

SEQ ID NO: 3206422 - RNA, 21 nt, Mycobacterium bovis subsp bovis AF2122/97
cugccaucggcaccagcgcgc

SEQ ID NO: 3206423 - RNA, 14 nt, Mycobacterium bovis subsp bovis AF2122/97
cugccaugcgggug

SEQ ID NO: 3206424 - RNA, 18 nt, Mycobacterium bovis subsp bovis AF2122/97
cugccauugccugggcga

SEQ ID NO: 3206425 - RNA, 20 nt, Mycobacterium bovis subsp bovis AF2122/97
cugcccaaaagcgcggcaac

SEQ ID NO: 3206426 - RNA, 12 nt, Mycobacterium bovis subsp bovis AF2122/97
cugcccaccauc

SEQ ID NO: 3206427 - RNA, 15 nt, Mycobacterium bovis subsp bovis AF2122/97
cugcccaccaucccg

SEQ ID NO: 3206428 - RNA, 17 nt, Mycobacterium bovis subsp bovis AF2122/97
cugcccaccaucccgcu

SEQ ID NO: 3206429 - RNA, 13 nt, Mycobacterium bovis subsp bovis AF2122/97
cugcccaccuucg

SEQ ID NO: 3206430 - RNA, 15 nt, Mycobacterium bovis subsp bovis AF2122/97
cugcccacgggccgg

SEQ ID NO: 3206431 - RNA, 16 nt, Mycobacterium bovis subsp bovis AF2122/97
cugcccacgggccggc

SEQ ID NO: 3206432 - RNA, 22 nt, Mycobacterium bovis subsp bovis AF2122/97
cugcccacgggccggccgagcg

SEQ ID NO: 3206433 - RNA, 12 nt, Mycobacterium bovis subsp bovis AF2122/97
cugcccagcacc

SEQ ID NO: 3206434 - RNA, 15 nt, Mycobacterium bovis subsp bovis AF2122/97
cugcccagcaccacc

SEQ ID NO: 3206435 - RNA, 13 nt, Mycobacterium bovis subsp bovis AF2122/97
cugcccagcaccc

SEQ ID NO: 3206436 - RNA, 15 nt, Mycobacterium bovis subsp bovis AF2122/97
cugcccaguauaauu

SEQ ID NO: 3206437 - RNA, 18 nt, Mycobacterium bovis subsp bovis AF2122/97
cugcccaucacacccggu

SEQ ID NO: 3206438 - RNA, 14 nt, Mycobacterium bovis subsp bovis AF2122/97
cugcccaucccggc

SEQ ID NO: 3206439 - RNA, 16 nt, Mycobacterium bovis subsp bovis AF2122/97
cugcccaugcggcagg

SEQ ID NO: 3206440 - RNA, 22 nt, Mycobacterium bovis subsp bovis AF2122/97
cugccccccagacaauccgccg

SEQ ID NO: 3206441 - RNA, 14 nt, Mycobacterium bovis subsp bovis AF2122/97
cugcccccgccggc

SEQ ID NO: 3206442 - RNA, 17 nt, Mycobacterium bovis subsp bovis AF2122/97
cugcccccgccggccgu

SEQ ID NO: 3206443 - RNA, 14 nt, Mycobacterium bovis subsp bovis AF2122/97
cugcccccggcgcg

SEQ ID NO: 3206444 - RNA, 15 nt, Mycobacterium bovis subsp bovis AF2122/97
cugcccccggcgcgg

SEQ ID NO: 3206445 - RNA, 17 nt, Mycobacterium bovis subsp bovis AF2122/97
cugcccccggcgcggcg

SEQ ID NO: 3206446 - RNA, 18 nt, Mycobacterium bovis subsp bovis AF2122/97
cugcccccggcgcggcgg

SEQ ID NO: 3206447 - RNA, 23 nt, Mycobacterium bovis subsp bovis AF2122/97
cugcccccggcgcggcggaccgu

SEQ ID NO: 3206448 - RNA, 16 nt, Mycobacterium bovis subsp bovis AF2122/97
cugccccgcaucgccc

SEQ ID NO: 3206449 - RNA, 15 nt, Mycobacterium bovis subsp bovis AF2122/97
cugccccgccaccuc

SEQ ID NO: 3206450 - RNA, 14 nt, Mycobacterium bovis subsp bovis AF2122/97
cugccccgccgcca

SEQ ID NO: 3206451 - RNA, 12 nt, Mycobacterium bovis subsp bovis AF2122/97
cugccccuccgg

SEQ ID NO: 3206452 - RNA, 14 nt, Mycobacterium bovis subsp bovis AF2122/97
cugcccgaaccacc

SEQ ID NO: 3206453 - RNA, 16 nt, Mycobacterium bovis subsp bovis AF2122/97
cugcccgaaccaccac

SEQ ID NO: 3206454 - RNA, 15 nt, Mycobacterium bovis subsp bovis AF2122/97
cugcccgacacccgc

SEQ ID NO: 3206455 - RNA, 13 nt, Mycobacterium bovis subsp bovis AF2122/97
cugcccgacgacc

SEQ ID NO: 3206456 - RNA, 13 nt, Mycobacterium bovis subsp bovis AF2122/97
cugcccgaggucc

SEQ ID NO: 3206457 - RNA, 22 nt, Mycobacterium bovis subsp bovis AF2122/97
cugcccgaugaucugugccgcu

SEQ ID NO: 3206458 - RNA, 21 nt, Mycobacterium bovis subsp bovis AF2122/97
cugcccgauggcuaccuugga

SEQ ID NO: 3206459 - RNA, 13 nt, Mycobacterium bovis subsp bovis AF2122/97
cugcccgccagcg

SEQ ID NO: 3206460 - RNA, 19 nt, Mycobacterium bovis subsp bovis AF2122/97
cugcccgccagcgccgccg

SEQ ID NO: 3206461 - RNA, 20 nt, Mycobacterium bovis subsp bovis AF2122/97
cugcccgccagcgccgccgc

SEQ ID NO: 3206462 - RNA, 15 nt, Mycobacterium bovis subsp bovis AF2122/97
cugcccgcccagccc

SEQ ID NO: 3206463 - RNA, 23 nt, Mycobacterium bovis subsp bovis AF2122/97
cugcccgcccagcccggcguugu

SEQ ID NO: 3206464 - RNA, 19 nt, Mycobacterium bovis subsp bovis AF2122/97
cugcccgccgacgccagau

SEQ ID NO: 3206465 - RNA, 12 nt, Mycobacterium bovis subsp bovis AF2122/97
cugcccgcgcgg

SEQ ID NO: 3206466 - RNA, 14 nt, Mycobacterium bovis subsp bovis AF2122/97
cugcccgcgcggcc

SEQ ID NO: 3206467 - RNA, 13 nt, Mycobacterium bovis subsp bovis AF2122/97
cugcccgcggacg

SEQ ID NO: 3206468 - RNA, 14 nt, Mycobacterium bovis subsp bovis AF2122/97
cugcccgcggcgga

SEQ ID NO: 3206469 - RNA, 17 nt, Mycobacterium bovis subsp bovis AF2122/97
cugcccggcaaccugga

SEQ ID NO: 3206470 - RNA, 16 nt, Mycobacterium bovis subsp bovis AF2122/97
cugcccggcccgcccg

SEQ ID NO: 3206471 - RNA, 17 nt, Mycobacterium bovis subsp bovis AF2122/97
cugcccggcccgcucag

SEQ ID NO: 3206472 - RNA, 14 nt, Mycobacterium bovis subsp bovis AF2122/97
cugcccggcgccgu

SEQ ID NO: 3206473 - RNA, 18 nt, Mycobacterium bovis subsp bovis AF2122/97
cugcccgggcugccgccc

SEQ ID NO: 3206474 - RNA, 19 nt, Mycobacterium bovis subsp bovis AF2122/97
cugcccgggcugccgccca

SEQ ID NO: 3206475 - RNA, 19 nt, Mycobacterium bovis subsp bovis AF2122/97
cugcccguucugcccaggc

SEQ ID NO: 3206476 - RNA, 19 nt, Mycobacterium bovis subsp bovis AF2122/97
cugcccucaacgaucgcgc

SEQ ID NO: 3206477 - RNA, 21 nt, Mycobacterium bovis subsp bovis AF2122/97
cugcccuccgugggcagcgcg

SEQ ID NO: 3206478 - RNA, 22 nt, Mycobacterium bovis subsp bovis AF2122/97
cugcccuuguugaaguaaugga

SEQ ID NO: 3206479 - RNA, 17 nt, Mycobacterium bovis subsp bovis AF2122/97
cugccgaaacgccgacc

SEQ ID NO: 3206480 - RNA, 17 nt, Mycobacterium bovis subsp bovis AF2122/97
cugccgaagcggccacc

SEQ ID NO: 3206481 - RNA, 18 nt, Mycobacterium bovis subsp bovis AF2122/97
cugccgaagcggccaccg

SEQ ID NO: 3206482 - RNA, 24 nt, Mycobacterium bovis subsp bovis AF2122/97
cugccgaagcggccaccgccgccg

SEQ ID NO: 3206483 - RNA, 21 nt, Mycobacterium bovis subsp bovis AF2122/97
cugccgaaguugaagaagcca

SEQ ID NO: 3206484 - RNA, 16 nt, Mycobacterium bovis subsp bovis AF2122/97
cugccgaccagcgcgc

SEQ ID NO: 3206485 - RNA, 17 nt, Mycobacterium bovis subsp bovis AF2122/97
cugccgaccagcgcgcu

SEQ ID NO: 3206486 - RNA, 15 nt, Mycobacterium bovis subsp bovis AF2122/97
cugccgacgcuccag

SEQ ID NO: 3206487 - RNA, 15 nt, Mycobacterium bovis subsp bovis AF2122/97
cugccgacucaucgg

SEQ ID NO: 3206488 - RNA, 19 nt, Mycobacterium bovis subsp bovis AF2122/97
cugccgacucaucggccgc

SEQ ID NO: 3206489 - RNA, 20 nt, Mycobacterium bovis subsp bovis AF2122/97
cugccgacucaucggccgcg

SEQ ID NO: 3206490 - RNA, 16 nt, Mycobacterium bovis subsp bovis AF2122/97
cugccgagaucccagc

SEQ ID NO: 3206491 - RNA, 19 nt, Mycobacterium bovis subsp bovis AF2122/97
cugccgagaucccagcggg

SEQ ID NO: 3206492 - RNA, 19 nt, Mycobacterium bovis subsp bovis AF2122/97
cugccgaucaauggcaacg

SEQ ID NO: 3206493 - RNA, 23 nt, Mycobacterium bovis subsp bovis AF2122/97
cugccgauguguggaacauccgc

SEQ ID NO: 3206494 - RNA, 18 nt, Mycobacterium bovis subsp bovis AF2122/97
cugccgcacacgcgugca

SEQ ID NO: 3206495 - RNA, 17 nt, Mycobacterium bovis subsp bovis AF2122/97
cugccgcaccaaggccg

SEQ ID NO: 3206496 - RNA, 13 nt, Mycobacterium bovis subsp bovis AF2122/97
cugccgcacccgg

SEQ ID NO: 3206497 - RNA, 14 nt, Mycobacterium bovis subsp bovis AF2122/97
cugccgcacccggu

SEQ ID NO: 3206498 - RNA, 17 nt, Mycobacterium bovis subsp bovis AF2122/97
cugccgcacccggucga

SEQ ID NO: 3206499 - RNA, 12 nt, Mycobacterium bovis subsp bovis AF2122/97
cugccgcaccgg

SEQ ID NO: 3206500 - RNA, 15 nt, Mycobacterium bovis subsp bovis AF2122/97
cugccgcacgggccc

SEQ ID NO: 3206501 - RNA, 18 nt, Mycobacterium bovis subsp bovis AF2122/97
cugccgcacgggcccagg

SEQ ID NO: 3206502 - RNA, 21 nt, Mycobacterium bovis subsp bovis AF2122/97
cugccgcacgggcccaggaca

SEQ ID NO: 3206503 - RNA, 17 nt, Mycobacterium bovis subsp bovis AF2122/97
cugccgcacguucggcg

SEQ ID NO: 3206504 - RNA, 18 nt, Mycobacterium bovis subsp bovis AF2122/97
cugccgcacguucggcga

SEQ ID NO: 3206505 - RNA, 16 nt, Mycobacterium bovis subsp bovis AF2122/97
cugccgcacugggcga

SEQ ID NO: 3206506 - RNA, 14 nt, Mycobacterium bovis subsp bovis AF2122/97
cugccgcagcucag

SEQ ID NO: 3206507 - RNA, 19 nt, Mycobacterium bovis subsp bovis AF2122/97
cugccgcaguucaucgaga

SEQ ID NO: 3206508 - RNA, 19 nt, Mycobacterium bovis subsp bovis AF2122/97
cugccgcaugcgcuccggc

SEQ ID NO: 3206509 - RNA, 15 nt, Mycobacterium bovis subsp bovis AF2122/97
cugccgcccuugccg

SEQ ID NO: 3206510 - RNA, 21 nt, Mycobacterium bovis subsp bovis AF2122/97
cugccgcccuugccgcccgcu

SEQ ID NO: 3206511 - RNA, 14 nt, Mycobacterium bovis subsp bovis AF2122/97
cugccgccgagcug

SEQ ID NO: 3206512 - RNA, 16 nt, Mycobacterium bovis subsp bovis AF2122/97
cugccgccgagcuggc

SEQ ID NO: 3206513 - RNA, 19 nt, Mycobacterium bovis subsp bovis AF2122/97
cugccgccgagcuggcgcg

SEQ ID NO: 3206514 - RNA, 13 nt, Mycobacterium bovis subsp bovis AF2122/97
cugccgccgccgc

SEQ ID NO: 3206515 - RNA, 15 nt, Mycobacterium bovis subsp bovis AF2122/97
cugccgccgccgccg

SEQ ID NO: 3206516 - RNA, 15 nt, Mycobacterium bovis subsp bovis AF2122/97
cugccgccgcggcca

SEQ ID NO: 3206517 - RNA, 17 nt, Mycobacterium bovis subsp bovis AF2122/97
cugccgccgcggccaca

SEQ ID NO: 3206518 - RNA, 14 nt, Mycobacterium bovis subsp bovis AF2122/97
cugccgccgcucca

SEQ ID NO: 3206519 - RNA, 16 nt, Mycobacterium bovis subsp bovis AF2122/97
cugccgccggugccgc

SEQ ID NO: 3206520 - RNA, 19 nt, Mycobacterium bovis subsp bovis AF2122/97
cugccgccggugccgccgg

SEQ ID NO: 3206521 - RNA, 18 nt, Mycobacterium bovis subsp bovis AF2122/97
cugccgccgucgccgccg

SEQ ID NO: 3206522 - RNA, 22 nt, Mycobacterium bovis subsp bovis AF2122/97
cugccgccgucgccgccgucac

SEQ ID NO: 3206523 - RNA, 11 nt, Mycobacterium bovis subsp bovis AF2122/97
cugccgccguu

SEQ ID NO: 3206524 - RNA, 21 nt, Mycobacterium bovis subsp bovis AF2122/97
cugccgccuuggucgcgucgg

SEQ ID NO: 3206525 - RNA, 17 nt, Mycobacterium bovis subsp bovis AF2122/97
cugccgcgaugagcggc

SEQ ID NO: 3206526 - RNA, 14 nt, Mycobacterium bovis subsp bovis AF2122/97
cugccgcgcgcugc

SEQ ID NO: 3206527 - RNA, 14 nt, Mycobacterium bovis subsp bovis AF2122/97
cugccgcgcggcga

SEQ ID NO: 3206528 - RNA, 13 nt, Mycobacterium bovis subsp bovis AF2122/97
cugccgcggcacc

SEQ ID NO: 3206529 - RNA, 13 nt, Mycobacterium bovis subsp bovis AF2122/97
cugccgcggccgg

SEQ ID NO: 3206530 - RNA, 16 nt, Mycobacterium bovis subsp bovis AF2122/97
cugccgcggccggcgu

SEQ ID NO: 3206531 - RNA, 20 nt, Mycobacterium bovis subsp bovis AF2122/97
cugccgcguagaacccaggc

SEQ ID NO: 3206532 - RNA, 15 nt, Mycobacterium bovis subsp bovis AF2122/97
cugccgcucgccggu

SEQ ID NO: 3206533 - RNA, 15 nt, Mycobacterium bovis subsp bovis AF2122/97
cugccgcugcgccgu

SEQ ID NO: 3206534 - RNA, 17 nt, Mycobacterium bovis subsp bovis AF2122/97
cugccgcuggucgucga

SEQ ID NO: 3206535 - RNA, 18 nt, Mycobacterium bovis subsp bovis AF2122/97
cugccggacagccacgca

SEQ ID NO: 3206536 - RNA, 15 nt, Mycobacterium bovis subsp bovis AF2122/97
cugccggacuaccgc

SEQ ID NO: 3206537 - RNA, 18 nt, Mycobacterium bovis subsp bovis AF2122/97
cugccggacuaccgccgg

SEQ ID NO: 3206538 - RNA, 17 nt, Mycobacterium bovis subsp bovis AF2122/97
cugccggagacacccgc

SEQ ID NO: 3206539 - RNA, 19 nt, Mycobacterium bovis subsp bovis AF2122/97
cugccggcaacagcucgcc

SEQ ID NO: 3206540 - RNA, 15 nt, Mycobacterium bovis subsp bovis AF2122/97
cugccggcaccaacc

SEQ ID NO: 3206541 - RNA, 21 nt, Mycobacterium bovis subsp bovis AF2122/97
cugccggcaccaaccaccgac

SEQ ID NO: 3206542 - RNA, 15 nt, Mycobacterium bovis subsp bovis AF2122/97
cugccggcacgcaug

SEQ ID NO: 3206543 - RNA, 17 nt, Mycobacterium bovis subsp bovis AF2122/97
cugccggcacgcaugcc

SEQ ID NO: 3206544 - RNA, 14 nt, Mycobacterium bovis subsp bovis AF2122/97
cugccggcacgccg

SEQ ID NO: 3206545 - RNA, 14 nt, Mycobacterium bovis subsp bovis AF2122/97
cugccggcagcggc

SEQ ID NO: 3206546 - RNA, 15 nt, Mycobacterium bovis subsp bovis AF2122/97
cugccggcagcgucc

SEQ ID NO: 3206547 - RNA, 14 nt, Mycobacterium bovis subsp bovis AF2122/97
cugccggcccacca

SEQ ID NO: 3206548 - RNA, 14 nt, Mycobacterium bovis subsp bovis AF2122/97
cugccggccgcgua

SEQ ID NO: 3206549 - RNA, 18 nt, Mycobacterium bovis subsp bovis AF2122/97
cugccggccgcguaaacc

SEQ ID NO: 3206550 - RNA, 12 nt, Mycobacterium bovis subsp bovis AF2122/97
cugccggccggc

SEQ ID NO: 3206551 - RNA, 16 nt, Mycobacterium bovis subsp bovis AF2122/97
cugccggccggcgggc

SEQ ID NO: 3206552 - RNA, 20 nt, Mycobacterium bovis subsp bovis AF2122/97
cugccggccggcgggccugc

SEQ ID NO: 3206553 - RNA, 22 nt, Mycobacterium bovis subsp bovis AF2122/97
cugccggccggcgggccugccc

SEQ ID NO: 3206554 - RNA, 13 nt, Mycobacterium bovis subsp bovis AF2122/97
cugccggcugaca

SEQ ID NO: 3206555 - RNA, 17 nt, Mycobacterium bovis subsp bovis AF2122/97
cugccggcugacgacca

SEQ ID NO: 3206556 - RNA, 22 nt, Mycobacterium bovis subsp bovis AF2122/97
cugccggcugacgaccaaccac

SEQ ID NO: 3206557 - RNA, 15 nt, Mycobacterium bovis subsp bovis AF2122/97
cugccgggccacggc

SEQ ID NO: 3206558 - RNA, 17 nt, Mycobacterium bovis subsp bovis AF2122/97
cugccgggccacggcug

SEQ ID NO: 3206559 - RNA, 16 nt, Mycobacterium bovis subsp bovis AF2122/97
cugccgggggcccgac

SEQ ID NO: 3206560 - RNA, 19 nt, Mycobacterium bovis subsp bovis AF2122/97
cugccgggugggcaagcug

SEQ ID NO: 3206561 - RNA, 24 nt, Mycobacterium bovis subsp bovis AF2122/97
cugccggguggguaauacaggccg

SEQ ID NO: 3206562 - RNA, 17 nt, Mycobacterium bovis subsp bovis AF2122/97
cugccgguagcacagca

SEQ ID NO: 3206563 - RNA, 20 nt, Mycobacterium bovis subsp bovis AF2122/97
cugccgguagcacagcagca

SEQ ID NO: 3206564 - RNA, 21 nt, Mycobacterium bovis subsp bovis AF2122/97
cugccgguagcacagcagcaa

SEQ ID NO: 3206565 - RNA, 16 nt, Mycobacterium bovis subsp bovis AF2122/97
cugccggucgaugucg

SEQ ID NO: 3206566 - RNA, 18 nt, Mycobacterium bovis subsp bovis AF2122/97
cugccggugagugcgcga

SEQ ID NO: 3206567 - RNA, 23 nt, Mycobacterium bovis subsp bovis AF2122/97
cugccggugagugcgcgauaggu

SEQ ID NO: 3206568 - RNA, 14 nt, Mycobacterium bovis subsp bovis AF2122/97
cugccgguggcggc

SEQ ID NO: 3206569 - RNA, 17 nt, Mycobacterium bovis subsp bovis AF2122/97
cugccgguggcggcggc

SEQ ID NO: 3206570 - RNA, 23 nt, Mycobacterium bovis subsp bovis AF2122/97
cugccgguggcggcggcggcaac

SEQ ID NO: 3206571 - RNA, 13 nt, Mycobacterium bovis subsp bovis AF2122/97
cugccgguguaca

SEQ ID NO: 3206572 - RNA, 22 nt, Mycobacterium bovis subsp bovis AF2122/97
cugccgguguaggccucggcag

SEQ ID NO: 3206573 - RNA, 21 nt, Mycobacterium bovis subsp bovis AF2122/97
cugccggugucucccuugccg

SEQ ID NO: 3206574 - RNA, 21 nt, Mycobacterium bovis subsp bovis AF2122/97
cugccgguguuguaggccggg

SEQ ID NO: 3206575 - RNA, 19 nt, Mycobacterium bovis subsp bovis AF2122/97
cugccguauccaggcgugc

SEQ ID NO: 3206576 - RNA, 19 nt, Mycobacterium bovis subsp bovis AF2122/97
cugccgucagccguucggc

SEQ ID NO: 3206577 - RNA, 14 nt, Mycobacterium bovis subsp bovis AF2122/97
cugccgucgcugcc

SEQ ID NO: 3206578 - RNA, 16 nt, Mycobacterium bovis subsp bovis AF2122/97
cugccgucgcugcccc

SEQ ID NO: 3206579 - RNA, 21 nt, Mycobacterium bovis subsp bovis AF2122/97
cugccgucggagaccagcucg

SEQ ID NO: 3206580 - RNA, 22 nt, Mycobacterium bovis subsp bovis AF2122/97
cugccgucggagaccagcucgu

SEQ ID NO: 3206581 - RNA, 15 nt, Mycobacterium bovis subsp bovis AF2122/97
cugccgucuccuggu

SEQ ID NO: 3206582 - RNA, 20 nt, Mycobacterium bovis subsp bovis AF2122/97
cugccguuagcuuagcugcc

SEQ ID NO: 3206583 - RNA, 23 nt, Mycobacterium bovis subsp bovis AF2122/97
cugccguuagcuuagcugccguc

SEQ ID NO: 3206584 - RNA, 22 nt, Mycobacterium bovis subsp bovis AF2122/97
cugccguuccagcaucggugcg

SEQ ID NO: 3206585 - RNA, 12 nt, Mycobacterium bovis subsp bovis AF2122/97
cugccguucggg

SEQ ID NO: 3206586 - RNA, 22 nt, Mycobacterium bovis subsp bovis AF2122/97
cugccguucggggcgcgguacc

SEQ ID NO: 3206587 - RNA, 20 nt, Mycobacterium bovis subsp bovis AF2122/97
cugccguugauucggccgcc

SEQ ID NO: 3206588 - RNA, 21 nt, Mycobacterium bovis subsp bovis AF2122/97
cugccguugauucggccgccg

SEQ ID NO: 3206589 - RNA, 24 nt, Mycobacterium bovis subsp bovis AF2122/97
cugccguugauucggccgccgacg

SEQ ID NO: 3206590 - RNA, 16 nt, Mycobacterium bovis subsp bovis AF2122/97
cugccguugggcaccg

SEQ ID NO: 3206591 - RNA, 16 nt, Mycobacterium bovis subsp bovis AF2122/97
cugccucaccgccgcu

SEQ ID NO: 3206592 - RNA, 21 nt, Mycobacterium bovis subsp bovis AF2122/97
cugccucaccgccgcuaccgc

SEQ ID NO: 3206593 - RNA, 17 nt, Mycobacterium bovis subsp bovis AF2122/97
cugccuccggaaggcuc

SEQ ID NO: 3206594 - RNA, 22 nt, Mycobacterium bovis subsp bovis AF2122/97
cugccucgccugcacgcccggc

SEQ ID NO: 3206595 - RNA, 19 nt, Mycobacterium bovis subsp bovis AF2122/97
cugccucggggccuaucaa

SEQ ID NO: 3206596 - RNA, 14 nt, Mycobacterium bovis subsp bovis AF2122/97
cugccucucgaccu

SEQ ID NO: 3206597 - RNA, 17 nt, Mycobacterium bovis subsp bovis AF2122/97
cugccucuugcucggcg

SEQ ID NO: 3206598 - RNA, 20 nt, Mycobacterium bovis subsp bovis AF2122/97
cugccucuugcucggcgugc

SEQ ID NO: 3206599 - RNA, 18 nt, Mycobacterium bovis subsp bovis AF2122/97
cugccuggccgggaccgc

SEQ ID NO: 3206600 - RNA, 21 nt, Mycobacterium bovis subsp bovis AF2122/97
cugccuggccgggaccgcccc

SEQ ID NO: 3206601 - RNA, 22 nt, Mycobacterium bovis subsp bovis AF2122/97
cugccuggccgggaccgccccg

SEQ ID NO: 3206602 - RNA, 15 nt, Mycobacterium bovis subsp bovis AF2122/97
cugccuuacacgccu

SEQ ID NO: 3206603 - RNA, 16 nt, Mycobacterium bovis subsp bovis AF2122/97
cugccuuaccaaccgg

SEQ ID NO: 3206604 - RNA, 12 nt, Mycobacterium bovis subsp bovis AF2122/97
cugccuucggcg

SEQ ID NO: 3206605 - RNA, 11 nt, Mycobacterium bovis subsp bovis AF2122/97
cugccuucuuu

SEQ ID NO: 3206606 - RNA, 21 nt, Mycobacterium bovis subsp bovis AF2122/97
cugccuucuuugccggcgccu

SEQ ID NO: 3206607 - RNA, 14 nt, Mycobacterium bovis subsp bovis AF2122/97
cugccuuggccggc

SEQ ID NO: 3206608 - RNA, 15 nt, Mycobacterium bovis subsp bovis AF2122/97
cugccuuggccggcu

SEQ ID NO: 3206609 - RNA, 17 nt, Mycobacterium bovis subsp bovis AF2122/97
cugccuugggaccgcgc

SEQ ID NO: 3206610 - RNA, 18 nt, Mycobacterium bovis subsp bovis AF2122/97
cugcgaaaauccgugccg

SEQ ID NO: 3206611 - RNA, 15 nt, Mycobacterium bovis subsp bovis AF2122/97
cugcgaaacgccacc

SEQ ID NO: 3206612 - RNA, 16 nt, Mycobacterium bovis subsp bovis AF2122/97
cugcgaaacgccaccg

SEQ ID NO: 3206613 - RNA, 15 nt, Mycobacterium bovis subsp bovis AF2122/97
cugcgaaacgcuggc

SEQ ID NO: 3206614 - RNA, 18 nt, Mycobacterium bovis subsp bovis AF2122/97
cugcgaaagccacucgcg

SEQ ID NO: 3206615 - RNA, 13 nt, Mycobacterium bovis subsp bovis AF2122/97
cugcgaacccugc

SEQ ID NO: 3206616 - RNA, 23 nt, Mycobacterium bovis subsp bovis AF2122/97
cugcgaagaguccuuaaacgucg

SEQ ID NO: 3206617 - RNA, 20 nt, Mycobacterium bovis subsp bovis AF2122/97
cugcgaagccgagcaucaga

SEQ ID NO: 3206618 - RNA, 22 nt, Mycobacterium bovis subsp bovis AF2122/97
cugcgaaggaccagagcucgaa

SEQ ID NO: 3206619 - RNA, 20 nt, Mycobacterium bovis subsp bovis AF2122/97
cugcgaagucgcauggcggc

SEQ ID NO: 3206620 - RNA, 19 nt, Mycobacterium bovis subsp bovis AF2122/97
cugcgaaucuccgcgcggu

SEQ ID NO: 3206621 - RNA, 14 nt, Mycobacterium bovis subsp bovis AF2122/97
cugcgaaugcuggg

SEQ ID NO: 3206622 - RNA, 21 nt, Mycobacterium bovis subsp bovis AF2122/97
cugcgaaugcugggcccgcca

SEQ ID NO: 3206623 - RNA, 18 nt, Mycobacterium bovis subsp bovis AF2122/97
cugcgacagcacgugccc

SEQ ID NO: 3206624 - RNA, 17 nt, Mycobacterium bovis subsp bovis AF2122/97
cugcgaccaagucaugc

SEQ ID NO: 3206625 - RNA, 21 nt, Mycobacterium bovis subsp bovis AF2122/97
cugcgaccaagucaugcccac

SEQ ID NO: 3206626 - RNA, 16 nt, Mycobacterium bovis subsp bovis AF2122/97
cugcgaccaggcgcgg

SEQ ID NO: 3206627 - RNA, 15 nt, Mycobacterium bovis subsp bovis AF2122/97
cugcgacccgggccg

SEQ ID NO: 3206628 - RNA, 16 nt, Mycobacterium bovis subsp bovis AF2122/97
cugcgaccgucccggc

SEQ ID NO: 3206629 - RNA, 18 nt, Mycobacterium bovis subsp bovis AF2122/97
cugcgaccgucccggccu

SEQ ID NO: 3206630 - RNA, 22 nt, Mycobacterium bovis subsp bovis AF2122/97
cugcgaccgucccggccucgau

SEQ ID NO: 3206631 - RNA, 15 nt, Mycobacterium bovis subsp bovis AF2122/97
cugcgaccucgccgg

SEQ ID NO: 3206632 - RNA, 18 nt, Mycobacterium bovis subsp bovis AF2122/97
cugcgaccucgccggacg

SEQ ID NO: 3206633 - RNA, 18 nt, Mycobacterium bovis subsp bovis AF2122/97
cugcgacgagcccaccgu

SEQ ID NO: 3206634 - RNA, 19 nt, Mycobacterium bovis subsp bovis AF2122/97
cugcgacgaugccgccugg

SEQ ID NO: 3206635 - RNA, 19 nt, Mycobacterium bovis subsp bovis AF2122/97
cugcgacguuaacugcgcc

SEQ ID NO: 3206636 - RNA, 18 nt, Mycobacterium bovis subsp bovis AF2122/97
cugcgacuaagggcacuc

SEQ ID NO: 3206637 - RNA, 22 nt, Mycobacterium bovis subsp bovis AF2122/97
cugcgacuaagggcacuccacc

SEQ ID NO: 3206638 - RNA, 23 nt, Mycobacterium bovis subsp bovis AF2122/97
cugcgacuaagggcacuccaccg

SEQ ID NO: 3206639 - RNA, 18 nt, Mycobacterium bovis subsp bovis AF2122/97
cugcgagauguccuccca

SEQ ID NO: 3206640 - RNA, 13 nt, Mycobacterium bovis subsp bovis AF2122/97
cugcgagcaguug

SEQ ID NO: 3206641 - RNA, 14 nt, Mycobacterium bovis subsp bovis AF2122/97
cugcgagcgcagcg

SEQ ID NO: 3206642 - RNA, 16 nt, Mycobacterium bovis subsp bovis AF2122/97
cugcgagcgcagcgca

SEQ ID NO: 3206643 - RNA, 17 nt, Mycobacterium bovis subsp bovis AF2122/97
cugcgagggcacgcgca

SEQ ID NO: 3206644 - RNA, 15 nt, Mycobacterium bovis subsp bovis AF2122/97
cugcgagugcggcac

SEQ ID NO: 3206645 - RNA, 18 nt, Mycobacterium bovis subsp bovis AF2122/97
cugcgaguucguagucgg

SEQ ID NO: 3206646 - RNA, 22 nt, Mycobacterium bovis subsp bovis AF2122/97
cugcgaucaacccuacccgcau

SEQ ID NO: 3206647 - RNA, 24 nt, Mycobacterium bovis subsp bovis AF2122/97
cugcgaucaacccuacccgcauga

SEQ ID NO: 3206648 - RNA, 16 nt, Mycobacterium bovis subsp bovis AF2122/97
cugcgaucgccgcgcu

SEQ ID NO: 3206649 - RNA, 15 nt, Mycobacterium bovis subsp bovis AF2122/97
cugcgaucgcgaccc

SEQ ID NO: 3206650 - RNA, 14 nt, Mycobacterium bovis subsp bovis AF2122/97
cugcgaucggccgc

SEQ ID NO: 3206651 - RNA, 15 nt, Mycobacterium bovis subsp bovis AF2122/97
cugcgaucggccgcc

SEQ ID NO: 3206652 - RNA, 20 nt, Mycobacterium bovis subsp bovis AF2122/97
cugcgaucugaaacagucga

SEQ ID NO: 3206653 - RNA, 21 nt, Mycobacterium bovis subsp bovis AF2122/97
cugcgaugaugugcgaccaca

SEQ ID NO: 3206654 - RNA, 19 nt, Mycobacterium bovis subsp bovis AF2122/97
cugcgauuuucggcacgga

SEQ ID NO: 3206655 - RNA, 17 nt, Mycobacterium bovis subsp bovis AF2122/97
cugcgcaacaccaucag

SEQ ID NO: 3206656 - RNA, 18 nt, Mycobacterium bovis subsp bovis AF2122/97
cugcgcaacaccaucagc

SEQ ID NO: 3206657 - RNA, 17 nt, Mycobacterium bovis subsp bovis AF2122/97
cugcgcaaccgagcggu

SEQ ID NO: 3206658 - RNA, 20 nt, Mycobacterium bovis subsp bovis AF2122/97
cugcgcaaccgagcggucga

SEQ ID NO: 3206659 - RNA, 14 nt, Mycobacterium bovis subsp bovis AF2122/97
cugcgcaccaaggc

SEQ ID NO: 3206660 - RNA, 14 nt, Mycobacterium bovis subsp bovis AF2122/97
cugcgcaccgccgc

SEQ ID NO: 3206661 - RNA, 16 nt, Mycobacterium bovis subsp bovis AF2122/97
cugcgcaccgccgcgc

SEQ ID NO: 3206662 - RNA, 17 nt, Mycobacterium bovis subsp bovis AF2122/97
cugcgcaccgccgcgcg

SEQ ID NO: 3206663 - RNA, 18 nt, Mycobacterium bovis subsp bovis AF2122/97
cugcgcaccgccgcgcga

SEQ ID NO: 3206664 - RNA, 12 nt, Mycobacterium bovis subsp bovis AF2122/97
cugcgcaccugg

SEQ ID NO: 3206665 - RNA, 20 nt, Mycobacterium bovis subsp bovis AF2122/97
cugcgcaccugggucgacga

SEQ ID NO: 3206666 - RNA, 21 nt, Mycobacterium bovis subsp bovis AF2122/97
cugcgcagaaucgccugcgac

SEQ ID NO: 3206667 - RNA, 17 nt, Mycobacterium bovis subsp bovis AF2122/97
cugcgcagccgccucaa

SEQ ID NO: 3206668 - RNA, 14 nt, Mycobacterium bovis subsp bovis AF2122/97
cugcgcagcgcaac

SEQ ID NO: 3206669 - RNA, 18 nt, Mycobacterium bovis subsp bovis AF2122/97
cugcgcagcgcaacaucg

SEQ ID NO: 3206670 - RNA, 15 nt, Mycobacterium bovis subsp bovis AF2122/97
cugcgcagcgccugc

SEQ ID NO: 3206671 - RNA, 13 nt, Mycobacterium bovis subsp bovis AF2122/97
cugcgcaucacca

SEQ ID NO: 3206672 - RNA, 18 nt, Mycobacterium bovis subsp bovis AF2122/97
cugcgcaucaccacuggc

SEQ ID NO: 3206673 - RNA, 21 nt, Mycobacterium bovis subsp bovis AF2122/97
cugcgcaucaccacuggcggu

SEQ ID NO: 3206674 - RNA, 14 nt, Mycobacterium bovis subsp bovis AF2122/97
cugcgcaucgccac

SEQ ID NO: 3206675 - RNA, 16 nt, Mycobacterium bovis subsp bovis AF2122/97
cugcgcaucgccacca

SEQ ID NO: 3206676 - RNA, 15 nt, Mycobacterium bovis subsp bovis AF2122/97
cugcgcaucggucca

SEQ ID NO: 3206677 - RNA, 21 nt, Mycobacterium bovis subsp bovis AF2122/97
cugcgccaaaauccgcccacc

SEQ ID NO: 3206678 - RNA, 12 nt, Mycobacterium bovis subsp bovis AF2122/97
cugcgccacacc

SEQ ID NO: 3206679 - RNA, 16 nt, Mycobacterium bovis subsp bovis AF2122/97
cugcgccacccgcggu

SEQ ID NO: 3206680 - RNA, 13 nt, Mycobacterium bovis subsp bovis AF2122/97
cugcgccaccggu

SEQ ID NO: 3206681 - RNA, 17 nt, Mycobacterium bovis subsp bovis AF2122/97
cugcgccaccggugagg

SEQ ID NO: 3206682 - RNA, 21 nt, Mycobacterium bovis subsp bovis AF2122/97
cugcgccagaaagcccagggg

SEQ ID NO: 3206683 - RNA, 17 nt, Mycobacterium bovis subsp bovis AF2122/97
cugcgccaggaauugcc

SEQ ID NO: 3206684 - RNA, 14 nt, Mycobacterium bovis subsp bovis AF2122/97
cugcgccaggucag

SEQ ID NO: 3206685 - RNA, 20 nt, Mycobacterium bovis subsp bovis AF2122/97
cugcgccaucacaucggccu

SEQ ID NO: 3206686 - RNA, 17 nt, Mycobacterium bovis subsp bovis AF2122/97
cugcgcccacccgcgcc

SEQ ID NO: 3206687 - RNA, 18 nt, Mycobacterium bovis subsp bovis AF2122/97
cugcgcccacccgcgccu

SEQ ID NO: 3206688 - RNA, 15 nt, Mycobacterium bovis subsp bovis AF2122/97
cugcgcccauagcug

SEQ ID NO: 3206689 - RNA, 12 nt, Mycobacterium bovis subsp bovis AF2122/97
cugcgcccgcca

SEQ ID NO: 3206690 - RNA, 14 nt, Mycobacterium bovis subsp bovis AF2122/97
cugcgcccguccgc

SEQ ID NO: 3206691 - RNA, 14 nt, Mycobacterium bovis subsp bovis AF2122/97
cugcgccgaacacc

SEQ ID NO: 3206692 - RNA, 22 nt, Mycobacterium bovis subsp bovis AF2122/97
cugcgccgaacaccacaccgag

SEQ ID NO: 3206693 - RNA, 18 nt, Mycobacterium bovis subsp bovis AF2122/97
cugcgccgaacgcuccag

SEQ ID NO: 3206694 - RNA, 17 nt, Mycobacterium bovis subsp bovis AF2122/97
cugcgccgacccgcgcg

SEQ ID NO: 3206695 - RNA, 18 nt, Mycobacterium bovis subsp bovis AF2122/97
cugcgccgacccgcgcgc

SEQ ID NO: 3206696 - RNA, 21 nt, Mycobacterium bovis subsp bovis AF2122/97
cugcgccgacccgcgcgccgg

SEQ ID NO: 3206697 - RNA, 22 nt, Mycobacterium bovis subsp bovis AF2122/97
cugcgccgauacccagcggguc

SEQ ID NO: 3206698 - RNA, 14 nt, Mycobacterium bovis subsp bovis AF2122/97
cugcgccgccagcg

SEQ ID NO: 3206699 - RNA, 20 nt, Mycobacterium bovis subsp bovis AF2122/97
cugcgccgccagcgccgccg

SEQ ID NO: 3206700 - RNA, 12 nt, Mycobacterium bovis subsp bovis AF2122/97
cugcgccgcccg

SEQ ID NO: 3206701 - RNA, 20 nt, Mycobacterium bovis subsp bovis AF2122/97
cugcgccgcccgcgccaccg

SEQ ID NO: 3206702 - RNA, 14 nt, Mycobacterium bovis subsp bovis AF2122/97
cugcgccgccggcg

SEQ ID NO: 3206703 - RNA, 16 nt, Mycobacterium bovis subsp bovis AF2122/97
cugcgccgccggcggc

SEQ ID NO: 3206704 - RNA, 17 nt, Mycobacterium bovis subsp bovis AF2122/97
cugcgccgccggcggcg

SEQ ID NO: 3206705 - RNA, 13 nt, Mycobacterium bovis subsp bovis AF2122/97
cugcgccgcgcgc

SEQ ID NO: 3206706 - RNA, 14 nt, Mycobacterium bovis subsp bovis AF2122/97
cugcgccggccggc

SEQ ID NO: 3206707 - RNA, 17 nt, Mycobacterium bovis subsp bovis AF2122/97
cugcgccggccggcgca

SEQ ID NO: 3206708 - RNA, 22 nt, Mycobacterium bovis subsp bovis AF2122/97
cugcgccgggucuguccaaugc

SEQ ID NO: 3206709 - RNA, 19 nt, Mycobacterium bovis subsp bovis AF2122/97
cugcgccgguaacuguccg

SEQ ID NO: 3206710 - RNA, 19 nt, Mycobacterium bovis subsp bovis AF2122/97
cugcgccggugccggccau

SEQ ID NO: 3206711 - RNA, 16 nt, Mycobacterium bovis subsp bovis AF2122/97
cugcgccgugacccau

SEQ ID NO: 3206712 - RNA, 15 nt, Mycobacterium bovis subsp bovis AF2122/97
cugcgccguucgcuc

SEQ ID NO: 3206713 - RNA, 19 nt, Mycobacterium bovis subsp bovis AF2122/97
cugcgccguucgcuccccc

SEQ ID NO: 3206714 - RNA, 17 nt, Mycobacterium bovis subsp bovis AF2122/97
cugcgccuaaccccggc

SEQ ID NO: 3206715 - RNA, 14 nt, Mycobacterium bovis subsp bovis AF2122/97
cugcgccucggcgg

SEQ ID NO: 3206716 - RNA, 15 nt, Mycobacterium bovis subsp bovis AF2122/97
cugcgccucggcggc

SEQ ID NO: 3206717 - RNA, 18 nt, Mycobacterium bovis subsp bovis AF2122/97
cugcgccucggcggccag

SEQ ID NO: 3206718 - RNA, 15 nt, Mycobacterium bovis subsp bovis AF2122/97
cugcgccuucgccag

SEQ ID NO: 3206719 - RNA, 16 nt, Mycobacterium bovis subsp bovis AF2122/97
cugcgccuucgccagc

SEQ ID NO: 3206720 - RNA, 17 nt, Mycobacterium bovis subsp bovis AF2122/97
cugcgccuucgccagcg

SEQ ID NO: 3206721 - RNA, 21 nt, Mycobacterium bovis subsp bovis AF2122/97
cugcgccuucgccagcggcgc

SEQ ID NO: 3206722 - RNA, 23 nt, Mycobacterium bovis subsp bovis AF2122/97
cugcgccuucgccagcggcgcga

SEQ ID NO: 3206723 - RNA, 15 nt, Mycobacterium bovis subsp bovis AF2122/97
cugcgcgaagccacc

SEQ ID NO: 3206724 - RNA, 18 nt, Mycobacterium bovis subsp bovis AF2122/97
cugcgcgaagccaccagg

SEQ ID NO: 3206725 - RNA, 19 nt, Mycobacterium bovis subsp bovis AF2122/97
cugcgcgaaggggacgugc

SEQ ID NO: 3206726 - RNA, 18 nt, Mycobacterium bovis subsp bovis AF2122/97
cugcgcgacgacauuggu

SEQ ID NO: 3206727 - RNA, 16 nt, Mycobacterium bovis subsp bovis AF2122/97
cugcgcgauccgcgcg

SEQ ID NO: 3206728 - RNA, 21 nt, Mycobacterium bovis subsp bovis AF2122/97
cugcgcgaugcccacgcacag

SEQ ID NO: 3206729 - RNA, 15 nt, Mycobacterium bovis subsp bovis AF2122/97
cugcgcgaugcgauu

SEQ ID NO: 3206730 - RNA, 22 nt, Mycobacterium bovis subsp bovis AF2122/97
cugcgcgauggccguugccaac

SEQ ID NO: 3206731 - RNA, 20 nt, Mycobacterium bovis subsp bovis AF2122/97
cugcgcgccagacacaaccg

SEQ ID NO: 3206732 - RNA, 18 nt, Mycobacterium bovis subsp bovis AF2122/97
cugcgcgcccaccgggcg

SEQ ID NO: 3206733 - RNA, 20 nt, Mycobacterium bovis subsp bovis AF2122/97
cugcgcgcccaccgggcggc

SEQ ID NO: 3206734 - RNA, 21 nt, Mycobacterium bovis subsp bovis AF2122/97
cugcgcgcccaccgggcggcg

SEQ ID NO: 3206735 - RNA, 13 nt, Mycobacterium bovis subsp bovis AF2122/97
cugcgcgccguuc

SEQ ID NO: 3206736 - RNA, 14 nt, Mycobacterium bovis subsp bovis AF2122/97
cugcgcgcgaucca

SEQ ID NO: 3206737 - RNA, 17 nt, Mycobacterium bovis subsp bovis AF2122/97
cugcgcgcggccgcgcu

SEQ ID NO: 3206738 - RNA, 23 nt, Mycobacterium bovis subsp bovis AF2122/97
cugcgcgcggccgcgcugcagca

SEQ ID NO: 3206739 - RNA, 21 nt, Mycobacterium bovis subsp bovis AF2122/97
cugcgcgcggcggccgcggcu

SEQ ID NO: 3206740 - RNA, 18 nt, Mycobacterium bovis subsp bovis AF2122/97
cugcgcgcguugcgguca

SEQ ID NO: 3206741 - RNA, 15 nt, Mycobacterium bovis subsp bovis AF2122/97
cugcgcggccaccuc

SEQ ID NO: 3206742 - RNA, 20 nt, Mycobacterium bovis subsp bovis AF2122/97
cugcgcggcgaucgcuccgc

SEQ ID NO: 3206743 - RNA, 14 nt, Mycobacterium bovis subsp bovis AF2122/97
cugcgcggcugccg

SEQ ID NO: 3206744 - RNA, 15 nt, Mycobacterium bovis subsp bovis AF2122/97
cugcgcggcugccgu

SEQ ID NO: 3206745 - RNA, 14 nt, Mycobacterium bovis subsp bovis AF2122/97
cugcgcggcuucgu

SEQ ID NO: 3206746 - RNA, 23 nt, Mycobacterium bovis subsp bovis AF2122/97
cugcgcggcuucgucgacaucgc

SEQ ID NO: 3206747 - RNA, 15 nt, Mycobacterium bovis subsp bovis AF2122/97
cugcgcggcuugucg

SEQ ID NO: 3206748 - RNA, 18 nt, Mycobacterium bovis subsp bovis AF2122/97
cugcgcggcuugucgcgg

SEQ ID NO: 3206749 - RNA, 12 nt, Mycobacterium bovis subsp bovis AF2122/97
cugcgcggugcc

SEQ ID NO: 3206750 - RNA, 17 nt, Mycobacterium bovis subsp bovis AF2122/97
cugcgcggugcccgcga

SEQ ID NO: 3206751 - RNA, 15 nt, Mycobacterium bovis subsp bovis AF2122/97
cugcgcgucaggcca

SEQ ID NO: 3206752 - RNA, 16 nt, Mycobacterium bovis subsp bovis AF2122/97
cugcgcgucgagcagc

SEQ ID NO: 3206753 - RNA, 17 nt, Mycobacterium bovis subsp bovis AF2122/97
cugcgcgucgagcgacc

SEQ ID NO: 3206754 - RNA, 19 nt, Mycobacterium bovis subsp bovis AF2122/97
cugcgcgugcucgacgcgc

SEQ ID NO: 3206755 - RNA, 20 nt, Mycobacterium bovis subsp bovis AF2122/97
cugcgcgugcucgacgcgca

SEQ ID NO: 3206756 - RNA, 22 nt, Mycobacterium bovis subsp bovis AF2122/97
cugcgcgugcucgacgcgcauc

SEQ ID NO: 3206757 - RNA, 20 nt, Mycobacterium bovis subsp bovis AF2122/97
cugcgcgugcuuggcagcgg

SEQ ID NO: 3206758 - RNA, 15 nt, Mycobacterium bovis subsp bovis AF2122/97
cugcgcgugggcaca

SEQ ID NO: 3206759 - RNA, 21 nt, Mycobacterium bovis subsp bovis AF2122/97
cugcgcgugggcacagccaug

SEQ ID NO: 3206760 - RNA, 22 nt, Mycobacterium bovis subsp bovis AF2122/97
cugcgcucgggcugccgcaugc

SEQ ID NO: 3206761 - RNA, 13 nt, Mycobacterium bovis subsp bovis AF2122/97
cugcgcugcacca

SEQ ID NO: 3206762 - RNA, 19 nt, Mycobacterium bovis subsp bovis AF2122/97
cugcgcuuugcacagcggc

SEQ ID NO: 3206763 - RNA, 20 nt, Mycobacterium bovis subsp bovis AF2122/97
cugcggaacaccagcaggcg

SEQ ID NO: 3206764 - RNA, 14 nt, Mycobacterium bovis subsp bovis AF2122/97
cugcggaagccacc

SEQ ID NO: 3206765 - RNA, 14 nt, Mycobacterium bovis subsp bovis AF2122/97
cugcggaccggcgc

SEQ ID NO: 3206766 - RNA, 18 nt, Mycobacterium bovis subsp bovis AF2122/97
cugcggaccggcgcgcuc

SEQ ID NO: 3206767 - RNA, 13 nt, Mycobacterium bovis subsp bovis AF2122/97
cugcggacuggca

SEQ ID NO: 3206768 - RNA, 19 nt, Mycobacterium bovis subsp bovis AF2122/97
cugcggaggcgaccccggc

SEQ ID NO: 3206769 - RNA, 22 nt, Mycobacterium bovis subsp bovis AF2122/97
cugcggaggcgaccccggcccc

SEQ ID NO: 3206770 - RNA, 13 nt, Mycobacterium bovis subsp bovis AF2122/97
cugcggaggcggg

SEQ ID NO: 3206771 - RNA, 15 nt, Mycobacterium bovis subsp bovis AF2122/97
cugcggaggcgggug

SEQ ID NO: 3206772 - RNA, 18 nt, Mycobacterium bovis subsp bovis AF2122/97
cugcggaggcggguugca

SEQ ID NO: 3206773 - RNA, 17 nt, Mycobacterium bovis subsp bovis AF2122/97
cugcggaggguucgccg

SEQ ID NO: 3206774 - RNA, 21 nt, Mycobacterium bovis subsp bovis AF2122/97
cugcggauacagccgccgccg

SEQ ID NO: 3206775 - RNA, 19 nt, Mycobacterium bovis subsp bovis AF2122/97
cugcggauacuguucugcu

SEQ ID NO: 3206776 - RNA, 17 nt, Mycobacterium bovis subsp bovis AF2122/97
cugcggauagugguugc

SEQ ID NO: 3206777 - RNA, 22 nt, Mycobacterium bovis subsp bovis AF2122/97
cugcggauagugguugcggccg

SEQ ID NO: 3206778 - RNA, 15 nt, Mycobacterium bovis subsp bovis AF2122/97
cugcggauccaccac

SEQ ID NO: 3206779 - RNA, 18 nt, Mycobacterium bovis subsp bovis AF2122/97
cugcggaugcgcggcggg

SEQ ID NO: 3206780 - RNA, 20 nt, Mycobacterium bovis subsp bovis AF2122/97
cugcggauuaagucggcggc

SEQ ID NO: 3206781 - RNA, 11 nt, Mycobacterium bovis subsp bovis AF2122/97
cugcggcacca

SEQ ID NO: 3206782 - RNA, 13 nt, Mycobacterium bovis subsp bovis AF2122/97
cugcggcaccacc

SEQ ID NO: 3206783 - RNA, 20 nt, Mycobacterium bovis subsp bovis AF2122/97
cugcggcaccacccggcgaa

SEQ ID NO: 3206784 - RNA, 16 nt, Mycobacterium bovis subsp bovis AF2122/97
cugcggcagcgcggcc

SEQ ID NO: 3206785 - RNA, 13 nt, Mycobacterium bovis subsp bovis AF2122/97
cugcggcagcgga

SEQ ID NO: 3206786 - RNA, 20 nt, Mycobacterium bovis subsp bovis AF2122/97
cugcggcaguaccccucgca

SEQ ID NO: 3206787 - RNA, 15 nt, Mycobacterium bovis subsp bovis AF2122/97
cugcggcauggcagg

SEQ ID NO: 3206788 - RNA, 16 nt, Mycobacterium bovis subsp bovis AF2122/97
cugcggcauggcaggc

SEQ ID NO: 3206789 - RNA, 19 nt, Mycobacterium bovis subsp bovis AF2122/97
cugcggccaauggugggcg

SEQ ID NO: 3206790 - RNA, 14 nt, Mycobacterium bovis subsp bovis AF2122/97
cugcggccacgccg

SEQ ID NO: 3206791 - RNA, 20 nt, Mycobacterium bovis subsp bovis AF2122/97
cugcggccacgccgaugcgg

SEQ ID NO: 3206792 - RNA, 13 nt, Mycobacterium bovis subsp bovis AF2122/97
cugcggccacggu

SEQ ID NO: 3206793 - RNA, 14 nt, Mycobacterium bovis subsp bovis AF2122/97
cugcggccagcgcg

SEQ ID NO: 3206794 - RNA, 15 nt, Mycobacterium bovis subsp bovis AF2122/97
cugcggccagcgcgg

SEQ ID NO: 3206795 - RNA, 17 nt, Mycobacterium bovis subsp bovis AF2122/97
cugcggccagcgcggcg

SEQ ID NO: 3206796 - RNA, 14 nt, Mycobacterium bovis subsp bovis AF2122/97
cugcggccagucag

SEQ ID NO: 3206797 - RNA, 17 nt, Mycobacterium bovis subsp bovis AF2122/97
cugcggcccacaccagc

SEQ ID NO: 3206798 - RNA, 18 nt, Mycobacterium bovis subsp bovis AF2122/97
cugcggcccacaccagcg

SEQ ID NO: 3206799 - RNA, 21 nt, Mycobacterium bovis subsp bovis AF2122/97
cugcggcccacaccagcgcag

SEQ ID NO: 3206800 - RNA, 23 nt, Mycobacterium bovis subsp bovis AF2122/97
cugcggcccacaccagcgcagca

SEQ ID NO: 3206801 - RNA, 19 nt, Mycobacterium bovis subsp bovis AF2122/97
cugcggcccaugaucucgg

SEQ ID NO: 3206802 - RNA, 17 nt, Mycobacterium bovis subsp bovis AF2122/97
cugcggcccgacccggc

SEQ ID NO: 3206803 - RNA, 19 nt, Mycobacterium bovis subsp bovis AF2122/97
cugcggcccgacccggccg

SEQ ID NO: 3206804 - RNA, 20 nt, Mycobacterium bovis subsp bovis AF2122/97
cugcggcccgacccggccga

SEQ ID NO: 3206805 - RNA, 23 nt, Mycobacterium bovis subsp bovis AF2122/97
cugcggcccgacccggccgaugg

SEQ ID NO: 3206806 - RNA, 12 nt, Mycobacterium bovis subsp bovis AF2122/97
cugcggccgcga

SEQ ID NO: 3206807 - RNA, 18 nt, Mycobacterium bovis subsp bovis AF2122/97
cugcggccugcucgacca

SEQ ID NO: 3206808 - RNA, 20 nt, Mycobacterium bovis subsp bovis AF2122/97
cugcggcgcccggucgagcc

SEQ ID NO: 3206809 - RNA, 21 nt, Mycobacterium bovis subsp bovis AF2122/97
cugcggcgcccggucgagcca

SEQ ID NO: 3206810 - RNA, 22 nt, Mycobacterium bovis subsp bovis AF2122/97
cugcggcgcuggccagcagggu

SEQ ID NO: 3206811 - RNA, 13 nt, Mycobacterium bovis subsp bovis AF2122/97
cugcggcggccau

SEQ ID NO: 3206812 - RNA, 19 nt, Mycobacterium bovis subsp bovis AF2122/97
cugcggcggccauucgguc

SEQ ID NO: 3206813 - RNA, 12 nt, Mycobacterium bovis subsp bovis AF2122/97
cugcggcggcuu

SEQ ID NO: 3206814 - RNA, 18 nt, Mycobacterium bovis subsp bovis AF2122/97
cugcggcgucguugagga

SEQ ID NO: 3206815 - RNA, 21 nt, Mycobacterium bovis subsp bovis AF2122/97
cugcggcucagaacccuccgc

SEQ ID NO: 3206816 - RNA, 22 nt, Mycobacterium bovis subsp bovis AF2122/97
cugcggcucagaacccuccgca

SEQ ID NO: 3206817 - RNA, 20 nt, Mycobacterium bovis subsp bovis AF2122/97
cugcggcuccggcggcagcg

SEQ ID NO: 3206818 - RNA, 13 nt, Mycobacterium bovis subsp bovis AF2122/97
cugcggcucgcug

SEQ ID NO: 3206819 - RNA, 23 nt, Mycobacterium bovis subsp bovis AF2122/97
cugcggcucgcugaucuggggca

SEQ ID NO: 3206820 - RNA, 12 nt, Mycobacterium bovis subsp bovis AF2122/97
cugcggcuuuca

SEQ ID NO: 3206821 - RNA, 14 nt, Mycobacterium bovis subsp bovis AF2122/97
cugcgggaacccca

SEQ ID NO: 3206822 - RNA, 20 nt, Mycobacterium bovis subsp bovis AF2122/97
cugcgggaacgcggcggcga

SEQ ID NO: 3206823 - RNA, 14 nt, Mycobacterium bovis subsp bovis AF2122/97
cugcgggccgagau

SEQ ID NO: 3206824 - RNA, 21 nt, Mycobacterium bovis subsp bovis AF2122/97
cugcgggccgagaucacgccg

SEQ ID NO: 3206825 - RNA, 12 nt, Mycobacterium bovis subsp bovis AF2122/97
cugcgggccggc

SEQ ID NO: 3206826 - RNA, 20 nt, Mycobacterium bovis subsp bovis AF2122/97
cugcgggccggcaucgucgg

SEQ ID NO: 3206827 - RNA, 24 nt, Mycobacterium bovis subsp bovis AF2122/97
cugcggggcuaugaccugcgaagu

SEQ ID NO: 3206828 - RNA, 20 nt, Mycobacterium bovis subsp bovis AF2122/97
cugcggggguacgucaccgg

SEQ ID NO: 3206829 - RNA, 21 nt, Mycobacterium bovis subsp bovis AF2122/97
cugcggggugagugaccacgc

SEQ ID NO: 3206830 - RNA, 22 nt, Mycobacterium bovis subsp bovis AF2122/97
cugcggggugagugaccacgcu

SEQ ID NO: 3206831 - RNA, 23 nt, Mycobacterium bovis subsp bovis AF2122/97
cugcggggugagugaccacgcug

SEQ ID NO: 3206832 - RNA, 21 nt, Mycobacterium bovis subsp bovis AF2122/97
cugcggguagauguucacgcc

SEQ ID NO: 3206833 - RNA, 22 nt, Mycobacterium bovis subsp bovis AF2122/97
cugcggguagauguucacgccg

SEQ ID NO: 3206834 - RNA, 20 nt, Mycobacterium bovis subsp bovis AF2122/97
cugcggguaggugacgacgu

SEQ ID NO: 3206835 - RNA, 23 nt, Mycobacterium bovis subsp bovis AF2122/97
cugcggguaggugacgacgucgu

SEQ ID NO: 3206836 - RNA, 16 nt, Mycobacterium bovis subsp bovis AF2122/97
cugcgggucagcgccg

SEQ ID NO: 3206837 - RNA, 20 nt, Mycobacterium bovis subsp bovis AF2122/97
cugcgggucccaaucgucgg

SEQ ID NO: 3206838 - RNA, 19 nt, Mycobacterium bovis subsp bovis AF2122/97
cugcgggucgaagcgaucc

SEQ ID NO: 3206839 - RNA, 19 nt, Mycobacterium bovis subsp bovis AF2122/97
cugcgggucgugccccggc

SEQ ID NO: 3206840 - RNA, 22 nt, Mycobacterium bovis subsp bovis AF2122/97
cugcgggucgugccccggcgcg

SEQ ID NO: 3206841 - RNA, 24 nt, Mycobacterium bovis subsp bovis AF2122/97
cugcgggucgugccccggcgcggu

SEQ ID NO: 3206842 - RNA, 14 nt, Mycobacterium bovis subsp bovis AF2122/97
cugcgggucucgcu

SEQ ID NO: 3206843 - RNA, 18 nt, Mycobacterium bovis subsp bovis AF2122/97
cugcgggugcgucgauga

SEQ ID NO: 3206844 - RNA, 19 nt, Mycobacterium bovis subsp bovis AF2122/97
cugcggguggauuggugcc

SEQ ID NO: 3206845 - RNA, 16 nt, Mycobacterium bovis subsp bovis AF2122/97
cugcgguaaucgccac

SEQ ID NO: 3206846 - RNA, 17 nt, Mycobacterium bovis subsp bovis AF2122/97
cugcggucaauguggcg

SEQ ID NO: 3206847 - RNA, 13 nt, Mycobacterium bovis subsp bovis AF2122/97
cugcggucagggc

SEQ ID NO: 3206848 - RNA, 15 nt, Mycobacterium bovis subsp bovis AF2122/97
cugcggucagggcuu

SEQ ID NO: 3206849 - RNA, 19 nt, Mycobacterium bovis subsp bovis AF2122/97
cugcggucgaacaucaucg

SEQ ID NO: 3206850 - RNA, 21 nt, Mycobacterium bovis subsp bovis AF2122/97
cugcggucgaacaucaucggg

SEQ ID NO: 3206851 - RNA, 21 nt, Mycobacterium bovis subsp bovis AF2122/97
cugcggucgaggguaccaggc

SEQ ID NO: 3206852 - RNA, 14 nt, Mycobacterium bovis subsp bovis AF2122/97
cugcggucgcccag

SEQ ID NO: 3206853 - RNA, 15 nt, Mycobacterium bovis subsp bovis AF2122/97
cugcggucgcggagc

SEQ ID NO: 3206854 - RNA, 20 nt, Mycobacterium bovis subsp bovis AF2122/97
cugcggucuggacaucggcc

SEQ ID NO: 3206855 - RNA, 22 nt, Mycobacterium bovis subsp bovis AF2122/97
cugcggugauggacugaucgcg

SEQ ID NO: 3206856 - RNA, 23 nt, Mycobacterium bovis subsp bovis AF2122/97
cugcggugauggacugaucgcga

SEQ ID NO: 3206857 - RNA, 20 nt, Mycobacterium bovis subsp bovis AF2122/97
cugcggugcaggauucggcg

SEQ ID NO: 3206858 - RNA, 22 nt, Mycobacterium bovis subsp bovis AF2122/97
cugcggugcaggauucggcggu

SEQ ID NO: 3206859 - RNA, 15 nt, Mycobacterium bovis subsp bovis AF2122/97
cugcggugccacggu

SEQ ID NO: 3206860 - RNA, 14 nt, Mycobacterium bovis subsp bovis AF2122/97
cugcggugccggcc

SEQ ID NO: 3206861 - RNA, 13 nt, Mycobacterium bovis subsp bovis AF2122/97
cugcggugcgggc

SEQ ID NO: 3206862 - RNA, 15 nt, Mycobacterium bovis subsp bovis AF2122/97
cugcggugcgggcuu

SEQ ID NO: 3206863 - RNA, 21 nt, Mycobacterium bovis subsp bovis AF2122/97
cugcggugcuaugcaacaccg

SEQ ID NO: 3206864 - RNA, 12 nt, Mycobacterium bovis subsp bovis AF2122/97
cugcgguugagu

SEQ ID NO: 3206865 - RNA, 16 nt, Mycobacterium bovis subsp bovis AF2122/97
cugcgguugaguugca

SEQ ID NO: 3206866 - RNA, 20 nt, Mycobacterium bovis subsp bovis AF2122/97
cugcguaguugauggccccg

SEQ ID NO: 3206867 - RNA, 12 nt, Mycobacterium bovis subsp bovis AF2122/97
cugcgucaucgc

SEQ ID NO: 3206868 - RNA, 13 nt, Mycobacterium bovis subsp bovis AF2122/97
cugcguccaccac

SEQ ID NO: 3206869 - RNA, 18 nt, Mycobacterium bovis subsp bovis AF2122/97
cugcguccaccggacggg

SEQ ID NO: 3206870 - RNA, 14 nt, Mycobacterium bovis subsp bovis AF2122/97
cugcguccagaucu

SEQ ID NO: 3206871 - RNA, 17 nt, Mycobacterium bovis subsp bovis AF2122/97
cugcguccagaucucga

SEQ ID NO: 3206872 - RNA, 15 nt, Mycobacterium bovis subsp bovis AF2122/97
cugcguccgacgccu

SEQ ID NO: 3206873 - RNA, 14 nt, Mycobacterium bovis subsp bovis AF2122/97
cugcguccugcucg

SEQ ID NO: 3206874 - RNA, 15 nt, Mycobacterium bovis subsp bovis AF2122/97
cugcgucggcccgcg

SEQ ID NO: 3206875 - RNA, 15 nt, Mycobacterium bovis subsp bovis AF2122/97
cugcgucggcggcuu

SEQ ID NO: 3206876 - RNA, 17 nt, Mycobacterium bovis subsp bovis AF2122/97
cugcgucggcggcuucc

SEQ ID NO: 3206877 - RNA, 18 nt, Mycobacterium bovis subsp bovis AF2122/97
cugcgucgucugcagacc

SEQ ID NO: 3206878 - RNA, 14 nt, Mycobacterium bovis subsp bovis AF2122/97
cugcgucguggaga

SEQ ID NO: 3206879 - RNA, 15 nt, Mycobacterium bovis subsp bovis AF2122/97
cugcgucucgaugag

SEQ ID NO: 3206880 - RNA, 16 nt, Mycobacterium bovis subsp bovis AF2122/97
cugcgucugcucacca

SEQ ID NO: 3206881 - RNA, 19 nt, Mycobacterium bovis subsp bovis AF2122/97
cugcgucugcucaccagcg

SEQ ID NO: 3206882 - RNA, 22 nt, Mycobacterium bovis subsp bovis AF2122/97
cugcgucugcucaccagcgguc

SEQ ID NO: 3206883 - RNA, 21 nt, Mycobacterium bovis subsp bovis AF2122/97
cugcgucugcucgccguggug

SEQ ID NO: 3206884 - RNA, 18 nt, Mycobacterium bovis subsp bovis AF2122/97
cugcgucugcucgcgcag

SEQ ID NO: 3206885 - RNA, 16 nt, Mycobacterium bovis subsp bovis AF2122/97
cugcgucugcucgcgg

SEQ ID NO: 3206886 - RNA, 18 nt, Mycobacterium bovis subsp bovis AF2122/97
cugcgucugcucggcgcu

SEQ ID NO: 3206887 - RNA, 17 nt, Mycobacterium bovis subsp bovis AF2122/97
cugcgucugcucggcgg

SEQ ID NO: 3206888 - RNA, 17 nt, Mycobacterium bovis subsp bovis AF2122/97
cugcgugcagaucacgg

SEQ ID NO: 3206889 - RNA, 15 nt, Mycobacterium bovis subsp bovis AF2122/97
cugcgugccgcaccg

SEQ ID NO: 3206890 - RNA, 22 nt, Mycobacterium bovis subsp bovis AF2122/97
cugcgugccgcaccgccugcuc

SEQ ID NO: 3206891 - RNA, 14 nt, Mycobacterium bovis subsp bovis AF2122/97
cugcguggcgaacc

SEQ ID NO: 3206892 - RNA, 17 nt, Mycobacterium bovis subsp bovis AF2122/97
cugcguggcgggcugca

SEQ ID NO: 3206893 - RNA, 13 nt, Mycobacterium bovis subsp bovis AF2122/97
cugcgugggccug

SEQ ID NO: 3206894 - RNA, 17 nt, Mycobacterium bovis subsp bovis AF2122/97
cugcgugggccugcgca

SEQ ID NO: 3206895 - RNA, 19 nt, Mycobacterium bovis subsp bovis AF2122/97
cugcguuccaucgccgacg

SEQ ID NO: 3206896 - RNA, 15 nt, Mycobacterium bovis subsp bovis AF2122/97
cugcguugcggcaac

SEQ ID NO: 3206897 - RNA, 20 nt, Mycobacterium bovis subsp bovis AF2122/97
cugcuacccgagccggcacg

SEQ ID NO: 3206898 - RNA, 14 nt, Mycobacterium bovis subsp bovis AF2122/97
cugcuacucugcaa

SEQ ID NO: 3206899 - RNA, 15 nt, Mycobacterium bovis subsp bovis AF2122/97
cugcuagccagucgg

SEQ ID NO: 3206900 - RNA, 17 nt, Mycobacterium bovis subsp bovis AF2122/97
cugcuagccagucggcc

SEQ ID NO: 3206901 - RNA, 19 nt, Mycobacterium bovis subsp bovis AF2122/97
cugcuagccagucggccac

SEQ ID NO: 3206902 - RNA, 20 nt, Mycobacterium bovis subsp bovis AF2122/97
cugcuagccagucggccacc

SEQ ID NO: 3206903 - RNA, 21 nt, Mycobacterium bovis subsp bovis AF2122/97
cugcuagccagucggccaccu

SEQ ID NO: 3206904 - RNA, 14 nt, Mycobacterium bovis subsp bovis AF2122/97
cugcuagugcgggc

SEQ ID NO: 3206905 - RNA, 13 nt, Mycobacterium bovis subsp bovis AF2122/97
cugcucagggcgc

SEQ ID NO: 3206906 - RNA, 12 nt, Mycobacterium bovis subsp bovis AF2122/97
cugcucauccac

SEQ ID NO: 3206907 - RNA, 16 nt, Mycobacterium bovis subsp bovis AF2122/97
cugcucauccaccucg

SEQ ID NO: 3206908 - RNA, 20 nt, Mycobacterium bovis subsp bovis AF2122/97
cugcucauccaccucgaugg

SEQ ID NO: 3206909 - RNA, 14 nt, Mycobacterium bovis subsp bovis AF2122/97
cugcuccaggcgcg

SEQ ID NO: 3206910 - RNA, 17 nt, Mycobacterium bovis subsp bovis AF2122/97
cugcuccaggcgcgccg

SEQ ID NO: 3206911 - RNA, 18 nt, Mycobacterium bovis subsp bovis AF2122/97
cugcucccgaaaagcgcc

SEQ ID NO: 3206912 - RNA, 14 nt, Mycobacterium bovis subsp bovis AF2122/97
cugcuccgcuguca

SEQ ID NO: 3206913 - RNA, 13 nt, Mycobacterium bovis subsp bovis AF2122/97
cugcuccucgcgg

SEQ ID NO: 3206914 - RNA, 13 nt, Mycobacterium bovis subsp bovis AF2122/97
cugcuccucgguc

SEQ ID NO: 3206915 - RNA, 22 nt, Mycobacterium bovis subsp bovis AF2122/97
cugcucgaaaucgcacagcgca

SEQ ID NO: 3206916 - RNA, 15 nt, Mycobacterium bovis subsp bovis AF2122/97
cugcucgaacgcuga

SEQ ID NO: 3206917 - RNA, 12 nt, Mycobacterium bovis subsp bovis AF2122/97
cugcucgacaag

SEQ ID NO: 3206918 - RNA, 20 nt, Mycobacterium bovis subsp bovis AF2122/97
cugcucgacgaggccacggg

SEQ ID NO: 3206919 - RNA, 23 nt, Mycobacterium bovis subsp bovis AF2122/97
cugcucgagagcaugguccagca

SEQ ID NO: 3206920 - RNA, 15 nt, Mycobacterium bovis subsp bovis AF2122/97
cugcucgaucaucgg

SEQ ID NO: 3206921 - RNA, 15 nt, Mycobacterium bovis subsp bovis AF2122/97
cugcucgauccgcaa

SEQ ID NO: 3206922 - RNA, 23 nt, Mycobacterium bovis subsp bovis AF2122/97
cugcucgauguccucgauccggg

SEQ ID NO: 3206923 - RNA, 17 nt, Mycobacterium bovis subsp bovis AF2122/97
cugcucgcacagcacca

SEQ ID NO: 3206924 - RNA, 15 nt, Mycobacterium bovis subsp bovis AF2122/97
cugcucgccagccgg

SEQ ID NO: 3206925 - RNA, 18 nt, Mycobacterium bovis subsp bovis AF2122/97
cugcucgccagccggccu

SEQ ID NO: 3206926 - RNA, 20 nt, Mycobacterium bovis subsp bovis AF2122/97
cugcucgccagccggccuca

SEQ ID NO: 3206927 - RNA, 15 nt, Mycobacterium bovis subsp bovis AF2122/97
cugcucgccaggcaa

SEQ ID NO: 3206928 - RNA, 23 nt, Mycobacterium bovis subsp bovis AF2122/97
cugcucgccccaugucaagcgau

SEQ ID NO: 3206929 - RNA, 15 nt, Mycobacterium bovis subsp bovis AF2122/97
cugcucgccggccaa

SEQ ID NO: 3206930 - RNA, 24 nt, Mycobacterium bovis subsp bovis AF2122/97
cugcucgccggccaacugggccga

SEQ ID NO: 3206931 - RNA, 13 nt, Mycobacterium bovis subsp bovis AF2122/97
cugcucgccgggc

SEQ ID NO: 3206932 - RNA, 21 nt, Mycobacterium bovis subsp bovis AF2122/97
cugcucgcgcaaggcgccgca

SEQ ID NO: 3206933 - RNA, 13 nt, Mycobacterium bovis subsp bovis AF2122/97
cugcucgcgccgc

SEQ ID NO: 3206934 - RNA, 14 nt, Mycobacterium bovis subsp bovis AF2122/97
cugcucgcgccgcu

SEQ ID NO: 3206935 - RNA, 13 nt, Mycobacterium bovis subsp bovis AF2122/97
cugcucgcgcucg

SEQ ID NO: 3206936 - RNA, 13 nt, Mycobacterium bovis subsp bovis AF2122/97
cugcucggagagc

SEQ ID NO: 3206937 - RNA, 16 nt, Mycobacterium bovis subsp bovis AF2122/97
cugcucggauccggcc

SEQ ID NO: 3206938 - RNA, 23 nt, Mycobacterium bovis subsp bovis AF2122/97
cugcucggcaucgagcagcccgg

SEQ ID NO: 3206939 - RNA, 14 nt, Mycobacterium bovis subsp bovis AF2122/97
cugcucggcaucgg

SEQ ID NO: 3206940 - RNA, 14 nt, Mycobacterium bovis subsp bovis AF2122/97
cugcucggccaacg

SEQ ID NO: 3206941 - RNA, 19 nt, Mycobacterium bovis subsp bovis AF2122/97
cugcucggcgaccgucggg

SEQ ID NO: 3206942 - RNA, 12 nt, Mycobacterium bovis subsp bovis AF2122/97
cugcucggcgca

SEQ ID NO: 3206943 - RNA, 15 nt, Mycobacterium bovis subsp bovis AF2122/97
cugcucggcgcggug

SEQ ID NO: 3206944 - RNA, 17 nt, Mycobacterium bovis subsp bovis AF2122/97
cugcucggcgcuagcug

SEQ ID NO: 3206945 - RNA, 22 nt, Mycobacterium bovis subsp bovis AF2122/97
cugcucggcgcuagcugcugau

SEQ ID NO: 3206946 - RNA, 13 nt, Mycobacterium bovis subsp bovis AF2122/97
cugcucggcggcc

SEQ ID NO: 3206947 - RNA, 14 nt, Mycobacterium bovis subsp bovis AF2122/97
cugcucggcggccu

SEQ ID NO: 3206948 - RNA, 15 nt, Mycobacterium bovis subsp bovis AF2122/97
cugcucggcggugcc

SEQ ID NO: 3206949 - RNA, 21 nt, Mycobacterium bovis subsp bovis AF2122/97
cugcucggcggugccgcggcu

SEQ ID NO: 3206950 - RNA, 12 nt, Mycobacterium bovis subsp bovis AF2122/97
cugcucggcgua

SEQ ID NO: 3206951 - RNA, 19 nt, Mycobacterium bovis subsp bovis AF2122/97
cugcucggucaggcggcug

SEQ ID NO: 3206952 - RNA, 21 nt, Mycobacterium bovis subsp bovis AF2122/97
cugcucggucaggcggcuggc

SEQ ID NO: 3206953 - RNA, 22 nt, Mycobacterium bovis subsp bovis AF2122/97
cugcucggucaggcggcuggcc

SEQ ID NO: 3206954 - RNA, 21 nt, Mycobacterium bovis subsp bovis AF2122/97
cugcucguagcggcggcgccc

SEQ ID NO: 3206955 - RNA, 23 nt, Mycobacterium bovis subsp bovis AF2122/97
cugcucguagcggcggcgcccgg

SEQ ID NO: 3206956 - RNA, 15 nt, Mycobacterium bovis subsp bovis AF2122/97
cugcucguccacccc

SEQ ID NO: 3206957 - RNA, 18 nt, Mycobacterium bovis subsp bovis AF2122/97
cugcucgucgagccgacc

SEQ ID NO: 3206958 - RNA, 21 nt, Mycobacterium bovis subsp bovis AF2122/97
cugcucgucgugagacugggc

SEQ ID NO: 3206959 - RNA, 18 nt, Mycobacterium bovis subsp bovis AF2122/97
cugcucgucuuggcggcg

SEQ ID NO: 3206960 - RNA, 19 nt, Mycobacterium bovis subsp bovis AF2122/97
cugcucgucuuggcggcgg

SEQ ID NO: 3206961 - RNA, 23 nt, Mycobacterium bovis subsp bovis AF2122/97
cugcucgucuuggcggcggugca

SEQ ID NO: 3206962 - RNA, 21 nt, Mycobacterium bovis subsp bovis AF2122/97
cugcucgugagccccagcgac

SEQ ID NO: 3206963 - RNA, 23 nt, Mycobacterium bovis subsp bovis AF2122/97
cugcucguggguaccgagcagca

SEQ ID NO: 3206964 - RNA, 21 nt, Mycobacterium bovis subsp bovis AF2122/97
cugcucugcgaccucgccgga

SEQ ID NO: 3206965 - RNA, 21 nt, Mycobacterium bovis subsp bovis AF2122/97
cugcucuuuuagccacaaucg

SEQ ID NO: 3206966 - RNA, 19 nt, Mycobacterium bovis subsp bovis AF2122/97
cugcugaaauccuagggug

SEQ ID NO: 3206967 - RNA, 18 nt, Mycobacterium bovis subsp bovis AF2122/97
cugcugaacaaccagcau

SEQ ID NO: 3206968 - RNA, 14 nt, Mycobacterium bovis subsp bovis AF2122/97
cugcugaacaccgg

SEQ ID NO: 3206969 - RNA, 15 nt, Mycobacterium bovis subsp bovis AF2122/97
cugcugaccaugacc

SEQ ID NO: 3206970 - RNA, 17 nt, Mycobacterium bovis subsp bovis AF2122/97
cugcugagcugcucgcc

SEQ ID NO: 3206971 - RNA, 19 nt, Mycobacterium bovis subsp bovis AF2122/97
cugcugagcugcucgccgg

SEQ ID NO: 3206972 - RNA, 13 nt, Mycobacterium bovis subsp bovis AF2122/97
cugcugaugcggu

SEQ ID NO: 3206973 - RNA, 19 nt, Mycobacterium bovis subsp bovis AF2122/97
cugcugcacaucgcaucca

SEQ ID NO: 3206974 - RNA, 13 nt, Mycobacterium bovis subsp bovis AF2122/97
cugcugcagccug

SEQ ID NO: 3206975 - RNA, 13 nt, Mycobacterium bovis subsp bovis AF2122/97
cugcugcagggcc

SEQ ID NO: 3206976 - RNA, 16 nt, Mycobacterium bovis subsp bovis AF2122/97
cugcugcagggccugg

SEQ ID NO: 3206977 - RNA, 18 nt, Mycobacterium bovis subsp bovis AF2122/97
cugcugcagggccuggcc

SEQ ID NO: 3206978 - RNA, 19 nt, Mycobacterium bovis subsp bovis AF2122/97
cugcugcagggccuggcca

SEQ ID NO: 3206979 - RNA, 14 nt, Mycobacterium bovis subsp bovis AF2122/97
cugcugccagccga

SEQ ID NO: 3206980 - RNA, 15 nt, Mycobacterium bovis subsp bovis AF2122/97
cugcugccagccgaa

SEQ ID NO: 3206981 - RNA, 20 nt, Mycobacterium bovis subsp bovis AF2122/97
cugcugccauugccgauggu

SEQ ID NO: 3206982 - RNA, 15 nt, Mycobacterium bovis subsp bovis AF2122/97
cugcugccccccaga

SEQ ID NO: 3206983 - RNA, 16 nt, Mycobacterium bovis subsp bovis AF2122/97
cugcugccgcaccggu

SEQ ID NO: 3206984 - RNA, 19 nt, Mycobacterium bovis subsp bovis AF2122/97
cugcugccgcaccggugcu

SEQ ID NO: 3206985 - RNA, 14 nt, Mycobacterium bovis subsp bovis AF2122/97
cugcugcucggccu

SEQ ID NO: 3206986 - RNA, 16 nt, Mycobacterium bovis subsp bovis AF2122/97
cugcugcugcagcgau

SEQ ID NO: 3206987 - RNA, 20 nt, Mycobacterium bovis subsp bovis AF2122/97
cugcugcuugacuccgcgcg

SEQ ID NO: 3206988 - RNA, 22 nt, Mycobacterium bovis subsp bovis AF2122/97
cugcugcuugacuccgcgcgcu

SEQ ID NO: 3206989 - RNA, 14 nt, Mycobacterium bovis subsp bovis AF2122/97
cugcuggaucucgg

SEQ ID NO: 3206990 - RNA, 17 nt, Mycobacterium bovis subsp bovis AF2122/97
cugcuggaucucggugg

SEQ ID NO: 3206991 - RNA, 13 nt, Mycobacterium bovis subsp bovis AF2122/97
cugcuggcagacc

SEQ ID NO: 3206992 - RNA, 18 nt, Mycobacterium bovis subsp bovis AF2122/97
cugcuggcccugcuccuc

SEQ ID NO: 3206993 - RNA, 16 nt, Mycobacterium bovis subsp bovis AF2122/97
cugcuggccgcggccu

SEQ ID NO: 3206994 - RNA, 19 nt, Mycobacterium bovis subsp bovis AF2122/97
cugcuggccgcggccucgu

SEQ ID NO: 3206995 - RNA, 21 nt, Mycobacterium bovis subsp bovis AF2122/97
cugcuggccggguuccagcgg

SEQ ID NO: 3206996 - RNA, 22 nt, Mycobacterium bovis subsp bovis AF2122/97
cugcuggccggguuccagcggc

SEQ ID NO: 3206997 - RNA, 21 nt, Mycobacterium bovis subsp bovis AF2122/97
cugcuggcgcuuugggcugcc

SEQ ID NO: 3206998 - RNA, 13 nt, Mycobacterium bovis subsp bovis AF2122/97
cugcuggcuggga

SEQ ID NO: 3206999 - RNA, 19 nt, Mycobacterium bovis subsp bovis AF2122/97
cugcugggagggaccaccc

SEQ ID NO: 3207000 - RNA, 14 nt, Mycobacterium bovis subsp bovis AF2122/97
cugcugggcacgau

SEQ ID NO: 3207001 - RNA, 18 nt, Mycobacterium bovis subsp bovis AF2122/97
cugcugguaccgggcucc

SEQ ID NO: 3207002 - RNA, 13 nt, Mycobacterium bovis subsp bovis AF2122/97
cugcuggucacca

SEQ ID NO: 3207003 - RNA, 16 nt, Mycobacterium bovis subsp bovis AF2122/97
cugcuggucaccauca

SEQ ID NO: 3207004 - RNA, 22 nt, Mycobacterium bovis subsp bovis AF2122/97
cugcuggugacgaaagcgccca

SEQ ID NO: 3207005 - RNA, 19 nt, Mycobacterium bovis subsp bovis AF2122/97
cugcuggugucggcucgag

SEQ ID NO: 3207006 - RNA, 19 nt, Mycobacterium bovis subsp bovis AF2122/97
cugcugucaccgcaaccga

SEQ ID NO: 3207007 - RNA, 14 nt, Mycobacterium bovis subsp bovis AF2122/97
cugcuguggaucga

SEQ ID NO: 3207008 - RNA, 21 nt, Mycobacterium bovis subsp bovis AF2122/97
cugcuguuccaucaaggucau

SEQ ID NO: 3207009 - RNA, 13 nt, Mycobacterium bovis subsp bovis AF2122/97
cugcuugacuccg

SEQ ID NO: 3207010 - RNA, 22 nt, Mycobacterium bovis subsp bovis AF2122/97
cugcuugaugguguccucgucg

SEQ ID NO: 3207011 - RNA, 13 nt, Mycobacterium bovis subsp bovis AF2122/97
cugcuugccaccg

SEQ ID NO: 3207012 - RNA, 18 nt, Mycobacterium bovis subsp bovis AF2122/97
cugcuugccaccgccgcc

SEQ ID NO: 3207013 - RNA, 20 nt, Mycobacterium bovis subsp bovis AF2122/97
cugcuugcgcaucgccgaca

SEQ ID NO: 3207014 - RNA, 16 nt, Mycobacterium bovis subsp bovis AF2122/97
cugcuugcgcccggcc

SEQ ID NO: 3207015 - RNA, 20 nt, Mycobacterium bovis subsp bovis AF2122/97
cugcuuggucgcccagccac

SEQ ID NO: 3207016 - RNA, 21 nt, Mycobacterium bovis subsp bovis AF2122/97
cugcuugguggucuuggccgg

SEQ ID NO: 3207017 - RNA, 13 nt, Mycobacterium bovis subsp bovis AF2122/97
cuggaaagcagca

SEQ ID NO: 3207018 - RNA, 16 nt, Mycobacterium bovis subsp bovis AF2122/97
cuggaaagggccgccg

SEQ ID NO: 3207019 - RNA, 17 nt, Mycobacterium bovis subsp bovis AF2122/97
cuggaaagggccgccgc

SEQ ID NO: 3207020 - RNA, 16 nt, Mycobacterium bovis subsp bovis AF2122/97
cuggaaccccgagcug

SEQ ID NO: 3207021 - RNA, 14 nt, Mycobacterium bovis subsp bovis AF2122/97
cuggaacgugaugc

SEQ ID NO: 3207022 - RNA, 21 nt, Mycobacterium bovis subsp bovis AF2122/97
cuggaagaagagguuggcggc

SEQ ID NO: 3207023 - RNA, 23 nt, Mycobacterium bovis subsp bovis AF2122/97
cuggaagaagagguuggcggccu

SEQ ID NO: 3207024 - RNA, 21 nt, Mycobacterium bovis subsp bovis AF2122/97
cuggaagaucacgcgucgugc

SEQ ID NO: 3207025 - RNA, 16 nt, Mycobacterium bovis subsp bovis AF2122/97
cuggaagcggcgacua

SEQ ID NO: 3207026 - RNA, 22 nt, Mycobacterium bovis subsp bovis AF2122/97
cuggaagcggcgacuacccagc

SEQ ID NO: 3207027 - RNA, 15 nt, Mycobacterium bovis subsp bovis AF2122/97
cuggaaggucagcgc

SEQ ID NO: 3207028 - RNA, 17 nt, Mycobacterium bovis subsp bovis AF2122/97
cuggaaggucagcgccc

SEQ ID NO: 3207029 - RNA, 19 nt, Mycobacterium bovis subsp bovis AF2122/97
cuggaaguacacggcggcc

SEQ ID NO: 3207030 - RNA, 20 nt, Mycobacterium bovis subsp bovis AF2122/97
cuggaaguacacggcggccc

SEQ ID NO: 3207031 - RNA, 14 nt, Mycobacterium bovis subsp bovis AF2122/97
cuggaaguaguccc

SEQ ID NO: 3207032 - RNA, 16 nt, Mycobacterium bovis subsp bovis AF2122/97
cuggaauccggccaga

SEQ ID NO: 3207033 - RNA, 22 nt, Mycobacterium bovis subsp bovis AF2122/97
cuggaauggcucacgcuccgcc

SEQ ID NO: 3207034 - RNA, 17 nt, Mycobacterium bovis subsp bovis AF2122/97
cuggacaaccucgucga

SEQ ID NO: 3207035 - RNA, 20 nt, Mycobacterium bovis subsp bovis AF2122/97
cuggacaaccucgucgaucu

SEQ ID NO: 3207036 - RNA, 23 nt, Mycobacterium bovis subsp bovis AF2122/97
cuggacaacggcggucugguugu

SEQ ID NO: 3207037 - RNA, 16 nt, Mycobacterium bovis subsp bovis AF2122/97
cuggacaucggccggc

SEQ ID NO: 3207038 - RNA, 17 nt, Mycobacterium bovis subsp bovis AF2122/97
cuggacaucggccggcg

SEQ ID NO: 3207039 - RNA, 18 nt, Mycobacterium bovis subsp bovis AF2122/97
cuggaccacagccgcgcc

SEQ ID NO: 3207040 - RNA, 22 nt, Mycobacterium bovis subsp bovis AF2122/97
cuggaccacagccgcgccgacc

SEQ ID NO: 3207041 - RNA, 15 nt, Mycobacterium bovis subsp bovis AF2122/97
cuggacccgcccagg

SEQ ID NO: 3207042 - RNA, 11 nt, Mycobacterium bovis subsp bovis AF2122/97
cuggaccuccg

SEQ ID NO: 3207043 - RNA, 14 nt, Mycobacterium bovis subsp bovis AF2122/97
cuggacgccgccgg

SEQ ID NO: 3207044 - RNA, 22 nt, Mycobacterium bovis subsp bovis AF2122/97
cuggacgccgccggagaucuug

SEQ ID NO: 3207045 - RNA, 19 nt, Mycobacterium bovis subsp bovis AF2122/97
cuggacgcgaaauccccug

SEQ ID NO: 3207046 - RNA, 22 nt, Mycobacterium bovis subsp bovis AF2122/97
cuggacgcuccgggaauggcga

SEQ ID NO: 3207047 - RNA, 18 nt, Mycobacterium bovis subsp bovis AF2122/97
cuggacggaucuggaugu

SEQ ID NO: 3207048 - RNA, 15 nt, Mycobacterium bovis subsp bovis AF2122/97
cuggacggcgggccg

SEQ ID NO: 3207049 - RNA, 16 nt, Mycobacterium bovis subsp bovis AF2122/97
cuggacggcgggccgc

SEQ ID NO: 3207050 - RNA, 15 nt, Mycobacterium bovis subsp bovis AF2122/97
cuggacggggaagcc

SEQ ID NO: 3207051 - RNA, 21 nt, Mycobacterium bovis subsp bovis AF2122/97
cuggacgggguacugcggcuc

SEQ ID NO: 3207052 - RNA, 20 nt, Mycobacterium bovis subsp bovis AF2122/97
cuggacggucauccggccgu

SEQ ID NO: 3207053 - RNA, 14 nt, Mycobacterium bovis subsp bovis AF2122/97
cuggacgucggcga

SEQ ID NO: 3207054 - RNA, 17 nt, Mycobacterium bovis subsp bovis AF2122/97
cuggacucuucagcuac

SEQ ID NO: 3207055 - RNA, 18 nt, Mycobacterium bovis subsp bovis AF2122/97
cuggacucuucagcuacc

SEQ ID NO: 3207056 - RNA, 22 nt, Mycobacterium bovis subsp bovis AF2122/97
cuggacucuucagcuaccuccg

SEQ ID NO: 3207057 - RNA, 18 nt, Mycobacterium bovis subsp bovis AF2122/97
cuggacuggggcgccacc

SEQ ID NO: 3207058 - RNA, 19 nt, Mycobacterium bovis subsp bovis AF2122/97
cuggacuuccgguucaucg

SEQ ID NO: 3207059 - RNA, 20 nt, Mycobacterium bovis subsp bovis AF2122/97
cuggagaaaccacuggaugg

SEQ ID NO: 3207060 - RNA, 18 nt, Mycobacterium bovis subsp bovis AF2122/97
cuggagaacucugcgaga

SEQ ID NO: 3207061 - RNA, 16 nt, Mycobacterium bovis subsp bovis AF2122/97
cuggagcagccacgau

SEQ ID NO: 3207062 - RNA, 23 nt, Mycobacterium bovis subsp bovis AF2122/97
cuggagccgugcggucgcgcccu

SEQ ID NO: 3207063 - RNA, 14 nt, Mycobacterium bovis subsp bovis AF2122/97
cuggaggcggcgcc

SEQ ID NO: 3207064 - RNA, 21 nt, Mycobacterium bovis subsp bovis AF2122/97
cuggaggcggcgccuguucgg

SEQ ID NO: 3207065 - RNA, 23 nt, Mycobacterium bovis subsp bovis AF2122/97
cuggaggggcaacaggggaaaac

SEQ ID NO: 3207066 - RNA, 14 nt, Mycobacterium bovis subsp bovis AF2122/97
cuggagugaggcug

SEQ ID NO: 3207067 - RNA, 13 nt, Mycobacterium bovis subsp bovis AF2122/97
cuggauacccagc

SEQ ID NO: 3207068 - RNA, 15 nt, Mycobacterium bovis subsp bovis AF2122/97
cuggauacccagcgc

SEQ ID NO: 3207069 - RNA, 18 nt, Mycobacterium bovis subsp bovis AF2122/97
cuggauacccagcgcccg

SEQ ID NO: 3207070 - RNA, 16 nt, Mycobacterium bovis subsp bovis AF2122/97
cuggaucaacccggcc

SEQ ID NO: 3207071 - RNA, 17 nt, Mycobacterium bovis subsp bovis AF2122/97
cuggaucaacccggccu

SEQ ID NO: 3207072 - RNA, 21 nt, Mycobacterium bovis subsp bovis AF2122/97
cuggaucaacccggccuucuc

SEQ ID NO: 3207073 - RNA, 20 nt, Mycobacterium bovis subsp bovis AF2122/97
cuggaucgcgcccugagcca

SEQ ID NO: 3207074 - RNA, 14 nt, Mycobacterium bovis subsp bovis AF2122/97
cuggaucgcggugg

SEQ ID NO: 3207075 - RNA, 21 nt, Mycobacterium bovis subsp bovis AF2122/97
cuggaucgugccgaacacggu

SEQ ID NO: 3207076 - RNA, 15 nt, Mycobacterium bovis subsp bovis AF2122/97
cuggaugccgaucgg

SEQ ID NO: 3207077 - RNA, 12 nt, Mycobacterium bovis subsp bovis AF2122/97
cuggauggcgcu

SEQ ID NO: 3207078 - RNA, 19 nt, Mycobacterium bovis subsp bovis AF2122/97
cuggauucuucagcgcggc

SEQ ID NO: 3207079 - RNA, 20 nt, Mycobacterium bovis subsp bovis AF2122/97
cuggauucuucagcgcggca

SEQ ID NO: 3207080 - RNA, 22 nt, Mycobacterium bovis subsp bovis AF2122/97
cuggauucuucagcgcggcacg

SEQ ID NO: 3207081 - RNA, 13 nt, Mycobacterium bovis subsp bovis AF2122/97
cuggcaacgacac

SEQ ID NO: 3207082 - RNA, 22 nt, Mycobacterium bovis subsp bovis AF2122/97
cuggcaacgacacgccgcuccc

SEQ ID NO: 3207083 - RNA, 17 nt, Mycobacterium bovis subsp bovis AF2122/97
cuggcacacggucaccg

SEQ ID NO: 3207084 - RNA, 17 nt, Mycobacterium bovis subsp bovis AF2122/97
cuggcacacuccugcac

SEQ ID NO: 3207085 - RNA, 14 nt, Mycobacterium bovis subsp bovis AF2122/97
cuggcaccucccgg

SEQ ID NO: 3207086 - RNA, 17 nt, Mycobacterium bovis subsp bovis AF2122/97
cuggcaccucccgggcg

SEQ ID NO: 3207087 - RNA, 20 nt, Mycobacterium bovis subsp bovis AF2122/97
cuggcaccucgcccucccgg

SEQ ID NO: 3207088 - RNA, 16 nt, Mycobacterium bovis subsp bovis AF2122/97
cuggcacgcagagcca

SEQ ID NO: 3207089 - RNA, 16 nt, Mycobacterium bovis subsp bovis AF2122/97
cuggcagaccaacgcu

SEQ ID NO: 3207090 - RNA, 19 nt, Mycobacterium bovis subsp bovis AF2122/97
cuggcagccgaaguggcgc

SEQ ID NO: 3207091 - RNA, 16 nt, Mycobacterium bovis subsp bovis AF2122/97
cuggcagcggccuccg

SEQ ID NO: 3207092 - RNA, 21 nt, Mycobacterium bovis subsp bovis AF2122/97
cuggcagcggccuccgggcca

SEQ ID NO: 3207093 - RNA, 22 nt, Mycobacterium bovis subsp bovis AF2122/97
cuggcagcuccucgcgcucgcc

SEQ ID NO: 3207094 - RNA, 16 nt, Mycobacterium bovis subsp bovis AF2122/97
cuggcagcucggaucg

SEQ ID NO: 3207095 - RNA, 19 nt, Mycobacterium bovis subsp bovis AF2122/97
cuggcaggccgggcaccaa

SEQ ID NO: 3207096 - RNA, 21 nt, Mycobacterium bovis subsp bovis AF2122/97
cuggcagugugggggucaggg

SEQ ID NO: 3207097 - RNA, 19 nt, Mycobacterium bovis subsp bovis AF2122/97
cuggcauaggaucgcgccc

SEQ ID NO: 3207098 - RNA, 17 nt, Mycobacterium bovis subsp bovis AF2122/97
cuggcauaucccuugcc

SEQ ID NO: 3207099 - RNA, 18 nt, Mycobacterium bovis subsp bovis AF2122/97
cuggcauaucccuugccg

SEQ ID NO: 3207100 - RNA, 20 nt, Mycobacterium bovis subsp bovis AF2122/97
cuggcauccgccccgcccgc

SEQ ID NO: 3207101 - RNA, 21 nt, Mycobacterium bovis subsp bovis AF2122/97
cuggcauccgccccgcccgca

SEQ ID NO: 3207102 - RNA, 14 nt, Mycobacterium bovis subsp bovis AF2122/97
cuggcaugccggcg

SEQ ID NO: 3207103 - RNA, 18 nt, Mycobacterium bovis subsp bovis AF2122/97
cuggccaacuugacccgg

SEQ ID NO: 3207104 - RNA, 14 nt, Mycobacterium bovis subsp bovis AF2122/97
cuggccacaaucgc

SEQ ID NO: 3207105 - RNA, 15 nt, Mycobacterium bovis subsp bovis AF2122/97
cuggccaccgcaucg

SEQ ID NO: 3207106 - RNA, 21 nt, Mycobacterium bovis subsp bovis AF2122/97
cuggccacgauccgcgguagc

SEQ ID NO: 3207107 - RNA, 19 nt, Mycobacterium bovis subsp bovis AF2122/97
cuggccacggggcugccgg

SEQ ID NO: 3207108 - RNA, 20 nt, Mycobacterium bovis subsp bovis AF2122/97
cuggccacggggcugccggu

SEQ ID NO: 3207109 - RNA, 15 nt, Mycobacterium bovis subsp bovis AF2122/97
cuggccacucacauu

SEQ ID NO: 3207110 - RNA, 23 nt, Mycobacterium bovis subsp bovis AF2122/97
cuggccacucacauuggccaggu

SEQ ID NO: 3207111 - RNA, 12 nt, Mycobacterium bovis subsp bovis AF2122/97
cuggccagcaca

SEQ ID NO: 3207112 - RNA, 14 nt, Mycobacterium bovis subsp bovis AF2122/97
cuggccagcacacc

SEQ ID NO: 3207113 - RNA, 13 nt, Mycobacterium bovis subsp bovis AF2122/97
cuggccagcacgc

SEQ ID NO: 3207114 - RNA, 17 nt, Mycobacterium bovis subsp bovis AF2122/97
cuggccagcagagcggc

SEQ ID NO: 3207115 - RNA, 23 nt, Mycobacterium bovis subsp bovis AF2122/97
cuggccagcagagcggcacgcac

SEQ ID NO: 3207116 - RNA, 18 nt, Mycobacterium bovis subsp bovis AF2122/97
cuggccagcgaaauacag

SEQ ID NO: 3207117 - RNA, 14 nt, Mycobacterium bovis subsp bovis AF2122/97
cuggccagcgcgcu

SEQ ID NO: 3207118 - RNA, 14 nt, Mycobacterium bovis subsp bovis AF2122/97
cuggccaggccggc

SEQ ID NO: 3207119 - RNA, 15 nt, Mycobacterium bovis subsp bovis AF2122/97
cuggccaggccggca

SEQ ID NO: 3207120 - RNA, 17 nt, Mycobacterium bovis subsp bovis AF2122/97
cuggccagguggccgca

SEQ ID NO: 3207121 - RNA, 18 nt, Mycobacterium bovis subsp bovis AF2122/97
cuggccagguggccgcau

SEQ ID NO: 3207122 - RNA, 14 nt, Mycobacterium bovis subsp bovis AF2122/97
cuggccagguugcc

SEQ ID NO: 3207123 - RNA, 21 nt, Mycobacterium bovis subsp bovis AF2122/97
cuggccagguugccgucggcc

SEQ ID NO: 3207124 - RNA, 13 nt, Mycobacterium bovis subsp bovis AF2122/97
cuggccaguccga

SEQ ID NO: 3207125 - RNA, 19 nt, Mycobacterium bovis subsp bovis AF2122/97
cuggcccaauugcgccgag

SEQ ID NO: 3207126 - RNA, 20 nt, Mycobacterium bovis subsp bovis AF2122/97
cuggcccaauugcgccgagc

SEQ ID NO: 3207127 - RNA, 15 nt, Mycobacterium bovis subsp bovis AF2122/97
cuggcccacgccgca

SEQ ID NO: 3207128 - RNA, 21 nt, Mycobacterium bovis subsp bovis AF2122/97
cuggcccacgccgcaucggcg

SEQ ID NO: 3207129 - RNA, 17 nt, Mycobacterium bovis subsp bovis AF2122/97
cuggccccgccagcggc

SEQ ID NO: 3207130 - RNA, 20 nt, Mycobacterium bovis subsp bovis AF2122/97
cuggccccgccagcggcagc

SEQ ID NO: 3207131 - RNA, 15 nt, Mycobacterium bovis subsp bovis AF2122/97
cuggccccgguggug

SEQ ID NO: 3207132 - RNA, 17 nt, Mycobacterium bovis subsp bovis AF2122/97
cuggccccgguggugcu

SEQ ID NO: 3207133 - RNA, 21 nt, Mycobacterium bovis subsp bovis AF2122/97
cuggccccgguggugcugccg

SEQ ID NO: 3207134 - RNA, 21 nt, Mycobacterium bovis subsp bovis AF2122/97
cuggcccgcacgaaccggucg

SEQ ID NO: 3207135 - RNA, 18 nt, Mycobacterium bovis subsp bovis AF2122/97
cuggcccgccacgauguc

SEQ ID NO: 3207136 - RNA, 23 nt, Mycobacterium bovis subsp bovis AF2122/97
cuggcccgccacgaugucgucga

SEQ ID NO: 3207137 - RNA, 23 nt, Mycobacterium bovis subsp bovis AF2122/97
cuggcccgccagaacggcgucga

SEQ ID NO: 3207138 - RNA, 17 nt, Mycobacterium bovis subsp bovis AF2122/97
cuggcccgcuguaccuc

SEQ ID NO: 3207139 - RNA, 17 nt, Mycobacterium bovis subsp bovis AF2122/97
cuggcccggacaugcgg

SEQ ID NO: 3207140 - RNA, 22 nt, Mycobacterium bovis subsp bovis AF2122/97
cuggcccggacaugcgggcagc

SEQ ID NO: 3207141 - RNA, 13 nt, Mycobacterium bovis subsp bovis AF2122/97
cuggcccggcgcu

SEQ ID NO: 3207142 - RNA, 21 nt, Mycobacterium bovis subsp bovis AF2122/97
cuggcccugcuccucgcgggc

SEQ ID NO: 3207143 - RNA, 22 nt, Mycobacterium bovis subsp bovis AF2122/97
cuggcccuuguuggccugcaac

SEQ ID NO: 3207144 - RNA, 21 nt, Mycobacterium bovis subsp bovis AF2122/97
cuggccgaacgacggguccgg

SEQ ID NO: 3207145 - RNA, 23 nt, Mycobacterium bovis subsp bovis AF2122/97
cuggccgaacgacggguccgggc

SEQ ID NO: 3207146 - RNA, 14 nt, Mycobacterium bovis subsp bovis AF2122/97
cuggccgaagaacu

SEQ ID NO: 3207147 - RNA, 20 nt, Mycobacterium bovis subsp bovis AF2122/97
cuggccgaauaacagcaggc

SEQ ID NO: 3207148 - RNA, 21 nt, Mycobacterium bovis subsp bovis AF2122/97
cuggccgaauaacagcaggca

SEQ ID NO: 3207149 - RNA, 14 nt, Mycobacterium bovis subsp bovis AF2122/97
cuggccgacucgag

SEQ ID NO: 3207150 - RNA, 22 nt, Mycobacterium bovis subsp bovis AF2122/97
cuggccgauggcgucaagcaca

SEQ ID NO: 3207151 - RNA, 21 nt, Mycobacterium bovis subsp bovis AF2122/97
cuggccgauguaguccggcca

SEQ ID NO: 3207152 - RNA, 23 nt, Mycobacterium bovis subsp bovis AF2122/97
cuggccgauguaguccggccagu

SEQ ID NO: 3207153 - RNA, 20 nt, Mycobacterium bovis subsp bovis AF2122/97
cuggccgaugugggcggagc

SEQ ID NO: 3207154 - RNA, 21 nt, Mycobacterium bovis subsp bovis AF2122/97
cuggccgcccagaccgccgac

SEQ ID NO: 3207155 - RNA, 14 nt, Mycobacterium bovis subsp bovis AF2122/97
cuggccgcccgcuc

SEQ ID NO: 3207156 - RNA, 14 nt, Mycobacterium bovis subsp bovis AF2122/97
cuggccgcccggcg

SEQ ID NO: 3207157 - RNA, 13 nt, Mycobacterium bovis subsp bovis AF2122/97
cuggccgccgccc

SEQ ID NO: 3207158 - RNA, 14 nt, Mycobacterium bovis subsp bovis AF2122/97
cuggccgccgccgu

SEQ ID NO: 3207159 - RNA, 12 nt, Mycobacterium bovis subsp bovis AF2122/97
cuggccgccgcg

SEQ ID NO: 3207160 - RNA, 14 nt, Mycobacterium bovis subsp bovis AF2122/97
cuggccgccgcgca

SEQ ID NO: 3207161 - RNA, 15 nt, Mycobacterium bovis subsp bovis AF2122/97
cuggccgccgcgcac

SEQ ID NO: 3207162 - RNA, 16 nt, Mycobacterium bovis subsp bovis AF2122/97
cuggccgccgcgcacc

SEQ ID NO: 3207163 - RNA, 17 nt, Mycobacterium bovis subsp bovis AF2122/97
cuggccgccgcgcaccg

SEQ ID NO: 3207164 - RNA, 19 nt, Mycobacterium bovis subsp bovis AF2122/97
cuggccgccgcgcaccgcg

SEQ ID NO: 3207165 - RNA, 12 nt, Mycobacterium bovis subsp bovis AF2122/97
cuggccgccggc

SEQ ID NO: 3207166 - RNA, 14 nt, Mycobacterium bovis subsp bovis AF2122/97
cuggccgccggccc

SEQ ID NO: 3207167 - RNA, 16 nt, Mycobacterium bovis subsp bovis AF2122/97
cuggccgccggccccg

SEQ ID NO: 3207168 - RNA, 17 nt, Mycobacterium bovis subsp bovis AF2122/97
cuggccgccggccccgc

SEQ ID NO: 3207169 - RNA, 20 nt, Mycobacterium bovis subsp bovis AF2122/97
cuggccgccggccccgccgu

SEQ ID NO: 3207170 - RNA, 13 nt, Mycobacterium bovis subsp bovis AF2122/97
cuggccgccggcg

SEQ ID NO: 3207171 - RNA, 15 nt, Mycobacterium bovis subsp bovis AF2122/97
cuggccgccggcgcc

SEQ ID NO: 3207172 - RNA, 16 nt, Mycobacterium bovis subsp bovis AF2122/97
cuggccgccuccgcgg

SEQ ID NO: 3207173 - RNA, 17 nt, Mycobacterium bovis subsp bovis AF2122/97
cuggccgccuccgcggc

SEQ ID NO: 3207174 - RNA, 12 nt, Mycobacterium bovis subsp bovis AF2122/97
cuggccgcgccg

SEQ ID NO: 3207175 - RNA, 15 nt, Mycobacterium bovis subsp bovis AF2122/97
cuggccgcgccgggg

SEQ ID NO: 3207176 - RNA, 16 nt, Mycobacterium bovis subsp bovis AF2122/97
cuggccgcgccgggga

SEQ ID NO: 3207177 - RNA, 12 nt, Mycobacterium bovis subsp bovis AF2122/97
cuggccgcggcc

SEQ ID NO: 3207178 - RNA, 23 nt, Mycobacterium bovis subsp bovis AF2122/97
cuggccgcuauccaggccgucag

SEQ ID NO: 3207179 - RNA, 14 nt, Mycobacterium bovis subsp bovis AF2122/97
cuggccggcaccgu

SEQ ID NO: 3207180 - RNA, 14 nt, Mycobacterium bovis subsp bovis AF2122/97
cuggccggcggugu

SEQ ID NO: 3207181 - RNA, 14 nt, Mycobacterium bovis subsp bovis AF2122/97
cuggccgggaccgc

SEQ ID NO: 3207182 - RNA, 13 nt, Mycobacterium bovis subsp bovis AF2122/97
cuggccgggugcg

SEQ ID NO: 3207183 - RNA, 20 nt, Mycobacterium bovis subsp bovis AF2122/97
cuggccggguuccagcggca

SEQ ID NO: 3207184 - RNA, 22 nt, Mycobacterium bovis subsp bovis AF2122/97
cuggccggugguagcggacagc

SEQ ID NO: 3207185 - RNA, 22 nt, Mycobacterium bovis subsp bovis AF2122/97
cuggccguauaggcccgggcgg

SEQ ID NO: 3207186 - RNA, 23 nt, Mycobacterium bovis subsp bovis AF2122/97
cuggccguauaggcccgggcggc

SEQ ID NO: 3207187 - RNA, 12 nt, Mycobacterium bovis subsp bovis AF2122/97
cuggccgucagc

SEQ ID NO: 3207188 - RNA, 22 nt, Mycobacterium bovis subsp bovis AF2122/97
cuggccguccuaccgaugaacc

SEQ ID NO: 3207189 - RNA, 21 nt, Mycobacterium bovis subsp bovis AF2122/97
cuggccgucgaagacgaacgu

SEQ ID NO: 3207190 - RNA, 16 nt, Mycobacterium bovis subsp bovis AF2122/97
cuggccgucgcuggug

SEQ ID NO: 3207191 - RNA, 20 nt, Mycobacterium bovis subsp bovis AF2122/97
cuggccguuguucuugucgg

SEQ ID NO: 3207192 - RNA, 16 nt, Mycobacterium bovis subsp bovis AF2122/97
cuggccguuucggcgc

SEQ ID NO: 3207193 - RNA, 15 nt, Mycobacterium bovis subsp bovis AF2122/97
cuggccuccagcuug

SEQ ID NO: 3207194 - RNA, 18 nt, Mycobacterium bovis subsp bovis AF2122/97
cuggccucggggaucgca

SEQ ID NO: 3207195 - RNA, 17 nt, Mycobacterium bovis subsp bovis AF2122/97
cuggccugcccagcacc

SEQ ID NO: 3207196 - RNA, 13 nt, Mycobacterium bovis subsp bovis AF2122/97
cuggccugcccca

SEQ ID NO: 3207197 - RNA, 13 nt, Mycobacterium bovis subsp bovis AF2122/97
cuggccugcggca

SEQ ID NO: 3207198 - RNA, 18 nt, Mycobacterium bovis subsp bovis AF2122/97
cuggccuuugagcgcggc

SEQ ID NO: 3207199 - RNA, 23 nt, Mycobacterium bovis subsp bovis AF2122/97
cuggcgaacucgaggucgagcgc

SEQ ID NO: 3207200 - RNA, 18 nt, Mycobacterium bovis subsp bovis AF2122/97
cuggcgaaggacaacagc

SEQ ID NO: 3207201 - RNA, 21 nt, Mycobacterium bovis subsp bovis AF2122/97
cuggcgaaugcgggccuccug

SEQ ID NO: 3207202 - RNA, 22 nt, Mycobacterium bovis subsp bovis AF2122/97
cuggcgaaugcgggccuccugc

SEQ ID NO: 3207203 - RNA, 14 nt, Mycobacterium bovis subsp bovis AF2122/97
cuggcgacgcgaca

SEQ ID NO: 3207204 - RNA, 20 nt, Mycobacterium bovis subsp bovis AF2122/97
cuggcgauaaccgacgauca

SEQ ID NO: 3207205 - RNA, 15 nt, Mycobacterium bovis subsp bovis AF2122/97
cuggcgauaucggcc

SEQ ID NO: 3207206 - RNA, 17 nt, Mycobacterium bovis subsp bovis AF2122/97
cuggcgaucgcgacgau

SEQ ID NO: 3207207 - RNA, 21 nt, Mycobacterium bovis subsp bovis AF2122/97
cuggcgaucucuaccagccgc

SEQ ID NO: 3207208 - RNA, 16 nt, Mycobacterium bovis subsp bovis AF2122/97
cuggcgaucuggucgg

SEQ ID NO: 3207209 - RNA, 19 nt, Mycobacterium bovis subsp bovis AF2122/97
cuggcgaucuggucggcgg

SEQ ID NO: 3207210 - RNA, 17 nt, Mycobacterium bovis subsp bovis AF2122/97
cuggcgaugacgaucgc

SEQ ID NO: 3207211 - RNA, 21 nt, Mycobacterium bovis subsp bovis AF2122/97
cuggcgauggccguccgaccg

SEQ ID NO: 3207212 - RNA, 20 nt, Mycobacterium bovis subsp bovis AF2122/97
cuggcgauuucgaucacauc

SEQ ID NO: 3207213 - RNA, 12 nt, Mycobacterium bovis subsp bovis AF2122/97
cuggcgcagccu

SEQ ID NO: 3207214 - RNA, 12 nt, Mycobacterium bovis subsp bovis AF2122/97
cuggcgcagcgc

SEQ ID NO: 3207215 - RNA, 14 nt, Mycobacterium bovis subsp bovis AF2122/97
cuggcgcagcgcca

SEQ ID NO: 3207216 - RNA, 17 nt, Mycobacterium bovis subsp bovis AF2122/97
cuggcgcccccgacgac

SEQ ID NO: 3207217 - RNA, 20 nt, Mycobacterium bovis subsp bovis AF2122/97
cuggcgcccccgacgacggc

SEQ ID NO: 3207218 - RNA, 13 nt, Mycobacterium bovis subsp bovis AF2122/97
cuggcgcccccgc

SEQ ID NO: 3207219 - RNA, 15 nt, Mycobacterium bovis subsp bovis AF2122/97
cuggcgcccccgcca

SEQ ID NO: 3207220 - RNA, 17 nt, Mycobacterium bovis subsp bovis AF2122/97
cuggcgcccccgccauu

SEQ ID NO: 3207221 - RNA, 23 nt, Mycobacterium bovis subsp bovis AF2122/97
cuggcgcccccgccauugccgcc

SEQ ID NO: 3207222 - RNA, 18 nt, Mycobacterium bovis subsp bovis AF2122/97
cuggcgcccuugccggcg

SEQ ID NO: 3207223 - RNA, 12 nt, Mycobacterium bovis subsp bovis AF2122/97
cuggcgccgaag

SEQ ID NO: 3207224 - RNA, 23 nt, Mycobacterium bovis subsp bovis AF2122/97
cuggcgccgaaguagccgaccgg

SEQ ID NO: 3207225 - RNA, 16 nt, Mycobacterium bovis subsp bovis AF2122/97
cuggcgccggccagcc

SEQ ID NO: 3207226 - RNA, 18 nt, Mycobacterium bovis subsp bovis AF2122/97
cuggcgccggccagccag

SEQ ID NO: 3207227 - RNA, 16 nt, Mycobacterium bovis subsp bovis AF2122/97
cuggcgccggugccgc

SEQ ID NO: 3207228 - RNA, 19 nt, Mycobacterium bovis subsp bovis AF2122/97
cuggcgccggugccgccgg

SEQ ID NO: 3207229 - RNA, 14 nt, Mycobacterium bovis subsp bovis AF2122/97
cuggcgccguuagc

SEQ ID NO: 3207230 - RNA, 19 nt, Mycobacterium bovis subsp bovis AF2122/97
cuggcgcucauaggccggc

SEQ ID NO: 3207231 - RNA, 20 nt, Mycobacterium bovis subsp bovis AF2122/97
cuggcgcucauaggccggcg

SEQ ID NO: 3207232 - RNA, 21 nt, Mycobacterium bovis subsp bovis AF2122/97
cuggcgcucauaggccggcgg

SEQ ID NO: 3207233 - RNA, 22 nt, Mycobacterium bovis subsp bovis AF2122/97
cuggcgcugaugcuggccaugu

SEQ ID NO: 3207234 - RNA, 23 nt, Mycobacterium bovis subsp bovis AF2122/97
cuggcgcugaugcuggccauguu

SEQ ID NO: 3207235 - RNA, 14 nt, Mycobacterium bovis subsp bovis AF2122/97
cuggcgcugcuggc

SEQ ID NO: 3207236 - RNA, 18 nt, Mycobacterium bovis subsp bovis AF2122/97
cuggcgcuuugggcugcc

SEQ ID NO: 3207237 - RNA, 19 nt, Mycobacterium bovis subsp bovis AF2122/97
cuggcgcuuugggcugccg

SEQ ID NO: 3207238 - RNA, 11 nt, Mycobacterium bovis subsp bovis AF2122/97
cuggcggaugg

SEQ ID NO: 3207239 - RNA, 21 nt, Mycobacterium bovis subsp bovis AF2122/97
cuggcggcagcgguuuuaggc

SEQ ID NO: 3207240 - RNA, 20 nt, Mycobacterium bovis subsp bovis AF2122/97
cuggcggccagcaucgggug

SEQ ID NO: 3207241 - RNA, 13 nt, Mycobacterium bovis subsp bovis AF2122/97
cuggcggcccggg

SEQ ID NO: 3207242 - RNA, 18 nt, Mycobacterium bovis subsp bovis AF2122/97
cuggcggccucgccggcg

SEQ ID NO: 3207243 - RNA, 19 nt, Mycobacterium bovis subsp bovis AF2122/97
cuggcggccucgccggcgc

SEQ ID NO: 3207244 - RNA, 22 nt, Mycobacterium bovis subsp bovis AF2122/97
cuggcggccucgccggcgcgca

SEQ ID NO: 3207245 - RNA, 14 nt, Mycobacterium bovis subsp bovis AF2122/97
cuggcggcgcagcg

SEQ ID NO: 3207246 - RNA, 15 nt, Mycobacterium bovis subsp bovis AF2122/97
cuggcggcgccgcag

SEQ ID NO: 3207247 - RNA, 21 nt, Mycobacterium bovis subsp bovis AF2122/97
cuggcggcgccgcagaucacc

SEQ ID NO: 3207248 - RNA, 14 nt, Mycobacterium bovis subsp bovis AF2122/97
cuggcggcgcgaca

SEQ ID NO: 3207249 - RNA, 15 nt, Mycobacterium bovis subsp bovis AF2122/97
cuggcggcgcgacag

SEQ ID NO: 3207250 - RNA, 22 nt, Mycobacterium bovis subsp bovis AF2122/97
cuggcggcugcagccgaccgaa

SEQ ID NO: 3207251 - RNA, 20 nt, Mycobacterium bovis subsp bovis AF2122/97
cuggcggguaagcgaccgac

SEQ ID NO: 3207252 - RNA, 21 nt, Mycobacterium bovis subsp bovis AF2122/97
cuggcggguaagcgaccgacg

SEQ ID NO: 3207253 - RNA, 22 nt, Mycobacterium bovis subsp bovis AF2122/97
cuggcggguuggucccgaugac

SEQ ID NO: 3207254 - RNA, 17 nt, Mycobacterium bovis subsp bovis AF2122/97
cuggcgguaucgaaagc

SEQ ID NO: 3207255 - RNA, 15 nt, Mycobacterium bovis subsp bovis AF2122/97
cuggcggugccggcg

SEQ ID NO: 3207256 - RNA, 19 nt, Mycobacterium bovis subsp bovis AF2122/97
cuggcgguguaacccggaa

SEQ ID NO: 3207257 - RNA, 12 nt, Mycobacterium bovis subsp bovis AF2122/97
cuggcgguugcc

SEQ ID NO: 3207258 - RNA, 15 nt, Mycobacterium bovis subsp bovis AF2122/97
cuggcguagaucauc

SEQ ID NO: 3207259 - RNA, 16 nt, Mycobacterium bovis subsp bovis AF2122/97
cuggcguagugcagcu

SEQ ID NO: 3207260 - RNA, 14 nt, Mycobacterium bovis subsp bovis AF2122/97
cuggcgucgaugcc

SEQ ID NO: 3207261 - RNA, 22 nt, Mycobacterium bovis subsp bovis AF2122/97
cuggcgucgaugccggcugccg

SEQ ID NO: 3207262 - RNA, 23 nt, Mycobacterium bovis subsp bovis AF2122/97
cuggcgucgucuucgguuaaggu

SEQ ID NO: 3207263 - RNA, 16 nt, Mycobacterium bovis subsp bovis AF2122/97
cuggcgugcagcagga

SEQ ID NO: 3207264 - RNA, 15 nt, Mycobacterium bovis subsp bovis AF2122/97
cuggcgugucgccgc

SEQ ID NO: 3207265 - RNA, 16 nt, Mycobacterium bovis subsp bovis AF2122/97
cuggcgugucgccgcc

SEQ ID NO: 3207266 - RNA, 18 nt, Mycobacterium bovis subsp bovis AF2122/97
cuggcgugucgccgccac

SEQ ID NO: 3207267 - RNA, 21 nt, Mycobacterium bovis subsp bovis AF2122/97
cuggcgugucgccgccaccag

SEQ ID NO: 3207268 - RNA, 23 nt, Mycobacterium bovis subsp bovis AF2122/97
cuggcgugugugcgccuccggga

SEQ ID NO: 3207269 - RNA, 12 nt, Mycobacterium bovis subsp bovis AF2122/97
cuggcguucagc

SEQ ID NO: 3207270 - RNA, 22 nt, Mycobacterium bovis subsp bovis AF2122/97
cuggcguugcugaugucgccgg

SEQ ID NO: 3207271 - RNA, 19 nt, Mycobacterium bovis subsp bovis AF2122/97
cuggcguuguugacgauca

SEQ ID NO: 3207272 - RNA, 21 nt, Mycobacterium bovis subsp bovis AF2122/97
cuggcguuguugacgaucacc

SEQ ID NO: 3207273 - RNA, 23 nt, Mycobacterium bovis subsp bovis AF2122/97
cuggcguuguugacgaucacccc

SEQ ID NO: 3207274 - RNA, 16 nt, Mycobacterium bovis subsp bovis AF2122/97
cuggcuacccaccggc

SEQ ID NO: 3207275 - RNA, 17 nt, Mycobacterium bovis subsp bovis AF2122/97
cuggcuacccaccggcc

SEQ ID NO: 3207276 - RNA, 20 nt, Mycobacterium bovis subsp bovis AF2122/97
cuggcuacccaccggccggu

SEQ ID NO: 3207277 - RNA, 15 nt, Mycobacterium bovis subsp bovis AF2122/97
cuggcuacgccuccu

SEQ ID NO: 3207278 - RNA, 19 nt, Mycobacterium bovis subsp bovis AF2122/97
cuggcuacgcgcgcccgau

SEQ ID NO: 3207279 - RNA, 16 nt, Mycobacterium bovis subsp bovis AF2122/97
cuggcuacgggccgcg

SEQ ID NO: 3207280 - RNA, 17 nt, Mycobacterium bovis subsp bovis AF2122/97
cuggcuacgggccgcgg

SEQ ID NO: 3207281 - RNA, 20 nt, Mycobacterium bovis subsp bovis AF2122/97
cuggcuagcgccgaucuucg

SEQ ID NO: 3207282 - RNA, 21 nt, Mycobacterium bovis subsp bovis AF2122/97
cuggcuaguugggugggugca

SEQ ID NO: 3207283 - RNA, 15 nt, Mycobacterium bovis subsp bovis AF2122/97
cuggcucaucgaagc

SEQ ID NO: 3207284 - RNA, 22 nt, Mycobacterium bovis subsp bovis AF2122/97
cuggcucaucgaagcuucggcc

SEQ ID NO: 3207285 - RNA, 22 nt, Mycobacterium bovis subsp bovis AF2122/97
cuggcugaccgaauggccgccg

SEQ ID NO: 3207286 - RNA, 18 nt, Mycobacterium bovis subsp bovis AF2122/97
cuggcugccacgaacgcu

SEQ ID NO: 3207287 - RNA, 20 nt, Mycobacterium bovis subsp bovis AF2122/97
cuggcugcgguaguugcagu

SEQ ID NO: 3207288 - RNA, 15 nt, Mycobacterium bovis subsp bovis AF2122/97
cuggcuggaccacuc

SEQ ID NO: 3207289 - RNA, 22 nt, Mycobacterium bovis subsp bovis AF2122/97
cuggcuggaccacucgccggcg

SEQ ID NO: 3207290 - RNA, 14 nt, Mycobacterium bovis subsp bovis AF2122/97
cuggcuggccagcu

SEQ ID NO: 3207291 - RNA, 13 nt, Mycobacterium bovis subsp bovis AF2122/97
cuggcuggucagg

SEQ ID NO: 3207292 - RNA, 22 nt, Mycobacterium bovis subsp bovis AF2122/97
cuggcuguggcugaacaccgcg

SEQ ID NO: 3207293 - RNA, 15 nt, Mycobacterium bovis subsp bovis AF2122/97
cuggcuucucgcagu

SEQ ID NO: 3207294 - RNA, 21 nt, Mycobacterium bovis subsp bovis AF2122/97
cuggcuugagguaggucacca

SEQ ID NO: 3207295 - RNA, 23 nt, Mycobacterium bovis subsp bovis AF2122/97
cuggcuugggccagcgcaucuuu

SEQ ID NO: 3207296 - RNA, 19 nt, Mycobacterium bovis subsp bovis AF2122/97
cuggcuuugaucgcccggu

SEQ ID NO: 3207297 - RNA, 19 nt, Mycobacterium bovis subsp bovis AF2122/97
cugggacaguucgcgccgu

SEQ ID NO: 3207298 - RNA, 20 nt, Mycobacterium bovis subsp bovis AF2122/97
cugggaccccgcugcgacgu

SEQ ID NO: 3207299 - RNA, 14 nt, Mycobacterium bovis subsp bovis AF2122/97
cugggacggcggca

SEQ ID NO: 3207300 - RNA, 18 nt, Mycobacterium bovis subsp bovis AF2122/97
cugggacgggcgcgucgg

SEQ ID NO: 3207301 - RNA, 11 nt, Mycobacterium bovis subsp bovis AF2122/97
cugggagaucg

SEQ ID NO: 3207302 - RNA, 14 nt, Mycobacterium bovis subsp bovis AF2122/97
cugggagcggaugu

SEQ ID NO: 3207303 - RNA, 13 nt, Mycobacterium bovis subsp bovis AF2122/97
cugggauagcgcg

SEQ ID NO: 3207304 - RNA, 17 nt, Mycobacterium bovis subsp bovis AF2122/97
cugggaugugccgcgca

SEQ ID NO: 3207305 - RNA, 16 nt, Mycobacterium bovis subsp bovis AF2122/97
cugggauguucgauca

SEQ ID NO: 3207306 - RNA, 21 nt, Mycobacterium bovis subsp bovis AF2122/97
cugggauguucgaucagcgac

SEQ ID NO: 3207307 - RNA, 15 nt, Mycobacterium bovis subsp bovis AF2122/97
cugggauucugggcg

SEQ ID NO: 3207308 - RNA, 19 nt, Mycobacterium bovis subsp bovis AF2122/97
cugggcaaacugggcaccg

SEQ ID NO: 3207309 - RNA, 21 nt, Mycobacterium bovis subsp bovis AF2122/97
cugggcaaacugggcaccggc

SEQ ID NO: 3207310 - RNA, 18 nt, Mycobacterium bovis subsp bovis AF2122/97
cugggcaaguucugcgcu

SEQ ID NO: 3207311 - RNA, 15 nt, Mycobacterium bovis subsp bovis AF2122/97
cugggcaccggcggu

SEQ ID NO: 3207312 - RNA, 14 nt, Mycobacterium bovis subsp bovis AF2122/97
cugggcacucggcc

SEQ ID NO: 3207313 - RNA, 18 nt, Mycobacterium bovis subsp bovis AF2122/97
cugggcacucggcccggc

SEQ ID NO: 3207314 - RNA, 14 nt, Mycobacterium bovis subsp bovis AF2122/97
cugggcagaccgau

SEQ ID NO: 3207315 - RNA, 18 nt, Mycobacterium bovis subsp bovis AF2122/97
cugggcagaccgaucggc

SEQ ID NO: 3207316 - RNA, 19 nt, Mycobacterium bovis subsp bovis AF2122/97
cugggcagaccgaucggca

SEQ ID NO: 3207317 - RNA, 17 nt, Mycobacterium bovis subsp bovis AF2122/97
cugggcaggaucgaggc

SEQ ID NO: 3207318 - RNA, 13 nt, Mycobacterium bovis subsp bovis AF2122/97
cugggcaucaccg

SEQ ID NO: 3207319 - RNA, 15 nt, Mycobacterium bovis subsp bovis AF2122/97
cugggcaucaccgac

SEQ ID NO: 3207320 - RNA, 16 nt, Mycobacterium bovis subsp bovis AF2122/97
cugggcaucaccgacg

SEQ ID NO: 3207321 - RNA, 15 nt, Mycobacterium bovis subsp bovis AF2122/97
cugggcaucaccgcc

SEQ ID NO: 3207322 - RNA, 20 nt, Mycobacterium bovis subsp bovis AF2122/97
cugggcaucaccgccgcggc

SEQ ID NO: 3207323 - RNA, 23 nt, Mycobacterium bovis subsp bovis AF2122/97
cugggcaucaccgccgcggccgc

SEQ ID NO: 3207324 - RNA, 21 nt, Mycobacterium bovis subsp bovis AF2122/97
cugggcaucaucagcggcgcc

SEQ ID NO: 3207325 - RNA, 17 nt, Mycobacterium bovis subsp bovis AF2122/97
cugggccagcagccguu

SEQ ID NO: 3207326 - RNA, 11 nt, Mycobacterium bovis subsp bovis AF2122/97
cugggccagcc

SEQ ID NO: 3207327 - RNA, 15 nt, Mycobacterium bovis subsp bovis AF2122/97
cugggccagccgcuc

SEQ ID NO: 3207328 - RNA, 12 nt, Mycobacterium bovis subsp bovis AF2122/97
cugggccagggu

SEQ ID NO: 3207329 - RNA, 23 nt, Mycobacterium bovis subsp bovis AF2122/97
cugggcccccaaucagugcagcg

SEQ ID NO: 3207330 - RNA, 18 nt, Mycobacterium bovis subsp bovis AF2122/97
cugggcccgccagcccag

SEQ ID NO: 3207331 - RNA, 18 nt, Mycobacterium bovis subsp bovis AF2122/97
cugggccgcuccaccacg

SEQ ID NO: 3207332 - RNA, 23 nt, Mycobacterium bovis subsp bovis AF2122/97
cugggccgcuccaccacgaccgc

SEQ ID NO: 3207333 - RNA, 14 nt, Mycobacterium bovis subsp bovis AF2122/97
cugggccggggagg

SEQ ID NO: 3207334 - RNA, 23 nt, Mycobacterium bovis subsp bovis AF2122/97
cugggcgaaagugauccagucga

SEQ ID NO: 3207335 - RNA, 16 nt, Mycobacterium bovis subsp bovis AF2122/97
cugggcgacuaccggc

SEQ ID NO: 3207336 - RNA, 17 nt, Mycobacterium bovis subsp bovis AF2122/97
cugggcgaucgacaccg

SEQ ID NO: 3207337 - RNA, 19 nt, Mycobacterium bovis subsp bovis AF2122/97
cugggcgaugacgccaucg

SEQ ID NO: 3207338 - RNA, 23 nt, Mycobacterium bovis subsp bovis AF2122/97
cugggcgcccgcgguccggcgaa

SEQ ID NO: 3207339 - RNA, 16 nt, Mycobacterium bovis subsp bovis AF2122/97
cugggcgccgcgcucg

SEQ ID NO: 3207340 - RNA, 17 nt, Mycobacterium bovis subsp bovis AF2122/97
cugggcgcgcucaucga

SEQ ID NO: 3207341 - RNA, 21 nt, Mycobacterium bovis subsp bovis AF2122/97
cugggcgcgcucaucgaccgc

SEQ ID NO: 3207342 - RNA, 22 nt, Mycobacterium bovis subsp bovis AF2122/97
cugggcgcgcucaucgaccgcg

SEQ ID NO: 3207343 - RNA, 22 nt, Mycobacterium bovis subsp bovis AF2122/97
cugggcgcgcucaucgaccggg

SEQ ID NO: 3207344 - RNA, 15 nt, Mycobacterium bovis subsp bovis AF2122/97
cugggcgcgcuggcg

SEQ ID NO: 3207345 - RNA, 18 nt, Mycobacterium bovis subsp bovis AF2122/97
cugggcgcgcuggcgggc

SEQ ID NO: 3207346 - RNA, 15 nt, Mycobacterium bovis subsp bovis AF2122/97
cugggcgcuggaggc

SEQ ID NO: 3207347 - RNA, 22 nt, Mycobacterium bovis subsp bovis AF2122/97
cugggcgcuggaggccaccacc

SEQ ID NO: 3207348 - RNA, 14 nt, Mycobacterium bovis subsp bovis AF2122/97
cugggcggccagca

SEQ ID NO: 3207349 - RNA, 15 nt, Mycobacterium bovis subsp bovis AF2122/97
cugggcggccagcac

SEQ ID NO: 3207350 - RNA, 14 nt, Mycobacterium bovis subsp bovis AF2122/97
cugggcggccgggc

SEQ ID NO: 3207351 - RNA, 19 nt, Mycobacterium bovis subsp bovis AF2122/97
cugggcggcuacccauggc

SEQ ID NO: 3207352 - RNA, 22 nt, Mycobacterium bovis subsp bovis AF2122/97
cugggcgguagcuuccgcgacg

SEQ ID NO: 3207353 - RNA, 15 nt, Mycobacterium bovis subsp bovis AF2122/97
cugggcggugaaggc

SEQ ID NO: 3207354 - RNA, 21 nt, Mycobacterium bovis subsp bovis AF2122/97
cugggcguaaaccguggccgc

SEQ ID NO: 3207355 - RNA, 16 nt, Mycobacterium bovis subsp bovis AF2122/97
cugggcgucgaccacg

SEQ ID NO: 3207356 - RNA, 14 nt, Mycobacterium bovis subsp bovis AF2122/97
cugggcugccggcc

SEQ ID NO: 3207357 - RNA, 15 nt, Mycobacterium bovis subsp bovis AF2122/97
cugggcugcggccgc

SEQ ID NO: 3207358 - RNA, 15 nt, Mycobacterium bovis subsp bovis AF2122/97
cugggcuggccagca

SEQ ID NO: 3207359 - RNA, 18 nt, Mycobacterium bovis subsp bovis AF2122/97
cugggcuucaucggcgau

SEQ ID NO: 3207360 - RNA, 15 nt, Mycobacterium bovis subsp bovis AF2122/97
cugggcuugugggcc

SEQ ID NO: 3207361 - RNA, 18 nt, Mycobacterium bovis subsp bovis AF2122/97
cugggcuuucugcacccg

SEQ ID NO: 3207362 - RNA, 21 nt, Mycobacterium bovis subsp bovis AF2122/97
cugggcuuucugcacccgcca

SEQ ID NO: 3207363 - RNA, 22 nt, Mycobacterium bovis subsp bovis AF2122/97
cuggggauaaacugccgcggca

SEQ ID NO: 3207364 - RNA, 21 nt, Mycobacterium bovis subsp bovis AF2122/97
cuggggaugcgauggcccggg

SEQ ID NO: 3207365 - RNA, 16 nt, Mycobacterium bovis subsp bovis AF2122/97
cuggggcaccacgcug

SEQ ID NO: 3207366 - RNA, 12 nt, Mycobacterium bovis subsp bovis AF2122/97
cuggggccacca

SEQ ID NO: 3207367 - RNA, 21 nt, Mycobacterium bovis subsp bovis AF2122/97
cuggggccccgcgccggccgc

SEQ ID NO: 3207368 - RNA, 22 nt, Mycobacterium bovis subsp bovis AF2122/97
cuggggccccgcgccggccgca

SEQ ID NO: 3207369 - RNA, 20 nt, Mycobacterium bovis subsp bovis AF2122/97
cuggggccguccggcuuggc

SEQ ID NO: 3207370 - RNA, 16 nt, Mycobacterium bovis subsp bovis AF2122/97
cuggggcgccaccacc

SEQ ID NO: 3207371 - RNA, 22 nt, Mycobacterium bovis subsp bovis AF2122/97
cuggggcgccaccacccggcgc

SEQ ID NO: 3207372 - RNA, 13 nt, Mycobacterium bovis subsp bovis AF2122/97
cugggggccggca

SEQ ID NO: 3207373 - RNA, 16 nt, Mycobacterium bovis subsp bovis AF2122/97
cuggggguaccucccg

SEQ ID NO: 3207374 - RNA, 18 nt, Mycobacterium bovis subsp bovis AF2122/97
cuggggguagccgccggc

SEQ ID NO: 3207375 - RNA, 13 nt, Mycobacterium bovis subsp bovis AF2122/97
cugggguagccau

SEQ ID NO: 3207376 - RNA, 21 nt, Mycobacterium bovis subsp bovis AF2122/97
cugggguagccaucggcuagg

SEQ ID NO: 3207377 - RNA, 21 nt, Mycobacterium bovis subsp bovis AF2122/97
cugggguccgcgucggcggcg

SEQ ID NO: 3207378 - RNA, 17 nt, Mycobacterium bovis subsp bovis AF2122/97
cugggguccggugacga

SEQ ID NO: 3207379 - RNA, 19 nt, Mycobacterium bovis subsp bovis AF2122/97
cuggggugcugcgcgcggc

SEQ ID NO: 3207380 - RNA, 20 nt, Mycobacterium bovis subsp bovis AF2122/97
cuggggugcugcgcgcggcg

SEQ ID NO: 3207381 - RNA, 23 nt, Mycobacterium bovis subsp bovis AF2122/97
cuggggugcugcgcgcggcggcc

SEQ ID NO: 3207382 - RNA, 16 nt, Mycobacterium bovis subsp bovis AF2122/97
cuggguaguucaccgc

SEQ ID NO: 3207383 - RNA, 18 nt, Mycobacterium bovis subsp bovis AF2122/97
cuggguaguucaccgcgu

SEQ ID NO: 3207384 - RNA, 14 nt, Mycobacterium bovis subsp bovis AF2122/97
cuggguauccaccg

SEQ ID NO: 3207385 - RNA, 17 nt, Mycobacterium bovis subsp bovis AF2122/97
cuggguauccaccgcga

SEQ ID NO: 3207386 - RNA, 17 nt, Mycobacterium bovis subsp bovis AF2122/97
cuggguccacgcgcucg

SEQ ID NO: 3207387 - RNA, 21 nt, Mycobacterium bovis subsp bovis AF2122/97
cugggucggaccuuccgggug

SEQ ID NO: 3207388 - RNA, 22 nt, Mycobacterium bovis subsp bovis AF2122/97
cugggucuuggauccggccgcc

SEQ ID NO: 3207389 - RNA, 18 nt, Mycobacterium bovis subsp bovis AF2122/97
cugggugauggccgcgcc

SEQ ID NO: 3207390 - RNA, 19 nt, Mycobacterium bovis subsp bovis AF2122/97
cugggugauggccgcgccc

SEQ ID NO: 3207391 - RNA, 16 nt, Mycobacterium bovis subsp bovis AF2122/97
cugggugccggcagcg

SEQ ID NO: 3207392 - RNA, 18 nt, Mycobacterium bovis subsp bovis AF2122/97
cugggugccggcagcggc

SEQ ID NO: 3207393 - RNA, 15 nt, Mycobacterium bovis subsp bovis AF2122/97
cugggugcgcgaagg

SEQ ID NO: 3207394 - RNA, 13 nt, Mycobacterium bovis subsp bovis AF2122/97
cuggguggcgucg

SEQ ID NO: 3207395 - RNA, 14 nt, Mycobacterium bovis subsp bovis AF2122/97
cuggguggcgucgc

SEQ ID NO: 3207396 - RNA, 23 nt, Mycobacterium bovis subsp bovis AF2122/97
cuggguggguuuacgcugccgca

SEQ ID NO: 3207397 - RNA, 22 nt, Mycobacterium bovis subsp bovis AF2122/97
cuggguucccgaugugaacgca

SEQ ID NO: 3207398 - RNA, 22 nt, Mycobacterium bovis subsp bovis AF2122/97
cuggguuggugauugcggccgc

SEQ ID NO: 3207399 - RNA, 23 nt, Mycobacterium bovis subsp bovis AF2122/97
cuggguuggugauugcggccgcc

SEQ ID NO: 3207400 - RNA, 21 nt, Mycobacterium bovis subsp bovis AF2122/97
cuggguuucaaagcgacagcg

SEQ ID NO: 3207401 - RNA, 20 nt, Mycobacterium bovis subsp bovis AF2122/97
cuggguuugcacggcgcgcc

SEQ ID NO: 3207402 - RNA, 21 nt, Mycobacterium bovis subsp bovis AF2122/97
cuggguuugcacggcgcgcca

SEQ ID NO: 3207403 - RNA, 21 nt, Mycobacterium bovis subsp bovis AF2122/97
cugguaaacggguggauugac

SEQ ID NO: 3207404 - RNA, 20 nt, Mycobacterium bovis subsp bovis AF2122/97
cugguaccccagcacaaggc

SEQ ID NO: 3207405 - RNA, 18 nt, Mycobacterium bovis subsp bovis AF2122/97
cugguaccgcgguguucg

SEQ ID NO: 3207406 - RNA, 13 nt, Mycobacterium bovis subsp bovis AF2122/97
cugguagcaccca

SEQ ID NO: 3207407 - RNA, 16 nt, Mycobacterium bovis subsp bovis AF2122/97
cugguagcgcaccaca

SEQ ID NO: 3207408 - RNA, 22 nt, Mycobacterium bovis subsp bovis AF2122/97
cugguaggagaucaccucggug

SEQ ID NO: 3207409 - RNA, 15 nt, Mycobacterium bovis subsp bovis AF2122/97
cugguaggcggccau

SEQ ID NO: 3207410 - RNA, 14 nt, Mycobacterium bovis subsp bovis AF2122/97
cugguaggucaccg

SEQ ID NO: 3207411 - RNA, 20 nt, Mycobacterium bovis subsp bovis AF2122/97
cugguauucaugcccguccu

SEQ ID NO: 3207412 - RNA, 16 nt, Mycobacterium bovis subsp bovis AF2122/97
cugguauuuguccggc

SEQ ID NO: 3207413 - RNA, 16 nt, Mycobacterium bovis subsp bovis AF2122/97
cuggucaacacgacug

SEQ ID NO: 3207414 - RNA, 21 nt, Mycobacterium bovis subsp bovis AF2122/97
cuggucaacuccacgcggacc

SEQ ID NO: 3207415 - RNA, 21 nt, Mycobacterium bovis subsp bovis AF2122/97
cuggucaccaucaccggugcg

SEQ ID NO: 3207416 - RNA, 18 nt, Mycobacterium bovis subsp bovis AF2122/97
cuggucacccguaucggg

SEQ ID NO: 3207417 - RNA, 21 nt, Mycobacterium bovis subsp bovis AF2122/97
cuggucagccgcggcggcagc

SEQ ID NO: 3207418 - RNA, 22 nt, Mycobacterium bovis subsp bovis AF2122/97
cuggucagccgcggcggcagca

SEQ ID NO: 3207419 - RNA, 13 nt, Mycobacterium bovis subsp bovis AF2122/97
cuggucagcggcg

SEQ ID NO: 3207420 - RNA, 16 nt, Mycobacterium bovis subsp bovis AF2122/97
cuggucagcggcgcga

SEQ ID NO: 3207421 - RNA, 21 nt, Mycobacterium bovis subsp bovis AF2122/97
cuggucauggccgaacauucc

SEQ ID NO: 3207422 - RNA, 13 nt, Mycobacterium bovis subsp bovis AF2122/97
cugguccagcacc

SEQ ID NO: 3207423 - RNA, 17 nt, Mycobacterium bovis subsp bovis AF2122/97
cugguccagccggugac

SEQ ID NO: 3207424 - RNA, 18 nt, Mycobacterium bovis subsp bovis AF2122/97
cuggucccacaccuccuc

SEQ ID NO: 3207425 - RNA, 14 nt, Mycobacterium bovis subsp bovis AF2122/97
cuggucccaccgca

SEQ ID NO: 3207426 - RNA, 14 nt, Mycobacterium bovis subsp bovis AF2122/97
cugguccgcacggu

SEQ ID NO: 3207427 - RNA, 20 nt, Mycobacterium bovis subsp bovis AF2122/97
cugguccucacgggucagca

SEQ ID NO: 3207428 - RNA, 18 nt, Mycobacterium bovis subsp bovis AF2122/97
cugguccuccuucggugg

SEQ ID NO: 3207429 - RNA, 16 nt, Mycobacterium bovis subsp bovis AF2122/97
cuggucgaccaucggu

SEQ ID NO: 3207430 - RNA, 17 nt, Mycobacterium bovis subsp bovis AF2122/97
cuggucgaccggcguug

SEQ ID NO: 3207431 - RNA, 13 nt, Mycobacterium bovis subsp bovis AF2122/97
cuggucgagcacg

SEQ ID NO: 3207432 - RNA, 19 nt, Mycobacterium bovis subsp bovis AF2122/97
cuggucgagcacgcugcug

SEQ ID NO: 3207433 - RNA, 22 nt, Mycobacterium bovis subsp bovis AF2122/97
cuggucgagcacgcugcugcgg

SEQ ID NO: 3207434 - RNA, 17 nt, Mycobacterium bovis subsp bovis AF2122/97
cuggucgccaacgccag

SEQ ID NO: 3207435 - RNA, 19 nt, Mycobacterium bovis subsp bovis AF2122/97
cuggucgccaacgccagca

SEQ ID NO: 3207436 - RNA, 16 nt, Mycobacterium bovis subsp bovis AF2122/97
cuggucgccgcggcag

SEQ ID NO: 3207437 - RNA, 21 nt, Mycobacterium bovis subsp bovis AF2122/97
cuggucgccugccaucacgcg

SEQ ID NO: 3207438 - RNA, 16 nt, Mycobacterium bovis subsp bovis AF2122/97
cuggucgcgcagcucc

SEQ ID NO: 3207439 - RNA, 19 nt, Mycobacterium bovis subsp bovis AF2122/97
cuggucgcgguggcggcgg

SEQ ID NO: 3207440 - RNA, 22 nt, Mycobacterium bovis subsp bovis AF2122/97
cuggucgcguaccaacaggaug

SEQ ID NO: 3207441 - RNA, 18 nt, Mycobacterium bovis subsp bovis AF2122/97
cuggucgcguccacccac

SEQ ID NO: 3207442 - RNA, 14 nt, Mycobacterium bovis subsp bovis AF2122/97
cuggucggccgcaa

SEQ ID NO: 3207443 - RNA, 18 nt, Mycobacterium bovis subsp bovis AF2122/97
cuggucggcuaccgccga

SEQ ID NO: 3207444 - RNA, 20 nt, Mycobacterium bovis subsp bovis AF2122/97
cuggucggcuaccgccgacc

SEQ ID NO: 3207445 - RNA, 21 nt, Mycobacterium bovis subsp bovis AF2122/97
cuggucggcuaccgccgaccg

SEQ ID NO: 3207446 - RNA, 16 nt, Mycobacterium bovis subsp bovis AF2122/97
cuggucggcuucgggg

SEQ ID NO: 3207447 - RNA, 23 nt, Mycobacterium bovis subsp bovis AF2122/97
cuggucggugggcuugccgcgca

SEQ ID NO: 3207448 - RNA, 16 nt, Mycobacterium bovis subsp bovis AF2122/97
cuggucgucgaacggc

SEQ ID NO: 3207449 - RNA, 19 nt, Mycobacterium bovis subsp bovis AF2122/97
cuggucgucgaacggcagc

SEQ ID NO: 3207450 - RNA, 21 nt, Mycobacterium bovis subsp bovis AF2122/97
cuggucgucgaacggcagccc

SEQ ID NO: 3207451 - RNA, 20 nt, Mycobacterium bovis subsp bovis AF2122/97
cuggucgugggccaccaccu

SEQ ID NO: 3207452 - RNA, 22 nt, Mycobacterium bovis subsp bovis AF2122/97
cuggucucccagaggucgagcg

SEQ ID NO: 3207453 - RNA, 22 nt, Mycobacterium bovis subsp bovis AF2122/97
cuggugacgaaagcgcccagga

SEQ ID NO: 3207454 - RNA, 16 nt, Mycobacterium bovis subsp bovis AF2122/97
cuggugacggugaagc

SEQ ID NO: 3207455 - RNA, 18 nt, Mycobacterium bovis subsp bovis AF2122/97
cuggugaucugguccggc

SEQ ID NO: 3207456 - RNA, 20 nt, Mycobacterium bovis subsp bovis AF2122/97
cuggugaucugguccggcaa

SEQ ID NO: 3207457 - RNA, 17 nt, Mycobacterium bovis subsp bovis AF2122/97
cuggugcaaccgugccg

SEQ ID NO: 3207458 - RNA, 20 nt, Mycobacterium bovis subsp bovis AF2122/97
cuggugcagaauucggcgcg

SEQ ID NO: 3207459 - RNA, 13 nt, Mycobacterium bovis subsp bovis AF2122/97
cuggugcagcgcc

SEQ ID NO: 3207460 - RNA, 14 nt, Mycobacterium bovis subsp bovis AF2122/97
cuggugcagcgccg

SEQ ID NO: 3207461 - RNA, 15 nt, Mycobacterium bovis subsp bovis AF2122/97
cuggugcagcgccga

SEQ ID NO: 3207462 - RNA, 17 nt, Mycobacterium bovis subsp bovis AF2122/97
cuggugcagcgccgaca

SEQ ID NO: 3207463 - RNA, 18 nt, Mycobacterium bovis subsp bovis AF2122/97
cuggugccaacugcgccg

SEQ ID NO: 3207464 - RNA, 22 nt, Mycobacterium bovis subsp bovis AF2122/97
cuggugccaacugcgccguucg

SEQ ID NO: 3207465 - RNA, 19 nt, Mycobacterium bovis subsp bovis AF2122/97
cuggugcccgacccgccga

SEQ ID NO: 3207466 - RNA, 23 nt, Mycobacterium bovis subsp bovis AF2122/97
cuggugcccgacccgccgaugau

SEQ ID NO: 3207467 - RNA, 22 nt, Mycobacterium bovis subsp bovis AF2122/97
cuggugcgccacgccaccgcgg

SEQ ID NO: 3207468 - RNA, 18 nt, Mycobacterium bovis subsp bovis AF2122/97
cuggugcgcggagagcgc

SEQ ID NO: 3207469 - RNA, 16 nt, Mycobacterium bovis subsp bovis AF2122/97
cuggugcguagcccac

SEQ ID NO: 3207470 - RNA, 21 nt, Mycobacterium bovis subsp bovis AF2122/97
cuggugcuacuggugugacga

SEQ ID NO: 3207471 - RNA, 17 nt, Mycobacterium bovis subsp bovis AF2122/97
cugguggcagaaaccgg

SEQ ID NO: 3207472 - RNA, 14 nt, Mycobacterium bovis subsp bovis AF2122/97
cugguggcagcgca

SEQ ID NO: 3207473 - RNA, 16 nt, Mycobacterium bovis subsp bovis AF2122/97
cugguggcagcgcacc

SEQ ID NO: 3207474 - RNA, 13 nt, Mycobacterium bovis subsp bovis AF2122/97
cugguggcgaucc

SEQ ID NO: 3207475 - RNA, 23 nt, Mycobacterium bovis subsp bovis AF2122/97
cugguggcgcugaagccgacgau

SEQ ID NO: 3207476 - RNA, 21 nt, Mycobacterium bovis subsp bovis AF2122/97
cugguggcggcacuggccccg

SEQ ID NO: 3207477 - RNA, 16 nt, Mycobacterium bovis subsp bovis AF2122/97
cuggugggagaccugu

SEQ ID NO: 3207478 - RNA, 20 nt, Mycobacterium bovis subsp bovis AF2122/97
cuggugggagaccugucggu

SEQ ID NO: 3207479 - RNA, 14 nt, Mycobacterium bovis subsp bovis AF2122/97
cuggugggccaucg

SEQ ID NO: 3207480 - RNA, 19 nt, Mycobacterium bovis subsp bovis AF2122/97
cuggugggggagcggccgc

SEQ ID NO: 3207481 - RNA, 15 nt, Mycobacterium bovis subsp bovis AF2122/97
cugguggucagcacc

SEQ ID NO: 3207482 - RNA, 16 nt, Mycobacterium bovis subsp bovis AF2122/97
cugguggucagucacc

SEQ ID NO: 3207483 - RNA, 14 nt, Mycobacterium bovis subsp bovis AF2122/97
cugguggucggcga

SEQ ID NO: 3207484 - RNA, 18 nt, Mycobacterium bovis subsp bovis AF2122/97
cugguguccagccaggcg

SEQ ID NO: 3207485 - RNA, 13 nt, Mycobacterium bovis subsp bovis AF2122/97
cuggugucgaucg

SEQ ID NO: 3207486 - RNA, 22 nt, Mycobacterium bovis subsp bovis AF2122/97
cuggugucggcucgagucgcag

SEQ ID NO: 3207487 - RNA, 16 nt, Mycobacterium bovis subsp bovis AF2122/97
cuggugucgggcguca

SEQ ID NO: 3207488 - RNA, 13 nt, Mycobacterium bovis subsp bovis AF2122/97
cuggugucgucgg

SEQ ID NO: 3207489 - RNA, 20 nt, Mycobacterium bovis subsp bovis AF2122/97
cuggugugccgcguugccgg

SEQ ID NO: 3207490 - RNA, 15 nt, Mycobacterium bovis subsp bovis AF2122/97
cugguucaacaccgg

SEQ ID NO: 3207491 - RNA, 16 nt, Mycobacterium bovis subsp bovis AF2122/97
cugguucaacaccggu

SEQ ID NO: 3207492 - RNA, 16 nt, Mycobacterium bovis subsp bovis AF2122/97
cugguucagccauucu

SEQ ID NO: 3207493 - RNA, 22 nt, Mycobacterium bovis subsp bovis AF2122/97
cugguucguuaggucacuccau

SEQ ID NO: 3207494 - RNA, 22 nt, Mycobacterium bovis subsp bovis AF2122/97
cugguugaacauguccagugcc

SEQ ID NO: 3207495 - RNA, 19 nt, Mycobacterium bovis subsp bovis AF2122/97
cugguugccuuugcggcgg

SEQ ID NO: 3207496 - RNA, 19 nt, Mycobacterium bovis subsp bovis AF2122/97
cugguuggcacgcaacacc

SEQ ID NO: 3207497 - RNA, 18 nt, Mycobacterium bovis subsp bovis AF2122/97
cugguugggagcuacggu

SEQ ID NO: 3207498 - RNA, 22 nt, Mycobacterium bovis subsp bovis AF2122/97
cugguugggcgagaccgcgagc

SEQ ID NO: 3207499 - RNA, 12 nt, Mycobacterium bovis subsp bovis AF2122/97
cugguuggugac

SEQ ID NO: 3207500 - RNA, 14 nt, Mycobacterium bovis subsp bovis AF2122/97
cugguuggugacgu

SEQ ID NO: 3207501 - RNA, 20 nt, Mycobacterium bovis subsp bovis AF2122/97
cugguugucgaucucggcca

SEQ ID NO: 3207502 - RNA, 15 nt, Mycobacterium bovis subsp bovis AF2122/97
cugguuucggccgca

SEQ ID NO: 3207503 - RNA, 12 nt, Mycobacterium bovis subsp bovis AF2122/97
cugguuucgggg

SEQ ID NO: 3207504 - RNA, 21 nt, Mycobacterium bovis subsp bovis AF2122/97
cuguaaaaaugcuucgccaac

SEQ ID NO: 3207505 - RNA, 13 nt, Mycobacterium bovis subsp bovis AF2122/97
cuguaacacccgg

SEQ ID NO: 3207506 - RNA, 15 nt, Mycobacterium bovis subsp bovis AF2122/97
cuguaacacccggcc

SEQ ID NO: 3207507 - RNA, 17 nt, Mycobacterium bovis subsp bovis AF2122/97
cuguaacugcuccuggu

SEQ ID NO: 3207508 - RNA, 21 nt, Mycobacterium bovis subsp bovis AF2122/97
cuguaagacagcuaucccagg

SEQ ID NO: 3207509 - RNA, 22 nt, Mycobacterium bovis subsp bovis AF2122/97
cuguacggaucaggcccgggcg

SEQ ID NO: 3207510 - RNA, 13 nt, Mycobacterium bovis subsp bovis AF2122/97
cuguacggcggcu

SEQ ID NO: 3207511 - RNA, 17 nt, Mycobacterium bovis subsp bovis AF2122/97
cuguacggcggcuaggc

SEQ ID NO: 3207512 - RNA, 17 nt, Mycobacterium bovis subsp bovis AF2122/97
cuguacucgcggcgcgg

SEQ ID NO: 3207513 - RNA, 22 nt, Mycobacterium bovis subsp bovis AF2122/97
cuguagcgaaugaucuugccac

SEQ ID NO: 3207514 - RNA, 15 nt, Mycobacterium bovis subsp bovis AF2122/97
cuguagcgucgcacc

SEQ ID NO: 3207515 - RNA, 15 nt, Mycobacterium bovis subsp bovis AF2122/97
cuguaggcgaccaga

SEQ ID NO: 3207516 - RNA, 12 nt, Mycobacterium bovis subsp bovis AF2122/97
cuguaggcgaua

SEQ ID NO: 3207517 - RNA, 13 nt, Mycobacterium bovis subsp bovis AF2122/97
cuguaggcgauca

SEQ ID NO: 3207518 - RNA, 19 nt, Mycobacterium bovis subsp bovis AF2122/97
cuguagucccucaucaccu

SEQ ID NO: 3207519 - RNA, 18 nt, Mycobacterium bovis subsp bovis AF2122/97
cugucaagcgggcuggcg

SEQ ID NO: 3207520 - RNA, 16 nt, Mycobacterium bovis subsp bovis AF2122/97
cugucaccccugggcg

SEQ ID NO: 3207521 - RNA, 14 nt, Mycobacterium bovis subsp bovis AF2122/97
cugucacgccugcc

SEQ ID NO: 3207522 - RNA, 16 nt, Mycobacterium bovis subsp bovis AF2122/97
cugucacgccugccac

SEQ ID NO: 3207523 - RNA, 20 nt, Mycobacterium bovis subsp bovis AF2122/97
cugucacgccugccaccggc

SEQ ID NO: 3207524 - RNA, 22 nt, Mycobacterium bovis subsp bovis AF2122/97
cugucagaaggaucagcgcacu

SEQ ID NO: 3207525 - RNA, 15 nt, Mycobacterium bovis subsp bovis AF2122/97
cugucagccgaccga

SEQ ID NO: 3207526 - RNA, 15 nt, Mycobacterium bovis subsp bovis AF2122/97
cugucagcgcggcgc

SEQ ID NO: 3207527 - RNA, 23 nt, Mycobacterium bovis subsp bovis AF2122/97
cugucauguccugggccgccgcc

SEQ ID NO: 3207528 - RNA, 21 nt, Mycobacterium bovis subsp bovis AF2122/97
cuguccaccgaugccacaucg

SEQ ID NO: 3207529 - RNA, 23 nt, Mycobacterium bovis subsp bovis AF2122/97
cuguccacgaugacgucgacaac

SEQ ID NO: 3207530 - RNA, 16 nt, Mycobacterium bovis subsp bovis AF2122/97
cuguccacguccagcc

SEQ ID NO: 3207531 - RNA, 18 nt, Mycobacterium bovis subsp bovis AF2122/97
cuguccacguccagcccg

SEQ ID NO: 3207532 - RNA, 22 nt, Mycobacterium bovis subsp bovis AF2122/97
cuguccacguccagcccgucca

SEQ ID NO: 3207533 - RNA, 15 nt, Mycobacterium bovis subsp bovis AF2122/97
cuguccaggucuggg

SEQ ID NO: 3207534 - RNA, 23 nt, Mycobacterium bovis subsp bovis AF2122/97
cuguccaggucugggcuuugcag

SEQ ID NO: 3207535 - RNA, 19 nt, Mycobacterium bovis subsp bovis AF2122/97
cuguccccgccgagggcuu

SEQ ID NO: 3207536 - RNA, 16 nt, Mycobacterium bovis subsp bovis AF2122/97
cugucccgccggcccc

SEQ ID NO: 3207537 - RNA, 17 nt, Mycobacterium bovis subsp bovis AF2122/97
cugucccgccggccccg

SEQ ID NO: 3207538 - RNA, 18 nt, Mycobacterium bovis subsp bovis AF2122/97
cugucccgccggccccgc

SEQ ID NO: 3207539 - RNA, 17 nt, Mycobacterium bovis subsp bovis AF2122/97
cugucccgcgcaaccag

SEQ ID NO: 3207540 - RNA, 15 nt, Mycobacterium bovis subsp bovis AF2122/97
cugucccgcgggcca

SEQ ID NO: 3207541 - RNA, 19 nt, Mycobacterium bovis subsp bovis AF2122/97
cugucccgcgggccagcac

SEQ ID NO: 3207542 - RNA, 16 nt, Mycobacterium bovis subsp bovis AF2122/97
cuguccgaccucgccg

SEQ ID NO: 3207543 - RNA, 18 nt, Mycobacterium bovis subsp bovis AF2122/97
cuguccgaccucgccgcg

SEQ ID NO: 3207544 - RNA, 19 nt, Mycobacterium bovis subsp bovis AF2122/97
cuguccgaccucgccgcgc

SEQ ID NO: 3207545 - RNA, 20 nt, Mycobacterium bovis subsp bovis AF2122/97
cuguccgaccucgccgcgcg

SEQ ID NO: 3207546 - RNA, 21 nt, Mycobacterium bovis subsp bovis AF2122/97
cuguccgaccucgccgcgcgu

SEQ ID NO: 3207547 - RNA, 18 nt, Mycobacterium bovis subsp bovis AF2122/97
cuguccgcgggccgcgcg

SEQ ID NO: 3207548 - RNA, 17 nt, Mycobacterium bovis subsp bovis AF2122/97
cuguccggguagcggcg

SEQ ID NO: 3207549 - RNA, 19 nt, Mycobacterium bovis subsp bovis AF2122/97
cuguccggguagcggcgcc

SEQ ID NO: 3207550 - RNA, 20 nt, Mycobacterium bovis subsp bovis AF2122/97
cuguccggguagcggcgccg

SEQ ID NO: 3207551 - RNA, 21 nt, Mycobacterium bovis subsp bovis AF2122/97
cuguccggguagcggcgccgc

SEQ ID NO: 3207552 - RNA, 13 nt, Mycobacterium bovis subsp bovis AF2122/97
cuguccgguggaa

SEQ ID NO: 3207553 - RNA, 15 nt, Mycobacterium bovis subsp bovis AF2122/97
cuguccucgcgggcu

SEQ ID NO: 3207554 - RNA, 14 nt, Mycobacterium bovis subsp bovis AF2122/97
cuguccugccagaa

SEQ ID NO: 3207555 - RNA, 15 nt, Mycobacterium bovis subsp bovis AF2122/97
cugucgaagauccag

SEQ ID NO: 3207556 - RNA, 21 nt, Mycobacterium bovis subsp bovis AF2122/97
cugucgaagauccagcgcacc

SEQ ID NO: 3207557 - RNA, 13 nt, Mycobacterium bovis subsp bovis AF2122/97
cugucgaccgcga

SEQ ID NO: 3207558 - RNA, 16 nt, Mycobacterium bovis subsp bovis AF2122/97
cugucgaucacggccg

SEQ ID NO: 3207559 - RNA, 17 nt, Mycobacterium bovis subsp bovis AF2122/97
cugucgaucagcgaccc

SEQ ID NO: 3207560 - RNA, 21 nt, Mycobacterium bovis subsp bovis AF2122/97
cugucgauggacaaggugugg

SEQ ID NO: 3207561 - RNA, 13 nt, Mycobacterium bovis subsp bovis AF2122/97
cugucgcaccaga

SEQ ID NO: 3207562 - RNA, 22 nt, Mycobacterium bovis subsp bovis AF2122/97
cugucgcgccgguggucagguu

SEQ ID NO: 3207563 - RNA, 20 nt, Mycobacterium bovis subsp bovis AF2122/97
cugucggauagccucggcgg

SEQ ID NO: 3207564 - RNA, 14 nt, Mycobacterium bovis subsp bovis AF2122/97
cugucggccggguc

SEQ ID NO: 3207565 - RNA, 18 nt, Mycobacterium bovis subsp bovis AF2122/97
cugucggcuuccuccucg

SEQ ID NO: 3207566 - RNA, 19 nt, Mycobacterium bovis subsp bovis AF2122/97
cugucggcuuccuccucgg

SEQ ID NO: 3207567 - RNA, 16 nt, Mycobacterium bovis subsp bovis AF2122/97
cugucggugccgucga

SEQ ID NO: 3207568 - RNA, 14 nt, Mycobacterium bovis subsp bovis AF2122/97
cugucguaccgcuc

SEQ ID NO: 3207569 - RNA, 19 nt, Mycobacterium bovis subsp bovis AF2122/97
cugucguaccgcucggcgg

SEQ ID NO: 3207570 - RNA, 16 nt, Mycobacterium bovis subsp bovis AF2122/97
cugucgucuuggcgau

SEQ ID NO: 3207571 - RNA, 23 nt, Mycobacterium bovis subsp bovis AF2122/97
cugucgugauacagcucggugca

SEQ ID NO: 3207572 - RNA, 21 nt, Mycobacterium bovis subsp bovis AF2122/97
cugucgugccucucgggggcc

SEQ ID NO: 3207573 - RNA, 20 nt, Mycobacterium bovis subsp bovis AF2122/97
cugucgugguggcauaaccg

SEQ ID NO: 3207574 - RNA, 12 nt, Mycobacterium bovis subsp bovis AF2122/97
cugucucggugc

SEQ ID NO: 3207575 - RNA, 15 nt, Mycobacterium bovis subsp bovis AF2122/97
cugugaacagcgcgu

SEQ ID NO: 3207576 - RNA, 17 nt, Mycobacterium bovis subsp bovis AF2122/97
cugugaacagcgcgucg

SEQ ID NO: 3207577 - RNA, 18 nt, Mycobacterium bovis subsp bovis AF2122/97
cugugaaucugacgacgc

SEQ ID NO: 3207578 - RNA, 19 nt, Mycobacterium bovis subsp bovis AF2122/97
cugugacacccgagggccu

SEQ ID NO: 3207579 - RNA, 11 nt, Mycobacterium bovis subsp bovis AF2122/97
cugugagguca

SEQ ID NO: 3207580 - RNA, 14 nt, Mycobacterium bovis subsp bovis AF2122/97
cugugaggucauug

SEQ ID NO: 3207581 - RNA, 16 nt, Mycobacterium bovis subsp bovis AF2122/97
cugugauccgacagug

SEQ ID NO: 3207582 - RNA, 20 nt, Mycobacterium bovis subsp bovis AF2122/97
cugugccagcagcagcgccg

SEQ ID NO: 3207583 - RNA, 14 nt, Mycobacterium bovis subsp bovis AF2122/97
cugugcccggcgcc

SEQ ID NO: 3207584 - RNA, 22 nt, Mycobacterium bovis subsp bovis AF2122/97
cugugcccggcuccuccccggc

SEQ ID NO: 3207585 - RNA, 21 nt, Mycobacterium bovis subsp bovis AF2122/97
cugugccgagaugccggcgag

SEQ ID NO: 3207586 - RNA, 22 nt, Mycobacterium bovis subsp bovis AF2122/97
cugugccgagaugccggcgagc

SEQ ID NO: 3207587 - RNA, 15 nt, Mycobacterium bovis subsp bovis AF2122/97
cugugccgcccccgg

SEQ ID NO: 3207588 - RNA, 16 nt, Mycobacterium bovis subsp bovis AF2122/97
cugugccgcccccggc

SEQ ID NO: 3207589 - RNA, 14 nt, Mycobacterium bovis subsp bovis AF2122/97
cugugccgccggcg

SEQ ID NO: 3207590 - RNA, 12 nt, Mycobacterium bovis subsp bovis AF2122/97
cugugcgccgca

SEQ ID NO: 3207591 - RNA, 13 nt, Mycobacterium bovis subsp bovis AF2122/97
cugugcgccgcag

SEQ ID NO: 3207592 - RNA, 21 nt, Mycobacterium bovis subsp bovis AF2122/97
cugugcgccgcagccugcaac

SEQ ID NO: 3207593 - RNA, 15 nt, Mycobacterium bovis subsp bovis AF2122/97
cugugcgcggacacc

SEQ ID NO: 3207594 - RNA, 18 nt, Mycobacterium bovis subsp bovis AF2122/97
cugugcgcggacaccuuu

SEQ ID NO: 3207595 - RNA, 14 nt, Mycobacterium bovis subsp bovis AF2122/97
cugugcggagccgc

SEQ ID NO: 3207596 - RNA, 23 nt, Mycobacterium bovis subsp bovis AF2122/97
cugugcggagccgccauugacga

SEQ ID NO: 3207597 - RNA, 17 nt, Mycobacterium bovis subsp bovis AF2122/97
cugugcguuccugaucg

SEQ ID NO: 3207598 - RNA, 13 nt, Mycobacterium bovis subsp bovis AF2122/97
cugugcucacggc

SEQ ID NO: 3207599 - RNA, 18 nt, Mycobacterium bovis subsp bovis AF2122/97
cugugcucacggcggcga

SEQ ID NO: 3207600 - RNA, 22 nt, Mycobacterium bovis subsp bovis AF2122/97
cugugcucgccggaucuugccg

SEQ ID NO: 3207601 - RNA, 19 nt, Mycobacterium bovis subsp bovis AF2122/97
cuguggaagcccgucgcgg

SEQ ID NO: 3207602 - RNA, 21 nt, Mycobacterium bovis subsp bovis AF2122/97
cuguggaagcccgucgcggcc

SEQ ID NO: 3207603 - RNA, 22 nt, Mycobacterium bovis subsp bovis AF2122/97
cuguggaagcccgucgcggccg

SEQ ID NO: 3207604 - RNA, 23 nt, Mycobacterium bovis subsp bovis AF2122/97
cuguggacacggcgcugcccacg

SEQ ID NO: 3207605 - RNA, 15 nt, Mycobacterium bovis subsp bovis AF2122/97
cuguggccgcgucgc

SEQ ID NO: 3207606 - RNA, 13 nt, Mycobacterium bovis subsp bovis AF2122/97
cuguggcgccgcc

SEQ ID NO: 3207607 - RNA, 14 nt, Mycobacterium bovis subsp bovis AF2122/97
cuguggcgccgccg

SEQ ID NO: 3207608 - RNA, 19 nt, Mycobacterium bovis subsp bovis AF2122/97
cuguggcugaacaccgcgg

SEQ ID NO: 3207609 - RNA, 20 nt, Mycobacterium bovis subsp bovis AF2122/97
cugugggcgagucgggggcc

SEQ ID NO: 3207610 - RNA, 16 nt, Mycobacterium bovis subsp bovis AF2122/97
cugugggucgauccgg

SEQ ID NO: 3207611 - RNA, 19 nt, Mycobacterium bovis subsp bovis AF2122/97
cugugguaggccggugcgu

SEQ ID NO: 3207612 - RNA, 17 nt, Mycobacterium bovis subsp bovis AF2122/97
cuguggucgcugcugcc

SEQ ID NO: 3207613 - RNA, 20 nt, Mycobacterium bovis subsp bovis AF2122/97
cuguggucgcugcugccgca

SEQ ID NO: 3207614 - RNA, 22 nt, Mycobacterium bovis subsp bovis AF2122/97
cuguggucgcugcugccgcacc

SEQ ID NO: 3207615 - RNA, 15 nt, Mycobacterium bovis subsp bovis AF2122/97
cuguggucggugcca

SEQ ID NO: 3207616 - RNA, 22 nt, Mycobacterium bovis subsp bovis AF2122/97
cuguggugacagauccgccccg

SEQ ID NO: 3207617 - RNA, 18 nt, Mycobacterium bovis subsp bovis AF2122/97
cugugucguacccggcaa

SEQ ID NO: 3207618 - RNA, 15 nt, Mycobacterium bovis subsp bovis AF2122/97
cugugucguggucga

SEQ ID NO: 3207619 - RNA, 18 nt, Mycobacterium bovis subsp bovis AF2122/97
cugugucugcucgcgccg

SEQ ID NO: 3207620 - RNA, 19 nt, Mycobacterium bovis subsp bovis AF2122/97
cugugucugcucgcgccgc

SEQ ID NO: 3207621 - RNA, 18 nt, Mycobacterium bovis subsp bovis AF2122/97
cuguguuugcggcuucgg

SEQ ID NO: 3207622 - RNA, 22 nt, Mycobacterium bovis subsp bovis AF2122/97
cuguguuugcggcuucggcaga

SEQ ID NO: 3207623 - RNA, 14 nt, Mycobacterium bovis subsp bovis AF2122/97
cuguuacuccgacg

SEQ ID NO: 3207624 - RNA, 19 nt, Mycobacterium bovis subsp bovis AF2122/97
cuguuacuccgacggcccg

SEQ ID NO: 3207625 - RNA, 20 nt, Mycobacterium bovis subsp bovis AF2122/97
cuguuacuccgacggcccgg

SEQ ID NO: 3207626 - RNA, 12 nt, Mycobacterium bovis subsp bovis AF2122/97
cuguucaacucc

SEQ ID NO: 3207627 - RNA, 16 nt, Mycobacterium bovis subsp bovis AF2122/97
cuguucaacuccggca

SEQ ID NO: 3207628 - RNA, 20 nt, Mycobacterium bovis subsp bovis AF2122/97
cuguuccagaaggccgcacc

SEQ ID NO: 3207629 - RNA, 19 nt, Mycobacterium bovis subsp bovis AF2122/97
cuguuccuugugaccccgg

SEQ ID NO: 3207630 - RNA, 13 nt, Mycobacterium bovis subsp bovis AF2122/97
cuguucgccgacg

SEQ ID NO: 3207631 - RNA, 13 nt, Mycobacterium bovis subsp bovis AF2122/97
cuguucgccgucg

SEQ ID NO: 3207632 - RNA, 16 nt, Mycobacterium bovis subsp bovis AF2122/97
cuguucggccauggcg

SEQ ID NO: 3207633 - RNA, 21 nt, Mycobacterium bovis subsp bovis AF2122/97
cuguucggcggcugccagcgc

SEQ ID NO: 3207634 - RNA, 16 nt, Mycobacterium bovis subsp bovis AF2122/97
cuguucuccgugaucg

SEQ ID NO: 3207635 - RNA, 15 nt, Mycobacterium bovis subsp bovis AF2122/97
cuguucucgccgaag

SEQ ID NO: 3207636 - RNA, 20 nt, Mycobacterium bovis subsp bovis AF2122/97
cuguucucgccgaagcccgg

SEQ ID NO: 3207637 - RNA, 15 nt, Mycobacterium bovis subsp bovis AF2122/97
cuguugaacggccgc

SEQ ID NO: 3207638 - RNA, 16 nt, Mycobacterium bovis subsp bovis AF2122/97
cuguugaagaagcccg

SEQ ID NO: 3207639 - RNA, 20 nt, Mycobacterium bovis subsp bovis AF2122/97
cuguugaagaagcccgaaga

SEQ ID NO: 3207640 - RNA, 18 nt, Mycobacterium bovis subsp bovis AF2122/97
cuguugaagaggcgcacc

SEQ ID NO: 3207641 - RNA, 23 nt, Mycobacterium bovis subsp bovis AF2122/97
cuguugaagaggcgcaccuccug

SEQ ID NO: 3207642 - RNA, 18 nt, Mycobacterium bovis subsp bovis AF2122/97
cuguugacgccacgacgc

SEQ ID NO: 3207643 - RNA, 16 nt, Mycobacterium bovis subsp bovis AF2122/97
cuguugcaucgccgcg

SEQ ID NO: 3207644 - RNA, 17 nt, Mycobacterium bovis subsp bovis AF2122/97
cuguugcaucgccgcga

SEQ ID NO: 3207645 - RNA, 18 nt, Mycobacterium bovis subsp bovis AF2122/97
cuguugcaucgccgcgau

SEQ ID NO: 3207646 - RNA, 13 nt, Mycobacterium bovis subsp bovis AF2122/97
cuguugccccucc

SEQ ID NO: 3207647 - RNA, 15 nt, Mycobacterium bovis subsp bovis AF2122/97
cuguugcccuuggga

SEQ ID NO: 3207648 - RNA, 16 nt, Mycobacterium bovis subsp bovis AF2122/97
cuguugcggcggcgcu

SEQ ID NO: 3207649 - RNA, 22 nt, Mycobacterium bovis subsp bovis AF2122/97
cuguuggcaugccgcccgcucc

SEQ ID NO: 3207650 - RNA, 18 nt, Mycobacterium bovis subsp bovis AF2122/97
cuguuggccagccgacaa

SEQ ID NO: 3207651 - RNA, 19 nt, Mycobacterium bovis subsp bovis AF2122/97
cuguuggcgaaggccgcaa

SEQ ID NO: 3207652 - RNA, 21 nt, Mycobacterium bovis subsp bovis AF2122/97
cuguuggugccgccaccaccg

SEQ ID NO: 3207653 - RNA, 15 nt, Mycobacterium bovis subsp bovis AF2122/97
cuguuguacggccca

SEQ ID NO: 3207654 - RNA, 12 nt, Mycobacterium bovis subsp bovis AF2122/97
cuguugucgcgg

SEQ ID NO: 3207655 - RNA, 19 nt, Mycobacterium bovis subsp bovis AF2122/97
cuguuguggaacaccgcgg

SEQ ID NO: 3207656 - RNA, 24 nt, Mycobacterium bovis subsp bovis AF2122/97
cuguuguugccccggucggcgacg

SEQ ID NO: 3207657 - RNA, 14 nt, Mycobacterium bovis subsp bovis AF2122/97
cuguuucugagcgc

SEQ ID NO: 3207658 - RNA, 22 nt, Mycobacterium bovis subsp bovis AF2122/97
cuuaaacgggcucuucgcagcg

SEQ ID NO: 3207659 - RNA, 16 nt, Mycobacterium bovis subsp bovis AF2122/97
cuuaacacaugcaagu

SEQ ID NO: 3207660 - RNA, 18 nt, Mycobacterium bovis subsp bovis AF2122/97
cuuaaccgagccgaccgg

SEQ ID NO: 3207661 - RNA, 19 nt, Mycobacterium bovis subsp bovis AF2122/97
cuuaaccgagccgaccggc

SEQ ID NO: 3207662 - RNA, 17 nt, Mycobacterium bovis subsp bovis AF2122/97
cuuaagccggcgcggcg

SEQ ID NO: 3207663 - RNA, 21 nt, Mycobacterium bovis subsp bovis AF2122/97
cuuaagcgaacccgagccgcc

SEQ ID NO: 3207664 - RNA, 15 nt, Mycobacterium bovis subsp bovis AF2122/97
cuuacacgccuggcu

SEQ ID NO: 3207665 - RNA, 16 nt, Mycobacterium bovis subsp bovis AF2122/97
cuuacuuccauccaca

SEQ ID NO: 3207666 - RNA, 16 nt, Mycobacterium bovis subsp bovis AF2122/97
cuuagaacgugcuggu

SEQ ID NO: 3207667 - RNA, 18 nt, Mycobacterium bovis subsp bovis AF2122/97
cuuagaacgugcuggugg

SEQ ID NO: 3207668 - RNA, 21 nt, Mycobacterium bovis subsp bovis AF2122/97
cuuagagcuauacagcggacc

SEQ ID NO: 3207669 - RNA, 20 nt, Mycobacterium bovis subsp bovis AF2122/97
cuuagccauuuccuuggcgc

SEQ ID NO: 3207670 - RNA, 15 nt, Mycobacterium bovis subsp bovis AF2122/97
cuuagcccgauggug

SEQ ID NO: 3207671 - RNA, 20 nt, Mycobacterium bovis subsp bovis AF2122/97
cuuagcgccguugccgccac

SEQ ID NO: 3207672 - RNA, 18 nt, Mycobacterium bovis subsp bovis AF2122/97
cuuagcgcgggccuggcc

SEQ ID NO: 3207673 - RNA, 19 nt, Mycobacterium bovis subsp bovis AF2122/97
cuuagcgcgggccuggccc

SEQ ID NO: 3207674 - RNA, 21 nt, Mycobacterium bovis subsp bovis AF2122/97
cuuagcgcgggccuggcccac

SEQ ID NO: 3207675 - RNA, 22 nt, Mycobacterium bovis subsp bovis AF2122/97
cuuagcgcuugacccgcggacc

SEQ ID NO: 3207676 - RNA, 14 nt, Mycobacterium bovis subsp bovis AF2122/97
cuuagcgcuugccg

SEQ ID NO: 3207677 - RNA, 14 nt, Mycobacterium bovis subsp bovis AF2122/97
cuuagcggcuuggc

SEQ ID NO: 3207678 - RNA, 18 nt, Mycobacterium bovis subsp bovis AF2122/97
cuuaggacccaauguggu

SEQ ID NO: 3207679 - RNA, 13 nt, Mycobacterium bovis subsp bovis AF2122/97
cuuagggucgccg

SEQ ID NO: 3207680 - RNA, 14 nt, Mycobacterium bovis subsp bovis AF2122/97
cuuauccggccagu

SEQ ID NO: 3207681 - RNA, 13 nt, Mycobacterium bovis subsp bovis AF2122/97
cuuaucggcgucg

SEQ ID NO: 3207682 - RNA, 17 nt, Mycobacterium bovis subsp bovis AF2122/97
cuuaucgucgacgccga

SEQ ID NO: 3207683 - RNA, 12 nt, Mycobacterium bovis subsp bovis AF2122/97
cuuaugcgcggu

SEQ ID NO: 3207684 - RNA, 15 nt, Mycobacterium bovis subsp bovis AF2122/97
cuuauguguccgcuc

SEQ ID NO: 3207685 - RNA, 20 nt, Mycobacterium bovis subsp bovis AF2122/97
cuuauuggacugcagcgugu

SEQ ID NO: 3207686 - RNA, 15 nt, Mycobacterium bovis subsp bovis AF2122/97
cuucaaagaucgccu

SEQ ID NO: 3207687 - RNA, 21 nt, Mycobacterium bovis subsp bovis AF2122/97
cuucaacuuacgcgacgccgu

SEQ ID NO: 3207688 - RNA, 18 nt, Mycobacterium bovis subsp bovis AF2122/97
cuucaaggaagccgcggc

SEQ ID NO: 3207689 - RNA, 19 nt, Mycobacterium bovis subsp bovis AF2122/97
cuucaaggaagccgcggcc

SEQ ID NO: 3207690 - RNA, 11 nt, Mycobacterium bovis subsp bovis AF2122/97
cuucaaugucg

SEQ ID NO: 3207691 - RNA, 16 nt, Mycobacterium bovis subsp bovis AF2122/97
cuucacagccaccagc

SEQ ID NO: 3207692 - RNA, 13 nt, Mycobacterium bovis subsp bovis AF2122/97
cuucaccacccug

SEQ ID NO: 3207693 - RNA, 13 nt, Mycobacterium bovis subsp bovis AF2122/97
cuucaccacgccg

SEQ ID NO: 3207694 - RNA, 15 nt, Mycobacterium bovis subsp bovis AF2122/97
cuucaccacgccgua

SEQ ID NO: 3207695 - RNA, 19 nt, Mycobacterium bovis subsp bovis AF2122/97
cuucacccaaccccgccgg

SEQ ID NO: 3207696 - RNA, 21 nt, Mycobacterium bovis subsp bovis AF2122/97
cuucacccaaccccgccggcc

SEQ ID NO: 3207697 - RNA, 22 nt, Mycobacterium bovis subsp bovis AF2122/97
cuucacccaaccccgccggccg

SEQ ID NO: 3207698 - RNA, 15 nt, Mycobacterium bovis subsp bovis AF2122/97
cuucacccaacggug

SEQ ID NO: 3207699 - RNA, 14 nt, Mycobacterium bovis subsp bovis AF2122/97
cuucaccggccggu

SEQ ID NO: 3207700 - RNA, 16 nt, Mycobacterium bovis subsp bovis AF2122/97
cuucaccggccggugc

SEQ ID NO: 3207701 - RNA, 16 nt, Mycobacterium bovis subsp bovis AF2122/97
cuucaccggcucgucg

SEQ ID NO: 3207702 - RNA, 14 nt, Mycobacterium bovis subsp bovis AF2122/97
cuucaccucgucga

SEQ ID NO: 3207703 - RNA, 17 nt, Mycobacterium bovis subsp bovis AF2122/97
cuucaccucgucgacaa

SEQ ID NO: 3207704 - RNA, 13 nt, Mycobacterium bovis subsp bovis AF2122/97
cuucaccuggaag

SEQ ID NO: 3207705 - RNA, 13 nt, Mycobacterium bovis subsp bovis AF2122/97
cuucaccuggugu

SEQ ID NO: 3207706 - RNA, 20 nt, Mycobacterium bovis subsp bovis AF2122/97
cuucacgccgccccugcgcg

SEQ ID NO: 3207707 - RNA, 21 nt, Mycobacterium bovis subsp bovis AF2122/97
cuucacgccgccccugcgcgg

SEQ ID NO: 3207708 - RNA, 23 nt, Mycobacterium bovis subsp bovis AF2122/97
cuucacgccgccccugcgcggcc

SEQ ID NO: 3207709 - RNA, 20 nt, Mycobacterium bovis subsp bovis AF2122/97
cuucacgcuggccuccagcu

SEQ ID NO: 3207710 - RNA, 17 nt, Mycobacterium bovis subsp bovis AF2122/97
cuucacgggccguccag

SEQ ID NO: 3207711 - RNA, 19 nt, Mycobacterium bovis subsp bovis AF2122/97
cuucacgggccguccagga

SEQ ID NO: 3207712 - RNA, 17 nt, Mycobacterium bovis subsp bovis AF2122/97
cuucacggucgacgaug

SEQ ID NO: 3207713 - RNA, 13 nt, Mycobacterium bovis subsp bovis AF2122/97
cuucacugcgacc

SEQ ID NO: 3207714 - RNA, 15 nt, Mycobacterium bovis subsp bovis AF2122/97
cuucacugcgaccgu

SEQ ID NO: 3207715 - RNA, 20 nt, Mycobacterium bovis subsp bovis AF2122/97
cuucacugcgaccgucccgg

SEQ ID NO: 3207716 - RNA, 15 nt, Mycobacterium bovis subsp bovis AF2122/97
cuucagcaacggcau

SEQ ID NO: 3207717 - RNA, 21 nt, Mycobacterium bovis subsp bovis AF2122/97
cuucagcacgcgggagaucuc

SEQ ID NO: 3207718 - RNA, 13 nt, Mycobacterium bovis subsp bovis AF2122/97
cuucagcaggccc

SEQ ID NO: 3207719 - RNA, 18 nt, Mycobacterium bovis subsp bovis AF2122/97
cuucagcaugguggacga

SEQ ID NO: 3207720 - RNA, 14 nt, Mycobacterium bovis subsp bovis AF2122/97
cuucagccagucca

SEQ ID NO: 3207721 - RNA, 20 nt, Mycobacterium bovis subsp bovis AF2122/97
cuucagccaguccagcgcgc

SEQ ID NO: 3207722 - RNA, 19 nt, Mycobacterium bovis subsp bovis AF2122/97
cuucagcggccgguacacg

SEQ ID NO: 3207723 - RNA, 20 nt, Mycobacterium bovis subsp bovis AF2122/97
cuucagcuaccuccgccacc

SEQ ID NO: 3207724 - RNA, 22 nt, Mycobacterium bovis subsp bovis AF2122/97
cuucaggcaccggaugaugugg

SEQ ID NO: 3207725 - RNA, 14 nt, Mycobacterium bovis subsp bovis AF2122/97
cuucaggccgcgca

SEQ ID NO: 3207726 - RNA, 16 nt, Mycobacterium bovis subsp bovis AF2122/97
cuucaggcgccacugc

SEQ ID NO: 3207727 - RNA, 17 nt, Mycobacterium bovis subsp bovis AF2122/97
cuucaggcgccacugcu

SEQ ID NO: 3207728 - RNA, 14 nt, Mycobacterium bovis subsp bovis AF2122/97
cuucagguagcggc

SEQ ID NO: 3207729 - RNA, 16 nt, Mycobacterium bovis subsp bovis AF2122/97
cuucagguagcggccc

SEQ ID NO: 3207730 - RNA, 17 nt, Mycobacterium bovis subsp bovis AF2122/97
cuucaguccggcccccg

SEQ ID NO: 3207731 - RNA, 17 nt, Mycobacterium bovis subsp bovis AF2122/97
cuucaucaacgacacca

SEQ ID NO: 3207732 - RNA, 19 nt, Mycobacterium bovis subsp bovis AF2122/97
cuucaucaacgacaccaga

SEQ ID NO: 3207733 - RNA, 20 nt, Mycobacterium bovis subsp bovis AF2122/97
cuucaucgccucgaggacca

SEQ ID NO: 3207734 - RNA, 20 nt, Mycobacterium bovis subsp bovis AF2122/97
cuucaucuggcgccguuagc

SEQ ID NO: 3207735 - RNA, 19 nt, Mycobacterium bovis subsp bovis AF2122/97
cuucaugagccgcugcgcc

SEQ ID NO: 3207736 - RNA, 20 nt, Mycobacterium bovis subsp bovis AF2122/97
cuucauucgugggaaccacc

SEQ ID NO: 3207737 - RNA, 13 nt, Mycobacterium bovis subsp bovis AF2122/97
cuuccaaacccgg

SEQ ID NO: 3207738 - RNA, 15 nt, Mycobacterium bovis subsp bovis AF2122/97
cuuccaacaccaacg

SEQ ID NO: 3207739 - RNA, 20 nt, Mycobacterium bovis subsp bovis AF2122/97
cuuccaacucggcggccagc

SEQ ID NO: 3207740 - RNA, 21 nt, Mycobacterium bovis subsp bovis AF2122/97
cuuccaauugauaggccccga

SEQ ID NO: 3207741 - RNA, 16 nt, Mycobacterium bovis subsp bovis AF2122/97
cuuccacgccggacua

SEQ ID NO: 3207742 - RNA, 21 nt, Mycobacterium bovis subsp bovis AF2122/97
cuuccacugacgucucaucaa

SEQ ID NO: 3207743 - RNA, 22 nt, Mycobacterium bovis subsp bovis AF2122/97
cuuccagccacagcccggcggc

SEQ ID NO: 3207744 - RNA, 13 nt, Mycobacterium bovis subsp bovis AF2122/97
cuuccagcucguc

SEQ ID NO: 3207745 - RNA, 15 nt, Mycobacterium bovis subsp bovis AF2122/97
cuuccagcucgucgu

SEQ ID NO: 3207746 - RNA, 17 nt, Mycobacterium bovis subsp bovis AF2122/97
cuuccaggagcgccguc

SEQ ID NO: 3207747 - RNA, 20 nt, Mycobacterium bovis subsp bovis AF2122/97
cuuccaggcgggcggcaccg

SEQ ID NO: 3207748 - RNA, 16 nt, Mycobacterium bovis subsp bovis AF2122/97
cuucccaaccgcccgu

SEQ ID NO: 3207749 - RNA, 13 nt, Mycobacterium bovis subsp bovis AF2122/97
cuucccacccggc

SEQ ID NO: 3207750 - RNA, 23 nt, Mycobacterium bovis subsp bovis AF2122/97
cuucccagccgacgccuuccagc

SEQ ID NO: 3207751 - RNA, 24 nt, Mycobacterium bovis subsp bovis AF2122/97
cuucccaggauccggcugcggauc

SEQ ID NO: 3207752 - RNA, 19 nt, Mycobacterium bovis subsp bovis AF2122/97
cuucccaguaaguccucga

SEQ ID NO: 3207753 - RNA, 15 nt, Mycobacterium bovis subsp bovis AF2122/97
cuuccccgaucgugc

SEQ ID NO: 3207754 - RNA, 19 nt, Mycobacterium bovis subsp bovis AF2122/97
cuuccccgguagcguucgg

SEQ ID NO: 3207755 - RNA, 16 nt, Mycobacterium bovis subsp bovis AF2122/97
cuuccccucggccgcc

SEQ ID NO: 3207756 - RNA, 17 nt, Mycobacterium bovis subsp bovis AF2122/97
cuucccgcgcgagccgc

SEQ ID NO: 3207757 - RNA, 16 nt, Mycobacterium bovis subsp bovis AF2122/97
cuucccggaagcgccg

SEQ ID NO: 3207758 - RNA, 14 nt, Mycobacterium bovis subsp bovis AF2122/97
cuucccgucgacga

SEQ ID NO: 3207759 - RNA, 12 nt, Mycobacterium bovis subsp bovis AF2122/97
cuucccuccaga

SEQ ID NO: 3207760 - RNA, 21 nt, Mycobacterium bovis subsp bovis AF2122/97
cuucccuccagauaccaccgc

SEQ ID NO: 3207761 - RNA, 21 nt, Mycobacterium bovis subsp bovis AF2122/97
cuuccgacaugaaccggucga

SEQ ID NO: 3207762 - RNA, 16 nt, Mycobacterium bovis subsp bovis AF2122/97
cuuccgacccaacgac

SEQ ID NO: 3207763 - RNA, 21 nt, Mycobacterium bovis subsp bovis AF2122/97
cuuccgacccaacgaccacca

SEQ ID NO: 3207764 - RNA, 14 nt, Mycobacterium bovis subsp bovis AF2122/97
cuuccgcagcgcca

SEQ ID NO: 3207765 - RNA, 19 nt, Mycobacterium bovis subsp bovis AF2122/97
cuuccggaacaaaggcuug

SEQ ID NO: 3207766 - RNA, 16 nt, Mycobacterium bovis subsp bovis AF2122/97
cuuccggauucggacu

SEQ ID NO: 3207767 - RNA, 15 nt, Mycobacterium bovis subsp bovis AF2122/97
cuuccggcgcgaccg

SEQ ID NO: 3207768 - RNA, 22 nt, Mycobacterium bovis subsp bovis AF2122/97
cuuccggcguggccccaccgaa

SEQ ID NO: 3207769 - RNA, 13 nt, Mycobacterium bovis subsp bovis AF2122/97
cgcccgguccgcc

SEQ ID NO: 3207770 - RNA, 17 nt, Mycobacterium bovis subsp bovis AF2122/97
cgcccggucgagccagc

SEQ ID NO: 3207771 - RNA, 21 nt, Mycobacterium bovis subsp bovis AF2122/97
cgcccggucgagccagcggag

SEQ ID NO: 3207772 - RNA, 14 nt, Mycobacterium bovis subsp bovis AF2122/97
cgcccggucgggcg

SEQ ID NO: 3207773 - RNA, 16 nt, Mycobacterium bovis subsp bovis AF2122/97
cgcccggucgggcgcg

SEQ ID NO: 3207774 - RNA, 20 nt, Mycobacterium bovis subsp bovis AF2122/97
cgcccggucgggcgcggggc

SEQ ID NO: 3207775 - RNA, 16 nt, Mycobacterium bovis subsp bovis AF2122/97
cgcccggucucgacgg

SEQ ID NO: 3207776 - RNA, 19 nt, Mycobacterium bovis subsp bovis AF2122/97
cgcccggugcuaaccgacg

SEQ ID NO: 3207777 - RNA, 23 nt, Mycobacterium bovis subsp bovis AF2122/97
cgcccguauugaugcugcccgag

SEQ ID NO: 3207778 - RNA, 21 nt, Mycobacterium bovis subsp bovis AF2122/97
cgcccgucgcugggaggcgcg

SEQ ID NO: 3207779 - RNA, 20 nt, Mycobacterium bovis subsp bovis AF2122/97
cgcccgucguagguggccgg

SEQ ID NO: 3207780 - RNA, 15 nt, Mycobacterium bovis subsp bovis AF2122/97
cgcccgucuccagca

SEQ ID NO: 3207781 - RNA, 16 nt, Mycobacterium bovis subsp bovis AF2122/97
cgcccgucuccagcac

SEQ ID NO: 3207782 - RNA, 22 nt, Mycobacterium bovis subsp bovis AF2122/97
cgcccgucuuccagccaggccu

SEQ ID NO: 3207783 - RNA, 14 nt, Mycobacterium bovis subsp bovis AF2122/97
cgcccgugagaucc

SEQ ID NO: 3207784 - RNA, 15 nt, Mycobacterium bovis subsp bovis AF2122/97
cgcccgugagcgccg

SEQ ID NO: 3207785 - RNA, 20 nt, Mycobacterium bovis subsp bovis AF2122/97
cgcccgugccgcccgcgccg

SEQ ID NO: 3207786 - RNA, 23 nt, Mycobacterium bovis subsp bovis AF2122/97
cgcccgugccgcccgcgccgccc

SEQ ID NO: 3207787 - RNA, 16 nt, Mycobacterium bovis subsp bovis AF2122/97
cgcccgugccgcccuc

SEQ ID NO: 3207788 - RNA, 13 nt, Mycobacterium bovis subsp bovis AF2122/97
cgcccguguugaa

SEQ ID NO: 3207789 - RNA, 16 nt, Mycobacterium bovis subsp bovis AF2122/97
cgcccguguugaagaa

SEQ ID NO: 3207790 - RNA, 23 nt, Mycobacterium bovis subsp bovis AF2122/97
cgcccuagcgagcggcaccaaug

SEQ ID NO: 3207791 - RNA, 19 nt, Mycobacterium bovis subsp bovis AF2122/97
cgcccuagcuggugcgccc

SEQ ID NO: 3207792 - RNA, 19 nt, Mycobacterium bovis subsp bovis AF2122/97
cgcccucacaacgauugcg

SEQ ID NO: 3207793 - RNA, 23 nt, Mycobacterium bovis subsp bovis AF2122/97
cgcccucaccgccugugccgccg

SEQ ID NO: 3207794 - RNA, 21 nt, Mycobacterium bovis subsp bovis AF2122/97
cgcccucacgccaaguccgcu

SEQ ID NO: 3207795 - RNA, 14 nt, Mycobacterium bovis subsp bovis AF2122/97
cgcccucagccgcg

SEQ ID NO: 3207796 - RNA, 16 nt, Mycobacterium bovis subsp bovis AF2122/97
cgcccucagccgcggc

SEQ ID NO: 3207797 - RNA, 23 nt, Mycobacterium bovis subsp bovis AF2122/97
cgcccucaguucacgcucgacga

SEQ ID NO: 3207798 - RNA, 22 nt, Mycobacterium bovis subsp bovis AF2122/97
cgcccucauaggccugcagccg

SEQ ID NO: 3207799 - RNA, 14 nt, Mycobacterium bovis subsp bovis AF2122/97
cgcccucccgggcc

SEQ ID NO: 3207800 - RNA, 15 nt, Mycobacterium bovis subsp bovis AF2122/97
cgcccucccgggccc

SEQ ID NO: 3207801 - RNA, 14 nt, Mycobacterium bovis subsp bovis AF2122/97
cgcccucccugggg

SEQ ID NO: 3207802 - RNA, 15 nt, Mycobacterium bovis subsp bovis AF2122/97
cgcccuccuggcggg

SEQ ID NO: 3207803 - RNA, 13 nt, Mycobacterium bovis subsp bovis AF2122/97
cgcccuccuuggc

SEQ ID NO: 3207804 - RNA, 18 nt, Mycobacterium bovis subsp bovis AF2122/97
cgcccuccuuggcguugc

SEQ ID NO: 3207805 - RNA, 15 nt, Mycobacterium bovis subsp bovis AF2122/97
cgcccucgacgccgc

SEQ ID NO: 3207806 - RNA, 17 nt, Mycobacterium bovis subsp bovis AF2122/97
cgcccucgacgccgcgc

SEQ ID NO: 3207807 - RNA, 20 nt, Mycobacterium bovis subsp bovis AF2122/97
cgcccucgacgccgcgcagc

SEQ ID NO: 3207808 - RNA, 20 nt, Mycobacterium bovis subsp bovis AF2122/97
cgcccucgacgcgcucgggc

SEQ ID NO: 3207809 - RNA, 20 nt, Mycobacterium bovis subsp bovis AF2122/97
cgcccucguaauccacgccg

SEQ ID NO: 3207810 - RNA, 16 nt, Mycobacterium bovis subsp bovis AF2122/97
cgcccucgucgaucgc

SEQ ID NO: 3207811 - RNA, 21 nt, Mycobacterium bovis subsp bovis AF2122/97
cgcccucgucgaucgccgcga

SEQ ID NO: 3207812 - RNA, 22 nt, Mycobacterium bovis subsp bovis AF2122/97
cgcccucgucgaucgccgcgau

SEQ ID NO: 3207813 - RNA, 12 nt, Mycobacterium bovis subsp bovis AF2122/97
cgcccucgucgc

SEQ ID NO: 3207814 - RNA, 16 nt, Mycobacterium bovis subsp bovis AF2122/97
cgcccucgucgcgggc

SEQ ID NO: 3207815 - RNA, 21 nt, Mycobacterium bovis subsp bovis AF2122/97
cgcccucgucgcgggccaccg

SEQ ID NO: 3207816 - RNA, 22 nt, Mycobacterium bovis subsp bovis AF2122/97
cgcccucgucgcgggccaccgc

SEQ ID NO: 3207817 - RNA, 16 nt, Mycobacterium bovis subsp bovis AF2122/97
cgcccugaagggccgc

SEQ ID NO: 3207818 - RNA, 18 nt, Mycobacterium bovis subsp bovis AF2122/97
cgcccugaagggccgccu

SEQ ID NO: 3207819 - RNA, 20 nt, Mycobacterium bovis subsp bovis AF2122/97
cgcccugacacaacaccggc

SEQ ID NO: 3207820 - RNA, 13 nt, Mycobacterium bovis subsp bovis AF2122/97
cgcccugacaccc

SEQ ID NO: 3207821 - RNA, 23 nt, Mycobacterium bovis subsp bovis AF2122/97
cgcccugacacccaucgaccgcc

SEQ ID NO: 3207822 - RNA, 14 nt, Mycobacterium bovis subsp bovis AF2122/97
cgcccugacccgga

SEQ ID NO: 3207823 - RNA, 20 nt, Mycobacterium bovis subsp bovis AF2122/97
cgcccugacccggagccgcc

SEQ ID NO: 3207824 - RNA, 23 nt, Mycobacterium bovis subsp bovis AF2122/97
cgcccugacccggagccgccagg

SEQ ID NO: 3207825 - RNA, 20 nt, Mycobacterium bovis subsp bovis AF2122/97
cgcccugacgguggugaccg

SEQ ID NO: 3207826 - RNA, 16 nt, Mycobacterium bovis subsp bovis AF2122/97
cgcccugacgucacgu

SEQ ID NO: 3207827 - RNA, 20 nt, Mycobacterium bovis subsp bovis AF2122/97
cgcccugacgucacguucgg

SEQ ID NO: 3207828 - RNA, 19 nt, Mycobacterium bovis subsp bovis AF2122/97
cgcccugagaacacguucg

SEQ ID NO: 3207829 - RNA, 18 nt, Mycobacterium bovis subsp bovis AF2122/97
cgcccugcagacgggugg

SEQ ID NO: 3207830 - RNA, 20 nt, Mycobacterium bovis subsp bovis AF2122/97
cgcccugcgccacacccggc

SEQ ID NO: 3207831 - RNA, 12 nt, Mycobacterium bovis subsp bovis AF2122/97
cgcccugcggau

SEQ ID NO: 3207832 - RNA, 17 nt, Mycobacterium bovis subsp bovis AF2122/97
cgcccuggaaugccgcc

SEQ ID NO: 3207833 - RNA, 18 nt, Mycobacterium bovis subsp bovis AF2122/97
cgcccuggaaugccgcca

SEQ ID NO: 3207834 - RNA, 18 nt, Mycobacterium bovis subsp bovis AF2122/97
cgcccuggacgucggcga

SEQ ID NO: 3207835 - RNA, 23 nt, Mycobacterium bovis subsp bovis AF2122/97
cgcccuggacgucggcgauaucg

SEQ ID NO: 3207836 - RNA, 22 nt, Mycobacterium bovis subsp bovis AF2122/97
cgcccuggcaacgacacgccgc

SEQ ID NO: 3207837 - RNA, 16 nt, Mycobacterium bovis subsp bovis AF2122/97
cgcccuggccgcccug

SEQ ID NO: 3207838 - RNA, 14 nt, Mycobacterium bovis subsp bovis AF2122/97
cgcccuggccgccg

SEQ ID NO: 3207839 - RNA, 13 nt, Mycobacterium bovis subsp bovis AF2122/97
cgcccuggccgcu

SEQ ID NO: 3207840 - RNA, 11 nt, Mycobacterium bovis subsp bovis AF2122/97
cgcccugggcg

SEQ ID NO: 3207841 - RNA, 14 nt, Mycobacterium bovis subsp bovis AF2122/97
cgcccugggcgccg

SEQ ID NO: 3207842 - RNA, 23 nt, Mycobacterium bovis subsp bovis AF2122/97
cgcccugggcgccggcguccgga

SEQ ID NO: 3207843 - RNA, 21 nt, Mycobacterium bovis subsp bovis AF2122/97
cgcccugguccaggcccuggc

SEQ ID NO: 3207844 - RNA, 22 nt, Mycobacterium bovis subsp bovis AF2122/97
cgcccuguccggguagcggcgc

SEQ ID NO: 3207845 - RNA, 17 nt, Mycobacterium bovis subsp bovis AF2122/97
cgcccuguucggcccga

SEQ ID NO: 3207846 - RNA, 18 nt, Mycobacterium bovis subsp bovis AF2122/97
cgcccuuagggucgccgc

SEQ ID NO: 3207847 - RNA, 19 nt, Mycobacterium bovis subsp bovis AF2122/97
cgcccuuagggucgccgca

SEQ ID NO: 3207848 - RNA, 19 nt, Mycobacterium bovis subsp bovis AF2122/97
cgcccuucagcacggugau

SEQ ID NO: 3207849 - RNA, 14 nt, Mycobacterium bovis subsp bovis AF2122/97
cgcccuugagccgc

SEQ ID NO: 3207850 - RNA, 19 nt, Mycobacterium bovis subsp bovis AF2122/97
cgcccuugauguccgcgac

SEQ ID NO: 3207851 - RNA, 20 nt, Mycobacterium bovis subsp bovis AF2122/97
cgcccuugauguccgcgacg

SEQ ID NO: 3207852 - RNA, 10 nt, Mycobacterium bovis subsp bovis AF2122/97
cgcccuugcc

SEQ ID NO: 3207853 - RNA, 14 nt, Mycobacterium bovis subsp bovis AF2122/97
cgcccuugccgcag

SEQ ID NO: 3207854 - RNA, 13 nt, Mycobacterium bovis subsp bovis AF2122/97
cgcccuugccgcc

SEQ ID NO: 3207855 - RNA, 16 nt, Mycobacterium bovis subsp bovis AF2122/97
cgcccuugccgccagc

SEQ ID NO: 3207856 - RNA, 18 nt, Mycobacterium bovis subsp bovis AF2122/97
cgcccuugccgccagccc

SEQ ID NO: 3207857 - RNA, 17 nt, Mycobacterium bovis subsp bovis AF2122/97
cgcccuugccgcccgcu

SEQ ID NO: 3207858 - RNA, 14 nt, Mycobacterium bovis subsp bovis AF2122/97
cgcccuugccgccg

SEQ ID NO: 3207859 - RNA, 15 nt, Mycobacterium bovis subsp bovis AF2122/97
cgcccuugccgccga

SEQ ID NO: 3207860 - RNA, 17 nt, Mycobacterium bovis subsp bovis AF2122/97
cgcccuugccgccgagg

SEQ ID NO: 3207861 - RNA, 16 nt, Mycobacterium bovis subsp bovis AF2122/97
cgcccuugccgccggc

SEQ ID NO: 3207862 - RNA, 20 nt, Mycobacterium bovis subsp bovis AF2122/97
cgcccuugccgccggccccg

SEQ ID NO: 3207863 - RNA, 21 nt, Mycobacterium bovis subsp bovis AF2122/97
cgcccuugccgccggccccgc

SEQ ID NO: 3207864 - RNA, 14 nt, Mycobacterium bovis subsp bovis AF2122/97
cgcccuugccgccu

SEQ ID NO: 3207865 - RNA, 15 nt, Mycobacterium bovis subsp bovis AF2122/97
cgcccuugccgccuu

SEQ ID NO: 3207866 - RNA, 19 nt, Mycobacterium bovis subsp bovis AF2122/97
cgccgaaaaccucgaaacc

SEQ ID NO: 3207867 - RNA, 14 nt, Mycobacterium bovis subsp bovis AF2122/97
cgccgaaaaugccg

SEQ ID NO: 3207868 - RNA, 17 nt, Mycobacterium bovis subsp bovis AF2122/97
cgccgaaaaugccgccc

SEQ ID NO: 3207869 - RNA, 19 nt, Mycobacterium bovis subsp bovis AF2122/97
cgccgaaaaugccgcccag

SEQ ID NO: 3207870 - RNA, 14 nt, Mycobacterium bovis subsp bovis AF2122/97
cgccgaaacagcac

SEQ ID NO: 3207871 - RNA, 19 nt, Mycobacterium bovis subsp bovis AF2122/97
cgccgaaacucaccagcac

SEQ ID NO: 3207872 - RNA, 17 nt, Mycobacterium bovis subsp bovis AF2122/97
cgccgaaagccuugccg

SEQ ID NO: 3207873 - RNA, 21 nt, Mycobacterium bovis subsp bovis AF2122/97
cgccgaaagccuugccgucga

SEQ ID NO: 3207874 - RNA, 14 nt, Mycobacterium bovis subsp bovis AF2122/97
cgccgaaagggucg

SEQ ID NO: 3207875 - RNA, 14 nt, Mycobacterium bovis subsp bovis AF2122/97
cgccgaaaucggcc

SEQ ID NO: 3207876 - RNA, 17 nt, Mycobacterium bovis subsp bovis AF2122/97
cgccgaaaucggccagc

SEQ ID NO: 3207877 - RNA, 15 nt, Mycobacterium bovis subsp bovis AF2122/97
cgccgaacaccacac

SEQ ID NO: 3207878 - RNA, 17 nt, Mycobacterium bovis subsp bovis AF2122/97
cgccgaacaccacaccg

SEQ ID NO: 3207879 - RNA, 19 nt, Mycobacterium bovis subsp bovis AF2122/97
cgccgaacaccgagugcgg

SEQ ID NO: 3207880 - RNA, 15 nt, Mycobacterium bovis subsp bovis AF2122/97
cgccgaacaccgccg

SEQ ID NO: 3207881 - RNA, 16 nt, Mycobacterium bovis subsp bovis AF2122/97
cgccgaacaccggcuc

SEQ ID NO: 3207882 - RNA, 18 nt, Mycobacterium bovis subsp bovis AF2122/97
cgccgaacaccggcucca

SEQ ID NO: 3207883 - RNA, 17 nt, Mycobacterium bovis subsp bovis AF2122/97
cgccgaacaccgguaac

SEQ ID NO: 3207884 - RNA, 21 nt, Mycobacterium bovis subsp bovis AF2122/97
cgccgaacacgcacacgaucg

SEQ ID NO: 3207885 - RNA, 23 nt, Mycobacterium bovis subsp bovis AF2122/97
cgccgaacacgcacacgaucgcg

SEQ ID NO: 3207886 - RNA, 16 nt, Mycobacterium bovis subsp bovis AF2122/97
cgccgaaccagcgaug

SEQ ID NO: 3207887 - RNA, 19 nt, Mycobacterium bovis subsp bovis AF2122/97
cgccgaaccagcgaugggu

SEQ ID NO: 3207888 - RNA, 21 nt, Mycobacterium bovis subsp bovis AF2122/97
cgccgaacgcaacgccgaugg

SEQ ID NO: 3207889 - RNA, 14 nt, Mycobacterium bovis subsp bovis AF2122/97
cgccgaacgccacc

SEQ ID NO: 3207890 - RNA, 17 nt, Mycobacterium bovis subsp bovis AF2122/97
cgccgaacgccaccacc

SEQ ID NO: 3207891 - RNA, 18 nt, Mycobacterium bovis subsp bovis AF2122/97
cgccgaacgccaccaccu

SEQ ID NO: 3207892 - RNA, 23 nt, Mycobacterium bovis subsp bovis AF2122/97
cgccgaacgccucugcgaucagu

SEQ ID NO: 3207893 - RNA, 14 nt, Mycobacterium bovis subsp bovis AF2122/97
cgccgaacgcgagg

SEQ ID NO: 3207894 - RNA, 17 nt, Mycobacterium bovis subsp bovis AF2122/97
cgccgaacgcgagguuc

SEQ ID NO: 3207895 - RNA, 20 nt, Mycobacterium bovis subsp bovis AF2122/97
cgccgaacgugcaaccacgg

SEQ ID NO: 3207896 - RNA, 16 nt, Mycobacterium bovis subsp bovis AF2122/97
cgccgaacguguugac

SEQ ID NO: 3207897 - RNA, 23 nt, Mycobacterium bovis subsp bovis AF2122/97
cgccgaacguguugaccaggcuc

SEQ ID NO: 3207898 - RNA, 22 nt, Mycobacterium bovis subsp bovis AF2122/97
cgccgaacugcuugcgcaucgc

SEQ ID NO: 3207899 - RNA, 17 nt, Mycobacterium bovis subsp bovis AF2122/97
cgccgaagaaggugacg

SEQ ID NO: 3207900 - RNA, 19 nt, Mycobacterium bovis subsp bovis AF2122/97
cgccgaagaaggugacgau

SEQ ID NO: 3207901 - RNA, 16 nt, Mycobacterium bovis subsp bovis AF2122/97
cgccgaagaggagaac

SEQ ID NO: 3207902 - RNA, 21 nt, Mycobacterium bovis subsp bovis AF2122/97
cgccgaagagucgugccgccg

SEQ ID NO: 3207903 - RNA, 23 nt, Mycobacterium bovis subsp bovis AF2122/97
cgccgaagagucgugccgccgca

SEQ ID NO: 3207904 - RNA, 15 nt, Mycobacterium bovis subsp bovis AF2122/97
cgccgaagccgacga

SEQ ID NO: 3207905 - RNA, 17 nt, Mycobacterium bovis subsp bovis AF2122/97
cgccgaagccgacgaac

SEQ ID NO: 3207906 - RNA, 14 nt, Mycobacterium bovis subsp bovis AF2122/97
cgccgaagccgcgc

SEQ ID NO: 3207907 - RNA, 15 nt, Mycobacterium bovis subsp bovis AF2122/97
cgccgaagccgcgca

SEQ ID NO: 3207908 - RNA, 16 nt, Mycobacterium bovis subsp bovis AF2122/97
cgccgaagccgcgcau

SEQ ID NO: 3207909 - RNA, 21 nt, Mycobacterium bovis subsp bovis AF2122/97
cgccgaagccuugcagcgccc

SEQ ID NO: 3207910 - RNA, 15 nt, Mycobacterium bovis subsp bovis AF2122/97
cgccgaagcgaugcc

SEQ ID NO: 3207911 - RNA, 15 nt, Mycobacterium bovis subsp bovis AF2122/97
cgccgaagcgccgcu

SEQ ID NO: 3207912 - RNA, 16 nt, Mycobacterium bovis subsp bovis AF2122/97
cgccgaagcgggcccg

SEQ ID NO: 3207913 - RNA, 18 nt, Mycobacterium bovis subsp bovis AF2122/97
cgccgaagcgggcccgca

SEQ ID NO: 3207914 - RNA, 22 nt, Mycobacterium bovis subsp bovis AF2122/97
cgccgaagcgggcccgcagguc

SEQ ID NO: 3207915 - RNA, 15 nt, Mycobacterium bovis subsp bovis AF2122/97
cgccgaaggccgcca

SEQ ID NO: 3207916 - RNA, 16 nt, Mycobacterium bovis subsp bovis AF2122/97
cgccgaaguagccgac

SEQ ID NO: 3207917 - RNA, 17 nt, Mycobacterium bovis subsp bovis AF2122/97
cgccgaaguagccgacc

SEQ ID NO: 3207918 - RNA, 18 nt, Mycobacterium bovis subsp bovis AF2122/97
cgccgaaguagccgaccg

SEQ ID NO: 3207919 - RNA, 23 nt, Mycobacterium bovis subsp bovis AF2122/97
cgccgaaguagccgaccggcagc

SEQ ID NO: 3207920 - RNA, 21 nt, Mycobacterium bovis subsp bovis AF2122/97
cgccgaaguuccagccgacgg

SEQ ID NO: 3207921 - RNA, 24 nt, Mycobacterium bovis subsp bovis AF2122/97
cgccgaauacggcugccuccauga

SEQ ID NO: 3207922 - RNA, 17 nt, Mycobacterium bovis subsp bovis AF2122/97
cgccgaauccgacgucg

SEQ ID NO: 3207923 - RNA, 20 nt, Mycobacterium bovis subsp bovis AF2122/97
cgccgaauccgacgucgacg

SEQ ID NO: 3207924 - RNA, 22 nt, Mycobacterium bovis subsp bovis AF2122/97
cgccgaauccgacgucgacgag

SEQ ID NO: 3207925 - RNA, 15 nt, Mycobacterium bovis subsp bovis AF2122/97
cgccgaaucgcgggc

SEQ ID NO: 3207926 - RNA, 23 nt, Mycobacterium bovis subsp bovis AF2122/97
cgccgaaucgcgggcugaccaac

SEQ ID NO: 3207927 - RNA, 16 nt, Mycobacterium bovis subsp bovis AF2122/97
cgccgaaucgcugacc

SEQ ID NO: 3207928 - RNA, 13 nt, Mycobacterium bovis subsp bovis AF2122/97
cgccgaaucggca

SEQ ID NO: 3207929 - RNA, 14 nt, Mycobacterium bovis subsp bovis AF2122/97
cgccgaaucggcag

SEQ ID NO: 3207930 - RNA, 17 nt, Mycobacterium bovis subsp bovis AF2122/97
cgccgaaucggcaguug

SEQ ID NO: 3207931 - RNA, 22 nt, Mycobacterium bovis subsp bovis AF2122/97
cgccgaaucggcaguugaacuc

SEQ ID NO: 3207932 - RNA, 16 nt, Mycobacterium bovis subsp bovis AF2122/97
cgccgaaucucaccgu

SEQ ID NO: 3207933 - RNA, 20 nt, Mycobacterium bovis subsp bovis AF2122/97
cgccgaaucucaccgucaac

SEQ ID NO: 3207934 - RNA, 14 nt, Mycobacterium bovis subsp bovis AF2122/97
cgccgaaugccacc

SEQ ID NO: 3207935 - RNA, 14 nt, Mycobacterium bovis subsp bovis AF2122/97
cgccgacaaaagcc

SEQ ID NO: 3207936 - RNA, 20 nt, Mycobacterium bovis subsp bovis AF2122/97
cgccgacaaaagccagggcc

SEQ ID NO: 3207937 - RNA, 14 nt, Mycobacterium bovis subsp bovis AF2122/97
cgccgacaaccccg

SEQ ID NO: 3207938 - RNA, 16 nt, Mycobacterium bovis subsp bovis AF2122/97
cgccgacaaccccgcc

SEQ ID NO: 3207939 - RNA, 17 nt, Mycobacterium bovis subsp bovis AF2122/97
cgccgacaaccccgcca

SEQ ID NO: 3207940 - RNA, 14 nt, Mycobacterium bovis subsp bovis AF2122/97
cgccgacaccaccg

SEQ ID NO: 3207941 - RNA, 20 nt, Mycobacterium bovis subsp bovis AF2122/97
cgccgacaccaccggcgccg

SEQ ID NO: 3207942 - RNA, 21 nt, Mycobacterium bovis subsp bovis AF2122/97
cgccgacaccaccggcgccgc

SEQ ID NO: 3207943 - RNA, 18 nt, Mycobacterium bovis subsp bovis AF2122/97
cgccgacacccucgggca

SEQ ID NO: 3207944 - RNA, 19 nt, Mycobacterium bovis subsp bovis AF2122/97
cgccgacaccggcugaccg

SEQ ID NO: 3207945 - RNA, 12 nt, Mycobacterium bovis subsp bovis AF2122/97
cgccgacagccc

SEQ ID NO: 3207946 - RNA, 16 nt, Mycobacterium bovis subsp bovis AF2122/97
cgccgacagccgaucc

SEQ ID NO: 3207947 - RNA, 23 nt, Mycobacterium bovis subsp bovis AF2122/97
cgccgacagccgauccgaucgca

SEQ ID NO: 3207948 - RNA, 15 nt, Mycobacterium bovis subsp bovis AF2122/97
cgccgacagcgccuu

SEQ ID NO: 3207949 - RNA, 20 nt, Mycobacterium bovis subsp bovis AF2122/97
cgccgacaggccggccacca

SEQ ID NO: 3207950 - RNA, 22 nt, Mycobacterium bovis subsp bovis AF2122/97
cgccgacauggcggugcgcagc

SEQ ID NO: 3207951 - RNA, 19 nt, Mycobacterium bovis subsp bovis AF2122/97
cgccgaccacauuccgcag

SEQ ID NO: 3207952 - RNA, 14 nt, Mycobacterium bovis subsp bovis AF2122/97
cgccgaccacccgg

SEQ ID NO: 3207953 - RNA, 16 nt, Mycobacterium bovis subsp bovis AF2122/97
cgccgaccacccggau

SEQ ID NO: 3207954 - RNA, 14 nt, Mycobacterium bovis subsp bovis AF2122/97
cgccgaccaccgcu

SEQ ID NO: 3207955 - RNA, 21 nt, Mycobacterium bovis subsp bovis AF2122/97
cgccgaccagaacgacgccgc

SEQ ID NO: 3207956 - RNA, 18 nt, Mycobacterium bovis subsp bovis AF2122/97
cgccgaccagcuugaccg

SEQ ID NO: 3207957 - RNA, 19 nt, Mycobacterium bovis subsp bovis AF2122/97
cgccgaccaucucaccggg

SEQ ID NO: 3207958 - RNA, 22 nt, Mycobacterium bovis subsp bovis AF2122/97
cgccgaccaucucaccgggccc

SEQ ID NO: 3207959 - RNA, 15 nt, Mycobacterium bovis subsp bovis AF2122/97
cgccgacccaacccg

SEQ ID NO: 3207960 - RNA, 22 nt, Mycobacterium bovis subsp bovis AF2122/97
cgccgacccaacccgaucucug

SEQ ID NO: 3207961 - RNA, 18 nt, Mycobacterium bovis subsp bovis AF2122/97
cgccgacccgccacaucg

SEQ ID NO: 3207962 - RNA, 14 nt, Mycobacterium bovis subsp bovis AF2122/97
cgccgacccgccgc

SEQ ID NO: 3207963 - RNA, 16 nt, Mycobacterium bovis subsp bovis AF2122/97
cgccgacccgccgcgg

SEQ ID NO: 3207964 - RNA, 13 nt, Mycobacterium bovis subsp bovis AF2122/97
cgccgacccgcgc

SEQ ID NO: 3207965 - RNA, 18 nt, Mycobacterium bovis subsp bovis AF2122/97
cgccgacccgcgcgccgg

SEQ ID NO: 3207966 - RNA, 20 nt, Mycobacterium bovis subsp bovis AF2122/97
cgccgacccgcgcgccggcg

SEQ ID NO: 3207967 - RNA, 16 nt, Mycobacterium bovis subsp bovis AF2122/97
cgccgacccgggggcg

SEQ ID NO: 3207968 - RNA, 13 nt, Mycobacterium bovis subsp bovis AF2122/97
cgccgacccguac

SEQ ID NO: 3207969 - RNA, 21 nt, Mycobacterium bovis subsp bovis AF2122/97
cgccgaccgacaccaccaggu

SEQ ID NO: 3207970 - RNA, 15 nt, Mycobacterium bovis subsp bovis AF2122/97
cgccgaccgacgucg

SEQ ID NO: 3207971 - RNA, 16 nt, Mycobacterium bovis subsp bovis AF2122/97
cgccgaccgacgucgc

SEQ ID NO: 3207972 - RNA, 16 nt, Mycobacterium bovis subsp bovis AF2122/97
cgccgaccgcgccgca

SEQ ID NO: 3207973 - RNA, 14 nt, Mycobacterium bovis subsp bovis AF2122/97
cgccgaccggaccg

SEQ ID NO: 3207974 - RNA, 15 nt, Mycobacterium bovis subsp bovis AF2122/97
cgccgaccggaccgg

SEQ ID NO: 3207975 - RNA, 23 nt, Mycobacterium bovis subsp bovis AF2122/97
cgccgaccggcccgcauccgcac

SEQ ID NO: 3207976 - RNA, 14 nt, Mycobacterium bovis subsp bovis AF2122/97
cgccgaccgguggc

SEQ ID NO: 3207977 - RNA, 17 nt, Mycobacterium bovis subsp bovis AF2122/97
cgccgaccgguggcacc

SEQ ID NO: 3207978 - RNA, 15 nt, Mycobacterium bovis subsp bovis AF2122/97
cgccgaccucaucgg

SEQ ID NO: 3207979 - RNA, 17 nt, Mycobacterium bovis subsp bovis AF2122/97
cgccgaccucaucggca

SEQ ID NO: 3207980 - RNA, 15 nt, Mycobacterium bovis subsp bovis AF2122/97
cgccgaccuccuccu

SEQ ID NO: 3207981 - RNA, 14 nt, Mycobacterium bovis subsp bovis AF2122/97
cgccgaccuggaca

SEQ ID NO: 3207982 - RNA, 23 nt, Mycobacterium bovis subsp bovis AF2122/97
cgccgaccuggacaaccucgucg

SEQ ID NO: 3207983 - RNA, 13 nt, Mycobacterium bovis subsp bovis AF2122/97
cgccgaccuucgg

SEQ ID NO: 3207984 - RNA, 17 nt, Mycobacterium bovis subsp bovis AF2122/97
cgccgaccuucggcccg

SEQ ID NO: 3207985 - RNA, 19 nt, Mycobacterium bovis subsp bovis AF2122/97
cgccgaccuucggcccgcu

SEQ ID NO: 3207986 - RNA, 13 nt, Mycobacterium bovis subsp bovis AF2122/97
cgccgaccuugau

SEQ ID NO: 3207987 - RNA, 21 nt, Mycobacterium bovis subsp bovis AF2122/97
cgccgaccuugauuccugccc

SEQ ID NO: 3207988 - RNA, 17 nt, Mycobacterium bovis subsp bovis AF2122/97
cgccgaccuuggcgucg

SEQ ID NO: 3207989 - RNA, 14 nt, Mycobacterium bovis subsp bovis AF2122/97
cgccgacgaaaucg

SEQ ID NO: 3207990 - RNA, 24 nt, Mycobacterium bovis subsp bovis AF2122/97
cgccgacgaacaguugcggcuggc

SEQ ID NO: 3207991 - RNA, 17 nt, Mycobacterium bovis subsp bovis AF2122/97
cgccgacgaacugcagc

SEQ ID NO: 3207992 - RNA, 19 nt, Mycobacterium bovis subsp bovis AF2122/97
cgccgacgacuccggcaag

SEQ ID NO: 3207993 - RNA, 16 nt, Mycobacterium bovis subsp bovis AF2122/97
cgccgacgaugacgcg

SEQ ID NO: 3207994 - RNA, 18 nt, Mycobacterium bovis subsp bovis AF2122/97
cgccgacgauuaccagcg

SEQ ID NO: 3207995 - RNA, 20 nt, Mycobacterium bovis subsp bovis AF2122/97
cgccgacgauuaccagcggc

SEQ ID NO: 3207996 - RNA, 21 nt, Mycobacterium bovis subsp bovis AF2122/97
cgccgacgccagauccuucaa

SEQ ID NO: 3207997 - RNA, 14 nt, Mycobacterium bovis subsp bovis AF2122/97
cgccgacgcccagg

SEQ ID NO: 3207998 - RNA, 15 nt, Mycobacterium bovis subsp bovis AF2122/97
cgccgacgccgauac

SEQ ID NO: 3207999 - RNA, 15 nt, Mycobacterium bovis subsp bovis AF2122/97
cgccgacgccgccgg

SEQ ID NO: 3208000 - RNA, 18 nt, Mycobacterium bovis subsp bovis AF2122/97
cgccgacgccgccggcac

SEQ ID NO: 3208001 - RNA, 20 nt, Mycobacterium bovis subsp bovis AF2122/97
cgccgacgccgccggcaccg

SEQ ID NO: 3208002 - RNA, 18 nt, Mycobacterium bovis subsp bovis AF2122/97
cgccgacgccgccggccc

SEQ ID NO: 3208003 - RNA, 22 nt, Mycobacterium bovis subsp bovis AF2122/97
cgccgacgccgccggccccgcc

SEQ ID NO: 3208004 - RNA, 16 nt, Mycobacterium bovis subsp bovis AF2122/97
cgccgacgccgguggg

SEQ ID NO: 3208005 - RNA, 15 nt, Mycobacterium bovis subsp bovis AF2122/97
cgccgacgccguugc

SEQ ID NO: 3208006 - RNA, 14 nt, Mycobacterium bovis subsp bovis AF2122/97
cgccgacggccagc

SEQ ID NO: 3208007 - RNA, 17 nt, Mycobacterium bovis subsp bovis AF2122/97
cgccgacggccagcagg

SEQ ID NO: 3208008 - RNA, 18 nt, Mycobacterium bovis subsp bovis AF2122/97
cgccgacggccagcagga

SEQ ID NO: 3208009 - RNA, 20 nt, Mycobacterium bovis subsp bovis AF2122/97
cgccgacggccagcaggaug

SEQ ID NO: 3208010 - RNA, 21 nt, Mycobacterium bovis subsp bovis AF2122/97
cgccgacggccagcaggauga

SEQ ID NO: 3208011 - RNA, 15 nt, Mycobacterium bovis subsp bovis AF2122/97
cgccgacggcgacca

SEQ ID NO: 3208012 - RNA, 20 nt, Mycobacterium bovis subsp bovis AF2122/97
cgccgacggcgaccaccgcg

SEQ ID NO: 3208013 - RNA, 13 nt, Mycobacterium bovis subsp bovis AF2122/97
cgccgacggcgcc

SEQ ID NO: 3208014 - RNA, 20 nt, Mycobacterium bovis subsp bovis AF2122/97
cgccgacggcgccccgcgcu

SEQ ID NO: 3208015 - RNA, 12 nt, Mycobacterium bovis subsp bovis AF2122/97
cgccgacggugc

SEQ ID NO: 3208016 - RNA, 20 nt, Mycobacterium bovis subsp bovis AF2122/97
cgccgacguauagaccaggu

SEQ ID NO: 3208017 - RNA, 20 nt, Mycobacterium bovis subsp bovis AF2122/97
cgccgacgucgacgccggcc

SEQ ID NO: 3208018 - RNA, 22 nt, Mycobacterium bovis subsp bovis AF2122/97
cgccgacgucgacgccggccag

SEQ ID NO: 3208019 - RNA, 14 nt, Mycobacterium bovis subsp bovis AF2122/97
cgccgacuacgaag

SEQ ID NO: 3208020 - RNA, 14 nt, Mycobacterium bovis subsp bovis AF2122/97
cgccgacuccccgc

SEQ ID NO: 3208021 - RNA, 17 nt, Mycobacterium bovis subsp bovis AF2122/97
cgccgacuccccgccgg

SEQ ID NO: 3208022 - RNA, 18 nt, Mycobacterium bovis subsp bovis AF2122/97
cgccgacuccccgccggg

SEQ ID NO: 3208023 - RNA, 19 nt, Mycobacterium bovis subsp bovis AF2122/97
cgccgacuccccgccgggc

SEQ ID NO: 3208024 - RNA, 16 nt, Mycobacterium bovis subsp bovis AF2122/97
cgccgacucggcaccg

SEQ ID NO: 3208025 - RNA, 18 nt, Mycobacterium bovis subsp bovis AF2122/97
cgccgacucggcaccgcg

SEQ ID NO: 3208026 - RNA, 20 nt, Mycobacterium bovis subsp bovis AF2122/97
cgccgacucggcaccgcggc

SEQ ID NO: 3208027 - RNA, 17 nt, Mycobacterium bovis subsp bovis AF2122/97
cgccgacuuccgcgucg

SEQ ID NO: 3208028 - RNA, 21 nt, Mycobacterium bovis subsp bovis AF2122/97
cgccgacuuccgcgucgccgg

SEQ ID NO: 3208029 - RNA, 22 nt, Mycobacterium bovis subsp bovis AF2122/97
cgccgacuuccgcgucgccggc

SEQ ID NO: 3208030 - RNA, 21 nt, Mycobacterium bovis subsp bovis AF2122/97
cgccgacuugauuucgaucgc

SEQ ID NO: 3208031 - RNA, 18 nt, Mycobacterium bovis subsp bovis AF2122/97
cgccgagaacgauguccg

SEQ ID NO: 3208032 - RNA, 19 nt, Mycobacterium bovis subsp bovis AF2122/97
cgccgagaacgauguccgc

SEQ ID NO: 3208033 - RNA, 20 nt, Mycobacterium bovis subsp bovis AF2122/97
cgccgagaagacgcaaaagc

SEQ ID NO: 3208034 - RNA, 18 nt, Mycobacterium bovis subsp bovis AF2122/97
cgccgagaccgcgugguc

SEQ ID NO: 3208035 - RNA, 23 nt, Mycobacterium bovis subsp bovis AF2122/97
cgccgagaccgcguggucggcga

SEQ ID NO: 3208036 - RNA, 17 nt, Mycobacterium bovis subsp bovis AF2122/97
cgccgagaccggccagu

SEQ ID NO: 3208037 - RNA, 15 nt, Mycobacterium bovis subsp bovis AF2122/97
cgccgagauccgcgc

SEQ ID NO: 3208038 - RNA, 17 nt, Mycobacterium bovis subsp bovis AF2122/97
cgccgagauccgcgcuu

SEQ ID NO: 3208039 - RNA, 21 nt, Mycobacterium bovis subsp bovis AF2122/97
cgccgagaugaugcugccggc

SEQ ID NO: 3208040 - RNA, 23 nt, Mycobacterium bovis subsp bovis AF2122/97
cgccgagaugaugcugccggcac

SEQ ID NO: 3208041 - RNA, 18 nt, Mycobacterium bovis subsp bovis AF2122/97
cgccgagaugcugcaccc

SEQ ID NO: 3208042 - RNA, 22 nt, Mycobacterium bovis subsp bovis AF2122/97
cgccgagaugcugcacccggag

SEQ ID NO: 3208043 - RNA, 18 nt, Mycobacterium bovis subsp bovis AF2122/97
cgccgagaugcuggucgg

SEQ ID NO: 3208044 - RNA, 21 nt, Mycobacterium bovis subsp bovis AF2122/97
cgccgagaugcuggucggcga

SEQ ID NO: 3208045 - RNA, 17 nt, Mycobacterium bovis subsp bovis AF2122/97
cgccgagcacacgucgg

SEQ ID NO: 3208046 - RNA, 19 nt, Mycobacterium bovis subsp bovis AF2122/97
cgccgagcacacgucggga

SEQ ID NO: 3208047 - RNA, 21 nt, Mycobacterium bovis subsp bovis AF2122/97
cgccgagcacacgucgggagu

SEQ ID NO: 3208048 - RNA, 17 nt, Mycobacterium bovis subsp bovis AF2122/97
cgccgagcaccgggcuc

SEQ ID NO: 3208049 - RNA, 14 nt, Mycobacterium bovis subsp bovis AF2122/97
cgccgagcacgccg

SEQ ID NO: 3208050 - RNA, 16 nt, Mycobacterium bovis subsp bovis AF2122/97
cgccgagcacgccgag

SEQ ID NO: 3208051 - RNA, 16 nt, Mycobacterium bovis subsp bovis AF2122/97
cgccgagcagacgcag

SEQ ID NO: 3208052 - RNA, 16 nt, Mycobacterium bovis subsp bovis AF2122/97
cgccgagcagacgcgg

SEQ ID NO: 3208053 - RNA, 20 nt, Mycobacterium bovis subsp bovis AF2122/97
cgccgagcagcccgcggauc

SEQ ID NO: 3208054 - RNA, 23 nt, Mycobacterium bovis subsp bovis AF2122/97
cgccgagcagcccgcggaucacg

SEQ ID NO: 3208055 - RNA, 17 nt, Mycobacterium bovis subsp bovis AF2122/97
cgccgagcaggucggca

SEQ ID NO: 3208056 - RNA, 18 nt, Mycobacterium bovis subsp bovis AF2122/97
cgccgagcaggucggcaa

SEQ ID NO: 3208057 - RNA, 16 nt, Mycobacterium bovis subsp bovis AF2122/97
cgccgagccagcaccc

SEQ ID NO: 3208058 - RNA, 13 nt, Mycobacterium bovis subsp bovis AF2122/97
cgccgagcccgcc

SEQ ID NO: 3208059 - RNA, 15 nt, Mycobacterium bovis subsp bovis AF2122/97
cgccgagcccgccgg

SEQ ID NO: 3208060 - RNA, 17 nt, Mycobacterium bovis subsp bovis AF2122/97
cgccgagcccgccgggu

SEQ ID NO: 3208061 - RNA, 17 nt, Mycobacterium bovis subsp bovis AF2122/97
cgccgagcccgggccgu

SEQ ID NO: 3208062 - RNA, 13 nt, Mycobacterium bovis subsp bovis AF2122/97
cgccgagcgccag

SEQ ID NO: 3208063 - RNA, 23 nt, Mycobacterium bovis subsp bovis AF2122/97
cgccgagcgcgccgaaggccgcc

SEQ ID NO: 3208064 - RNA, 18 nt, Mycobacterium bovis subsp bovis AF2122/97
cgccgagcggaccaccgc

SEQ ID NO: 3208065 - RNA, 19 nt, Mycobacterium bovis subsp bovis AF2122/97
cgccgagcggaccaccgcu

SEQ ID NO: 3208066 - RNA, 22 nt, Mycobacterium bovis subsp bovis AF2122/97
cgccgagcggaccaccgcucgc

SEQ ID NO: 3208067 - RNA, 24 nt, Mycobacterium bovis subsp bovis AF2122/97
cgccgagcggaccaccgcucgcca

SEQ ID NO: 3208068 - RNA, 16 nt, Mycobacterium bovis subsp bovis AF2122/97
cgccgagcggugccgg

SEQ ID NO: 3208069 - RNA, 18 nt, Mycobacterium bovis subsp bovis AF2122/97
cgccgagcggugccggcg

SEQ ID NO: 3208070 - RNA, 20 nt, Mycobacterium bovis subsp bovis AF2122/97
cgccgagcgugaagucacgg

SEQ ID NO: 3208071 - RNA, 18 nt, Mycobacterium bovis subsp bovis AF2122/97
cgccgagcuagaucacgg

SEQ ID NO: 3208072 - RNA, 18 nt, Mycobacterium bovis subsp bovis AF2122/97
cgccgagcucggucacca

SEQ ID NO: 3208073 - RNA, 15 nt, Mycobacterium bovis subsp bovis AF2122/97
cgccgagcuggcaac

SEQ ID NO: 3208074 - RNA, 22 nt, Mycobacterium bovis subsp bovis AF2122/97
cgccgagcuggcaacgccgcgc

SEQ ID NO: 3208075 - RNA, 15 nt, Mycobacterium bovis subsp bovis AF2122/97
cgccgagcuggcgcg

SEQ ID NO: 3208076 - RNA, 21 nt, Mycobacterium bovis subsp bovis AF2122/97
cgccgagcugguugacggcga

SEQ ID NO: 3208077 - RNA, 19 nt, Mycobacterium bovis subsp bovis AF2122/97
cgccgaggaaaccaccagu

SEQ ID NO: 3208078 - RNA, 16 nt, Mycobacterium bovis subsp bovis AF2122/97
cgccgaggacgccggc

SEQ ID NO: 3208079 - RNA, 19 nt, Mycobacterium bovis subsp bovis AF2122/97
cgccgaggacgccggcgcc

SEQ ID NO: 3208080 - RNA, 22 nt, Mycobacterium bovis subsp bovis AF2122/97
cgccgaggacgccggcgccgcc

SEQ ID NO: 3208081 - RNA, 14 nt, Mycobacterium bovis subsp bovis AF2122/97
cgccgaggcaaccg

SEQ ID NO: 3208082 - RNA, 22 nt, Mycobacterium bovis subsp bovis AF2122/97
cgccgaggcauugcuguguugc

SEQ ID NO: 3208083 - RNA, 14 nt, Mycobacterium bovis subsp bovis AF2122/97
cgccgaggccgccg

SEQ ID NO: 3208084 - RNA, 15 nt, Mycobacterium bovis subsp bovis AF2122/97
cgccgaggccgccgu

SEQ ID NO: 3208085 - RNA, 20 nt, Mycobacterium bovis subsp bovis AF2122/97
cgccgaggccgccguugccg

SEQ ID NO: 3208086 - RNA, 20 nt, Mycobacterium bovis subsp bovis AF2122/97
cgccgaggccuaccaggcgc

SEQ ID NO: 3208087 - RNA, 21 nt, Mycobacterium bovis subsp bovis AF2122/97
cgccgaggccuaccaggcgcg

SEQ ID NO: 3208088 - RNA, 13 nt, Mycobacterium bovis subsp bovis AF2122/97
cgccgagggcgcc

SEQ ID NO: 3208089 - RNA, 14 nt, Mycobacterium bovis subsp bovis AF2122/97
cgccgagggcgccg

SEQ ID NO: 3208090 - RNA, 16 nt, Mycobacterium bovis subsp bovis AF2122/97
cgccgagggcgccggg

SEQ ID NO: 3208091 - RNA, 23 nt, Mycobacterium bovis subsp bovis AF2122/97
cgccgaggucgaaccgccggcug

SEQ ID NO: 3208092 - RNA, 12 nt, Mycobacterium bovis subsp bovis AF2122/97
cgccgaggucgg

SEQ ID NO: 3208093 - RNA, 20 nt, Mycobacterium bovis subsp bovis AF2122/97
cgccgaggucgguucggccg

SEQ ID NO: 3208094 - RNA, 14 nt, Mycobacterium bovis subsp bovis AF2122/97
cgccgaggucuccg

SEQ ID NO: 3208095 - RNA, 17 nt, Mycobacterium bovis subsp bovis AF2122/97
cgccgaggucuccggug

SEQ ID NO: 3208096 - RNA, 14 nt, Mycobacterium bovis subsp bovis AF2122/97
cgccgagguggaca

SEQ ID NO: 3208097 - RNA, 17 nt, Mycobacterium bovis subsp bovis AF2122/97
cgccgaguaccggccag

SEQ ID NO: 3208098 - RNA, 18 nt, Mycobacterium bovis subsp bovis AF2122/97
cgccgaguaccggccagc

SEQ ID NO: 3208099 - RNA, 21 nt, Mycobacterium bovis subsp bovis AF2122/97
cgccgaguaccggccagccgc

SEQ ID NO: 3208100 - RNA, 20 nt, Mycobacterium bovis subsp bovis AF2122/97
cgccgaguauuggucggugg

SEQ ID NO: 3208101 - RNA, 23 nt, Mycobacterium bovis subsp bovis AF2122/97
cgccgagugugacuaccgagacg

SEQ ID NO: 3208102 - RNA, 18 nt, Mycobacterium bovis subsp bovis AF2122/97
cgccgaguugcccggguc

SEQ ID NO: 3208103 - RNA, 20 nt, Mycobacterium bovis subsp bovis AF2122/97
cgccgaguugcccgggucgg

SEQ ID NO: 3208104 - RNA, 18 nt, Mycobacterium bovis subsp bovis AF2122/97
cgccgaguuguucgccca

SEQ ID NO: 3208105 - RNA, 13 nt, Mycobacterium bovis subsp bovis AF2122/97
cgccgauaccgcc

SEQ ID NO: 3208106 - RNA, 18 nt, Mycobacterium bovis subsp bovis AF2122/97
cgccgauaccgccggccc

SEQ ID NO: 3208107 - RNA, 19 nt, Mycobacterium bovis subsp bovis AF2122/97
cgccgauaccgccggcccc

SEQ ID NO: 3208108 - RNA, 23 nt, Mycobacterium bovis subsp bovis AF2122/97
cgccgauaccgccggccccaccg

SEQ ID NO: 3208109 - RNA, 14 nt, Mycobacterium bovis subsp bovis AF2122/97
cgccgauaccggcg

SEQ ID NO: 3208110 - RNA, 17 nt, Mycobacterium bovis subsp bovis AF2122/97
cgccgauaccggcggcg

SEQ ID NO: 3208111 - RNA, 20 nt, Mycobacterium bovis subsp bovis AF2122/97
cgccgauacuaaacaggccg

SEQ ID NO: 3208112 - RNA, 22 nt, Mycobacterium bovis subsp bovis AF2122/97
cgccgauacuaaacaggccgcc

SEQ ID NO: 3208113 - RNA, 23 nt, Mycobacterium bovis subsp bovis AF2122/97
cgccgauacuaaacaggccgcca

SEQ ID NO: 3208114 - RNA, 19 nt, Mycobacterium bovis subsp bovis AF2122/97
cgccgauacuucaucggca

SEQ ID NO: 3208115 - RNA, 21 nt, Mycobacterium bovis subsp bovis AF2122/97
cgccgauacuucaucggcaca

SEQ ID NO: 3208116 - RNA, 14 nt, Mycobacterium bovis subsp bovis AF2122/97
cgccgauaucgcag

SEQ ID NO: 3208117 - RNA, 16 nt, Mycobacterium bovis subsp bovis AF2122/97
cgccgauaucgcagau

SEQ ID NO: 3208118 - RNA, 20 nt, Mycobacterium bovis subsp bovis AF2122/97
cgccgauaucgcagauggcg

SEQ ID NO: 3208119 - RNA, 22 nt, Mycobacterium bovis subsp bovis AF2122/97
cgccgauaucggugaccguggc

SEQ ID NO: 3208120 - RNA, 17 nt, Mycobacterium bovis subsp bovis AF2122/97
cgccgauaucugccacg

SEQ ID NO: 3208121 - RNA, 18 nt, Mycobacterium bovis subsp bovis AF2122/97
cgccgaucaacagcaccg

SEQ ID NO: 3208122 - RNA, 16 nt, Mycobacterium bovis subsp bovis AF2122/97
cgccgaucaacaugcc

SEQ ID NO: 3208123 - RNA, 20 nt, Mycobacterium bovis subsp bovis AF2122/97
cgccgaucaacaugccgguc

SEQ ID NO: 3208124 - RNA, 13 nt, Mycobacterium bovis subsp bovis AF2122/97
cgccgaucaccac

SEQ ID NO: 3208125 - RNA, 16 nt, Mycobacterium bovis subsp bovis AF2122/97
cgccgaucaccaccgg

SEQ ID NO: 3208126 - RNA, 17 nt, Mycobacterium bovis subsp bovis AF2122/97
cgccgaucaccaccggc

SEQ ID NO: 3208127 - RNA, 20 nt, Mycobacterium bovis subsp bovis AF2122/97
cgccgaucaccaccggcaga

SEQ ID NO: 3208128 - RNA, 14 nt, Mycobacterium bovis subsp bovis AF2122/97
cgccgaucaccagg

SEQ ID NO: 3208129 - RNA, 20 nt, Mycobacterium bovis subsp bovis AF2122/97
cgccgaucaccaggguuggc

SEQ ID NO: 3208130 - RNA, 15 nt, Mycobacterium bovis subsp bovis AF2122/97
cgccgaucaccgcug

SEQ ID NO: 3208131 - RNA, 16 nt, Mycobacterium bovis subsp bovis AF2122/97
cgccgaucaccgcugu

SEQ ID NO: 3208132 - RNA, 21 nt, Mycobacterium bovis subsp bovis AF2122/97
cgccgaucacggugggcgccg

SEQ ID NO: 3208133 - RNA, 16 nt, Mycobacterium bovis subsp bovis AF2122/97
cgccgaucacugucgg

SEQ ID NO: 3208134 - RNA, 21 nt, Mycobacterium bovis subsp bovis AF2122/97
cgccgaucagcgaaccaccgg

SEQ ID NO: 3208135 - RNA, 22 nt, Mycobacterium bovis subsp bovis AF2122/97
cgccgaucagcgaaccaccggc

SEQ ID NO: 3208136 - RNA, 23 nt, Mycobacterium bovis subsp bovis AF2122/97
cgccgaucagcgaaccaccggcg

SEQ ID NO: 3208137 - RNA, 13 nt, Mycobacterium bovis subsp bovis AF2122/97
cgccgaucccggc

SEQ ID NO: 3208138 - RNA, 14 nt, Mycobacterium bovis subsp bovis AF2122/97
cgccgaucccggcg

SEQ ID NO: 3208139 - RNA, 16 nt, Mycobacterium bovis subsp bovis AF2122/97
cgccgaucccgucggg

SEQ ID NO: 3208140 - RNA, 20 nt, Mycobacterium bovis subsp bovis AF2122/97
cgccgaucccgucgggcaca

SEQ ID NO: 3208141 - RNA, 12 nt, Mycobacterium bovis subsp bovis AF2122/97
cgccgauccggu

SEQ ID NO: 3208142 - RNA, 21 nt, Mycobacterium bovis subsp bovis AF2122/97
cgccgauccgguggcuggccg

SEQ ID NO: 3208143 - RNA, 20 nt, Mycobacterium bovis subsp bovis AF2122/97
cgccgaucgaaccgcugcuc

SEQ ID NO: 3208144 - RNA, 15 nt, Mycobacterium bovis subsp bovis AF2122/97
cgccgaucgacaccc

SEQ ID NO: 3208145 - RNA, 13 nt, Mycobacterium bovis subsp bovis AF2122/97
cgccgaucgagac

SEQ ID NO: 3208146 - RNA, 16 nt, Mycobacterium bovis subsp bovis AF2122/97
cgccgaucgcggcggc

SEQ ID NO: 3208147 - RNA, 15 nt, Mycobacterium bovis subsp bovis AF2122/97
cgccgaucggccaca

SEQ ID NO: 3208148 - RNA, 21 nt, Mycobacterium bovis subsp bovis AF2122/97
cgccgaucgggcuucggccag

SEQ ID NO: 3208149 - RNA, 18 nt, Mycobacterium bovis subsp bovis AF2122/97
cgccgaucuucgcgcgcu

SEQ ID NO: 3208150 - RNA, 16 nt, Mycobacterium bovis subsp bovis AF2122/97
cgccgaugaugcggcg

SEQ ID NO: 3208151 - RNA, 18 nt, Mycobacterium bovis subsp bovis AF2122/97
cgccgaugaugcggcgca

SEQ ID NO: 3208152 - RNA, 20 nt, Mycobacterium bovis subsp bovis AF2122/97
cgccgaugaugcggcgcagc

SEQ ID NO: 3208153 - RNA, 21 nt, Mycobacterium bovis subsp bovis AF2122/97
cgccgaugaugcggcgcagcg

SEQ ID NO: 3208154 - RNA, 17 nt, Mycobacterium bovis subsp bovis AF2122/97
cgccgaugauggacacc

SEQ ID NO: 3208155 - RNA, 22 nt, Mycobacterium bovis subsp bovis AF2122/97
cgccgaugaugugcggugaccg

SEQ ID NO: 3208156 - RNA, 16 nt, Mycobacterium bovis subsp bovis AF2122/97
cgccgaugccaccgcu

SEQ ID NO: 3208157 - RNA, 21 nt, Mycobacterium bovis subsp bovis AF2122/97
cgccgaugcccgacaccgccc

SEQ ID NO: 3208158 - RNA, 11 nt, Mycobacterium bovis subsp bovis AF2122/97
cgccgaugccg

SEQ ID NO: 3208159 - RNA, 15 nt, Mycobacterium bovis subsp bovis AF2122/97
cgccgaugccgaugc

SEQ ID NO: 3208160 - RNA, 14 nt, Mycobacterium bovis subsp bovis AF2122/97
cgccgaugccgccg

SEQ ID NO: 3208161 - RNA, 13 nt, Mycobacterium bovis subsp bovis AF2122/97
cgccgaugccggc

SEQ ID NO: 3208162 - RNA, 14 nt, Mycobacterium bovis subsp bovis AF2122/97
cgccgaugcugccg

SEQ ID NO: 3208163 - RNA, 16 nt, Mycobacterium bovis subsp bovis AF2122/97
cgccgaugcugccgcc

SEQ ID NO: 3208164 - RNA, 17 nt, Mycobacterium bovis subsp bovis AF2122/97
cgccgaugcugccgccg

SEQ ID NO: 3208165 - RNA, 18 nt, Mycobacterium bovis subsp bovis AF2122/97
cgccgaugcugccgccgc

SEQ ID NO: 3208166 - RNA, 20 nt, Mycobacterium bovis subsp bovis AF2122/97
cgccgaugcugccgccgccg

SEQ ID NO: 3208167 - RNA, 15 nt, Mycobacterium bovis subsp bovis AF2122/97
cgccgaugucgacga

SEQ ID NO: 3208168 - RNA, 13 nt, Mycobacterium bovis subsp bovis AF2122/97
cgccgauguggcc

SEQ ID NO: 3208169 - RNA, 15 nt, Mycobacterium bovis subsp bovis AF2122/97
cgccgauguggccgg

SEQ ID NO: 3208170 - RNA, 21 nt, Mycobacterium bovis subsp bovis AF2122/97
cgccgauguggucggcuguca

SEQ ID NO: 3208171 - RNA, 13 nt, Mycobacterium bovis subsp bovis AF2122/97
cgccgauuccacc

SEQ ID NO: 3208172 - RNA, 17 nt, Mycobacterium bovis subsp bovis AF2122/97
cgccgauuccaccgccg

SEQ ID NO: 3208173 - RNA, 18 nt, Mycobacterium bovis subsp bovis AF2122/97
cgccgauuccaccgccga

SEQ ID NO: 3208174 - RNA, 21 nt, Mycobacterium bovis subsp bovis AF2122/97
cgccgauuccaccgccgacgc

SEQ ID NO: 3208175 - RNA, 23 nt, Mycobacterium bovis subsp bovis AF2122/97
cgccgauuccaccgccgacgccc

SEQ ID NO: 3208176 - RNA, 14 nt, Mycobacterium bovis subsp bovis AF2122/97
cgccgauucgccgu

SEQ ID NO: 3208177 - RNA, 16 nt, Mycobacterium bovis subsp bovis AF2122/97
cgccgauucgccgucg

SEQ ID NO: 3208178 - RNA, 19 nt, Mycobacterium bovis subsp bovis AF2122/97
cgccgauuuggccgucauc

SEQ ID NO: 3208179 - RNA, 23 nt, Mycobacterium bovis subsp bovis AF2122/97
cgccgauuuggccgucaucuccg

SEQ ID NO: 3208180 - RNA, 13 nt, Mycobacterium bovis subsp bovis AF2122/97
cgccgcaaccgcc

SEQ ID NO: 3208181 - RNA, 19 nt, Mycobacterium bovis subsp bovis AF2122/97
cgccgcaaccgccgcguca

SEQ ID NO: 3208182 - RNA, 22 nt, Mycobacterium bovis subsp bovis AF2122/97
cgccgcaagugucuccggcaac

SEQ ID NO: 3208183 - RNA, 22 nt, Mycobacterium bovis subsp bovis AF2122/97
cgccgcaaguucacccaucauc

SEQ ID NO: 3208184 - RNA, 23 nt, Mycobacterium bovis subsp bovis AF2122/97
cgccgcaaguucacccaucaucg

SEQ ID NO: 3208185 - RNA, 17 nt, Mycobacterium bovis subsp bovis AF2122/97
cgccgcaaucagacggc

SEQ ID NO: 3208186 - RNA, 19 nt, Mycobacterium bovis subsp bovis AF2122/97
cgccgcaaucagacggcga

SEQ ID NO: 3208187 - RNA, 15 nt, Mycobacterium bovis subsp bovis AF2122/97
cgccgcaaugacguc

SEQ ID NO: 3208188 - RNA, 16 nt, Mycobacterium bovis subsp bovis AF2122/97
cgccgcaaugacgucg

SEQ ID NO: 3208189 - RNA, 20 nt, Mycobacterium bovis subsp bovis AF2122/97
cgccgcaaugacgucgucgg

SEQ ID NO: 3208190 - RNA, 21 nt, Mycobacterium bovis subsp bovis AF2122/97
cgccgcaauggaccgaacgac

SEQ ID NO: 3208191 - RNA, 21 nt, Mycobacterium bovis subsp bovis AF2122/97
cgccgcacagaaaacgauggu

SEQ ID NO: 3208192 - RNA, 23 nt, Mycobacterium bovis subsp bovis AF2122/97
cgccgcacaucugcgggacgucg

SEQ ID NO: 3208193 - RNA, 19 nt, Mycobacterium bovis subsp bovis AF2122/97
cgccgcacauuggugucca

SEQ ID NO: 3208194 - RNA, 12 nt, Mycobacterium bovis subsp bovis AF2122/97
cgccgcacccgg

SEQ ID NO: 3208195 - RNA, 21 nt, Mycobacterium bovis subsp bovis AF2122/97
cgccgcacccgggacguuguc

SEQ ID NO: 3208196 - RNA, 13 nt, Mycobacterium bovis subsp bovis AF2122/97
cgccgcaccgccg

SEQ ID NO: 3208197 - RNA, 16 nt, Mycobacterium bovis subsp bovis AF2122/97
cgccgcaccgccgcau

SEQ ID NO: 3208198 - RNA, 19 nt, Mycobacterium bovis subsp bovis AF2122/97
cgccgcaccggaucaccgc

SEQ ID NO: 3208199 - RNA, 14 nt, Mycobacterium bovis subsp bovis AF2122/97
cgccgcacgccgac

SEQ ID NO: 3208200 - RNA, 16 nt, Mycobacterium bovis subsp bovis AF2122/97
cgccgcacgccgaccg

SEQ ID NO: 3208201 - RNA, 14 nt, Mycobacterium bovis subsp bovis AF2122/97
cgccgcacgccggc

SEQ ID NO: 3208202 - RNA, 21 nt, Mycobacterium bovis subsp bovis AF2122/97
cgccgcacgccggcaugccag

SEQ ID NO: 3208203 - RNA, 22 nt, Mycobacterium bovis subsp bovis AF2122/97
cgccgcacgccggcaugccagc

SEQ ID NO: 3208204 - RNA, 16 nt, Mycobacterium bovis subsp bovis AF2122/97
cgccgcacgcuagccg

SEQ ID NO: 3208205 - RNA, 23 nt, Mycobacterium bovis subsp bovis AF2122/97
cgccgcacgcuagccgacagcuc

SEQ ID NO: 3208206 - RNA, 12 nt, Mycobacterium bovis subsp bovis AF2122/97
cgccgcacggcg

SEQ ID NO: 3208207 - RNA, 14 nt, Mycobacterium bovis subsp bovis AF2122/97
cgccgcagacgccg

SEQ ID NO: 3208208 - RNA, 21 nt, Mycobacterium bovis subsp bovis AF2122/97
cgccgcagagcaccgcgaaca

SEQ ID NO: 3208209 - RNA, 19 nt, Mycobacterium bovis subsp bovis AF2122/97
cgccgcagaucaccgccag

SEQ ID NO: 3208210 - RNA, 13 nt, Mycobacterium bovis subsp bovis AF2122/97
cgccgcagauggg

SEQ ID NO: 3208211 - RNA, 18 nt, Mycobacterium bovis subsp bovis AF2122/97
cgccgcagaugggccucc

SEQ ID NO: 3208212 - RNA, 19 nt, Mycobacterium bovis subsp bovis AF2122/97
cgccgcagaugggccucca

SEQ ID NO: 3208213 - RNA, 21 nt, Mycobacterium bovis subsp bovis AF2122/97
cgccgcagaugggccuccacc

SEQ ID NO: 3208214 - RNA, 13 nt, Mycobacterium bovis subsp bovis AF2122/97
cgccgcagcaggu

SEQ ID NO: 3208215 - RNA, 23 nt, Mycobacterium bovis subsp bovis AF2122/97
cgccgcagcaggugcaucgccac

SEQ ID NO: 3208216 - RNA, 19 nt, Mycobacterium bovis subsp bovis AF2122/97
cgccgcagcgaaaacccgg

SEQ ID NO: 3208217 - RNA, 16 nt, Mycobacterium bovis subsp bovis AF2122/97
cgccgcagcgcucgcg

SEQ ID NO: 3208218 - RNA, 13 nt, Mycobacterium bovis subsp bovis AF2122/97
cgccgcagcgucc

SEQ ID NO: 3208219 - RNA, 17 nt, Mycobacterium bovis subsp bovis AF2122/97
cgccgcagcgucguaac

SEQ ID NO: 3208220 - RNA, 16 nt, Mycobacterium bovis subsp bovis AF2122/97
cgccgcagcuccccga

SEQ ID NO: 3208221 - RNA, 20 nt, Mycobacterium bovis subsp bovis AF2122/97
cgccgcagcuccccgaccga

SEQ ID NO: 3208222 - RNA, 22 nt, Mycobacterium bovis subsp bovis AF2122/97
cgccgcagcuccccgaccgaac

SEQ ID NO: 3208223 - RNA, 13 nt, Mycobacterium bovis subsp bovis AF2122/97
cgccgcagggccg

SEQ ID NO: 3208224 - RNA, 14 nt, Mycobacterium bovis subsp bovis AF2122/97
cgccgcagggccgc

SEQ ID NO: 3208225 - RNA, 18 nt, Mycobacterium bovis subsp bovis AF2122/97
cgccgcagggccgcgcgc

SEQ ID NO: 3208226 - RNA, 19 nt, Mycobacterium bovis subsp bovis AF2122/97
cgccgcagggccgcgcgca

SEQ ID NO: 3208227 - RNA, 15 nt, Mycobacterium bovis subsp bovis AF2122/97
cgccgcaguggaugc

SEQ ID NO: 3208228 - RNA, 16 nt, Mycobacterium bovis subsp bovis AF2122/97
cgccgcaguggaugca

SEQ ID NO: 3208229 - RNA, 22 nt, Mycobacterium bovis subsp bovis AF2122/97
cgccgcaucauagacagggccg

SEQ ID NO: 3208230 - RNA, 22 nt, Mycobacterium bovis subsp bovis AF2122/97
cgccgcauccagccgugcggcg

SEQ ID NO: 3208231 - RNA, 14 nt, Mycobacterium bovis subsp bovis AF2122/97
cgccgcaucggcga

SEQ ID NO: 3208232 - RNA, 16 nt, Mycobacterium bovis subsp bovis AF2122/97
cgccgcaucggcgaac

SEQ ID NO: 3208233 - RNA, 14 nt, Mycobacterium bovis subsp bovis AF2122/97
cgccgcaucggcgg

SEQ ID NO: 3208234 - RNA, 15 nt, Mycobacterium bovis subsp bovis AF2122/97
cgccgcaucggcggg

SEQ ID NO: 3208235 - RNA, 16 nt, Mycobacterium bovis subsp bovis AF2122/97
cgccgcaucggcgggu

SEQ ID NO: 3208236 - RNA, 17 nt, Mycobacterium bovis subsp bovis AF2122/97
cgccgcaucggcggguc

SEQ ID NO: 3208237 - RNA, 16 nt, Mycobacterium bovis subsp bovis AF2122/97
cgccgcaucguuuucg

SEQ ID NO: 3208238 - RNA, 20 nt, Mycobacterium bovis subsp bovis AF2122/97
cgccgcaucguuuucgccga

SEQ ID NO: 3208239 - RNA, 22 nt, Mycobacterium bovis subsp bovis AF2122/97
cgccgcauggugggugccggcg

SEQ ID NO: 3208240 - RNA, 21 nt, Mycobacterium bovis subsp bovis AF2122/97
cgccgcauugcagaaccgcca

SEQ ID NO: 3208241 - RNA, 23 nt, Mycobacterium bovis subsp bovis AF2122/97
cgccgcauugcagaaccgccaac

SEQ ID NO: 3208242 - RNA, 18 nt, Mycobacterium bovis subsp bovis AF2122/97
cgccgccaagcucggcca

SEQ ID NO: 3208243 - RNA, 19 nt, Mycobacterium bovis subsp bovis AF2122/97
cgccgccaagcucggccac

SEQ ID NO: 3208244 - RNA, 20 nt, Mycobacterium bovis subsp bovis AF2122/97
cgccgccaagcucggccacc

SEQ ID NO: 3208245 - RNA, 21 nt, Mycobacterium bovis subsp bovis AF2122/97
cgccgccaagcucggccacca

SEQ ID NO: 3208246 - RNA, 23 nt, Mycobacterium bovis subsp bovis AF2122/97
cgccgccaagcucggccaccagc

SEQ ID NO: 3208247 - RNA, 19 nt, Mycobacterium bovis subsp bovis AF2122/97
cgccgccacagcacccacg

SEQ ID NO: 3208248 - RNA, 20 nt, Mycobacterium bovis subsp bovis AF2122/97
cgccgccacagcacccacgc

SEQ ID NO: 3208249 - RNA, 14 nt, Mycobacterium bovis subsp bovis AF2122/97
cgccgccaccaccc

SEQ ID NO: 3208250 - RNA, 21 nt, Mycobacterium bovis subsp bovis AF2122/97
cgccgccaccacccaacagcc

SEQ ID NO: 3208251 - RNA, 21 nt, Mycobacterium bovis subsp bovis AF2122/97
cgccgccaccaccgcugccgg

SEQ ID NO: 3208252 - RNA, 22 nt, Mycobacterium bovis subsp bovis AF2122/97
cgccgccaccaccgcugccggc

SEQ ID NO: 3208253 - RNA, 13 nt, Mycobacterium bovis subsp bovis AF2122/97
cgccgccaccagc

SEQ ID NO: 3208254 - RNA, 14 nt, Mycobacterium bovis subsp bovis AF2122/97
cgccgccaccagcg

SEQ ID NO: 3208255 - RNA, 15 nt, Mycobacterium bovis subsp bovis AF2122/97
cgccgccaccagcgc

SEQ ID NO: 3208256 - RNA, 19 nt, Mycobacterium bovis subsp bovis AF2122/97
cgccgccaccagcgcacgc

SEQ ID NO: 3208257 - RNA, 20 nt, Mycobacterium bovis subsp bovis AF2122/97
cgccgccaccagcugcgcga

SEQ ID NO: 3208258 - RNA, 23 nt, Mycobacterium bovis subsp bovis AF2122/97
cgccgccaccagcugcgcgaugu

SEQ ID NO: 3208259 - RNA, 14 nt, Mycobacterium bovis subsp bovis AF2122/97
cgccgccaccccgc

SEQ ID NO: 3208260 - RNA, 22 nt, Mycobacterium bovis subsp bovis AF2122/97
cgccgccaccccgcgcgccagc

SEQ ID NO: 3208261 - RNA, 13 nt, Mycobacterium bovis subsp bovis AF2122/97
cgccgccacccgg

SEQ ID NO: 3208262 - RNA, 15 nt, Mycobacterium bovis subsp bovis AF2122/97
cgccgccacccggcg

SEQ ID NO: 3208263 - RNA, 20 nt, Mycobacterium bovis subsp bovis AF2122/97
cgccgccacccggcgggcgg

SEQ ID NO: 3208264 - RNA, 12 nt, Mycobacterium bovis subsp bovis AF2122/97
cgccgccaccga

SEQ ID NO: 3208265 - RNA, 21 nt, Mycobacterium bovis subsp bovis AF2122/97
cgccgccaccgaagccgccgg

SEQ ID NO: 3208266 - RNA, 13 nt, Mycobacterium bovis subsp bovis AF2122/97
cgccgccaccggc

SEQ ID NO: 3208267 - RNA, 14 nt, Mycobacterium bovis subsp bovis AF2122/97
cgccgccaccggcg

SEQ ID NO: 3208268 - RNA, 15 nt, Mycobacterium bovis subsp bovis AF2122/97
cgccgccaccggcgc

SEQ ID NO: 3208269 - RNA, 16 nt, Mycobacterium bovis subsp bovis AF2122/97
cgccgccaccggcgcc

SEQ ID NO: 3208270 - RNA, 17 nt, Mycobacterium bovis subsp bovis AF2122/97
cgccgccaccggcgccg

SEQ ID NO: 3208271 - RNA, 19 nt, Mycobacterium bovis subsp bovis AF2122/97
cgccgccacggaucgcggc

SEQ ID NO: 3208272 - RNA, 22 nt, Mycobacterium bovis subsp bovis AF2122/97
cgccgccacggaucgcggcggc

SEQ ID NO: 3208273 - RNA, 19 nt, Mycobacterium bovis subsp bovis AF2122/97
cgccgccacgggugacgaa

SEQ ID NO: 3208274 - RNA, 13 nt, Mycobacterium bovis subsp bovis AF2122/97
cgccgccagauga

SEQ ID NO: 3208275 - RNA, 12 nt, Mycobacterium bovis subsp bovis AF2122/97
cgccgccagcac

SEQ ID NO: 3208276 - RNA, 19 nt, Mycobacterium bovis subsp bovis AF2122/97
cgccgccagcaccaccggc

SEQ ID NO: 3208277 - RNA, 16 nt, Mycobacterium bovis subsp bovis AF2122/97
cgccgccagcaccucg

SEQ ID NO: 3208278 - RNA, 14 nt, Mycobacterium bovis subsp bovis AF2122/97
cgccgccagccugg

SEQ ID NO: 3208279 - RNA, 12 nt, Mycobacterium bovis subsp bovis AF2122/97
cgccgccagcgc

SEQ ID NO: 3208280 - RNA, 19 nt, Mycobacterium bovis subsp bovis AF2122/97
cgccgccagcgccgccggc

SEQ ID NO: 3208281 - RNA, 13 nt, Mycobacterium bovis subsp bovis AF2122/97
cgccgccagcgcg

SEQ ID NO: 3208282 - RNA, 17 nt, Mycobacterium bovis subsp bovis AF2122/97
cgccgccagcgcggugu

SEQ ID NO: 3208283 - RNA, 17 nt, Mycobacterium bovis subsp bovis AF2122/97
cgccgccagguccgccg

SEQ ID NO: 3208284 - RNA, 19 nt, Mycobacterium bovis subsp bovis AF2122/97
cgccgccagguccgccggu

SEQ ID NO: 3208285 - RNA, 20 nt, Mycobacterium bovis subsp bovis AF2122/97
cgccgccagguguucgccgg

SEQ ID NO: 3208286 - RNA, 16 nt, Mycobacterium bovis subsp bovis AF2122/97
cgccgccaguccggac

SEQ ID NO: 3208287 - RNA, 20 nt, Mycobacterium bovis subsp bovis AF2122/97
cgccgccaguccggacggca

SEQ ID NO: 3208288 - RNA, 22 nt, Mycobacterium bovis subsp bovis AF2122/97
cgccgccaguccggacggcagc

SEQ ID NO: 3208289 - RNA, 17 nt, Mycobacterium bovis subsp bovis AF2122/97
cgccgccagucguccuc

SEQ ID NO: 3208290 - RNA, 13 nt, Mycobacterium bovis subsp bovis AF2122/97
cgccgccaucacg

SEQ ID NO: 3208291 - RNA, 15 nt, Mycobacterium bovis subsp bovis AF2122/97
cgccgccaucacgca

SEQ ID NO: 3208292 - RNA, 13 nt, Mycobacterium bovis subsp bovis AF2122/97
cgccgccaucagc

SEQ ID NO: 3208293 - RNA, 17 nt, Mycobacterium bovis subsp bovis AF2122/97
cgccgccauugccgccg

SEQ ID NO: 3208294 - RNA, 19 nt, Mycobacterium bovis subsp bovis AF2122/97
cgccgccauugccgccggu

SEQ ID NO: 3208295 - RNA, 21 nt, Mycobacterium bovis subsp bovis AF2122/97
cgccgccauugccgccggugc

SEQ ID NO: 3208296 - RNA, 15 nt, Mycobacterium bovis subsp bovis AF2122/97
cgccgccauuggaca

SEQ ID NO: 3208297 - RNA, 20 nt, Mycobacterium bovis subsp bovis AF2122/97
cgccgccauugucgccaaau

SEQ ID NO: 3208298 - RNA, 14 nt, Mycobacterium bovis subsp bovis AF2122/97
cgccgcccagcauc

SEQ ID NO: 3208299 - RNA, 22 nt, Mycobacterium bovis subsp bovis AF2122/97
cgccgcccagcaucucggcggc

SEQ ID NO: 3208300 - RNA, 12 nt, Mycobacterium bovis subsp bovis AF2122/97
cgccgcccagcg

SEQ ID NO: 3208301 - RNA, 14 nt, Mycobacterium bovis subsp bovis AF2122/97
cgccgcccagcgga

SEQ ID NO: 3208302 - RNA, 22 nt, Mycobacterium bovis subsp bovis AF2122/97
cgccgccccauacuugcgccga

SEQ ID NO: 3208303 - RNA, 15 nt, Mycobacterium bovis subsp bovis AF2122/97
cgccgcccccgccgg

SEQ ID NO: 3208304 - RNA, 13 nt, Mycobacterium bovis subsp bovis AF2122/97
cgccgccccgaua

SEQ ID NO: 3208305 - RNA, 13 nt, Mycobacterium bovis subsp bovis AF2122/97
cgccgccccgcuc

SEQ ID NO: 3208306 - RNA, 14 nt, Mycobacterium bovis subsp bovis AF2122/97
cgccgccccgcucg

SEQ ID NO: 3208307 - RNA, 16 nt, Mycobacterium bovis subsp bovis AF2122/97
cgccgccccgcucggu

SEQ ID NO: 3208308 - RNA, 13 nt, Mycobacterium bovis subsp bovis AF2122/97
cgccgccccggcg

SEQ ID NO: 3208309 - RNA, 16 nt, Mycobacterium bovis subsp bovis AF2122/97
cgccgccccggcgcug

SEQ ID NO: 3208310 - RNA, 21 nt, Mycobacterium bovis subsp bovis AF2122/97
cgccgccccggcgcuggugcg

SEQ ID NO: 3208311 - RNA, 19 nt, Mycobacterium bovis subsp bovis AF2122/97
cgccgccccugcgcggcca

SEQ ID NO: 3208312 - RNA, 15 nt, Mycobacterium bovis subsp bovis AF2122/97
cgccgcccgcagggc

SEQ ID NO: 3208313 - RNA, 19 nt, Mycobacterium bovis subsp bovis AF2122/97
cgccgcccgcagggccgcc

SEQ ID NO: 3208314 - RNA, 21 nt, Mycobacterium bovis subsp bovis AF2122/97
cgccgcccgcagggccgccgc

SEQ ID NO: 3208315 - RNA, 18 nt, Mycobacterium bovis subsp bovis AF2122/97
cgccgcccgcaucgcggc

SEQ ID NO: 3208316 - RNA, 14 nt, Mycobacterium bovis subsp bovis AF2122/97
cgccgcccgcgcca

SEQ ID NO: 3208317 - RNA, 22 nt, Mycobacterium bovis subsp bovis AF2122/97
cgccgcccgcuccuccggcacc

SEQ ID NO: 3208318 - RNA, 15 nt, Mycobacterium bovis subsp bovis AF2122/97
cgccgcccgcugggc

SEQ ID NO: 3208319 - RNA, 12 nt, Mycobacterium bovis subsp bovis AF2122/97
cgccgcccggcg

SEQ ID NO: 3208320 - RNA, 15 nt, Mycobacterium bovis subsp bovis AF2122/97
cgccgcccggcguau

SEQ ID NO: 3208321 - RNA, 16 nt, Mycobacterium bovis subsp bovis AF2122/97
cgccgcccgugccgcc

SEQ ID NO: 3208322 - RNA, 19 nt, Mycobacterium bovis subsp bovis AF2122/97
cgccgcccgugccgcccuc

SEQ ID NO: 3208323 - RNA, 15 nt, Mycobacterium bovis subsp bovis AF2122/97
cgccgcccuccgacg

SEQ ID NO: 3208324 - RNA, 16 nt, Mycobacterium bovis subsp bovis AF2122/97
cgccgcccuccgacgg

SEQ ID NO: 3208325 - RNA, 17 nt, Mycobacterium bovis subsp bovis AF2122/97
cgccgcccuccgacggg

SEQ ID NO: 3208326 - RNA, 19 nt, Mycobacterium bovis subsp bovis AF2122/97
cgccgcccuggccgccggc

SEQ ID NO: 3208327 - RNA, 21 nt, Mycobacterium bovis subsp bovis AF2122/97
cgccgcccuggccgccggccc

SEQ ID NO: 3208328 - RNA, 23 nt, Mycobacterium bovis subsp bovis AF2122/97
cgccgcccuggccgccggccccg

SEQ ID NO: 3208329 - RNA, 15 nt, Mycobacterium bovis subsp bovis AF2122/97
cgccgcccuguccgg

SEQ ID NO: 3208330 - RNA, 19 nt, Mycobacterium bovis subsp bovis AF2122/97
cgccgcccuugccgccggc

SEQ ID NO: 3208331 - RNA, 23 nt, Mycobacterium bovis subsp bovis AF2122/97
cgccgcccuugccgccggccccg

SEQ ID NO: 3208332 - RNA, 19 nt, Mycobacterium bovis subsp bovis AF2122/97
cgccgccgaaaaccucgcc

SEQ ID NO: 3208333 - RNA, 18 nt, Mycobacterium bovis subsp bovis AF2122/97
cgccgccgacaaucacca

SEQ ID NO: 3208334 - RNA, 16 nt, Mycobacterium bovis subsp bovis AF2122/97
cgccgccgacgaaggc

SEQ ID NO: 3208335 - RNA, 22 nt, Mycobacterium bovis subsp bovis AF2122/97
cgccgccgacggaucgcccuga

SEQ ID NO: 3208336 - RNA, 19 nt, Mycobacterium bovis subsp bovis AF2122/97
cgccgccgagauuggugca

SEQ ID NO: 3208337 - RNA, 14 nt, Mycobacterium bovis subsp bovis AF2122/97
cgccgccgaucacc

SEQ ID NO: 3208338 - RNA, 13 nt, Mycobacterium bovis subsp bovis AF2122/97
cgccgccgaugcc

SEQ ID NO: 3208339 - RNA, 14 nt, Mycobacterium bovis subsp bovis AF2122/97
cgccgccgccaccg

SEQ ID NO: 3208340 - RNA, 13 nt, Mycobacterium bovis subsp bovis AF2122/97
cgccgccgccacg

SEQ ID NO: 3208341 - RNA, 16 nt, Mycobacterium bovis subsp bovis AF2122/97
cgccgccgccaucgcc

SEQ ID NO: 3208342 - RNA, 17 nt, Mycobacterium bovis subsp bovis AF2122/97
cgccgccgccaucgccg

SEQ ID NO: 3208343 - RNA, 13 nt, Mycobacterium bovis subsp bovis AF2122/97
cgccgccgcccgu

SEQ ID NO: 3208344 - RNA, 15 nt, Mycobacterium bovis subsp bovis AF2122/97
cgccgccgccgacga

SEQ ID NO: 3208345 - RNA, 14 nt, Mycobacterium bovis subsp bovis AF2122/97
cgccgccgccgcca

SEQ ID NO: 3208346 - RNA, 13 nt, Mycobacterium bovis subsp bovis AF2122/97
cgccgccgccggc

SEQ ID NO: 3208347 - RNA, 16 nt, Mycobacterium bovis subsp bovis AF2122/97
cgccgccgccggcgcc

SEQ ID NO: 3208348 - RNA, 12 nt, Mycobacterium bovis subsp bovis AF2122/97
cgccgccgcgac

SEQ ID NO: 3208349 - RNA, 13 nt, Mycobacterium bovis subsp bovis AF2122/97
cgccgccgcgacg

SEQ ID NO: 3208350 - RNA, 16 nt, Mycobacterium bovis subsp bovis AF2122/97
cgccgccgcgagcgcc

SEQ ID NO: 3208351 - RNA, 18 nt, Mycobacterium bovis subsp bovis AF2122/97
cgccgccgcgagcgccgg

SEQ ID NO: 3208352 - RNA, 22 nt, Mycobacterium bovis subsp bovis AF2122/97
cgccgccgcgagcgccggccgc

SEQ ID NO: 3208353 - RNA, 13 nt, Mycobacterium bovis subsp bovis AF2122/97
cgccgccgcgggc

SEQ ID NO: 3208354 - RNA, 18 nt, Mycobacterium bovis subsp bovis AF2122/97
cgccgccgcgggcgccgg

SEQ ID NO: 3208355 - RNA, 12 nt, Mycobacterium bovis subsp bovis AF2122/97
cgccgccgcguu

SEQ ID NO: 3208356 - RNA, 16 nt, Mycobacterium bovis subsp bovis AF2122/97
cgccgccgcugccgcc

SEQ ID NO: 3208357 - RNA, 21 nt, Mycobacterium bovis subsp bovis AF2122/97
cgccgccgcuguugaucgaca

SEQ ID NO: 3208358 - RNA, 20 nt, Mycobacterium bovis subsp bovis AF2122/97
cgccgccggaagcgccggcc

SEQ ID NO: 3208359 - RNA, 19 nt, Mycobacterium bovis subsp bovis AF2122/97
cgccgccggacccaccguc

SEQ ID NO: 3208360 - RNA, 22 nt, Mycobacterium bovis subsp bovis AF2122/97
cgccgccggacccaccgucacc

SEQ ID NO: 3208361 - RNA, 12 nt, Mycobacterium bovis subsp bovis AF2122/97
cgccgccggcaa

SEQ ID NO: 3208362 - RNA, 14 nt, Mycobacterium bovis subsp bovis AF2122/97
cgccgccggcaccg

SEQ ID NO: 3208363 - RNA, 15 nt, Mycobacterium bovis subsp bovis AF2122/97
cgccgccggcaccgc

SEQ ID NO: 3208364 - RNA, 18 nt, Mycobacterium bovis subsp bovis AF2122/97
cgccgccggcaccgccgg

SEQ ID NO: 3208365 - RNA, 21 nt, Mycobacterium bovis subsp bovis AF2122/97
cgccgccggcaccgccggcac

SEQ ID NO: 3208366 - RNA, 21 nt, Mycobacterium bovis subsp bovis AF2122/97
cgccgccggcaccgccggcgc

SEQ ID NO: 3208367 - RNA, 13 nt, Mycobacterium bovis subsp bovis AF2122/97
cgccgccggcccc

SEQ ID NO: 3208368 - RNA, 13 nt, Mycobacterium bovis subsp bovis AF2122/97
cgccgccggccgc

SEQ ID NO: 3208369 - RNA, 12 nt, Mycobacterium bovis subsp bovis AF2122/97
cgccgccggcga

SEQ ID NO: 3208370 - RNA, 16 nt, Mycobacterium bovis subsp bovis AF2122/97
cgccgccggcgccacc

SEQ ID NO: 3208371 - RNA, 14 nt, Mycobacterium bovis subsp bovis AF2122/97
cgccgccggcgccg

SEQ ID NO: 3208372 - RNA, 16 nt, Mycobacterium bovis subsp bovis AF2122/97
cgccgccggcgccgcc

SEQ ID NO: 3208373 - RNA, 18 nt, Mycobacterium bovis subsp bovis AF2122/97
cgccgccggcgccgcccg

SEQ ID NO: 3208374 - RNA, 21 nt, Mycobacterium bovis subsp bovis AF2122/97
cgccgccggcgccgccggugc

SEQ ID NO: 3208375 - RNA, 16 nt, Mycobacterium bovis subsp bovis AF2122/97
cgccgccggcgccgga

SEQ ID NO: 3208376 - RNA, 18 nt, Mycobacterium bovis subsp bovis AF2122/97
cgccgccggcgccggcgc

SEQ ID NO: 3208377 - RNA, 19 nt, Mycobacterium bovis subsp bovis AF2122/97
cgccgccggcgccggcgcu

SEQ ID NO: 3208378 - RNA, 13 nt, Mycobacterium bovis subsp bovis AF2122/97
cgccgccggcgcg

SEQ ID NO: 3208379 - RNA, 13 nt, Mycobacterium bovis subsp bovis AF2122/97
cgccgccggcgcu

SEQ ID NO: 3208380 - RNA, 14 nt, Mycobacterium bovis subsp bovis AF2122/97
cgccgccggcgcug

SEQ ID NO: 3208381 - RNA, 15 nt, Mycobacterium bovis subsp bovis AF2122/97
cgccgccggcgcuga

SEQ ID NO: 3208382 - RNA, 12 nt, Mycobacterium bovis subsp bovis AF2122/97
cgccgccggcgg

SEQ ID NO: 3208383 - RNA, 16 nt, Mycobacterium bovis subsp bovis AF2122/97
cgccgccggcggcggu

SEQ ID NO: 3208384 - RNA, 18 nt, Mycobacterium bovis subsp bovis AF2122/97
cgccgccggcggcgguac

SEQ ID NO: 3208385 - RNA, 16 nt, Mycobacterium bovis subsp bovis AF2122/97
cgccgccggcuccggc

SEQ ID NO: 3208386 - RNA, 16 nt, Mycobacterium bovis subsp bovis AF2122/97
cgccgccggcucgccg

SEQ ID NO: 3208387 - RNA, 11 nt, Mycobacterium bovis subsp bovis AF2122/97
cgccgccgggc

SEQ ID NO: 3208388 - RNA, 12 nt, Mycobacterium bovis subsp bovis AF2122/97
cgccgccgggca

SEQ ID NO: 3208389 - RNA, 14 nt, Mycobacterium bovis subsp bovis AF2122/97
cgccgccgggcagu

SEQ ID NO: 3208390 - RNA, 22 nt, Mycobacterium bovis subsp bovis AF2122/97
cgccgccgggucgaacgcaugc

SEQ ID NO: 3208391 - RNA, 22 nt, Mycobacterium bovis subsp bovis AF2122/97
cgccgccggguuuauccagucg

SEQ ID NO: 3208392 - RNA, 14 nt, Mycobacterium bovis subsp bovis AF2122/97
cgccgccggucccc

SEQ ID NO: 3208393 - RNA, 19 nt, Mycobacterium bovis subsp bovis AF2122/97
cgccgccggugccaccggc

SEQ ID NO: 3208394 - RNA, 22 nt, Mycobacterium bovis subsp bovis AF2122/97
cgccgccggugccaccggcugg

SEQ ID NO: 3208395 - RNA, 17 nt, Mycobacterium bovis subsp bovis AF2122/97
cgccgccggugccgccc

SEQ ID NO: 3208396 - RNA, 15 nt, Mycobacterium bovis subsp bovis AF2122/97
cgccgccgucaccgc

SEQ ID NO: 3208397 - RNA, 16 nt, Mycobacterium bovis subsp bovis AF2122/97
cgccgccgucaccgcc

SEQ ID NO: 3208398 - RNA, 18 nt, Mycobacterium bovis subsp bovis AF2122/97
cgccgccguccagcgccg

SEQ ID NO: 3208399 - RNA, 14 nt, Mycobacterium bovis subsp bovis AF2122/97
cgccgccgucggcg

SEQ ID NO: 3208400 - RNA, 14 nt, Mycobacterium bovis subsp bovis AF2122/97
cgccgccgucguac

SEQ ID NO: 3208401 - RNA, 16 nt, Mycobacterium bovis subsp bovis AF2122/97
cgccgccguuaccgcc

SEQ ID NO: 3208402 - RNA, 19 nt, Mycobacterium bovis subsp bovis AF2122/97
cgccgccguucccgccggc

SEQ ID NO: 3208403 - RNA, 21 nt, Mycobacterium bovis subsp bovis AF2122/97
cgccgccguucccgccggcgc

SEQ ID NO: 3208404 - RNA, 12 nt, Mycobacterium bovis subsp bovis AF2122/97
cgccgccguugc

SEQ ID NO: 3208405 - RNA, 15 nt, Mycobacterium bovis subsp bovis AF2122/97
cgccgccguugccga

SEQ ID NO: 3208406 - RNA, 16 nt, Mycobacterium bovis subsp bovis AF2122/97
cgccgccguugccgcc

SEQ ID NO: 3208407 - RNA, 17 nt, Mycobacterium bovis subsp bovis AF2122/97
cgccgccguugccgccg

SEQ ID NO: 3208408 - RNA, 18 nt, Mycobacterium bovis subsp bovis AF2122/97
cgccgccguugccgccgg

SEQ ID NO: 3208409 - RNA, 20 nt, Mycobacterium bovis subsp bovis AF2122/97
cgccgccguugccgccggcg

SEQ ID NO: 3208410 - RNA, 21 nt, Mycobacterium bovis subsp bovis AF2122/97
cgccgccguugccgccggcgc

SEQ ID NO: 3208411 - RNA, 22 nt, Mycobacterium bovis subsp bovis AF2122/97
cgccgccguugccgccggcgcc

SEQ ID NO: 3208412 - RNA, 21 nt, Mycobacterium bovis subsp bovis AF2122/97
cgccgccguugccgccggugu

SEQ ID NO: 3208413 - RNA, 19 nt, Mycobacterium bovis subsp bovis AF2122/97
cgccgccguugccgccguc

SEQ ID NO: 3208414 - RNA, 18 nt, Mycobacterium bovis subsp bovis AF2122/97
cgccgccguuggcucgag

SEQ ID NO: 3208415 - RNA, 23 nt, Mycobacterium bovis subsp bovis AF2122/97
cgccgccguuggcucgagccgcc

SEQ ID NO: 3208416 - RNA, 12 nt, Mycobacterium bovis subsp bovis AF2122/97
cgccgccguugu

SEQ ID NO: 3208417 - RNA, 14 nt, Mycobacterium bovis subsp bovis AF2122/97
cgccgccuccgccg

SEQ ID NO: 3208418 - RNA, 16 nt, Mycobacterium bovis subsp bovis AF2122/97
cgccgccuccgccgag

SEQ ID NO: 3208419 - RNA, 19 nt, Mycobacterium bovis subsp bovis AF2122/97
cgccgccuccgccgaggcc

SEQ ID NO: 3208420 - RNA, 22 nt, Mycobacterium bovis subsp bovis AF2122/97
cgccgccuccgccgaggccgcc

SEQ ID NO: 3208421 - RNA, 14 nt, Mycobacterium bovis subsp bovis AF2122/97
cgccgccugcccgg

SEQ ID NO: 3208422 - RNA, 15 nt, Mycobacterium bovis subsp bovis AF2122/97
cgccgccugcccggc

SEQ ID NO: 3208423 - RNA, 19 nt, Mycobacterium bovis subsp bovis AF2122/97
cgccgccugcccggcccgc

SEQ ID NO: 3208424 - RNA, 20 nt, Mycobacterium bovis subsp bovis AF2122/97
cgccgccugcccggcccgcu

SEQ ID NO: 3208425 - RNA, 13 nt, Mycobacterium bovis subsp bovis AF2122/97
cgccgccugcgca

SEQ ID NO: 3208426 - RNA, 12 nt, Mycobacterium bovis subsp bovis AF2122/97
cgccgccugcuc

SEQ ID NO: 3208427 - RNA, 21 nt, Mycobacterium bovis subsp bovis AF2122/97
cgccgccugcuccucggccag

SEQ ID NO: 3208428 - RNA, 22 nt, Mycobacterium bovis subsp bovis AF2122/97
cgccgccugcuccucggccagc

SEQ ID NO: 3208429 - RNA, 23 nt, Mycobacterium bovis subsp bovis AF2122/97
cgccgccugcuccucggccagcg

SEQ ID NO: 3208430 - RNA, 22 nt, Mycobacterium bovis subsp bovis AF2122/97
cgccgccuggaaaaaguuaccg

SEQ ID NO: 3208431 - RNA, 19 nt, Mycobacterium bovis subsp bovis AF2122/97
cgccgccuggacgccgccg

SEQ ID NO: 3208432 - RNA, 20 nt, Mycobacterium bovis subsp bovis AF2122/97
cgccgccuggacgccgccgg

SEQ ID NO: 3208433 - RNA, 18 nt, Mycobacterium bovis subsp bovis AF2122/97
cgccgccugugcgcggug

SEQ ID NO: 3208434 - RNA, 22 nt, Mycobacterium bovis subsp bovis AF2122/97
cgccgccugugcgcggugacga

SEQ ID NO: 3208435 - RNA, 22 nt, Mycobacterium bovis subsp bovis AF2122/97
cgccgccuuccuggcgggcgcc

SEQ ID NO: 3208436 - RNA, 22 nt, Mycobacterium bovis subsp bovis AF2122/97
cgccgccuucuucucggcgagc

SEQ ID NO: 3208437 - RNA, 16 nt, Mycobacterium bovis subsp bovis AF2122/97
cgccgcgaacuccagc

SEQ ID NO: 3208438 - RNA, 21 nt, Mycobacterium bovis subsp bovis AF2122/97
cgccgcgaacuccagcagccc

SEQ ID NO: 3208439 - RNA, 23 nt, Mycobacterium bovis subsp bovis AF2122/97
cgccgcgaacuccagcagcccgg

SEQ ID NO: 3208440 - RNA, 19 nt, Mycobacterium bovis subsp bovis AF2122/97
cgccgcgaagcgcucggca

SEQ ID NO: 3208441 - RNA, 21 nt, Mycobacterium bovis subsp bovis AF2122/97
cgccgcgaagcgcucggcagc

SEQ ID NO: 3208442 - RNA, 21 nt, Mycobacterium bovis subsp bovis AF2122/97
cgccgcgaaggggugcccggc

SEQ ID NO: 3208443 - RNA, 19 nt, Mycobacterium bovis subsp bovis AF2122/97
cgccgcgaaugucgccgcc

SEQ ID NO: 3208444 - RNA, 20 nt, Mycobacterium bovis subsp bovis AF2122/97
cgccgcgaaugucgccgccu

SEQ ID NO: 3208445 - RNA, 19 nt, Mycobacterium bovis subsp bovis AF2122/97
cgccgcgacaaaucggucg

SEQ ID NO: 3208446 - RNA, 23 nt, Mycobacterium bovis subsp bovis AF2122/97
cgccgcgacaaaucggucgacga

SEQ ID NO: 3208447 - RNA, 22 nt, Mycobacterium bovis subsp bovis AF2122/97
cgccgcgaccacgcaccgcccc

SEQ ID NO: 3208448 - RNA, 14 nt, Mycobacterium bovis subsp bovis AF2122/97
cgccgcgacgaugc

SEQ ID NO: 3208449 - RNA, 20 nt, Mycobacterium bovis subsp bovis AF2122/97
cgccgcgacgcacugccccg

SEQ ID NO: 3208450 - RNA, 13 nt, Mycobacterium bovis subsp bovis AF2122/97
cgccgcgacgugg

SEQ ID NO: 3208451 - RNA, 14 nt, Mycobacterium bovis subsp bovis AF2122/97
cgccgcgacgugga

SEQ ID NO: 3208452 - RNA, 15 nt, Mycobacterium bovis subsp bovis AF2122/97
cgccgcgagagccgg

SEQ ID NO: 3208453 - RNA, 19 nt, Mycobacterium bovis subsp bovis AF2122/97
cgccgcgagagccggcggc

SEQ ID NO: 3208454 - RNA, 14 nt, Mycobacterium bovis subsp bovis AF2122/97
cgccgcgagcgccg

SEQ ID NO: 3208455 - RNA, 17 nt, Mycobacterium bovis subsp bovis AF2122/97
cgccgcgagcgccggcc

SEQ ID NO: 3208456 - RNA, 20 nt, Mycobacterium bovis subsp bovis AF2122/97
cgccgcgaggaugcugagcg

SEQ ID NO: 3208457 - RNA, 23 nt, Mycobacterium bovis subsp bovis AF2122/97
cgccgcgaggaugcugagcgcca

SEQ ID NO: 3208458 - RNA, 15 nt, Mycobacterium bovis subsp bovis AF2122/97
cgccgcgaggcaccg

SEQ ID NO: 3208459 - RNA, 17 nt, Mycobacterium bovis subsp bovis AF2122/97
cgccgcgaggcaccgac

SEQ ID NO: 3208460 - RNA, 13 nt, Mycobacterium bovis subsp bovis AF2122/97
cgccgcgaucagu

SEQ ID NO: 3208461 - RNA, 20 nt, Mycobacterium bovis subsp bovis AF2122/97
cgccgcgaugccacccaaca

SEQ ID NO: 3208462 - RNA, 13 nt, Mycobacterium bovis subsp bovis AF2122/97
cgccgcgauggcg

SEQ ID NO: 3208463 - RNA, 20 nt, Mycobacterium bovis subsp bovis AF2122/97
cgccgcgauggcgguccacc

SEQ ID NO: 3208464 - RNA, 22 nt, Mycobacterium bovis subsp bovis AF2122/97
cgccgcgauggcgguccaccgg

SEQ ID NO: 3208465 - RNA, 15 nt, Mycobacterium bovis subsp bovis AF2122/97
cgccgcgcagccggc

SEQ ID NO: 3208466 - RNA, 16 nt, Mycobacterium bovis subsp bovis AF2122/97
cgccgcgcagccggcc

SEQ ID NO: 3208467 - RNA, 16 nt, Mycobacterium bovis subsp bovis AF2122/97
cgccgcgcauccgcag

SEQ ID NO: 3208468 - RNA, 19 nt, Mycobacterium bovis subsp bovis AF2122/97
cgccgcgcaucgcggccga

SEQ ID NO: 3208469 - RNA, 18 nt, Mycobacterium bovis subsp bovis AF2122/97
cgccgcgcccaccaugau

SEQ ID NO: 3208470 - RNA, 12 nt, Mycobacterium bovis subsp bovis AF2122/97
cgccgcgccccg

SEQ ID NO: 3208471 - RNA, 16 nt, Mycobacterium bovis subsp bovis AF2122/97
cgccgcgccccgcggc

SEQ ID NO: 3208472 - RNA, 17 nt, Mycobacterium bovis subsp bovis AF2122/97
cgccgcgccccgcggca

SEQ ID NO: 3208473 - RNA, 13 nt, Mycobacterium bovis subsp bovis AF2122/97
cgccgcgcccggc

SEQ ID NO: 3208474 - RNA, 16 nt, Mycobacterium bovis subsp bovis AF2122/97
cgccgcgcccggcgcu

SEQ ID NO: 3208475 - RNA, 18 nt, Mycobacterium bovis subsp bovis AF2122/97
cgccgcgccgaaucgcgg

SEQ ID NO: 3208476 - RNA, 20 nt, Mycobacterium bovis subsp bovis AF2122/97
cgccgcgccgauuccaccgc

SEQ ID NO: 3208477 - RNA, 22 nt, Mycobacterium bovis subsp bovis AF2122/97
cgccgcgccgauuccaccgccg

SEQ ID NO: 3208478 - RNA, 16 nt, Mycobacterium bovis subsp bovis AF2122/97
cgccgcgccgcgccgc

SEQ ID NO: 3208479 - RNA, 18 nt, Mycobacterium bovis subsp bovis AF2122/97
cgccgcgccgcgccgccu

SEQ ID NO: 3208480 - RNA, 14 nt, Mycobacterium bovis subsp bovis AF2122/97
cgccgcgccggcac

SEQ ID NO: 3208481 - RNA, 14 nt, Mycobacterium bovis subsp bovis AF2122/97
cgccgcgccggugu

SEQ ID NO: 3208482 - RNA, 14 nt, Mycobacterium bovis subsp bovis AF2122/97
cgccgcgccguccc

SEQ ID NO: 3208483 - RNA, 13 nt, Mycobacterium bovis subsp bovis AF2122/97
cgccgcgccguuc

SEQ ID NO: 3208484 - RNA, 22 nt, Mycobacterium bovis subsp bovis AF2122/97
cgccgcgcgcauuuuucgccag

SEQ ID NO: 3208485 - RNA, 15 nt, Mycobacterium bovis subsp bovis AF2122/97
cgccgcgcgcggcgu

SEQ ID NO: 3208486 - RNA, 14 nt, Mycobacterium bovis subsp bovis AF2122/97
cgccgcgcggcuug

SEQ ID NO: 3208487 - RNA, 12 nt, Mycobacterium bovis subsp bovis AF2122/97
cgccgcgcgggu

SEQ ID NO: 3208488 - RNA, 12 nt, Mycobacterium bovis subsp bovis AF2122/97
cgccgcgcguca

SEQ ID NO: 3208489 - RNA, 13 nt, Mycobacterium bovis subsp bovis AF2122/97
cgccgcgcgucgc

SEQ ID NO: 3208490 - RNA, 15 nt, Mycobacterium bovis subsp bovis AF2122/97
cgccgcgcgucgcga

SEQ ID NO: 3208491 - RNA, 16 nt, Mycobacterium bovis subsp bovis AF2122/97
cgccgcgcgucgcgag

SEQ ID NO: 3208492 - RNA, 18 nt, Mycobacterium bovis subsp bovis AF2122/97
cgccgcgcguuccagcac

SEQ ID NO: 3208493 - RNA, 14 nt, Mycobacterium bovis subsp bovis AF2122/97
cgccgcgcguucgg

SEQ ID NO: 3208494 - RNA, 16 nt, Mycobacterium bovis subsp bovis AF2122/97
cgccgcgcguucggcg

SEQ ID NO: 3208495 - RNA, 18 nt, Mycobacterium bovis subsp bovis AF2122/97
cgccgcgcguucggcgcu

SEQ ID NO: 3208496 - RNA, 20 nt, Mycobacterium bovis subsp bovis AF2122/97
cgccgcgcguucggcgcuga

SEQ ID NO: 3208497 - RNA, 20 nt, Mycobacterium bovis subsp bovis AF2122/97
cgccgcgcucaucugcgcgc

SEQ ID NO: 3208498 - RNA, 13 nt, Mycobacterium bovis subsp bovis AF2122/97
cgccgcgcucgac

SEQ ID NO: 3208499 - RNA, 14 nt, Mycobacterium bovis subsp bovis AF2122/97
cgccgcgcucgacg

SEQ ID NO: 3208500 - RNA, 15 nt, Mycobacterium bovis subsp bovis AF2122/97
cgccgcgcucgacga

SEQ ID NO: 3208501 - RNA, 13 nt, Mycobacterium bovis subsp bovis AF2122/97
cgccgcgcugguc

SEQ ID NO: 3208502 - RNA, 17 nt, Mycobacterium bovis subsp bovis AF2122/97
cgccgcgcuugcgaucg

SEQ ID NO: 3208503 - RNA, 20 nt, Mycobacterium bovis subsp bovis AF2122/97
cgccgcgcuugcgaucgccg

SEQ ID NO: 3208504 - RNA, 22 nt, Mycobacterium bovis subsp bovis AF2122/97
cgccgcgcuugcgaucgccgcu

SEQ ID NO: 3208505 - RNA, 23 nt, Mycobacterium bovis subsp bovis AF2122/97
cgccgcgcuugcgaucgccgcua

SEQ ID NO: 3208506 - RNA, 19 nt, Mycobacterium bovis subsp bovis AF2122/97
cgccgcgcuugcgaucggc

SEQ ID NO: 3208507 - RNA, 14 nt, Mycobacterium bovis subsp bovis AF2122/97
cgccgcggacacca

SEQ ID NO: 3208508 - RNA, 21 nt, Mycobacterium bovis subsp bovis AF2122/97
cgccgcggacucgggcaggcc

SEQ ID NO: 3208509 - RNA, 16 nt, Mycobacterium bovis subsp bovis AF2122/97
cgccgcggcagcguug

SEQ ID NO: 3208510 - RNA, 23 nt, Mycobacterium bovis subsp bovis AF2122/97
cgccgcggcagcguugacgguca

SEQ ID NO: 3208511 - RNA, 13 nt, Mycobacterium bovis subsp bovis AF2122/97
cgccgcggcaggg

SEQ ID NO: 3208512 - RNA, 13 nt, Mycobacterium bovis subsp bovis AF2122/97
cgccgcggccacc

SEQ ID NO: 3208513 - RNA, 15 nt, Mycobacterium bovis subsp bovis AF2122/97
cgccgcggccaccac

SEQ ID NO: 3208514 - RNA, 17 nt, Mycobacterium bovis subsp bovis AF2122/97
cgccgcggccaccaccg

SEQ ID NO: 3208515 - RNA, 17 nt, Mycobacterium bovis subsp bovis AF2122/97
cgccgcggcccgcucca

SEQ ID NO: 3208516 - RNA, 13 nt, Mycobacterium bovis subsp bovis AF2122/97
cgccgcggccgcc

SEQ ID NO: 3208517 - RNA, 18 nt, Mycobacterium bovis subsp bovis AF2122/97
cgccgcggccgccguccc

SEQ ID NO: 3208518 - RNA, 14 nt, Mycobacterium bovis subsp bovis AF2122/97
cgccgcggccggcg

SEQ ID NO: 3208519 - RNA, 15 nt, Mycobacterium bovis subsp bovis AF2122/97
cgccgcggccggcgc

SEQ ID NO: 3208520 - RNA, 12 nt, Mycobacterium bovis subsp bovis AF2122/97
cgccgcggcgcc

SEQ ID NO: 3208521 - RNA, 14 nt, Mycobacterium bovis subsp bovis AF2122/97
cgccgcggcgcccg

SEQ ID NO: 3208522 - RNA, 19 nt, Mycobacterium bovis subsp bovis AF2122/97
cgccgcggcgcccggcgga

SEQ ID NO: 3208523 - RNA, 14 nt, Mycobacterium bovis subsp bovis AF2122/97
cgccgcggcggcag

SEQ ID NO: 3208524 - RNA, 21 nt, Mycobacterium bovis subsp bovis AF2122/97
cgccgcggcuacaucggcggc

SEQ ID NO: 3208525 - RNA, 15 nt, Mycobacterium bovis subsp bovis AF2122/97
cgccgcgggacacca

SEQ ID NO: 3208526 - RNA, 18 nt, Mycobacterium bovis subsp bovis AF2122/97
cgccgcgggacaccaccg

SEQ ID NO: 3208527 - RNA, 23 nt, Mycobacterium bovis subsp bovis AF2122/97
cgccgcgggacaccaccgcccgc

SEQ ID NO: 3208528 - RNA, 23 nt, Mycobacterium bovis subsp bovis AF2122/97
cgccgcgggacagauggcggccg

SEQ ID NO: 3208529 - RNA, 16 nt, Mycobacterium bovis subsp bovis AF2122/97
cgccgcgggcgccggu

SEQ ID NO: 3208530 - RNA, 17 nt, Mycobacterium bovis subsp bovis AF2122/97
cgccgcgggcuccccgg

SEQ ID NO: 3208531 - RNA, 18 nt, Mycobacterium bovis subsp bovis AF2122/97
cgccgcgggcugaccaac

SEQ ID NO: 3208532 - RNA, 13 nt, Mycobacterium bovis subsp bovis AF2122/97
cgccgcgggucgc

SEQ ID NO: 3208533 - RNA, 16 nt, Mycobacterium bovis subsp bovis AF2122/97
cgccgcgggugaucug

SEQ ID NO: 3208534 - RNA, 18 nt, Mycobacterium bovis subsp bovis AF2122/97
cgccgcgguagacgccgc

SEQ ID NO: 3208535 - RNA, 21 nt, Mycobacterium bovis subsp bovis AF2122/97
cgccgcggucggaccacccgg

SEQ ID NO: 3208536 - RNA, 18 nt, Mycobacterium bovis subsp bovis AF2122/97
cgccgcgucauucaccgc

SEQ ID NO: 3208537 - RNA, 19 nt, Mycobacterium bovis subsp bovis AF2122/97
cgccgcgucauucaccgcg

SEQ ID NO: 3208538 - RNA, 19 nt, Mycobacterium bovis subsp bovis AF2122/97
cgccgcgucuaccaaccgg

SEQ ID NO: 3208539 - RNA, 17 nt, Mycobacterium bovis subsp bovis AF2122/97
cgccgcgugcugcggcu

SEQ ID NO: 3208540 - RNA, 16 nt, Mycobacterium bovis subsp bovis AF2122/97
cgccgcguggcuggcg

SEQ ID NO: 3208541 - RNA, 19 nt, Mycobacterium bovis subsp bovis AF2122/97
cgccgcguggcuggcggcg

SEQ ID NO: 3208542 - RNA, 20 nt, Mycobacterium bovis subsp bovis AF2122/97
cgccgcgugguuccggcgug

SEQ ID NO: 3208543 - RNA, 16 nt, Mycobacterium bovis subsp bovis AF2122/97
cgccgcguucagggca

SEQ ID NO: 3208544 - RNA, 17 nt, Mycobacterium bovis subsp bovis AF2122/97
cgccgcuaaccggaccu

SEQ ID NO: 3208545 - RNA, 15 nt, Mycobacterium bovis subsp bovis AF2122/97
cgccgcuaacgcacc

SEQ ID NO: 3208546 - RNA, 19 nt, Mycobacterium bovis subsp bovis AF2122/97
cgccgcuaacgcaccugcg

SEQ ID NO: 3208547 - RNA, 19 nt, Mycobacterium bovis subsp bovis AF2122/97
cgccgcuaauggauccagc

SEQ ID NO: 3208548 - RNA, 13 nt, Mycobacterium bovis subsp bovis AF2122/97
cgccgcuacccca

SEQ ID NO: 3208549 - RNA, 21 nt, Mycobacterium bovis subsp bovis AF2122/97
cgccgcuaccccagccggcag

SEQ ID NO: 3208550 - RNA, 15 nt, Mycobacterium bovis subsp bovis AF2122/97
cgccgcuacccccga

SEQ ID NO: 3208551 - RNA, 14 nt, Mycobacterium bovis subsp bovis AF2122/97
cgccgcuaccgccc

SEQ ID NO: 3208552 - RNA, 16 nt, Mycobacterium bovis subsp bovis AF2122/97
cgccgcuaccgcccgc

SEQ ID NO: 3208553 - RNA, 17 nt, Mycobacterium bovis subsp bovis AF2122/97
cgccgcuaccgcccgcg

SEQ ID NO: 3208554 - RNA, 18 nt, Mycobacterium bovis subsp bovis AF2122/97
cgccgcuaccgcccgcgc

SEQ ID NO: 3208555 - RNA, 20 nt, Mycobacterium bovis subsp bovis AF2122/97
cgccgcuaccgcccgcgcca

SEQ ID NO: 3208556 - RNA, 16 nt, Mycobacterium bovis subsp bovis AF2122/97
cgccgcuaccgccggg

SEQ ID NO: 3208557 - RNA, 17 nt, Mycobacterium bovis subsp bovis AF2122/97
cgccgcuacgccggccc

SEQ ID NO: 3208558 - RNA, 19 nt, Mycobacterium bovis subsp bovis AF2122/97
cgccgcuacgccggcccga

SEQ ID NO: 3208559 - RNA, 18 nt, Mycobacterium bovis subsp bovis AF2122/97
cgccgcuaggugacgccg

SEQ ID NO: 3208560 - RNA, 19 nt, Mycobacterium bovis subsp bovis AF2122/97
cgccgcuaggugacgccgc

SEQ ID NO: 3208561 - RNA, 20 nt, Mycobacterium bovis subsp bovis AF2122/97
cgccgcuaggugacgccgcc

SEQ ID NO: 3208562 - RNA, 21 nt, Mycobacterium bovis subsp bovis AF2122/97
cgccgcuaggugacgccgcca

SEQ ID NO: 3208563 - RNA, 23 nt, Mycobacterium bovis subsp bovis AF2122/97
cgccgcuaggugacgccgccagc

SEQ ID NO: 3208564 - RNA, 23 nt, Mycobacterium bovis subsp bovis AF2122/97
cgccgcuaucgaggaggcggucg

SEQ ID NO: 3208565 - RNA, 19 nt, Mycobacterium bovis subsp bovis AF2122/97
cgccgcucauccagcgcgu

SEQ ID NO: 3208566 - RNA, 23 nt, Mycobacterium bovis subsp bovis AF2122/97
cgccgcucauuagcccccgcggg

SEQ ID NO: 3208567 - RNA, 20 nt, Mycobacterium bovis subsp bovis AF2122/97
cgccgcuccaugacaaaccu

SEQ ID NO: 3208568 - RNA, 13 nt, Mycobacterium bovis subsp bovis AF2122/97
cgccgcucccgca

SEQ ID NO: 3208569 - RNA, 14 nt, Mycobacterium bovis subsp bovis AF2122/97
cgccgcucgguccc

SEQ ID NO: 3208570 - RNA, 16 nt, Mycobacterium bovis subsp bovis AF2122/97
cgccgcugacuccugc

SEQ ID NO: 3208571 - RNA, 17 nt, Mycobacterium bovis subsp bovis AF2122/97
cgccgcugacuccugcg

SEQ ID NO: 3208572 - RNA, 13 nt, Mycobacterium bovis subsp bovis AF2122/97
cgccgcugccauc

SEQ ID NO: 3208573 - RNA, 16 nt, Mycobacterium bovis subsp bovis AF2122/97
cgccgcugccaucugg

SEQ ID NO: 3208574 - RNA, 22 nt, Mycobacterium bovis subsp bovis AF2122/97
cgccgcugccaucuggguccgu

SEQ ID NO: 3208575 - RNA, 13 nt, Mycobacterium bovis subsp bovis AF2122/97
cgccgcugccgau

SEQ ID NO: 3208576 - RNA, 14 nt, Mycobacterium bovis subsp bovis AF2122/97
cgccgcugccgccg

SEQ ID NO: 3208577 - RNA, 17 nt, Mycobacterium bovis subsp bovis AF2122/97
cgccgcugccgccgagc

SEQ ID NO: 3208578 - RNA, 15 nt, Mycobacterium bovis subsp bovis AF2122/97
cgccgcugccgccgg

SEQ ID NO: 3208579 - RNA, 22 nt, Mycobacterium bovis subsp bovis AF2122/97
cgccgcugccgccggugccgcc

SEQ ID NO: 3208580 - RNA, 14 nt, Mycobacterium bovis subsp bovis AF2122/97
cgccgcugccgccu

SEQ ID NO: 3208581 - RNA, 13 nt, Mycobacterium bovis subsp bovis AF2122/97
cgccgcugccgcg

SEQ ID NO: 3208582 - RNA, 14 nt, Mycobacterium bovis subsp bovis AF2122/97
cgccgcugccgcgc

SEQ ID NO: 3208583 - RNA, 24 nt, Mycobacterium bovis subsp bovis AF2122/97
cgccgcugccgcgcggcgagagcc

SEQ ID NO: 3208584 - RNA, 20 nt, Mycobacterium bovis subsp bovis AF2122/97
cgccgcuggagaucacgccg

SEQ ID NO: 3208585 - RNA, 23 nt, Mycobacterium bovis subsp bovis AF2122/97
cgccgcuggagaucacgccgacg

SEQ ID NO: 3208586 - RNA, 13 nt, Mycobacterium bovis subsp bovis AF2122/97
cgccgcuggcaau

SEQ ID NO: 3208587 - RNA, 14 nt, Mycobacterium bovis subsp bovis AF2122/97
cgccgcuggccagc

SEQ ID NO: 3208588 - RNA, 15 nt, Mycobacterium bovis subsp bovis AF2122/97
cgccgcuucacccca

SEQ ID NO: 3208589 - RNA, 20 nt, Mycobacterium bovis subsp bovis AF2122/97
cgccgcuucaccccacuggc

SEQ ID NO: 3208590 - RNA, 16 nt, Mycobacterium bovis subsp bovis AF2122/97
cgccgcuugacgcagc

SEQ ID NO: 3208591 - RNA, 18 nt, Mycobacterium bovis subsp bovis AF2122/97
cgccgcuugacgcagcuc

SEQ ID NO: 3208592 - RNA, 19 nt, Mycobacterium bovis subsp bovis AF2122/97
cgccgcuuggcccggcaaa

SEQ ID NO: 3208593 - RNA, 14 nt, Mycobacterium bovis subsp bovis AF2122/97
cgccgcuuggcgau

SEQ ID NO: 3208594 - RNA, 20 nt, Mycobacterium bovis subsp bovis AF2122/97
cgccgcuuucgccggcgcca

SEQ ID NO: 3208595 - RNA, 18 nt, Mycobacterium bovis subsp bovis AF2122/97
cgccgcuuucuuggcggg

SEQ ID NO: 3208596 - RNA, 20 nt, Mycobacterium bovis subsp bovis AF2122/97
cgccgcuuucuuggcgggcg

SEQ ID NO: 3208597 - RNA, 17 nt, Mycobacterium bovis subsp bovis AF2122/97
cgccggaaagcccgucg

SEQ ID NO: 3208598 - RNA, 16 nt, Mycobacterium bovis subsp bovis AF2122/97
cgccggaacugcgcaa

SEQ ID NO: 3208599 - RNA, 17 nt, Mycobacterium bovis subsp bovis AF2122/97
cgccggaacugcgcaac

SEQ ID NO: 3208600 - RNA, 21 nt, Mycobacterium bovis subsp bovis AF2122/97
cgccggaacugcgcaacaccg

SEQ ID NO: 3208601 - RNA, 19 nt, Mycobacterium bovis subsp bovis AF2122/97
cgccggaagcuucgggaac

SEQ ID NO: 3208602 - RNA, 20 nt, Mycobacterium bovis subsp bovis AF2122/97
cgccggaauacaccagcgac

SEQ ID NO: 3208603 - RNA, 21 nt, Mycobacterium bovis subsp bovis AF2122/97
cgccggaauacaccagcgacg

SEQ ID NO: 3208604 - RNA, 16 nt, Mycobacterium bovis subsp bovis AF2122/97
cgccggacagcgcauc

SEQ ID NO: 3208605 - RNA, 16 nt, Mycobacterium bovis subsp bovis AF2122/97
cgccggaccagcuccu

SEQ ID NO: 3208606 - RNA, 13 nt, Mycobacterium bovis subsp bovis AF2122/97
cgccggacccgcc

SEQ ID NO: 3208607 - RNA, 14 nt, Mycobacterium bovis subsp bovis AF2122/97
cgccggacccgccc

SEQ ID NO: 3208608 - RNA, 16 nt, Mycobacterium bovis subsp bovis AF2122/97
cgccggacccgccggg

SEQ ID NO: 3208609 - RNA, 17 nt, Mycobacterium bovis subsp bovis AF2122/97
cgccggacccgccgggu

SEQ ID NO: 3208610 - RNA, 23 nt, Mycobacterium bovis subsp bovis AF2122/97
cgccggacccggucgccgggacg

SEQ ID NO: 3208611 - RNA, 16 nt, Mycobacterium bovis subsp bovis AF2122/97
cgccggaccggugugg

SEQ ID NO: 3208612 - RNA, 20 nt, Mycobacterium bovis subsp bovis AF2122/97
cgccggacgacaacaggccg

SEQ ID NO: 3208613 - RNA, 21 nt, Mycobacterium bovis subsp bovis AF2122/97
cgccggacgacaacaggccgu

SEQ ID NO: 3208614 - RNA, 13 nt, Mycobacterium bovis subsp bovis AF2122/97
cgccggacgggug

SEQ ID NO: 3208615 - RNA, 20 nt, Mycobacterium bovis subsp bovis AF2122/97
cgccggacgggugcagcgca

SEQ ID NO: 3208616 - RNA, 16 nt, Mycobacterium bovis subsp bovis AF2122/97
cgccggacugcggccc

SEQ ID NO: 3208617 - RNA, 17 nt, Mycobacterium bovis subsp bovis AF2122/97
cgccggacugcggcccg

SEQ ID NO: 3208618 - RNA, 18 nt, Mycobacterium bovis subsp bovis AF2122/97
cgccggacugcggcccga

SEQ ID NO: 3208619 - RNA, 21 nt, Mycobacterium bovis subsp bovis AF2122/97
cgccggacugcggcccgaccc

SEQ ID NO: 3208620 - RNA, 15 nt, Mycobacterium bovis subsp bovis AF2122/97
cgccggagacccggg

SEQ ID NO: 3208621 - RNA, 22 nt, Mycobacterium bovis subsp bovis AF2122/97
cgccggagaucuugcgcaaugc

SEQ ID NO: 3208622 - RNA, 14 nt, Mycobacterium bovis subsp bovis AF2122/97
cgccggagaugaca

SEQ ID NO: 3208623 - RNA, 14 nt, Mycobacterium bovis subsp bovis AF2122/97
cgccggagaugauc

SEQ ID NO: 3208624 - RNA, 22 nt, Mycobacterium bovis subsp bovis AF2122/97
cgccggagaugaucauguggug

SEQ ID NO: 3208625 - RNA, 15 nt, Mycobacterium bovis subsp bovis AF2122/97
cgccggagccaacgg

SEQ ID NO: 3208626 - RNA, 13 nt, Mycobacterium bovis subsp bovis AF2122/97
cgccggagccgcc

SEQ ID NO: 3208627 - RNA, 15 nt, Mycobacterium bovis subsp bovis AF2122/97
cgccggagccgccca

SEQ ID NO: 3208628 - RNA, 19 nt, Mycobacterium bovis subsp bovis AF2122/97
cgccggagccgcccaagcc

SEQ ID NO: 3208629 - RNA, 20 nt, Mycobacterium bovis subsp bovis AF2122/97
cgccggagccgcccaagccg

SEQ ID NO: 3208630 - RNA, 21 nt, Mycobacterium bovis subsp bovis AF2122/97
cgccggaggcaagcaaccggu

SEQ ID NO: 3208631 - RNA, 22 nt, Mycobacterium bovis subsp bovis AF2122/97
cgccggaggcaagcaaccggug

SEQ ID NO: 3208632 - RNA, 14 nt, Mycobacterium bovis subsp bovis AF2122/97
cgccggaggugaca

SEQ ID NO: 3208633 - RNA, 21 nt, Mycobacterium bovis subsp bovis AF2122/97
cgccggagucgacccugccca

SEQ ID NO: 3208634 - RNA, 21 nt, Mycobacterium bovis subsp bovis AF2122/97
cgccggaguugaagaagcccg

SEQ ID NO: 3208635 - RNA, 22 nt, Mycobacterium bovis subsp bovis AF2122/97
cgccggaguugaagaagcccga

SEQ ID NO: 3208636 - RNA, 17 nt, Mycobacterium bovis subsp bovis AF2122/97
cgccggaguuucccuua

SEQ ID NO: 3208637 - RNA, 22 nt, Mycobacterium bovis subsp bovis AF2122/97
cgccaguugcguuguccaccau

SEQ ID NO: 3208638 - RNA, 16 nt, Mycobacterium bovis subsp bovis AF2122/97
cgccaguuugggaucc

SEQ ID NO: 3208639 - RNA, 20 nt, Mycobacterium bovis subsp bovis AF2122/97
cgccaguuugggauccuggc

SEQ ID NO: 3208640 - RNA, 23 nt, Mycobacterium bovis subsp bovis AF2122/97
cgccaguuugggauccuggccga

SEQ ID NO: 3208641 - RNA, 14 nt, Mycobacterium bovis subsp bovis AF2122/97
cgccauaacaccgg

SEQ ID NO: 3208642 - RNA, 15 nt, Mycobacterium bovis subsp bovis AF2122/97
cgccauaacaccggg

SEQ ID NO: 3208643 - RNA, 18 nt, Mycobacterium bovis subsp bovis AF2122/97
cgccauaauauugccgcc

SEQ ID NO: 3208644 - RNA, 20 nt, Mycobacterium bovis subsp bovis AF2122/97
cgccauaauauugccgccuc

SEQ ID NO: 3208645 - RNA, 14 nt, Mycobacterium bovis subsp bovis AF2122/97
cgccauacacaacg

SEQ ID NO: 3208646 - RNA, 16 nt, Mycobacterium bovis subsp bovis AF2122/97
cgccauaccggccgcc

SEQ ID NO: 3208647 - RNA, 13 nt, Mycobacterium bovis subsp bovis AF2122/97
cgccauaccggcu

SEQ ID NO: 3208648 - RNA, 23 nt, Mycobacterium bovis subsp bovis AF2122/97
cgccauaccggcuggccaggugg

SEQ ID NO: 3208649 - RNA, 13 nt, Mycobacterium bovis subsp bovis AF2122/97
cgccauacgucgc

SEQ ID NO: 3208650 - RNA, 21 nt, Mycobacterium bovis subsp bovis AF2122/97
cgccauacgucgccucgagau

SEQ ID NO: 3208651 - RNA, 14 nt, Mycobacterium bovis subsp bovis AF2122/97
cgccauagccgcga

SEQ ID NO: 3208652 - RNA, 21 nt, Mycobacterium bovis subsp bovis AF2122/97
cgccauagccgcgacccgcgc

SEQ ID NO: 3208653 - RNA, 13 nt, Mycobacterium bovis subsp bovis AF2122/97
cgccauagcgggc

SEQ ID NO: 3208654 - RNA, 16 nt, Mycobacterium bovis subsp bovis AF2122/97
cgccauagcgggcggu

SEQ ID NO: 3208655 - RNA, 19 nt, Mycobacterium bovis subsp bovis AF2122/97
cgccaucacaucggccucu

SEQ ID NO: 3208656 - RNA, 12 nt, Mycobacterium bovis subsp bovis AF2122/97
cgccaucacccc

SEQ ID NO: 3208657 - RNA, 13 nt, Mycobacterium bovis subsp bovis AF2122/97
cgccaucaccccg

SEQ ID NO: 3208658 - RNA, 18 nt, Mycobacterium bovis subsp bovis AF2122/97
cgccaucaccgccguuac

SEQ ID NO: 3208659 - RNA, 22 nt, Mycobacterium bovis subsp bovis AF2122/97
cgccaucagaccaaugaccgcc

SEQ ID NO: 3208660 - RNA, 14 nt, Mycobacterium bovis subsp bovis AF2122/97
cgccaucagcccgg

SEQ ID NO: 3208661 - RNA, 18 nt, Mycobacterium bovis subsp bovis AF2122/97
cgccaucagcccggcgcg

SEQ ID NO: 3208662 - RNA, 18 nt, Mycobacterium bovis subsp bovis AF2122/97
cgccaucagcccuucagc

SEQ ID NO: 3208663 - RNA, 12 nt, Mycobacterium bovis subsp bovis AF2122/97
cgccaucagccg

SEQ ID NO: 3208664 - RNA, 16 nt, Mycobacterium bovis subsp bovis AF2122/97
cgccaucagccgcugc

SEQ ID NO: 3208665 - RNA, 17 nt, Mycobacterium bovis subsp bovis AF2122/97
cgccaucagccgcugcg

SEQ ID NO: 3208666 - RNA, 18 nt, Mycobacterium bovis subsp bovis AF2122/97
cgccaucauggcggcccg

SEQ ID NO: 3208667 - RNA, 17 nt, Mycobacterium bovis subsp bovis AF2122/97
cgccauccaugauggcc

SEQ ID NO: 3208668 - RNA, 22 nt, Mycobacterium bovis subsp bovis AF2122/97
cgccauccaugauggccgucag

SEQ ID NO: 3208669 - RNA, 18 nt, Mycobacterium bovis subsp bovis AF2122/97
cgccauccccgccggcgc

SEQ ID NO: 3208670 - RNA, 23 nt, Mycobacterium bovis subsp bovis AF2122/97
cgccauccccgccggcgccaccg

SEQ ID NO: 3208671 - RNA, 18 nt, Mycobacterium bovis subsp bovis AF2122/97
cgccauccccuggccagc

SEQ ID NO: 3208672 - RNA, 19 nt, Mycobacterium bovis subsp bovis AF2122/97
cgccauccccuggccagca

SEQ ID NO: 3208673 - RNA, 16 nt, Mycobacterium bovis subsp bovis AF2122/97
cgccaucccgccgccc

SEQ ID NO: 3208674 - RNA, 17 nt, Mycobacterium bovis subsp bovis AF2122/97
cgccaucccgccgcccg

SEQ ID NO: 3208675 - RNA, 19 nt, Mycobacterium bovis subsp bovis AF2122/97
cgccaucccgccgcccgca

SEQ ID NO: 3208676 - RNA, 21 nt, Mycobacterium bovis subsp bovis AF2122/97
cgccauccuucggggugaaug

SEQ ID NO: 3208677 - RNA, 18 nt, Mycobacterium bovis subsp bovis AF2122/97
cgccaucgccaacaccaa

SEQ ID NO: 3208678 - RNA, 19 nt, Mycobacterium bovis subsp bovis AF2122/97
cgccaucgccgccaaccac

SEQ ID NO: 3208679 - RNA, 14 nt, Mycobacterium bovis subsp bovis AF2122/97
cgccaucgccgccg

SEQ ID NO: 3208680 - RNA, 15 nt, Mycobacterium bovis subsp bovis AF2122/97
cgccaucgccgccgg

SEQ ID NO: 3208681 - RNA, 18 nt, Mycobacterium bovis subsp bovis AF2122/97
cgccaucgccgccggugc

SEQ ID NO: 3208682 - RNA, 23 nt, Mycobacterium bovis subsp bovis AF2122/97
cgccaucgccgccggugccgccc

SEQ ID NO: 3208683 - RNA, 14 nt, Mycobacterium bovis subsp bovis AF2122/97
cgccaucgccucca

SEQ ID NO: 3208684 - RNA, 16 nt, Mycobacterium bovis subsp bovis AF2122/97
cgccaucgccuccagc

SEQ ID NO: 3208685 - RNA, 20 nt, Mycobacterium bovis subsp bovis AF2122/97
cgccaucgccuccagccggc

SEQ ID NO: 3208686 - RNA, 22 nt, Mycobacterium bovis subsp bovis AF2122/97
cgccaucgccuccagccggcga

SEQ ID NO: 3208687 - RNA, 16 nt, Mycobacterium bovis subsp bovis AF2122/97
cgccaucgggucaccc

SEQ ID NO: 3208688 - RNA, 15 nt, Mycobacterium bovis subsp bovis AF2122/97
cgccaucgguugacc

SEQ ID NO: 3208689 - RNA, 19 nt, Mycobacterium bovis subsp bovis AF2122/97
cgccaucgucgaagaccuc

SEQ ID NO: 3208690 - RNA, 20 nt, Mycobacterium bovis subsp bovis AF2122/97
cgccaucguuucacccgggc

SEQ ID NO: 3208691 - RNA, 24 nt, Mycobacterium bovis subsp bovis AF2122/97
cgccaucguuucacccgggcugcu

SEQ ID NO: 3208692 - RNA, 18 nt, Mycobacterium bovis subsp bovis AF2122/97
cgccaucucgacggugac

SEQ ID NO: 3208693 - RNA, 23 nt, Mycobacterium bovis subsp bovis AF2122/97
cgccaucucgacggugaccggau

SEQ ID NO: 3208694 - RNA, 14 nt, Mycobacterium bovis subsp bovis AF2122/97
cgccaucuucgggc

SEQ ID NO: 3208695 - RNA, 16 nt, Mycobacterium bovis subsp bovis AF2122/97
cgccaugaaaucaccc

SEQ ID NO: 3208696 - RNA, 16 nt, Mycobacterium bovis subsp bovis AF2122/97
cgccaugaagccgggc

SEQ ID NO: 3208697 - RNA, 18 nt, Mycobacterium bovis subsp bovis AF2122/97
cgccaugaagccgggcgc

SEQ ID NO: 3208698 - RNA, 17 nt, Mycobacterium bovis subsp bovis AF2122/97
cgccaugagcgcgccca

SEQ ID NO: 3208699 - RNA, 15 nt, Mycobacterium bovis subsp bovis AF2122/97
cgccaugauggacag

SEQ ID NO: 3208700 - RNA, 15 nt, Mycobacterium bovis subsp bovis AF2122/97
cgccaugcacguugc

SEQ ID NO: 3208701 - RNA, 23 nt, Mycobacterium bovis subsp bovis AF2122/97
cgccaugcccgcacgcucggcgg

SEQ ID NO: 3208702 - RNA, 19 nt, Mycobacterium bovis subsp bovis AF2122/97
cgccaugcccucggcgccg

SEQ ID NO: 3208703 - RNA, 15 nt, Mycobacterium bovis subsp bovis AF2122/97
cgccaugccgggaac

SEQ ID NO: 3208704 - RNA, 15 nt, Mycobacterium bovis subsp bovis AF2122/97
cgccaugcgccaacc

SEQ ID NO: 3208705 - RNA, 16 nt, Mycobacterium bovis subsp bovis AF2122/97
cgccaugcgccaaccc

SEQ ID NO: 3208706 - RNA, 18 nt, Mycobacterium bovis subsp bovis AF2122/97
cgccaugcgccaacccgg

SEQ ID NO: 3208707 - RNA, 12 nt, Mycobacterium bovis subsp bovis AF2122/97
cgccaugcggcg

SEQ ID NO: 3208708 - RNA, 14 nt, Mycobacterium bovis subsp bovis AF2122/97
cgccaugcggcgcg

SEQ ID NO: 3208709 - RNA, 23 nt, Mycobacterium bovis subsp bovis AF2122/97
cgccauggaucccacgaguuggc

SEQ ID NO: 3208710 - RNA, 15 nt, Mycobacterium bovis subsp bovis AF2122/97
cgccauggcguucug

SEQ ID NO: 3208711 - RNA, 12 nt, Mycobacterium bovis subsp bovis AF2122/97
cgccauggugaa

SEQ ID NO: 3208712 - RNA, 14 nt, Mycobacterium bovis subsp bovis AF2122/97
cgccaugucggcca

SEQ ID NO: 3208713 - RNA, 22 nt, Mycobacterium bovis subsp bovis AF2122/97
cgccaugugugcaaaggcgccg

SEQ ID NO: 3208714 - RNA, 19 nt, Mycobacterium bovis subsp bovis AF2122/97
cgccauguugaagcgaagc

SEQ ID NO: 3208715 - RNA, 16 nt, Mycobacterium bovis subsp bovis AF2122/97
cgccauucaucggcau

SEQ ID NO: 3208716 - RNA, 22 nt, Mycobacterium bovis subsp bovis AF2122/97
cgccauucaucggcaucgacug

SEQ ID NO: 3208717 - RNA, 15 nt, Mycobacterium bovis subsp bovis AF2122/97
cgccauuccaagacg

SEQ ID NO: 3208718 - RNA, 18 nt, Mycobacterium bovis subsp bovis AF2122/97
cgccauuccagccggugc

SEQ ID NO: 3208719 - RNA, 19 nt, Mycobacterium bovis subsp bovis AF2122/97
cgccauuccagccggugcc

SEQ ID NO: 3208720 - RNA, 13 nt, Mycobacterium bovis subsp bovis AF2122/97
cgccauugacgcc

SEQ ID NO: 3208721 - RNA, 15 nt, Mycobacterium bovis subsp bovis AF2122/97
cgccauugacgccgu

SEQ ID NO: 3208722 - RNA, 17 nt, Mycobacterium bovis subsp bovis AF2122/97
cgccauugacgccguug

SEQ ID NO: 3208723 - RNA, 13 nt, Mycobacterium bovis subsp bovis AF2122/97
cgccauugccgcc

SEQ ID NO: 3208724 - RNA, 14 nt, Mycobacterium bovis subsp bovis AF2122/97
cgccauugccgccg

SEQ ID NO: 3208725 - RNA, 15 nt, Mycobacterium bovis subsp bovis AF2122/97
cgccauugccgccgg

SEQ ID NO: 3208726 - RNA, 22 nt, Mycobacterium bovis subsp bovis AF2122/97
cgccauugccgccggcgccgcc

SEQ ID NO: 3208727 - RNA, 18 nt, Mycobacterium bovis subsp bovis AF2122/97
cgccauugccgccgucgc

SEQ ID NO: 3208728 - RNA, 22 nt, Mycobacterium bovis subsp bovis AF2122/97
cgccauuggcaggcauggcgcc

SEQ ID NO: 3208729 - RNA, 23 nt, Mycobacterium bovis subsp bovis AF2122/97
cgccauuggcaggcauggcgccg

SEQ ID NO: 3208730 - RNA, 23 nt, Mycobacterium bovis subsp bovis AF2122/97
cgccauuggccugucaggcggcg

SEQ ID NO: 3208731 - RNA, 13 nt, Mycobacterium bovis subsp bovis AF2122/97
cgccauuggcgcc

SEQ ID NO: 3208732 - RNA, 14 nt, Mycobacterium bovis subsp bovis AF2122/97
cgccauuggcgccg

SEQ ID NO: 3208733 - RNA, 17 nt, Mycobacterium bovis subsp bovis AF2122/97
cgccauuggcgccgccg

SEQ ID NO: 3208734 - RNA, 18 nt, Mycobacterium bovis subsp bovis AF2122/97
cgccauuggcgccgccga

SEQ ID NO: 3208735 - RNA, 16 nt, Mycobacterium bovis subsp bovis AF2122/97
cgccauuggcgguggu

SEQ ID NO: 3208736 - RNA, 14 nt, Mycobacterium bovis subsp bovis AF2122/97
cgccauuggcgucc

SEQ ID NO: 3208737 - RNA, 22 nt, Mycobacterium bovis subsp bovis AF2122/97
cgcccaacaacgcuucggcgug

SEQ ID NO: 3208738 - RNA, 14 nt, Mycobacterium bovis subsp bovis AF2122/97
cgcccaacaccgcg

SEQ ID NO: 3208739 - RNA, 21 nt, Mycobacterium bovis subsp bovis AF2122/97
cgcccaaccugggaaugacgg

SEQ ID NO: 3208740 - RNA, 17 nt, Mycobacterium bovis subsp bovis AF2122/97
cgcccaacgucgccagg

SEQ ID NO: 3208741 - RNA, 19 nt, Mycobacterium bovis subsp bovis AF2122/97
cgcccaacgucgccagguc

SEQ ID NO: 3208742 - RNA, 15 nt, Mycobacterium bovis subsp bovis AF2122/97
cgcccaagccgccgg

SEQ ID NO: 3208743 - RNA, 20 nt, Mycobacterium bovis subsp bovis AF2122/97
cgcccaagccgccggcgcca

SEQ ID NO: 3208744 - RNA, 16 nt, Mycobacterium bovis subsp bovis AF2122/97
cgcccaagguggcggc

SEQ ID NO: 3208745 - RNA, 18 nt, Mycobacterium bovis subsp bovis AF2122/97
cgcccaagguggcggcca

SEQ ID NO: 3208746 - RNA, 19 nt, Mycobacterium bovis subsp bovis AF2122/97
cgcccaagguggcggccag

SEQ ID NO: 3208747 - RNA, 23 nt, Mycobacterium bovis subsp bovis AF2122/97
cgcccaauccaccgauucggcga

SEQ ID NO: 3208748 - RNA, 22 nt, Mycobacterium bovis subsp bovis AF2122/97
cgcccaauguccaggcgcgcac

SEQ ID NO: 3208749 - RNA, 23 nt, Mycobacterium bovis subsp bovis AF2122/97
cgcccaauguccaggcgcgcacc

SEQ ID NO: 3208750 - RNA, 21 nt, Mycobacterium bovis subsp bovis AF2122/97
cgcccaauuucgucucgaaau

SEQ ID NO: 3208751 - RNA, 17 nt, Mycobacterium bovis subsp bovis AF2122/97
cgcccaauuucgugccg

SEQ ID NO: 3208752 - RNA, 19 nt, Mycobacterium bovis subsp bovis AF2122/97
cgcccaauuucgugccgaa

SEQ ID NO: 3208753 - RNA, 23 nt, Mycobacterium bovis subsp bovis AF2122/97
cgcccacaaugacucggccgcac

SEQ ID NO: 3208754 - RNA, 14 nt, Mycobacterium bovis subsp bovis AF2122/97
cgcccacagcugac

SEQ ID NO: 3208755 - RNA, 15 nt, Mycobacterium bovis subsp bovis AF2122/97
cgcccacagcugacg

SEQ ID NO: 3208756 - RNA, 19 nt, Mycobacterium bovis subsp bovis AF2122/97
cgcccacagcugacgagcc

SEQ ID NO: 3208757 - RNA, 21 nt, Mycobacterium bovis subsp bovis AF2122/97
cgcccacagcugacgagccgg

SEQ ID NO: 3208758 - RNA, 21 nt, Mycobacterium bovis subsp bovis AF2122/97
cgcccacagcuugcccgagcc

SEQ ID NO: 3208759 - RNA, 21 nt, Mycobacterium bovis subsp bovis AF2122/97
cgcccacaggggcagcgcggc

SEQ ID NO: 3208760 - RNA, 15 nt, Mycobacterium bovis subsp bovis AF2122/97
cgcccacaucgucgg

SEQ ID NO: 3208761 - RNA, 18 nt, Mycobacterium bovis subsp bovis AF2122/97
cgcccacaugcgcucgcg

SEQ ID NO: 3208762 - RNA, 16 nt, Mycobacterium bovis subsp bovis AF2122/97
cgcccacaugcucagg

SEQ ID NO: 3208763 - RNA, 21 nt, Mycobacterium bovis subsp bovis AF2122/97
cgcccaccacacagccgcgcu

SEQ ID NO: 3208764 - RNA, 23 nt, Mycobacterium bovis subsp bovis AF2122/97
cgcccaccacacagccgcgcugc

SEQ ID NO: 3208765 - RNA, 15 nt, Mycobacterium bovis subsp bovis AF2122/97
cgcccaccacgcgac

SEQ ID NO: 3208766 - RNA, 22 nt, Mycobacterium bovis subsp bovis AF2122/97
cgcccaccacgcgacgcggggc

SEQ ID NO: 3208767 - RNA, 23 nt, Mycobacterium bovis subsp bovis AF2122/97
cgcccaccacugugacacccgag

SEQ ID NO: 3208768 - RNA, 13 nt, Mycobacterium bovis subsp bovis AF2122/97
cgcccaccaugau

SEQ ID NO: 3208769 - RNA, 22 nt, Mycobacterium bovis subsp bovis AF2122/97
cgcccaccaugaucacaccgag

SEQ ID NO: 3208770 - RNA, 24 nt, Mycobacterium bovis subsp bovis AF2122/97
cgcccaccaugaucacaccgagcg

SEQ ID NO: 3208771 - RNA, 16 nt, Mycobacterium bovis subsp bovis AF2122/97
cgcccaccccggccgc

SEQ ID NO: 3208772 - RNA, 17 nt, Mycobacterium bovis subsp bovis AF2122/97
cgcccaccccggccgca

SEQ ID NO: 3208773 - RNA, 18 nt, Mycobacterium bovis subsp bovis AF2122/97
cgcccaccccggccgcau

SEQ ID NO: 3208774 - RNA, 12 nt, Mycobacterium bovis subsp bovis AF2122/97
cgcccacccgcu

SEQ ID NO: 3208775 - RNA, 15 nt, Mycobacterium bovis subsp bovis AF2122/97
cgcccacccgcugcg

SEQ ID NO: 3208776 - RNA, 24 nt, Mycobacterium bovis subsp bovis AF2122/97
cgcccacccgcugcgagaucgcgg

SEQ ID NO: 3208777 - RNA, 20 nt, Mycobacterium bovis subsp bovis AF2122/97
cgcccacccggaaagaucuc

SEQ ID NO: 3208778 - RNA, 21 nt, Mycobacterium bovis subsp bovis AF2122/97
cgcccaccgaaaccggucagc

SEQ ID NO: 3208779 - RNA, 13 nt, Mycobacterium bovis subsp bovis AF2122/97
cgcccaccgggcg

SEQ ID NO: 3208780 - RNA, 17 nt, Mycobacterium bovis subsp bovis AF2122/97
cgcccacggcaccacca

SEQ ID NO: 3208781 - RNA, 18 nt, Mycobacterium bovis subsp bovis AF2122/97
cgcccacggcaccaccaa

SEQ ID NO: 3208782 - RNA, 17 nt, Mycobacterium bovis subsp bovis AF2122/97
cgcccacuccagcagcu

SEQ ID NO: 3208783 - RNA, 22 nt, Mycobacterium bovis subsp bovis AF2122/97
cgcccacuccagcagcucgccg

SEQ ID NO: 3208784 - RNA, 15 nt, Mycobacterium bovis subsp bovis AF2122/97
cgcccacuggugauc

SEQ ID NO: 3208785 - RNA, 16 nt, Mycobacterium bovis subsp bovis AF2122/97
cgcccacuggugaucu

SEQ ID NO: 3208786 - RNA, 17 nt, Mycobacterium bovis subsp bovis AF2122/97
cgcccagaccgacccgc

SEQ ID NO: 3208787 - RNA, 17 nt, Mycobacterium bovis subsp bovis AF2122/97
cgcccagaccgccgacg

SEQ ID NO: 3208788 - RNA, 18 nt, Mycobacterium bovis subsp bovis AF2122/97
cgcccagaccgccgacgc

SEQ ID NO: 3208789 - RNA, 20 nt, Mycobacterium bovis subsp bovis AF2122/97
cgcccagaccgccgacgccg

SEQ ID NO: 3208790 - RNA, 14 nt, Mycobacterium bovis subsp bovis AF2122/97
cgcccagagccgcu

SEQ ID NO: 3208791 - RNA, 17 nt, Mycobacterium bovis subsp bovis AF2122/97
cgcccagagccgcugcg

SEQ ID NO: 3208792 - RNA, 19 nt, Mycobacterium bovis subsp bovis AF2122/97
cgcccagagccgcugcggc

SEQ ID NO: 3208793 - RNA, 21 nt, Mycobacterium bovis subsp bovis AF2122/97
cgcccagagugaauccggcau

SEQ ID NO: 3208794 - RNA, 22 nt, Mycobacterium bovis subsp bovis AF2122/97
cgcccagagugaauccggcaua

SEQ ID NO: 3208795 - RNA, 16 nt, Mycobacterium bovis subsp bovis AF2122/97
cgcccagaucgccgag

SEQ ID NO: 3208796 - RNA, 13 nt, Mycobacterium bovis subsp bovis AF2122/97
cgcccagcaaggc

SEQ ID NO: 3208797 - RNA, 18 nt, Mycobacterium bovis subsp bovis AF2122/97
cgcccagcaaggcccgaa

SEQ ID NO: 3208798 - RNA, 18 nt, Mycobacterium bovis subsp bovis AF2122/97
cgcccagcagcaccugca

SEQ ID NO: 3208799 - RNA, 22 nt, Mycobacterium bovis subsp bovis AF2122/97
cgcccagcagcaccugcaccgc

SEQ ID NO: 3208800 - RNA, 13 nt, Mycobacterium bovis subsp bovis AF2122/97
cgcccagcaggcc

SEQ ID NO: 3208801 - RNA, 23 nt, Mycobacterium bovis subsp bovis AF2122/97
cgcccagccacugacggcuucca

SEQ ID NO: 3208802 - RNA, 14 nt, Mycobacterium bovis subsp bovis AF2122/97
cgcccagcccggcg

SEQ ID NO: 3208803 - RNA, 21 nt, Mycobacterium bovis subsp bovis AF2122/97
cgcccagcccggcguuguuga

SEQ ID NO: 3208804 - RNA, 14 nt, Mycobacterium bovis subsp bovis AF2122/97
cgcccagccgcagc

SEQ ID NO: 3208805 - RNA, 19 nt, Mycobacterium bovis subsp bovis AF2122/97
cgcccagcgacaacaccac

SEQ ID NO: 3208806 - RNA, 12 nt, Mycobacterium bovis subsp bovis AF2122/97
cgcccagcgacc

SEQ ID NO: 3208807 - RNA, 15 nt, Mycobacterium bovis subsp bovis AF2122/97
cgcccagcgacccgg

SEQ ID NO: 3208808 - RNA, 21 nt, Mycobacterium bovis subsp bovis AF2122/97
cgcccagcgacccggccagcg

SEQ ID NO: 3208809 - RNA, 18 nt, Mycobacterium bovis subsp bovis AF2122/97
cgcccagcgagcgccagg

SEQ ID NO: 3208810 - RNA, 21 nt, Mycobacterium bovis subsp bovis AF2122/97
cgcccagcgagcgccagguca

SEQ ID NO: 3208811 - RNA, 19 nt, Mycobacterium bovis subsp bovis AF2122/97
cgcccagcgcccgcgcggc

SEQ ID NO: 3208812 - RNA, 22 nt, Mycobacterium bovis subsp bovis AF2122/97
cgcccagcgcuagccgggcgcg

SEQ ID NO: 3208813 - RNA, 21 nt, Mycobacterium bovis subsp bovis AF2122/97
cgcccagcgugaacugagggc

SEQ ID NO: 3208814 - RNA, 12 nt, Mycobacterium bovis subsp bovis AF2122/97
cgcccagcucga

SEQ ID NO: 3208815 - RNA, 13 nt, Mycobacterium bovis subsp bovis AF2122/97
cgcccagcucgau

SEQ ID NO: 3208816 - RNA, 23 nt, Mycobacterium bovis subsp bovis AF2122/97
cgcccagcugucauccccggcca

SEQ ID NO: 3208817 - RNA, 15 nt, Mycobacterium bovis subsp bovis AF2122/97
cgcccaggcgaccgc

SEQ ID NO: 3208818 - RNA, 20 nt, Mycobacterium bovis subsp bovis AF2122/97
cgcccaggcgaccgcugagg

SEQ ID NO: 3208819 - RNA, 14 nt, Mycobacterium bovis subsp bovis AF2122/97
cgcccagggcgucg

SEQ ID NO: 3208820 - RNA, 17 nt, Mycobacterium bovis subsp bovis AF2122/97
cgcccagggugucugug

SEQ ID NO: 3208821 - RNA, 14 nt, Mycobacterium bovis subsp bovis AF2122/97
cgcccaggugaucg

SEQ ID NO: 3208822 - RNA, 19 nt, Mycobacterium bovis subsp bovis AF2122/97
cgcccaggugaucgcgagg

SEQ ID NO: 3208823 - RNA, 16 nt, Mycobacterium bovis subsp bovis AF2122/97
cgcccagucccaggug

SEQ ID NO: 3208824 - RNA, 13 nt, Mycobacterium bovis subsp bovis AF2122/97
cgcccagucgccg

SEQ ID NO: 3208825 - RNA, 14 nt, Mycobacterium bovis subsp bovis AF2122/97
cgcccagucgccgc

SEQ ID NO: 3208826 - RNA, 16 nt, Mycobacterium bovis subsp bovis AF2122/97
cgcccagucgccgcgg

SEQ ID NO: 3208827 - RNA, 16 nt, Mycobacterium bovis subsp bovis AF2122/97
cgcccagugccagaac

SEQ ID NO: 3208828 - RNA, 20 nt, Mycobacterium bovis subsp bovis AF2122/97
cgcccagugccagaacccgg

SEQ ID NO: 3208829 - RNA, 22 nt, Mycobacterium bovis subsp bovis AF2122/97
cgcccagugcgcaacccagccg

SEQ ID NO: 3208830 - RNA, 18 nt, Mycobacterium bovis subsp bovis AF2122/97
cgcccagugugcgccgug

SEQ ID NO: 3208831 - RNA, 19 nt, Mycobacterium bovis subsp bovis AF2122/97
cgcccaguugggccucagc

SEQ ID NO: 3208832 - RNA, 18 nt, Mycobacterium bovis subsp bovis AF2122/97
cgcccauagcugccggcc

SEQ ID NO: 3208833 - RNA, 22 nt, Mycobacterium bovis subsp bovis AF2122/97
cgcccauagcugccggcccacc

SEQ ID NO: 3208834 - RNA, 19 nt, Mycobacterium bovis subsp bovis AF2122/97
cgcccaucccgguuccggc

SEQ ID NO: 3208835 - RNA, 18 nt, Mycobacterium bovis subsp bovis AF2122/97
cgcccaucgcgacggccc

SEQ ID NO: 3208836 - RNA, 19 nt, Mycobacterium bovis subsp bovis AF2122/97
cgcccaucgcgacggcccg

SEQ ID NO: 3208837 - RNA, 15 nt, Mycobacterium bovis subsp bovis AF2122/97
cgcccaucucaugca

SEQ ID NO: 3208838 - RNA, 17 nt, Mycobacterium bovis subsp bovis AF2122/97
cgcccaugaccggccgc

SEQ ID NO: 3208839 - RNA, 18 nt, Mycobacterium bovis subsp bovis AF2122/97
cgcccaugaccggccgcc

SEQ ID NO: 3208840 - RNA, 21 nt, Mycobacterium bovis subsp bovis AF2122/97
cgcccaugaccggccgccaac

SEQ ID NO: 3208841 - RNA, 13 nt, Mycobacterium bovis subsp bovis AF2122/97
cgcccaugccggg

SEQ ID NO: 3208842 - RNA, 20 nt, Mycobacterium bovis subsp bovis AF2122/97
cgcccaugcugacacgacau

SEQ ID NO: 3208843 - RNA, 15 nt, Mycobacterium bovis subsp bovis AF2122/97
cgcccauggccacca

SEQ ID NO: 3208844 - RNA, 18 nt, Mycobacterium bovis subsp bovis AF2122/97
cgcccauggccaccaggg

SEQ ID NO: 3208845 - RNA, 21 nt, Mycobacterium bovis subsp bovis AF2122/97
cgcccauggcgucgaaccagu

SEQ ID NO: 3208846 - RNA, 22 nt, Mycobacterium bovis subsp bovis AF2122/97
cgcccauucccauaucgaucgg

SEQ ID NO: 3208847 - RNA, 18 nt, Mycobacterium bovis subsp bovis AF2122/97
cgcccauugacguagacc

SEQ ID NO: 3208848 - RNA, 21 nt, Mycobacterium bovis subsp bovis AF2122/97
cgcccauuggguaaccagcgc

SEQ ID NO: 3208849 - RNA, 22 nt, Mycobacterium bovis subsp bovis AF2122/97
cgcccauuggguaaccagcgcc

SEQ ID NO: 3208850 - RNA, 16 nt, Mycobacterium bovis subsp bovis AF2122/97
cgcccauuucggcacg

SEQ ID NO: 3208851 - RNA, 18 nt, Mycobacterium bovis subsp bovis AF2122/97
cgcccauuucggcacgaa

SEQ ID NO: 3208852 - RNA, 18 nt, Mycobacterium bovis subsp bovis AF2122/97
cgcccauuucggcccgaa

SEQ ID NO: 3208853 - RNA, 16 nt, Mycobacterium bovis subsp bovis AF2122/97
cgccccaagcgccuga

SEQ ID NO: 3208854 - RNA, 16 nt, Mycobacterium bovis subsp bovis AF2122/97
cgccccacaacaugcu

SEQ ID NO: 3208855 - RNA, 21 nt, Mycobacterium bovis subsp bovis AF2122/97
cgccccacaacaugcuggaga

SEQ ID NO: 3208856 - RNA, 12 nt, Mycobacterium bovis subsp bovis AF2122/97
cgccccacccga

SEQ ID NO: 3208857 - RNA, 16 nt, Mycobacterium bovis subsp bovis AF2122/97
cgccccaccgcgccga

SEQ ID NO: 3208858 - RNA, 14 nt, Mycobacterium bovis subsp bovis AF2122/97
cgccccaccggccc

SEQ ID NO: 3208859 - RNA, 16 nt, Mycobacterium bovis subsp bovis AF2122/97
cgccccaccggcccgg

SEQ ID NO: 3208860 - RNA, 16 nt, Mycobacterium bovis subsp bovis AF2122/97
cgccccaccggccgaa

SEQ ID NO: 3208861 - RNA, 18 nt, Mycobacterium bovis subsp bovis AF2122/97
cgccccagccaugcugcu

SEQ ID NO: 3208862 - RNA, 20 nt, Mycobacterium bovis subsp bovis AF2122/97
cgccccagccaugcugcucg

SEQ ID NO: 3208863 - RNA, 19 nt, Mycobacterium bovis subsp bovis AF2122/97
cgccccagggggcgugccg

SEQ ID NO: 3208864 - RNA, 19 nt, Mycobacterium bovis subsp bovis AF2122/97
cgccccagguuccgcuguc

SEQ ID NO: 3208865 - RNA, 22 nt, Mycobacterium bovis subsp bovis AF2122/97
cgccccagugcucaucgacaau

SEQ ID NO: 3208866 - RNA, 16 nt, Mycobacterium bovis subsp bovis AF2122/97
cgccccaguucgacgg

SEQ ID NO: 3208867 - RNA, 22 nt, Mycobacterium bovis subsp bovis AF2122/97
cgccccaugucaagcgaugucc

SEQ ID NO: 3208868 - RNA, 20 nt, Mycobacterium bovis subsp bovis AF2122/97
cgcccccagcagcugcgaua

SEQ ID NO: 3208869 - RNA, 16 nt, Mycobacterium bovis subsp bovis AF2122/97
cgcccccagugcacgc

SEQ ID NO: 3208870 - RNA, 20 nt, Mycobacterium bovis subsp bovis AF2122/97
cgcccccauaacugcggccc

SEQ ID NO: 3208871 - RNA, 15 nt, Mycobacterium bovis subsp bovis AF2122/97
cgccccccacggccc

SEQ ID NO: 3208872 - RNA, 11 nt, Mycobacterium bovis subsp bovis AF2122/97
cgcccccgcca

SEQ ID NO: 3208873 - RNA, 20 nt, Mycobacterium bovis subsp bovis AF2122/97
cgcccccgccauugccgccg

SEQ ID NO: 3208874 - RNA, 22 nt, Mycobacterium bovis subsp bovis AF2122/97
cgcccccgccauugccgccggc

SEQ ID NO: 3208875 - RNA, 14 nt, Mycobacterium bovis subsp bovis AF2122/97
cgcccccgcugcca

SEQ ID NO: 3208876 - RNA, 12 nt, Mycobacterium bovis subsp bovis AF2122/97
cgcccccggcac

SEQ ID NO: 3208877 - RNA, 13 nt, Mycobacterium bovis subsp bovis AF2122/97
cgcccccgugggg

SEQ ID NO: 3208878 - RNA, 19 nt, Mycobacterium bovis subsp bovis AF2122/97
cgcccccuggauggcgccc

SEQ ID NO: 3208879 - RNA, 19 nt, Mycobacterium bovis subsp bovis AF2122/97
cgccccgaggaugccgaac

SEQ ID NO: 3208880 - RNA, 21 nt, Mycobacterium bovis subsp bovis AF2122/97
cgccccgauaaaaaccacccc

SEQ ID NO: 3208881 - RNA, 22 nt, Mycobacterium bovis subsp bovis AF2122/97
cgccccgauaaaaaccaccccc

SEQ ID NO: 3208882 - RNA, 13 nt, Mycobacterium bovis subsp bovis AF2122/97
cgccccgaucggc

SEQ ID NO: 3208883 - RNA, 15 nt, Mycobacterium bovis subsp bovis AF2122/97
cgccccgaucggcca

SEQ ID NO: 3208884 - RNA, 17 nt, Mycobacterium bovis subsp bovis AF2122/97
cgccccgaucggccacc

SEQ ID NO: 3208885 - RNA, 18 nt, Mycobacterium bovis subsp bovis AF2122/97
cgccccgaucggugacgc

SEQ ID NO: 3208886 - RNA, 15 nt, Mycobacterium bovis subsp bovis AF2122/97
cgccccgaugaccgc

SEQ ID NO: 3208887 - RNA, 16 nt, Mycobacterium bovis subsp bovis AF2122/97
cgccccgaugaccgcc

SEQ ID NO: 3208888 - RNA, 17 nt, Mycobacterium bovis subsp bovis AF2122/97
cgccccgaugaccgccu

SEQ ID NO: 3208889 - RNA, 17 nt, Mycobacterium bovis subsp bovis AF2122/97
cgccccgccgcacgcac

SEQ ID NO: 3208890 - RNA, 13 nt, Mycobacterium bovis subsp bovis AF2122/97
cgccccgccguug

SEQ ID NO: 3208891 - RNA, 12 nt, Mycobacterium bovis subsp bovis AF2122/97
cgccccgcgccc

SEQ ID NO: 3208892 - RNA, 19 nt, Mycobacterium bovis subsp bovis AF2122/97
cgccccgcgccuuggcacc

SEQ ID NO: 3208893 - RNA, 12 nt, Mycobacterium bovis subsp bovis AF2122/97
cgccccgcguug

SEQ ID NO: 3208894 - RNA, 11 nt, Mycobacterium bovis subsp bovis AF2122/97
cgccccgcucg

SEQ ID NO: 3208895 - RNA, 12 nt, Mycobacterium bovis subsp bovis AF2122/97
cgccccggagcc

SEQ ID NO: 3208896 - RNA, 12 nt, Mycobacterium bovis subsp bovis AF2122/97
cgccccggcaua

SEQ ID NO: 3208897 - RNA, 13 nt, Mycobacterium bovis subsp bovis AF2122/97
cgccccggccagg

SEQ ID NO: 3208898 - RNA, 15 nt, Mycobacterium bovis subsp bovis AF2122/97
cgccccggccaggac

SEQ ID NO: 3208899 - RNA, 13 nt, Mycobacterium bovis subsp bovis AF2122/97
cgccccggccgcu

SEQ ID NO: 3208900 - RNA, 12 nt, Mycobacterium bovis subsp bovis AF2122/97
cgccccggcgcg

SEQ ID NO: 3208901 - RNA, 17 nt, Mycobacterium bovis subsp bovis AF2122/97
cgccccggcgcggccag

SEQ ID NO: 3208902 - RNA, 18 nt, Mycobacterium bovis subsp bovis AF2122/97
cgccccggcgcggccagc

SEQ ID NO: 3208903 - RNA, 12 nt, Mycobacterium bovis subsp bovis AF2122/97
cgccccggcggc

SEQ ID NO: 3208904 - RNA, 13 nt, Mycobacterium bovis subsp bovis AF2122/97
cgccccggcggcg

SEQ ID NO: 3208905 - RNA, 15 nt, Mycobacterium bovis subsp bovis AF2122/97
cgccccgggccacca

SEQ ID NO: 3208906 - RNA, 16 nt, Mycobacterium bovis subsp bovis AF2122/97
cgccccguaaucggug

SEQ ID NO: 3208907 - RNA, 21 nt, Mycobacterium bovis subsp bovis AF2122/97
cgccccguuucggucgacaac

SEQ ID NO: 3208908 - RNA, 16 nt, Mycobacterium bovis subsp bovis AF2122/97
cgccccugcacagcag

SEQ ID NO: 3208909 - RNA, 18 nt, Mycobacterium bovis subsp bovis AF2122/97
cgcccgaagaugccugga

SEQ ID NO: 3208910 - RNA, 15 nt, Mycobacterium bovis subsp bovis AF2122/97
cgcccgaagccgggc

SEQ ID NO: 3208911 - RNA, 16 nt, Mycobacterium bovis subsp bovis AF2122/97
cgcccgaagccgggcc

SEQ ID NO: 3208912 - RNA, 18 nt, Mycobacterium bovis subsp bovis AF2122/97
cgcccgaagccgggcccc

SEQ ID NO: 3208913 - RNA, 18 nt, Mycobacterium bovis subsp bovis AF2122/97
cgcccgaaugcgacgucg

SEQ ID NO: 3208914 - RNA, 15 nt, Mycobacterium bovis subsp bovis AF2122/97
cgcccgaaugcggug

SEQ ID NO: 3208915 - RNA, 12 nt, Mycobacterium bovis subsp bovis AF2122/97
cgcccgacaccc

SEQ ID NO: 3208916 - RNA, 22 nt, Mycobacterium bovis subsp bovis AF2122/97
cgcccgacccaucaccagcggc

SEQ ID NO: 3208917 - RNA, 18 nt, Mycobacterium bovis subsp bovis AF2122/97
cgcccgacgaacagcggu

SEQ ID NO: 3208918 - RNA, 22 nt, Mycobacterium bovis subsp bovis AF2122/97
cgcccgacgaggaugucgauga

SEQ ID NO: 3208919 - RNA, 17 nt, Mycobacterium bovis subsp bovis AF2122/97
cgcccgacgccagcugc

SEQ ID NO: 3208920 - RNA, 22 nt, Mycobacterium bovis subsp bovis AF2122/97
cgcccgacggaguucgacgucg

SEQ ID NO: 3208921 - RNA, 22 nt, Mycobacterium bovis subsp bovis AF2122/97
cgcccgagaccgggcaacggcg

SEQ ID NO: 3208922 - RNA, 17 nt, Mycobacterium bovis subsp bovis AF2122/97
cgcccgagccggugcca

SEQ ID NO: 3208923 - RNA, 19 nt, Mycobacterium bovis subsp bovis AF2122/97
cgcccgagccggugccacu

SEQ ID NO: 3208924 - RNA, 21 nt, Mycobacterium bovis subsp bovis AF2122/97
cgcccgaggcgagacgcucca

SEQ ID NO: 3208925 - RNA, 16 nt, Mycobacterium bovis subsp bovis AF2122/97
cgcccgagucucgucg

SEQ ID NO: 3208926 - RNA, 18 nt, Mycobacterium bovis subsp bovis AF2122/97
cgcccgagugaccagggu

SEQ ID NO: 3208927 - RNA, 16 nt, Mycobacterium bovis subsp bovis AF2122/97
cgcccgaguugaagaa

SEQ ID NO: 3208928 - RNA, 19 nt, Mycobacterium bovis subsp bovis AF2122/97
cgcccgaguugaagaagcc

SEQ ID NO: 3208929 - RNA, 20 nt, Mycobacterium bovis subsp bovis AF2122/97
cgcccgaguugaagaagccg

SEQ ID NO: 3208930 - RNA, 18 nt, Mycobacterium bovis subsp bovis AF2122/97
cgcccgaguuguggacgc

SEQ ID NO: 3208931 - RNA, 22 nt, Mycobacterium bovis subsp bovis AF2122/97
cgcccgaguuguggacgcccga

SEQ ID NO: 3208932 - RNA, 17 nt, Mycobacterium bovis subsp bovis AF2122/97
cgcccgauacgccaccg

SEQ ID NO: 3208933 - RNA, 18 nt, Mycobacterium bovis subsp bovis AF2122/97
cgcccgauacgccaccgg

SEQ ID NO: 3208934 - RNA, 19 nt, Mycobacterium bovis subsp bovis AF2122/97
cgcccgauacgccaccggc

SEQ ID NO: 3208935 - RNA, 22 nt, Mycobacterium bovis subsp bovis AF2122/97
cgcccgauccggaucccaccac

SEQ ID NO: 3208936 - RNA, 15 nt, Mycobacterium bovis subsp bovis AF2122/97
cgcccgauccgguua

SEQ ID NO: 3208937 - RNA, 19 nt, Mycobacterium bovis subsp bovis AF2122/97
cgcccgaucgauaucggca

SEQ ID NO: 3208938 - RNA, 15 nt, Mycobacterium bovis subsp bovis AF2122/97
cgcccgaugcgccag

SEQ ID NO: 3208939 - RNA, 22 nt, Mycobacterium bovis subsp bovis AF2122/97
cgcccgcaauuguucgcggccg

SEQ ID NO: 3208940 - RNA, 23 nt, Mycobacterium bovis subsp bovis AF2122/97
cgcccgcaauuguucgcggccgu

SEQ ID NO: 3208941 - RNA, 13 nt, Mycobacterium bovis subsp bovis AF2122/97
cgcccgcacacag

SEQ ID NO: 3208942 - RNA, 15 nt, Mycobacterium bovis subsp bovis AF2122/97
cgcccgcaccaccgg

SEQ ID NO: 3208943 - RNA, 18 nt, Mycobacterium bovis subsp bovis AF2122/97
cgcccgcaccaccggccc

SEQ ID NO: 3208944 - RNA, 19 nt, Mycobacterium bovis subsp bovis AF2122/97
cgcccgcaccaccggcccc

SEQ ID NO: 3208945 - RNA, 18 nt, Mycobacterium bovis subsp bovis AF2122/97
cgcccgcaccagcugucg

SEQ ID NO: 3208946 - RNA, 23 nt, Mycobacterium bovis subsp bovis AF2122/97
cgcccgcaccagcugucgggcag

SEQ ID NO: 3208947 - RNA, 14 nt, Mycobacterium bovis subsp bovis AF2122/97
cgcccgcacccaug

SEQ ID NO: 3208948 - RNA, 17 nt, Mycobacterium bovis subsp bovis AF2122/97
cgcccgcacucggcggu

SEQ ID NO: 3208949 - RNA, 20 nt, Mycobacterium bovis subsp bovis AF2122/97
cgcccgcaggacgcugccgg

SEQ ID NO: 3208950 - RNA, 21 nt, Mycobacterium bovis subsp bovis AF2122/97
cgcccgcaggacgcugccggu

SEQ ID NO: 3208951 - RNA, 13 nt, Mycobacterium bovis subsp bovis AF2122/97
cgcccgcagggcc

SEQ ID NO: 3208952 - RNA, 14 nt, Mycobacterium bovis subsp bovis AF2122/97
cgcccgcagggccg

SEQ ID NO: 3208953 - RNA, 19 nt, Mycobacterium bovis subsp bovis AF2122/97
cgcccgcagggccgccgcg

SEQ ID NO: 3208954 - RNA, 15 nt, Mycobacterium bovis subsp bovis AF2122/97
cgcccgcaucgcggc

SEQ ID NO: 3208955 - RNA, 23 nt, Mycobacterium bovis subsp bovis AF2122/97
cgcccgcaucgcggcaucgacgc

SEQ ID NO: 3208956 - RNA, 11 nt, Mycobacterium bovis subsp bovis AF2122/97
cgcccgccacc

SEQ ID NO: 3208957 - RNA, 15 nt, Mycobacterium bovis subsp bovis AF2122/97
cgcccgccaccggag

SEQ ID NO: 3208958 - RNA, 17 nt, Mycobacterium bovis subsp bovis AF2122/97
cgcccgccaccggaggu

SEQ ID NO: 3208959 - RNA, 22 nt, Mycobacterium bovis subsp bovis AF2122/97
cgcccgccaccggguucaccga

SEQ ID NO: 3208960 - RNA, 17 nt, Mycobacterium bovis subsp bovis AF2122/97
cgcccgccaucagcccg

SEQ ID NO: 3208961 - RNA, 20 nt, Mycobacterium bovis subsp bovis AF2122/97
cgcccgccaucagcccggcg

SEQ ID NO: 3208962 - RNA, 15 nt, Mycobacterium bovis subsp bovis AF2122/97
cgcccgcccaccucg

SEQ ID NO: 3208963 - RNA, 11 nt, Mycobacterium bovis subsp bovis AF2122/97
cgcccgccccg

SEQ ID NO: 3208964 - RNA, 12 nt, Mycobacterium bovis subsp bovis AF2122/97
cgcccgccccgc

SEQ ID NO: 3208965 - RNA, 17 nt, Mycobacterium bovis subsp bovis AF2122/97
cgcccgcccgagccgcu

SEQ ID NO: 3208966 - RNA, 11 nt, Mycobacterium bovis subsp bovis AF2122/97
cgcccgcccgu

SEQ ID NO: 3208967 - RNA, 20 nt, Mycobacterium bovis subsp bovis AF2122/97
cgcccgcccuugcggcguga

SEQ ID NO: 3208968 - RNA, 17 nt, Mycobacterium bovis subsp bovis AF2122/97
cgcccgccgccaccagc

SEQ ID NO: 3208969 - RNA, 14 nt, Mycobacterium bovis subsp bovis AF2122/97
cgcccgccgcgaac

SEQ ID NO: 3208970 - RNA, 15 nt, Mycobacterium bovis subsp bovis AF2122/97
cgcccgccgcggcag

SEQ ID NO: 3208971 - RNA, 13 nt, Mycobacterium bovis subsp bovis AF2122/97
cgcccgccggcau

SEQ ID NO: 3208972 - RNA, 14 nt, Mycobacterium bovis subsp bovis AF2122/97
cgcccgccggcgcg

SEQ ID NO: 3208973 - RNA, 15 nt, Mycobacterium bovis subsp bovis AF2122/97
cgcccgccggcgcga

SEQ ID NO: 3208974 - RNA, 22 nt, Mycobacterium bovis subsp bovis AF2122/97
cgcccgccggcgcgagccggcu

SEQ ID NO: 3208975 - RNA, 21 nt, Mycobacterium bovis subsp bovis AF2122/97
cgcccgccggugaucggcggc

SEQ ID NO: 3208976 - RNA, 15 nt, Mycobacterium bovis subsp bovis AF2122/97
cgcccgccucgaccg

SEQ ID NO: 3208977 - RNA, 17 nt, Mycobacterium bovis subsp bovis AF2122/97
cgcccgccucugucuuc

SEQ ID NO: 3208978 - RNA, 20 nt, Mycobacterium bovis subsp bovis AF2122/97
cgcccgcgaaccgcggaucg

SEQ ID NO: 3208979 - RNA, 24 nt, Mycobacterium bovis subsp bovis AF2122/97
cgcccgcgagagaguucgcaugcu

SEQ ID NO: 3208980 - RNA, 14 nt, Mycobacterium bovis subsp bovis AF2122/97
cgcccgcgagcugu

SEQ ID NO: 3208981 - RNA, 17 nt, Mycobacterium bovis subsp bovis AF2122/97
cgcccgcgagcuguagg

SEQ ID NO: 3208982 - RNA, 23 nt, Mycobacterium bovis subsp bovis AF2122/97
cgcccgcgccaccagcaccgccg

SEQ ID NO: 3208983 - RNA, 14 nt, Mycobacterium bovis subsp bovis AF2122/97
cgcccgcgccaccg

SEQ ID NO: 3208984 - RNA, 22 nt, Mycobacterium bovis subsp bovis AF2122/97
cgcccgcgccaccgauaccguc

SEQ ID NO: 3208985 - RNA, 17 nt, Mycobacterium bovis subsp bovis AF2122/97
cgcccgcgccaccggca

SEQ ID NO: 3208986 - RNA, 18 nt, Mycobacterium bovis subsp bovis AF2122/97
cgcccgcgccaccggcac

SEQ ID NO: 3208987 - RNA, 14 nt, Mycobacterium bovis subsp bovis AF2122/97
cgcccgcgccgccg

SEQ ID NO: 3208988 - RNA, 15 nt, Mycobacterium bovis subsp bovis AF2122/97
cgcccgcgccgccgc

SEQ ID NO: 3208989 - RNA, 17 nt, Mycobacterium bovis subsp bovis AF2122/97
cgcccgcgccgccgcca

SEQ ID NO: 3208990 - RNA, 18 nt, Mycobacterium bovis subsp bovis AF2122/97
cgcccgcgccgccgccac

SEQ ID NO: 3208991 - RNA, 16 nt, Mycobacterium bovis subsp bovis AF2122/97
cgcccgcgccgccgcu

SEQ ID NO: 3208992 - RNA, 17 nt, Mycobacterium bovis subsp bovis AF2122/97
cgcccgcgccgccgcua

SEQ ID NO: 3208993 - RNA, 17 nt, Mycobacterium bovis subsp bovis AF2122/97
cgcccgcgccgccggac

SEQ ID NO: 3208994 - RNA, 19 nt, Mycobacterium bovis subsp bovis AF2122/97
cgcccgcgccgccggaccc

SEQ ID NO: 3208995 - RNA, 13 nt, Mycobacterium bovis subsp bovis AF2122/97
cgcccgcgccucc

SEQ ID NO: 3208996 - RNA, 17 nt, Mycobacterium bovis subsp bovis AF2122/97
cgcccgcgccuccguug

SEQ ID NO: 3208997 - RNA, 18 nt, Mycobacterium bovis subsp bovis AF2122/97
cgcccgcgccuccguugc

SEQ ID NO: 3208998 - RNA, 22 nt, Mycobacterium bovis subsp bovis AF2122/97
cgcccgcgccuccguugccccc

SEQ ID NO: 3208999 - RNA, 16 nt, Mycobacterium bovis subsp bovis AF2122/97
cgcccgcgcggccacu

SEQ ID NO: 3209000 - RNA, 13 nt, Mycobacterium bovis subsp bovis AF2122/97
cgcccgcgcggug

SEQ ID NO: 3209001 - RNA, 14 nt, Mycobacterium bovis subsp bovis AF2122/97
cgcccgcgcugccg

SEQ ID NO: 3209002 - RNA, 15 nt, Mycobacterium bovis subsp bovis AF2122/97
cgcccgcgcugccga

SEQ ID NO: 3209003 - RNA, 13 nt, Mycobacterium bovis subsp bovis AF2122/97
cgcccgcggccgc

SEQ ID NO: 3209004 - RNA, 15 nt, Mycobacterium bovis subsp bovis AF2122/97
cgcccgcggccgcca

SEQ ID NO: 3209005 - RNA, 18 nt, Mycobacterium bovis subsp bovis AF2122/97
cgcccgcggccgccagcg

SEQ ID NO: 3209006 - RNA, 20 nt, Mycobacterium bovis subsp bovis AF2122/97
cgcccgcggccgccagcgga

SEQ ID NO: 3209007 - RNA, 13 nt, Mycobacterium bovis subsp bovis AF2122/97
cgcccgcggccgu

SEQ ID NO: 3209008 - RNA, 18 nt, Mycobacterium bovis subsp bovis AF2122/97
cgcccgcggccguggugg

SEQ ID NO: 3209009 - RNA, 14 nt, Mycobacterium bovis subsp bovis AF2122/97
cgcccgcgggcagu

SEQ ID NO: 3209010 - RNA, 22 nt, Mycobacterium bovis subsp bovis AF2122/97
cgcccgcgggcaguggcagccc

SEQ ID NO: 3209011 - RNA, 15 nt, Mycobacterium bovis subsp bovis AF2122/97
cgcccgcgggcccca

SEQ ID NO: 3209012 - RNA, 17 nt, Mycobacterium bovis subsp bovis AF2122/97
cgcccgcgguccggcga

SEQ ID NO: 3209013 - RNA, 23 nt, Mycobacterium bovis subsp bovis AF2122/97
cgcccgcuaccaacgcaacacgg

SEQ ID NO: 3209014 - RNA, 18 nt, Mycobacterium bovis subsp bovis AF2122/97
cgcccgcuacggcagccc

SEQ ID NO: 3209015 - RNA, 21 nt, Mycobacterium bovis subsp bovis AF2122/97
cgcccgcuaggcgaagcgucu

SEQ ID NO: 3209016 - RNA, 20 nt, Mycobacterium bovis subsp bovis AF2122/97
cgcccgcuccuccggcacca

SEQ ID NO: 3209017 - RNA, 13 nt, Mycobacterium bovis subsp bovis AF2122/97
cgcccgcucgaug

SEQ ID NO: 3209018 - RNA, 21 nt, Mycobacterium bovis subsp bovis AF2122/97
cgcccgcucgcgagcggcuga

SEQ ID NO: 3209019 - RNA, 22 nt, Mycobacterium bovis subsp bovis AF2122/97
cgcccgcucggagaucgccacu

SEQ ID NO: 3209020 - RNA, 14 nt, Mycobacterium bovis subsp bovis AF2122/97
cgcccgcucggccg

SEQ ID NO: 3209021 - RNA, 15 nt, Mycobacterium bovis subsp bovis AF2122/97
cgcccgcucggccgc

SEQ ID NO: 3209022 - RNA, 16 nt, Mycobacterium bovis subsp bovis AF2122/97
cgcccgcucggccgca

SEQ ID NO: 3209023 - RNA, 18 nt, Mycobacterium bovis subsp bovis AF2122/97
cgcccgcucggccgcagc

SEQ ID NO: 3209024 - RNA, 21 nt, Mycobacterium bovis subsp bovis AF2122/97
cgcccgcugagcacucaugau

SEQ ID NO: 3209025 - RNA, 19 nt, Mycobacterium bovis subsp bovis AF2122/97
cgcccgcugccgucggaga

SEQ ID NO: 3209026 - RNA, 14 nt, Mycobacterium bovis subsp bovis AF2122/97
cgcccgcugcggcg

SEQ ID NO: 3209027 - RNA, 15 nt, Mycobacterium bovis subsp bovis AF2122/97
cgcccgcugcggcgg

SEQ ID NO: 3209028 - RNA, 17 nt, Mycobacterium bovis subsp bovis AF2122/97
cgcccgcugcggcggcu

SEQ ID NO: 3209029 - RNA, 15 nt, Mycobacterium bovis subsp bovis AF2122/97
cgcccggaaccggcg

SEQ ID NO: 3209030 - RNA, 20 nt, Mycobacterium bovis subsp bovis AF2122/97
cgcccggaccacuguuggug

SEQ ID NO: 3209031 - RNA, 19 nt, Mycobacterium bovis subsp bovis AF2122/97
cgcccggacccaaagcacu

SEQ ID NO: 3209032 - RNA, 23 nt, Mycobacterium bovis subsp bovis AF2122/97
cgcccggaucucggcguaggcga

SEQ ID NO: 3209033 - RNA, 16 nt, Mycobacterium bovis subsp bovis AF2122/97
cgcccggauguccgcc

SEQ ID NO: 3209034 - RNA, 19 nt, Mycobacterium bovis subsp bovis AF2122/97
cgcccggauguccgccgac

SEQ ID NO: 3209035 - RNA, 14 nt, Mycobacterium bovis subsp bovis AF2122/97
cgcccggccaagcc

SEQ ID NO: 3209036 - RNA, 15 nt, Mycobacterium bovis subsp bovis AF2122/97
cgcccggccaagccg

SEQ ID NO: 3209037 - RNA, 20 nt, Mycobacterium bovis subsp bovis AF2122/97
cgcccggccaagccggcgag

SEQ ID NO: 3209038 - RNA, 12 nt, Mycobacterium bovis subsp bovis AF2122/97
cgcccggccagg

SEQ ID NO: 3209039 - RNA, 14 nt, Mycobacterium bovis subsp bovis AF2122/97
cgcccggccccgca

SEQ ID NO: 3209040 - RNA, 17 nt, Mycobacterium bovis subsp bovis AF2122/97
cgcccggccccgcaagc

SEQ ID NO: 3209041 - RNA, 16 nt, Mycobacterium bovis subsp bovis AF2122/97
cgcccggccccgcggc

SEQ ID NO: 3209042 - RNA, 12 nt, Mycobacterium bovis subsp bovis AF2122/97
cgcccggcccgc

SEQ ID NO: 3209043 - RNA, 15 nt, Mycobacterium bovis subsp bovis AF2122/97
cgcccggcccgccac

SEQ ID NO: 3209044 - RNA, 13 nt, Mycobacterium bovis subsp bovis AF2122/97
cgcccggcccggc

SEQ ID NO: 3209045 - RNA, 14 nt, Mycobacterium bovis subsp bovis AF2122/97
cgcccggcccggcu

SEQ ID NO: 3209046 - RNA, 14 nt, Mycobacterium bovis subsp bovis AF2122/97
cgcccggccgguuc

SEQ ID NO: 3209047 - RNA, 15 nt, Mycobacterium bovis subsp bovis AF2122/97
cgcccggcgagcagg

SEQ ID NO: 3209048 - RNA, 16 nt, Mycobacterium bovis subsp bovis AF2122/97
cgcccggcgcaagcgc

SEQ ID NO: 3209049 - RNA, 21 nt, Mycobacterium bovis subsp bovis AF2122/97
cgcccggcgcaccaucgcggc

SEQ ID NO: 3209050 - RNA, 20 nt, Mycobacterium bovis subsp bovis AF2122/97
cgcccggcgcuagcgccgcg

SEQ ID NO: 3209051 - RNA, 17 nt, Mycobacterium bovis subsp bovis AF2122/97
cgcccggcggaucccga

SEQ ID NO: 3209052 - RNA, 19 nt, Mycobacterium bovis subsp bovis AF2122/97
cgcccggcggaucccgagg

SEQ ID NO: 3209053 - RNA, 21 nt, Mycobacterium bovis subsp bovis AF2122/97
cgcccggcguauugcaccgcc

SEQ ID NO: 3209054 - RNA, 22 nt, Mycobacterium bovis subsp bovis AF2122/97
cgcccggcguggcuucacccaa

SEQ ID NO: 3209055 - RNA, 16 nt, Mycobacterium bovis subsp bovis AF2122/97
cgcccggcgugucgcc

SEQ ID NO: 3209056 - RNA, 21 nt, Mycobacterium bovis subsp bovis AF2122/97
cgcccggcuuuugcgcccagc

SEQ ID NO: 3209057 - RNA, 18 nt, Mycobacterium bovis subsp bovis AF2122/97
cgcccgggcaccggccgg

SEQ ID NO: 3209058 - RNA, 19 nt, Mycobacterium bovis subsp bovis AF2122/97
cgcccgggcaccggccggu

SEQ ID NO: 3209059 - RNA, 13 nt, Mycobacterium bovis subsp bovis AF2122/97
cgcccgggccgcg

SEQ ID NO: 3209060 - RNA, 15 nt, Mycobacterium bovis subsp bovis AF2122/97
cgcccgggccgcgua

SEQ ID NO: 3209061 - RNA, 22 nt, Mycobacterium bovis subsp bovis AF2122/97
cgcccgggcggaacgccggcac

SEQ ID NO: 3209062 - RNA, 19 nt, Mycobacterium bovis subsp bovis AF2122/97
cgcccgggcggcgucggug

SEQ ID NO: 3209063 - RNA, 12 nt, Mycobacterium bovis subsp bovis AF2122/97
cgcccgggcggg

SEQ ID NO: 3209064 - RNA, 17 nt, Mycobacterium bovis subsp bovis AF2122/97
cgcccggggcgcacagc

SEQ ID NO: 3209065 - RNA, 20 nt, Mycobacterium bovis subsp bovis AF2122/97
cgcccggggcggugggcgcu

SEQ ID NO: 3209066 - RNA, 18 nt, Mycobacterium bovis subsp bovis AF2122/97
cgcccgggucccggcagc

SEQ ID NO: 3209067 - RNA, 19 nt, Mycobacterium bovis subsp bovis AF2122/97
cgcccgggucccggcagcu

SEQ ID NO: 3209068 - RNA, 21 nt, Mycobacterium bovis subsp bovis AF2122/97
cgcccgggucccggcagcugg

SEQ ID NO: 3209069 - RNA, 16 nt, Mycobacterium bovis subsp bovis AF2122/97
cgcccggguugaccgc

SEQ ID NO: 3209070 - RNA, 17 nt, Mycobacterium bovis subsp bovis AF2122/97
cgcccggucacgcugug

SEQ ID NO: 3209071 - RNA, 12 nt, Mycobacterium bovis subsp bovis AF2122/97
cgacgucugcca

SEQ ID NO: 3209072 - RNA, 16 nt, Mycobacterium bovis subsp bovis AF2122/97
cgacgucugccaggcg

SEQ ID NO: 3209073 - RNA, 19 nt, Mycobacterium bovis subsp bovis AF2122/97
cgacgucugccaggcgcag

SEQ ID NO: 3209074 - RNA, 21 nt, Mycobacterium bovis subsp bovis AF2122/97
cgacgucuucgaccucaccca

SEQ ID NO: 3209075 - RNA, 21 nt, Mycobacterium bovis subsp bovis AF2122/97
cgacgugaaugguggugucgg

SEQ ID NO: 3209076 - RNA, 23 nt, Mycobacterium bovis subsp bovis AF2122/97
cgacgugaaugguggugucggcg

SEQ ID NO: 3209077 - RNA, 13 nt, Mycobacterium bovis subsp bovis AF2122/97
cgacgugaccagc

SEQ ID NO: 3209078 - RNA, 16 nt, Mycobacterium bovis subsp bovis AF2122/97
cgacgugaccagcuuc

SEQ ID NO: 3209079 - RNA, 22 nt, Mycobacterium bovis subsp bovis AF2122/97
cgacgugaccagcuucggcugg

SEQ ID NO: 3209080 - RNA, 13 nt, Mycobacterium bovis subsp bovis AF2122/97
cgacgugaccggc

SEQ ID NO: 3209081 - RNA, 20 nt, Mycobacterium bovis subsp bovis AF2122/97
cgacgugaccggcaaugcca

SEQ ID NO: 3209082 - RNA, 15 nt, Mycobacterium bovis subsp bovis AF2122/97
cgacgugaucgcggu

SEQ ID NO: 3209083 - RNA, 23 nt, Mycobacterium bovis subsp bovis AF2122/97
cgacgugaucgcgguccaacagc

SEQ ID NO: 3209084 - RNA, 14 nt, Mycobacterium bovis subsp bovis AF2122/97
cgacgugcgcggca

SEQ ID NO: 3209085 - RNA, 15 nt, Mycobacterium bovis subsp bovis AF2122/97
cgacgugcggcggcc

SEQ ID NO: 3209086 - RNA, 15 nt, Mycobacterium bovis subsp bovis AF2122/97
cgacguggccagccc

SEQ ID NO: 3209087 - RNA, 15 nt, Mycobacterium bovis subsp bovis AF2122/97
cgacguggcgccgac

SEQ ID NO: 3209088 - RNA, 13 nt, Mycobacterium bovis subsp bovis AF2122/97
cgacguggcugcg

SEQ ID NO: 3209089 - RNA, 21 nt, Mycobacterium bovis subsp bovis AF2122/97
cgacguguugcacguacgggc

SEQ ID NO: 3209090 - RNA, 22 nt, Mycobacterium bovis subsp bovis AF2122/97
cgacguucaucuucaccacgcc

SEQ ID NO: 3209091 - RNA, 15 nt, Mycobacterium bovis subsp bovis AF2122/97
cgacguuccagcagu

SEQ ID NO: 3209092 - RNA, 21 nt, Mycobacterium bovis subsp bovis AF2122/97
cgacguuccccuucagcacga

SEQ ID NO: 3209093 - RNA, 15 nt, Mycobacterium bovis subsp bovis AF2122/97
cgacguucgacgaca

SEQ ID NO: 3209094 - RNA, 17 nt, Mycobacterium bovis subsp bovis AF2122/97
cgacguucgacgacagc

SEQ ID NO: 3209095 - RNA, 23 nt, Mycobacterium bovis subsp bovis AF2122/97
cgacguucgacgacagcaccgaa

SEQ ID NO: 3209096 - RNA, 15 nt, Mycobacterium bovis subsp bovis AF2122/97
cgacguucgggucga

SEQ ID NO: 3209097 - RNA, 12 nt, Mycobacterium bovis subsp bovis AF2122/97
cgacguucggug

SEQ ID NO: 3209098 - RNA, 13 nt, Mycobacterium bovis subsp bovis AF2122/97
cgacguucggugg

SEQ ID NO: 3209099 - RNA, 14 nt, Mycobacterium bovis subsp bovis AF2122/97
cgacguucgguggc

SEQ ID NO: 3209100 - RNA, 18 nt, Mycobacterium bovis subsp bovis AF2122/97
cgacguucgguggcgaug

SEQ ID NO: 3209101 - RNA, 18 nt, Mycobacterium bovis subsp bovis AF2122/97
cgacguucuuguccagga

SEQ ID NO: 3209102 - RNA, 23 nt, Mycobacterium bovis subsp bovis AF2122/97
cgacguugaagccgccggaguug

SEQ ID NO: 3209103 - RNA, 20 nt, Mycobacterium bovis subsp bovis AF2122/97
cgacguugauccccagcucc

SEQ ID NO: 3209104 - RNA, 16 nt, Mycobacterium bovis subsp bovis AF2122/97
cgacguugaucgccau

SEQ ID NO: 3209105 - RNA, 13 nt, Mycobacterium bovis subsp bovis AF2122/97
cgacguugccgaa

SEQ ID NO: 3209106 - RNA, 18 nt, Mycobacterium bovis subsp bovis AF2122/97
cgacguugccucgcgacg

SEQ ID NO: 3209107 - RNA, 16 nt, Mycobacterium bovis subsp bovis AF2122/97
cgacguugcgaggccg

SEQ ID NO: 3209108 - RNA, 18 nt, Mycobacterium bovis subsp bovis AF2122/97
cgacguugcgaggccgca

SEQ ID NO: 3209109 - RNA, 15 nt, Mycobacterium bovis subsp bovis AF2122/97
cgacguugcggacgg

SEQ ID NO: 3209110 - RNA, 20 nt, Mycobacterium bovis subsp bovis AF2122/97
cgacguugcuggcugggugg

SEQ ID NO: 3209111 - RNA, 14 nt, Mycobacterium bovis subsp bovis AF2122/97
cgacguuggcggga

SEQ ID NO: 3209112 - RNA, 17 nt, Mycobacterium bovis subsp bovis AF2122/97
cgacguuggcgggagca

SEQ ID NO: 3209113 - RNA, 20 nt, Mycobacterium bovis subsp bovis AF2122/97
cgacguuggcgugcaccgca

SEQ ID NO: 3209114 - RNA, 21 nt, Mycobacterium bovis subsp bovis AF2122/97
cgacguuguuuuugcacugaa

SEQ ID NO: 3209115 - RNA, 19 nt, Mycobacterium bovis subsp bovis AF2122/97
cgacuaacggugcgguugc

SEQ ID NO: 3209116 - RNA, 13 nt, Mycobacterium bovis subsp bovis AF2122/97
cgacuaccaucgc

SEQ ID NO: 3209117 - RNA, 15 nt, Mycobacterium bovis subsp bovis AF2122/97
cgacuaccaucgccg

SEQ ID NO: 3209118 - RNA, 18 nt, Mycobacterium bovis subsp bovis AF2122/97
cgacuacccagccagccg

SEQ ID NO: 3209119 - RNA, 19 nt, Mycobacterium bovis subsp bovis AF2122/97
cgacuacccagccagccgc

SEQ ID NO: 3209120 - RNA, 12 nt, Mycobacterium bovis subsp bovis AF2122/97
cgacuacgaaga

SEQ ID NO: 3209121 - RNA, 12 nt, Mycobacterium bovis subsp bovis AF2122/97
cgacuacggccu

SEQ ID NO: 3209122 - RNA, 14 nt, Mycobacterium bovis subsp bovis AF2122/97
cgacuagacgccgc

SEQ ID NO: 3209123 - RNA, 16 nt, Mycobacterium bovis subsp bovis AF2122/97
cgacuagacgccgccg

SEQ ID NO: 3209124 - RNA, 17 nt, Mycobacterium bovis subsp bovis AF2122/97
cgacuagacgccgccgc

SEQ ID NO: 3209125 - RNA, 19 nt, Mycobacterium bovis subsp bovis AF2122/97
cgacuagacgccgccgcug

SEQ ID NO: 3209126 - RNA, 15 nt, Mycobacterium bovis subsp bovis AF2122/97
cgacuaucggccgcc

SEQ ID NO: 3209127 - RNA, 16 nt, Mycobacterium bovis subsp bovis AF2122/97
cgacuaucggccgccg

SEQ ID NO: 3209128 - RNA, 17 nt, Mycobacterium bovis subsp bovis AF2122/97
cgacuaucggccgccgg

SEQ ID NO: 3209129 - RNA, 16 nt, Mycobacterium bovis subsp bovis AF2122/97
cgacucacccacccgc

SEQ ID NO: 3209130 - RNA, 21 nt, Mycobacterium bovis subsp bovis AF2122/97
cgacucacccacccgcaccgc

SEQ ID NO: 3209131 - RNA, 19 nt, Mycobacterium bovis subsp bovis AF2122/97
cgacucagcacgcguucaa

SEQ ID NO: 3209132 - RNA, 13 nt, Mycobacterium bovis subsp bovis AF2122/97
cgacucaggucgg

SEQ ID NO: 3209133 - RNA, 20 nt, Mycobacterium bovis subsp bovis AF2122/97
cgacucaguucugcacagug

SEQ ID NO: 3209134 - RNA, 14 nt, Mycobacterium bovis subsp bovis AF2122/97
cgacucaucggccg

SEQ ID NO: 3209135 - RNA, 15 nt, Mycobacterium bovis subsp bovis AF2122/97
cgacucaucggccgc

SEQ ID NO: 3209136 - RNA, 22 nt, Mycobacterium bovis subsp bovis AF2122/97
cgacucaucggccgcggucggc

SEQ ID NO: 3209137 - RNA, 13 nt, Mycobacterium bovis subsp bovis AF2122/97
cgacuccacccca

SEQ ID NO: 3209138 - RNA, 16 nt, Mycobacterium bovis subsp bovis AF2122/97
cgacuccagcaccagc

SEQ ID NO: 3209139 - RNA, 22 nt, Mycobacterium bovis subsp bovis AF2122/97
cgacuccagcaccagcacggca

SEQ ID NO: 3209140 - RNA, 16 nt, Mycobacterium bovis subsp bovis AF2122/97
cgacuccccgccgggc

SEQ ID NO: 3209141 - RNA, 17 nt, Mycobacterium bovis subsp bovis AF2122/97
cgacuccccgccgggca

SEQ ID NO: 3209142 - RNA, 15 nt, Mycobacterium bovis subsp bovis AF2122/97
cgacuccgcguagag

SEQ ID NO: 3209143 - RNA, 21 nt, Mycobacterium bovis subsp bovis AF2122/97
cgacuccggcaagcacaccgc

SEQ ID NO: 3209144 - RNA, 20 nt, Mycobacterium bovis subsp bovis AF2122/97
cgacuccggcaggcccgacg

SEQ ID NO: 3209145 - RNA, 24 nt, Mycobacterium bovis subsp bovis AF2122/97
cgacuccuauugcagcacaacgga

SEQ ID NO: 3209146 - RNA, 16 nt, Mycobacterium bovis subsp bovis AF2122/97
cgacuccuggcgaaug

SEQ ID NO: 3209147 - RNA, 16 nt, Mycobacterium bovis subsp bovis AF2122/97
cgacucgaccgcgacg

SEQ ID NO: 3209148 - RNA, 20 nt, Mycobacterium bovis subsp bovis AF2122/97
cgacucgaggaccugcucgg

SEQ ID NO: 3209149 - RNA, 22 nt, Mycobacterium bovis subsp bovis AF2122/97
cgacucgauauaacccggcucc

SEQ ID NO: 3209150 - RNA, 22 nt, Mycobacterium bovis subsp bovis AF2122/97
cgacucgccggcgaauccgcac

SEQ ID NO: 3209151 - RNA, 14 nt, Mycobacterium bovis subsp bovis AF2122/97
cgacucgcgguggc

SEQ ID NO: 3209152 - RNA, 14 nt, Mycobacterium bovis subsp bovis AF2122/97
cgacucggcaccgc

SEQ ID NO: 3209153 - RNA, 15 nt, Mycobacterium bovis subsp bovis AF2122/97
cgacucggcaccgcg

SEQ ID NO: 3209154 - RNA, 23 nt, Mycobacterium bovis subsp bovis AF2122/97
cgacucggcggcgcggucgaagc

SEQ ID NO: 3209155 - RNA, 19 nt, Mycobacterium bovis subsp bovis AF2122/97
cgacucguggcgccacggc

SEQ ID NO: 3209156 - RNA, 22 nt, Mycobacterium bovis subsp bovis AF2122/97
cgacucguggcgccacggcagc

SEQ ID NO: 3209157 - RNA, 15 nt, Mycobacterium bovis subsp bovis AF2122/97
cgacucgugucugcc

SEQ ID NO: 3209158 - RNA, 13 nt, Mycobacterium bovis subsp bovis AF2122/97
cgacugagaucgc

SEQ ID NO: 3209159 - RNA, 17 nt, Mycobacterium bovis subsp bovis AF2122/97
cgacugagaucgcuucc

SEQ ID NO: 3209160 - RNA, 19 nt, Mycobacterium bovis subsp bovis AF2122/97
cgacugagaucgcuucccg

SEQ ID NO: 3209161 - RNA, 16 nt, Mycobacterium bovis subsp bovis AF2122/97
cgacugcaacucuucc

SEQ ID NO: 3209162 - RNA, 15 nt, Mycobacterium bovis subsp bovis AF2122/97
cgacugcaccuggcc

SEQ ID NO: 3209163 - RNA, 17 nt, Mycobacterium bovis subsp bovis AF2122/97
cgacugcaccuggccgc

SEQ ID NO: 3209164 - RNA, 21 nt, Mycobacterium bovis subsp bovis AF2122/97
cgacugcagaaacagccgcag

SEQ ID NO: 3209165 - RNA, 13 nt, Mycobacterium bovis subsp bovis AF2122/97
cgacugcagcggc

SEQ ID NO: 3209166 - RNA, 15 nt, Mycobacterium bovis subsp bovis AF2122/97
cgacugcagcggcgc

SEQ ID NO: 3209167 - RNA, 16 nt, Mycobacterium bovis subsp bovis AF2122/97
cgacugcagcggcgca

SEQ ID NO: 3209168 - RNA, 18 nt, Mycobacterium bovis subsp bovis AF2122/97
cgacugccagcgccgcgg

SEQ ID NO: 3209169 - RNA, 18 nt, Mycobacterium bovis subsp bovis AF2122/97
cgacugccguucagcggc

SEQ ID NO: 3209170 - RNA, 17 nt, Mycobacterium bovis subsp bovis AF2122/97
cgacugcgaaugcuggg

SEQ ID NO: 3209171 - RNA, 18 nt, Mycobacterium bovis subsp bovis AF2122/97
cgacugcgaaugcugggc

SEQ ID NO: 3209172 - RNA, 22 nt, Mycobacterium bovis subsp bovis AF2122/97
cgacugcgaaugcugggcccgc

SEQ ID NO: 3209173 - RNA, 17 nt, Mycobacterium bovis subsp bovis AF2122/97
cgacugcgucggcggcu

SEQ ID NO: 3209174 - RNA, 19 nt, Mycobacterium bovis subsp bovis AF2122/97
cgacugcgugccgcaccgc

SEQ ID NO: 3209175 - RNA, 20 nt, Mycobacterium bovis subsp bovis AF2122/97
cgacugcguuccgaucggca

SEQ ID NO: 3209176 - RNA, 16 nt, Mycobacterium bovis subsp bovis AF2122/97
cgacugcugucaccgc

SEQ ID NO: 3209177 - RNA, 21 nt, Mycobacterium bovis subsp bovis AF2122/97
cgacuggacaggucgcccaac

SEQ ID NO: 3209178 - RNA, 14 nt, Mycobacterium bovis subsp bovis AF2122/97
cgacuggccccgcc

SEQ ID NO: 3209179 - RNA, 21 nt, Mycobacterium bovis subsp bovis AF2122/97
cgacuggccccgccagcggca

SEQ ID NO: 3209180 - RNA, 20 nt, Mycobacterium bovis subsp bovis AF2122/97
cgacuggccguuucggcgcc

SEQ ID NO: 3209181 - RNA, 12 nt, Mycobacterium bovis subsp bovis AF2122/97
cgacugggacga

SEQ ID NO: 3209182 - RNA, 19 nt, Mycobacterium bovis subsp bovis AF2122/97
cgacuguccccguugagau

SEQ ID NO: 3209183 - RNA, 17 nt, Mycobacterium bovis subsp bovis AF2122/97
cgacugucccgcgcaac

SEQ ID NO: 3209184 - RNA, 20 nt, Mycobacterium bovis subsp bovis AF2122/97
cgacugugaaucucacgacg

SEQ ID NO: 3209185 - RNA, 22 nt, Mycobacterium bovis subsp bovis AF2122/97
cgacugugaaucugacgacgcg

SEQ ID NO: 3209186 - RNA, 14 nt, Mycobacterium bovis subsp bovis AF2122/97
cgacugugcgccgc

SEQ ID NO: 3209187 - RNA, 18 nt, Mycobacterium bovis subsp bovis AF2122/97
cgacugugcgccgcagcc

SEQ ID NO: 3209188 - RNA, 17 nt, Mycobacterium bovis subsp bovis AF2122/97
cgacuucagcaacgcau

SEQ ID NO: 3209189 - RNA, 18 nt, Mycobacterium bovis subsp bovis AF2122/97
cgacuucauagcgccgga

SEQ ID NO: 3209190 - RNA, 22 nt, Mycobacterium bovis subsp bovis AF2122/97
cgacuuccuguacaaccugaug

SEQ ID NO: 3209191 - RNA, 12 nt, Mycobacterium bovis subsp bovis AF2122/97
cgacuucgaugg

SEQ ID NO: 3209192 - RNA, 15 nt, Mycobacterium bovis subsp bovis AF2122/97
cgacuucggcgucgg

SEQ ID NO: 3209193 - RNA, 12 nt, Mycobacterium bovis subsp bovis AF2122/97
cgacuucuccag

SEQ ID NO: 3209194 - RNA, 17 nt, Mycobacterium bovis subsp bovis AF2122/97
cgacuucuccaggcuga

SEQ ID NO: 3209195 - RNA, 16 nt, Mycobacterium bovis subsp bovis AF2122/97
cgacuucuucgcgcaa

SEQ ID NO: 3209196 - RNA, 19 nt, Mycobacterium bovis subsp bovis AF2122/97
cgacuucuucgcgcaacca

SEQ ID NO: 3209197 - RNA, 16 nt, Mycobacterium bovis subsp bovis AF2122/97
cgacuugacggcgggu

SEQ ID NO: 3209198 - RNA, 12 nt, Mycobacterium bovis subsp bovis AF2122/97
cgacuugccgcc

SEQ ID NO: 3209199 - RNA, 17 nt, Mycobacterium bovis subsp bovis AF2122/97
cgacuugccuagcgcgg

SEQ ID NO: 3209200 - RNA, 13 nt, Mycobacterium bovis subsp bovis AF2122/97
cgacuugcggugc

SEQ ID NO: 3209201 - RNA, 13 nt, Mycobacterium bovis subsp bovis AF2122/97
cgacuugcuggcg

SEQ ID NO: 3209202 - RNA, 13 nt, Mycobacterium bovis subsp bovis AF2122/97
cgacuuggcaucg

SEQ ID NO: 3209203 - RNA, 17 nt, Mycobacterium bovis subsp bovis AF2122/97
cgacuugugacggucgu

SEQ ID NO: 3209204 - RNA, 17 nt, Mycobacterium bovis subsp bovis AF2122/97
cgacuuguugggcgcga

SEQ ID NO: 3209205 - RNA, 18 nt, Mycobacterium bovis subsp bovis AF2122/97
cgacuuguugggcgcgaa

SEQ ID NO: 3209206 - RNA, 23 nt, Mycobacterium bovis subsp bovis AF2122/97
cgagaaaaugacccacacaccga

SEQ ID NO: 3209207 - RNA, 13 nt, Mycobacterium bovis subsp bovis AF2122/97
cgagaaagugcag

SEQ ID NO: 3209208 - RNA, 17 nt, Mycobacterium bovis subsp bovis AF2122/97
cgagaaagugcaguucc

SEQ ID NO: 3209209 - RNA, 15 nt, Mycobacterium bovis subsp bovis AF2122/97
cgagaacaccacgca

SEQ ID NO: 3209210 - RNA, 13 nt, Mycobacterium bovis subsp bovis AF2122/97
cgagaacacccgu

SEQ ID NO: 3209211 - RNA, 23 nt, Mycobacterium bovis subsp bovis AF2122/97
cgagaacaccggccaacagucgc

SEQ ID NO: 3209212 - RNA, 14 nt, Mycobacterium bovis subsp bovis AF2122/97
cgagaacgaugucc

SEQ ID NO: 3209213 - RNA, 14 nt, Mycobacterium bovis subsp bovis AF2122/97
cgagaacgcccgag

SEQ ID NO: 3209214 - RNA, 15 nt, Mycobacterium bovis subsp bovis AF2122/97
cgagaacgcccgcug

SEQ ID NO: 3209215 - RNA, 23 nt, Mycobacterium bovis subsp bovis AF2122/97
cgagaacggauaauucaacagca

SEQ ID NO: 3209216 - RNA, 15 nt, Mycobacterium bovis subsp bovis AF2122/97
cgagaacggcgggcg

SEQ ID NO: 3209217 - RNA, 12 nt, Mycobacterium bovis subsp bovis AF2122/97
cgagaacgucga

SEQ ID NO: 3209218 - RNA, 13 nt, Mycobacterium bovis subsp bovis AF2122/97
cgagaagaucucg

SEQ ID NO: 3209219 - RNA, 14 nt, Mycobacterium bovis subsp bovis AF2122/97
cgagaagcugugcc

SEQ ID NO: 3209220 - RNA, 15 nt, Mycobacterium bovis subsp bovis AF2122/97
cgagaagucgcagcg

SEQ ID NO: 3209221 - RNA, 17 nt, Mycobacterium bovis subsp bovis AF2122/97
cgagaaucacggucauc

SEQ ID NO: 3209222 - RNA, 18 nt, Mycobacterium bovis subsp bovis AF2122/97
cgagaauuccccagccgc

SEQ ID NO: 3209223 - RNA, 20 nt, Mycobacterium bovis subsp bovis AF2122/97
cgagaauuccccagccgcau

SEQ ID NO: 3209224 - RNA, 21 nt, Mycobacterium bovis subsp bovis AF2122/97
cgagaccgaaacuugcucacc

SEQ ID NO: 3209225 - RNA, 14 nt, Mycobacterium bovis subsp bovis AF2122/97
cgagaccgccgcug

SEQ ID NO: 3209226 - RNA, 16 nt, Mycobacterium bovis subsp bovis AF2122/97
cgagaccgccgcugcc

SEQ ID NO: 3209227 - RNA, 19 nt, Mycobacterium bovis subsp bovis AF2122/97
cgagaccgccgcugccgcc

SEQ ID NO: 3209228 - RNA, 20 nt, Mycobacterium bovis subsp bovis AF2122/97
cgagaccgcgagcagcacag

SEQ ID NO: 3209229 - RNA, 15 nt, Mycobacterium bovis subsp bovis AF2122/97
cgagaccgcgugguc

SEQ ID NO: 3209230 - RNA, 21 nt, Mycobacterium bovis subsp bovis AF2122/97
cgagaccucucugcgccaggc

SEQ ID NO: 3209231 - RNA, 22 nt, Mycobacterium bovis subsp bovis AF2122/97
cgagaccucucugcgccaggcg

SEQ ID NO: 3209232 - RNA, 18 nt, Mycobacterium bovis subsp bovis AF2122/97
cgagacgaaccgccgacg

SEQ ID NO: 3209233 - RNA, 16 nt, Mycobacterium bovis subsp bovis AF2122/97
cgagacgacgaccggc

SEQ ID NO: 3209234 - RNA, 16 nt, Mycobacterium bovis subsp bovis AF2122/97
cgagacgcaaaaucgc

SEQ ID NO: 3209235 - RNA, 17 nt, Mycobacterium bovis subsp bovis AF2122/97
cgagacgcacggccacc

SEQ ID NO: 3209236 - RNA, 18 nt, Mycobacterium bovis subsp bovis AF2122/97
cgagacgcaugucgggcc

SEQ ID NO: 3209237 - RNA, 20 nt, Mycobacterium bovis subsp bovis AF2122/97
cgagacgcuuuccgccgcac

SEQ ID NO: 3209238 - RNA, 23 nt, Mycobacterium bovis subsp bovis AF2122/97
cgagacgcuuuccgccgcaccgg

SEQ ID NO: 3209239 - RNA, 14 nt, Mycobacterium bovis subsp bovis AF2122/97
cgagacggcgucgg

SEQ ID NO: 3209240 - RNA, 21 nt, Mycobacterium bovis subsp bovis AF2122/97
cgagacggcgucgggccguug

SEQ ID NO: 3209241 - RNA, 13 nt, Mycobacterium bovis subsp bovis AF2122/97
cgagacggcguug

SEQ ID NO: 3209242 - RNA, 22 nt, Mycobacterium bovis subsp bovis AF2122/97
cgagacggcguugucgacgaag

SEQ ID NO: 3209243 - RNA, 15 nt, Mycobacterium bovis subsp bovis AF2122/97
cgagacuccgccuug

SEQ ID NO: 3209244 - RNA, 20 nt, Mycobacterium bovis subsp bovis AF2122/97
cgagacuucgacgcggcgac

SEQ ID NO: 3209245 - RNA, 16 nt, Mycobacterium bovis subsp bovis AF2122/97
cgagacuucgguguag

SEQ ID NO: 3209246 - RNA, 14 nt, Mycobacterium bovis subsp bovis AF2122/97
cgagagcaccgacu

SEQ ID NO: 3209247 - RNA, 23 nt, Mycobacterium bovis subsp bovis AF2122/97
cgagagcaccgacuucagcaacg

SEQ ID NO: 3209248 - RNA, 14 nt, Mycobacterium bovis subsp bovis AF2122/97
cgagagcagccagc

SEQ ID NO: 3209249 - RNA, 18 nt, Mycobacterium bovis subsp bovis AF2122/97
cgagagcagccagccacc

SEQ ID NO: 3209250 - RNA, 17 nt, Mycobacterium bovis subsp bovis AF2122/97
cgagagccccgaccagc

SEQ ID NO: 3209251 - RNA, 23 nt, Mycobacterium bovis subsp bovis AF2122/97
cgagagccccgaccagcagacca

SEQ ID NO: 3209252 - RNA, 14 nt, Mycobacterium bovis subsp bovis AF2122/97
cgagagccgaccgg

SEQ ID NO: 3209253 - RNA, 14 nt, Mycobacterium bovis subsp bovis AF2122/97
cgagagccucggcc

SEQ ID NO: 3209254 - RNA, 15 nt, Mycobacterium bovis subsp bovis AF2122/97
cgagagcgcuguccc

SEQ ID NO: 3209255 - RNA, 23 nt, Mycobacterium bovis subsp bovis AF2122/97
cgagaguggacgugucaucacgg

SEQ ID NO: 3209256 - RNA, 17 nt, Mycobacterium bovis subsp bovis AF2122/97
cgagaguggccucgucc

SEQ ID NO: 3209257 - RNA, 16 nt, Mycobacterium bovis subsp bovis AF2122/97
cgagauacggccacca

SEQ ID NO: 3209258 - RNA, 19 nt, Mycobacterium bovis subsp bovis AF2122/97
cgagauacggccaccaggu

SEQ ID NO: 3209259 - RNA, 15 nt, Mycobacterium bovis subsp bovis AF2122/97
cgagauagccgacgu

SEQ ID NO: 3209260 - RNA, 17 nt, Mycobacterium bovis subsp bovis AF2122/97
cgagauauugcgcgccu

SEQ ID NO: 3209261 - RNA, 13 nt, Mycobacterium bovis subsp bovis AF2122/97
cgagaucaccgcc

SEQ ID NO: 3209262 - RNA, 15 nt, Mycobacterium bovis subsp bovis AF2122/97
cgagaucaccgccac

SEQ ID NO: 3209263 - RNA, 17 nt, Mycobacterium bovis subsp bovis AF2122/97
cgagaucaccgccacca

SEQ ID NO: 3209264 - RNA, 22 nt, Mycobacterium bovis subsp bovis AF2122/97
cgagaucaccgccaccaccagg

SEQ ID NO: 3209265 - RNA, 16 nt, Mycobacterium bovis subsp bovis AF2122/97
cgagaucagcaugccc

SEQ ID NO: 3209266 - RNA, 15 nt, Mycobacterium bovis subsp bovis AF2122/97
cgagaucagccggca

SEQ ID NO: 3209267 - RNA, 18 nt, Mycobacterium bovis subsp bovis AF2122/97
cgagaucagccggcagcg

SEQ ID NO: 3209268 - RNA, 19 nt, Mycobacterium bovis subsp bovis AF2122/97
cgagaucagccggcagcga

SEQ ID NO: 3209269 - RNA, 21 nt, Mycobacterium bovis subsp bovis AF2122/97
cgagaucagccggcagcgaga

SEQ ID NO: 3209270 - RNA, 18 nt, Mycobacterium bovis subsp bovis AF2122/97
cgagaucagucugggcga

SEQ ID NO: 3209271 - RNA, 17 nt, Mycobacterium bovis subsp bovis AF2122/97
cgagauccagcgccuug

SEQ ID NO: 3209272 - RNA, 14 nt, Mycobacterium bovis subsp bovis AF2122/97
cgagaucccagcgg

SEQ ID NO: 3209273 - RNA, 24 nt, Mycobacterium bovis subsp bovis AF2122/97
cgagaucccagcgggacaaaauca

SEQ ID NO: 3209274 - RNA, 15 nt, Mycobacterium bovis subsp bovis AF2122/97
cgagauccucgucga

SEQ ID NO: 3209275 - RNA, 18 nt, Mycobacterium bovis subsp bovis AF2122/97
cgagauccucgucgaggu

SEQ ID NO: 3209276 - RNA, 23 nt, Mycobacterium bovis subsp bovis AF2122/97
cgagauccugguaaggccggccg

SEQ ID NO: 3209277 - RNA, 17 nt, Mycobacterium bovis subsp bovis AF2122/97
cgagauccuucgcguug

SEQ ID NO: 3209278 - RNA, 15 nt, Mycobacterium bovis subsp bovis AF2122/97
cgagaucgccgagca

SEQ ID NO: 3209279 - RNA, 14 nt, Mycobacterium bovis subsp bovis AF2122/97
cgagaucgccguug

SEQ ID NO: 3209280 - RNA, 20 nt, Mycobacterium bovis subsp bovis AF2122/97
cgagaucgccguugccggcg

SEQ ID NO: 3209281 - RNA, 24 nt, Mycobacterium bovis subsp bovis AF2122/97
cgagaucgccguugccggcgacca

SEQ ID NO: 3209282 - RNA, 18 nt, Mycobacterium bovis subsp bovis AF2122/97
cgagaucgcgugcgacga

SEQ ID NO: 3209283 - RNA, 13 nt, Mycobacterium bovis subsp bovis AF2122/97
cgagaucgggccg

SEQ ID NO: 3209284 - RNA, 18 nt, Mycobacterium bovis subsp bovis AF2122/97
cgagaucucacgugcccg

SEQ ID NO: 3209285 - RNA, 22 nt, Mycobacterium bovis subsp bovis AF2122/97
cgagaucucacgugcccgcgcg

SEQ ID NO: 3209286 - RNA, 16 nt, Mycobacterium bovis subsp bovis AF2122/97
cgagaucugcgauggg

SEQ ID NO: 3209287 - RNA, 15 nt, Mycobacterium bovis subsp bovis AF2122/97
cgagaugaugcugcc

SEQ ID NO: 3209288 - RNA, 14 nt, Mycobacterium bovis subsp bovis AF2122/97
cgagaugccaucgg

SEQ ID NO: 3209289 - RNA, 20 nt, Mycobacterium bovis subsp bovis AF2122/97
cgagaugccaucggugauga

SEQ ID NO: 3209290 - RNA, 20 nt, Mycobacterium bovis subsp bovis AF2122/97
cgagaugccgcgaucgugca

SEQ ID NO: 3209291 - RNA, 22 nt, Mycobacterium bovis subsp bovis AF2122/97
cgagaugccgcgaucgugcagg

SEQ ID NO: 3209292 - RNA, 15 nt, Mycobacterium bovis subsp bovis AF2122/97
cgagaugccggcgag

SEQ ID NO: 3209293 - RNA, 23 nt, Mycobacterium bovis subsp bovis AF2122/97
cgagaugcgcaauagaccgcagu

SEQ ID NO: 3209294 - RNA, 15 nt, Mycobacterium bovis subsp bovis AF2122/97
cgagaugcugcaccc

SEQ ID NO: 3209295 - RNA, 17 nt, Mycobacterium bovis subsp bovis AF2122/97
cgagaugcugcacccgg

SEQ ID NO: 3209296 - RNA, 22 nt, Mycobacterium bovis subsp bovis AF2122/97
cgagauggaauggcugagcccg

SEQ ID NO: 3209297 - RNA, 23 nt, Mycobacterium bovis subsp bovis AF2122/97
cgagauggcgaucaugagcagca

SEQ ID NO: 3209298 - RNA, 18 nt, Mycobacterium bovis subsp bovis AF2122/97
cgagaugugagcacaccg

SEQ ID NO: 3209299 - RNA, 21 nt, Mycobacterium bovis subsp bovis AF2122/97
cgagaugugagcacaccgaca

SEQ ID NO: 3209300 - RNA, 22 nt, Mycobacterium bovis subsp bovis AF2122/97
cgagauucggagucaccagcaa

SEQ ID NO: 3209301 - RNA, 21 nt, Mycobacterium bovis subsp bovis AF2122/97
cgagauucuccugaguugcgg

SEQ ID NO: 3209302 - RNA, 20 nt, Mycobacterium bovis subsp bovis AF2122/97
cgagauugccgggccgccga

SEQ ID NO: 3209303 - RNA, 20 nt, Mycobacterium bovis subsp bovis AF2122/97
cgagauuggguccagcgagg

SEQ ID NO: 3209304 - RNA, 23 nt, Mycobacterium bovis subsp bovis AF2122/97
cgagcaaacacgccucgccgaag

SEQ ID NO: 3209305 - RNA, 17 nt, Mycobacterium bovis subsp bovis AF2122/97
cgagcaaacauccaccc

SEQ ID NO: 3209306 - RNA, 19 nt, Mycobacterium bovis subsp bovis AF2122/97
cgagcaaacauccacccgc

SEQ ID NO: 3209307 - RNA, 16 nt, Mycobacterium bovis subsp bovis AF2122/97
cgagcaacaccagggc

SEQ ID NO: 3209308 - RNA, 20 nt, Mycobacterium bovis subsp bovis AF2122/97
cgagcaacaccagggccucc

SEQ ID NO: 3209309 - RNA, 15 nt, Mycobacterium bovis subsp bovis AF2122/97
cgagcaacaccccug

SEQ ID NO: 3209310 - RNA, 13 nt, Mycobacterium bovis subsp bovis AF2122/97
cgagcaacaccgu

SEQ ID NO: 3209311 - RNA, 22 nt, Mycobacterium bovis subsp bovis AF2122/97
cgagcaacugcucgacgaggcc

SEQ ID NO: 3209312 - RNA, 23 nt, Mycobacterium bovis subsp bovis AF2122/97
cgagcaauagcuccuauggcaag

SEQ ID NO: 3209313 - RNA, 23 nt, Mycobacterium bovis subsp bovis AF2122/97
cgagcacaccgaggucgccaacc

SEQ ID NO: 3209314 - RNA, 18 nt, Mycobacterium bovis subsp bovis AF2122/97
cgagcacaggaucaccca

SEQ ID NO: 3209315 - RNA, 17 nt, Mycobacterium bovis subsp bovis AF2122/97
cgagcacaugcucgacg

SEQ ID NO: 3209316 - RNA, 15 nt, Mycobacterium bovis subsp bovis AF2122/97
cgagcacaugcugcc

SEQ ID NO: 3209317 - RNA, 18 nt, Mycobacterium bovis subsp bovis AF2122/97
cgagcaccaccccagcgg

SEQ ID NO: 3209318 - RNA, 19 nt, Mycobacterium bovis subsp bovis AF2122/97
cgagcaccaccccagcggc

SEQ ID NO: 3209319 - RNA, 23 nt, Mycobacterium bovis subsp bovis AF2122/97
cgagcaccaccccagcggccacc

SEQ ID NO: 3209320 - RNA, 14 nt, Mycobacterium bovis subsp bovis AF2122/97
cgagcaccacccgg

SEQ ID NO: 3209321 - RNA, 20 nt, Mycobacterium bovis subsp bovis AF2122/97
cgagcaccauccggucccgc

SEQ ID NO: 3209322 - RNA, 18 nt, Mycobacterium bovis subsp bovis AF2122/97
cgagcaccccgacguucg

SEQ ID NO: 3209323 - RNA, 16 nt, Mycobacterium bovis subsp bovis AF2122/97
cgagcacccgcaaugc

SEQ ID NO: 3209324 - RNA, 13 nt, Mycobacterium bovis subsp bovis AF2122/97
cgagcacccgcug

SEQ ID NO: 3209325 - RNA, 15 nt, Mycobacterium bovis subsp bovis AF2122/97
cgagcacccgcuggu

SEQ ID NO: 3209326 - RNA, 16 nt, Mycobacterium bovis subsp bovis AF2122/97
cgagcacccgcugguc

SEQ ID NO: 3209327 - RNA, 20 nt, Mycobacterium bovis subsp bovis AF2122/97
cgagcaccgacaccggccgc

SEQ ID NO: 3209328 - RNA, 21 nt, Mycobacterium bovis subsp bovis AF2122/97
cgagcaccgacaccggccgcg

SEQ ID NO: 3209329 - RNA, 18 nt, Mycobacterium bovis subsp bovis AF2122/97
cgagcaccgcaaccacgc

SEQ ID NO: 3209330 - RNA, 14 nt, Mycobacterium bovis subsp bovis AF2122/97
cgagcaccgcgaac

SEQ ID NO: 3209331 - RNA, 15 nt, Mycobacterium bovis subsp bovis AF2122/97
cgagcaccgcgaaca

SEQ ID NO: 3209332 - RNA, 13 nt, Mycobacterium bovis subsp bovis AF2122/97
cgagcaccgcgcc

SEQ ID NO: 3209333 - RNA, 13 nt, Mycobacterium bovis subsp bovis AF2122/97
cgagcaccggcug

SEQ ID NO: 3209334 - RNA, 14 nt, Mycobacterium bovis subsp bovis AF2122/97
cgagcaccucggcc

SEQ ID NO: 3209335 - RNA, 18 nt, Mycobacterium bovis subsp bovis AF2122/97
cgagcaccugaccguuga

SEQ ID NO: 3209336 - RNA, 22 nt, Mycobacterium bovis subsp bovis AF2122/97
cgagcaccuuggggugggcgac

SEQ ID NO: 3209337 - RNA, 18 nt, Mycobacterium bovis subsp bovis AF2122/97
cgagcacgacgacgucgg

SEQ ID NO: 3209338 - RNA, 15 nt, Mycobacterium bovis subsp bovis AF2122/97
cgagcacgaugucga

SEQ ID NO: 3209339 - RNA, 19 nt, Mycobacterium bovis subsp bovis AF2122/97
cgagcacgaugucgaugcc

SEQ ID NO: 3209340 - RNA, 14 nt, Mycobacterium bovis subsp bovis AF2122/97
cgagcacgccgacc

SEQ ID NO: 3209341 - RNA, 17 nt, Mycobacterium bovis subsp bovis AF2122/97
cgagcacgccgaccaau

SEQ ID NO: 3209342 - RNA, 20 nt, Mycobacterium bovis subsp bovis AF2122/97
cgagcacgccgagcccgccg

SEQ ID NO: 3209343 - RNA, 21 nt, Mycobacterium bovis subsp bovis AF2122/97
cgagcacgccgagcccgccgg

SEQ ID NO: 3209344 - RNA, 22 nt, Mycobacterium bovis subsp bovis AF2122/97
cgagcacgcgggcacugguggc

SEQ ID NO: 3209345 - RNA, 23 nt, Mycobacterium bovis subsp bovis AF2122/97
cgagcacgggacuucgugccucg

SEQ ID NO: 3209346 - RNA, 21 nt, Mycobacterium bovis subsp bovis AF2122/97
cgagcacggguagcguccagg

SEQ ID NO: 3209347 - RNA, 16 nt, Mycobacterium bovis subsp bovis AF2122/97
cgagcacggugagccg

SEQ ID NO: 3209348 - RNA, 21 nt, Mycobacterium bovis subsp bovis AF2122/97
cgagcacggugagccgguggc

SEQ ID NO: 3209349 - RNA, 19 nt, Mycobacterium bovis subsp bovis AF2122/97
cgagcacgucacgcgcggc

SEQ ID NO: 3209350 - RNA, 14 nt, Mycobacterium bovis subsp bovis AF2122/97
cgagcacucggcca

SEQ ID NO: 3209351 - RNA, 15 nt, Mycobacterium bovis subsp bovis AF2122/97
cgagcacucggccac

SEQ ID NO: 3209352 - RNA, 16 nt, Mycobacterium bovis subsp bovis AF2122/97
cgagcacucggccacg

SEQ ID NO: 3209353 - RNA, 22 nt, Mycobacterium bovis subsp bovis AF2122/97
cgagcacucggccacgacgacu

SEQ ID NO: 3209354 - RNA, 20 nt, Mycobacterium bovis subsp bovis AF2122/97
cgagcacugaggagaugagc

SEQ ID NO: 3209355 - RNA, 16 nt, Mycobacterium bovis subsp bovis AF2122/97
cgagcagaaacaacgu

SEQ ID NO: 3209356 - RNA, 19 nt, Mycobacterium bovis subsp bovis AF2122/97
cgagcagacacagaaucgc

SEQ ID NO: 3209357 - RNA, 19 nt, Mycobacterium bovis subsp bovis AF2122/97
cgagcagacgcaaaagccc

SEQ ID NO: 3209358 - RNA, 19 nt, Mycobacterium bovis subsp bovis AF2122/97
cgagcagacgcaaaaucgc

SEQ ID NO: 3209359 - RNA, 20 nt, Mycobacterium bovis subsp bovis AF2122/97
cgagcagacgcaaaaucgcc

SEQ ID NO: 3209360 - RNA, 23 nt, Mycobacterium bovis subsp bovis AF2122/97
cgagcagacgcaaaaucgcccaa

SEQ ID NO: 3209361 - RNA, 15 nt, Mycobacterium bovis subsp bovis AF2122/97
cgagcagacgcagaa

SEQ ID NO: 3209362 - RNA, 20 nt, Mycobacterium bovis subsp bovis AF2122/97
cgagcagacgcagaaucgca

SEQ ID NO: 3209363 - RNA, 20 nt, Mycobacterium bovis subsp bovis AF2122/97
cgagcagacgcagaaucgcc

SEQ ID NO: 3209364 - RNA, 21 nt, Mycobacterium bovis subsp bovis AF2122/97
cgagcagacgcauaagccccc

SEQ ID NO: 3209365 - RNA, 16 nt, Mycobacterium bovis subsp bovis AF2122/97
cgagcagacgccgcgu

SEQ ID NO: 3209366 - RNA, 17 nt, Mycobacterium bovis subsp bovis AF2122/97
cgagcagacgccgcguu

SEQ ID NO: 3209367 - RNA, 13 nt, Mycobacterium bovis subsp bovis AF2122/97
cgagcagacgcga

SEQ ID NO: 3209368 - RNA, 19 nt, Mycobacterium bovis subsp bovis AF2122/97
cgagcagacgcgaaagcac

SEQ ID NO: 3209369 - RNA, 23 nt, Mycobacterium bovis subsp bovis AF2122/97
cgagcagacgcgaaagcacccca

SEQ ID NO: 3209370 - RNA, 19 nt, Mycobacterium bovis subsp bovis AF2122/97
cgagcagacgcgaaauccc

SEQ ID NO: 3209371 - RNA, 15 nt, Mycobacterium bovis subsp bovis AF2122/97
cgagcagacgcggaa

SEQ ID NO: 3209372 - RNA, 18 nt, Mycobacterium bovis subsp bovis AF2122/97
cgagcagacgcggaaucg

SEQ ID NO: 3209373 - RNA, 19 nt, Mycobacterium bovis subsp bovis AF2122/97
cgagcagacgcggaaucgc

SEQ ID NO: 3209374 - RNA, 19 nt, Mycobacterium bovis subsp bovis AF2122/97
cgagcagacguaaaagccc

SEQ ID NO: 3209375 - RNA, 20 nt, Mycobacterium bovis subsp bovis AF2122/97
cgagcagacguaaaagcccc

SEQ ID NO: 3209376 - RNA, 21 nt, Mycobacterium bovis subsp bovis AF2122/97
cgagcagacguaaaagccccc

SEQ ID NO: 3209377 - RNA, 22 nt, Mycobacterium bovis subsp bovis AF2122/97
cgagcagacguaaaagcccccg

SEQ ID NO: 3209378 - RNA, 17 nt, Mycobacterium bovis subsp bovis AF2122/97
cgagcagacgugggcgc

SEQ ID NO: 3209379 - RNA, 14 nt, Mycobacterium bovis subsp bovis AF2122/97
cgagcagauacucc

SEQ ID NO: 3209380 - RNA, 16 nt, Mycobacterium bovis subsp bovis AF2122/97
cgagcagauacuccgc

SEQ ID NO: 3209381 - RNA, 20 nt, Mycobacterium bovis subsp bovis AF2122/97
cgagcagauacuccgcgguu

SEQ ID NO: 3209382 - RNA, 21 nt, Mycobacterium bovis subsp bovis AF2122/97
cgagcagauacuccgcgguug

SEQ ID NO: 3209383 - RNA, 22 nt, Mycobacterium bovis subsp bovis AF2122/97
cgagcagauacuccgcgguugu

SEQ ID NO: 3209384 - RNA, 15 nt, Mycobacterium bovis subsp bovis AF2122/97
cgagcagauggugaa

SEQ ID NO: 3209385 - RNA, 17 nt, Mycobacterium bovis subsp bovis AF2122/97
cgagcagauggugaacg

SEQ ID NO: 3209386 - RNA, 13 nt, Mycobacterium bovis subsp bovis AF2122/97
cgagcagcacagc

SEQ ID NO: 3209387 - RNA, 17 nt, Mycobacterium bovis subsp bovis AF2122/97
cgagcagcaccacccgc

SEQ ID NO: 3209388 - RNA, 18 nt, Mycobacterium bovis subsp bovis AF2122/97
cgagcagcagaaacggcg

SEQ ID NO: 3209389 - RNA, 13 nt, Mycobacterium bovis subsp bovis AF2122/97
cgagcagcaggua

SEQ ID NO: 3209390 - RNA, 13 nt, Mycobacterium bovis subsp bovis AF2122/97
cgagcagcccgcg

SEQ ID NO: 3209391 - RNA, 13 nt, Mycobacterium bovis subsp bovis AF2122/97
cgagcagcccggc

SEQ ID NO: 3209392 - RNA, 15 nt, Mycobacterium bovis subsp bovis AF2122/97
cgagcagccgaugcu

SEQ ID NO: 3209393 - RNA, 17 nt, Mycobacterium bovis subsp bovis AF2122/97
cgagcagccgaugcugc

SEQ ID NO: 3209394 - RNA, 16 nt, Mycobacterium bovis subsp bovis AF2122/97
cgagcagccgcgacau

SEQ ID NO: 3209395 - RNA, 14 nt, Mycobacterium bovis subsp bovis AF2122/97
cgagcagcgcgccg

SEQ ID NO: 3209396 - RNA, 22 nt, Mycobacterium bovis subsp bovis AF2122/97
cgagcagcgcgccguucgccug

SEQ ID NO: 3209397 - RNA, 14 nt, Mycobacterium bovis subsp bovis AF2122/97
cgagcagcuacagc

SEQ ID NO: 3209398 - RNA, 12 nt, Mycobacterium bovis subsp bovis AF2122/97
cgagcagcucaa

SEQ ID NO: 3209399 - RNA, 23 nt, Mycobacterium bovis subsp bovis AF2122/97
cgagcagcuccuugaggucaccc

SEQ ID NO: 3209400 - RNA, 22 nt, Mycobacterium bovis subsp bovis AF2122/97
cgagcaggauaaacccggcgag

SEQ ID NO: 3209401 - RNA, 19 nt, Mycobacterium bovis subsp bovis AF2122/97
cgagcaggaugcgaucguc

SEQ ID NO: 3209402 - RNA, 23 nt, Mycobacterium bovis subsp bovis AF2122/97
cgagcaggaugcgaucgucacgc

SEQ ID NO: 3209403 - RNA, 19 nt, Mycobacterium bovis subsp bovis AF2122/97
cgagcaggcccaacgcgau

SEQ ID NO: 3209404 - RNA, 23 nt, Mycobacterium bovis subsp bovis AF2122/97
cgagcaggcccaacgcgaugucc

SEQ ID NO: 3209405 - RNA, 14 nt, Mycobacterium bovis subsp bovis AF2122/97
cgagcaggccgccc

SEQ ID NO: 3209406 - RNA, 15 nt, Mycobacterium bovis subsp bovis AF2122/97
cgagcaggccgccca

SEQ ID NO: 3209407 - RNA, 13 nt, Mycobacterium bovis subsp bovis AF2122/97
cgagcaggcuggc

SEQ ID NO: 3209408 - RNA, 18 nt, Mycobacterium bovis subsp bovis AF2122/97
cgagcagggccggcaccg

SEQ ID NO: 3209409 - RNA, 20 nt, Mycobacterium bovis subsp bovis AF2122/97
cgagcagggccggcaccgca

SEQ ID NO: 3209410 - RNA, 22 nt, Mycobacterium bovis subsp bovis AF2122/97
cgagcagggccggcaccgcagc

SEQ ID NO: 3209411 - RNA, 16 nt, Mycobacterium bovis subsp bovis AF2122/97
cgagcagggcgucgac

SEQ ID NO: 3209412 - RNA, 17 nt, Mycobacterium bovis subsp bovis AF2122/97
cgagcaggggaguugcu

SEQ ID NO: 3209413 - RNA, 14 nt, Mycobacterium bovis subsp bovis AF2122/97
cgagcagggugacc

SEQ ID NO: 3209414 - RNA, 20 nt, Mycobacterium bovis subsp bovis AF2122/97
cgagcagguguugcacgagc

SEQ ID NO: 3209415 - RNA, 22 nt, Mycobacterium bovis subsp bovis AF2122/97
cgagcagguguugcacgagcau

SEQ ID NO: 3209416 - RNA, 19 nt, Mycobacterium bovis subsp bovis AF2122/97
cgagcagucgcaaaagccc

SEQ ID NO: 3209417 - RNA, 17 nt, Mycobacterium bovis subsp bovis AF2122/97
cgagcagugaccgcugg

SEQ ID NO: 3209418 - RNA, 18 nt, Mycobacterium bovis subsp bovis AF2122/97
cgagcagugaccgcuggu

SEQ ID NO: 3209419 - RNA, 20 nt, Mycobacterium bovis subsp bovis AF2122/97
cgagcagugccucggcgaug

SEQ ID NO: 3209420 - RNA, 16 nt, Mycobacterium bovis subsp bovis AF2122/97
cgagcaguggccgccg

SEQ ID NO: 3209421 - RNA, 17 nt, Mycobacterium bovis subsp bovis AF2122/97
cgagcaguuccagcucg

SEQ ID NO: 3209422 - RNA, 18 nt, Mycobacterium bovis subsp bovis AF2122/97
cgagcaguuccagcucgc

SEQ ID NO: 3209423 - RNA, 22 nt, Mycobacterium bovis subsp bovis AF2122/97
cgagcaguuccagcucgcggug

SEQ ID NO: 3209424 - RNA, 22 nt, Mycobacterium bovis subsp bovis AF2122/97
cgagcaguucucggucccgccg

SEQ ID NO: 3209425 - RNA, 18 nt, Mycobacterium bovis subsp bovis AF2122/97
cgagcauaccgccgcugc

SEQ ID NO: 3209426 - RNA, 19 nt, Mycobacterium bovis subsp bovis AF2122/97
cgagcaucaacgaaccagc

SEQ ID NO: 3209427 - RNA, 16 nt, Mycobacterium bovis subsp bovis AF2122/97
cgagcaucagauucgc

SEQ ID NO: 3209428 - RNA, 23 nt, Mycobacterium bovis subsp bovis AF2122/97
cgagcauccacccauagacccgg

SEQ ID NO: 3209429 - RNA, 16 nt, Mycobacterium bovis subsp bovis AF2122/97
cgagcaucucgacauc

SEQ ID NO: 3209430 - RNA, 21 nt, Mycobacterium bovis subsp bovis AF2122/97
cgagcaucucgacaucggcca

SEQ ID NO: 3209431 - RNA, 22 nt, Mycobacterium bovis subsp bovis AF2122/97
cgagcaucucgacaucggccag

SEQ ID NO: 3209432 - RNA, 17 nt, Mycobacterium bovis subsp bovis AF2122/97
cgagcaucucgucggug

SEQ ID NO: 3209433 - RNA, 20 nt, Mycobacterium bovis subsp bovis AF2122/97
cgagcaucuucgcgcagccg

SEQ ID NO: 3209434 - RNA, 19 nt, Mycobacterium bovis subsp bovis AF2122/97
cgagcaugauguccuccca

SEQ ID NO: 3209435 - RNA, 19 nt, Mycobacterium bovis subsp bovis AF2122/97
cgagcauuucggaugccgc

SEQ ID NO: 3209436 - RNA, 22 nt, Mycobacterium bovis subsp bovis AF2122/97
cgagcauuucggaugccgcggc

SEQ ID NO: 3209437 - RNA, 21 nt, Mycobacterium bovis subsp bovis AF2122/97
cgagccaaacuacccgcccac

SEQ ID NO: 3209438 - RNA, 23 nt, Mycobacterium bovis subsp bovis AF2122/97
cgagccaaacuacccgcccacgg

SEQ ID NO: 3209439 - RNA, 13 nt, Mycobacterium bovis subsp bovis AF2122/97
cgagccaacgcau

SEQ ID NO: 3209440 - RNA, 17 nt, Mycobacterium bovis subsp bovis AF2122/97
cgagccaacgcgcagag

SEQ ID NO: 3209441 - RNA, 20 nt, Mycobacterium bovis subsp bovis AF2122/97
cgagccaacuccacccaacg

SEQ ID NO: 3209442 - RNA, 14 nt, Mycobacterium bovis subsp bovis AF2122/97
cgagccaaggcuuc

SEQ ID NO: 3209443 - RNA, 19 nt, Mycobacterium bovis subsp bovis AF2122/97
cgagccacaaaggcgccgg

SEQ ID NO: 3209444 - RNA, 12 nt, Mycobacterium bovis subsp bovis AF2122/97
cgagccacagcg

SEQ ID NO: 3209445 - RNA, 16 nt, Mycobacterium bovis subsp bovis AF2122/97
cgagccacagcgucga

SEQ ID NO: 3209446 - RNA, 17 nt, Mycobacterium bovis subsp bovis AF2122/97
cgagccacaugaccuga

SEQ ID NO: 3209447 - RNA, 22 nt, Mycobacterium bovis subsp bovis AF2122/97
cgagccacaugaccugauccgg

SEQ ID NO: 3209448 - RNA, 13 nt, Mycobacterium bovis subsp bovis AF2122/97
cgagccaccaccg

SEQ ID NO: 3209449 - RNA, 16 nt, Mycobacterium bovis subsp bovis AF2122/97
cgagccaccaccgccg

SEQ ID NO: 3209450 - RNA, 17 nt, Mycobacterium bovis subsp bovis AF2122/97
cgagccaccaccgccga

SEQ ID NO: 3209451 - RNA, 21 nt, Mycobacterium bovis subsp bovis AF2122/97
cgagccacgccagcgucgacc

SEQ ID NO: 3209452 - RNA, 15 nt, Mycobacterium bovis subsp bovis AF2122/97
cgagccacggcuucg

SEQ ID NO: 3209453 - RNA, 16 nt, Mycobacterium bovis subsp bovis AF2122/97
cgagccacggcuucgc

SEQ ID NO: 3209454 - RNA, 15 nt, Mycobacterium bovis subsp bovis AF2122/97
cgagccagcacccgc

SEQ ID NO: 3209455 - RNA, 14 nt, Mycobacterium bovis subsp bovis AF2122/97
cgagccagcggagc

SEQ ID NO: 3209456 - RNA, 13 nt, Mycobacterium bovis subsp bovis AF2122/97
cgagccagcuccg

SEQ ID NO: 3209457 - RNA, 18 nt, Mycobacterium bovis subsp bovis AF2122/97
cgagccagcuccggcgcu

SEQ ID NO: 3209458 - RNA, 21 nt, Mycobacterium bovis subsp bovis AF2122/97
cgagccagcugcuccacccga

SEQ ID NO: 3209459 - RNA, 19 nt, Mycobacterium bovis subsp bovis AF2122/97
cgagccagggaggggccgu

SEQ ID NO: 3209460 - RNA, 13 nt, Mycobacterium bovis subsp bovis AF2122/97
cgagccaucaccg

SEQ ID NO: 3209461 - RNA, 17 nt, Mycobacterium bovis subsp bovis AF2122/97
cgagccaucaccgcaag

SEQ ID NO: 3209462 - RNA, 15 nt, Mycobacterium bovis subsp bovis AF2122/97
cgagcccaccgucgc

SEQ ID NO: 3209463 - RNA, 16 nt, Mycobacterium bovis subsp bovis AF2122/97
cgagcccaccgucgca

SEQ ID NO: 3209464 - RNA, 16 nt, Mycobacterium bovis subsp bovis AF2122/97
cgagcccagccgggca

SEQ ID NO: 3209465 - RNA, 18 nt, Mycobacterium bovis subsp bovis AF2122/97
cgagcccagccgggcacc

SEQ ID NO: 3209466 - RNA, 13 nt, Mycobacterium bovis subsp bovis AF2122/97
cgagcccagcgcc

SEQ ID NO: 3209467 - RNA, 13 nt, Mycobacterium bovis subsp bovis AF2122/97
cgagcccagcugc

SEQ ID NO: 3209468 - RNA, 14 nt, Mycobacterium bovis subsp bovis AF2122/97
cgagcccagcugcg

SEQ ID NO: 3209469 - RNA, 17 nt, Mycobacterium bovis subsp bovis AF2122/97
cgagcccagcugcgccg

SEQ ID NO: 3209470 - RNA, 18 nt, Mycobacterium bovis subsp bovis AF2122/97
cgagcccagcugcgccga

SEQ ID NO: 3209471 - RNA, 20 nt, Mycobacterium bovis subsp bovis AF2122/97
cgagcccagcugcgccgaac

SEQ ID NO: 3209472 - RNA, 21 nt, Mycobacterium bovis subsp bovis AF2122/97
cgagcccgaaccaccgcguug

SEQ ID NO: 3209473 - RNA, 20 nt, Mycobacterium bovis subsp bovis AF2122/97
cgagcccgaucgcggcccgg

SEQ ID NO: 3209474 - RNA, 21 nt, Mycobacterium bovis subsp bovis AF2122/97
cgagcccgaucgcggcccggc

SEQ ID NO: 3209475 - RNA, 21 nt, Mycobacterium bovis subsp bovis AF2122/97
cgagcccgaugguggugccga

SEQ ID NO: 3209476 - RNA, 22 nt, Mycobacterium bovis subsp bovis AF2122/97
cgagcccgaugguggugccgac

SEQ ID NO: 3209477 - RNA, 14 nt, Mycobacterium bovis subsp bovis AF2122/97
cgagcccgcaucgc

SEQ ID NO: 3209478 - RNA, 17 nt, Mycobacterium bovis subsp bovis AF2122/97
cgagcccgccggccucu

SEQ ID NO: 3209479 - RNA, 22 nt, Mycobacterium bovis subsp bovis AF2122/97
cgagcccgccggccucuggauc

SEQ ID NO: 3209480 - RNA, 16 nt, Mycobacterium bovis subsp bovis AF2122/97
cgagcccgcugcgccg

SEQ ID NO: 3209481 - RNA, 13 nt, Mycobacterium bovis subsp bovis AF2122/97
cgagcccggagcg

SEQ ID NO: 3209482 - RNA, 14 nt, Mycobacterium bovis subsp bovis AF2122/97
cgagcccggccucg

SEQ ID NO: 3209483 - RNA, 18 nt, Mycobacterium bovis subsp bovis AF2122/97
cgagcccggccucggcga

SEQ ID NO: 3209484 - RNA, 14 nt, Mycobacterium bovis subsp bovis AF2122/97
cgagcccgggccgu

SEQ ID NO: 3209485 - RNA, 18 nt, Mycobacterium bovis subsp bovis AF2122/97
cgagcccgggccguacgg

SEQ ID NO: 3209486 - RNA, 16 nt, Mycobacterium bovis subsp bovis AF2122/97
cgagcccggugcuacc

SEQ ID NO: 3209487 - RNA, 18 nt, Mycobacterium bovis subsp bovis AF2122/97
cgagcccguccucgucgg

SEQ ID NO: 3209488 - RNA, 20 nt, Mycobacterium bovis subsp bovis AF2122/97
cgagcccguccucgucggug

SEQ ID NO: 3209489 - RNA, 22 nt, Mycobacterium bovis subsp bovis AF2122/97
cgagcccucguuaucgaccgcc

SEQ ID NO: 3209490 - RNA, 13 nt, Mycobacterium bovis subsp bovis AF2122/97
cgagccgacaucg

SEQ ID NO: 3209491 - RNA, 15 nt, Mycobacterium bovis subsp bovis AF2122/97
cgagccgacccgacg

SEQ ID NO: 3209492 - RNA, 15 nt, Mycobacterium bovis subsp bovis AF2122/97
cgagccgaccggcgg

SEQ ID NO: 3209493 - RNA, 19 nt, Mycobacterium bovis subsp bovis AF2122/97
cgagccgagccucgcucuc

SEQ ID NO: 3209494 - RNA, 15 nt, Mycobacterium bovis subsp bovis AF2122/97
cgagccgaucugcug

SEQ ID NO: 3209495 - RNA, 20 nt, Mycobacterium bovis subsp bovis AF2122/97
cgagccgcaaaaucgaugac

SEQ ID NO: 3209496 - RNA, 12 nt, Mycobacterium bovis subsp bovis AF2122/97
cgagccgcacaa

SEQ ID NO: 3209497 - RNA, 20 nt, Mycobacterium bovis subsp bovis AF2122/97
cgagccgcacaaacgggcgu

SEQ ID NO: 3209498 - RNA, 24 nt, Mycobacterium bovis subsp bovis AF2122/97
cgagccgcacaaacgggcgugggc

SEQ ID NO: 3209499 - RNA, 17 nt, Mycobacterium bovis subsp bovis AF2122/97
cgagccgcacgaugccg

SEQ ID NO: 3209500 - RNA, 12 nt, Mycobacterium bovis subsp bovis AF2122/97
cgagccgcagcu

SEQ ID NO: 3209501 - RNA, 17 nt, Mycobacterium bovis subsp bovis AF2122/97
cgagccgcagcucgccg

SEQ ID NO: 3209502 - RNA, 14 nt, Mycobacterium bovis subsp bovis AF2122/97
cgagccgccaccgu

SEQ ID NO: 3209503 - RNA, 14 nt, Mycobacterium bovis subsp bovis AF2122/97
cgagccgcccgccc

SEQ ID NO: 3209504 - RNA, 14 nt, Mycobacterium bovis subsp bovis AF2122/97
cgagccgccgugga

SEQ ID NO: 3209505 - RNA, 21 nt, Mycobacterium bovis subsp bovis AF2122/97
cgagccgcgcccaaugcgggc

SEQ ID NO: 3209506 - RNA, 21 nt, Mycobacterium bovis subsp bovis AF2122/97
cgagccgcggcaacaccaccu

SEQ ID NO: 3209507 - RNA, 14 nt, Mycobacterium bovis subsp bovis AF2122/97
cgagccgcggucac

SEQ ID NO: 3209508 - RNA, 19 nt, Mycobacterium bovis subsp bovis AF2122/97
cgagccgcggucaccccgg

SEQ ID NO: 3209509 - RNA, 18 nt, Mycobacterium bovis subsp bovis AF2122/97
cgagccgcggucggcgug

SEQ ID NO: 3209510 - RNA, 22 nt, Mycobacterium bovis subsp bovis AF2122/97
cgagccgcggucggcgugcagg

SEQ ID NO: 3209511 - RNA, 15 nt, Mycobacterium bovis subsp bovis AF2122/97
cgagccgcgugggcc

SEQ ID NO: 3209512 - RNA, 12 nt, Mycobacterium bovis subsp bovis AF2122/97
cgagccgcucca

SEQ ID NO: 3209513 - RNA, 20 nt, Mycobacterium bovis subsp bovis AF2122/97
cgagccggauucggcugcca

SEQ ID NO: 3209514 - RNA, 17 nt, Mycobacterium bovis subsp bovis AF2122/97
cgagccggcgccggguc

SEQ ID NO: 3209515 - RNA, 12 nt, Mycobacterium bovis subsp bovis AF2122/97
cgagccggcgcg

SEQ ID NO: 3209516 - RNA, 22 nt, Mycobacterium bovis subsp bovis AF2122/97
cgagccggcggccuugcgggcu

SEQ ID NO: 3209517 - RNA, 15 nt, Mycobacterium bovis subsp bovis AF2122/97
cgagccggcucagac

SEQ ID NO: 3209518 - RNA, 16 nt, Mycobacterium bovis subsp bovis AF2122/97
cgagccggcucagacg

SEQ ID NO: 3209519 - RNA, 19 nt, Mycobacterium bovis subsp bovis AF2122/97
cgagccgguaaccgcgucg

SEQ ID NO: 3209520 - RNA, 22 nt, Mycobacterium bovis subsp bovis AF2122/97
cgagccgguaaccgcgucgacc

SEQ ID NO: 3209521 - RNA, 18 nt, Mycobacterium bovis subsp bovis AF2122/97
cgagccgguauacccggc

SEQ ID NO: 3209522 - RNA, 21 nt, Mycobacterium bovis subsp bovis AF2122/97
cgagccgguauacccggcccc

SEQ ID NO: 3209523 - RNA, 17 nt, Mycobacterium bovis subsp bovis AF2122/97
cgagccggugauccggu

SEQ ID NO: 3209524 - RNA, 19 nt, Mycobacterium bovis subsp bovis AF2122/97
cgagccggugccacugccg

SEQ ID NO: 3209525 - RNA, 15 nt, Mycobacterium bovis subsp bovis AF2122/97
cgagccggugcgcgc

SEQ ID NO: 3209526 - RNA, 13 nt, Mycobacterium bovis subsp bovis AF2122/97
cgagccguagacc

SEQ ID NO: 3209527 - RNA, 22 nt, Mycobacterium bovis subsp bovis AF2122/97
cgagccguccaauuccgcagag

SEQ ID NO: 3209528 - RNA, 22 nt, Mycobacterium bovis subsp bovis AF2122/97
cgagccucgcucuccauggccg

SEQ ID NO: 3209529 - RNA, 20 nt, Mycobacterium bovis subsp bovis AF2122/97
cgagccugauaaagcccggc

SEQ ID NO: 3209530 - RNA, 22 nt, Mycobacterium bovis subsp bovis AF2122/97
cgagccugauaaagcccggcgg

SEQ ID NO: 3209531 - RNA, 23 nt, Mycobacterium bovis subsp bovis AF2122/97
cgagccugauaaagcccggcggc

SEQ ID NO: 3209532 - RNA, 19 nt, Mycobacterium bovis subsp bovis AF2122/97
cgagccuugagcgcggcua

SEQ ID NO: 3209533 - RNA, 13 nt, Mycobacterium bovis subsp bovis AF2122/97
cgagcgaaccgaa

SEQ ID NO: 3209534 - RNA, 18 nt, Mycobacterium bovis subsp bovis AF2122/97
cgagcgacccccagcgcc

SEQ ID NO: 3209535 - RNA, 15 nt, Mycobacterium bovis subsp bovis AF2122/97
cgagcgagaaucacg

SEQ ID NO: 3209536 - RNA, 14 nt, Mycobacterium bovis subsp bovis AF2122/97
cgagcgagccaacu

SEQ ID NO: 3209537 - RNA, 16 nt, Mycobacterium bovis subsp bovis AF2122/97
cgagcgauacgucguc

SEQ ID NO: 3209538 - RNA, 20 nt, Mycobacterium bovis subsp bovis AF2122/97
cgagcgauacgucgucagcc

SEQ ID NO: 3209539 - RNA, 21 nt, Mycobacterium bovis subsp bovis AF2122/97
cgagcgauacgucgucagcca

SEQ ID NO: 3209540 - RNA, 16 nt, Mycobacterium bovis subsp bovis AF2122/97
cgagcgaugcgaccga

SEQ ID NO: 3209541 - RNA, 21 nt, Mycobacterium bovis subsp bovis AF2122/97
cgagcgcaacucccagcacgg

SEQ ID NO: 3209542 - RNA, 19 nt, Mycobacterium bovis subsp bovis AF2122/97
cgagcgcaaucgaccacga

SEQ ID NO: 3209543 - RNA, 15 nt, Mycobacterium bovis subsp bovis AF2122/97
cgagcgcacaccggc

SEQ ID NO: 3209544 - RNA, 17 nt, Mycobacterium bovis subsp bovis AF2122/97
cgagcgcacaccggcuu

SEQ ID NO: 3209545 - RNA, 13 nt, Mycobacterium bovis subsp bovis AF2122/97
cgagcgcaccacg

SEQ ID NO: 3209546 - RNA, 15 nt, Mycobacterium bovis subsp bovis AF2122/97
cgagcgcaccacggc

SEQ ID NO: 3209547 - RNA, 13 nt, Mycobacterium bovis subsp bovis AF2122/97
cgagcgcaccgcu

SEQ ID NO: 3209548 - RNA, 19 nt, Mycobacterium bovis subsp bovis AF2122/97
cgagcgcaccgcugaccgc

SEQ ID NO: 3209549 - RNA, 19 nt, Mycobacterium bovis subsp bovis AF2122/97
cgagcgcacuggggaggcc

SEQ ID NO: 3209550 - RNA, 20 nt, Mycobacterium bovis subsp bovis AF2122/97
cgagcgcacuggggaggcca

SEQ ID NO: 3209551 - RNA, 13 nt, Mycobacterium bovis subsp bovis AF2122/97
cgagcgcagcgca

SEQ ID NO: 3209552 - RNA, 14 nt, Mycobacterium bovis subsp bovis AF2122/97
cgagcgcagcgugu

SEQ ID NO: 3209553 - RNA, 15 nt, Mycobacterium bovis subsp bovis AF2122/97
cgagcgcagcguguu

SEQ ID NO: 3209554 - RNA, 16 nt, Mycobacterium bovis subsp bovis AF2122/97
cgagcgcaucgauggc

SEQ ID NO: 3209555 - RNA, 20 nt, Mycobacterium bovis subsp bovis AF2122/97
cgagcgcaucggccaacacc

SEQ ID NO: 3209556 - RNA, 23 nt, Mycobacterium bovis subsp bovis AF2122/97
cgagcgcauguugcaggcgcagc

SEQ ID NO: 3209557 - RNA, 15 nt, Mycobacterium bovis subsp bovis AF2122/97
cgagcgccagcgcca

SEQ ID NO: 3209558 - RNA, 14 nt, Mycobacterium bovis subsp bovis AF2122/97
cgagcgccagguca

SEQ ID NO: 3209559 - RNA, 22 nt, Mycobacterium bovis subsp bovis AF2122/97
cgagcgccaggucagcucgagc

SEQ ID NO: 3209560 - RNA, 17 nt, Mycobacterium bovis subsp bovis AF2122/97
cgagcgcccacugguga

SEQ ID NO: 3209561 - RNA, 11 nt, Mycobacterium bovis subsp bovis AF2122/97
cgagcgccggc

SEQ ID NO: 3209562 - RNA, 13 nt, Mycobacterium bovis subsp bovis AF2122/97
cgagcgccggccg

SEQ ID NO: 3209563 - RNA, 14 nt, Mycobacterium bovis subsp bovis AF2122/97
cgagcgccggccgc

SEQ ID NO: 3209564 - RNA, 15 nt, Mycobacterium bovis subsp bovis AF2122/97
cgagcgccggccgcg

SEQ ID NO: 3209565 - RNA, 17 nt, Mycobacterium bovis subsp bovis AF2122/97
cgagcgccggccgcggc

SEQ ID NO: 3209566 - RNA, 20 nt, Mycobacterium bovis subsp bovis AF2122/97
cgagcgccggccgcggcggc

SEQ ID NO: 3209567 - RNA, 18 nt, Mycobacterium bovis subsp bovis AF2122/97
cgagcgccggccgcgggu

SEQ ID NO: 3209568 - RNA, 18 nt, Mycobacterium bovis subsp bovis AF2122/97
cgagcgccuuuggcggug

SEQ ID NO: 3209569 - RNA, 16 nt, Mycobacterium bovis subsp bovis AF2122/97
cgagcgcgaucgggcc

SEQ ID NO: 3209570 - RNA, 17 nt, Mycobacterium bovis subsp bovis AF2122/97
cgagcgcgaucgggccg

SEQ ID NO: 3209571 - RNA, 18 nt, Mycobacterium bovis subsp bovis AF2122/97
cgagcgcgaucgggccgg

SEQ ID NO: 3209572 - RNA, 19 nt, Mycobacterium bovis subsp bovis AF2122/97
cgagcgcgaugcagugcga

SEQ ID NO: 3209573 - RNA, 16 nt, Mycobacterium bovis subsp bovis AF2122/97
cgagcgcgccaaucgc

SEQ ID NO: 3209574 - RNA, 20 nt, Mycobacterium bovis subsp bovis AF2122/97
cgagcgcgccaaucgcccag

SEQ ID NO: 3209575 - RNA, 17 nt, Mycobacterium bovis subsp bovis AF2122/97
cgagcgcgccgaaggcc

SEQ ID NO: 3209576 - RNA, 15 nt, Mycobacterium bovis subsp bovis AF2122/97
cgagcgcgccggcca

SEQ ID NO: 3209577 - RNA, 23 nt, Mycobacterium bovis subsp bovis AF2122/97
cgagcgcgccggcucuccgguga

SEQ ID NO: 3209578 - RNA, 14 nt, Mycobacterium bovis subsp bovis AF2122/97
cgagcgcgccguug

SEQ ID NO: 3209579 - RNA, 19 nt, Mycobacterium bovis subsp bovis AF2122/97
cgagcgcgccguugccgcc

SEQ ID NO: 3209580 - RNA, 20 nt, Mycobacterium bovis subsp bovis AF2122/97
cgagcgcgccguugccgccc

SEQ ID NO: 3209581 - RNA, 14 nt, Mycobacterium bovis subsp bovis AF2122/97
cgagcgcgccuuca

SEQ ID NO: 3209582 - RNA, 13 nt, Mycobacterium bovis subsp bovis AF2122/97
cgagcgcgcgacg

SEQ ID NO: 3209583 - RNA, 14 nt, Mycobacterium bovis subsp bovis AF2122/97
cgagcgcggcaacc

SEQ ID NO: 3209584 - RNA, 15 nt, Mycobacterium bovis subsp bovis AF2122/97
cgagcgcggcgaucg

SEQ ID NO: 3209585 - RNA, 16 nt, Mycobacterium bovis subsp bovis AF2122/97
cgagcgcggugccgcc

SEQ ID NO: 3209586 - RNA, 20 nt, Mycobacterium bovis subsp bovis AF2122/97
cgagcgcggugccgccaccg

SEQ ID NO: 3209587 - RNA, 19 nt, Mycobacterium bovis subsp bovis AF2122/97
cgagcgcgucggucaccga

SEQ ID NO: 3209588 - RNA, 22 nt, Mycobacterium bovis subsp bovis AF2122/97
cgagcgcgucggucaccgaacg

SEQ ID NO: 3209589 - RNA, 17 nt, Mycobacterium bovis subsp bovis AF2122/97
cgagcgcuaucaccgcc

SEQ ID NO: 3209590 - RNA, 18 nt, Mycobacterium bovis subsp bovis AF2122/97
cgagcgcuaucaccgccu

SEQ ID NO: 3209591 - RNA, 19 nt, Mycobacterium bovis subsp bovis AF2122/97
cgagcgcuaucaccgccuc

SEQ ID NO: 3209592 - RNA, 16 nt, Mycobacterium bovis subsp bovis AF2122/97
cgagcgcuguggccca

SEQ ID NO: 3209593 - RNA, 19 nt, Mycobacterium bovis subsp bovis AF2122/97
cgagcgcuucgucgccgaa

SEQ ID NO: 3209594 - RNA, 17 nt, Mycobacterium bovis subsp bovis AF2122/97
cgagcgcuugaccccgc

SEQ ID NO: 3209595 - RNA, 21 nt, Mycobacterium bovis subsp bovis AF2122/97
cgagcgcuugaccccgccgaa

SEQ ID NO: 3209596 - RNA, 21 nt, Mycobacterium bovis subsp bovis AF2122/97
cgagcggacagggagcaaacg

SEQ ID NO: 3209597 - RNA, 15 nt, Mycobacterium bovis subsp bovis AF2122/97
cgagcggaccaccgc

SEQ ID NO: 3209598 - RNA, 18 nt, Mycobacterium bovis subsp bovis AF2122/97
cgagcggaccaccgcucg

SEQ ID NO: 3209599 - RNA, 20 nt, Mycobacterium bovis subsp bovis AF2122/97
cgagcggaccaccgcucgcc

SEQ ID NO: 3209600 - RNA, 18 nt, Mycobacterium bovis subsp bovis AF2122/97
cgagcggagacuccagca

SEQ ID NO: 3209601 - RNA, 15 nt, Mycobacterium bovis subsp bovis AF2122/97
cgagcggagccgccg

SEQ ID NO: 3209602 - RNA, 20 nt, Mycobacterium bovis subsp bovis AF2122/97
cgagcggcaccaaugcggug

SEQ ID NO: 3209603 - RNA, 17 nt, Mycobacterium bovis subsp bovis AF2122/97
cgagcggcaucggucac

SEQ ID NO: 3209604 - RNA, 21 nt, Mycobacterium bovis subsp bovis AF2122/97
cgagcggcaucggucaccgcg

SEQ ID NO: 3209605 - RNA, 13 nt, Mycobacterium bovis subsp bovis AF2122/97
cgagcggccgcgc

SEQ ID NO: 3209606 - RNA, 14 nt, Mycobacterium bovis subsp bovis AF2122/97
cgagcggccgcgcg

SEQ ID NO: 3209607 - RNA, 15 nt, Mycobacterium bovis subsp bovis AF2122/97
cgagcggccgcgcgc

SEQ ID NO: 3209608 - RNA, 16 nt, Mycobacterium bovis subsp bovis AF2122/97
cgagcggccgcgcgca

SEQ ID NO: 3209609 - RNA, 16 nt, Mycobacterium bovis subsp bovis AF2122/97
cgagcggccuccagca

SEQ ID NO: 3209610 - RNA, 18 nt, Mycobacterium bovis subsp bovis AF2122/97
cgagcggccuccagcacc

SEQ ID NO: 3209611 - RNA, 15 nt, Mycobacterium bovis subsp bovis AF2122/97
cgagcggcggcacug

SEQ ID NO: 3209612 - RNA, 15 nt, Mycobacterium bovis subsp bovis AF2122/97
cgagcggcugagccg

SEQ ID NO: 3209613 - RNA, 21 nt, Mycobacterium bovis subsp bovis AF2122/97
cgagcgggaacgagccacgcc

SEQ ID NO: 3209614 - RNA, 17 nt, Mycobacterium bovis subsp bovis AF2122/97
cgagcgggaucgggccc

SEQ ID NO: 3209615 - RNA, 21 nt, Mycobacterium bovis subsp bovis AF2122/97
cgagcgggaucgggcccuccg

SEQ ID NO: 3209616 - RNA, 14 nt, Mycobacterium bovis subsp bovis AF2122/97
cgagcggucgacgu

SEQ ID NO: 3209617 - RNA, 16 nt, Mycobacterium bovis subsp bovis AF2122/97
cgagcggucgacgugu

SEQ ID NO: 3209618 - RNA, 16 nt, Mycobacterium bovis subsp bovis AF2122/97
cgagcggucgaucuga

SEQ ID NO: 3209619 - RNA, 16 nt, Mycobacterium bovis subsp bovis AF2122/97
cgagcggucgcgguag

SEQ ID NO: 3209620 - RNA, 23 nt, Mycobacterium bovis subsp bovis AF2122/97
cgagcggugauugcaagcgggca

SEQ ID NO: 3209621 - RNA, 16 nt, Mycobacterium bovis subsp bovis AF2122/97
cgagcggugccggcgu

SEQ ID NO: 3209622 - RNA, 23 nt, Mycobacterium bovis subsp bovis AF2122/97
cgagcgguggugagugcgucucg

SEQ ID NO: 3209623 - RNA, 14 nt, Mycobacterium bovis subsp bovis AF2122/97
cgagcgguugccau

SEQ ID NO: 3209624 - RNA, 17 nt, Mycobacterium bovis subsp bovis AF2122/97
cgagcgguugccauccg

SEQ ID NO: 3209625 - RNA, 22 nt, Mycobacterium bovis subsp bovis AF2122/97
cgagcgguugccuucuuggcgg

SEQ ID NO: 3209626 - RNA, 20 nt, Mycobacterium bovis subsp bovis AF2122/97
cgagcguaacguggcugcga

SEQ ID NO: 3209627 - RNA, 18 nt, Mycobacterium bovis subsp bovis AF2122/97
cgagcguaaugcugcugc

SEQ ID NO: 3209628 - RNA, 22 nt, Mycobacterium bovis subsp bovis AF2122/97
cgagcguaaugcugcugcagca

SEQ ID NO: 3209629 - RNA, 16 nt, Mycobacterium bovis subsp bovis AF2122/97
cgagcguagcgaccuc

SEQ ID NO: 3209630 - RNA, 18 nt, Mycobacterium bovis subsp bovis AF2122/97
cgagcguagcgaccucgc

SEQ ID NO: 3209631 - RNA, 20 nt, Mycobacterium bovis subsp bovis AF2122/97
cgagcgucagauccggccgu

SEQ ID NO: 3209632 - RNA, 22 nt, Mycobacterium bovis subsp bovis AF2122/97
cgagcgucagauccggccguug

SEQ ID NO: 3209633 - RNA, 19 nt, Mycobacterium bovis subsp bovis AF2122/97
cgagcgugaaccuggcgac

SEQ ID NO: 3209634 - RNA, 12 nt, Mycobacterium bovis subsp bovis AF2122/97
cgagcgugcgca

SEQ ID NO: 3209635 - RNA, 19 nt, Mycobacterium bovis subsp bovis AF2122/97
cgagcgugcgcugguggcg

SEQ ID NO: 3209636 - RNA, 15 nt, Mycobacterium bovis subsp bovis AF2122/97
cgagcguggcaacga

SEQ ID NO: 3209637 - RNA, 13 nt, Mycobacterium bovis subsp bovis AF2122/97
cgagcguggccaa

SEQ ID NO: 3209638 - RNA, 20 nt, Mycobacterium bovis subsp bovis AF2122/97
cgagcguggccaauccggcg

SEQ ID NO: 3209639 - RNA, 21 nt, Mycobacterium bovis subsp bovis AF2122/97
cgagcguggccaauccggcgg

SEQ ID NO: 3209640 - RNA, 22 nt, Mycobacterium bovis subsp bovis AF2122/97
cgagcguggccaauccggcggc

SEQ ID NO: 3209641 - RNA, 14 nt, Mycobacterium bovis subsp bovis AF2122/97
cgagcguggcguug

SEQ ID NO: 3209642 - RNA, 18 nt, Mycobacterium bovis subsp bovis AF2122/97
cgagcguuuggacgggcg

SEQ ID NO: 3209643 - RNA, 15 nt, Mycobacterium bovis subsp bovis AF2122/97
cgagcuaacacccga

SEQ ID NO: 3209644 - RNA, 19 nt, Mycobacterium bovis subsp bovis AF2122/97
cgagcuacgacgagugguc

SEQ ID NO: 3209645 - RNA, 21 nt, Mycobacterium bovis subsp bovis AF2122/97
cgagcucaccaaggucggcga

SEQ ID NO: 3209646 - RNA, 13 nt, Mycobacterium bovis subsp bovis AF2122/97
cgagcucaccgca

SEQ ID NO: 3209647 - RNA, 15 nt, Mycobacterium bovis subsp bovis AF2122/97
cgagcucaccgcaca

SEQ ID NO: 3209648 - RNA, 20 nt, Mycobacterium bovis subsp bovis AF2122/97
cgagcucaccgcacaccugc

SEQ ID NO: 3209649 - RNA, 15 nt, Mycobacterium bovis subsp bovis AF2122/97
cgagcucaccugcgg

SEQ ID NO: 3209650 - RNA, 13 nt, Mycobacterium bovis subsp bovis AF2122/97
cgagcucacuuca

SEQ ID NO: 3209651 - RNA, 18 nt, Mycobacterium bovis subsp bovis AF2122/97
cgagcuccgaugccgacg

SEQ ID NO: 3209652 - RNA, 13 nt, Mycobacterium bovis subsp bovis AF2122/97
cgagcuccgcggc

SEQ ID NO: 3209653 - RNA, 15 nt, Mycobacterium bovis subsp bovis AF2122/97
cgagcuccgcggcga

SEQ ID NO: 3209654 - RNA, 17 nt, Mycobacterium bovis subsp bovis AF2122/97
cgagcucgaagcccgga

SEQ ID NO: 3209655 - RNA, 15 nt, Mycobacterium bovis subsp bovis AF2122/97
cgagcucgaggcccg

SEQ ID NO: 3209656 - RNA, 20 nt, Mycobacterium bovis subsp bovis AF2122/97
cgagcucgaggcccgggugc

SEQ ID NO: 3209657 - RNA, 13 nt, Mycobacterium bovis subsp bovis AF2122/97
cgagcucgccgca

SEQ ID NO: 3209658 - RNA, 17 nt, Mycobacterium bovis subsp bovis AF2122/97
cgagcucgccgcagcgu

SEQ ID NO: 3209659 - RNA, 19 nt, Mycobacterium bovis subsp bovis AF2122/97
cgagcucgccgcagcgucg

SEQ ID NO: 3209660 - RNA, 16 nt, Mycobacterium bovis subsp bovis AF2122/97
cgagcucggccccgcc

SEQ ID NO: 3209661 - RNA, 17 nt, Mycobacterium bovis subsp bovis AF2122/97
cgagcucggccccgccg

SEQ ID NO: 3209662 - RNA, 19 nt, Mycobacterium bovis subsp bovis AF2122/97
cgagcucggccccgccgcc

SEQ ID NO: 3209663 - RNA, 20 nt, Mycobacterium bovis subsp bovis AF2122/97
cgagcucggccccgccgccg

SEQ ID NO: 3209664 - RNA, 14 nt, Mycobacterium bovis subsp bovis AF2122/97
cgagcucggcgccc

SEQ ID NO: 3209665 - RNA, 17 nt, Mycobacterium bovis subsp bovis AF2122/97
cgagcucggcgcccagc

SEQ ID NO: 3209666 - RNA, 15 nt, Mycobacterium bovis subsp bovis AF2122/97
cgagcucgggugcga

SEQ ID NO: 3209667 - RNA, 15 nt, Mycobacterium bovis subsp bovis AF2122/97
cgagcucggucacca

SEQ ID NO: 3209668 - RNA, 20 nt, Mycobacterium bovis subsp bovis AF2122/97
cgagcucguccucgucuucg

SEQ ID NO: 3209669 - RNA, 22 nt, Mycobacterium bovis subsp bovis AF2122/97
cgagcucguccucgucuucguc

SEQ ID NO: 3209670 - RNA, 14 nt, Mycobacterium bovis subsp bovis AF2122/97
cgagcucgucgagc

SEQ ID NO: 3209671 - RNA, 13 nt, Mycobacterium bovis subsp bovis AF2122/97
cgagcugaccacg

SEQ ID NO: 3209672 - RNA, 14 nt, Mycobacterium bovis subsp bovis AF2122/97
cgagcugaccuggu

SEQ ID NO: 3209673 - RNA, 14 nt, Mycobacterium bovis subsp bovis AF2122/97
cgagcugacgaugg

SEQ ID NO: 3209674 - RNA, 15 nt, Mycobacterium bovis subsp bovis AF2122/97
cgagcugacgauggc

SEQ ID NO: 3209675 - RNA, 20 nt, Mycobacterium bovis subsp bovis AF2122/97
cgagcugacgccgagcuggu

SEQ ID NO: 3209676 - RNA, 13 nt, Mycobacterium bovis subsp bovis AF2122/97
cgagcugagcggc

SEQ ID NO: 3209677 - RNA, 17 nt, Mycobacterium bovis subsp bovis AF2122/97
cgagcugagcggccagc

SEQ ID NO: 3209678 - RNA, 18 nt, Mycobacterium bovis subsp bovis AF2122/97
cgagcugagcggccagca

SEQ ID NO: 3209679 - RNA, 17 nt, Mycobacterium bovis subsp bovis AF2122/97
cgagcugauacgcaugc

SEQ ID NO: 3209680 - RNA, 17 nt, Mycobacterium bovis subsp bovis AF2122/97
cgagcugauccgggugg

SEQ ID NO: 3209681 - RNA, 14 nt, Mycobacterium bovis subsp bovis AF2122/97
cgagcugccaggcc

SEQ ID NO: 3209682 - RNA, 18 nt, Mycobacterium bovis subsp bovis AF2122/97
cgagcugccgucgcugcc

SEQ ID NO: 3209683 - RNA, 22 nt, Mycobacterium bovis subsp bovis AF2122/97
cgagcugcgacgaugccgccug

SEQ ID NO: 3209684 - RNA, 21 nt, Mycobacterium bovis subsp bovis AF2122/97
cgagcugcgggucgcguuucg

SEQ ID NO: 3209685 - RNA, 16 nt, Mycobacterium bovis subsp bovis AF2122/97
cgagcuggcaacgccg

SEQ ID NO: 3209686 - RNA, 20 nt, Mycobacterium bovis subsp bovis AF2122/97
cgagcuggcaacgccgcgcc

SEQ ID NO: 3209687 - RNA, 21 nt, Mycobacterium bovis subsp bovis AF2122/97
cgagcuggcaacgccgcgccg

SEQ ID NO: 3209688 - RNA, 21 nt, Mycobacterium bovis subsp bovis AF2122/97
cgagcuggccgucagcgucgg

SEQ ID NO: 3209689 - RNA, 14 nt, Mycobacterium bovis subsp bovis AF2122/97
cgagcuggcguucc

SEQ ID NO: 3209690 - RNA, 19 nt, Mycobacterium bovis subsp bovis AF2122/97
cgagcugguaaacgggugg

SEQ ID NO: 3209691 - RNA, 20 nt, Mycobacterium bovis subsp bovis AF2122/97
cgagcugguaaacgggugga

SEQ ID NO: 3209692 - RNA, 23 nt, Mycobacterium bovis subsp bovis AF2122/97
cgagcugguagguuacgccgggg

SEQ ID NO: 3209693 - RNA, 17 nt, Mycobacterium bovis subsp bovis AF2122/97
cgagcugguuggcgccg

SEQ ID NO: 3209694 - RNA, 20 nt, Mycobacterium bovis subsp bovis AF2122/97
cgagcuguaggucagcgcgu

SEQ ID NO: 3209695 - RNA, 18 nt, Mycobacterium bovis subsp bovis AF2122/97
cgagcuucagcgcgcugc

SEQ ID NO: 3209696 - RNA, 16 nt, Mycobacterium bovis subsp bovis AF2122/97
cgagcuuccacgccgg

SEQ ID NO: 3209697 - RNA, 21 nt, Mycobacterium bovis subsp bovis AF2122/97
cgagcuugagcgugagcgccg

SEQ ID NO: 3209698 - RNA, 19 nt, Mycobacterium bovis subsp bovis AF2122/97
cgagcuugccgucgcugac

SEQ ID NO: 3209699 - RNA, 15 nt, Mycobacterium bovis subsp bovis AF2122/97
cgagcuuggccgccg

SEQ ID NO: 3209700 - RNA, 18 nt, Mycobacterium bovis subsp bovis AF2122/97
cgagcuuggccgccgcca

SEQ ID NO: 3209701 - RNA, 14 nt, Mycobacterium bovis subsp bovis AF2122/97
cgagcuuggccggc

SEQ ID NO: 3209702 - RNA, 23 nt, Mycobacterium bovis subsp bovis AF2122/97
cgagcuuggccggcagguccauc

SEQ ID NO: 3209703 - RNA, 17 nt, Mycobacterium bovis subsp bovis AF2122/97
cgagcuuggcuuggccg

SEQ ID NO: 3209704 - RNA, 23 nt, Mycobacterium bovis subsp bovis AF2122/97
cgagcuuuucgaccuucaccgcg

SEQ ID NO: 3209705 - RNA, 15 nt, Mycobacterium bovis subsp bovis AF2122/97
cgaggaaaccaccag

SEQ ID NO: 3209706 - RNA, 16 nt, Mycobacterium bovis subsp bovis AF2122/97
cgaggaacacgaugcc

SEQ ID NO: 3209707 - RNA, 14 nt, Mycobacterium bovis subsp bovis AF2122/97
cgaggaacgccggg

SEQ ID NO: 3209708 - RNA, 17 nt, Mycobacterium bovis subsp bovis AF2122/97
cgaggaacgccggggcg

SEQ ID NO: 3209709 - RNA, 20 nt, Mycobacterium bovis subsp bovis AF2122/97
cgaggaacucggacccaccc

SEQ ID NO: 3209710 - RNA, 19 nt, Mycobacterium bovis subsp bovis AF2122/97
cgaggaacuggaccggugc

SEQ ID NO: 3209711 - RNA, 24 nt, Mycobacterium bovis subsp bovis AF2122/97
cgaggaacuggaccggugccagca

SEQ ID NO: 3209712 - RNA, 23 nt, Mycobacterium bovis subsp bovis AF2122/97
cgaggaaguccagcuggccgggu

SEQ ID NO: 3209713 - RNA, 15 nt, Mycobacterium bovis subsp bovis AF2122/97
cgaggaauuccgcua

SEQ ID NO: 3209714 - RNA, 20 nt, Mycobacterium bovis subsp bovis AF2122/97
cgaggaauuccgcuaccgca

SEQ ID NO: 3209715 - RNA, 20 nt, Mycobacterium bovis subsp bovis AF2122/97
cgaggacacauugaccaggu

SEQ ID NO: 3209716 - RNA, 16 nt, Mycobacterium bovis subsp bovis AF2122/97
cgaggaccagaggcgc

SEQ ID NO: 3209717 - RNA, 21 nt, Mycobacterium bovis subsp bovis AF2122/97
cgaggaccucgucaccgguca

SEQ ID NO: 3209718 - RNA, 18 nt, Mycobacterium bovis subsp bovis AF2122/97
cgaggaccugcucgggcg

SEQ ID NO: 3209719 - RNA, 20 nt, Mycobacterium bovis subsp bovis AF2122/97
cgaggaccugcucgggcgug

SEQ ID NO: 3209720 - RNA, 19 nt, Mycobacterium bovis subsp bovis AF2122/97
cgaggacgccggcgccgcc

SEQ ID NO: 3209721 - RNA, 14 nt, Mycobacterium bovis subsp bovis AF2122/97
cgaggacggcguag

SEQ ID NO: 3209722 - RNA, 21 nt, Mycobacterium bovis subsp bovis AF2122/97
cgaggacggcuugagccgcag

SEQ ID NO: 3209723 - RNA, 14 nt, Mycobacterium bovis subsp bovis AF2122/97
cgaggacgucaccg

SEQ ID NO: 3209724 - RNA, 17 nt, Mycobacterium bovis subsp bovis AF2122/97
cgaggacuggaaagcag

SEQ ID NO: 3209725 - RNA, 12 nt, Mycobacterium bovis subsp bovis AF2122/97
cgaggagcccgg

SEQ ID NO: 3209726 - RNA, 12 nt, Mycobacterium bovis subsp bovis AF2122/97
cgaggagggccg

SEQ ID NO: 3209727 - RNA, 14 nt, Mycobacterium bovis subsp bovis AF2122/97
cgaggagggccgcg

SEQ ID NO: 3209728 - RNA, 15 nt, Mycobacterium bovis subsp bovis AF2122/97
cgaggagggccgcga

SEQ ID NO: 3209729 - RNA, 16 nt, Mycobacterium bovis subsp bovis AF2122/97
cgaggauccauuggaa

SEQ ID NO: 3209730 - RNA, 18 nt, Mycobacterium bovis subsp bovis AF2122/97
cgaggaucccgcugcacg

SEQ ID NO: 3209731 - RNA, 19 nt, Mycobacterium bovis subsp bovis AF2122/97
cgaggaucccgcugcacga

SEQ ID NO: 3209732 - RNA, 20 nt, Mycobacterium bovis subsp bovis AF2122/97
cgaggaucccgcugcacgac

SEQ ID NO: 3209733 - RNA, 16 nt, Mycobacterium bovis subsp bovis AF2122/97
cgaggaucucggcgug

SEQ ID NO: 3209734 - RNA, 14 nt, Mycobacterium bovis subsp bovis AF2122/97
cgaggaugccgaac

SEQ ID NO: 3209735 - RNA, 17 nt, Mycobacterium bovis subsp bovis AF2122/97
cgaggaugccgaaccgc

SEQ ID NO: 3209736 - RNA, 19 nt, Mycobacterium bovis subsp bovis AF2122/97
cgaggaugccgaaccgcgc

SEQ ID NO: 3209737 - RNA, 21 nt, Mycobacterium bovis subsp bovis AF2122/97
cgaggaugcugagcgccaggc

SEQ ID NO: 3209738 - RNA, 13 nt, Mycobacterium bovis subsp bovis AF2122/97
cgaggaugucgau

SEQ ID NO: 3209739 - RNA, 16 nt, Mycobacterium bovis subsp bovis AF2122/97
cgaggaugugguuggu

SEQ ID NO: 3209740 - RNA, 24 nt, Mycobacterium bovis subsp bovis AF2122/97
cgaggauguugugccgaucggcca

SEQ ID NO: 3209741 - RNA, 15 nt, Mycobacterium bovis subsp bovis AF2122/97
cgaggauucauggcg

SEQ ID NO: 3209742 - RNA, 17 nt, Mycobacterium bovis subsp bovis AF2122/97
cgaggauucauggcggc

SEQ ID NO: 3209743 - RNA, 13 nt, Mycobacterium bovis subsp bovis AF2122/97
cgaggcaaugcga

SEQ ID NO: 3209744 - RNA, 18 nt, Mycobacterium bovis subsp bovis AF2122/97
cgaggcacaaucaccgcc

SEQ ID NO: 3209745 - RNA, 22 nt, Mycobacterium bovis subsp bovis AF2122/97
cgaggcacaaucaccgccgcga

SEQ ID NO: 3209746 - RNA, 17 nt, Mycobacterium bovis subsp bovis AF2122/97
cgaggcaccgacaucgu

SEQ ID NO: 3209747 - RNA, 16 nt, Mycobacterium bovis subsp bovis AF2122/97
cgaggcagcacccgca

SEQ ID NO: 3209748 - RNA, 17 nt, Mycobacterium bovis subsp bovis AF2122/97
cgaggcagcacccgcac

SEQ ID NO: 3209749 - RNA, 23 nt, Mycobacterium bovis subsp bovis AF2122/97
cgaggcaggccucggcgccgccc

SEQ ID NO: 3209750 - RNA, 18 nt, Mycobacterium bovis subsp bovis AF2122/97
cgaggcaucguccacgca

SEQ ID NO: 3209751 - RNA, 17 nt, Mycobacterium bovis subsp bovis AF2122/97
cgaggcauucucccggu

SEQ ID NO: 3209752 - RNA, 13 nt, Mycobacterium bovis subsp bovis AF2122/97
cgaggccacgcca

SEQ ID NO: 3209753 - RNA, 18 nt, Mycobacterium bovis subsp bovis AF2122/97
cgaggccacgccagcucg

SEQ ID NO: 3209754 - RNA, 20 nt, Mycobacterium bovis subsp bovis AF2122/97
cgaggccacgccagcucgcc

SEQ ID NO: 3209755 - RNA, 21 nt, Mycobacterium bovis subsp bovis AF2122/97
cgaggccacgccagcucgccg

SEQ ID NO: 3209756 - RNA, 13 nt, Mycobacterium bovis subsp bovis AF2122/97
cgaggccagcggu

SEQ ID NO: 3209757 - RNA, 16 nt, Mycobacterium bovis subsp bovis AF2122/97
cgaggccaugcucgcc

SEQ ID NO: 3209758 - RNA, 20 nt, Mycobacterium bovis subsp bovis AF2122/97
cgaggccauguugccgugga

SEQ ID NO: 3209759 - RNA, 15 nt, Mycobacterium bovis subsp bovis AF2122/97
cgaggcccgggugcu

SEQ ID NO: 3209760 - RNA, 11 nt, Mycobacterium bovis subsp bovis AF2122/97
cgaggccgacc

SEQ ID NO: 3209761 - RNA, 12 nt, Mycobacterium bovis subsp bovis AF2122/97
cgaggccgacga

SEQ ID NO: 3209762 - RNA, 16 nt, Mycobacterium bovis subsp bovis AF2122/97
cgaggccgcacgucga

SEQ ID NO: 3209763 - RNA, 18 nt, Mycobacterium bovis subsp bovis AF2122/97
cgaggccgcacgucgacc

SEQ ID NO: 3209764 - RNA, 14 nt, Mycobacterium bovis subsp bovis AF2122/97
cgaggccgccaucg

SEQ ID NO: 3209765 - RNA, 14 nt, Mycobacterium bovis subsp bovis AF2122/97
cgaggccgccguug

SEQ ID NO: 3209766 - RNA, 14 nt, Mycobacterium bovis subsp bovis AF2122/97
cgaggccgucgcga

SEQ ID NO: 3209767 - RNA, 22 nt, Mycobacterium bovis subsp bovis AF2122/97
cgaggccuaccaggcgcggccc

SEQ ID NO: 3209768 - RNA, 15 nt, Mycobacterium bovis subsp bovis AF2122/97
cgaggccucggccag

SEQ ID NO: 3209769 - RNA, 17 nt, Mycobacterium bovis subsp bovis AF2122/97
cgaggccucggcggccg

SEQ ID NO: 3209770 - RNA, 18 nt, Mycobacterium bovis subsp bovis AF2122/97
cgaggccucggcggccgu

SEQ ID NO: 3209771 - RNA, 21 nt, Mycobacterium bovis subsp bovis AF2122/97
cgaggccucggcggccguggc

SEQ ID NO: 3209772 - RNA, 23 nt, Mycobacterium bovis subsp bovis AF2122/97
cgaggcgaagcgggacugcagcg

SEQ ID NO: 3209773 - RNA, 16 nt, Mycobacterium bovis subsp bovis AF2122/97
cgaggcgaccggaccg

SEQ ID NO: 3209774 - RNA, 17 nt, Mycobacterium bovis subsp bovis AF2122/97
cgaggcgagcggccagu

SEQ ID NO: 3209775 - RNA, 17 nt, Mycobacterium bovis subsp bovis AF2122/97
cgaggcgagucaccggg

SEQ ID NO: 3209776 - RNA, 18 nt, Mycobacterium bovis subsp bovis AF2122/97
cgaggcgaguucgcgcac

SEQ ID NO: 3209777 - RNA, 23 nt, Mycobacterium bovis subsp bovis AF2122/97
cgaggcgaguucgcgcacgucgg

SEQ ID NO: 3209778 - RNA, 12 nt, Mycobacterium bovis subsp bovis AF2122/97
cgaggcgaucac

SEQ ID NO: 3209779 - RNA, 21 nt, Mycobacterium bovis subsp bovis AF2122/97
cgaggcgaucaccgcgccgga

SEQ ID NO: 3209780 - RNA, 13 nt, Mycobacterium bovis subsp bovis AF2122/97
cgaggcgcccaac

SEQ ID NO: 3209781 - RNA, 16 nt, Mycobacterium bovis subsp bovis AF2122/97
cgaggcgcucacccgc

SEQ ID NO: 3209782 - RNA, 22 nt, Mycobacterium bovis subsp bovis AF2122/97
cgaggcgcucacccgccgcggu

SEQ ID NO: 3209783 - RNA, 20 nt, Mycobacterium bovis subsp bovis AF2122/97
cgaggcgcucgaucgcguug

SEQ ID NO: 3209784 - RNA, 14 nt, Mycobacterium bovis subsp bovis AF2122/97
cgaggcggcggucg

SEQ ID NO: 3209785 - RNA, 18 nt, Mycobacterium bovis subsp bovis AF2122/97
cgaggcggcggucgagcu

SEQ ID NO: 3209786 - RNA, 21 nt, Mycobacterium bovis subsp bovis AF2122/97
cgaggcgggcagaagaguguc

SEQ ID NO: 3209787 - RNA, 17 nt, Mycobacterium bovis subsp bovis AF2122/97
cgaggcggguacaccac

SEQ ID NO: 3209788 - RNA, 17 nt, Mycobacterium bovis subsp bovis AF2122/97
cgaggcggucgccgaau

SEQ ID NO: 3209789 - RNA, 18 nt, Mycobacterium bovis subsp bovis AF2122/97
cgaggcguaaucaagcag

SEQ ID NO: 3209790 - RNA, 21 nt, Mycobacterium bovis subsp bovis AF2122/97
cgaggcgucaccccggucccg

SEQ ID NO: 3209791 - RNA, 21 nt, Mycobacterium bovis subsp bovis AF2122/97
cgaggcguucaccacgaucgc

SEQ ID NO: 3209792 - RNA, 22 nt, Mycobacterium bovis subsp bovis AF2122/97
cgaggcguucaccacgaucgcg

SEQ ID NO: 3209793 - RNA, 14 nt, Mycobacterium bovis subsp bovis AF2122/97
cgaggcguucagug

SEQ ID NO: 3209794 - RNA, 19 nt, Mycobacterium bovis subsp bovis AF2122/97
cgaggcucccccaccaggg

SEQ ID NO: 3209795 - RNA, 21 nt, Mycobacterium bovis subsp bovis AF2122/97
cgaggcucccgcaauggggcg

SEQ ID NO: 3209796 - RNA, 17 nt, Mycobacterium bovis subsp bovis AF2122/97
cgaggcucgcguggccg

SEQ ID NO: 3209797 - RNA, 18 nt, Mycobacterium bovis subsp bovis AF2122/97
cgaggcucgcguggccgc

SEQ ID NO: 3209798 - RNA, 20 nt, Mycobacterium bovis subsp bovis AF2122/97
cgaggcucgcguggccgccg

SEQ ID NO: 3209799 - RNA, 22 nt, Mycobacterium bovis subsp bovis AF2122/97
cgaggcucgcguggccgccggc

SEQ ID NO: 3209800 - RNA, 12 nt, Mycobacterium bovis subsp bovis AF2122/97
cgaggcucgggc

SEQ ID NO: 3209801 - RNA, 19 nt, Mycobacterium bovis subsp bovis AF2122/97
cgaggcucguggcgacggc

SEQ ID NO: 3209802 - RNA, 13 nt, Mycobacterium bovis subsp bovis AF2122/97
cgaggcuguccga

SEQ ID NO: 3209803 - RNA, 19 nt, Mycobacterium bovis subsp bovis AF2122/97
cgaggcuguccgaaccgac

SEQ ID NO: 3209804 - RNA, 17 nt, Mycobacterium bovis subsp bovis AF2122/97
cgagggaacggugcaca

SEQ ID NO: 3209805 - RNA, 20 nt, Mycobacterium bovis subsp bovis AF2122/97
cgagggauguagugcugcuc

SEQ ID NO: 3209806 - RNA, 12 nt, Mycobacterium bovis subsp bovis AF2122/97
cgagggcaacga

SEQ ID NO: 3209807 - RNA, 14 nt, Mycobacterium bovis subsp bovis AF2122/97
cgagggcacgcgca

SEQ ID NO: 3209808 - RNA, 20 nt, Mycobacterium bovis subsp bovis AF2122/97
cgagggccacguagcagcag

SEQ ID NO: 3209809 - RNA, 24 nt, Mycobacterium bovis subsp bovis AF2122/97
cgagggccagcaaguacgcgucgg

SEQ ID NO: 3209810 - RNA, 18 nt, Mycobacterium bovis subsp bovis AF2122/97
cgagggccagcagccgcg

SEQ ID NO: 3209811 - RNA, 20 nt, Mycobacterium bovis subsp bovis AF2122/97
cgagggccagcagccgcgac

SEQ ID NO: 3209812 - RNA, 15 nt, Mycobacterium bovis subsp bovis AF2122/97
cgagggccgucacag

SEQ ID NO: 3209813 - RNA, 12 nt, Mycobacterium bovis subsp bovis AF2122/97
cgagggcgcgcc

SEQ ID NO: 3209814 - RNA, 13 nt, Mycobacterium bovis subsp bovis AF2122/97
cgagggcgcgccg

SEQ ID NO: 3209815 - RNA, 14 nt, Mycobacterium bovis subsp bovis AF2122/97
cgagggcgcgccgu

SEQ ID NO: 3209816 - RNA, 14 nt, Mycobacterium bovis subsp bovis AF2122/97
cgagggcgcguguc

SEQ ID NO: 3209817 - RNA, 16 nt, Mycobacterium bovis subsp bovis AF2122/97
cgagggcggucagcgg

SEQ ID NO: 3209818 - RNA, 18 nt, Mycobacterium bovis subsp bovis AF2122/97
cgagggcggucagcggcc

SEQ ID NO: 3209819 - RNA, 19 nt, Mycobacterium bovis subsp bovis AF2122/97
cgagggcggucagcggcca

SEQ ID NO: 3209820 - RNA, 15 nt, Mycobacterium bovis subsp bovis AF2122/97
cgagggcuaccggcg

SEQ ID NO: 3209821 - RNA, 16 nt, Mycobacterium bovis subsp bovis AF2122/97
cgagggcuaccggcgc

SEQ ID NO: 3209822 - RNA, 21 nt, Mycobacterium bovis subsp bovis AF2122/97
cgagggcuaccggcgccgcgc

SEQ ID NO: 3209823 - RNA, 19 nt, Mycobacterium bovis subsp bovis AF2122/97
cgagggcugacgggauggu

SEQ ID NO: 3209824 - RNA, 18 nt, Mycobacterium bovis subsp bovis AF2122/97
cgagggcugcguggcggg

SEQ ID NO: 3209825 - RNA, 22 nt, Mycobacterium bovis subsp bovis AF2122/97
cgaggggccggcucagucacgc

SEQ ID NO: 3209826 - RNA, 20 nt, Mycobacterium bovis subsp bovis AF2122/97
cgaggggcggcaaucggugg

SEQ ID NO: 3209827 - RNA, 17 nt, Mycobacterium bovis subsp bovis AF2122/97
cgaggguaccaggcgcc

SEQ ID NO: 3209828 - RNA, 23 nt, Mycobacterium bovis subsp bovis AF2122/97
cgaggguaucgucauugcgaaaa

SEQ ID NO: 3209829 - RNA, 18 nt, Mycobacterium bovis subsp bovis AF2122/97
cgagggugaagacaccgg

SEQ ID NO: 3209830 - RNA, 19 nt, Mycobacterium bovis subsp bovis AF2122/97
cgagggugaagacaccggc

SEQ ID NO: 3209831 - RNA, 20 nt, Mycobacterium bovis subsp bovis AF2122/97
cgagggugaagacaccggcg

SEQ ID NO: 3209832 - RNA, 18 nt, Mycobacterium bovis subsp bovis AF2122/97
cgagggugaaguggcgca

SEQ ID NO: 3209833 - RNA, 20 nt, Mycobacterium bovis subsp bovis AF2122/97
cgagggugaaguggcgcagc

SEQ ID NO: 3209834 - RNA, 17 nt, Mycobacterium bovis subsp bovis AF2122/97
cgagggugacccccaau

SEQ ID NO: 3209835 - RNA, 17 nt, Mycobacterium bovis subsp bovis AF2122/97
cgagguaagcgagucga

SEQ ID NO: 3209836 - RNA, 16 nt, Mycobacterium bovis subsp bovis AF2122/97
cgagguacagcgggca

SEQ ID NO: 3209837 - RNA, 14 nt, Mycobacterium bovis subsp bovis AF2122/97
cgagguagcgcgca

SEQ ID NO: 3209838 - RNA, 17 nt, Mycobacterium bovis subsp bovis AF2122/97
cgagguaguggucuucg

SEQ ID NO: 3209839 - RNA, 23 nt, Mycobacterium bovis subsp bovis AF2122/97
cgagguaguggucuucggaacgc

SEQ ID NO: 3209840 - RNA, 21 nt, Mycobacterium bovis subsp bovis AF2122/97
cgagguauaaacgcggcgcgc

SEQ ID NO: 3209841 - RNA, 13 nt, Mycobacterium bovis subsp bovis AF2122/97
cgaggucacccgg

SEQ ID NO: 3209842 - RNA, 17 nt, Mycobacterium bovis subsp bovis AF2122/97
cgaggucacgcgaggcg

SEQ ID NO: 3209843 - RNA, 17 nt, Mycobacterium bovis subsp bovis AF2122/97
cgaggucagcucccggc

SEQ ID NO: 3209844 - RNA, 15 nt, Mycobacterium bovis subsp bovis AF2122/97
cgaggucccggccga

SEQ ID NO: 3209845 - RNA, 18 nt, Mycobacterium bovis subsp bovis AF2122/97
cgagguccucgucggcgu

SEQ ID NO: 3209846 - RNA, 19 nt, Mycobacterium bovis subsp bovis AF2122/97
cgagguccucgucggcguc

SEQ ID NO: 3209847 - RNA, 14 nt, Mycobacterium bovis subsp bovis AF2122/97
cgaggucgaaccgc

SEQ ID NO: 3209848 - RNA, 18 nt, Mycobacterium bovis subsp bovis AF2122/97
cgaggucgagcgacccca

SEQ ID NO: 3209849 - RNA, 18 nt, Mycobacterium bovis subsp bovis AF2122/97
cgaggucgagcgccgcgg

SEQ ID NO: 3209850 - RNA, 15 nt, Mycobacterium bovis subsp bovis AF2122/97
cgaggucggccagca

SEQ ID NO: 3209851 - RNA, 23 nt, Mycobacterium bovis subsp bovis AF2122/97
cgaggucggccagcagcagugcc

SEQ ID NO: 3209852 - RNA, 12 nt, Mycobacterium bovis subsp bovis AF2122/97
cgaggucggcga

SEQ ID NO: 3209853 - RNA, 12 nt, Mycobacterium bovis subsp bovis AF2122/97
cgaggucggcgg

SEQ ID NO: 3209854 - RNA, 22 nt, Mycobacterium bovis subsp bovis AF2122/97
cgaggucggugaggucgaugcc

SEQ ID NO: 3209855 - RNA, 17 nt, Mycobacterium bovis subsp bovis AF2122/97
cgaggucgguucggccg

SEQ ID NO: 3209856 - RNA, 22 nt, Mycobacterium bovis subsp bovis AF2122/97
cgaggucgguucggccggagcc

SEQ ID NO: 3209857 - RNA, 20 nt, Mycobacterium bovis subsp bovis AF2122/97
cgaggucguuucccuggccg

SEQ ID NO: 3209858 - RNA, 22 nt, Mycobacterium bovis subsp bovis AF2122/97
cgaggucguuucccuggccgcc

SEQ ID NO: 3209859 - RNA, 23 nt, Mycobacterium bovis subsp bovis AF2122/97
cgaggucguuucccuggccgccg

SEQ ID NO: 3209860 - RNA, 19 nt, Mycobacterium bovis subsp bovis AF2122/97
cgaggucugcggccgauac

SEQ ID NO: 3209861 - RNA, 13 nt, Mycobacterium bovis subsp bovis AF2122/97
cgaggugacggug

SEQ ID NO: 3209862 - RNA, 17 nt, Mycobacterium bovis subsp bovis AF2122/97
cgaggugacucggcacc

SEQ ID NO: 3209863 - RNA, 23 nt, Mycobacterium bovis subsp bovis AF2122/97
cgaggugagguugacccccgggu

SEQ ID NO: 3209864 - RNA, 18 nt, Mycobacterium bovis subsp bovis AF2122/97
cgaggugauguuggccgc

SEQ ID NO: 3209865 - RNA, 19 nt, Mycobacterium bovis subsp bovis AF2122/97
cgaggugauguuggccgcc

SEQ ID NO: 3209866 - RNA, 21 nt, Mycobacterium bovis subsp bovis AF2122/97
cgaggugauguuggccgccac

SEQ ID NO: 3209867 - RNA, 14 nt, Mycobacterium bovis subsp bovis AF2122/97
cgaggugcccaagg

SEQ ID NO: 3209868 - RNA, 13 nt, Mycobacterium bovis subsp bovis AF2122/97
cgaggugccgcgc

SEQ ID NO: 3209869 - RNA, 16 nt, Mycobacterium bovis subsp bovis AF2122/97
cgaggugccgcgcagc

SEQ ID NO: 3209870 - RNA, 19 nt, Mycobacterium bovis subsp bovis AF2122/97
cgaggugccgcgcagcugc

SEQ ID NO: 3209871 - RNA, 15 nt, Mycobacterium bovis subsp bovis AF2122/97
cgaggugccggggcc

SEQ ID NO: 3209872 - RNA, 19 nt, Mycobacterium bovis subsp bovis AF2122/97
cgaggugccggggccccau

SEQ ID NO: 3209873 - RNA, 23 nt, Mycobacterium bovis subsp bovis AF2122/97
cgaggugccgggguggcgcgcca

SEQ ID NO: 3209874 - RNA, 22 nt, Mycobacterium bovis subsp bovis AF2122/97
cgaggugccguggauugcgcca

SEQ ID NO: 3209875 - RNA, 23 nt, Mycobacterium bovis subsp bovis AF2122/97
cgaggugcucggaucggcucgcc

SEQ ID NO: 3209876 - RNA, 15 nt, Mycobacterium bovis subsp bovis AF2122/97
cgagguggcgggcga

SEQ ID NO: 3209877 - RNA, 19 nt, Mycobacterium bovis subsp bovis AF2122/97
cgagguggcgggcgaugcg

SEQ ID NO: 3209878 - RNA, 19 nt, Mycobacterium bovis subsp bovis AF2122/97
cgaggugggcgucaucgac

SEQ ID NO: 3209879 - RNA, 15 nt, Mycobacterium bovis subsp bovis AF2122/97
cgagguggucgaccc

SEQ ID NO: 3209880 - RNA, 17 nt, Mycobacterium bovis subsp bovis AF2122/97
cgagguguagcccuccg

SEQ ID NO: 3209881 - RNA, 21 nt, Mycobacterium bovis subsp bovis AF2122/97
cgagguguagcccuccgagca

SEQ ID NO: 3209882 - RNA, 23 nt, Mycobacterium bovis subsp bovis AF2122/97
cgagguguagcccuccgagcaca

SEQ ID NO: 3209883 - RNA, 18 nt, Mycobacterium bovis subsp bovis AF2122/97
cgagguucaaagcagcgc

SEQ ID NO: 3209884 - RNA, 19 nt, Mycobacterium bovis subsp bovis AF2122/97
cgagguucaaagcagcgca

SEQ ID NO: 3209885 - RNA, 22 nt, Mycobacterium bovis subsp bovis AF2122/97
cgagguucaaagcagcgcacca

SEQ ID NO: 3209886 - RNA, 21 nt, Mycobacterium bovis subsp bovis AF2122/97
cgagguuccaguacccacgca

SEQ ID NO: 3209887 - RNA, 16 nt, Mycobacterium bovis subsp bovis AF2122/97
cgagguucucccgcgc

SEQ ID NO: 3209888 - RNA, 15 nt, Mycobacterium bovis subsp bovis AF2122/97
cgagguucugccgcg

SEQ ID NO: 3209889 - RNA, 21 nt, Mycobacterium bovis subsp bovis AF2122/97
cgagguugaccaccagcgugc

SEQ ID NO: 3209890 - RNA, 20 nt, Mycobacterium bovis subsp bovis AF2122/97
cgagguugacgucaggcuga

SEQ ID NO: 3209891 - RNA, 21 nt, Mycobacterium bovis subsp bovis AF2122/97
cgagguugauuggggccaggu

SEQ ID NO: 3209892 - RNA, 18 nt, Mycobacterium bovis subsp bovis AF2122/97
cgagguugccgcaccagu

SEQ ID NO: 3209893 - RNA, 16 nt, Mycobacterium bovis subsp bovis AF2122/97
cgagguugcgccgacc

SEQ ID NO: 3209894 - RNA, 19 nt, Mycobacterium bovis subsp bovis AF2122/97
cgagguugcggacggugua

SEQ ID NO: 3209895 - RNA, 22 nt, Mycobacterium bovis subsp bovis AF2122/97
cgagguuggcguugguggucgg

SEQ ID NO: 3209896 - RNA, 20 nt, Mycobacterium bovis subsp bovis AF2122/97
cgagguuguaggcgaaccgc

SEQ ID NO: 3209897 - RNA, 21 nt, Mycobacterium bovis subsp bovis AF2122/97
cgaguaccagcccaccggcgc

SEQ ID NO: 3209898 - RNA, 15 nt, Mycobacterium bovis subsp bovis AF2122/97
cgaguaccaggacga

SEQ ID NO: 3209899 - RNA, 16 nt, Mycobacterium bovis subsp bovis AF2122/97
cgaguacccaaccggu

SEQ ID NO: 3209900 - RNA, 15 nt, Mycobacterium bovis subsp bovis AF2122/97
cgaguaccgauagcc

SEQ ID NO: 3209901 - RNA, 15 nt, Mycobacterium bovis subsp bovis AF2122/97
cgaguaccggccagc

SEQ ID NO: 3209902 - RNA, 17 nt, Mycobacterium bovis subsp bovis AF2122/97
cgaguaccggccagccg

SEQ ID NO: 3209903 - RNA, 18 nt, Mycobacterium bovis subsp bovis AF2122/97
cgaguaccggccagccgc

SEQ ID NO: 3209904 - RNA, 14 nt, Mycobacterium bovis subsp bovis AF2122/97
cgaguacggccugc

SEQ ID NO: 3209905 - RNA, 17 nt, Mycobacterium bovis subsp bovis AF2122/97
cgaguacgggcaggccg

SEQ ID NO: 3209906 - RNA, 21 nt, Mycobacterium bovis subsp bovis AF2122/97
cgaguacgggcaggccgcugg

SEQ ID NO: 3209907 - RNA, 16 nt, Mycobacterium bovis subsp bovis AF2122/97
cgaguagauggucgac

SEQ ID NO: 3209908 - RNA, 19 nt, Mycobacterium bovis subsp bovis AF2122/97
cgaguagccguagccgccg

SEQ ID NO: 3209909 - RNA, 20 nt, Mycobacterium bovis subsp bovis AF2122/97
cgaguagccguagccgccgu

SEQ ID NO: 3209910 - RNA, 14 nt, Mycobacterium bovis subsp bovis AF2122/97
cgaguagugcaggu

SEQ ID NO: 3209911 - RNA, 16 nt, Mycobacterium bovis subsp bovis AF2122/97
cgaguaugggggugcu

SEQ ID NO: 3209912 - RNA, 20 nt, Mycobacterium bovis subsp bovis AF2122/97
cgagucaccggguccaccgc

SEQ ID NO: 3209913 - RNA, 24 nt, Mycobacterium bovis subsp bovis AF2122/97
cgaguccaagauguccgguccgcc

SEQ ID NO: 3209914 - RNA, 23 nt, Mycobacterium bovis subsp bovis AF2122/97
cgaguccacaaguaccgcaucga

SEQ ID NO: 3209915 - RNA, 14 nt, Mycobacterium bovis subsp bovis AF2122/97
cgaguccacagcgc

SEQ ID NO: 3209916 - RNA, 18 nt, Mycobacterium bovis subsp bovis AF2122/97
cgaguccaggcagcuugc

SEQ ID NO: 3209917 - RNA, 16 nt, Mycobacterium bovis subsp bovis AF2122/97
cgaguccaggccggca

SEQ ID NO: 3209918 - RNA, 17 nt, Mycobacterium bovis subsp bovis AF2122/97
cgaguccaggccggcag

SEQ ID NO: 3209919 - RNA, 15 nt, Mycobacterium bovis subsp bovis AF2122/97
cgaguccaggcugau

SEQ ID NO: 3209920 - RNA, 18 nt, Mycobacterium bovis subsp bovis AF2122/97
cgaguccccuuagcucca

SEQ ID NO: 3209921 - RNA, 19 nt, Mycobacterium bovis subsp bovis AF2122/97
cgaguccgacaguccgcgc

SEQ ID NO: 3209922 - RNA, 19 nt, Mycobacterium bovis subsp bovis AF2122/97
cgaguccucgagugccgcc

SEQ ID NO: 3209923 - RNA, 20 nt, Mycobacterium bovis subsp bovis AF2122/97
cgaguccucgagugccgccg

SEQ ID NO: 3209924 - RNA, 22 nt, Mycobacterium bovis subsp bovis AF2122/97
cgagucgaucacguggugcggc

SEQ ID NO: 3209925 - RNA, 17 nt, Mycobacterium bovis subsp bovis AF2122/97
cgagucgaugaccccgg

SEQ ID NO: 3209926 - RNA, 18 nt, Mycobacterium bovis subsp bovis AF2122/97
cgagucgaugaccccggu

SEQ ID NO: 3209927 - RNA, 17 nt, Mycobacterium bovis subsp bovis AF2122/97
cgagucgccagaccgca

SEQ ID NO: 3209928 - RNA, 18 nt, Mycobacterium bovis subsp bovis AF2122/97
cgagucgccagaccgcac

SEQ ID NO: 3209929 - RNA, 22 nt, Mycobacterium bovis subsp bovis AF2122/97
cgagucgccgaggacgccggcg

SEQ ID NO: 3209930 - RNA, 16 nt, Mycobacterium bovis subsp bovis AF2122/97
cgagucgccgcgggca

SEQ ID NO: 3209931 - RNA, 21 nt, Mycobacterium bovis subsp bovis AF2122/97
cgagucgcgcuugggguccgg

SEQ ID NO: 3209932 - RNA, 14 nt, Mycobacterium bovis subsp bovis AF2122/97
cgagucggcgggcg

SEQ ID NO: 3209933 - RNA, 14 nt, Mycobacterium bovis subsp bovis AF2122/97
cgagucggcggggc

SEQ ID NO: 3209934 - RNA, 16 nt, Mycobacterium bovis subsp bovis AF2122/97
cgagucggcggggcgg

SEQ ID NO: 3209935 - RNA, 21 nt, Mycobacterium bovis subsp bovis AF2122/97
cgagucgggggccgcgucucg

SEQ ID NO: 3209936 - RNA, 20 nt, Mycobacterium bovis subsp bovis AF2122/97
cgagucgggguacaggcugc

SEQ ID NO: 3209937 - RNA, 17 nt, Mycobacterium bovis subsp bovis AF2122/97
cgagucgguccugccaa

SEQ ID NO: 3209938 - RNA, 24 nt, Mycobacterium bovis subsp bovis AF2122/97
cgagucgguugucggggucgcagg

SEQ ID NO: 3209939 - RNA, 17 nt, Mycobacterium bovis subsp bovis AF2122/97
cgagucuaaggaugacc

SEQ ID NO: 3209940 - RNA, 15 nt, Mycobacterium bovis subsp bovis AF2122/97
cgagucucgucgggu

SEQ ID NO: 3209941 - RNA, 21 nt, Mycobacterium bovis subsp bovis AF2122/97
cgagugaacucguccugacgg

SEQ ID NO: 3209942 - RNA, 18 nt, Mycobacterium bovis subsp bovis AF2122/97
cgagugaaguuguuggcc

SEQ ID NO: 3209943 - RNA, 19 nt, Mycobacterium bovis subsp bovis AF2122/97
cgagugcacagccgggcuc

SEQ ID NO: 3209944 - RNA, 13 nt, Mycobacterium bovis subsp bovis AF2122/97
cgagugcagcggc

SEQ ID NO: 3209945 - RNA, 16 nt, Mycobacterium bovis subsp bovis AF2122/97
cgagugcagcggcgca

SEQ ID NO: 3209946 - RNA, 14 nt, Mycobacterium bovis subsp bovis AF2122/97
cgagugcccagcga

SEQ ID NO: 3209947 - RNA, 22 nt, Mycobacterium bovis subsp bovis AF2122/97
cgagugcccagcgaugcgcuca

SEQ ID NO: 3209948 - RNA, 17 nt, Mycobacterium bovis subsp bovis AF2122/97
cgagugccucgaccugg

SEQ ID NO: 3209949 - RNA, 21 nt, Mycobacterium bovis subsp bovis AF2122/97
cgagugcggacuucgccgccc

SEQ ID NO: 3209950 - RNA, 14 nt, Mycobacterium bovis subsp bovis AF2122/97
cgagugcggcacga

SEQ ID NO: 3209951 - RNA, 18 nt, Mycobacterium bovis subsp bovis AF2122/97
cgagugcggcacgaucgc

SEQ ID NO: 3209952 - RNA, 21 nt, Mycobacterium bovis subsp bovis AF2122/97
cgagugcggcacgaucgccaa

SEQ ID NO: 3209953 - RNA, 15 nt, Mycobacterium bovis subsp bovis AF2122/97
cgagugcggcgacca

SEQ ID NO: 3209954 - RNA, 22 nt, Mycobacterium bovis subsp bovis AF2122/97
cgagugcggugugugcaagccg

SEQ ID NO: 3209955 - RNA, 18 nt, Mycobacterium bovis subsp bovis AF2122/97
cgaguggaucauguucgg

SEQ ID NO: 3209956 - RNA, 16 nt, Mycobacterium bovis subsp bovis AF2122/97
cgagugggugaggcca

SEQ ID NO: 3209957 - RNA, 17 nt, Mycobacterium bovis subsp bovis AF2122/97
cgagugguccagccaga

SEQ ID NO: 3209958 - RNA, 23 nt, Mycobacterium bovis subsp bovis AF2122/97
cgaguggucccguucgcccgccc

SEQ ID NO: 3209959 - RNA, 17 nt, Mycobacterium bovis subsp bovis AF2122/97
cgagugguccggcggcc

SEQ ID NO: 3209960 - RNA, 18 nt, Mycobacterium bovis subsp bovis AF2122/97
cgagugguccggcggccg

SEQ ID NO: 3209961 - RNA, 13 nt, Mycobacterium bovis subsp bovis AF2122/97
cgagugucagcag

SEQ ID NO: 3209962 - RNA, 14 nt, Mycobacterium bovis subsp bovis AF2122/97
cgagugucagcaga

SEQ ID NO: 3209963 - RNA, 16 nt, Mycobacterium bovis subsp bovis AF2122/97
cgagugucagcagaug

SEQ ID NO: 3209964 - RNA, 21 nt, Mycobacterium bovis subsp bovis AF2122/97
cgagugucuuagccagcagca

SEQ ID NO: 3209965 - RNA, 23 nt, Mycobacterium bovis subsp bovis AF2122/97
cgaguguggccgaaagccaggcg

SEQ ID NO: 3209966 - RNA, 14 nt, Mycobacterium bovis subsp bovis AF2122/97
cgaguuaccgguga

SEQ ID NO: 3209967 - RNA, 15 nt, Mycobacterium bovis subsp bovis AF2122/97
cgaguuaggccgcca

SEQ ID NO: 3209968 - RNA, 17 nt, Mycobacterium bovis subsp bovis AF2122/97
cgaguuaggccgccagc

SEQ ID NO: 3209969 - RNA, 19 nt, Mycobacterium bovis subsp bovis AF2122/97
cgaguuaggccgccagccg

SEQ ID NO: 3209970 - RNA, 22 nt, Mycobacterium bovis subsp bovis AF2122/97
cgaguuaggccgccagccggcg

SEQ ID NO: 3209971 - RNA, 19 nt, Mycobacterium bovis subsp bovis AF2122/97
cgaguuccugcacggucaa

SEQ ID NO: 3209972 - RNA, 17 nt, Mycobacterium bovis subsp bovis AF2122/97
cgaguucgcgaaucccg

SEQ ID NO: 3209973 - RNA, 15 nt, Mycobacterium bovis subsp bovis AF2122/97
cgaguucgcgcacgu

SEQ ID NO: 3209974 - RNA, 16 nt, Mycobacterium bovis subsp bovis AF2122/97
cgaguucgcgcacguc

SEQ ID NO: 3209975 - RNA, 15 nt, Mycobacterium bovis subsp bovis AF2122/97
cgaguucggcccgca

SEQ ID NO: 3209976 - RNA, 16 nt, Mycobacterium bovis subsp bovis AF2122/97
cgaguucggccgcggu

SEQ ID NO: 3209977 - RNA, 17 nt, Mycobacterium bovis subsp bovis AF2122/97
cgaguucguagucggca

SEQ ID NO: 3209978 - RNA, 22 nt, Mycobacterium bovis subsp bovis AF2122/97
cgaguucuggaauccggccaga

SEQ ID NO: 3209979 - RNA, 23 nt, Mycobacterium bovis subsp bovis AF2122/97
cgaguugaagaagccgguguuga

SEQ ID NO: 3209980 - RNA, 13 nt, Mycobacterium bovis subsp bovis AF2122/97
cgaguugaccgcc

SEQ ID NO: 3209981 - RNA, 17 nt, Mycobacterium bovis subsp bovis AF2122/97
cgaguugagaaccggcu

SEQ ID NO: 3209982 - RNA, 12 nt, Mycobacterium bovis subsp bovis AF2122/97
cgaguugcccgg

SEQ ID NO: 3209983 - RNA, 14 nt, Mycobacterium bovis subsp bovis AF2122/97
cgaguugcgcggca

SEQ ID NO: 3209984 - RNA, 14 nt, Mycobacterium bovis subsp bovis AF2122/97
cgaguugcucgaca

SEQ ID NO: 3209985 - RNA, 20 nt, Mycobacterium bovis subsp bovis AF2122/97
cgaguugcucggccgaugcg

SEQ ID NO: 3209986 - RNA, 12 nt, Mycobacterium bovis subsp bovis AF2122/97
cgaguuggccau

SEQ ID NO: 3209987 - RNA, 20 nt, Mycobacterium bovis subsp bovis AF2122/97
cgaguuggccguggcgaaug

SEQ ID NO: 3209988 - RNA, 17 nt, Mycobacterium bovis subsp bovis AF2122/97
cgaguuguggacgcccg

SEQ ID NO: 3209989 - RNA, 16 nt, Mycobacterium bovis subsp bovis AF2122/97
cgaguuguugcugccc

SEQ ID NO: 3209990 - RNA, 19 nt, Mycobacterium bovis subsp bovis AF2122/97
cgaguuucugaagcccgac

SEQ ID NO: 3209991 - RNA, 19 nt, Mycobacterium bovis subsp bovis AF2122/97
cgaguuucugcucgaccgu

SEQ ID NO: 3209992 - RNA, 14 nt, Mycobacterium bovis subsp bovis AF2122/97
cgaguuuggccagu

SEQ ID NO: 3209993 - RNA, 22 nt, Mycobacterium bovis subsp bovis AF2122/97
cgaguuugguguagacgugcgu

SEQ ID NO: 3209994 - RNA, 15 nt, Mycobacterium bovis subsp bovis AF2122/97
cgauaaaaaccaccc

SEQ ID NO: 3209995 - RNA, 13 nt, Mycobacterium bovis subsp bovis AF2122/97
cgauaaaugccgc

SEQ ID NO: 3209996 - RNA, 17 nt, Mycobacterium bovis subsp bovis AF2122/97
cgauaacaaggccgccg

SEQ ID NO: 3209997 - RNA, 12 nt, Mycobacterium bovis subsp bovis AF2122/97
cgauaacacccg

SEQ ID NO: 3209998 - RNA, 15 nt, Mycobacterium bovis subsp bovis AF2122/97
cgauaacacccgggc

SEQ ID NO: 3209999 - RNA, 16 nt, Mycobacterium bovis subsp bovis AF2122/97
cgauaacccgcaucgg

SEQ ID NO: 3210000 - RNA, 15 nt, Mycobacterium bovis subsp bovis AF2122/97
cgauaaccgacgauc

SEQ ID NO: 3210001 - RNA, 16 nt, Mycobacterium bovis subsp bovis AF2122/97
cgauaaccucagcgcg

SEQ ID NO: 3210002 - RNA, 17 nt, Mycobacterium bovis subsp bovis AF2122/97
cgauaacuaauuuggug

SEQ ID NO: 3210003 - RNA, 16 nt, Mycobacterium bovis subsp bovis AF2122/97
cgauaaggaccgcgcc

SEQ ID NO: 3210004 - RNA, 21 nt, Mycobacterium bovis subsp bovis AF2122/97
cgauaaugaucucggcaagga

SEQ ID NO: 3210005 - RNA, 13 nt, Mycobacterium bovis subsp bovis AF2122/97
cgauacaccgacg

SEQ ID NO: 3210006 - RNA, 15 nt, Mycobacterium bovis subsp bovis AF2122/97
cgauacaccgacggg

SEQ ID NO: 3210007 - RNA, 14 nt, Mycobacterium bovis subsp bovis AF2122/97
cgauacagaucugg

SEQ ID NO: 3210008 - RNA, 20 nt, Mycobacterium bovis subsp bovis AF2122/97
cgauacagcacauccagccc

SEQ ID NO: 3210009 - RNA, 21 nt, Mycobacterium bovis subsp bovis AF2122/97
cgauacccagaauuccggcgg

SEQ ID NO: 3210010 - RNA, 14 nt, Mycobacterium bovis subsp bovis AF2122/97
cgauacccaggaug

SEQ ID NO: 3210011 - RNA, 22 nt, Mycobacterium bovis subsp bovis AF2122/97
cgauacccaggauguguugcca

SEQ ID NO: 3210012 - RNA, 13 nt, Mycobacterium bovis subsp bovis AF2122/97
cgauacccgguga

SEQ ID NO: 3210013 - RNA, 16 nt, Mycobacterium bovis subsp bovis AF2122/97
cgauaccgcaccaaag

SEQ ID NO: 3210014 - RNA, 19 nt, Mycobacterium bovis subsp bovis AF2122/97
cgauaccggcggcgagcgg

SEQ ID NO: 3210015 - RNA, 15 nt, Mycobacterium bovis subsp bovis AF2122/97
cgauaccggcgugca

SEQ ID NO: 3210016 - RNA, 20 nt, Mycobacterium bovis subsp bovis AF2122/97
cgauaccgucagcgccgcug

SEQ ID NO: 3210017 - RNA, 14 nt, Mycobacterium bovis subsp bovis AF2122/97
cgauacgcgcaccg

SEQ ID NO: 3210018 - RNA, 14 nt, Mycobacterium bovis subsp bovis AF2122/97
cgauacgcgcgucg

SEQ ID NO: 3210019 - RNA, 15 nt, Mycobacterium bovis subsp bovis AF2122/97
cgauacgcgcgucgg

SEQ ID NO: 3210020 - RNA, 13 nt, Mycobacterium bovis subsp bovis AF2122/97
cgauacgggugug

SEQ ID NO: 3210021 - RNA, 21 nt, Mycobacterium bovis subsp bovis AF2122/97
cgauacggguguggccguuga

SEQ ID NO: 3210022 - RNA, 18 nt, Mycobacterium bovis subsp bovis AF2122/97
cgauacuaaacaggccgc

SEQ ID NO: 3210023 - RNA, 23 nt, Mycobacterium bovis subsp bovis AF2122/97
cgauacuugcgcuguugcuggcg

SEQ ID NO: 3210024 - RNA, 18 nt, Mycobacterium bovis subsp bovis AF2122/97
cgauagaacguagcgccc

SEQ ID NO: 3210025 - RNA, 19 nt, Mycobacterium bovis subsp bovis AF2122/97
cgauagaacguagcgccca

SEQ ID NO: 3210026 - RNA, 22 nt, Mycobacterium bovis subsp bovis AF2122/97
cgauagaucgcguggaucgcgc

SEQ ID NO: 3210027 - RNA, 19 nt, Mycobacterium bovis subsp bovis AF2122/97
cgauagaugcgugcggcag

SEQ ID NO: 3210028 - RNA, 12 nt, Mycobacterium bovis subsp bovis AF2122/97
cgauagccaccg

SEQ ID NO: 3210029 - RNA, 18 nt, Mycobacterium bovis subsp bovis AF2122/97
cgauagccaccgacgaca

SEQ ID NO: 3210030 - RNA, 13 nt, Mycobacterium bovis subsp bovis AF2122/97
cgauagcccgcca

SEQ ID NO: 3210031 - RNA, 17 nt, Mycobacterium bovis subsp bovis AF2122/97
cgauagcgaccgcggcc

SEQ ID NO: 3210032 - RNA, 19 nt, Mycobacterium bovis subsp bovis AF2122/97
cgauagcgcggcaccagca

SEQ ID NO: 3210033 - RNA, 21 nt, Mycobacterium bovis subsp bovis AF2122/97
cgauagcgcggcaccagcacc

SEQ ID NO: 3210034 - RNA, 22 nt, Mycobacterium bovis subsp bovis AF2122/97
cgauagcgcggcaccagcaccg

SEQ ID NO: 3210035 - RNA, 21 nt, Mycobacterium bovis subsp bovis AF2122/97
cgauagcggcccgaucaccag

SEQ ID NO: 3210036 - RNA, 23 nt, Mycobacterium bovis subsp bovis AF2122/97
cgauagcggcccgaucaccagcc

SEQ ID NO: 3210037 - RNA, 13 nt, Mycobacterium bovis subsp bovis AF2122/97
cgauagcggcgcc

SEQ ID NO: 3210038 - RNA, 22 nt, Mycobacterium bovis subsp bovis AF2122/97
cgauauagccgccggugccgcc

SEQ ID NO: 3210039 - RNA, 20 nt, Mycobacterium bovis subsp bovis AF2122/97
cgauauccacaauccgcucg

SEQ ID NO: 3210040 - RNA, 14 nt, Mycobacterium bovis subsp bovis AF2122/97
cgauaucgaugcgg

SEQ ID NO: 3210041 - RNA, 20 nt, Mycobacterium bovis subsp bovis AF2122/97
cgauaucgcccggaacgaau

SEQ ID NO: 3210042 - RNA, 22 nt, Mycobacterium bovis subsp bovis AF2122/97
cgauaucgggcucagcggcgac

SEQ ID NO: 3210043 - RNA, 17 nt, Mycobacterium bovis subsp bovis AF2122/97
cgauaugcagcucgcug

SEQ ID NO: 3210044 - RNA, 14 nt, Mycobacterium bovis subsp bovis AF2122/97
cgauauggccgggu

SEQ ID NO: 3210045 - RNA, 18 nt, Mycobacterium bovis subsp bovis AF2122/97
cgauauggccuugcugcg

SEQ ID NO: 3210046 - RNA, 20 nt, Mycobacterium bovis subsp bovis AF2122/97
cgauauggguugccagcgac

SEQ ID NO: 3210047 - RNA, 22 nt, Mycobacterium bovis subsp bovis AF2122/97
cgauauggucaccaagacaccg

SEQ ID NO: 3210048 - RNA, 15 nt, Mycobacterium bovis subsp bovis AF2122/97
cgauauuggacgcgc

SEQ ID NO: 3210049 - RNA, 18 nt, Mycobacterium bovis subsp bovis AF2122/97
cgauauuggacgcgcaug

SEQ ID NO: 3210050 - RNA, 15 nt, Mycobacterium bovis subsp bovis AF2122/97
cgauauuggcaucgu

SEQ ID NO: 3210051 - RNA, 21 nt, Mycobacterium bovis subsp bovis AF2122/97
cgaucaacaacagccgcagcc

SEQ ID NO: 3210052 - RNA, 22 nt, Mycobacterium bovis subsp bovis AF2122/97
cgaucaacaacagccgcagcca

SEQ ID NO: 3210053 - RNA, 15 nt, Mycobacterium bovis subsp bovis AF2122/97
cgaucaacagcaccg

SEQ ID NO: 3210054 - RNA, 18 nt, Mycobacterium bovis subsp bovis AF2122/97
cgaucaaccccccgggcc

SEQ ID NO: 3210055 - RNA, 23 nt, Mycobacterium bovis subsp bovis AF2122/97
cgaucaaccccccgggcccgccg

SEQ ID NO: 3210056 - RNA, 22 nt, Mycobacterium bovis subsp bovis AF2122/97
cgaucaacccuagggcggugcc

SEQ ID NO: 3210057 - RNA, 15 nt, Mycobacterium bovis subsp bovis AF2122/97
cgaucaacgcgcacg

SEQ ID NO: 3210058 - RNA, 22 nt, Mycobacterium bovis subsp bovis AF2122/97
cgaucaacggaacaucgucauc

SEQ ID NO: 3210059 - RNA, 20 nt, Mycobacterium bovis subsp bovis AF2122/97
cgaucaagugcgguccggcu

SEQ ID NO: 3210060 - RNA, 20 nt, Mycobacterium bovis subsp bovis AF2122/97
cgaucaauccgcccuugccg

SEQ ID NO: 3210061 - RNA, 11 nt, Mycobacterium bovis subsp bovis AF2122/97
cgaucaaugcg

SEQ ID NO: 3210062 - RNA, 22 nt, Mycobacterium bovis subsp bovis AF2122/97
cgaucaaugcgaugcggucguc

SEQ ID NO: 3210063 - RNA, 16 nt, Mycobacterium bovis subsp bovis AF2122/97
cgaucaauggcaacga

SEQ ID NO: 3210064 - RNA, 17 nt, Mycobacterium bovis subsp bovis AF2122/97
cgaucaauugcccggca

SEQ ID NO: 3210065 - RNA, 22 nt, Mycobacterium bovis subsp bovis AF2122/97
cgaucacaccacgguuggccac

SEQ ID NO: 3210066 - RNA, 18 nt, Mycobacterium bovis subsp bovis AF2122/97
cgaucacacgguccgcca

SEQ ID NO: 3210067 - RNA, 22 nt, Mycobacterium bovis subsp bovis AF2122/97
cgaucacacgguccgccacggc

SEQ ID NO: 3210068 - RNA, 22 nt, Mycobacterium bovis subsp bovis AF2122/97
cgaucacacguccgcgcaccgc

SEQ ID NO: 3210069 - RNA, 16 nt, Mycobacterium bovis subsp bovis AF2122/97
cgaucaccaccggcag

SEQ ID NO: 3210070 - RNA, 19 nt, Mycobacterium bovis subsp bovis AF2122/97
cgaucaccaccggcagaug

SEQ ID NO: 3210071 - RNA, 22 nt, Mycobacterium bovis subsp bovis AF2122/97
cgaucaccacggcguugccgcc

SEQ ID NO: 3210072 - RNA, 12 nt, Mycobacterium bovis subsp bovis AF2122/97
cgaucaccagcc

SEQ ID NO: 3210073 - RNA, 13 nt, Mycobacterium bovis subsp bovis AF2122/97
cgaucaccagccc

SEQ ID NO: 3210074 - RNA, 17 nt, Mycobacterium bovis subsp bovis AF2122/97
cgaucacccacauggug

SEQ ID NO: 3210075 - RNA, 14 nt, Mycobacterium bovis subsp bovis AF2122/97
cgaucacccccugg

SEQ ID NO: 3210076 - RNA, 18 nt, Mycobacterium bovis subsp bovis AF2122/97
cgaucacccgcacuccac

SEQ ID NO: 3210077 - RNA, 23 nt, Mycobacterium bovis subsp bovis AF2122/97
cgaucacccgcacuccacgaucg

SEQ ID NO: 3210078 - RNA, 14 nt, Mycobacterium bovis subsp bovis AF2122/97
cgaucacccgcagg

SEQ ID NO: 3210079 - RNA, 16 nt, Mycobacterium bovis subsp bovis AF2122/97
cgaucaccgacaccgu

SEQ ID NO: 3210080 - RNA, 21 nt, Mycobacterium bovis subsp bovis AF2122/97
cgaucaccgagauggcgauca

SEQ ID NO: 3210081 - RNA, 17 nt, Mycobacterium bovis subsp bovis AF2122/97
cgaucaccgagucgacg

SEQ ID NO: 3210082 - RNA, 16 nt, Mycobacterium bovis subsp bovis AF2122/97
cgaucaccgccggggc

SEQ ID NO: 3210083 - RNA, 13 nt, Mycobacterium bovis subsp bovis AF2122/97
cgaucaccgcgcc

SEQ ID NO: 3210084 - RNA, 15 nt, Mycobacterium bovis subsp bovis AF2122/97
cgaucaccgcgccgg

SEQ ID NO: 3210085 - RNA, 17 nt, Mycobacterium bovis subsp bovis AF2122/97
cgaucaccuccgcgacg

SEQ ID NO: 3210086 - RNA, 18 nt, Mycobacterium bovis subsp bovis AF2122/97
cgaucaccucgcgggugc

SEQ ID NO: 3210087 - RNA, 18 nt, Mycobacterium bovis subsp bovis AF2122/97
cgaucaccucggcgacgu

SEQ ID NO: 3210088 - RNA, 21 nt, Mycobacterium bovis subsp bovis AF2122/97
cgaucaccucggcgacgucgg

SEQ ID NO: 3210089 - RNA, 18 nt, Mycobacterium bovis subsp bovis AF2122/97
cgaucaccugcagcacga

SEQ ID NO: 3210090 - RNA, 18 nt, Mycobacterium bovis subsp bovis AF2122/97
cgaucaccuucggccgac

SEQ ID NO: 3210091 - RNA, 20 nt, Mycobacterium bovis subsp bovis AF2122/97
cgaucaccuucggccgaccg

SEQ ID NO: 3210092 - RNA, 21 nt, Mycobacterium bovis subsp bovis AF2122/97
cgaucaccuucggccgaccgg

SEQ ID NO: 3210093 - RNA, 14 nt, Mycobacterium bovis subsp bovis AF2122/97
cgaucacgacguug

SEQ ID NO: 3210094 - RNA, 13 nt, Mycobacterium bovis subsp bovis AF2122/97
cgaucacgauguc

SEQ ID NO: 3210095 - RNA, 14 nt, Mycobacterium bovis subsp bovis AF2122/97
cgaucacgaugucc

SEQ ID NO: 3210096 - RNA, 20 nt, Mycobacterium bovis subsp bovis AF2122/97
cgaucacgccggccucgccg

SEQ ID NO: 3210097 - RNA, 12 nt, Mycobacterium bovis subsp bovis AF2122/97
cgaucacgcugc

SEQ ID NO: 3210098 - RNA, 21 nt, Mycobacterium bovis subsp bovis AF2122/97
cgaucacgcugccccgccgcc

SEQ ID NO: 3210099 - RNA, 14 nt, Mycobacterium bovis subsp bovis AF2122/97
cgaucacggcaccg

SEQ ID NO: 3210100 - RNA, 23 nt, Mycobacterium bovis subsp bovis AF2122/97
cgaucacggcgggaugcagcugc

SEQ ID NO: 3210101 - RNA, 12 nt, Mycobacterium bovis subsp bovis AF2122/97
cgaucacggugg

SEQ ID NO: 3210102 - RNA, 19 nt, Mycobacterium bovis subsp bovis AF2122/97
cgaucacggugggcgccga

SEQ ID NO: 3210103 - RNA, 17 nt, Mycobacterium bovis subsp bovis AF2122/97
cgaucacguacgccgcc

SEQ ID NO: 3210104 - RNA, 18 nt, Mycobacterium bovis subsp bovis AF2122/97
cgaucacguacgccgccg

SEQ ID NO: 3210105 - RNA, 13 nt, Mycobacterium bovis subsp bovis AF2122/97
cgaucacgucguc

SEQ ID NO: 3210106 - RNA, 19 nt, Mycobacterium bovis subsp bovis AF2122/97
cgaucacgucgucagccac

SEQ ID NO: 3210107 - RNA, 22 nt, Mycobacterium bovis subsp bovis AF2122/97
cgaucacgucgucagccaccgc

SEQ ID NO: 3210108 - RNA, 20 nt, Mycobacterium bovis subsp bovis AF2122/97
cgaucacgugguccaaccgg

SEQ ID NO: 3210109 - RNA, 19 nt, Mycobacterium bovis subsp bovis AF2122/97
cgaucacguggugcggccg

SEQ ID NO: 3210110 - RNA, 16 nt, Mycobacterium bovis subsp bovis AF2122/97
cgaucacuagcgcccc

SEQ ID NO: 3210111 - RNA, 16 nt, Mycobacterium bovis subsp bovis AF2122/97
cgaucagaaucugccu

SEQ ID NO: 3210112 - RNA, 19 nt, Mycobacterium bovis subsp bovis AF2122/97
cgaucagcaacucggccac

SEQ ID NO: 3210113 - RNA, 15 nt, Mycobacterium bovis subsp bovis AF2122/97
cgaucagcaccgacg

SEQ ID NO: 3210114 - RNA, 16 nt, Mycobacterium bovis subsp bovis AF2122/97
cgaucagcaccgacgg

SEQ ID NO: 3210115 - RNA, 19 nt, Mycobacterium bovis subsp bovis AF2122/97
cgaucagcaccgacggcgc

SEQ ID NO: 3210116 - RNA, 21 nt, Mycobacterium bovis subsp bovis AF2122/97
cgaucagcaccgacggcgcau

SEQ ID NO: 3210117 - RNA, 13 nt, Mycobacterium bovis subsp bovis AF2122/97
cgaucagcagccg

SEQ ID NO: 3210118 - RNA, 16 nt, Mycobacterium bovis subsp bovis AF2122/97
cgaucagcagccgccg

SEQ ID NO: 3210119 - RNA, 20 nt, Mycobacterium bovis subsp bovis AF2122/97
cgaucagcagggcggcguua

SEQ ID NO: 3210120 - RNA, 13 nt, Mycobacterium bovis subsp bovis AF2122/97
cgaucagccccag

SEQ ID NO: 3210121 - RNA, 17 nt, Mycobacterium bovis subsp bovis AF2122/97
cgaucagcccggccuug

SEQ ID NO: 3210122 - RNA, 23 nt, Mycobacterium bovis subsp bovis AF2122/97
cgaucagcccggccuugccgccg

SEQ ID NO: 3210123 - RNA, 13 nt, Mycobacterium bovis subsp bovis AF2122/97
cgaucagccgggu

SEQ ID NO: 3210124 - RNA, 21 nt, Mycobacterium bovis subsp bovis AF2122/97
cgaucagcgaaccaccggcgc

SEQ ID NO: 3210125 - RNA, 22 nt, Mycobacterium bovis subsp bovis AF2122/97
cgaucagcgaaccaccggcgcc

SEQ ID NO: 3210126 - RNA, 13 nt, Mycobacterium bovis subsp bovis AF2122/97
cgaucagcgaccc

SEQ ID NO: 3210127 - RNA, 20 nt, Mycobacterium bovis subsp bovis AF2122/97
cgaucagcgacuccacccca

SEQ ID NO: 3210128 - RNA, 17 nt, Mycobacterium bovis subsp bovis AF2122/97
cgaucagcgaguagccg

SEQ ID NO: 3210129 - RNA, 12 nt, Mycobacterium bovis subsp bovis AF2122/97
cgaucagcgccg

SEQ ID NO: 3210130 - RNA, 21 nt, Mycobacterium bovis subsp bovis AF2122/97
cgaucagcgccggauccacac

SEQ ID NO: 3210131 - RNA, 12 nt, Mycobacterium bovis subsp bovis AF2122/97
cgaucagcgcga

SEQ ID NO: 3210132 - RNA, 16 nt, Mycobacterium bovis subsp bovis AF2122/97
cgaucagcgcgacggu

SEQ ID NO: 3210133 - RNA, 17 nt, Mycobacterium bovis subsp bovis AF2122/97
cgaucagcgcgacgguc

SEQ ID NO: 3210134 - RNA, 16 nt, Mycobacterium bovis subsp bovis AF2122/97
cgaucagcgcggcgcc

SEQ ID NO: 3210135 - RNA, 18 nt, Mycobacterium bovis subsp bovis AF2122/97
cgaucagcggcagcaccg

SEQ ID NO: 3210136 - RNA, 21 nt, Mycobacterium bovis subsp bovis AF2122/97
cgaucagcggcagcaccgcac

SEQ ID NO: 3210137 - RNA, 21 nt, Mycobacterium bovis subsp bovis AF2122/97
cgaucagcugcgcaucgccac

SEQ ID NO: 3210138 - RNA, 21 nt, Mycobacterium bovis subsp bovis AF2122/97
cgaucagcuugugggcgacgg

SEQ ID NO: 3210139 - RNA, 20 nt, Mycobacterium bovis subsp bovis AF2122/97
cgaucaggccgacgucgacc

SEQ ID NO: 3210140 - RNA, 13 nt, Mycobacterium bovis subsp bovis AF2122/97
cgaucaggccguc

SEQ ID NO: 3210141 - RNA, 14 nt, Mycobacterium bovis subsp bovis AF2122/97
cgaucaggcggacg

SEQ ID NO: 3210142 - RNA, 12 nt, Mycobacterium bovis subsp bovis AF2122/97
cgaucaggcugc

SEQ ID NO: 3210143 - RNA, 14 nt, Mycobacterium bovis subsp bovis AF2122/97
cgaucaggcugccg

SEQ ID NO: 3210144 - RNA, 22 nt, Mycobacterium bovis subsp bovis AF2122/97
cgaucagggccccaccgagcgg

SEQ ID NO: 3210145 - RNA, 14 nt, Mycobacterium bovis subsp bovis AF2122/97
cgaucagggcgaug

SEQ ID NO: 3210146 - RNA, 15 nt, Mycobacterium bovis subsp bovis AF2122/97
cgaucaggggcccac

SEQ ID NO: 3210147 - RNA, 19 nt, Mycobacterium bovis subsp bovis AF2122/97
cgaucaggggcccacccga

SEQ ID NO: 3210148 - RNA, 16 nt, Mycobacterium bovis subsp bovis AF2122/97
cgaucagggugucgaa

SEQ ID NO: 3210149 - RNA, 19 nt, Mycobacterium bovis subsp bovis AF2122/97
cgaucagguacgccaggug

SEQ ID NO: 3210150 - RNA, 15 nt, Mycobacterium bovis subsp bovis AF2122/97
cgaucagguacuccc

SEQ ID NO: 3210151 - RNA, 21 nt, Mycobacterium bovis subsp bovis AF2122/97
cgaucagguacuccccguugc

SEQ ID NO: 3210152 - RNA, 20 nt, Mycobacterium bovis subsp bovis AF2122/97
cgaucagguuggcggcugca

SEQ ID NO: 3210153 - RNA, 20 nt, Mycobacterium bovis subsp bovis AF2122/97
cgaucagguuggugcucagc

SEQ ID NO: 3210154 - RNA, 21 nt, Mycobacterium bovis subsp bovis AF2122/97
cgaucagguuggugcucagcg

SEQ ID NO: 3210155 - RNA, 18 nt, Mycobacterium bovis subsp bovis AF2122/97
cgaucaguucgugacgug

SEQ ID NO: 3210156 - RNA, 19 nt, Mycobacterium bovis subsp bovis AF2122/97
cgaucaguucguggcuggc

SEQ ID NO: 3210157 - RNA, 23 nt, Mycobacterium bovis subsp bovis AF2122/97
cgaucaguucguggcuggcaugc

SEQ ID NO: 3210158 - RNA, 19 nt, Mycobacterium bovis subsp bovis AF2122/97
cgaucaucauauccgcccc

SEQ ID NO: 3210159 - RNA, 18 nt, Mycobacterium bovis subsp bovis AF2122/97
cgaucaucaugucggcgc

SEQ ID NO: 3210160 - RNA, 20 nt, Mycobacterium bovis subsp bovis AF2122/97
cgaucaucaugucggcgcag

SEQ ID NO: 3210161 - RNA, 14 nt, Mycobacterium bovis subsp bovis AF2122/97
cgaucaucggcccc

SEQ ID NO: 3210162 - RNA, 16 nt, Mycobacterium bovis subsp bovis AF2122/97
cgaucaucggccccga

SEQ ID NO: 3210163 - RNA, 21 nt, Mycobacterium bovis subsp bovis AF2122/97
cgaucaucgggguggccacca

SEQ ID NO: 3210164 - RNA, 23 nt, Mycobacterium bovis subsp bovis AF2122/97
cgaucaucgggguggccaccagc

SEQ ID NO: 3210165 - RNA, 22 nt, Mycobacterium bovis subsp bovis AF2122/97
cgaucaucucgucgucgcggcc

SEQ ID NO: 3210166 - RNA, 15 nt, Mycobacterium bovis subsp bovis AF2122/97
cgaucaugagcagca

SEQ ID NO: 3210167 - RNA, 15 nt, Mycobacterium bovis subsp bovis AF2122/97
cgaucauggcggcag

SEQ ID NO: 3210168 - RNA, 19 nt, Mycobacterium bovis subsp bovis AF2122/97
cgaucaugucggccggggc

SEQ ID NO: 3210169 - RNA, 15 nt, Mycobacterium bovis subsp bovis AF2122/97
cgauccacaggcuga

SEQ ID NO: 3210170 - RNA, 18 nt, Mycobacterium bovis subsp bovis AF2122/97
cgauccacaggcugaaga

SEQ ID NO: 3210171 - RNA, 18 nt, Mycobacterium bovis subsp bovis AF2122/97
cgauccacauggugacca

SEQ ID NO: 3210172 - RNA, 15 nt, Mycobacterium bovis subsp bovis AF2122/97
cgauccacccggcau

SEQ ID NO: 3210173 - RNA, 18 nt, Mycobacterium bovis subsp bovis AF2122/97
cgauccacccggcauuga

SEQ ID NO: 3210174 - RNA, 19 nt, Mycobacterium bovis subsp bovis AF2122/97
cgauccacucggcgaucuc

SEQ ID NO: 3210175 - RNA, 18 nt, Mycobacterium bovis subsp bovis AF2122/97
cgauccacugccgcgcgc

SEQ ID NO: 3210176 - RNA, 19 nt, Mycobacterium bovis subsp bovis AF2122/97
cgauccacugccgcgcgcc

SEQ ID NO: 3210177 - RNA, 21 nt, Mycobacterium bovis subsp bovis AF2122/97
cgauccacugccgcgcgcccg

SEQ ID NO: 3210178 - RNA, 23 nt, Mycobacterium bovis subsp bovis AF2122/97
cgauccacugccgcgcgcccgcc

SEQ ID NO: 3210179 - RNA, 21 nt, Mycobacterium bovis subsp bovis AF2122/97
cgauccacuguagggccggug

SEQ ID NO: 3210180 - RNA, 20 nt, Mycobacterium bovis subsp bovis AF2122/97
cgauccagaacaacggcgcg

SEQ ID NO: 3210181 - RNA, 21 nt, Mycobacterium bovis subsp bovis AF2122/97
cgauccagaacaacggcgcgg

SEQ ID NO: 3210182 - RNA, 18 nt, Mycobacterium bovis subsp bovis AF2122/97
cgauccagcccaacucgg

SEQ ID NO: 3210183 - RNA, 13 nt, Mycobacterium bovis subsp bovis AF2122/97
cgauccaggccag

SEQ ID NO: 3210184 - RNA, 15 nt, Mycobacterium bovis subsp bovis AF2122/97
cgauccaggccaguu

SEQ ID NO: 3210185 - RNA, 13 nt, Mycobacterium bovis subsp bovis AF2122/97
cgaucccaacgcc

SEQ ID NO: 3210186 - RNA, 19 nt, Mycobacterium bovis subsp bovis AF2122/97
cgaucccaacgcccgggcg

SEQ ID NO: 3210187 - RNA, 22 nt, Mycobacterium bovis subsp bovis AF2122/97
cgaucccaccggcuaugcuggc

SEQ ID NO: 3210188 - RNA, 23 nt, Mycobacterium bovis subsp bovis AF2122/97
cgaucccaccggcuaugcuggcg

SEQ ID NO: 3210189 - RNA, 21 nt, Mycobacterium bovis subsp bovis AF2122/97
cgauccccacaaucagcccga

SEQ ID NO: 3210190 - RNA, 21 nt, Mycobacterium bovis subsp bovis AF2122/97
cgauccccagcaccacgguga

SEQ ID NO: 3210191 - RNA, 22 nt, Mycobacterium bovis subsp bovis AF2122/97
cgauccccagcaccacggugac

SEQ ID NO: 3210192 - RNA, 14 nt, Mycobacterium bovis subsp bovis AF2122/97
cgauccccaggccg

SEQ ID NO: 3210193 - RNA, 15 nt, Mycobacterium bovis subsp bovis AF2122/97
cgaucccgaucgcgc

SEQ ID NO: 3210194 - RNA, 15 nt, Mycobacterium bovis subsp bovis AF2122/97
cgaucccgccggggc

SEQ ID NO: 3210195 - RNA, 16 nt, Mycobacterium bovis subsp bovis AF2122/97
cgaucccgccggggcc

SEQ ID NO: 3210196 - RNA, 13 nt, Mycobacterium bovis subsp bovis AF2122/97
cgaucccgcggcc

SEQ ID NO: 3210197 - RNA, 16 nt, Mycobacterium bovis subsp bovis AF2122/97
cgaucccgcggccggg

SEQ ID NO: 3210198 - RNA, 17 nt, Mycobacterium bovis subsp bovis AF2122/97
cgaucccgcggccgggc

SEQ ID NO: 3210199 - RNA, 17 nt, Mycobacterium bovis subsp bovis AF2122/97
cgaucccggcaacaacg

SEQ ID NO: 3210200 - RNA, 17 nt, Mycobacterium bovis subsp bovis AF2122/97
cgaucccggccagcucc

SEQ ID NO: 3210201 - RNA, 14 nt, Mycobacterium bovis subsp bovis AF2122/97
cgaucccggccguc

SEQ ID NO: 3210202 - RNA, 13 nt, Mycobacterium bovis subsp bovis AF2122/97
cgaucccggcgag

SEQ ID NO: 3210203 - RNA, 15 nt, Mycobacterium bovis subsp bovis AF2122/97
cgaucccggcgagca

SEQ ID NO: 3210204 - RNA, 18 nt, Mycobacterium bovis subsp bovis AF2122/97
cgaucccggcgagcaccc

SEQ ID NO: 3210205 - RNA, 16 nt, Mycobacterium bovis subsp bovis AF2122/97
cgaucccguccgcgcc

SEQ ID NO: 3210206 - RNA, 20 nt, Mycobacterium bovis subsp bovis AF2122/97
cgauccgauacagugcgcgg

SEQ ID NO: 3210207 - RNA, 21 nt, Mycobacterium bovis subsp bovis AF2122/97
cgauccgauacagugcgcgga

SEQ ID NO: 3210208 - RNA, 18 nt, Mycobacterium bovis subsp bovis AF2122/97
cgauccgauccgcucacc

SEQ ID NO: 3210209 - RNA, 19 nt, Mycobacterium bovis subsp bovis AF2122/97
cgauccgcaacaacgccgc

SEQ ID NO: 3210210 - RNA, 13 nt, Mycobacterium bovis subsp bovis AF2122/97
cgauccgcacagc

SEQ ID NO: 3210211 - RNA, 16 nt, Mycobacterium bovis subsp bovis AF2122/97
cgauccgcacagcaac

SEQ ID NO: 3210212 - RNA, 17 nt, Mycobacterium bovis subsp bovis AF2122/97
cgauccgcacccggccg

SEQ ID NO: 3210213 - RNA, 18 nt, Mycobacterium bovis subsp bovis AF2122/97
cgauccgcacccggccgc

SEQ ID NO: 3210214 - RNA, 19 nt, Mycobacterium bovis subsp bovis AF2122/97
cgauccgcacccggccgcg

SEQ ID NO: 3210215 - RNA, 17 nt, Mycobacterium bovis subsp bovis AF2122/97
cgauccgcacgaucguc

SEQ ID NO: 3210216 - RNA, 19 nt, Mycobacterium bovis subsp bovis AF2122/97
cgauccgccacgaaucgcc

SEQ ID NO: 3210217 - RNA, 22 nt, Mycobacterium bovis subsp bovis AF2122/97
cgauccgccacgaaucgcccau

SEQ ID NO: 3210218 - RNA, 14 nt, Mycobacterium bovis subsp bovis AF2122/97
cgauccgcgcgcau

SEQ ID NO: 3210219 - RNA, 19 nt, Mycobacterium bovis subsp bovis AF2122/97
cgauccgcugcgccgaggc

SEQ ID NO: 3210220 - RNA, 18 nt, Mycobacterium bovis subsp bovis AF2122/97
cgauccggaucccaccac

SEQ ID NO: 3210221 - RNA, 20 nt, Mycobacterium bovis subsp bovis AF2122/97
cgauccggaucccaccaccg

SEQ ID NO: 3210222 - RNA, 21 nt, Mycobacterium bovis subsp bovis AF2122/97
cgauccggaucccaccaccgc

SEQ ID NO: 3210223 - RNA, 21 nt, Mycobacterium bovis subsp bovis AF2122/97
cgauccggcaauugugcugcg

SEQ ID NO: 3210224 - RNA, 12 nt, Mycobacterium bovis subsp bovis AF2122/97
cgauccggcgcc

SEQ ID NO: 3210225 - RNA, 12 nt, Mycobacterium bovis subsp bovis AF2122/97
cgauccggucgg

SEQ ID NO: 3210226 - RNA, 19 nt, Mycobacterium bovis subsp bovis AF2122/97
cgauccggucggccaggcc

SEQ ID NO: 3210227 - RNA, 20 nt, Mycobacterium bovis subsp bovis AF2122/97
cgauccggucggccaggccg

SEQ ID NO: 3210228 - RNA, 21 nt, Mycobacterium bovis subsp bovis AF2122/97
cgauccggucggccaggccgu

SEQ ID NO: 3210229 - RNA, 20 nt, Mycobacterium bovis subsp bovis AF2122/97
cgauccgguggcuggccgcc

SEQ ID NO: 3210230 - RNA, 21 nt, Mycobacterium bovis subsp bovis AF2122/97
cgauccgguuaugcgguaccc

SEQ ID NO: 3210231 - RNA, 20 nt, Mycobacterium bovis subsp bovis AF2122/97
cgauccucgcccgcaccagc

SEQ ID NO: 3210232 - RNA, 18 nt, Mycobacterium bovis subsp bovis AF2122/97
cgauccugaccagccagg

SEQ ID NO: 3210233 - RNA, 14 nt, Mycobacterium bovis subsp bovis AF2122/97
cgauccugcccacc

SEQ ID NO: 3210234 - RNA, 15 nt, Mycobacterium bovis subsp bovis AF2122/97
cgauccugcccacca

SEQ ID NO: 3210235 - RNA, 16 nt, Mycobacterium bovis subsp bovis AF2122/97
cgauccugcccaccau

SEQ ID NO: 3210236 - RNA, 21 nt, Mycobacterium bovis subsp bovis AF2122/97
cgauccugcccaccaucccgc

SEQ ID NO: 3210237 - RNA, 21 nt, Mycobacterium bovis subsp bovis AF2122/97
cgaucgaauugcguucgccgc

SEQ ID NO: 3210238 - RNA, 23 nt, Mycobacterium bovis subsp bovis AF2122/97
cgaucgaauugcguucgccgccc

SEQ ID NO: 3210239 - RNA, 16 nt, Mycobacterium bovis subsp bovis AF2122/97
cgaucgacacccgcuc

SEQ ID NO: 3210240 - RNA, 20 nt, Mycobacterium bovis subsp bovis AF2122/97
cgaucgacacccgcucggcc

SEQ ID NO: 3210241 - RNA, 21 nt, Mycobacterium bovis subsp bovis AF2122/97
cgaucgacaccgugaccgccg

SEQ ID NO: 3210242 - RNA, 22 nt, Mycobacterium bovis subsp bovis AF2122/97
cgaucgacaccgugaccgccgc

SEQ ID NO: 3210243 - RNA, 23 nt, Mycobacterium bovis subsp bovis AF2122/97
cgaucgacaccgugaccgccgcg

SEQ ID NO: 3210244 - RNA, 16 nt, Mycobacterium bovis subsp bovis AF2122/97
cgaucgacagccccgc

SEQ ID NO: 3210245 - RNA, 13 nt, Mycobacterium bovis subsp bovis AF2122/97
cgaucgacccggu

SEQ ID NO: 3210246 - RNA, 14 nt, Mycobacterium bovis subsp bovis AF2122/97
cgaucgacgccgcc

SEQ ID NO: 3210247 - RNA, 14 nt, Mycobacterium bovis subsp bovis AF2122/97
cgaucgacggucgu

SEQ ID NO: 3210248 - RNA, 17 nt, Mycobacterium bovis subsp bovis AF2122/97
cgaucgacucacacacc

SEQ ID NO: 3210249 - RNA, 20 nt, Mycobacterium bovis subsp bovis AF2122/97
cgaucgacucgaaccguuuc

SEQ ID NO: 3210250 - RNA, 17 nt, Mycobacterium bovis subsp bovis AF2122/97
cgaucgacugcagcccg

SEQ ID NO: 3210251 - RNA, 13 nt, Mycobacterium bovis subsp bovis AF2122/97
cgaucgagcagga

SEQ ID NO: 3210252 - RNA, 15 nt, Mycobacterium bovis subsp bovis AF2122/97
cgaucgagcaggccg

SEQ ID NO: 3210253 - RNA, 17 nt, Mycobacterium bovis subsp bovis AF2122/97
cgaucgagcaggccgcc

SEQ ID NO: 3210254 - RNA, 17 nt, Mycobacterium bovis subsp bovis AF2122/97
cgaucgagcccggagcg

SEQ ID NO: 3210255 - RNA, 19 nt, Mycobacterium bovis subsp bovis AF2122/97
cgaucgagcugacgauggc

SEQ ID NO: 3210256 - RNA, 14 nt, Mycobacterium bovis subsp bovis AF2122/97
cgaucgaggaguug

SEQ ID NO: 3210257 - RNA, 20 nt, Mycobacterium bovis subsp bovis AF2122/97
cgaucgcagugagcagccgg

SEQ ID NO: 3210258 - RNA, 14 nt, Mycobacterium bovis subsp bovis AF2122/97
cgaucgccaaggcg

SEQ ID NO: 3210259 - RNA, 21 nt, Mycobacterium bovis subsp bovis AF2122/97
cgaucgccaggccgagcccgg

SEQ ID NO: 3210260 - RNA, 13 nt, Mycobacterium bovis subsp bovis AF2122/97
cgaucgcccgcug

SEQ ID NO: 3210261 - RNA, 18 nt, Mycobacterium bovis subsp bovis AF2122/97
cgaucgcccggccccgca

SEQ ID NO: 3210262 - RNA, 16 nt, Mycobacterium bovis subsp bovis AF2122/97
cgaucgccgacgccag

SEQ ID NO: 3210263 - RNA, 13 nt, Mycobacterium bovis subsp bovis AF2122/97
cgaucgccgcgcc

SEQ ID NO: 3210264 - RNA, 14 nt, Mycobacterium bovis subsp bovis AF2122/97
cgaucgccgcgccg

SEQ ID NO: 3210265 - RNA, 13 nt, Mycobacterium bovis subsp bovis AF2122/97
cgaucgccgcgcu

SEQ ID NO: 3210266 - RNA, 14 nt, Mycobacterium bovis subsp bovis AF2122/97
cgaucgccgcgcug

SEQ ID NO: 3210267 - RNA, 17 nt, Mycobacterium bovis subsp bovis AF2122/97
cgaucgccgcgcugguc

SEQ ID NO: 3210268 - RNA, 20 nt, Mycobacterium bovis subsp bovis AF2122/97
cgaucgccgcuaacgcaccu

SEQ ID NO: 3210269 - RNA, 15 nt, Mycobacterium bovis subsp bovis AF2122/97
cgaucgcgacccgau

SEQ ID NO: 3210270 - RNA, 13 nt, Mycobacterium bovis subsp bovis AF2122/97
cgaucgcgagccc

SEQ ID NO: 3210271 - RNA, 16 nt, Mycobacterium bovis subsp bovis AF2122/97
cgaucgcgagcgagcc

SEQ ID NO: 3210272 - RNA, 17 nt, Mycobacterium bovis subsp bovis AF2122/97
cgaucgcgagcgagcca

SEQ ID NO: 3210273 - RNA, 14 nt, Mycobacterium bovis subsp bovis AF2122/97
cgaucgcgccaggc

SEQ ID NO: 3210274 - RNA, 15 nt, Mycobacterium bovis subsp bovis AF2122/97
cgaucgcgccaggcc

SEQ ID NO: 3210275 - RNA, 20 nt, Mycobacterium bovis subsp bovis AF2122/97
cgaucgcgccgucggcgaug

SEQ ID NO: 3210276 - RNA, 18 nt, Mycobacterium bovis subsp bovis AF2122/97
cgaucgcgcgagcgaugg

SEQ ID NO: 3210277 - RNA, 18 nt, Mycobacterium bovis subsp bovis AF2122/97
cgaucgcgcuggcgcccu

SEQ ID NO: 3210278 - RNA, 22 nt, Mycobacterium bovis subsp bovis AF2122/97
cgaucgcggacccgucggcgug

SEQ ID NO: 3210279 - RNA, 20 nt, Mycobacterium bovis subsp bovis AF2122/97
cgaucgcggcaaugaggccg

SEQ ID NO: 3210280 - RNA, 15 nt, Mycobacterium bovis subsp bovis AF2122/97
cgaucgcggcaucga

SEQ ID NO: 3210281 - RNA, 19 nt, Mycobacterium bovis subsp bovis AF2122/97
cgaucgcggcccgcagcgu

SEQ ID NO: 3210282 - RNA, 16 nt, Mycobacterium bovis subsp bovis AF2122/97
cgaucgcggcccggcc

SEQ ID NO: 3210283 - RNA, 22 nt, Mycobacterium bovis subsp bovis AF2122/97
cgaucgcggcgagcaccacccc

SEQ ID NO: 3210284 - RNA, 13 nt, Mycobacterium bovis subsp bovis AF2122/97
cgaucgcggcgcc

SEQ ID NO: 3210285 - RNA, 15 nt, Mycobacterium bovis subsp bovis AF2122/97
cgaucgcggcgccca

SEQ ID NO: 3210286 - RNA, 17 nt, Mycobacterium bovis subsp bovis AF2122/97
cgaucgcggcgcccagg

SEQ ID NO: 3210287 - RNA, 17 nt, Mycobacterium bovis subsp bovis AF2122/97
cgaucgcggcggccucc

SEQ ID NO: 3210288 - RNA, 13 nt, Mycobacterium bovis subsp bovis AF2122/97
cgaucgcgucggg

SEQ ID NO: 3210289 - RNA, 22 nt, Mycobacterium bovis subsp bovis AF2122/97
cgaucgcgucgggcucggcgaa

SEQ ID NO: 3210290 - RNA, 19 nt, Mycobacterium bovis subsp bovis AF2122/97
cgaucgcguuagccagguc

SEQ ID NO: 3210291 - RNA, 16 nt, Mycobacterium bovis subsp bovis AF2122/97
cgaucgcguucugcac

SEQ ID NO: 3210292 - RNA, 18 nt, Mycobacterium bovis subsp bovis AF2122/97
cgaucgcguucugcacca

SEQ ID NO: 3210293 - RNA, 16 nt, Mycobacterium bovis subsp bovis AF2122/97
cgaucgcucauucgug

SEQ ID NO: 3210294 - RNA, 22 nt, Mycobacterium bovis subsp bovis AF2122/97
cgaucgcucauucgugcccggg

SEQ ID NO: 3210295 - RNA, 18 nt, Mycobacterium bovis subsp bovis AF2122/97
cgaucgcuccgcggcgca

SEQ ID NO: 3210296 - RNA, 22 nt, Mycobacterium bovis subsp bovis AF2122/97
cgaucgcuccggcccugccgcc

SEQ ID NO: 3210297 - RNA, 18 nt, Mycobacterium bovis subsp bovis AF2122/97
cgaucgcuugccccgccg

SEQ ID NO: 3210298 - RNA, 16 nt, Mycobacterium bovis subsp bovis AF2122/97
cgaucggaccaccagg

SEQ ID NO: 3210299 - RNA, 17 nt, Mycobacterium bovis subsp bovis AF2122/97
cgaucggaccaccaggg

SEQ ID NO: 3210300 - RNA, 14 nt, Mycobacterium bovis subsp bovis AF2122/97
cgaucggacgucgu

SEQ ID NO: 3210301 - RNA, 15 nt, Mycobacterium bovis subsp bovis AF2122/97
cgaucggaggcccgc

SEQ ID NO: 3210302 - RNA, 17 nt, Mycobacterium bovis subsp bovis AF2122/97
cgaucggaggcccgcca

SEQ ID NO: 3210303 - RNA, 16 nt, Mycobacterium bovis subsp bovis AF2122/97
cgaucggaucgaugcc

SEQ ID NO: 3210304 - RNA, 18 nt, Mycobacterium bovis subsp bovis AF2122/97
cgaucggaugcgugagaa

SEQ ID NO: 3210305 - RNA, 21 nt, Mycobacterium bovis subsp bovis AF2122/97
cgaucggcaacccgcaccagg

SEQ ID NO: 3210306 - RNA, 19 nt, Mycobacterium bovis subsp bovis AF2122/97
cgaucggcaaucgacucag

SEQ ID NO: 3210307 - RNA, 16 nt, Mycobacterium bovis subsp bovis AF2122/97
cgaucggcacuagcga

SEQ ID NO: 3210308 - RNA, 17 nt, Mycobacterium bovis subsp bovis AF2122/97
cgaucggcacuuagccc

SEQ ID NO: 3210309 - RNA, 13 nt, Mycobacterium bovis subsp bovis AF2122/97
cgaucggcagcca

SEQ ID NO: 3210310 - RNA, 15 nt, Mycobacterium bovis subsp bovis AF2122/97
cgaucggcagccagg

SEQ ID NO: 3210311 - RNA, 19 nt, Mycobacterium bovis subsp bovis AF2122/97
cgaucggcagccagggcgc

SEQ ID NO: 3210312 - RNA, 14 nt, Mycobacterium bovis subsp bovis AF2122/97
cgaucggcaggccg

SEQ ID NO: 3210313 - RNA, 21 nt, Mycobacterium bovis subsp bovis AF2122/97
cgaucggcagucccagcgccg

SEQ ID NO: 3210314 - RNA, 22 nt, Mycobacterium bovis subsp bovis AF2122/97
cgaucggcagucccagcgccgc

SEQ ID NO: 3210315 - RNA, 13 nt, Mycobacterium bovis subsp bovis AF2122/97
cgaucggccacca

SEQ ID NO: 3210316 - RNA, 14 nt, Mycobacterium bovis subsp bovis AF2122/97
cgaucggccaccau

SEQ ID NO: 3210317 - RNA, 18 nt, Mycobacterium bovis subsp bovis AF2122/97
cgaucggccaccaucgcc

SEQ ID NO: 3210318 - RNA, 15 nt, Mycobacterium bovis subsp bovis AF2122/97
cgaucggcggcggcg

SEQ ID NO: 3210319 - RNA, 18 nt, Mycobacterium bovis subsp bovis AF2122/97
cgaucggcucacgacugc

SEQ ID NO: 3210320 - RNA, 22 nt, Mycobacterium bovis subsp bovis AF2122/97
cgaucggcuugccugcgccgag

SEQ ID NO: 3210321 - RNA, 19 nt, Mycobacterium bovis subsp bovis AF2122/97
cgaucgggaguccgguagc

SEQ ID NO: 3210322 - RNA, 14 nt, Mycobacterium bovis subsp bovis AF2122/97
cgaucgggcccacc

SEQ ID NO: 3210323 - RNA, 16 nt, Mycobacterium bovis subsp bovis AF2122/97
cgaucgggcccaccgc

SEQ ID NO: 3210324 - RNA, 18 nt, Mycobacterium bovis subsp bovis AF2122/97
cgaucgggcccagcagcg

SEQ ID NO: 3210325 - RNA, 23 nt, Mycobacterium bovis subsp bovis AF2122/97
cgaucgggcccagcagcgcaacc

SEQ ID NO: 3210326 - RNA, 14 nt, Mycobacterium bovis subsp bovis AF2122/97
cgaucgggccggcg

SEQ ID NO: 3210327 - RNA, 15 nt, Mycobacterium bovis subsp bovis AF2122/97
cgaucggggcgacga

SEQ ID NO: 3210328 - RNA, 14 nt, Mycobacterium bovis subsp bovis AF2122/97
cgaucggucgaucg

SEQ ID NO: 3210329 - RNA, 14 nt, Mycobacterium bovis subsp bovis AF2122/97
cgaucggugacgcg

SEQ ID NO: 3210330 - RNA, 15 nt, Mycobacterium bovis subsp bovis AF2122/97
cgaucggugacgcgc

SEQ ID NO: 3210331 - RNA, 17 nt, Mycobacterium bovis subsp bovis AF2122/97
cgaucggugacgcgccg

SEQ ID NO: 3210332 - RNA, 18 nt, Mycobacterium bovis subsp bovis AF2122/97
cgaucggugacgcgccgu

SEQ ID NO: 3210333 - RNA, 21 nt, Mycobacterium bovis subsp bovis AF2122/97
cgaucggugacgcgccguaac

SEQ ID NO: 3210334 - RNA, 23 nt, Mycobacterium bovis subsp bovis AF2122/97
cgaucggugccagaaugccgaac

SEQ ID NO: 3210335 - RNA, 16 nt, Mycobacterium bovis subsp bovis AF2122/97
cgaucggugcgaucag

SEQ ID NO: 3210336 - RNA, 18 nt, Mycobacterium bovis subsp bovis AF2122/97
cgaucggugcgggcgccg

SEQ ID NO: 3210337 - RNA, 19 nt, Mycobacterium bovis subsp bovis AF2122/97
cgaucggugcgggcgccgc

SEQ ID NO: 3210338 - RNA, 20 nt, Mycobacterium bovis subsp bovis AF2122/97
cgaucggugcgggcgccgcu

SEQ ID NO: 3210339 - RNA, 12 nt, Mycobacterium bovis subsp bovis AF2122/97
cgaucguagccg

SEQ ID NO: 3210340 - RNA, 19 nt, Mycobacterium bovis subsp bovis AF2122/97
cgaucguaggacucggcgg

SEQ ID NO: 3210341 - RNA, 15 nt, Mycobacterium bovis subsp bovis AF2122/97
cgaucgucaacgacg

SEQ ID NO: 3210342 - RNA, 18 nt, Mycobacterium bovis subsp bovis AF2122/97
cgaucgucaacgacgacg

SEQ ID NO: 3210343 - RNA, 16 nt, Mycobacterium bovis subsp bovis AF2122/97
cgaucgucacgcgggu

SEQ ID NO: 3210344 - RNA, 23 nt, Mycobacterium bovis subsp bovis AF2122/97
cgaucgucacgcggguugcgcgg

SEQ ID NO: 3210345 - RNA, 13 nt, Mycobacterium bovis subsp bovis AF2122/97
cgaucgucgacgc

SEQ ID NO: 3210346 - RNA, 22 nt, Mycobacterium bovis subsp bovis AF2122/97
cgaucgucgacucggcggcgcg

SEQ ID NO: 3210347 - RNA, 22 nt, Mycobacterium bovis subsp bovis AF2122/97
cgaucgucgagccgaucgcccg

SEQ ID NO: 3210348 - RNA, 14 nt, Mycobacterium bovis subsp bovis AF2122/97
cgaucgucggguug

SEQ ID NO: 3210349 - RNA, 19 nt, Mycobacterium bovis subsp bovis AF2122/97
cgaucgucggguugucgcg

SEQ ID NO: 3210350 - RNA, 20 nt, Mycobacterium bovis subsp bovis AF2122/97
cgaucgucggguugucgcgg

SEQ ID NO: 3210351 - RNA, 14 nt, Mycobacterium bovis subsp bovis AF2122/97
cgaucgugacguug

SEQ ID NO: 3210352 - RNA, 20 nt, Mycobacterium bovis subsp bovis AF2122/97
cgaucgugagacgccgucga

SEQ ID NO: 3210353 - RNA, 13 nt, Mycobacterium bovis subsp bovis AF2122/97
cgaucgugcaggu

SEQ ID NO: 3210354 - RNA, 23 nt, Mycobacterium bovis subsp bovis AF2122/97
cgaucgugcgacgcaggaucaca

SEQ ID NO: 3210355 - RNA, 23 nt, Mycobacterium bovis subsp bovis AF2122/97
cgaucgugcggaaccugcucggc

SEQ ID NO: 3210356 - RNA, 20 nt, Mycobacterium bovis subsp bovis AF2122/97
cgaucucauccuccugcgcc

SEQ ID NO: 3210357 - RNA, 21 nt, Mycobacterium bovis subsp bovis AF2122/97
cgaucucauccuccugcgccg

SEQ ID NO: 3210358 - RNA, 20 nt, Mycobacterium bovis subsp bovis AF2122/97
cgaucuccacccgccggccg

SEQ ID NO: 3210359 - RNA, 20 nt, Mycobacterium bovis subsp bovis AF2122/97
cgaucuccagcgguucggug

SEQ ID NO: 3210360 - RNA, 21 nt, Mycobacterium bovis subsp bovis AF2122/97
cgaucuccaggcccggcggug

SEQ ID NO: 3210361 - RNA, 22 nt, Mycobacterium bovis subsp bovis AF2122/97
cgaucucccagugagcaugcga

SEQ ID NO: 3210362 - RNA, 15 nt, Mycobacterium bovis subsp bovis AF2122/97
cgaucuccuccacca

SEQ ID NO: 3210363 - RNA, 19 nt, Mycobacterium bovis subsp bovis AF2122/97
cgaucuccuccaccagugc

SEQ ID NO: 3210364 - RNA, 20 nt, Mycobacterium bovis subsp bovis AF2122/97
cgaucuccucuugcaccagg

SEQ ID NO: 3210365 - RNA, 23 nt, Mycobacterium bovis subsp bovis AF2122/97
cgaucuccucuugcaccagggcc

SEQ ID NO: 3210366 - RNA, 14 nt, Mycobacterium bovis subsp bovis AF2122/97
cgaucucgaccagc

SEQ ID NO: 3210367 - RNA, 14 nt, Mycobacterium bovis subsp bovis AF2122/97
cgaucucgaucauc

SEQ ID NO: 3210368 - RNA, 21 nt, Mycobacterium bovis subsp bovis AF2122/97
cgaucucgcccagcgagcgcc

SEQ ID NO: 3210369 - RNA, 13 nt, Mycobacterium bovis subsp bovis AF2122/97
cgaucucgccgcc

SEQ ID NO: 3210370 - RNA, 17 nt, Mycobacterium bovis subsp bovis AF2122/97
cgaucucgccgccagcg

SEQ ID NO: 3210371 - RNA, 19 nt, Mycobacterium bovis subsp bovis AF2122/97
cgaucucgccgccagcgcu

SEQ ID NO: 3210372 - RNA, 23 nt, Mycobacterium bovis subsp bovis AF2122/97
cgaucucgccggcgaagaccgcc

SEQ ID NO: 3210373 - RNA, 18 nt, Mycobacterium bovis subsp bovis AF2122/97
cgaucucgcgaaccgaca

SEQ ID NO: 3210374 - RNA, 14 nt, Mycobacterium bovis subsp bovis AF2122/97
cgaucucggccagg

SEQ ID NO: 3210375 - RNA, 19 nt, Mycobacterium bovis subsp bovis AF2122/97
cgaucucguggaucugccu

SEQ ID NO: 3210376 - RNA, 19 nt, Mycobacterium bovis subsp bovis AF2122/97
cgaucucguuuucgcgcuu

SEQ ID NO: 3210377 - RNA, 16 nt, Mycobacterium bovis subsp bovis AF2122/97
cgaucucuaccagccg

SEQ ID NO: 3210378 - RNA, 14 nt, Mycobacterium bovis subsp bovis AF2122/97
cgaucucuccugga

SEQ ID NO: 3210379 - RNA, 14 nt, Mycobacterium bovis subsp bovis AF2122/97
cgaucucugcggcg

SEQ ID NO: 3210380 - RNA, 20 nt, Mycobacterium bovis subsp bovis AF2122/97
cgaucugacugacggucauu

SEQ ID NO: 3210381 - RNA, 13 nt, Mycobacterium bovis subsp bovis AF2122/97
cgaucugcagcgc

SEQ ID NO: 3210382 - RNA, 15 nt, Mycobacterium bovis subsp bovis AF2122/97
cgaucugcaggccca

SEQ ID NO: 3210383 - RNA, 13 nt, Mycobacterium bovis subsp bovis AF2122/97
cgaucugcccccg

SEQ ID NO: 3210384 - RNA, 15 nt, Mycobacterium bovis subsp bovis AF2122/97
cgaucugcccccgcc

SEQ ID NO: 3210385 - RNA, 16 nt, Mycobacterium bovis subsp bovis AF2122/97
cgaucugcccccgccg

SEQ ID NO: 3210386 - RNA, 13 nt, Mycobacterium bovis subsp bovis AF2122/97
cgaucugcccggu

SEQ ID NO: 3210387 - RNA, 22 nt, Mycobacterium bovis subsp bovis AF2122/97
cgaucugcgacaagaccggcgg

SEQ ID NO: 3210388 - RNA, 20 nt, Mycobacterium bovis subsp bovis AF2122/97
cgaucugcgcgucaggccag

SEQ ID NO: 3210389 - RNA, 21 nt, Mycobacterium bovis subsp bovis AF2122/97
cgaucugcggcgcccggucga

SEQ ID NO: 3210390 - RNA, 22 nt, Mycobacterium bovis subsp bovis AF2122/97
cgaucugcggcgcccggucgag

SEQ ID NO: 3210391 - RNA, 14 nt, Mycobacterium bovis subsp bovis AF2122/97
cgaucugcuaccag

SEQ ID NO: 3210392 - RNA, 12 nt, Mycobacterium bovis subsp bovis AF2122/97
cgaucugcucgc

SEQ ID NO: 3210393 - RNA, 15 nt, Mycobacterium bovis subsp bovis AF2122/97
cgaucugcucgccga

SEQ ID NO: 3210394 - RNA, 17 nt, Mycobacterium bovis subsp bovis AF2122/97
cgaucugcucgccgagc

SEQ ID NO: 3210395 - RNA, 15 nt, Mycobacterium bovis subsp bovis AF2122/97
cgaucugcugugucg

SEQ ID NO: 3210396 - RNA, 16 nt, Mycobacterium bovis subsp bovis AF2122/97
cgaucuggccgaacga

SEQ ID NO: 3210397 - RNA, 21 nt, Mycobacterium bovis subsp bovis AF2122/97
cgaucugggcuuucagcaccg

SEQ ID NO: 3210398 - RNA, 23 nt, Mycobacterium bovis subsp bovis AF2122/97
cgaucugguaagucagcucgauc

SEQ ID NO: 3210399 - RNA, 19 nt, Mycobacterium bovis subsp bovis AF2122/97
cgaucugucgcgccggugg

SEQ ID NO: 3210400 - RNA, 20 nt, Mycobacterium bovis subsp bovis AF2122/97
cgaucuguggaagcccgucg

SEQ ID NO: 3210401 - RNA, 20 nt, Mycobacterium bovis subsp bovis AF2122/97
cgaucugugguugcagcaca

SEQ ID NO: 3210402 - RNA, 14 nt, Mycobacterium bovis subsp bovis AF2122/97
cgaucuucgcgcgc

SEQ ID NO: 3210403 - RNA, 18 nt, Mycobacterium bovis subsp bovis AF2122/97
cgaucuucuccucgucgg

SEQ ID NO: 3210404 - RNA, 13 nt, Mycobacterium bovis subsp bovis AF2122/97
cgaucuuggccac

SEQ ID NO: 3210405 - RNA, 13 nt, Mycobacterium bovis subsp bovis AF2122/97
cgaugaacagcga

SEQ ID NO: 3210406 - RNA, 20 nt, Mycobacterium bovis subsp bovis AF2122/97
cgaugaacaucuggcgacga

SEQ ID NO: 3210407 - RNA, 14 nt, Mycobacterium bovis subsp bovis AF2122/97
cgaugaaccgggca

SEQ ID NO: 3210408 - RNA, 20 nt, Mycobacterium bovis subsp bovis AF2122/97
cgaugaacgcguagucgcgg

SEQ ID NO: 3210409 - RNA, 16 nt, Mycobacterium bovis subsp bovis AF2122/97
cgaugaacgggaucga

SEQ ID NO: 3210410 - RNA, 19 nt, Mycobacterium bovis subsp bovis AF2122/97
cgaugaauucuuuggggcg

SEQ ID NO: 3210411 - RNA, 22 nt, Mycobacterium bovis subsp bovis AF2122/97
cgaugacaaagaaguggucggc

SEQ ID NO: 3210412 - RNA, 18 nt, Mycobacterium bovis subsp bovis AF2122/97
cgaugacaucaccgacca

SEQ ID NO: 3210413 - RNA, 21 nt, Mycobacterium bovis subsp bovis AF2122/97
cgaugacaucaccgaccaacg

SEQ ID NO: 3210414 - RNA, 15 nt, Mycobacterium bovis subsp bovis AF2122/97
cgaugacaucgguca

SEQ ID NO: 3210415 - RNA, 16 nt, Mycobacterium bovis subsp bovis AF2122/97
cgaugaccacgccgac

SEQ ID NO: 3210416 - RNA, 23 nt, Mycobacterium bovis subsp bovis AF2122/97
cgaugaccagauguaccucaucg

SEQ ID NO: 3210417 - RNA, 18 nt, Mycobacterium bovis subsp bovis AF2122/97
cgaugaccagcacaccgc

SEQ ID NO: 3210418 - RNA, 19 nt, Mycobacterium bovis subsp bovis AF2122/97
cgaugaccagcacaccgcc

SEQ ID NO: 3210419 - RNA, 15 nt, Mycobacterium bovis subsp bovis AF2122/97
cgaugaccccggugg

SEQ ID NO: 3210420 - RNA, 22 nt, Mycobacterium bovis subsp bovis AF2122/97
cgaugacccggaaucccgaguc

SEQ ID NO: 3210421 - RNA, 21 nt, Mycobacterium bovis subsp bovis AF2122/97
cgaugaccgaagagcgcgcgc

SEQ ID NO: 3210422 - RNA, 13 nt, Mycobacterium bovis subsp bovis AF2122/97
cgaugaccgcgcg

SEQ ID NO: 3210423 - RNA, 21 nt, Mycobacterium bovis subsp bovis AF2122/97
cgaugaccgcgcggcccgccg

SEQ ID NO: 3210424 - RNA, 13 nt, Mycobacterium bovis subsp bovis AF2122/97
cgaugaccgggga

SEQ ID NO: 3210425 - RNA, 14 nt, Mycobacterium bovis subsp bovis AF2122/97
cgaugaccgucgca

SEQ ID NO: 3210426 - RNA, 18 nt, Mycobacterium bovis subsp bovis AF2122/97
cgaugaccuugcccacca

SEQ ID NO: 3210427 - RNA, 20 nt, Mycobacterium bovis subsp bovis AF2122/97
cgaugaccuugcccaccagu

SEQ ID NO: 3210428 - RNA, 22 nt, Mycobacterium bovis subsp bovis AF2122/97
cgaugaccuugggaccaccggg

SEQ ID NO: 3210429 - RNA, 16 nt, Mycobacterium bovis subsp bovis AF2122/97
cgaugacgaagugcag

SEQ ID NO: 3210430 - RNA, 21 nt, Mycobacterium bovis subsp bovis AF2122/97
cgaugacgaccgaucggcgcg

SEQ ID NO: 3210431 - RNA, 13 nt, Mycobacterium bovis subsp bovis AF2122/97
cgaugacgaucgc

SEQ ID NO: 3210432 - RNA, 14 nt, Mycobacterium bovis subsp bovis AF2122/97
cgaugacgaucggc

SEQ ID NO: 3210433 - RNA, 18 nt, Mycobacterium bovis subsp bovis AF2122/97
cgaugacgaugccgccga

SEQ ID NO: 3210434 - RNA, 15 nt, Mycobacterium bovis subsp bovis AF2122/97
cgaugacgccaucga

SEQ ID NO: 3210435 - RNA, 18 nt, Mycobacterium bovis subsp bovis AF2122/97
cgaugacgccaucgaucg

SEQ ID NO: 3210436 - RNA, 13 nt, Mycobacterium bovis subsp bovis AF2122/97
cgaugacgccgug

SEQ ID NO: 3210437 - RNA, 14 nt, Mycobacterium bovis subsp bovis AF2122/97
cgaugacgcguuca

SEQ ID NO: 3210438 - RNA, 22 nt, Mycobacterium bovis subsp bovis AF2122/97
cgaugacgguccuggcccgcug

SEQ ID NO: 3210439 - RNA, 19 nt, Mycobacterium bovis subsp bovis AF2122/97
cgaugacggugccgaccgc

SEQ ID NO: 3210440 - RNA, 16 nt, Mycobacterium bovis subsp bovis AF2122/97
cgaugagcaugcccag

SEQ ID NO: 3210441 - RNA, 17 nt, Mycobacterium bovis subsp bovis AF2122/97
cgaugagcaugcccagc

SEQ ID NO: 3210442 - RNA, 19 nt, Mycobacterium bovis subsp bovis AF2122/97
cgaugagcaugcccagcgc

SEQ ID NO: 3210443 - RNA, 16 nt, Mycobacterium bovis subsp bovis AF2122/97
cgaugagcccagccgc

SEQ ID NO: 3210444 - RNA, 14 nt, Mycobacterium bovis subsp bovis AF2122/97
cgaugagcggcgcg

SEQ ID NO: 3210445 - RNA, 13 nt, Mycobacterium bovis subsp bovis AF2122/97
cgaugagcgugcc

SEQ ID NO: 3210446 - RNA, 19 nt, Mycobacterium bovis subsp bovis AF2122/97
cgaugagcgugccgcagcg

SEQ ID NO: 3210447 - RNA, 19 nt, Mycobacterium bovis subsp bovis AF2122/97
cgaugaggacauccggcgc

SEQ ID NO: 3210448 - RNA, 20 nt, Mycobacterium bovis subsp bovis AF2122/97
cgaugaggacauccggcgcc

SEQ ID NO: 3210449 - RNA, 21 nt, Mycobacterium bovis subsp bovis AF2122/97
cgaugagggugcucgucacca

SEQ ID NO: 3210450 - RNA, 19 nt, Mycobacterium bovis subsp bovis AF2122/97
cgaugagguggccgcgcag

SEQ ID NO: 3210451 - RNA, 23 nt, Mycobacterium bovis subsp bovis AF2122/97
cgaugagguggccgcgcaggggc

SEQ ID NO: 3210452 - RNA, 21 nt, Mycobacterium bovis subsp bovis AF2122/97
cgaugagucgggaagcgagca

SEQ ID NO: 3210453 - RNA, 19 nt, Mycobacterium bovis subsp bovis AF2122/97
cgaugaucaccagucgcug

SEQ ID NO: 3210454 - RNA, 21 nt, Mycobacterium bovis subsp bovis AF2122/97
cgaugaucaccagucgcugau

SEQ ID NO: 3210455 - RNA, 14 nt, Mycobacterium bovis subsp bovis AF2122/97
cgaugaucaggguc

SEQ ID NO: 3210456 - RNA, 14 nt, Mycobacterium bovis subsp bovis AF2122/97
cgaugaucccgcca

SEQ ID NO: 3210457 - RNA, 16 nt, Mycobacterium bovis subsp bovis AF2122/97
cgaugaucccgccacc

SEQ ID NO: 3210458 - RNA, 18 nt, Mycobacterium bovis subsp bovis AF2122/97
cgaugaucccgccaccga

SEQ ID NO: 3210459 - RNA, 20 nt, Mycobacterium bovis subsp bovis AF2122/97
cgaugaucccgccaccgaac

SEQ ID NO: 3210460 - RNA, 19 nt, Mycobacterium bovis subsp bovis AF2122/97
cgaugaucgguaccgacgg

SEQ ID NO: 3210461 - RNA, 21 nt, Mycobacterium bovis subsp bovis AF2122/97
cgaugaucugcuugccaccgc

SEQ ID NO: 3210462 - RNA, 18 nt, Mycobacterium bovis subsp bovis AF2122/97
cgaugaucugugccgcua

SEQ ID NO: 3210463 - RNA, 16 nt, Mycobacterium bovis subsp bovis AF2122/97
cgaugaucuugccgcg

SEQ ID NO: 3210464 - RNA, 20 nt, Mycobacterium bovis subsp bovis AF2122/97
cgaugaucuugccgcggcgc

SEQ ID NO: 3210465 - RNA, 15 nt, Mycobacterium bovis subsp bovis AF2122/97
cgaugaugacggcgg

SEQ ID NO: 3210466 - RNA, 24 nt, Mycobacterium bovis subsp bovis AF2122/97
cgaugaugacggcggcccgaucca

SEQ ID NO: 3210467 - RNA, 14 nt, Mycobacterium bovis subsp bovis AF2122/97
cgaugaugaugacc

SEQ ID NO: 3210468 - RNA, 20 nt, Mycobacterium bovis subsp bovis AF2122/97
cgaugaugaugaccacauug

SEQ ID NO: 3210469 - RNA, 22 nt, Mycobacterium bovis subsp bovis AF2122/97
cgaugaugccggacagcucgcg

SEQ ID NO: 3210470 - RNA, 14 nt, Mycobacterium bovis subsp bovis AF2122/97
cgaugaugcgcucg

SEQ ID NO: 3210471 - RNA, 19 nt, Mycobacterium bovis subsp bovis AF2122/97
cgaugaugcgcucggccug

SEQ ID NO: 3210472 - RNA, 17 nt, Mycobacterium bovis subsp bovis AF2122/97
cgaugaugcggcgcagc

SEQ ID NO: 3210473 - RNA, 17 nt, Mycobacterium bovis subsp bovis AF2122/97
cgaugaugcucgacaac

SEQ ID NO: 3210474 - RNA, 15 nt, Mycobacterium bovis subsp bovis AF2122/97
cgaugauggacacca

SEQ ID NO: 3210475 - RNA, 17 nt, Mycobacterium bovis subsp bovis AF2122/97
cgaugauggacaccagc

SEQ ID NO: 3210476 - RNA, 19 nt, Mycobacterium bovis subsp bovis AF2122/97
cgaugauggcgcgaucggu

SEQ ID NO: 3210477 - RNA, 16 nt, Mycobacterium bovis subsp bovis AF2122/97
cgaugauggcuccggc

SEQ ID NO: 3210478 - RNA, 19 nt, Mycobacterium bovis subsp bovis AF2122/97
cgaugauggcuccggccgc

SEQ ID NO: 3210479 - RNA, 20 nt, Mycobacterium bovis subsp bovis AF2122/97
cgaugaugucgagcacaccg

SEQ ID NO: 3210480 - RNA, 15 nt, Mycobacterium bovis subsp bovis AF2122/97
cgaugaugucggccg

SEQ ID NO: 3210481 - RNA, 16 nt, Mycobacterium bovis subsp bovis AF2122/97
cgaugaugugcgacca

SEQ ID NO: 3210482 - RNA, 14 nt, Mycobacterium bovis subsp bovis AF2122/97
cgaugauguugagc

SEQ ID NO: 3210483 - RNA, 18 nt, Mycobacterium bovis subsp bovis AF2122/97
cgaugauuucgucgaucg

SEQ ID NO: 3210484 - RNA, 21 nt, Mycobacterium bovis subsp bovis AF2122/97
cgaugcaacucgaauccggcc

SEQ ID NO: 3210485 - RNA, 13 nt, Mycobacterium bovis subsp bovis AF2122/97
cgaugcacaaccg

SEQ ID NO: 3210486 - RNA, 17 nt, Mycobacterium bovis subsp bovis AF2122/97
cgaugcaccccaugacc

SEQ ID NO: 3210487 - RNA, 18 nt, Mycobacterium bovis subsp bovis AF2122/97
cgaugcaccccaugaccg

SEQ ID NO: 3210488 - RNA, 22 nt, Mycobacterium bovis subsp bovis AF2122/97
cgaugcagccacauacaggccc

SEQ ID NO: 3210489 - RNA, 13 nt, Mycobacterium bovis subsp bovis AF2122/97
cgaugcagcgcgc

SEQ ID NO: 3210490 - RNA, 21 nt, Mycobacterium bovis subsp bovis AF2122/97
cgaugcagcgcgcccugcgcg

SEQ ID NO: 3210491 - RNA, 17 nt, Mycobacterium bovis subsp bovis AF2122/97
cgaugcagugcgacccg

SEQ ID NO: 3210492 - RNA, 18 nt, Mycobacterium bovis subsp bovis AF2122/97
cgaugcagugcgacccgg

SEQ ID NO: 3210493 - RNA, 21 nt, Mycobacterium bovis subsp bovis AF2122/97
cgaugcagugcgacccgggcg

SEQ ID NO: 3210494 - RNA, 13 nt, Mycobacterium bovis subsp bovis AF2122/97
cgaugcaucggug

SEQ ID NO: 3210495 - RNA, 18 nt, Mycobacterium bovis subsp bovis AF2122/97
cgaugcaucggugcagcc

SEQ ID NO: 3210496 - RNA, 23 nt, Mycobacterium bovis subsp bovis AF2122/97
cgaugcaucggugcagcccgccg

SEQ ID NO: 3210497 - RNA, 21 nt, Mycobacterium bovis subsp bovis AF2122/97
cgaugcauggcuugcucugcg

SEQ ID NO: 3210498 - RNA, 21 nt, Mycobacterium bovis subsp bovis AF2122/97
cgaugccacaucccacggugg

SEQ ID NO: 3210499 - RNA, 14 nt, Mycobacterium bovis subsp bovis AF2122/97
cgaugccacaucgu

SEQ ID NO: 3210500 - RNA, 12 nt, Mycobacterium bovis subsp bovis AF2122/97
cgaugccaccgc

SEQ ID NO: 3210501 - RNA, 16 nt, Mycobacterium bovis subsp bovis AF2122/97
cgaugccagugcaucg

SEQ ID NO: 3210502 - RNA, 14 nt, Mycobacterium bovis subsp bovis AF2122/97
cgaugcccaagccc

SEQ ID NO: 3210503 - RNA, 20 nt, Mycobacterium bovis subsp bovis AF2122/97
cgaugcccaagcccucgacg

SEQ ID NO: 3210504 - RNA, 21 nt, Mycobacterium bovis subsp bovis AF2122/97
cgaugcccacgcacagcaacg

SEQ ID NO: 3210505 - RNA, 19 nt, Mycobacterium bovis subsp bovis AF2122/97
cgaugccccacggugcggu

SEQ ID NO: 3210506 - RNA, 15 nt, Mycobacterium bovis subsp bovis AF2122/97
cgaugcccgacaccg

SEQ ID NO: 3210507 - RNA, 16 nt, Mycobacterium bovis subsp bovis AF2122/97
cgaugcccggcaucgc

SEQ ID NO: 3210508 - RNA, 22 nt, Mycobacterium bovis subsp bovis AF2122/97
cgaugcccuccucgaccgcggc

SEQ ID NO: 3210509 - RNA, 20 nt, Mycobacterium bovis subsp bovis AF2122/97
cgaugcccuggcccaucuug

SEQ ID NO: 3210510 - RNA, 15 nt, Mycobacterium bovis subsp bovis AF2122/97
cgaugccgaagcccc

SEQ ID NO: 3210511 - RNA, 23 nt, Mycobacterium bovis subsp bovis AF2122/97
cgaugccgaagcccccgacguug

SEQ ID NO: 3210512 - RNA, 13 nt, Mycobacterium bovis subsp bovis AF2122/97
cgaugccgaccuu

SEQ ID NO: 3210513 - RNA, 15 nt, Mycobacterium bovis subsp bovis AF2122/97
cgaugccgacggcgc

SEQ ID NO: 3210514 - RNA, 17 nt, Mycobacterium bovis subsp bovis AF2122/97
cgaugccgccgaagagg

SEQ ID NO: 3210515 - RNA, 12 nt, Mycobacterium bovis subsp bovis AF2122/97
cgaugccgccgg

SEQ ID NO: 3210516 - RNA, 20 nt, Mycobacterium bovis subsp bovis AF2122/97
cgaugccgccggccccgccg

SEQ ID NO: 3210517 - RNA, 18 nt, Mycobacterium bovis subsp bovis AF2122/97
cgaugccgcgcagcgcgg

SEQ ID NO: 3210518 - RNA, 19 nt, Mycobacterium bovis subsp bovis AF2122/97
cgaugccggccaagguggu

SEQ ID NO: 3210519 - RNA, 12 nt, Mycobacterium bovis subsp bovis AF2122/97
cgaugccggcga

SEQ ID NO: 3210520 - RNA, 16 nt, Mycobacterium bovis subsp bovis AF2122/97
cgaugccggcugccgc

SEQ ID NO: 3210521 - RNA, 14 nt, Mycobacterium bovis subsp bovis AF2122/97
cgaugccggcuggc

SEQ ID NO: 3210522 - RNA, 20 nt, Mycobacterium bovis subsp bovis AF2122/97
cgaugccggcuggcggcgug

SEQ ID NO: 3210523 - RNA, 19 nt, Mycobacterium bovis subsp bovis AF2122/97
cgaugccguaggcggccag

SEQ ID NO: 3210524 - RNA, 19 nt, Mycobacterium bovis subsp bovis AF2122/97
cgaugccguccaagauguc

SEQ ID NO: 3210525 - RNA, 19 nt, Mycobacterium bovis subsp bovis AF2122/97
cgaugccgugcccggugcg

SEQ ID NO: 3210526 - RNA, 14 nt, Mycobacterium bovis subsp bovis AF2122/97
cgaugccgugccgg

SEQ ID NO: 3210527 - RNA, 16 nt, Mycobacterium bovis subsp bovis AF2122/97
cgaugccgugccgggc

SEQ ID NO: 3210528 - RNA, 16 nt, Mycobacterium bovis subsp bovis AF2122/97
cgaugccgugcugggc

SEQ ID NO: 3210529 - RNA, 17 nt, Mycobacterium bovis subsp bovis AF2122/97
cgaugccguguucagca

SEQ ID NO: 3210530 - RNA, 22 nt, Mycobacterium bovis subsp bovis AF2122/97
cgaugccguguucgauagcggc

SEQ ID NO: 3210531 - RNA, 16 nt, Mycobacterium bovis subsp bovis AF2122/97
cgaugccucggcggcc

SEQ ID NO: 3210532 - RNA, 19 nt, Mycobacterium bovis subsp bovis AF2122/97
cgaugccucggcggccucg

SEQ ID NO: 3210533 - RNA, 18 nt, Mycobacterium bovis subsp bovis AF2122/97
cgaugccuuccucggcaa

SEQ ID NO: 3210534 - RNA, 17 nt, Mycobacterium bovis subsp bovis AF2122/97
cgaugccuugaccgcgg

SEQ ID NO: 3210535 - RNA, 20 nt, Mycobacterium bovis subsp bovis AF2122/97
cgaugcgacgaaccucggcg

SEQ ID NO: 3210536 - RNA, 13 nt, Mycobacterium bovis subsp bovis AF2122/97
cgaugcgacgcag

SEQ ID NO: 3210537 - RNA, 16 nt, Mycobacterium bovis subsp bovis AF2122/97
cgaugcgacgcagacc

SEQ ID NO: 3210538 - RNA, 15 nt, Mycobacterium bovis subsp bovis AF2122/97
cgaugcgaucgacga

SEQ ID NO: 3210539 - RNA, 16 nt, Mycobacterium bovis subsp bovis AF2122/97
cgaugcgaucgacgau

SEQ ID NO: 3210540 - RNA, 21 nt, Mycobacterium bovis subsp bovis AF2122/97
cgaugcgauuccgcgucugcu

SEQ ID NO: 3210541 - RNA, 21 nt, Mycobacterium bovis subsp bovis AF2122/97
cgaugcgauucugcgucugcu

SEQ ID NO: 3210542 - RNA, 15 nt, Mycobacterium bovis subsp bovis AF2122/97
cgaugcgcacaccga

SEQ ID NO: 3210543 - RNA, 13 nt, Mycobacterium bovis subsp bovis AF2122/97
cgaugcgcaccag

SEQ ID NO: 3210544 - RNA, 15 nt, Mycobacterium bovis subsp bovis AF2122/97
cgaugcgcaccagca

SEQ ID NO: 3210545 - RNA, 22 nt, Mycobacterium bovis subsp bovis AF2122/97
cgaugcgcaccagcaccugcac

SEQ ID NO: 3210546 - RNA, 17 nt, Mycobacterium bovis subsp bovis AF2122/97
cgaugcgcaccagcggc

SEQ ID NO: 3210547 - RNA, 17 nt, Mycobacterium bovis subsp bovis AF2122/97
cgaugcgcacucccggc

SEQ ID NO: 3210548 - RNA, 22 nt, Mycobacterium bovis subsp bovis AF2122/97
cgaugcgcacucccggcucggc

SEQ ID NO: 3210549 - RNA, 18 nt, Mycobacterium bovis subsp bovis AF2122/97
cgaugcgcagugcaccgc

SEQ ID NO: 3210550 - RNA, 12 nt, Mycobacterium bovis subsp bovis AF2122/97
cgaugcgccgga

SEQ ID NO: 3210551 - RNA, 20 nt, Mycobacterium bovis subsp bovis AF2122/97
cgaugcgccggaccagcucc

SEQ ID NO: 3210552 - RNA, 14 nt, Mycobacterium bovis subsp bovis AF2122/97
cgaugcgcgccccg

SEQ ID NO: 3210553 - RNA, 13 nt, Mycobacterium bovis subsp bovis AF2122/97
cgaugcgcgccga

SEQ ID NO: 3210554 - RNA, 14 nt, Mycobacterium bovis subsp bovis AF2122/97
cgaugcgcgccgau

SEQ ID NO: 3210555 - RNA, 13 nt, Mycobacterium bovis subsp bovis AF2122/97
cgaugcgcgccgg

SEQ ID NO: 3210556 - RNA, 16 nt, Mycobacterium bovis subsp bovis AF2122/97
cgaugcgcgccggcuu

SEQ ID NO: 3210557 - RNA, 17 nt, Mycobacterium bovis subsp bovis AF2122/97
cgaugcgcgcggcgcga

SEQ ID NO: 3210558 - RNA, 20 nt, Mycobacterium bovis subsp bovis AF2122/97
cgaugcgcgcggcgcgaucg

SEQ ID NO: 3210559 - RNA, 16 nt, Mycobacterium bovis subsp bovis AF2122/97
cgaugcgcugcucacg

SEQ ID NO: 3210560 - RNA, 14 nt, Mycobacterium bovis subsp bovis AF2122/97
cgaugcggcgacca

SEQ ID NO: 3210561 - RNA, 22 nt, Mycobacterium bovis subsp bovis AF2122/97
cgaugcggcgucgaacugccgg

SEQ ID NO: 3210562 - RNA, 14 nt, Mycobacterium bovis subsp bovis AF2122/97
cgaugcgggccgcc

SEQ ID NO: 3210563 - RNA, 18 nt, Mycobacterium bovis subsp bovis AF2122/97
cgaugcgggccgccaggc

SEQ ID NO: 3210564 - RNA, 20 nt, Mycobacterium bovis subsp bovis AF2122/97
cgaugcgggccgccaggcgg

SEQ ID NO: 3210565 - RNA, 21 nt, Mycobacterium bovis subsp bovis AF2122/97
cgaugcgggccgccaggcggc

SEQ ID NO: 3210566 - RNA, 15 nt, Mycobacterium bovis subsp bovis AF2122/97
cgaugcgggcgacga

SEQ ID NO: 3210567 - RNA, 15 nt, Mycobacterium bovis subsp bovis AF2122/97
cgaugcggguggcgc

SEQ ID NO: 3210568 - RNA, 22 nt, Mycobacterium bovis subsp bovis AF2122/97
cgaugcggguggcgccggugcg

SEQ ID NO: 3210569 - RNA, 16 nt, Mycobacterium bovis subsp bovis AF2122/97
cgaugcgguaucgguc

SEQ ID NO: 3210570 - RNA, 22 nt, Mycobacterium bovis subsp bovis AF2122/97
cgaugcgguaucggucgacugg

SEQ ID NO: 3210571 - RNA, 21 nt, Mycobacterium bovis subsp bovis AF2122/97
cgaugcgguauugcccgggcg

SEQ ID NO: 3210572 - RNA, 20 nt, Mycobacterium bovis subsp bovis AF2122/97
cgaugcggucgacgggcucg

SEQ ID NO: 3210573 - RNA, 15 nt, Mycobacterium bovis subsp bovis AF2122/97
cgaugcggucggcca

SEQ ID NO: 3210574 - RNA, 17 nt, Mycobacterium bovis subsp bovis AF2122/97
cgaugcggucggccaca

SEQ ID NO: 3210575 - RNA, 12 nt, Mycobacterium bovis subsp bovis AF2122/97
cgaugcggugua

SEQ ID NO: 3210576 - RNA, 23 nt, Mycobacterium bovis subsp bovis AF2122/97
cgaugcgguguagggcggcguug

SEQ ID NO: 3210577 - RNA, 14 nt, Mycobacterium bovis subsp bovis AF2122/97
cgaugcggugucgg

SEQ ID NO: 3210578 - RNA, 14 nt, Mycobacterium bovis subsp bovis AF2122/97
cgaugcgguucucg

SEQ ID NO: 3210579 - RNA, 21 nt, Mycobacterium bovis subsp bovis AF2122/97
cgaugcguccgcccagccgca

SEQ ID NO: 3210580 - RNA, 18 nt, Mycobacterium bovis subsp bovis AF2122/97
cgaugcucacuacccgca

SEQ ID NO: 3210581 - RNA, 19 nt, Mycobacterium bovis subsp bovis AF2122/97
cgaugcucagcuggucggc

SEQ ID NO: 3210582 - RNA, 17 nt, Mycobacterium bovis subsp bovis AF2122/97
cgaugcucgucccagaa

SEQ ID NO: 3210583 - RNA, 21 nt, Mycobacterium bovis subsp bovis AF2122/97
cgaugcugaacacgcagccga

SEQ ID NO: 3210584 - RNA, 11 nt, Mycobacterium bovis subsp bovis AF2122/97
cgaugcugacg

SEQ ID NO: 3210585 - RNA, 20 nt, Mycobacterium bovis subsp bovis AF2122/97
cgaugcugacgaugcggucg

SEQ ID NO: 3210586 - RNA, 15 nt, Mycobacterium bovis subsp bovis AF2122/97
cgaugcugacggugg

SEQ ID NO: 3210587 - RNA, 24 nt, Mycobacterium bovis subsp bovis AF2122/97
cgaugcugaucaccgucguacucg

SEQ ID NO: 3210588 - RNA, 14 nt, Mycobacterium bovis subsp bovis AF2122/97
cgaugcugccgccg

SEQ ID NO: 3210589 - RNA, 16 nt, Mycobacterium bovis subsp bovis AF2122/97
cgaugcugccgccgcc

SEQ ID NO: 3210590 - RNA, 13 nt, Mycobacterium bovis subsp bovis AF2122/97
cgaugcugcgggc

SEQ ID NO: 3210591 - RNA, 21 nt, Mycobacterium bovis subsp bovis AF2122/97
cgaugcuggcaaaguaucgca

SEQ ID NO: 3210592 - RNA, 13 nt, Mycobacterium bovis subsp bovis AF2122/97
cgaugcuggcggc

SEQ ID NO: 3210593 - RNA, 15 nt, Mycobacterium bovis subsp bovis AF2122/97
cgaugcuggcggccu

SEQ ID NO: 3210594 - RNA, 14 nt, Mycobacterium bovis subsp bovis AF2122/97
cgaugcugggcgag

SEQ ID NO: 3210595 - RNA, 23 nt, Mycobacterium bovis subsp bovis AF2122/97
cgaugcugggcgagacggcguug

SEQ ID NO: 3210596 - RNA, 23 nt, Mycobacterium bovis subsp bovis AF2122/97
cgaugcuucccggaugccgaccu

SEQ ID NO: 3210597 - RNA, 22 nt, Mycobacterium bovis subsp bovis AF2122/97
cgaugcuuucguauucggccgc

SEQ ID NO: 3210598 - RNA, 15 nt, Mycobacterium bovis subsp bovis AF2122/97
cgauggacgcccagu

SEQ ID NO: 3210599 - RNA, 20 nt, Mycobacterium bovis subsp bovis AF2122/97
cgauggagaaguuagccacc

SEQ ID NO: 3210600 - RNA, 21 nt, Mycobacterium bovis subsp bovis AF2122/97
cgauggagaaguuagccaccu

SEQ ID NO: 3210601 - RNA, 14 nt, Mycobacterium bovis subsp bovis AF2122/97
cgauggauggcguc

SEQ ID NO: 3210602 - RNA, 23 nt, Mycobacterium bovis subsp bovis AF2122/97
cgauggauuggcgucagcagcaa

SEQ ID NO: 3210603 - RNA, 15 nt, Mycobacterium bovis subsp bovis AF2122/97
cgauggcaccggcgu

SEQ ID NO: 3210604 - RNA, 22 nt, Mycobacterium bovis subsp bovis AF2122/97
cgauggcaccggcgugguagac

SEQ ID NO: 3210605 - RNA, 14 nt, Mycobacterium bovis subsp bovis AF2122/97
cgauggcaccgugg

SEQ ID NO: 3210606 - RNA, 13 nt, Mycobacterium bovis subsp bovis AF2122/97
cgauggcagcgcc

SEQ ID NO: 3210607 - RNA, 22 nt, Mycobacterium bovis subsp bovis AF2122/97
cgauggcagcgccgauggccgc

SEQ ID NO: 3210608 - RNA, 14 nt, Mycobacterium bovis subsp bovis AF2122/97
cgauggcaggggcg

SEQ ID NO: 3210609 - RNA, 16 nt, Mycobacterium bovis subsp bovis AF2122/97
cgauggcaucggccau

SEQ ID NO: 3210610 - RNA, 13 nt, Mycobacterium bovis subsp bovis AF2122/97
cgauggcaucucg

SEQ ID NO: 3210611 - RNA, 21 nt, Mycobacterium bovis subsp bovis AF2122/97
cgauggcaugggcuaccgaga

SEQ ID NO: 3210612 - RNA, 20 nt, Mycobacterium bovis subsp bovis AF2122/97
cgauggccacccgguggcgu

SEQ ID NO: 3210613 - RNA, 16 nt, Mycobacterium bovis subsp bovis AF2122/97
cgauggccagcacggu

SEQ ID NO: 3210614 - RNA, 17 nt, Mycobacterium bovis subsp bovis AF2122/97
cgauggccaguucuuca

SEQ ID NO: 3210615 - RNA, 19 nt, Mycobacterium bovis subsp bovis AF2122/97
cgauggcccggcucacagc

SEQ ID NO: 3210616 - RNA, 14 nt, Mycobacterium bovis subsp bovis AF2122/97
cgauggccgacgcu

SEQ ID NO: 3210617 - RNA, 16 nt, Mycobacterium bovis subsp bovis AF2122/97
cgauggccgucgauca

SEQ ID NO: 3210618 - RNA, 17 nt, Mycobacterium bovis subsp bovis AF2122/97
cgauggccugaaauacc

SEQ ID NO: 3210619 - RNA, 18 nt, Mycobacterium bovis subsp bovis AF2122/97
cgauggcgaugagguggc

SEQ ID NO: 3210620 - RNA, 13 nt, Mycobacterium bovis subsp bovis AF2122/97
cgauggcgcaccg

SEQ ID NO: 3210621 - RNA, 19 nt, Mycobacterium bovis subsp bovis AF2122/97
cgauggcgcaccggcgucg

SEQ ID NO: 3210622 - RNA, 21 nt, Mycobacterium bovis subsp bovis AF2122/97
cgauggcgcgcaacguagcca

SEQ ID NO: 3210623 - RNA, 13 nt, Mycobacterium bovis subsp bovis AF2122/97
cgauggcggccac

SEQ ID NO: 3210624 - RNA, 18 nt, Mycobacterium bovis subsp bovis AF2122/97
cgauggcggccaccagcg

SEQ ID NO: 3210625 - RNA, 19 nt, Mycobacterium bovis subsp bovis AF2122/97
cgauggcggccaccagcgc

SEQ ID NO: 3210626 - RNA, 16 nt, Mycobacterium bovis subsp bovis AF2122/97
cgauggcggccaccgu

SEQ ID NO: 3210627 - RNA, 22 nt, Mycobacterium bovis subsp bovis AF2122/97
cgauggcggccaccgucagcgc

SEQ ID NO: 3210628 - RNA, 13 nt, Mycobacterium bovis subsp bovis AF2122/97
cgauggcggcgcg

SEQ ID NO: 3210629 - RNA, 18 nt, Mycobacterium bovis subsp bovis AF2122/97
cgauggcgguccaccggc

SEQ ID NO: 3210630 - RNA, 13 nt, Mycobacterium bovis subsp bovis AF2122/97
cgauggcgguggc

SEQ ID NO: 3210631 - RNA, 23 nt, Mycobacterium bovis subsp bovis AF2122/97
cgauggcguagcccaugccgaug

SEQ ID NO: 3210632 - RNA, 15 nt, Mycobacterium bovis subsp bovis AF2122/97
cgauggcgucgccgg

SEQ ID NO: 3210633 - RNA, 18 nt, Mycobacterium bovis subsp bovis AF2122/97
cgauggcgucgccggccc

SEQ ID NO: 3210634 - RNA, 12 nt, Mycobacterium bovis subsp bovis AF2122/97
cgauggcgucgg

SEQ ID NO: 3210635 - RNA, 16 nt, Mycobacterium bovis subsp bovis AF2122/97
cgauggcgucggccag

SEQ ID NO: 3210636 - RNA, 23 nt, Mycobacterium bovis subsp bovis AF2122/97
cgauggcgucggugaaugccguc

SEQ ID NO: 3210637 - RNA, 17 nt, Mycobacterium bovis subsp bovis AF2122/97
cgauggcucucacgagc

SEQ ID NO: 3210638 - RNA, 20 nt, Mycobacterium bovis subsp bovis AF2122/97
cgaugggaacggggugggaa

SEQ ID NO: 3210639 - RNA, 15 nt, Mycobacterium bovis subsp bovis AF2122/97
cgaugggagcccggc

SEQ ID NO: 3210640 - RNA, 18 nt, Mycobacterium bovis subsp bovis AF2122/97
cgaugggagcccggcggc

SEQ ID NO: 3210641 - RNA, 12 nt, Mycobacterium bovis subsp bovis AF2122/97
cgaugggcauca

SEQ ID NO: 3210642 - RNA, 20 nt, Mycobacterium bovis subsp bovis AF2122/97
cgaugggcccagcggccgcg

SEQ ID NO: 3210643 - RNA, 18 nt, Mycobacterium bovis subsp bovis AF2122/97
cgauggggacggcggcga

SEQ ID NO: 3210644 - RNA, 19 nt, Mycobacterium bovis subsp bovis AF2122/97
cgauggggacggcggcgag

SEQ ID NO: 3210645 - RNA, 23 nt, Mycobacterium bovis subsp bovis AF2122/97
cgaugggucugguguccaccgca

SEQ ID NO: 3210646 - RNA, 21 nt, Mycobacterium bovis subsp bovis AF2122/97
cgaugggugacgguggccggc

SEQ ID NO: 3210647 - RNA, 20 nt, Mycobacterium bovis subsp bovis AF2122/97
cgauggguguugcuggccgc

SEQ ID NO: 3210648 - RNA, 16 nt, Mycobacterium bovis subsp bovis AF2122/97
cgaugguacccgcgcc

SEQ ID NO: 3210649 - RNA, 18 nt, Mycobacterium bovis subsp bovis AF2122/97
cgaugguacccgcgccgc

SEQ ID NO: 3210650 - RNA, 20 nt, Mycobacterium bovis subsp bovis AF2122/97
cgaugguacccgcgccgcgc

SEQ ID NO: 3210651 - RNA, 17 nt, Mycobacterium bovis subsp bovis AF2122/97
cgaugguaugcccgccg

SEQ ID NO: 3210652 - RNA, 23 nt, Mycobacterium bovis subsp bovis AF2122/97
cgauggucacugugacgccgggc

SEQ ID NO: 3210653 - RNA, 22 nt, Mycobacterium bovis subsp bovis AF2122/97
cgaugguccagcccugcgcuuc

SEQ ID NO: 3210654 - RNA, 19 nt, Mycobacterium bovis subsp bovis AF2122/97
cgauggucccgagggcggc

SEQ ID NO: 3210655 - RNA, 15 nt, Mycobacterium bovis subsp bovis AF2122/97
cgauggucucccggc

SEQ ID NO: 3210656 - RNA, 21 nt, Mycobacterium bovis subsp bovis AF2122/97
cgauggucuccucggucaccg

SEQ ID NO: 3210657 - RNA, 14 nt, Mycobacterium bovis subsp bovis AF2122/97
cgauggugccgacc

SEQ ID NO: 3210658 - RNA, 19 nt, Mycobacterium bovis subsp bovis AF2122/97
cgauggugccgacccgccg

SEQ ID NO: 3210659 - RNA, 17 nt, Mycobacterium bovis subsp bovis AF2122/97
cgauggugcgcccgccg

SEQ ID NO: 3210660 - RNA, 16 nt, Mycobacterium bovis subsp bovis AF2122/97
cgauggugcgccgggc

SEQ ID NO: 3210661 - RNA, 18 nt, Mycobacterium bovis subsp bovis AF2122/97
cgauggugcgccgggcgu

SEQ ID NO: 3210662 - RNA, 15 nt, Mycobacterium bovis subsp bovis AF2122/97
cgauggugcggccca

SEQ ID NO: 3210663 - RNA, 20 nt, Mycobacterium bovis subsp bovis AF2122/97
cgauggugcggcccaaccgg

SEQ ID NO: 3210664 - RNA, 13 nt, Mycobacterium bovis subsp bovis AF2122/97
cgaugguggccgc

SEQ ID NO: 3210665 - RNA, 15 nt, Mycobacterium bovis subsp bovis AF2122/97
cgaugguggccgcca

SEQ ID NO: 3210666 - RNA, 16 nt, Mycobacterium bovis subsp bovis AF2122/97
cgaugguggccgccac

SEQ ID NO: 3210667 - RNA, 18 nt, Mycobacterium bovis subsp bovis AF2122/97
cgaugguguacugcugcu

SEQ ID NO: 3210668 - RNA, 20 nt, Mycobacterium bovis subsp bovis AF2122/97
cgauggugugcacggcuucg

SEQ ID NO: 3210669 - RNA, 16 nt, Mycobacterium bovis subsp bovis AF2122/97
cgauggugugcccgca

SEQ ID NO: 3210670 - RNA, 21 nt, Mycobacterium bovis subsp bovis AF2122/97
cgaugguguuauuccacucgg

SEQ ID NO: 3210671 - RNA, 18 nt, Mycobacterium bovis subsp bovis AF2122/97
cgauguacagcgggaucc

SEQ ID NO: 3210672 - RNA, 23 nt, Mycobacterium bovis subsp bovis AF2122/97
cgauguacagcgggaucccgauc

SEQ ID NO: 3210673 - RNA, 17 nt, Mycobacterium bovis subsp bovis AF2122/97
cgauguaccccagcgcc

SEQ ID NO: 3210674 - RNA, 22 nt, Mycobacterium bovis subsp bovis AF2122/97
cgauguacugugccgcccccgg

SEQ ID NO: 3210675 - RNA, 15 nt, Mycobacterium bovis subsp bovis AF2122/97
cgauguagcgcugcg

SEQ ID NO: 3210676 - RNA, 16 nt, Mycobacterium bovis subsp bovis AF2122/97
cgauguauccgaugcg

SEQ ID NO: 3210677 - RNA, 22 nt, Mycobacterium bovis subsp bovis AF2122/97
cgaugucaaccaagugaccggc

SEQ ID NO: 3210678 - RNA, 17 nt, Mycobacterium bovis subsp bovis AF2122/97
cgaugucacccucccgc

SEQ ID NO: 3210679 - RNA, 20 nt, Mycobacterium bovis subsp bovis AF2122/97
cgaugucagccaccaucugg

SEQ ID NO: 3210680 - RNA, 23 nt, Mycobacterium bovis subsp bovis AF2122/97
cgaugucagcggccgcgacguug

SEQ ID NO: 3210681 - RNA, 13 nt, Mycobacterium bovis subsp bovis AF2122/97
cgauguccacgcc

SEQ ID NO: 3210682 - RNA, 14 nt, Mycobacterium bovis subsp bovis AF2122/97
cgauguccacgccg

SEQ ID NO: 3210683 - RNA, 15 nt, Mycobacterium bovis subsp bovis AF2122/97
cgauguccccggcgg

SEQ ID NO: 3210684 - RNA, 14 nt, Mycobacterium bovis subsp bovis AF2122/97
cgaugucccgagcc

SEQ ID NO: 3210685 - RNA, 15 nt, Mycobacterium bovis subsp bovis AF2122/97
cgauguccgacgcca

SEQ ID NO: 3210686 - RNA, 18 nt, Mycobacterium bovis subsp bovis AF2122/97
cgauguccgacgccaccg

SEQ ID NO: 3210687 - RNA, 21 nt, Mycobacterium bovis subsp bovis AF2122/97
cgauguccuauuugcagccuu

SEQ ID NO: 3210688 - RNA, 16 nt, Mycobacterium bovis subsp bovis AF2122/97
cgauguccucgaugcg

SEQ ID NO: 3210689 - RNA, 13 nt, Mycobacterium bovis subsp bovis AF2122/97
cgauguccucgua

SEQ ID NO: 3210690 - RNA, 19 nt, Mycobacterium bovis subsp bovis AF2122/97
cgauguccuuguuggccag

SEQ ID NO: 3210691 - RNA, 23 nt, Mycobacterium bovis subsp bovis AF2122/97
cgaugucgacucguggcgccacg

SEQ ID NO: 3210692 - RNA, 19 nt, Mycobacterium bovis subsp bovis AF2122/97
cgaugucgagcgcgaucgg

SEQ ID NO: 3210693 - RNA, 14 nt, Mycobacterium bovis subsp bovis AF2122/97
cgaugucgaugccg

SEQ ID NO: 3210694 - RNA, 16 nt, Mycobacterium bovis subsp bovis AF2122/97
cgaugucgcgcauugc

SEQ ID NO: 3210695 - RNA, 18 nt, Mycobacterium bovis subsp bovis AF2122/97
cgaugucgcgcauugccg

SEQ ID NO: 3210696 - RNA, 23 nt, Mycobacterium bovis subsp bovis AF2122/97
cgaugucgcgcauugccgacgcg

SEQ ID NO: 3210697 - RNA, 16 nt, Mycobacterium bovis subsp bovis AF2122/97
cgaugucgcggucgcc

SEQ ID NO: 3210698 - RNA, 22 nt, Mycobacterium bovis subsp bovis AF2122/97
cgaugucgcggucgcccgcuac

SEQ ID NO: 3210699 - RNA, 14 nt, Mycobacterium bovis subsp bovis AF2122/97
cgaugucggcacca

SEQ ID NO: 3210700 - RNA, 21 nt, Mycobacterium bovis subsp bovis AF2122/97
cgaugucggcucggcccccga

SEQ ID NO: 3210701 - RNA, 14 nt, Mycobacterium bovis subsp bovis AF2122/97
cgaugucggggccg

SEQ ID NO: 3210702 - RNA, 22 nt, Mycobacterium bovis subsp bovis AF2122/97
cgaugucggggccgucgucggu

SEQ ID NO: 3210703 - RNA, 15 nt, Mycobacterium bovis subsp bovis AF2122/97
cgaugucggucgggu

SEQ ID NO: 3210704 - RNA, 17 nt, Mycobacterium bovis subsp bovis AF2122/97
cgaugucguaccgggcg

SEQ ID NO: 3210705 - RNA, 19 nt, Mycobacterium bovis subsp bovis AF2122/97
cgaugucguaccgggcgag

SEQ ID NO: 3210706 - RNA, 15 nt, Mycobacterium bovis subsp bovis AF2122/97
cgaugucgucgauga

SEQ ID NO: 3210707 - RNA, 24 nt, Mycobacterium bovis subsp bovis AF2122/97
cgaugucguucgcgucacaccagc

SEQ ID NO: 3210708 - RNA, 16 nt, Mycobacterium bovis subsp bovis AF2122/97
cgaugucguuggccac

SEQ ID NO: 3210709 - RNA, 21 nt, Mycobacterium bovis subsp bovis AF2122/97
cgaugucguuguacggggccg

SEQ ID NO: 3210710 - RNA, 19 nt, Mycobacterium bovis subsp bovis AF2122/97
cgaugugaaccgggcacca

SEQ ID NO: 3210711 - RNA, 14 nt, Mycobacterium bovis subsp bovis AF2122/97
cgaugugcccgcca

SEQ ID NO: 3210712 - RNA, 15 nt, Mycobacterium bovis subsp bovis AF2122/97
cgaugugcccgccag

SEQ ID NO: 3210713 - RNA, 20 nt, Mycobacterium bovis subsp bovis AF2122/97
cgaugugccgauuggccugc

SEQ ID NO: 3210714 - RNA, 14 nt, Mycobacterium bovis subsp bovis AF2122/97
cgaugugguccauc

SEQ ID NO: 3210715 - RNA, 15 nt, Mycobacterium bovis subsp bovis AF2122/97
cgauguucgccgcgc

SEQ ID NO: 3210716 - RNA, 16 nt, Mycobacterium bovis subsp bovis AF2122/97
cgauguucgccgcgcg

SEQ ID NO: 3210717 - RNA, 19 nt, Mycobacterium bovis subsp bovis AF2122/97
cgauguucgccgcgcggaa

SEQ ID NO: 3210718 - RNA, 15 nt, Mycobacterium bovis subsp bovis AF2122/97
cgauguuggcagggc

SEQ ID NO: 3210719 - RNA, 20 nt, Mycobacterium bovis subsp bovis AF2122/97
cgauguuggcagggccagcg

SEQ ID NO: 3210720 - RNA, 22 nt, Mycobacterium bovis subsp bovis AF2122/97
cgauguuggcagggccagcggc

SEQ ID NO: 3210721 - RNA, 17 nt, Mycobacterium bovis subsp bovis AF2122/97
cgauguuggccagcgcg

SEQ ID NO: 3210722 - RNA, 14 nt, Mycobacterium bovis subsp bovis AF2122/97
cgauuaccagcggc

SEQ ID NO: 3210723 - RNA, 17 nt, Mycobacterium bovis subsp bovis AF2122/97
cgauuaccggcacgccg

SEQ ID NO: 3210724 - RNA, 18 nt, Mycobacterium bovis subsp bovis AF2122/97
cgauuacgacuuggugca

SEQ ID NO: 3210725 - RNA, 20 nt, Mycobacterium bovis subsp bovis AF2122/97
cgauuaucgcgcgcaaccgc

SEQ ID NO: 3210726 - RNA, 13 nt, Mycobacterium bovis subsp bovis AF2122/97
cgauucagccuga

SEQ ID NO: 3210727 - RNA, 15 nt, Mycobacterium bovis subsp bovis AF2122/97
cgauuccaugcgcga

SEQ ID NO: 3210728 - RNA, 15 nt, Mycobacterium bovis subsp bovis AF2122/97
cgauucccaaccggu

SEQ ID NO: 3210729 - RNA, 20 nt, Mycobacterium bovis subsp bovis AF2122/97
cgauucccgcggacagcccg

SEQ ID NO: 3210730 - RNA, 23 nt, Mycobacterium bovis subsp bovis AF2122/97
cgauuccgaacuggucgacgccg

SEQ ID NO: 3210731 - RNA, 21 nt, Mycobacterium bovis subsp bovis AF2122/97
cgauuccgcccacaugcgcuc

SEQ ID NO: 3210732 - RNA, 19 nt, Mycobacterium bovis subsp bovis AF2122/97
cgauuccgcgucugcucgc

SEQ ID NO: 3210733 - RNA, 20 nt, Mycobacterium bovis subsp bovis AF2122/97
cgauuccgcgucugcucgcg

SEQ ID NO: 3210734 - RNA, 20 nt, Mycobacterium bovis subsp bovis AF2122/97
cgauuccgcgucugcucggc

SEQ ID NO: 3210735 - RNA, 14 nt, Mycobacterium bovis subsp bovis AF2122/97
cgauuccggcggcc

SEQ ID NO: 3210736 - RNA, 15 nt, Mycobacterium bovis subsp bovis AF2122/97
cgauuccggcggcca

SEQ ID NO: 3210737 - RNA, 18 nt, Mycobacterium bovis subsp bovis AF2122/97
cgauuccggcggccacgc

SEQ ID NO: 3210738 - RNA, 21 nt, Mycobacterium bovis subsp bovis AF2122/97
cgauuccgggugcgaucgcaa

SEQ ID NO: 3210739 - RNA, 15 nt, Mycobacterium bovis subsp bovis AF2122/97
cgauucgaccgguga

SEQ ID NO: 3210740 - RNA, 18 nt, Mycobacterium bovis subsp bovis AF2122/97
cgauucgaccggugaugu

SEQ ID NO: 3210741 - RNA, 20 nt, Mycobacterium bovis subsp bovis AF2122/97
cgauucgccuagcgagcgca

SEQ ID NO: 3210742 - RNA, 21 nt, Mycobacterium bovis subsp bovis AF2122/97
cgauucgccuagcgagcgcac

SEQ ID NO: 3210743 - RNA, 22 nt, Mycobacterium bovis subsp bovis AF2122/97
cgauucgccuagcgagcgcaca

SEQ ID NO: 3210744 - RNA, 15 nt, Mycobacterium bovis subsp bovis AF2122/97
cgauucgcggcagcc

SEQ ID NO: 3210745 - RNA, 15 nt, Mycobacterium bovis subsp bovis AF2122/97
cgauucggccagcgc

SEQ ID NO: 3210746 - RNA, 21 nt, Mycobacterium bovis subsp bovis AF2122/97
cgauucggccagcgcccgcag

SEQ ID NO: 3210747 - RNA, 15 nt, Mycobacterium bovis subsp bovis AF2122/97
cgauucggcggccgu

SEQ ID NO: 3210748 - RNA, 18 nt, Mycobacterium bovis subsp bovis AF2122/97
cgauucgucgcggaucag

SEQ ID NO: 3210749 - RNA, 22 nt, Mycobacterium bovis subsp bovis AF2122/97
cgauucgucgcggaucagcccg

SEQ ID NO: 3210750 - RNA, 17 nt, Mycobacterium bovis subsp bovis AF2122/97
cgauucgugucggugcg

SEQ ID NO: 3210751 - RNA, 12 nt, Mycobacterium bovis subsp bovis AF2122/97
cgauucugcguc

SEQ ID NO: 3210752 - RNA, 20 nt, Mycobacterium bovis subsp bovis AF2122/97
cgauucugcguccugcucgc

SEQ ID NO: 3210753 - RNA, 16 nt, Mycobacterium bovis subsp bovis AF2122/97
cgauucugcgucugcu

SEQ ID NO: 3210754 - RNA, 21 nt, Mycobacterium bovis subsp bovis AF2122/97
cgauucugcgucugcucgccg

SEQ ID NO: 3210755 - RNA, 20 nt, Mycobacterium bovis subsp bovis AF2122/97
cgauucugcgucugcucgcg

SEQ ID NO: 3210756 - RNA, 19 nt, Mycobacterium bovis subsp bovis AF2122/97
cgauucugcgucugcucgg

SEQ ID NO: 3210757 - RNA, 20 nt, Mycobacterium bovis subsp bovis AF2122/97
cgauucugcgucugcucggc

SEQ ID NO: 3210758 - RNA, 19 nt, Mycobacterium bovis subsp bovis AF2122/97
cgauucugugucugcucgc

SEQ ID NO: 3210759 - RNA, 20 nt, Mycobacterium bovis subsp bovis AF2122/97
cgauucugugucugcucgcg

SEQ ID NO: 3210760 - RNA, 20 nt, Mycobacterium bovis subsp bovis AF2122/97
cgauucugugucugcucggc

SEQ ID NO: 3210761 - RNA, 23 nt, Mycobacterium bovis subsp bovis AF2122/97
cgauucugugucugcucggcgag

SEQ ID NO: 3210762 - RNA, 13 nt, Mycobacterium bovis subsp bovis AF2122/97
cgauugagcccca

SEQ ID NO: 3210763 - RNA, 14 nt, Mycobacterium bovis subsp bovis AF2122/97
cgauugcccgcgcu

SEQ ID NO: 3210764 - RNA, 18 nt, Mycobacterium bovis subsp bovis AF2122/97
cgauugcccgcgcucgca

SEQ ID NO: 3210765 - RNA, 18 nt, Mycobacterium bovis subsp bovis AF2122/97
cgauugcccgugcgaugc

SEQ ID NO: 3210766 - RNA, 13 nt, Mycobacterium bovis subsp bovis AF2122/97
cgauugccgucgu

SEQ ID NO: 3210767 - RNA, 20 nt, Mycobacterium bovis subsp bovis AF2122/97
cgauugcgaagggcaccggc

SEQ ID NO: 3210768 - RNA, 15 nt, Mycobacterium bovis subsp bovis AF2122/97
cgauugcugcggcuu

SEQ ID NO: 3210769 - RNA, 15 nt, Mycobacterium bovis subsp bovis AF2122/97
cgauuggaccgccaa

SEQ ID NO: 3210770 - RNA, 24 nt, Mycobacterium bovis subsp bovis AF2122/97
cgauuggcaggcaaugcccgaccg

SEQ ID NO: 3210771 - RNA, 13 nt, Mycobacterium bovis subsp bovis AF2122/97
cgauuggcucgag

SEQ ID NO: 3210772 - RNA, 15 nt, Mycobacterium bovis subsp bovis AF2122/97
cgauuggcucgagca

SEQ ID NO: 3210773 - RNA, 14 nt, Mycobacterium bovis subsp bovis AF2122/97
cgauuggcucgccg

SEQ ID NO: 3210774 - RNA, 19 nt, Mycobacterium bovis subsp bovis AF2122/97
cgauugggguauugccgga

SEQ ID NO: 3210775 - RNA, 15 nt, Mycobacterium bovis subsp bovis AF2122/97
cgauugucgccgcgc

SEQ ID NO: 3210776 - RNA, 16 nt, Mycobacterium bovis subsp bovis AF2122/97
cgauugucggcaacga

SEQ ID NO: 3210777 - RNA, 21 nt, Mycobacterium bovis subsp bovis AF2122/97
cgauugucggcaacgacccgc

SEQ ID NO: 3210778 - RNA, 22 nt, Mycobacterium bovis subsp bovis AF2122/97
cgauugucggggccgcaggcca

SEQ ID NO: 3210779 - RNA, 14 nt, Mycobacterium bovis subsp bovis AF2122/97
cgauuguggccagc

SEQ ID NO: 3210780 - RNA, 18 nt, Mycobacterium bovis subsp bovis AF2122/97
cgauuuccaucgcgaccu

SEQ ID NO: 3210781 - RNA, 15 nt, Mycobacterium bovis subsp bovis AF2122/97
cgauuucccaugcaa

SEQ ID NO: 3210782 - RNA, 15 nt, Mycobacterium bovis subsp bovis AF2122/97
cgauuucgacgacca

SEQ ID NO: 3210783 - RNA, 16 nt, Mycobacterium bovis subsp bovis AF2122/97
cgauuucgaugacgaa

SEQ ID NO: 3210784 - RNA, 21 nt, Mycobacterium bovis subsp bovis AF2122/97
cgauuucgaugacgaacaaga

SEQ ID NO: 3210785 - RNA, 24 nt, Mycobacterium bovis subsp bovis AF2122/97
cgauuucgaugacgaacaagaaaa

SEQ ID NO: 3210786 - RNA, 19 nt, Mycobacterium bovis subsp bovis AF2122/97
cgauuucggcgaccggccg

SEQ ID NO: 3210787 - RNA, 19 nt, Mycobacterium bovis subsp bovis AF2122/97
cgauuucggcggcgaggcg

SEQ ID NO: 3210788 - RNA, 17 nt, Mycobacterium bovis subsp bovis AF2122/97
cgauuuugcgucucgcg

SEQ ID NO: 3210789 - RNA, 19 nt, Mycobacterium bovis subsp bovis AF2122/97
cgauuuugcgucugcucgc

SEQ ID NO: 3210790 - RNA, 20 nt, Mycobacterium bovis subsp bovis AF2122/97
cgauuuugcgucugcucgcg

SEQ ID NO: 3210791 - RNA, 20 nt, Mycobacterium bovis subsp bovis AF2122/97
cgauuuugcgucugcucggc

SEQ ID NO: 3210792 - RNA, 22 nt, Mycobacterium bovis subsp bovis AF2122/97
cgauuuugcgucugcucggcgc

SEQ ID NO: 3210793 - RNA, 22 nt, Mycobacterium bovis subsp bovis AF2122/97
cgauuuuggcaagcugccccgc

SEQ ID NO: 3210794 - RNA, 20 nt, Mycobacterium bovis subsp bovis AF2122/97
cgcaaaacgagcuuccacgc

SEQ ID NO: 3210795 - RNA, 15 nt, Mycobacterium bovis subsp bovis AF2122/97
cgcaaaaucgcccau

SEQ ID NO: 3210796 - RNA, 14 nt, Mycobacterium bovis subsp bovis AF2122/97
cgcaaacaagauca

SEQ ID NO: 3210797 - RNA, 19 nt, Mycobacterium bovis subsp bovis AF2122/97
cgcaaacaagaucagaccc

SEQ ID NO: 3210798 - RNA, 15 nt, Mycobacterium bovis subsp bovis AF2122/97
cgcaaacagauucgg

SEQ ID NO: 3210799 - RNA, 21 nt, Mycobacterium bovis subsp bovis AF2122/97
cgcaaacagauucggugccag

SEQ ID NO: 3210800 - RNA, 16 nt, Mycobacterium bovis subsp bovis AF2122/97
cgcaaacccgccgaca

SEQ ID NO: 3210801 - RNA, 21 nt, Mycobacterium bovis subsp bovis AF2122/97
cgcaaacccgccgacaaaagc

SEQ ID NO: 3210802 - RNA, 22 nt, Mycobacterium bovis subsp bovis AF2122/97
cgcaaagacaccgaaagccucu

SEQ ID NO: 3210803 - RNA, 17 nt, Mycobacterium bovis subsp bovis AF2122/97
cgcaaagacagcgcggg

SEQ ID NO: 3210804 - RNA, 13 nt, Mycobacterium bovis subsp bovis AF2122/97
cgcaaaggagaag

SEQ ID NO: 3210805 - RNA, 15 nt, Mycobacterium bovis subsp bovis AF2122/97
cgcaaaggccccggu

SEQ ID NO: 3210806 - RNA, 21 nt, Mycobacterium bovis subsp bovis AF2122/97
cgcaaaggccccggugacgcc

SEQ ID NO: 3210807 - RNA, 20 nt, Mycobacterium bovis subsp bovis AF2122/97
cgcaaaguucgucaccacga

SEQ ID NO: 3210808 - RNA, 22 nt, Mycobacterium bovis subsp bovis AF2122/97
cgcaaauacuucauguagcggu

SEQ ID NO: 3210809 - RNA, 19 nt, Mycobacterium bovis subsp bovis AF2122/97
cgcaaauugcaacagagcg

SEQ ID NO: 3210810 - RNA, 17 nt, Mycobacterium bovis subsp bovis AF2122/97
cgcaacaacgccgcgac

SEQ ID NO: 3210811 - RNA, 14 nt, Mycobacterium bovis subsp bovis AF2122/97
cgcaacacauccag

SEQ ID NO: 3210812 - RNA, 12 nt, Mycobacterium bovis subsp bovis AF2122/97
cgcaacaccccc

SEQ ID NO: 3210813 - RNA, 20 nt, Mycobacterium bovis subsp bovis AF2122/97
cgcaacaccccccguccacc

SEQ ID NO: 3210814 - RNA, 18 nt, Mycobacterium bovis subsp bovis AF2122/97
cgcaacaccucaccgcgg

SEQ ID NO: 3210815 - RNA, 15 nt, Mycobacterium bovis subsp bovis AF2122/97
cgcaacacgggcgcc

SEQ ID NO: 3210816 - RNA, 20 nt, Mycobacterium bovis subsp bovis AF2122/97
cgcaacagcucggccaggcu

SEQ ID NO: 3210817 - RNA, 22 nt, Mycobacterium bovis subsp bovis AF2122/97
cgcaacagcucggccaggcugg

SEQ ID NO: 3210818 - RNA, 15 nt, Mycobacterium bovis subsp bovis AF2122/97
cgcaacaggccaacu

SEQ ID NO: 3210819 - RNA, 17 nt, Mycobacterium bovis subsp bovis AF2122/97
cgcaacaucggaugacc

SEQ ID NO: 3210820 - RNA, 13 nt, Mycobacterium bovis subsp bovis AF2122/97
cgcaaccagccca

SEQ ID NO: 3210821 - RNA, 19 nt, Mycobacterium bovis subsp bovis AF2122/97
cgcaaccagccuuuccggc

SEQ ID NO: 3210822 - RNA, 13 nt, Mycobacterium bovis subsp bovis AF2122/97
cgcaacccagccg

SEQ ID NO: 3210823 - RNA, 22 nt, Mycobacterium bovis subsp bovis AF2122/97
cgcaaccccuggggugcucggg

SEQ ID NO: 3210824 - RNA, 24 nt, Mycobacterium bovis subsp bovis AF2122/97
cgcaaccccuggggugcucgggcg

SEQ ID NO: 3210825 - RNA, 14 nt, Mycobacterium bovis subsp bovis AF2122/97
cgcaacccggacga

SEQ ID NO: 3210826 - RNA, 17 nt, Mycobacterium bovis subsp bovis AF2122/97
cgcaacccugccgcgau

SEQ ID NO: 3210827 - RNA, 21 nt, Mycobacterium bovis subsp bovis AF2122/97
cgcaaccgcgaagccgaccgu

SEQ ID NO: 3210828 - RNA, 21 nt, Mycobacterium bovis subsp bovis AF2122/97
cgcaaccgcgcuuggagcggg

SEQ ID NO: 3210829 - RNA, 14 nt, Mycobacterium bovis subsp bovis AF2122/97
cgcaaccgcggccc

SEQ ID NO: 3210830 - RNA, 16 nt, Mycobacterium bovis subsp bovis AF2122/97
cgcaaccggcgaucgg

SEQ ID NO: 3210831 - RNA, 18 nt, Mycobacterium bovis subsp bovis AF2122/97
cgcaaccggcggacaccu

SEQ ID NO: 3210832 - RNA, 12 nt, Mycobacterium bovis subsp bovis AF2122/97
cgcaaccggugg

SEQ ID NO: 3210833 - RNA, 21 nt, Mycobacterium bovis subsp bovis AF2122/97
cgcaaccuaaauugccgggcc

SEQ ID NO: 3210834 - RNA, 22 nt, Mycobacterium bovis subsp bovis AF2122/97
cgcaaccuaaauugccgggccc

SEQ ID NO: 3210835 - RNA, 21 nt, Mycobacterium bovis subsp bovis AF2122/97
cgcaacgauuuuagcggcugc

SEQ ID NO: 3210836 - RNA, 19 nt, Mycobacterium bovis subsp bovis AF2122/97
cgcaacgccauaccagcgu

SEQ ID NO: 3210837 - RNA, 15 nt, Mycobacterium bovis subsp bovis AF2122/97
cgcaacgccgccagc

SEQ ID NO: 3210838 - RNA, 13 nt, Mycobacterium bovis subsp bovis AF2122/97
cgcaacgcgucgg

SEQ ID NO: 3210839 - RNA, 23 nt, Mycobacterium bovis subsp bovis AF2122/97
cgcaacgcgugcgcaucagcggu

SEQ ID NO: 3210840 - RNA, 18 nt, Mycobacterium bovis subsp bovis AF2122/97
cgcaacgcuucggcagcu

SEQ ID NO: 3210841 - RNA, 14 nt, Mycobacterium bovis subsp bovis AF2122/97
cgcaacggaugugg

SEQ ID NO: 3210842 - RNA, 15 nt, Mycobacterium bovis subsp bovis AF2122/97
cgcaacggccagcgc

SEQ ID NO: 3210843 - RNA, 16 nt, Mycobacterium bovis subsp bovis AF2122/97
cgcaacgggacgucac

SEQ ID NO: 3210844 - RNA, 18 nt, Mycobacterium bovis subsp bovis AF2122/97
cgcaacgggacgucaccg

SEQ ID NO: 3210845 - RNA, 20 nt, Mycobacterium bovis subsp bovis AF2122/97
cgcaacgggacgucaccguu

SEQ ID NO: 3210846 - RNA, 16 nt, Mycobacterium bovis subsp bovis AF2122/97
cgcaacggugaucagc

SEQ ID NO: 3210847 - RNA, 22 nt, Mycobacterium bovis subsp bovis AF2122/97
cgcaacguacgcacgcagcccc

SEQ ID NO: 3210848 - RNA, 17 nt, Mycobacterium bovis subsp bovis AF2122/97
cgcaacucgaccacuuc

SEQ ID NO: 3210849 - RNA, 15 nt, Mycobacterium bovis subsp bovis AF2122/97
cgcaacucgccgaaa

SEQ ID NO: 3210850 - RNA, 23 nt, Mycobacterium bovis subsp bovis AF2122/97
cgcaacucgccgaaaucggccag

SEQ ID NO: 3210851 - RNA, 18 nt, Mycobacterium bovis subsp bovis AF2122/97
cgcaacuucuucagcagc

SEQ ID NO: 3210852 - RNA, 21 nt, Mycobacterium bovis subsp bovis AF2122/97
cgcaacuucuucagcagcggc

SEQ ID NO: 3210853 - RNA, 17 nt, Mycobacterium bovis subsp bovis AF2122/97
cgcaagaaucagcagca

SEQ ID NO: 3210854 - RNA, 20 nt, Mycobacterium bovis subsp bovis AF2122/97
cgcaagaaucagcagcagcg

SEQ ID NO: 3210855 - RNA, 15 nt, Mycobacterium bovis subsp bovis AF2122/97
cgcaagagccguccg

SEQ ID NO: 3210856 - RNA, 17 nt, Mycobacterium bovis subsp bovis AF2122/97
cgcaagcaaauucuggu

SEQ ID NO: 3210857 - RNA, 12 nt, Mycobacterium bovis subsp bovis AF2122/97
cgcaagcagcgc

SEQ ID NO: 3210858 - RNA, 17 nt, Mycobacterium bovis subsp bovis AF2122/97
cgcaagccgcgagucgc

SEQ ID NO: 3210859 - RNA, 24 nt, Mycobacterium bovis subsp bovis AF2122/97
cgcaagccucguggugagaucaug

SEQ ID NO: 3210860 - RNA, 22 nt, Mycobacterium bovis subsp bovis AF2122/97
cgcaagcgcggcgaagccgggu

SEQ ID NO: 3210861 - RNA, 24 nt, Mycobacterium bovis subsp bovis AF2122/97
cgcaagcgcggcgaagccgggugc

SEQ ID NO: 3210862 - RNA, 21 nt, Mycobacterium bovis subsp bovis AF2122/97
cgcaagcggacccgaccgucg

SEQ ID NO: 3210863 - RNA, 14 nt, Mycobacterium bovis subsp bovis AF2122/97
cgcaaggaugucgg

SEQ ID NO: 3210864 - RNA, 13 nt, Mycobacterium bovis subsp bovis AF2122/97
cgcaaggccgcgu

SEQ ID NO: 3210865 - RNA, 12 nt, Mycobacterium bovis subsp bovis AF2122/97
cgcaaggcgccg

SEQ ID NO: 3210866 - RNA, 13 nt, Mycobacterium bovis subsp bovis AF2122/97
cgcaagucgaugu

SEQ ID NO: 3210867 - RNA, 14 nt, Mycobacterium bovis subsp bovis AF2122/97
cgcaagugcuggcc

SEQ ID NO: 3210868 - RNA, 23 nt, Mycobacterium bovis subsp bovis AF2122/97
cgcaauaagggagaccgcggccg

SEQ ID NO: 3210869 - RNA, 23 nt, Mycobacterium bovis subsp bovis AF2122/97
cgcaauagaccgcagucgcuggg

SEQ ID NO: 3210870 - RNA, 20 nt, Mycobacterium bovis subsp bovis AF2122/97
cgcaauauccggccgagccg

SEQ ID NO: 3210871 - RNA, 19 nt, Mycobacterium bovis subsp bovis AF2122/97
cgcaauauccuccagcagg

SEQ ID NO: 3210872 - RNA, 15 nt, Mycobacterium bovis subsp bovis AF2122/97
cgcaauaugccacag

SEQ ID NO: 3210873 - RNA, 16 nt, Mycobacterium bovis subsp bovis AF2122/97
cgcaauaugccacaga

SEQ ID NO: 3210874 - RNA, 21 nt, Mycobacterium bovis subsp bovis AF2122/97
cgcaaucaacgucacccccuu

SEQ ID NO: 3210875 - RNA, 20 nt, Mycobacterium bovis subsp bovis AF2122/97
cgcaauccagcugucguuga

SEQ ID NO: 3210876 - RNA, 14 nt, Mycobacterium bovis subsp bovis AF2122/97
cgcaaucgcgacgg

SEQ ID NO: 3210877 - RNA, 17 nt, Mycobacterium bovis subsp bovis AF2122/97
cgcaaucguuggccaug

SEQ ID NO: 3210878 - RNA, 12 nt, Mycobacterium bovis subsp bovis AF2122/97
cgcaaugaccgc

SEQ ID NO: 3210879 - RNA, 18 nt, Mycobacterium bovis subsp bovis AF2122/97
cgcaaugaccugcagcgc

SEQ ID NO: 3210880 - RNA, 16 nt, Mycobacterium bovis subsp bovis AF2122/97
cgcaaugacgucgucg

SEQ ID NO: 3210881 - RNA, 19 nt, Mycobacterium bovis subsp bovis AF2122/97
cgcaaugacgucgucggcc

SEQ ID NO: 3210882 - RNA, 19 nt, Mycobacterium bovis subsp bovis AF2122/97
cgcaaugcaucgcggcggc

SEQ ID NO: 3210883 - RNA, 20 nt, Mycobacterium bovis subsp bovis AF2122/97
cgcaaugcaucgcggcggcg

SEQ ID NO: 3210884 - RNA, 19 nt, Mycobacterium bovis subsp bovis AF2122/97
cgcaaugccgugcgccacg

SEQ ID NO: 3210885 - RNA, 16 nt, Mycobacterium bovis subsp bovis AF2122/97
cgcaaugcgagcgcgc

SEQ ID NO: 3210886 - RNA, 19 nt, Mycobacterium bovis subsp bovis AF2122/97
cgcaaugcgcgcgauggcg

SEQ ID NO: 3210887 - RNA, 13 nt, Mycobacterium bovis subsp bovis AF2122/97
cgcaaugcggccc

SEQ ID NO: 3210888 - RNA, 14 nt, Mycobacterium bovis subsp bovis AF2122/97
cgcaaugcguugac

SEQ ID NO: 3210889 - RNA, 17 nt, Mycobacterium bovis subsp bovis AF2122/97
cgcaauucccaucggcc

SEQ ID NO: 3210890 - RNA, 20 nt, Mycobacterium bovis subsp bovis AF2122/97
cgcaauuccggugaucgcgg

SEQ ID NO: 3210891 - RNA, 18 nt, Mycobacterium bovis subsp bovis AF2122/97
cgcacaaacgacucgcgg

SEQ ID NO: 3210892 - RNA, 15 nt, Mycobacterium bovis subsp bovis AF2122/97
cgcacaaacgggcgu

SEQ ID NO: 3210893 - RNA, 15 nt, Mycobacterium bovis subsp bovis AF2122/97
cgcacaaguggucga

SEQ ID NO: 3210894 - RNA, 21 nt, Mycobacterium bovis subsp bovis AF2122/97
cgcacaaguucuucgacagcg

SEQ ID NO: 3210895 - RNA, 15 nt, Mycobacterium bovis subsp bovis AF2122/97
cgcacaauggcggcg

SEQ ID NO: 3210896 - RNA, 16 nt, Mycobacterium bovis subsp bovis AF2122/97
cgcacaauggcggcgc

SEQ ID NO: 3210897 - RNA, 17 nt, Mycobacterium bovis subsp bovis AF2122/97
cgcacaccaacaccgcg

SEQ ID NO: 3210898 - RNA, 20 nt, Mycobacterium bovis subsp bovis AF2122/97
cgcacaccaacaccgcggcg

SEQ ID NO: 3210899 - RNA, 22 nt, Mycobacterium bovis subsp bovis AF2122/97
cgcacaccaacaccgcggcgcu

SEQ ID NO: 3210900 - RNA, 15 nt, Mycobacterium bovis subsp bovis AF2122/97
cgcacacccgguugg

SEQ ID NO: 3210901 - RNA, 13 nt, Mycobacterium bovis subsp bovis AF2122/97
cgcacaccgaccc

SEQ ID NO: 3210902 - RNA, 15 nt, Mycobacterium bovis subsp bovis AF2122/97
cgcacaccggcuuug

SEQ ID NO: 3210903 - RNA, 15 nt, Mycobacterium bovis subsp bovis AF2122/97
cgcacaccugcgcgg

SEQ ID NO: 3210904 - RNA, 13 nt, Mycobacterium bovis subsp bovis AF2122/97
cgcacacgaucgc

SEQ ID NO: 3210905 - RNA, 15 nt, Mycobacterium bovis subsp bovis AF2122/97
cgcacacgaucgcgg

SEQ ID NO: 3210906 - RNA, 12 nt, Mycobacterium bovis subsp bovis AF2122/97
cgcacacgcgug

SEQ ID NO: 3210907 - RNA, 20 nt, Mycobacterium bovis subsp bovis AF2122/97
cgcacacuaccgccgcgacc

SEQ ID NO: 3210908 - RNA, 22 nt, Mycobacterium bovis subsp bovis AF2122/97
cgcacacuaccgccgcgaccgc

SEQ ID NO: 3210909 - RNA, 21 nt, Mycobacterium bovis subsp bovis AF2122/97
cgcacacucucggugaacgcc

SEQ ID NO: 3210910 - RNA, 12 nt, Mycobacterium bovis subsp bovis AF2122/97
cgcacagcacca

SEQ ID NO: 3210911 - RNA, 16 nt, Mycobacterium bovis subsp bovis AF2122/97
cgcacagcagcaccgc

SEQ ID NO: 3210912 - RNA, 17 nt, Mycobacterium bovis subsp bovis AF2122/97
cgcacagcagcaccgcg

SEQ ID NO: 3210913 - RNA, 19 nt, Mycobacterium bovis subsp bovis AF2122/97
cgcacagcccgaugccgug

SEQ ID NO: 3210914 - RNA, 19 nt, Mycobacterium bovis subsp bovis AF2122/97
cgcacagccgcuuggcgcg

SEQ ID NO: 3210915 - RNA, 14 nt, Mycobacterium bovis subsp bovis AF2122/97
cgcacagcgacgag

SEQ ID NO: 3210916 - RNA, 14 nt, Mycobacterium bovis subsp bovis AF2122/97
cgcacaggauuuuc

SEQ ID NO: 3210917 - RNA, 19 nt, Mycobacterium bovis subsp bovis AF2122/97
cgcacaggugccaaacgcc

SEQ ID NO: 3210918 - RNA, 19 nt, Mycobacterium bovis subsp bovis AF2122/97
cgcacauugguguccacca

SEQ ID NO: 3210919 - RNA, 22 nt, Mycobacterium bovis subsp bovis AF2122/97
cgcacauugguguccaccaccg

SEQ ID NO: 3210920 - RNA, 16 nt, Mycobacterium bovis subsp bovis AF2122/97
cgcaccaagacgccac

SEQ ID NO: 3210921 - RNA, 18 nt, Mycobacterium bovis subsp bovis AF2122/97
cgcaccaagacgccaccc

SEQ ID NO: 3210922 - RNA, 16 nt, Mycobacterium bovis subsp bovis AF2122/97
cgcaccaagcagcgac

SEQ ID NO: 3210923 - RNA, 17 nt, Mycobacterium bovis subsp bovis AF2122/97
cgcaccaagcagcgacc

SEQ ID NO: 3210924 - RNA, 13 nt, Mycobacterium bovis subsp bovis AF2122/97
cgcaccaaggccg

SEQ ID NO: 3210925 - RNA, 17 nt, Mycobacterium bovis subsp bovis AF2122/97
cgcaccaaggccgccug

SEQ ID NO: 3210926 - RNA, 18 nt, Mycobacterium bovis subsp bovis AF2122/97
cgcaccaaggccgccugc

SEQ ID NO: 3210927 - RNA, 15 nt, Mycobacterium bovis subsp bovis AF2122/97
cgcaccacaccacgg

SEQ ID NO: 3210928 - RNA, 23 nt, Mycobacterium bovis subsp bovis AF2122/97
cgcaccacaccacgguggccgcu

SEQ ID NO: 3210929 - RNA, 14 nt, Mycobacterium bovis subsp bovis AF2122/97
cgcaccacaccgug

SEQ ID NO: 3210930 - RNA, 19 nt, Mycobacterium bovis subsp bovis AF2122/97
cgcaccacaccgugggcga

SEQ ID NO: 3210931 - RNA, 14 nt, Mycobacterium bovis subsp bovis AF2122/97
cgcaccacagugcc

SEQ ID NO: 3210932 - RNA, 14 nt, Mycobacterium bovis subsp bovis AF2122/97
cgcaccaccgagcc

SEQ ID NO: 3210933 - RNA, 16 nt, Mycobacterium bovis subsp bovis AF2122/97
cgcaccaccgagccga

SEQ ID NO: 3210934 - RNA, 12 nt, Mycobacterium bovis subsp bovis AF2122/97
cgcaccaccgcc

SEQ ID NO: 3210935 - RNA, 13 nt, Mycobacterium bovis subsp bovis AF2122/97
cgcaccaccgccc

SEQ ID NO: 3210936 - RNA, 15 nt, Mycobacterium bovis subsp bovis AF2122/97
cgcaccaccgccccg

SEQ ID NO: 3210937 - RNA, 20 nt, Mycobacterium bovis subsp bovis AF2122/97
cgcaccaccgccccgcgccc

SEQ ID NO: 3210938 - RNA, 15 nt, Mycobacterium bovis subsp bovis AF2122/97
cgcaccaccgcggcg

SEQ ID NO: 3210939 - RNA, 17 nt, Mycobacterium bovis subsp bovis AF2122/97
cgcaccaccgcggcggc

SEQ ID NO: 3210940 - RNA, 22 nt, Mycobacterium bovis subsp bovis AF2122/97
cgcaccaccgcggcggcggcca

SEQ ID NO: 3210941 - RNA, 14 nt, Mycobacterium bovis subsp bovis AF2122/97
cgcaccaccggccc

SEQ ID NO: 3210942 - RNA, 13 nt, Mycobacterium bovis subsp bovis AF2122/97
cgcaccaccuccc

SEQ ID NO: 3210943 - RNA, 17 nt, Mycobacterium bovis subsp bovis AF2122/97
cgcaccaccugggcggc

SEQ ID NO: 3210944 - RNA, 22 nt, Mycobacterium bovis subsp bovis AF2122/97
cgcaccacgagcagccgaugcu

SEQ ID NO: 3210945 - RNA, 12 nt, Mycobacterium bovis subsp bovis AF2122/97
cgcaccacgccc

SEQ ID NO: 3210946 - RNA, 16 nt, Mycobacterium bovis subsp bovis AF2122/97
cgcaccacgcccgacg

SEQ ID NO: 3210947 - RNA, 15 nt, Mycobacterium bovis subsp bovis AF2122/97
cgcaccagcugucgg

SEQ ID NO: 3210948 - RNA, 20 nt, Mycobacterium bovis subsp bovis AF2122/97
cgcaccagcugucgggcagc

SEQ ID NO: 3210949 - RNA, 12 nt, Mycobacterium bovis subsp bovis AF2122/97
cgcaccaggcgg

SEQ ID NO: 3210950 - RNA, 15 nt, Mycobacterium bovis subsp bovis AF2122/97
cgcaccaggcggccg

SEQ ID NO: 3210951 - RNA, 16 nt, Mycobacterium bovis subsp bovis AF2122/97
cgcaccaggcggccgu

SEQ ID NO: 3210952 - RNA, 15 nt, Mycobacterium bovis subsp bovis AF2122/97
cgcaccagggagccg

SEQ ID NO: 3210953 - RNA, 16 nt, Mycobacterium bovis subsp bovis AF2122/97
cgcaccaguccagcgg

SEQ ID NO: 3210954 - RNA, 16 nt, Mycobacterium bovis subsp bovis AF2122/97
cgcaccaucgcggccg

SEQ ID NO: 3210955 - RNA, 17 nt, Mycobacterium bovis subsp bovis AF2122/97
cgcaccaucgcggccgc

SEQ ID NO: 3210956 - RNA, 18 nt, Mycobacterium bovis subsp bovis AF2122/97
cgcaccaucgcggccgcu

SEQ ID NO: 3210957 - RNA, 14 nt, Mycobacterium bovis subsp bovis AF2122/97
cgcaccaucggcga

SEQ ID NO: 3210958 - RNA, 16 nt, Mycobacterium bovis subsp bovis AF2122/97
cgcaccaucggcgagg

SEQ ID NO: 3210959 - RNA, 14 nt, Mycobacterium bovis subsp bovis AF2122/97
cgcacccaacucca

SEQ ID NO: 3210960 - RNA, 23 nt, Mycobacterium bovis subsp bovis AF2122/97
cgcacccaacuccaucagcgcga

SEQ ID NO: 3210961 - RNA, 16 nt, Mycobacterium bovis subsp bovis AF2122/97
cgcacccaccacacca

SEQ ID NO: 3210962 - RNA, 17 nt, Mycobacterium bovis subsp bovis AF2122/97
cgcacccagaccgccga

SEQ ID NO: 3210963 - RNA, 12 nt, Mycobacterium bovis subsp bovis AF2122/97
cgcacccagccc

SEQ ID NO: 3210964 - RNA, 13 nt, Mycobacterium bovis subsp bovis AF2122/97
cgcacccagggcg

SEQ ID NO: 3210965 - RNA, 20 nt, Mycobacterium bovis subsp bovis AF2122/97
cgcacccaugaucccgcuga

SEQ ID NO: 3210966 - RNA, 18 nt, Mycobacterium bovis subsp bovis AF2122/97
cgcaccccgcuugcgcgg

SEQ ID NO: 3210967 - RNA, 12 nt, Mycobacterium bovis subsp bovis AF2122/97
cgcaccccggca

SEQ ID NO: 3210968 - RNA, 14 nt, Mycobacterium bovis subsp bovis AF2122/97
cgcaccccggcaua

SEQ ID NO: 3210969 - RNA, 14 nt, Mycobacterium bovis subsp bovis AF2122/97
cgcaccccggccgc

SEQ ID NO: 3210970 - RNA, 16 nt, Mycobacterium bovis subsp bovis AF2122/97
cgcaccccggccgcgc

SEQ ID NO: 3210971 - RNA, 17 nt, Mycobacterium bovis subsp bovis AF2122/97
cgcaccccggccgcgcg

SEQ ID NO: 3210972 - RNA, 18 nt, Mycobacterium bovis subsp bovis AF2122/97
cgcaccccggccgcgcgc

SEQ ID NO: 3210973 - RNA, 19 nt, Mycobacterium bovis subsp bovis AF2122/97
cgcaccccggccgcgcgca

SEQ ID NO: 3210974 - RNA, 21 nt, Mycobacterium bovis subsp bovis AF2122/97
cgcacccgaauuugucggcga

SEQ ID NO: 3210975 - RNA, 19 nt, Mycobacterium bovis subsp bovis AF2122/97
cgcacccgaucgacggucg

SEQ ID NO: 3210976 - RNA, 13 nt, Mycobacterium bovis subsp bovis AF2122/97
cgcacccgcucgg

SEQ ID NO: 3210977 - RNA, 13 nt, Mycobacterium bovis subsp bovis AF2122/97
cgcacccgcucgu

SEQ ID NO: 3210978 - RNA, 13 nt, Mycobacterium bovis subsp bovis AF2122/97
cgcacccggccca

SEQ ID NO: 3210979 - RNA, 13 nt, Mycobacterium bovis subsp bovis AF2122/97
cgcacccggccgc

SEQ ID NO: 3210980 - RNA, 13 nt, Mycobacterium bovis subsp bovis AF2122/97
cgcacccguccgg

SEQ ID NO: 3210981 - RNA, 17 nt, Mycobacterium bovis subsp bovis AF2122/97
cgcacccguccggccgg

SEQ ID NO: 3210982 - RNA, 22 nt, Mycobacterium bovis subsp bovis AF2122/97
cgcacccguccggccgggcccu

SEQ ID NO: 3210983 - RNA, 15 nt, Mycobacterium bovis subsp bovis AF2122/97
cgcacccguucguga

SEQ ID NO: 3210984 - RNA, 23 nt, Mycobacterium bovis subsp bovis AF2122/97
cgcacccguucgugagcggccag

SEQ ID NO: 3210985 - RNA, 21 nt, Mycobacterium bovis subsp bovis AF2122/97
cgcacccguugcucccacggc

SEQ ID NO: 3210986 - RNA, 15 nt, Mycobacterium bovis subsp bovis AF2122/97
cgcacccugacagcg

SEQ ID NO: 3210987 - RNA, 16 nt, Mycobacterium bovis subsp bovis AF2122/97
cgcacccugcgugcgg

SEQ ID NO: 3210988 - RNA, 22 nt, Mycobacterium bovis subsp bovis AF2122/97
cgcacccuggguauccaccgcg

SEQ ID NO: 3210989 - RNA, 14 nt, Mycobacterium bovis subsp bovis AF2122/97
cgcaccgaccgcac

SEQ ID NO: 3210990 - RNA, 18 nt, Mycobacterium bovis subsp bovis AF2122/97
cgcaccgaccgcaccgug

SEQ ID NO: 3210991 - RNA, 16 nt, Mycobacterium bovis subsp bovis AF2122/97
cgcaccgaggccgccg

SEQ ID NO: 3210992 - RNA, 17 nt, Mycobacterium bovis subsp bovis AF2122/97
cgcaccgaggccgccga

SEQ ID NO: 3210993 - RNA, 19 nt, Mycobacterium bovis subsp bovis AF2122/97
cgcaccgaggccgccgaga

SEQ ID NO: 3210994 - RNA, 20 nt, Mycobacterium bovis subsp bovis AF2122/97
cgcaccgaugccuugaccgc

SEQ ID NO: 3210995 - RNA, 13 nt, Mycobacterium bovis subsp bovis AF2122/97
cgcaccgccaccc

SEQ ID NO: 3210996 - RNA, 14 nt, Mycobacterium bovis subsp bovis AF2122/97
cgcaccgccgcgcg

SEQ ID NO: 3210997 - RNA, 22 nt, Mycobacterium bovis subsp bovis AF2122/97
cgcaccgccgcgcgacaggccc

SEQ ID NO: 3210998 - RNA, 19 nt, Mycobacterium bovis subsp bovis AF2122/97
cgcaccgccugcucggcga

SEQ ID NO: 3210999 - RNA, 15 nt, Mycobacterium bovis subsp bovis AF2122/97
cgcaccgcgccgugg

SEQ ID NO: 3211000 - RNA, 19 nt, Mycobacterium bovis subsp bovis AF2122/97
cgcaccgcgggaucggugg

SEQ ID NO: 3211001 - RNA, 20 nt, Mycobacterium bovis subsp bovis AF2122/97
cgcaccgcgguacgccgguc

SEQ ID NO: 3211002 - RNA, 16 nt, Mycobacterium bovis subsp bovis AF2122/97
cgcaccgcgguggggu

SEQ ID NO: 3211003 - RNA, 21 nt, Mycobacterium bovis subsp bovis AF2122/97
cgcaccgcgguggggucgacg

SEQ ID NO: 3211004 - RNA, 22 nt, Mycobacterium bovis subsp bovis AF2122/97
cgcaccgcgguggggucgacgc

SEQ ID NO: 3211005 - RNA, 14 nt, Mycobacterium bovis subsp bovis AF2122/97
cgcaccgcguucug

SEQ ID NO: 3211006 - RNA, 21 nt, Mycobacterium bovis subsp bovis AF2122/97
cgcaccgcugaccccggcagc

SEQ ID NO: 3211007 - RNA, 15 nt, Mycobacterium bovis subsp bovis AF2122/97
cgcaccgcugaccgc

SEQ ID NO: 3211008 - RNA, 16 nt, Mycobacterium bovis subsp bovis AF2122/97
cgcaccgcugaccgca

SEQ ID NO: 3211009 - RNA, 22 nt, Mycobacterium bovis subsp bovis AF2122/97
cgcaccgcuguugcaucgccgc

SEQ ID NO: 3211010 - RNA, 18 nt, Mycobacterium bovis subsp bovis AF2122/97
cgcaccggagucgcccgg

SEQ ID NO: 3211011 - RNA, 21 nt, Mycobacterium bovis subsp bovis AF2122/97
cgcaccggagucggcgucgaa

SEQ ID NO: 3211012 - RNA, 22 nt, Mycobacterium bovis subsp bovis AF2122/97
cgcaccggccgcuauggcccgg

SEQ ID NO: 3211013 - RNA, 17 nt, Mycobacterium bovis subsp bovis AF2122/97
cgcaccggcgucggcgc

SEQ ID NO: 3211014 - RNA, 19 nt, Mycobacterium bovis subsp bovis AF2122/97
cgcaccggcgucggcgcgg

SEQ ID NO: 3211015 - RNA, 15 nt, Mycobacterium bovis subsp bovis AF2122/97
cgcaccggcuggccc

SEQ ID NO: 3211016 - RNA, 22 nt, Mycobacterium bovis subsp bovis AF2122/97
cgcaccggcuggcccagcgacc

SEQ ID NO: 3211017 - RNA, 21 nt, Mycobacterium bovis subsp bovis AF2122/97
cgcaccggggugugcgggcgg

SEQ ID NO: 3211018 - RNA, 22 nt, Mycobacterium bovis subsp bovis AF2122/97
cgcaccggguccuauccgggcc

SEQ ID NO: 3211019 - RNA, 23 nt, Mycobacterium bovis subsp bovis AF2122/97
cgcaccggguccuauccgggccc

SEQ ID NO: 3211020 - RNA, 15 nt, Mycobacterium bovis subsp bovis AF2122/97
cgcaccgguaccgac

SEQ ID NO: 3211021 - RNA, 23 nt, Mycobacterium bovis subsp bovis AF2122/97
cgcaccggugauggugaccagca

SEQ ID NO: 3211022 - RNA, 17 nt, Mycobacterium bovis subsp bovis AF2122/97
cgcaccggugcucgucg

SEQ ID NO: 3211023 - RNA, 17 nt, Mycobacterium bovis subsp bovis AF2122/97
cgcaccguagccgcugc

SEQ ID NO: 3211024 - RNA, 24 nt, Mycobacterium bovis subsp bovis AF2122/97
cgcaccguagccgcugcacguggc

SEQ ID NO: 3211025 - RNA, 18 nt, Mycobacterium bovis subsp bovis AF2122/97
cgcaccgugccgacgccc

SEQ ID NO: 3211026 - RNA, 22 nt, Mycobacterium bovis subsp bovis AF2122/97
cgcaccguggcggaucgcgagc

SEQ ID NO: 3211027 - RNA, 18 nt, Mycobacterium bovis subsp bovis AF2122/97
cgcaccgugucuacgccg

SEQ ID NO: 3211028 - RNA, 13 nt, Mycobacterium bovis subsp bovis AF2122/97
cgcaccguguggg

SEQ ID NO: 3211029 - RNA, 22 nt, Mycobacterium bovis subsp bovis AF2122/97
cgcaccgugugggccccgccga

SEQ ID NO: 3211030 - RNA, 14 nt, Mycobacterium bovis subsp bovis AF2122/97
cgcaccuaugguca

SEQ ID NO: 3211031 - RNA, 21 nt, Mycobacterium bovis subsp bovis AF2122/97
cgcaccuccggcguggcuugu

SEQ ID NO: 3211032 - RNA, 13 nt, Mycobacterium bovis subsp bovis AF2122/97
cgcaccuccugcg

SEQ ID NO: 3211033 - RNA, 22 nt, Mycobacterium bovis subsp bovis AF2122/97
cgcaccuccugcgagugcggca

SEQ ID NO: 3211034 - RNA, 13 nt, Mycobacterium bovis subsp bovis AF2122/97
cgcaccucggcga

SEQ ID NO: 3211035 - RNA, 19 nt, Mycobacterium bovis subsp bovis AF2122/97
cgcaccucgguggcugcca

SEQ ID NO: 3211036 - RNA, 18 nt, Mycobacterium bovis subsp bovis AF2122/97
cgcaccugaaggcggcga

SEQ ID NO: 3211037 - RNA, 14 nt, Mycobacterium bovis subsp bovis AF2122/97
cgcaccugaucggu

SEQ ID NO: 3211038 - RNA, 16 nt, Mycobacterium bovis subsp bovis AF2122/97
cgcaccugaucgguca

SEQ ID NO: 3211039 - RNA, 16 nt, Mycobacterium bovis subsp bovis AF2122/97
cgcaccugcgaugaug

SEQ ID NO: 3211040 - RNA, 14 nt, Mycobacterium bovis subsp bovis AF2122/97
cgcaccugcgcgcg

SEQ ID NO: 3211041 - RNA, 16 nt, Mycobacterium bovis subsp bovis AF2122/97
cgcaccugcgcgcggc

SEQ ID NO: 3211042 - RNA, 18 nt, Mycobacterium bovis subsp bovis AF2122/97
cgcaccugcgcgcggccg

SEQ ID NO: 3211043 - RNA, 22 nt, Mycobacterium bovis subsp bovis AF2122/97
cgcaccugcgcgcggccgcgcu

SEQ ID NO: 3211044 - RNA, 16 nt, Mycobacterium bovis subsp bovis AF2122/97
cgcaccuggcgcgcgc

SEQ ID NO: 3211045 - RNA, 13 nt, Mycobacterium bovis subsp bovis AF2122/97
cgcaccugggcgg

SEQ ID NO: 3211046 - RNA, 16 nt, Mycobacterium bovis subsp bovis AF2122/97
cgcaccugggcugccg

SEQ ID NO: 3211047 - RNA, 19 nt, Mycobacterium bovis subsp bovis AF2122/97
cgcaccugggcugccggcc

SEQ ID NO: 3211048 - RNA, 22 nt, Mycobacterium bovis subsp bovis AF2122/97
cgcaccugggcugccggccaga

SEQ ID NO: 3211049 - RNA, 22 nt, Mycobacterium bovis subsp bovis AF2122/97
cgcaccuugaccgucgcgcauu

SEQ ID NO: 3211050 - RNA, 16 nt, Mycobacterium bovis subsp bovis AF2122/97
cgcacgaaaccgcagc

SEQ ID NO: 3211051 - RNA, 17 nt, Mycobacterium bovis subsp bovis AF2122/97
cgcacgaaaccgcagcg

SEQ ID NO: 3211052 - RNA, 20 nt, Mycobacterium bovis subsp bovis AF2122/97
cgcacgaaaccgcagcgcga

SEQ ID NO: 3211053 - RNA, 22 nt, Mycobacterium bovis subsp bovis AF2122/97
cgcacgaaaucagcccgcccaa

SEQ ID NO: 3211054 - RNA, 21 nt, Mycobacterium bovis subsp bovis AF2122/97
cgcacgaaccccacgcagaag

SEQ ID NO: 3211055 - RNA, 22 nt, Mycobacterium bovis subsp bovis AF2122/97
cgcacgaacgaguccaacucgg

SEQ ID NO: 3211056 - RNA, 15 nt, Mycobacterium bovis subsp bovis AF2122/97
cgcacgaagccggcu

SEQ ID NO: 3211057 - RNA, 19 nt, Mycobacterium bovis subsp bovis AF2122/97
cgcacgaagccggcuucgg

SEQ ID NO: 3211058 - RNA, 13 nt, Mycobacterium bovis subsp bovis AF2122/97
cgcacgaccagcu

SEQ ID NO: 3211059 - RNA, 16 nt, Mycobacterium bovis subsp bovis AF2122/97
cgcacgaccagcugag

SEQ ID NO: 3211060 - RNA, 19 nt, Mycobacterium bovis subsp bovis AF2122/97
cgcacgacugugcgccgca

SEQ ID NO: 3211061 - RNA, 17 nt, Mycobacterium bovis subsp bovis AF2122/97
cgcacgauagccaccga

SEQ ID NO: 3211062 - RNA, 19 nt, Mycobacterium bovis subsp bovis AF2122/97
cgcacgauagccaccgacg

SEQ ID NO: 3211063 - RNA, 17 nt, Mycobacterium bovis subsp bovis AF2122/97
cgcacgaucgcccguga

SEQ ID NO: 3211064 - RNA, 12 nt, Mycobacterium bovis subsp bovis AF2122/97
cgcacgaucugc

SEQ ID NO: 3211065 - RNA, 14 nt, Mycobacterium bovis subsp bovis AF2122/97
cgcacgaucugcag

SEQ ID NO: 3211066 - RNA, 17 nt, Mycobacterium bovis subsp bovis AF2122/97
cgcacgauggccgucga

SEQ ID NO: 3211067 - RNA, 21 nt, Mycobacterium bovis subsp bovis AF2122/97
cgcacgauuucgagcgcugcu

SEQ ID NO: 3211068 - RNA, 16 nt, Mycobacterium bovis subsp bovis AF2122/97
cgcacgcacgccacug

SEQ ID NO: 3211069 - RNA, 14 nt, Mycobacterium bovis subsp bovis AF2122/97
cgcacgcacggcgu

SEQ ID NO: 3211070 - RNA, 13 nt, Mycobacterium bovis subsp bovis AF2122/97
cgcacgccaccgg

SEQ ID NO: 3211071 - RNA, 17 nt, Mycobacterium bovis subsp bovis AF2122/97
cgcacgccaccgggacg

SEQ ID NO: 3211072 - RNA, 17 nt, Mycobacterium bovis subsp bovis AF2122/97
cgcacgcccgcacucgg

SEQ ID NO: 3211073 - RNA, 20 nt, Mycobacterium bovis subsp bovis AF2122/97
cgcacgcccugaagggccgc

SEQ ID NO: 3211074 - RNA, 20 nt, Mycobacterium bovis subsp bovis AF2122/97
cgcacgccgaccagcacccg

SEQ ID NO: 3211075 - RNA, 14 nt, Mycobacterium bovis subsp bovis AF2122/97
cgcacgccgaccgg

SEQ ID NO: 3211076 - RNA, 18 nt, Mycobacterium bovis subsp bovis AF2122/97
cgcacgccgaccggcccg

SEQ ID NO: 3211077 - RNA, 19 nt, Mycobacterium bovis subsp bovis AF2122/97
cgcacgccgaccggcccgc

SEQ ID NO: 3211078 - RNA, 16 nt, Mycobacterium bovis subsp bovis AF2122/97
cgcacgccgcgugccg

SEQ ID NO: 3211079 - RNA, 16 nt, Mycobacterium bovis subsp bovis AF2122/97
cgcacgccggccagcg

SEQ ID NO: 3211080 - RNA, 16 nt, Mycobacterium bovis subsp bovis AF2122/97
cgcacgcgcgcaggcc

SEQ ID NO: 3211081 - RNA, 19 nt, Mycobacterium bovis subsp bovis AF2122/97
cgcacgcgcgcaggccgcc

SEQ ID NO: 3211082 - RNA, 14 nt, Mycobacterium bovis subsp bovis AF2122/97
cgcacgcgggaggu

SEQ ID NO: 3211083 - RNA, 18 nt, Mycobacterium bovis subsp bovis AF2122/97
cgcacgcgguucaccacg

SEQ ID NO: 3211084 - RNA, 20 nt, Mycobacterium bovis subsp bovis AF2122/97
cgcacgcgguucaccacguc

SEQ ID NO: 3211085 - RNA, 14 nt, Mycobacterium bovis subsp bovis AF2122/97
cgcacgcucaguuu

SEQ ID NO: 3211086 - RNA, 21 nt, Mycobacterium bovis subsp bovis AF2122/97
cgcacgcucaguuuggccugg

SEQ ID NO: 3211087 - RNA, 12 nt, Mycobacterium bovis subsp bovis AF2122/97
cgcacgcucgcc

SEQ ID NO: 3211088 - RNA, 19 nt, Mycobacterium bovis subsp bovis AF2122/97
cgcacgcucggcggggacc

SEQ ID NO: 3211089 - RNA, 15 nt, Mycobacterium bovis subsp bovis AF2122/97
cgcacgcucggcgug

SEQ ID NO: 3211090 - RNA, 19 nt, Mycobacterium bovis subsp bovis AF2122/97
cgcacgcucggcgugucgg

SEQ ID NO: 3211091 - RNA, 22 nt, Mycobacterium bovis subsp bovis AF2122/97
cgcacgcugaguccccaggugg

SEQ ID NO: 3211092 - RNA, 21 nt, Mycobacterium bovis subsp bovis AF2122/97
cgcacgcugcucgacggucag

SEQ ID NO: 3211093 - RNA, 14 nt, Mycobacterium bovis subsp bovis AF2122/97
cgcacgcuggcggg

SEQ ID NO: 3211094 - RNA, 15 nt, Mycobacterium bovis subsp bovis AF2122/97
cgcacgcuggcgggc

SEQ ID NO: 3211095 - RNA, 16 nt, Mycobacterium bovis subsp bovis AF2122/97
cgcacgcuggcgggca

SEQ ID NO: 3211096 - RNA, 18 nt, Mycobacterium bovis subsp bovis AF2122/97
cgcacggaaggcccggcg

SEQ ID NO: 3211097 - RNA, 14 nt, Mycobacterium bovis subsp bovis AF2122/97
cgcacggaaggucg

SEQ ID NO: 3211098 - RNA, 18 nt, Mycobacterium bovis subsp bovis AF2122/97
cgcacggaaggucgacau

SEQ ID NO: 3211099 - RNA, 14 nt, Mycobacterium bovis subsp bovis AF2122/97
cgcacggaccaucg

SEQ ID NO: 3211100 - RNA, 19 nt, Mycobacterium bovis subsp bovis AF2122/97
cgcacggaccaucgccagg

SEQ ID NO: 3211101 - RNA, 17 nt, Mycobacterium bovis subsp bovis AF2122/97
cgcacggaggcggacca

SEQ ID NO: 3211102 - RNA, 20 nt, Mycobacterium bovis subsp bovis AF2122/97
cgcacggaugaugccggugu

SEQ ID NO: 3211103 - RNA, 13 nt, Mycobacterium bovis subsp bovis AF2122/97
cgcacggccaccg

SEQ ID NO: 3211104 - RNA, 14 nt, Mycobacterium bovis subsp bovis AF2122/97
cgcacggccaccgc

SEQ ID NO: 3211105 - RNA, 23 nt, Mycobacterium bovis subsp bovis AF2122/97
cgcacggccgggucgaacaggcc

SEQ ID NO: 3211106 - RNA, 18 nt, Mycobacterium bovis subsp bovis AF2122/97
cgcacggccuccggaccg

SEQ ID NO: 3211107 - RNA, 15 nt, Mycobacterium bovis subsp bovis AF2122/97
cgcacggcgccgacc

SEQ ID NO: 3211108 - RNA, 17 nt, Mycobacterium bovis subsp bovis AF2122/97
cgcacggcgccgacccg

SEQ ID NO: 3211109 - RNA, 16 nt, Mycobacterium bovis subsp bovis AF2122/97
cgcacggcgucggcca

SEQ ID NO: 3211110 - RNA, 20 nt, Mycobacterium bovis subsp bovis AF2122/97
cgcacggcgucggccaccgc

SEQ ID NO: 3211111 - RNA, 23 nt, Mycobacterium bovis subsp bovis AF2122/97
cgcacggcgucggccaccgccug

SEQ ID NO: 3211112 - RNA, 14 nt, Mycobacterium bovis subsp bovis AF2122/97
cgcacggcuggcgu

SEQ ID NO: 3211113 - RNA, 22 nt, Mycobacterium bovis subsp bovis AF2122/97
cgcacgggaucgaucugcggag

SEQ ID NO: 3211114 - RNA, 13 nt, Mycobacterium bovis subsp bovis AF2122/97
cgcacgggccacc

SEQ ID NO: 3211115 - RNA, 14 nt, Mycobacterium bovis subsp bovis AF2122/97
cgcacgggccacca

SEQ ID NO: 3211116 - RNA, 16 nt, Mycobacterium bovis subsp bovis AF2122/97
cgcacgggccaccagc

SEQ ID NO: 3211117 - RNA, 19 nt, Mycobacterium bovis subsp bovis AF2122/97
cgcacgggccaccagcguc

SEQ ID NO: 3211118 - RNA, 17 nt, Mycobacterium bovis subsp bovis AF2122/97
cgcacgguccacggugg

SEQ ID NO: 3211119 - RNA, 23 nt, Mycobacterium bovis subsp bovis AF2122/97
cgcacgguccacgguggcgccga

SEQ ID NO: 3211120 - RNA, 21 nt, Mycobacterium bovis subsp bovis AF2122/97
cgcacggugaccacgccgugg

SEQ ID NO: 3211121 - RNA, 22 nt, Mycobacterium bovis subsp bovis AF2122/97
cgcacggugaccacgccguggc

SEQ ID NO: 3211122 - RNA, 15 nt, Mycobacterium bovis subsp bovis AF2122/97
cgcacggugccgccg

SEQ ID NO: 3211123 - RNA, 16 nt, Mycobacterium bovis subsp bovis AF2122/97
cgcacggugccgccgu

SEQ ID NO: 3211124 - RNA, 19 nt, Mycobacterium bovis subsp bovis AF2122/97
cgcacggugccgccgucga

SEQ ID NO: 3211125 - RNA, 22 nt, Mycobacterium bovis subsp bovis AF2122/97
cgcacggugccgccgucgauga

SEQ ID NO: 3211126 - RNA, 13 nt, Mycobacterium bovis subsp bovis AF2122/97
cgcacggugcuga

SEQ ID NO: 3211127 - RNA, 15 nt, Mycobacterium bovis subsp bovis AF2122/97
cgcacggugcugauc

SEQ ID NO: 3211128 - RNA, 22 nt, Mycobacterium bovis subsp bovis AF2122/97
cgcacggugcugaucgguccgg

SEQ ID NO: 3211129 - RNA, 12 nt, Mycobacterium bovis subsp bovis AF2122/97
cgcacgguggcu

SEQ ID NO: 3211130 - RNA, 16 nt, Mycobacterium bovis subsp bovis AF2122/97
cgcacgguugccguca

SEQ ID NO: 3211131 - RNA, 17 nt, Mycobacterium bovis subsp bovis AF2122/97
cgcacgguugccgucag

SEQ ID NO: 3211132 - RNA, 22 nt, Mycobacterium bovis subsp bovis AF2122/97
cgcacguagaaguaggcggcga

SEQ ID NO: 3211133 - RNA, 18 nt, Mycobacterium bovis subsp bovis AF2122/97
cgcacguauccacggucg

SEQ ID NO: 3211134 - RNA, 23 nt, Mycobacterium bovis subsp bovis AF2122/97
cgcacguaucgugggugccggcu

SEQ ID NO: 3211135 - RNA, 23 nt, Mycobacterium bovis subsp bovis AF2122/97
cgcacgucgaccucggcaaccac

SEQ ID NO: 3211136 - RNA, 15 nt, Mycobacterium bovis subsp bovis AF2122/97
cgcacgucgggcccg

SEQ ID NO: 3211137 - RNA, 20 nt, Mycobacterium bovis subsp bovis AF2122/97
cgcacgugaugcccuggggg

SEQ ID NO: 3211138 - RNA, 21 nt, Mycobacterium bovis subsp bovis AF2122/97
cgcacguucacgcgcggaucg

SEQ ID NO: 3211139 - RNA, 20 nt, Mycobacterium bovis subsp bovis AF2122/97
cgcacguuggcggccagcgc

SEQ ID NO: 3211140 - RNA, 20 nt, Mycobacterium bovis subsp bovis AF2122/97
cgcacuaccgccuuugcccg

SEQ ID NO: 3211141 - RNA, 22 nt, Mycobacterium bovis subsp bovis AF2122/97
cgcacuacucgaacaaccccgg

SEQ ID NO: 3211142 - RNA, 15 nt, Mycobacterium bovis subsp bovis AF2122/97
cgcacucagucuggg

SEQ ID NO: 3211143 - RNA, 17 nt, Mycobacterium bovis subsp bovis AF2122/97
cgcacucagucugggga

SEQ ID NO: 3211144 - RNA, 20 nt, Mycobacterium bovis subsp bovis AF2122/97
cgcacucaucgccggaccgg

SEQ ID NO: 3211145 - RNA, 18 nt, Mycobacterium bovis subsp bovis AF2122/97
cgcacuccacgaucggcc

SEQ ID NO: 3211146 - RNA, 19 nt, Mycobacterium bovis subsp bovis AF2122/97
cgcacucccggcucggcca

SEQ ID NO: 3211147 - RNA, 23 nt, Mycobacterium bovis subsp bovis AF2122/97
cgcacucgaagaugucgucaccg

SEQ ID NO: 3211148 - RNA, 14 nt, Mycobacterium bovis subsp bovis AF2122/97
cgcacucguugccg

SEQ ID NO: 3211149 - RNA, 22 nt, Mycobacterium bovis subsp bovis AF2122/97
cgcacucuagccggguguuggg

SEQ ID NO: 3211150 - RNA, 19 nt, Mycobacterium bovis subsp bovis AF2122/97
cgcacugaugucacccgcc

SEQ ID NO: 3211151 - RNA, 20 nt, Mycobacterium bovis subsp bovis AF2122/97
cgcacugaugucacccgccc

SEQ ID NO: 3211152 - RNA, 22 nt, Mycobacterium bovis subsp bovis AF2122/97
cgcacugaugucacccgcccga

SEQ ID NO: 3211153 - RNA, 22 nt, Mycobacterium bovis subsp bovis AF2122/97
cgcacugccccgcaucgcccaa

SEQ ID NO: 3211154 - RNA, 14 nt, Mycobacterium bovis subsp bovis AF2122/97
cgcacugccgccgg

SEQ ID NO: 3211155 - RNA, 13 nt, Mycobacterium bovis subsp bovis AF2122/97
cgcacugccgggu

SEQ ID NO: 3211156 - RNA, 15 nt, Mycobacterium bovis subsp bovis AF2122/97
cgcacugcgccggcc

SEQ ID NO: 3211157 - RNA, 16 nt, Mycobacterium bovis subsp bovis AF2122/97
cgcacugcgccggccg

SEQ ID NO: 3211158 - RNA, 17 nt, Mycobacterium bovis subsp bovis AF2122/97
cgcacugcgccggccgg

SEQ ID NO: 3211159 - RNA, 18 nt, Mycobacterium bovis subsp bovis AF2122/97
cgcacugcgccggccggc

SEQ ID NO: 3211160 - RNA, 21 nt, Mycobacterium bovis subsp bovis AF2122/97
cgcacugcgccggccggcgca

SEQ ID NO: 3211161 - RNA, 15 nt, Mycobacterium bovis subsp bovis AF2122/97
cgcacuggggaggcc

SEQ ID NO: 3211162 - RNA, 20 nt, Mycobacterium bovis subsp bovis AF2122/97
cgcacuggggaggccaaccc

SEQ ID NO: 3211163 - RNA, 18 nt, Mycobacterium bovis subsp bovis AF2122/97
cgcacugggugcgucgac

SEQ ID NO: 3211164 - RNA, 16 nt, Mycobacterium bovis subsp bovis AF2122/97
cgcacuggucaacacg

SEQ ID NO: 3211165 - RNA, 22 nt, Mycobacterium bovis subsp bovis AF2122/97
cgcacugguugggcgagaccgc

SEQ ID NO: 3211166 - RNA, 17 nt, Mycobacterium bovis subsp bovis AF2122/97
cgcacuguugcguagcg

SEQ ID NO: 3211167 - RNA, 22 nt, Mycobacterium bovis subsp bovis AF2122/97
cgcacuugaucgacggccaucg

SEQ ID NO: 3211168 - RNA, 16 nt, Mycobacterium bovis subsp bovis AF2122/97
cgcagaaacgccgagc

SEQ ID NO: 3211169 - RNA, 23 nt, Mycobacterium bovis subsp bovis AF2122/97
cgcagaaauguauugcggugagu

SEQ ID NO: 3211170 - RNA, 14 nt, Mycobacterium bovis subsp bovis AF2122/97
cgcagaacaccacc

SEQ ID NO: 3211171 - RNA, 17 nt, Mycobacterium bovis subsp bovis AF2122/97
cgcagaacaccaccgcc

SEQ ID NO: 3211172 - RNA, 18 nt, Mycobacterium bovis subsp bovis AF2122/97
cgcagaacaccaccgcca

SEQ ID NO: 3211173 - RNA, 13 nt, Mycobacterium bovis subsp bovis AF2122/97
cgcagaagccccc

SEQ ID NO: 3211174 - RNA, 20 nt, Mycobacterium bovis subsp bovis AF2122/97
cgcagaauccggcaaccacc

SEQ ID NO: 3211175 - RNA, 23 nt, Mycobacterium bovis subsp bovis AF2122/97
cgcagaauccggcaaccaccggc

SEQ ID NO: 3211176 - RNA, 15 nt, Mycobacterium bovis subsp bovis AF2122/97
cgcagaaucgcacgc

SEQ ID NO: 3211177 - RNA, 15 nt, Mycobacterium bovis subsp bovis AF2122/97
cgcagaaucgcauga

SEQ ID NO: 3211178 - RNA, 14 nt, Mycobacterium bovis subsp bovis AF2122/97
cgcagacacgaccc

SEQ ID NO: 3211179 - RNA, 19 nt, Mycobacterium bovis subsp bovis AF2122/97
cgcagacacgaccccgucg

SEQ ID NO: 3211180 - RNA, 16 nt, Mycobacterium bovis subsp bovis AF2122/97
cgcagacacugcugcg

SEQ ID NO: 3211181 - RNA, 18 nt, Mycobacterium bovis subsp bovis AF2122/97
cgcagacacugcugcggc

SEQ ID NO: 3211182 - RNA, 13 nt, Mycobacterium bovis subsp bovis AF2122/97
cgcagaccgccac

SEQ ID NO: 3211183 - RNA, 14 nt, Mycobacterium bovis subsp bovis AF2122/97
cgcagaccgccacc

SEQ ID NO: 3211184 - RNA, 16 nt, Mycobacterium bovis subsp bovis AF2122/97
cgcagaccguccagca

SEQ ID NO: 3211185 - RNA, 19 nt, Mycobacterium bovis subsp bovis AF2122/97
cgcagaccguccagcaaca

SEQ ID NO: 3211186 - RNA, 22 nt, Mycobacterium bovis subsp bovis AF2122/97
cgcagaccguccagcaacagcg

SEQ ID NO: 3211187 - RNA, 15 nt, Mycobacterium bovis subsp bovis AF2122/97
cgcagacgacaaccg

SEQ ID NO: 3211188 - RNA, 14 nt, Mycobacterium bovis subsp bovis AF2122/97
cgcagacgccgacu

SEQ ID NO: 3211189 - RNA, 15 nt, Mycobacterium bovis subsp bovis AF2122/97
cgcagacgccgacuc

SEQ ID NO: 3211190 - RNA, 16 nt, Mycobacterium bovis subsp bovis AF2122/97
cgcagacgcggcaggu

SEQ ID NO: 3211191 - RNA, 15 nt, Mycobacterium bovis subsp bovis AF2122/97
cgcagacggcugcca

SEQ ID NO: 3211192 - RNA, 19 nt, Mycobacterium bovis subsp bovis AF2122/97
cgcagacggcugccacgcg

SEQ ID NO: 3211193 - RNA, 22 nt, Mycobacterium bovis subsp bovis AF2122/97
cgcagacggcugccacgcgucg

SEQ ID NO: 3211194 - RNA, 15 nt, Mycobacterium bovis subsp bovis AF2122/97
cgcagacgugguagc

SEQ ID NO: 3211195 - RNA, 22 nt, Mycobacterium bovis subsp bovis AF2122/97
cgcagacucgauaugcagcucg

SEQ ID NO: 3211196 - RNA, 17 nt, Mycobacterium bovis subsp bovis AF2122/97
cgcagacucgccaccgc

SEQ ID NO: 3211197 - RNA, 21 nt, Mycobacterium bovis subsp bovis AF2122/97
cgcagacucgccaccgcggcg

SEQ ID NO: 3211198 - RNA, 23 nt, Mycobacterium bovis subsp bovis AF2122/97
cgcagacucgccaccgcggcgau

SEQ ID NO: 3211199 - RNA, 21 nt, Mycobacterium bovis subsp bovis AF2122/97
cgcagagcguacaggucggcc

SEQ ID NO: 3211200 - RNA, 18 nt, Mycobacterium bovis subsp bovis AF2122/97
cgcagagcguuccgcucg

SEQ ID NO: 3211201 - RNA, 16 nt, Mycobacterium bovis subsp bovis AF2122/97
cgcagaggcggcuggc

SEQ ID NO: 3211202 - RNA, 17 nt, Mycobacterium bovis subsp bovis AF2122/97
cgcagaggcggcuggcg

SEQ ID NO: 3211203 - RNA, 14 nt, Mycobacterium bovis subsp bovis AF2122/97
cgcagagucaacag

SEQ ID NO: 3211204 - RNA, 19 nt, Mycobacterium bovis subsp bovis AF2122/97
cgcagagucaacgucguga

SEQ ID NO: 3211205 - RNA, 20 nt, Mycobacterium bovis subsp bovis AF2122/97
cgcagagucgcacugcgccg

SEQ ID NO: 3211206 - RNA, 18 nt, Mycobacterium bovis subsp bovis AF2122/97
cgcagauauuccucgucg

SEQ ID NO: 3211207 - RNA, 15 nt, Mycobacterium bovis subsp bovis AF2122/97
cgcagaucaccgcca

SEQ ID NO: 3211208 - RNA, 16 nt, Mycobacterium bovis subsp bovis AF2122/97
cgcagaucaggguggc

SEQ ID NO: 3211209 - RNA, 18 nt, Mycobacterium bovis subsp bovis AF2122/97
cgcagaucaggguggcgc

SEQ ID NO: 3211210 - RNA, 15 nt, Mycobacterium bovis subsp bovis AF2122/97
cgcagauccccgcca

SEQ ID NO: 3211211 - RNA, 19 nt, Mycobacterium bovis subsp bovis AF2122/97
cgcagauccccgccaccga

SEQ ID NO: 3211212 - RNA, 21 nt, Mycobacterium bovis subsp bovis AF2122/97
cgcagauccccgccaccgaac

SEQ ID NO: 3211213 - RNA, 20 nt, Mycobacterium bovis subsp bovis AF2122/97
cgcagaucgaaaucagcccg

SEQ ID NO: 3211214 - RNA, 16 nt, Mycobacterium bovis subsp bovis AF2122/97
cgcagaucguccaccg

SEQ ID NO: 3211215 - RNA, 14 nt, Mycobacterium bovis subsp bovis AF2122/97
cgcagauggcgagg

SEQ ID NO: 3211216 - RNA, 18 nt, Mycobacterium bovis subsp bovis AF2122/97
cgcagauuggcggcuucg

SEQ ID NO: 3211217 - RNA, 21 nt, Mycobacterium bovis subsp bovis AF2122/97
cgcagauuugcuccagcgacg

SEQ ID NO: 3211218 - RNA, 13 nt, Mycobacterium bovis subsp bovis AF2122/97
cgcagcaacggcg

SEQ ID NO: 3211219 - RNA, 15 nt, Mycobacterium bovis subsp bovis AF2122/97
cgcagcaacggcggc

SEQ ID NO: 3211220 - RNA, 18 nt, Mycobacterium bovis subsp bovis AF2122/97
cgcagcaacggcggcguc

SEQ ID NO: 3211221 - RNA, 23 nt, Mycobacterium bovis subsp bovis AF2122/97
cgcagcaacggcggcgucgcggu

SEQ ID NO: 3211222 - RNA, 16 nt, Mycobacterium bovis subsp bovis AF2122/97
cgcagcaccaaggucu

SEQ ID NO: 3211223 - RNA, 17 nt, Mycobacterium bovis subsp bovis AF2122/97
cgcagcacccugcgggc

SEQ ID NO: 3211224 - RNA, 20 nt, Mycobacterium bovis subsp bovis AF2122/97
cgcagcacccugcgggccga

SEQ ID NO: 3211225 - RNA, 20 nt, Mycobacterium bovis subsp bovis AF2122/97
cgcagcaccggcucgacugc

SEQ ID NO: 3211226 - RNA, 18 nt, Mycobacterium bovis subsp bovis AF2122/97
cgcagcaccgucgggccc

SEQ ID NO: 3211227 - RNA, 19 nt, Mycobacterium bovis subsp bovis AF2122/97
cgcagcaccgucgggccca

SEQ ID NO: 3211228 - RNA, 22 nt, Mycobacterium bovis subsp bovis AF2122/97
cgcagcaccgucgggcccagcc

SEQ ID NO: 3211229 - RNA, 16 nt, Mycobacterium bovis subsp bovis AF2122/97
cgcagcaccucgucga

SEQ ID NO: 3211230 - RNA, 21 nt, Mycobacterium bovis subsp bovis AF2122/97
cgcagcaccucgucgaucgcc

SEQ ID NO: 3211231 - RNA, 14 nt, Mycobacterium bovis subsp bovis AF2122/97
cgcagcacggcacc

SEQ ID NO: 3211232 - RNA, 16 nt, Mycobacterium bovis subsp bovis AF2122/97
cgcagcacggcggcca

SEQ ID NO: 3211233 - RNA, 13 nt, Mycobacterium bovis subsp bovis AF2122/97
cgcagcacugcgg

SEQ ID NO: 3211234 - RNA, 18 nt, Mycobacterium bovis subsp bovis AF2122/97
cgcagcagacuccguugc

SEQ ID NO: 3211235 - RNA, 18 nt, Mycobacterium bovis subsp bovis AF2122/97
cgcagcagcaucggcacg

SEQ ID NO: 3211236 - RNA, 18 nt, Mycobacterium bovis subsp bovis AF2122/97
cgcagcaggggacgacca

SEQ ID NO: 3211237 - RNA, 20 nt, Mycobacterium bovis subsp bovis AF2122/97
cgcagcaggggacgaccaug

SEQ ID NO: 3211238 - RNA, 22 nt, Mycobacterium bovis subsp bovis AF2122/97
cgcagcaggggacgaccaugcc

SEQ ID NO: 3211239 - RNA, 14 nt, Mycobacterium bovis subsp bovis AF2122/97
cgcagcaggugagc

SEQ ID NO: 3211240 - RNA, 18 nt, Mycobacterium bovis subsp bovis AF2122/97
cgcagcaggugcaucgcc

SEQ ID NO: 3211241 - RNA, 16 nt, Mycobacterium bovis subsp bovis AF2122/97
cgcagcagugccgugc

SEQ ID NO: 3211242 - RNA, 14 nt, Mycobacterium bovis subsp bovis AF2122/97
cgcagcagugcgaa

SEQ ID NO: 3211243 - RNA, 20 nt, Mycobacterium bovis subsp bovis AF2122/97
cgcagcaguuggucgcgguc

SEQ ID NO: 3211244 - RNA, 16 nt, Mycobacterium bovis subsp bovis AF2122/97
cgcagcaucacguccg

SEQ ID NO: 3211245 - RNA, 16 nt, Mycobacterium bovis subsp bovis AF2122/97
cgcagcaucuccgccg

SEQ ID NO: 3211246 - RNA, 17 nt, Mycobacterium bovis subsp bovis AF2122/97
cgcagcaucuccgccgg

SEQ ID NO: 3211247 - RNA, 15 nt, Mycobacterium bovis subsp bovis AF2122/97
cgcagcaucucgucg

SEQ ID NO: 3211248 - RNA, 21 nt, Mycobacterium bovis subsp bovis AF2122/97
cgcagcaucucgucgaucucg

SEQ ID NO: 3211249 - RNA, 21 nt, Mycobacterium bovis subsp bovis AF2122/97
cgcagcaucugcgggucggca

SEQ ID NO: 3211250 - RNA, 17 nt, Mycobacterium bovis subsp bovis AF2122/97
cgcagcauggugcggcg

SEQ ID NO: 3211251 - RNA, 20 nt, Mycobacterium bovis subsp bovis AF2122/97
cgcagcauggugcggcggcg

SEQ ID NO: 3211252 - RNA, 14 nt, Mycobacterium bovis subsp bovis AF2122/97
cgcagcauguccgc

SEQ ID NO: 3211253 - RNA, 21 nt, Mycobacterium bovis subsp bovis AF2122/97
cgcagcauguccgcagcggug

SEQ ID NO: 3211254 - RNA, 17 nt, Mycobacterium bovis subsp bovis AF2122/97
cgcagcauguggccgcc

SEQ ID NO: 3211255 - RNA, 14 nt, Mycobacterium bovis subsp bovis AF2122/97
cgcagcauugacca

SEQ ID NO: 3211256 - RNA, 13 nt, Mycobacterium bovis subsp bovis AF2122/97
cgcagccaacgcu

SEQ ID NO: 3211257 - RNA, 15 nt, Mycobacterium bovis subsp bovis AF2122/97
cgcagccaacgcugu

SEQ ID NO: 3211258 - RNA, 17 nt, Mycobacterium bovis subsp bovis AF2122/97
cgcagccaacgucacca

SEQ ID NO: 3211259 - RNA, 21 nt, Mycobacterium bovis subsp bovis AF2122/97
cgcagccacguuacgcucgcg

SEQ ID NO: 3211260 - RNA, 23 nt, Mycobacterium bovis subsp bovis AF2122/97
cgcagccacguuacgcucgcggg

SEQ ID NO: 3211261 - RNA, 13 nt, Mycobacterium bovis subsp bovis AF2122/97
cgcagccagaucu

SEQ ID NO: 3211262 - RNA, 12 nt, Mycobacterium bovis subsp bovis AF2122/97
cgcagccagcaa

SEQ ID NO: 3211263 - RNA, 23 nt, Mycobacterium bovis subsp bovis AF2122/97
cgcagccagcaagucugcccgac

SEQ ID NO: 3211264 - RNA, 13 nt, Mycobacterium bovis subsp bovis AF2122/97
cgcagccagcgcc

SEQ ID NO: 3211265 - RNA, 17 nt, Mycobacterium bovis subsp bovis AF2122/97
cgcagccagcugaacac

SEQ ID NO: 3211266 - RNA, 18 nt, Mycobacterium bovis subsp bovis AF2122/97
cgcagccaggcugcggau

SEQ ID NO: 3211267 - RNA, 23 nt, Mycobacterium bovis subsp bovis AF2122/97
cgcagccaggugucgucgaucgc

SEQ ID NO: 3211268 - RNA, 14 nt, Mycobacterium bovis subsp bovis AF2122/97
cgcagccccucguc

SEQ ID NO: 3211269 - RNA, 15 nt, Mycobacterium bovis subsp bovis AF2122/97
cgcagccccucgucg

SEQ ID NO: 3211270 - RNA, 13 nt, Mycobacterium bovis subsp bovis AF2122/97
cgcagcccgccgg

SEQ ID NO: 3211271 - RNA, 16 nt, Mycobacterium bovis subsp bovis AF2122/97
cgcagcccgucggcgc

SEQ ID NO: 3211272 - RNA, 19 nt, Mycobacterium bovis subsp bovis AF2122/97
cgcagccgaucgagcagga

SEQ ID NO: 3211273 - RNA, 17 nt, Mycobacterium bovis subsp bovis AF2122/97
cgcagccgaucgucucg

SEQ ID NO: 3211274 - RNA, 18 nt, Mycobacterium bovis subsp bovis AF2122/97
cgcagccgaucgucucgg

SEQ ID NO: 3211275 - RNA, 14 nt, Mycobacterium bovis subsp bovis AF2122/97
cgcagccgaugucg

SEQ ID NO: 3211276 - RNA, 12 nt, Mycobacterium bovis subsp bovis AF2122/97
cgcagccgcgcg

SEQ ID NO: 3211277 - RNA, 15 nt, Mycobacterium bovis subsp bovis AF2122/97
cgcagccgcucgacg

SEQ ID NO: 3211278 - RNA, 15 nt, Mycobacterium bovis subsp bovis AF2122/97
cgcagccggcccguc

SEQ ID NO: 3211279 - RNA, 23 nt, Mycobacterium bovis subsp bovis AF2122/97
cgcagccggcccgucgcgucgac

SEQ ID NO: 3211280 - RNA, 14 nt, Mycobacterium bovis subsp bovis AF2122/97
cgcagccgggcacc

SEQ ID NO: 3211281 - RNA, 18 nt, Mycobacterium bovis subsp bovis AF2122/97
cgcagccgggcaccaccc

SEQ ID NO: 3211282 - RNA, 16 nt, Mycobacterium bovis subsp bovis AF2122/97
cgcagccgggcaccga

SEQ ID NO: 3211283 - RNA, 15 nt, Mycobacterium bovis subsp bovis AF2122/97
cgcagccggucaggu

SEQ ID NO: 3211284 - RNA, 13 nt, Mycobacterium bovis subsp bovis AF2122/97
cgcagccggugag

SEQ ID NO: 3211285 - RNA, 21 nt, Mycobacterium bovis subsp bovis AF2122/97
cgcagccgguuaauggaauga

SEQ ID NO: 3211286 - RNA, 14 nt, Mycobacterium bovis subsp bovis AF2122/97
cgcagccugcagcg

SEQ ID NO: 3211287 - RNA, 21 nt, Mycobacterium bovis subsp bovis AF2122/97
cgcagccugcagcgaaacacc

SEQ ID NO: 3211288 - RNA, 16 nt, Mycobacterium bovis subsp bovis AF2122/97
cgcagccugccgauga

SEQ ID NO: 3211289 - RNA, 17 nt, Mycobacterium bovis subsp bovis AF2122/97
cgcagccugccgaugac

SEQ ID NO: 3211290 - RNA, 18 nt, Mycobacterium bovis subsp bovis AF2122/97
cgcagccugccgaugacg

SEQ ID NO: 3211291 - RNA, 16 nt, Mycobacterium bovis subsp bovis AF2122/97
cgcagccuggucgcgc

SEQ ID NO: 3211292 - RNA, 20 nt, Mycobacterium bovis subsp bovis AF2122/97
cgcagccuggucgcgcagcu

SEQ ID NO: 3211293 - RNA, 20 nt, Mycobacterium bovis subsp bovis AF2122/97
cgcagcgaaaacccggucgg

SEQ ID NO: 3211294 - RNA, 23 nt, Mycobacterium bovis subsp bovis AF2122/97
cgcagcgaagaccagcggcggcg

SEQ ID NO: 3211295 - RNA, 18 nt, Mycobacterium bovis subsp bovis AF2122/97
cgcagcgacgcgauuucg

SEQ ID NO: 3211296 - RNA, 22 nt, Mycobacterium bovis subsp bovis AF2122/97
cgcagcgacgggaaagccaccu

SEQ ID NO: 3211297 - RNA, 13 nt, Mycobacterium bovis subsp bovis AF2122/97
cgcagcgccaucg

SEQ ID NO: 3211298 - RNA, 13 nt, Mycobacterium bovis subsp bovis AF2122/97
cgcagcgccgcca

SEQ ID NO: 3211299 - RNA, 14 nt, Mycobacterium bovis subsp bovis AF2122/97
cgcagcgccgccac

SEQ ID NO: 3211300 - RNA, 19 nt, Mycobacterium bovis subsp bovis AF2122/97
cgcagcgccuaccagcacc

SEQ ID NO: 3211301 - RNA, 12 nt, Mycobacterium bovis subsp bovis AF2122/97
cgcagcgccugc

SEQ ID NO: 3211302 - RNA, 19 nt, Mycobacterium bovis subsp bovis AF2122/97
cgcagcgccugcggcagca

SEQ ID NO: 3211303 - RNA, 17 nt, Mycobacterium bovis subsp bovis AF2122/97
cgcagcgcggcggcauc

SEQ ID NO: 3211304 - RNA, 19 nt, Mycobacterium bovis subsp bovis AF2122/97
cgcagcggcaaggucaacg

SEQ ID NO: 3211305 - RNA, 15 nt, Mycobacterium bovis subsp bovis AF2122/97
cgcagcggccagccc

SEQ ID NO: 3211306 - RNA, 16 nt, Mycobacterium bovis subsp bovis AF2122/97
cgcagcggccagccca

SEQ ID NO: 3211307 - RNA, 18 nt, Mycobacterium bovis subsp bovis AF2122/97
cgcagcggccagcccagc

SEQ ID NO: 3211308 - RNA, 13 nt, Mycobacterium bovis subsp bovis AF2122/97
cgcagcggcggca

SEQ ID NO: 3211309 - RNA, 15 nt, Mycobacterium bovis subsp bovis AF2122/97
cgcagcggcggcaac

SEQ ID NO: 3211310 - RNA, 19 nt, Mycobacterium bovis subsp bovis AF2122/97
cgcagcggcggcaacccug

SEQ ID NO: 3211311 - RNA, 24 nt, Mycobacterium bovis subsp bovis AF2122/97
cgcagcgggcggugucgucaucgg

SEQ ID NO: 3211312 - RNA, 15 nt, Mycobacterium bovis subsp bovis AF2122/97
cgcagcgguggucgg

SEQ ID NO: 3211313 - RNA, 21 nt, Mycobacterium bovis subsp bovis AF2122/97
cgcagcgguggucggcgcgcc

SEQ ID NO: 3211314 - RNA, 15 nt, Mycobacterium bovis subsp bovis AF2122/97
cgcagcgugagugca

SEQ ID NO: 3211315 - RNA, 22 nt, Mycobacterium bovis subsp bovis AF2122/97
cgcagcgugaucuggccacggc

SEQ ID NO: 3211316 - RNA, 14 nt, Mycobacterium bovis subsp bovis AF2122/97
cgcagcgugcccag

SEQ ID NO: 3211317 - RNA, 21 nt, Mycobacterium bovis subsp bovis AF2122/97
cgcagcguguaguggcccgcg

SEQ ID NO: 3211318 - RNA, 18 nt, Mycobacterium bovis subsp bovis AF2122/97
cgcagcguuggccgcugu

SEQ ID NO: 3211319 - RNA, 14 nt, Mycobacterium bovis subsp bovis AF2122/97
cgcagcuaacccgc

SEQ ID NO: 3211320 - RNA, 19 nt, Mycobacterium bovis subsp bovis AF2122/97
cgcagcuaacccgccacgu

SEQ ID NO: 3211321 - RNA, 20 nt, Mycobacterium bovis subsp bovis AF2122/97
cgcagcuaucuccaugcucg

SEQ ID NO: 3211322 - RNA, 16 nt, Mycobacterium bovis subsp bovis AF2122/97
cgcagcuauuucgcga

SEQ ID NO: 3211323 - RNA, 23 nt, Mycobacterium bovis subsp bovis AF2122/97
cgcagcucaccgacggagaucga

SEQ ID NO: 3211324 - RNA, 17 nt, Mycobacterium bovis subsp bovis AF2122/97
cgcagcuccaccgugac

SEQ ID NO: 3211325 - RNA, 18 nt, Mycobacterium bovis subsp bovis AF2122/97
cgcagcuccaccgugacg

SEQ ID NO: 3211326 - RNA, 18 nt, Mycobacterium bovis subsp bovis AF2122/97
cgcagcuccucgcccaga

SEQ ID NO: 3211327 - RNA, 16 nt, Mycobacterium bovis subsp bovis AF2122/97
cgcagcucgaccagga

SEQ ID NO: 3211328 - RNA, 15 nt, Mycobacterium bovis subsp bovis AF2122/97
cgcagcucgucguga

SEQ ID NO: 3211329 - RNA, 21 nt, Mycobacterium bovis subsp bovis AF2122/97
cgcagcucgucgugagucacc

SEQ ID NO: 3211330 - RNA, 15 nt, Mycobacterium bovis subsp bovis AF2122/97
cgcagcugacgucac

SEQ ID NO: 3211331 - RNA, 22 nt, Mycobacterium bovis subsp bovis AF2122/97
cgcagcugacgucaccacgauc

SEQ ID NO: 3211332 - RNA, 13 nt, Mycobacterium bovis subsp bovis AF2122/97
cgcagcugagccg

SEQ ID NO: 3211333 - RNA, 20 nt, Mycobacterium bovis subsp bovis AF2122/97
cgcagcugagccgugucaac

SEQ ID NO: 3211334 - RNA, 19 nt, Mycobacterium bovis subsp bovis AF2122/97
cgcagcugccgcacccccu

SEQ ID NO: 3211335 - RNA, 24 nt, Mycobacterium bovis subsp bovis AF2122/97
cgcagcugcgggucgugccccggc

SEQ ID NO: 3211336 - RNA, 18 nt, Mycobacterium bovis subsp bovis AF2122/97
cgcagcugggugcgccau

SEQ ID NO: 3211337 - RNA, 19 nt, Mycobacterium bovis subsp bovis AF2122/97
cgcagcugguuugcggugc

SEQ ID NO: 3211338 - RNA, 20 nt, Mycobacterium bovis subsp bovis AF2122/97
cgcagcugguuugcggugcc

SEQ ID NO: 3211339 - RNA, 13 nt, Mycobacterium bovis subsp bovis AF2122/97
cgcagcuugcccg

SEQ ID NO: 3211340 - RNA, 15 nt, Mycobacterium bovis subsp bovis AF2122/97
cgcagcuuggccagc

SEQ ID NO: 3211341 - RNA, 16 nt, Mycobacterium bovis subsp bovis AF2122/97
cgcagcuuggccagcc

SEQ ID NO: 3211342 - RNA, 16 nt, Mycobacterium bovis subsp bovis AF2122/97
cgcaggaaaaccccgg

SEQ ID NO: 3211343 - RNA, 22 nt, Mycobacterium bovis subsp bovis AF2122/97
cgcaggaaaaccccggccacca

SEQ ID NO: 3211344 - RNA, 15 nt, Mycobacterium bovis subsp bovis AF2122/97
cgcaggaagcccacg

SEQ ID NO: 3211345 - RNA, 20 nt, Mycobacterium bovis subsp bovis AF2122/97
cgcaggaagcccacgaucgc

SEQ ID NO: 3211346 - RNA, 19 nt, Mycobacterium bovis subsp bovis AF2122/97
cgcaggaauucgccauagc

SEQ ID NO: 3211347 - RNA, 23 nt, Mycobacterium bovis subsp bovis AF2122/97
cgcaggaauucgccauagcgggc

SEQ ID NO: 3211348 - RNA, 13 nt, Mycobacterium bovis subsp bovis AF2122/97
cgcaggaccugcg

SEQ ID NO: 3211349 - RNA, 18 nt, Mycobacterium bovis subsp bovis AF2122/97
cgcaggacgcugccggug

SEQ ID NO: 3211350 - RNA, 22 nt, Mycobacterium bovis subsp bovis AF2122/97
cgcaggagguugggaacagccu

SEQ ID NO: 3211351 - RNA, 18 nt, Mycobacterium bovis subsp bovis AF2122/97
cgcaggaucacacuggcc

SEQ ID NO: 3211352 - RNA, 13 nt, Mycobacterium bovis subsp bovis AF2122/97
cgcaggaucggcg

SEQ ID NO: 3211353 - RNA, 14 nt, Mycobacterium bovis subsp bovis AF2122/97
cgcaggaucggcgg

SEQ ID NO: 3211354 - RNA, 21 nt, Mycobacterium bovis subsp bovis AF2122/97
cgcaggauucccaguccagga

SEQ ID NO: 3211355 - RNA, 13 nt, Mycobacterium bovis subsp bovis AF2122/97
cgcaggcaccccg

SEQ ID NO: 3211356 - RNA, 21 nt, Mycobacterium bovis subsp bovis AF2122/97
cgcaggcagugagggucccac

SEQ ID NO: 3211357 - RNA, 13 nt, Mycobacterium bovis subsp bovis AF2122/97
cgcaggccagggu

SEQ ID NO: 3211358 - RNA, 17 nt, Mycobacterium bovis subsp bovis AF2122/97
cgcaggccgccgccagu

SEQ ID NO: 3211359 - RNA, 14 nt, Mycobacterium bovis subsp bovis AF2122/97
cgcaggccggcggc

SEQ ID NO: 3211360 - RNA, 23 nt, Mycobacterium bovis subsp bovis AF2122/97
cgcaggccuguuccauuccgguc

SEQ ID NO: 3211361 - RNA, 19 nt, Mycobacterium bovis subsp bovis AF2122/97
cgcaggcgauugcagcuuc

SEQ ID NO: 3211362 - RNA, 16 nt, Mycobacterium bovis subsp bovis AF2122/97
cgcaggcgcagauucc

SEQ ID NO: 3211363 - RNA, 21 nt, Mycobacterium bovis subsp bovis AF2122/97
cgcaggcgcagauuccucuuc

SEQ ID NO: 3211364 - RNA, 13 nt, Mycobacterium bovis subsp bovis AF2122/97
cgcaggcucaccg

SEQ ID NO: 3211365 - RNA, 14 nt, Mycobacterium bovis subsp bovis AF2122/97
cgcaggcucaccga

SEQ ID NO: 3211366 - RNA, 15 nt, Mycobacterium bovis subsp bovis AF2122/97
cgcaggcucagcugg

SEQ ID NO: 3211367 - RNA, 20 nt, Mycobacterium bovis subsp bovis AF2122/97
cgcaggcuuccagccacagc

SEQ ID NO: 3211368 - RNA, 22 nt, Mycobacterium bovis subsp bovis AF2122/97
cgcaggcuuccagccacagccc

SEQ ID NO: 3211369 - RNA, 13 nt, Mycobacterium bovis subsp bovis AF2122/97
cgcaggcuugccg

SEQ ID NO: 3211370 - RNA, 22 nt, Mycobacterium bovis subsp bovis AF2122/97
cgcaggcuugccgauggcggug

SEQ ID NO: 3211371 - RNA, 15 nt, Mycobacterium bovis subsp bovis AF2122/97
cgcagggaucacccc

SEQ ID NO: 3211372 - RNA, 21 nt, Mycobacterium bovis subsp bovis AF2122/97
cgcagggaucaccccggccgg

SEQ ID NO: 3211373 - RNA, 23 nt, Mycobacterium bovis subsp bovis AF2122/97
cgcagggaucaccccggccggcu

SEQ ID NO: 3211374 - RNA, 17 nt, Mycobacterium bovis subsp bovis AF2122/97
cgcagggaucgcaggga

SEQ ID NO: 3211375 - RNA, 20 nt, Mycobacterium bovis subsp bovis AF2122/97
cgcagggaucgcagggauca

SEQ ID NO: 3211376 - RNA, 24 nt, Mycobacterium bovis subsp bovis AF2122/97
cgcagggcaucggucucgcaccag

SEQ ID NO: 3211377 - RNA, 16 nt, Mycobacterium bovis subsp bovis AF2122/97
cgcagggccgccgcga

SEQ ID NO: 3211378 - RNA, 18 nt, Mycobacterium bovis subsp bovis AF2122/97
cgcagggccgcgcgcacu

SEQ ID NO: 3211379 - RNA, 16 nt, Mycobacterium bovis subsp bovis AF2122/97
cgcagggcgucggcga

SEQ ID NO: 3211380 - RNA, 18 nt, Mycobacterium bovis subsp bovis AF2122/97
cgcagggucccgucaucg

SEQ ID NO: 3211381 - RNA, 17 nt, Mycobacterium bovis subsp bovis AF2122/97
cgcaggguucgucggga

SEQ ID NO: 3211382 - RNA, 18 nt, Mycobacterium bovis subsp bovis AF2122/97
cgcaggguucgucgggac

SEQ ID NO: 3211383 - RNA, 12 nt, Mycobacterium bovis subsp bovis AF2122/97
cgcagguagcgg

SEQ ID NO: 3211384 - RNA, 15 nt, Mycobacterium bovis subsp bovis AF2122/97
cgcagguagcggguu

SEQ ID NO: 3211385 - RNA, 22 nt, Mycobacterium bovis subsp bovis AF2122/97
cgcaggucaagaaggagaucga

SEQ ID NO: 3211386 - RNA, 16 nt, Mycobacterium bovis subsp bovis AF2122/97
cgcaggucgcaccaca

SEQ ID NO: 3211387 - RNA, 19 nt, Mycobacterium bovis subsp bovis AF2122/97
cgcagguggcuguucaccu

SEQ ID NO: 3211388 - RNA, 20 nt, Mycobacterium bovis subsp bovis AF2122/97
cgcagguggcuguucaccuc

SEQ ID NO: 3211389 - RNA, 23 nt, Mycobacterium bovis subsp bovis AF2122/97
cgcaggugggcguuggcgacgaa

SEQ ID NO: 3211390 - RNA, 14 nt, Mycobacterium bovis subsp bovis AF2122/97
cgcagguggucgau

SEQ ID NO: 3211391 - RNA, 12 nt, Mycobacterium bovis subsp bovis AF2122/97
cgcaggugguga

SEQ ID NO: 3211392 - RNA, 20 nt, Mycobacterium bovis subsp bovis AF2122/97
cgcagguuggauacggugcg

SEQ ID NO: 3211393 - RNA, 16 nt, Mycobacterium bovis subsp bovis AF2122/97
cgcagguuggcaagca

SEQ ID NO: 3211394 - RNA, 17 nt, Mycobacterium bovis subsp bovis AF2122/97
cgcagguuggcaagcac

SEQ ID NO: 3211395 - RNA, 21 nt, Mycobacterium bovis subsp bovis AF2122/97
cgcagguuggcaagcacggcg

SEQ ID NO: 3211396 - RNA, 16 nt, Mycobacterium bovis subsp bovis AF2122/97
cgcaguaacgucgucg

SEQ ID NO: 3211397 - RNA, 17 nt, Mycobacterium bovis subsp bovis AF2122/97
cgcaguaacgucgucgc

SEQ ID NO: 3211398 - RNA, 23 nt, Mycobacterium bovis subsp bovis AF2122/97
cgcaguacuugaccguccaccga

SEQ ID NO: 3211399 - RNA, 18 nt, Mycobacterium bovis subsp bovis AF2122/97
cgcaguagccgaccagga

SEQ ID NO: 3211400 - RNA, 19 nt, Mycobacterium bovis subsp bovis AF2122/97
cgcaguagccgaccaggac

SEQ ID NO: 3211401 - RNA, 20 nt, Mycobacterium bovis subsp bovis AF2122/97
cgcaguagccgaccaggacc

SEQ ID NO: 3211402 - RNA, 21 nt, Mycobacterium bovis subsp bovis AF2122/97
cgcaguauucacagucgcucg

SEQ ID NO: 3211403 - RNA, 18 nt, Mycobacterium bovis subsp bovis AF2122/97
cgcagucaacgcaaucga

SEQ ID NO: 3211404 - RNA, 23 nt, Mycobacterium bovis subsp bovis AF2122/97
cgcagucccgaacaauucacgca

SEQ ID NO: 3211405 - RNA, 16 nt, Mycobacterium bovis subsp bovis AF2122/97
cgcaguccggggcgca

SEQ ID NO: 3211406 - RNA, 19 nt, Mycobacterium bovis subsp bovis AF2122/97
cgcaguccgguuacgcucg

SEQ ID NO: 3211407 - RNA, 21 nt, Mycobacterium bovis subsp bovis AF2122/97
cgcaguccgguuacgcucgcg

SEQ ID NO: 3211408 - RNA, 22 nt, Mycobacterium bovis subsp bovis AF2122/97
cgcagucgaugagugacggucc

SEQ ID NO: 3211409 - RNA, 15 nt, Mycobacterium bovis subsp bovis AF2122/97
cgcagucgcggcaga

SEQ ID NO: 3211410 - RNA, 14 nt, Mycobacterium bovis subsp bovis AF2122/97
cgcagucgcugggu

SEQ ID NO: 3211411 - RNA, 15 nt, Mycobacterium bovis subsp bovis AF2122/97
cgcagucgggcagcg

SEQ ID NO: 3211412 - RNA, 17 nt, Mycobacterium bovis subsp bovis AF2122/97
cgcagucggucacgcgg

SEQ ID NO: 3211413 - RNA, 19 nt, Mycobacterium bovis subsp bovis AF2122/97
cgcagucggucacgcgggg

SEQ ID NO: 3211414 - RNA, 13 nt, Mycobacterium bovis subsp bovis AF2122/97
cgcagucugacga

SEQ ID NO: 3211415 - RNA, 23 nt, Mycobacterium bovis subsp bovis AF2122/97
cgcagucuuguugcuuugcuggc

SEQ ID NO: 3211416 - RNA, 22 nt, Mycobacterium bovis subsp bovis AF2122/97
cgcagugacguuccgcucgccg

SEQ ID NO: 3211417 - RNA, 23 nt, Mycobacterium bovis subsp bovis AF2122/97
cgcagugacguuuguuggcuguc

SEQ ID NO: 3211418 - RNA, 14 nt, Mycobacterium bovis subsp bovis AF2122/97
cgcagugagcagcc

SEQ ID NO: 3211419 - RNA, 17 nt, Mycobacterium bovis subsp bovis AF2122/97
cgcagugagcagccgga

SEQ ID NO: 3211420 - RNA, 14 nt, Mycobacterium bovis subsp bovis AF2122/97
cgcagugcaccgcg

SEQ ID NO: 3211421 - RNA, 17 nt, Mycobacterium bovis subsp bovis AF2122/97
cgcagugcaccgcgucg

SEQ ID NO: 3211422 - RNA, 20 nt, Mycobacterium bovis subsp bovis AF2122/97
cgcagugcaccgcgucguag

SEQ ID NO: 3211423 - RNA, 20 nt, Mycobacterium bovis subsp bovis AF2122/97
cgcagugcccgaucgcuucc

SEQ ID NO: 3211424 - RNA, 20 nt, Mycobacterium bovis subsp bovis AF2122/97
cgcaguggagggcccggccg

SEQ ID NO: 3211425 - RNA, 22 nt, Mycobacterium bovis subsp bovis AF2122/97
cgcaguggcguuacgcucggcg

SEQ ID NO: 3211426 - RNA, 16 nt, Mycobacterium bovis subsp bovis AF2122/97
cgcaguucggucagcg

SEQ ID NO: 3211427 - RNA, 19 nt, Mycobacterium bovis subsp bovis AF2122/97
cgcaguucggucgucucgg

SEQ ID NO: 3211428 - RNA, 15 nt, Mycobacterium bovis subsp bovis AF2122/97
cgcaguuggcaccag

SEQ ID NO: 3211429 - RNA, 21 nt, Mycobacterium bovis subsp bovis AF2122/97
cgcaguuggcaccagccggug

SEQ ID NO: 3211430 - RNA, 17 nt, Mycobacterium bovis subsp bovis AF2122/97
cgcaguuuggcggcgcg

SEQ ID NO: 3211431 - RNA, 19 nt, Mycobacterium bovis subsp bovis AF2122/97
cgcaguuuggcggcgcgca

SEQ ID NO: 3211432 - RNA, 21 nt, Mycobacterium bovis subsp bovis AF2122/97
cgcaguuuggcggcgcgcagc

SEQ ID NO: 3211433 - RNA, 19 nt, Mycobacterium bovis subsp bovis AF2122/97
cgcauaacgcgaacccgcg

SEQ ID NO: 3211434 - RNA, 12 nt, Mycobacterium bovis subsp bovis AF2122/97
cgcauaagcccc

SEQ ID NO: 3211435 - RNA, 14 nt, Mycobacterium bovis subsp bovis AF2122/97
cgcauaagcccccg

SEQ ID NO: 3211436 - RNA, 23 nt, Mycobacterium bovis subsp bovis AF2122/97
cgcauacacgagguagccgacga

SEQ ID NO: 3211437 - RNA, 21 nt, Mycobacterium bovis subsp bovis AF2122/97
cgcauacgcggcuuugacgcc

SEQ ID NO: 3211438 - RNA, 22 nt, Mycobacterium bovis subsp bovis AF2122/97
cgcauacgcggcuuugacgccc

SEQ ID NO: 3211439 - RNA, 15 nt, Mycobacterium bovis subsp bovis AF2122/97
cgcauaggccccgcc

SEQ ID NO: 3211440 - RNA, 15 nt, Mycobacterium bovis subsp bovis AF2122/97
cgcauagggccaccg

SEQ ID NO: 3211441 - RNA, 15 nt, Mycobacterium bovis subsp bovis AF2122/97
cgcauagugcggcug

SEQ ID NO: 3211442 - RNA, 19 nt, Mycobacterium bovis subsp bovis AF2122/97
cgcauauugcggcgccgug

SEQ ID NO: 3211443 - RNA, 19 nt, Mycobacterium bovis subsp bovis AF2122/97
cgcaucaccacccgaccgc

SEQ ID NO: 3211444 - RNA, 13 nt, Mycobacterium bovis subsp bovis AF2122/97
cgcaucaccacug

SEQ ID NO: 3211445 - RNA, 22 nt, Mycobacterium bovis subsp bovis AF2122/97
cgcaucacccgggaugaccacc

SEQ ID NO: 3211446 - RNA, 23 nt, Mycobacterium bovis subsp bovis AF2122/97
cgcaucacccgggaugaccaccg

SEQ ID NO: 3211447 - RNA, 14 nt, Mycobacterium bovis subsp bovis AF2122/97
cgcaucagcgguac

SEQ ID NO: 3211448 - RNA, 17 nt, Mycobacterium bovis subsp bovis AF2122/97
cgcaucagggugggcga

SEQ ID NO: 3211449 - RNA, 21 nt, Mycobacterium bovis subsp bovis AF2122/97
cgcaucauagacagggccgcu

SEQ ID NO: 3211450 - RNA, 15 nt, Mycobacterium bovis subsp bovis AF2122/97
cgcauccagccgugc

SEQ ID NO: 3211451 - RNA, 23 nt, Mycobacterium bovis subsp bovis AF2122/97
cgcauccagccgugcggcggcug

SEQ ID NO: 3211452 - RNA, 15 nt, Mycobacterium bovis subsp bovis AF2122/97
cgcauccccagcaca

SEQ ID NO: 3211453 - RNA, 21 nt, Mycobacterium bovis subsp bovis AF2122/97
cgcaucccgaaguagaagccc

SEQ ID NO: 3211454 - RNA, 14 nt, Mycobacterium bovis subsp bovis AF2122/97
cgcauccgcaccga

SEQ ID NO: 3211455 - RNA, 12 nt, Mycobacterium bovis subsp bovis AF2122/97
cgcauccgcgac

SEQ ID NO: 3211456 - RNA, 13 nt, Mycobacterium bovis subsp bovis AF2122/97
cgcauccgcgacg

SEQ ID NO: 3211457 - RNA, 15 nt, Mycobacterium bovis subsp bovis AF2122/97
cgcauccgcgacggc

SEQ ID NO: 3211458 - RNA, 17 nt, Mycobacterium bovis subsp bovis AF2122/97
cgcauccgcgacggcgc

SEQ ID NO: 3211459 - RNA, 19 nt, Mycobacterium bovis subsp bovis AF2122/97
cgcauccgcgacggcgccc

SEQ ID NO: 3211460 - RNA, 16 nt, Mycobacterium bovis subsp bovis AF2122/97
cgcauccggcaagccg

SEQ ID NO: 3211461 - RNA, 18 nt, Mycobacterium bovis subsp bovis AF2122/97
cgcauccggucucggccg

SEQ ID NO: 3211462 - RNA, 23 nt, Mycobacterium bovis subsp bovis AF2122/97
cgcauccgguuuggucgccgcgu

SEQ ID NO: 3211463 - RNA, 16 nt, Mycobacterium bovis subsp bovis AF2122/97
cgcaucgacgugcgcg

SEQ ID NO: 3211464 - RNA, 17 nt, Mycobacterium bovis subsp bovis AF2122/97
cgcaucgacgugcgcgg

SEQ ID NO: 3211465 - RNA, 20 nt, Mycobacterium bovis subsp bovis AF2122/97
cgcaucgacgugcgcggcau

SEQ ID NO: 3211466 - RNA, 15 nt, Mycobacterium bovis subsp bovis AF2122/97
cgcaucgagcaccuc

SEQ ID NO: 3211467 - RNA, 21 nt, Mycobacterium bovis subsp bovis AF2122/97
cgcaucgagcccggacgagug

SEQ ID NO: 3211468 - RNA, 15 nt, Mycobacterium bovis subsp bovis AF2122/97
cgcaucgcacgggcc

SEQ ID NO: 3211469 - RNA, 19 nt, Mycobacterium bovis subsp bovis AF2122/97
cgcaucgcacgggccacca

SEQ ID NO: 3211470 - RNA, 21 nt, Mycobacterium bovis subsp bovis AF2122/97
cgcaucgcacgggccaccagc

SEQ ID NO: 3211471 - RNA, 22 nt, Mycobacterium bovis subsp bovis AF2122/97
cgcaucgcacgggccaccagcg

SEQ ID NO: 3211472 - RNA, 11 nt, Mycobacterium bovis subsp bovis AF2122/97
cgcaucgccaa

SEQ ID NO: 3211473 - RNA, 12 nt, Mycobacterium bovis subsp bovis AF2122/97
cgcaucgccaau

SEQ ID NO: 3211474 - RNA, 13 nt, Mycobacterium bovis subsp bovis AF2122/97
cgcaucgccacca

SEQ ID NO: 3211475 - RNA, 22 nt, Mycobacterium bovis subsp bovis AF2122/97
cgcaucgccaccaucaccgccu

SEQ ID NO: 3211476 - RNA, 15 nt, Mycobacterium bovis subsp bovis AF2122/97
cgcaucgccgacagc

SEQ ID NO: 3211477 - RNA, 22 nt, Mycobacterium bovis subsp bovis AF2122/97
cgcaucgccgcuggccagcaca

SEQ ID NO: 3211478 - RNA, 21 nt, Mycobacterium bovis subsp bovis AF2122/97
cgcaucgccuccucgacgucg

SEQ ID NO: 3211479 - RNA, 22 nt, Mycobacterium bovis subsp bovis AF2122/97
cgcaucgccuccucgacgucgg

SEQ ID NO: 3211480 - RNA, 16 nt, Mycobacterium bovis subsp bovis AF2122/97
cgcaucgccucgaggu

SEQ ID NO: 3211481 - RNA, 13 nt, Mycobacterium bovis subsp bovis AF2122/97
cgcaucgcggccg

SEQ ID NO: 3211482 - RNA, 17 nt, Mycobacterium bovis subsp bovis AF2122/97
cgcaucggauggccccc

SEQ ID NO: 3211483 - RNA, 19 nt, Mycobacterium bovis subsp bovis AF2122/97
cgcaucggccaacaccacu

SEQ ID NO: 3211484 - RNA, 13 nt, Mycobacterium bovis subsp bovis AF2122/97
cgcaucggccccc

SEQ ID NO: 3211485 - RNA, 20 nt, Mycobacterium bovis subsp bovis AF2122/97
cgcaucggcccccaacgcgg

SEQ ID NO: 3211486 - RNA, 16 nt, Mycobacterium bovis subsp bovis AF2122/97
cgcaucggcgaacaac

SEQ ID NO: 3211487 - RNA, 19 nt, Mycobacterium bovis subsp bovis AF2122/97
cgcaucggcgccagaucga

SEQ ID NO: 3211488 - RNA, 23 nt, Mycobacterium bovis subsp bovis AF2122/97
cgcaucgggcauuucguggcacg

SEQ ID NO: 3211489 - RNA, 14 nt, Mycobacterium bovis subsp bovis AF2122/97
cgcaucgucagcga

SEQ ID NO: 3211490 - RNA, 18 nt, Mycobacterium bovis subsp bovis AF2122/97
cgcaucgucgaaagccug

SEQ ID NO: 3211491 - RNA, 22 nt, Mycobacterium bovis subsp bovis AF2122/97
cgcaucugcucggcaucgagca

SEQ ID NO: 3211492 - RNA, 16 nt, Mycobacterium bovis subsp bovis AF2122/97
cgcaucuggccggcgg

SEQ ID NO: 3211493 - RNA, 16 nt, Mycobacterium bovis subsp bovis AF2122/97
cgcaucugucgcgcgg

SEQ ID NO: 3211494 - RNA, 14 nt, Mycobacterium bovis subsp bovis AF2122/97
cgcaugacgccggc

SEQ ID NO: 3211495 - RNA, 16 nt, Mycobacterium bovis subsp bovis AF2122/97
cgcaugaucgcaccga

SEQ ID NO: 3211496 - RNA, 18 nt, Mycobacterium bovis subsp bovis AF2122/97
cgcaugaucgcaccgagg

SEQ ID NO: 3211497 - RNA, 13 nt, Mycobacterium bovis subsp bovis AF2122/97
cgcaugccacggc

SEQ ID NO: 3211498 - RNA, 12 nt, Mycobacterium bovis subsp bovis AF2122/97
cgcaugccccga

SEQ ID NO: 3211499 - RNA, 21 nt, Mycobacterium bovis subsp bovis AF2122/97
cgcaugccccgaccgcguaca

SEQ ID NO: 3211500 - RNA, 14 nt, Mycobacterium bovis subsp bovis AF2122/97
cgcaugccggcgca

SEQ ID NO: 3211501 - RNA, 17 nt, Mycobacterium bovis subsp bovis AF2122/97
cgcaugccggcgcacca

SEQ ID NO: 3211502 - RNA, 19 nt, Mycobacterium bovis subsp bovis AF2122/97
cgcaugccggcgcaccaca

SEQ ID NO: 3211503 - RNA, 16 nt, Mycobacterium bovis subsp bovis AF2122/97
cgcaugcgcgcgccgg

SEQ ID NO: 3211504 - RNA, 19 nt, Mycobacterium bovis subsp bovis AF2122/97
cgcaugcgcgcgccggugc

SEQ ID NO: 3211505 - RNA, 19 nt, Mycobacterium bovis subsp bovis AF2122/97
cgcaugcgcuccggcgcga

SEQ ID NO: 3211506 - RNA, 18 nt, Mycobacterium bovis subsp bovis AF2122/97
cgcaugcguaugcccacg

SEQ ID NO: 3211507 - RNA, 18 nt, Mycobacterium bovis subsp bovis AF2122/97
cgcaugcucagcaucguc

SEQ ID NO: 3211508 - RNA, 20 nt, Mycobacterium bovis subsp bovis AF2122/97
cgcaugcucagcaucgucga

SEQ ID NO: 3211509 - RNA, 14 nt, Mycobacterium bovis subsp bovis AF2122/97
cgcaugcucgaucg

SEQ ID NO: 3211510 - RNA, 17 nt, Mycobacterium bovis subsp bovis AF2122/97
cgcaugcucgaucgcgu

SEQ ID NO: 3211511 - RNA, 19 nt, Mycobacterium bovis subsp bovis AF2122/97
cgcauggacaacagcuugg

SEQ ID NO: 3211512 - RNA, 18 nt, Mycobacterium bovis subsp bovis AF2122/97
cgcauggacgcgaugacc

SEQ ID NO: 3211513 - RNA, 22 nt, Mycobacterium bovis subsp bovis AF2122/97
cgcaugggucauggcgcuggga

SEQ ID NO: 3211514 - RNA, 12 nt, Mycobacterium bovis subsp bovis AF2122/97
cgcauggucgac

SEQ ID NO: 3211515 - RNA, 14 nt, Mycobacterium bovis subsp bovis AF2122/97
cgcauggucgacga

SEQ ID NO: 3211516 - RNA, 20 nt, Mycobacterium bovis subsp bovis AF2122/97
cgcauggugggugccggcgu

SEQ ID NO: 3211517 - RNA, 17 nt, Mycobacterium bovis subsp bovis AF2122/97
cgcauggugguggguga

SEQ ID NO: 3211518 - RNA, 19 nt, Mycobacterium bovis subsp bovis AF2122/97
cgcaugucgauccggcgcc

SEQ ID NO: 3211519 - RNA, 21 nt, Mycobacterium bovis subsp bovis AF2122/97
cgcaugucggacacguggcgu

SEQ ID NO: 3211520 - RNA, 19 nt, Mycobacterium bovis subsp bovis AF2122/97
cgcaugugaaagacaaccc

SEQ ID NO: 3211521 - RNA, 15 nt, Mycobacterium bovis subsp bovis AF2122/97
cgcauguucuccacg

SEQ ID NO: 3211522 - RNA, 17 nt, Mycobacterium bovis subsp bovis AF2122/97
cgcauguucuccacgcc

SEQ ID NO: 3211523 - RNA, 18 nt, Mycobacterium bovis subsp bovis AF2122/97
cgcauguucuccacgccg

SEQ ID NO: 3211524 - RNA, 14 nt, Mycobacterium bovis subsp bovis AF2122/97
cgcauuagccugcg

SEQ ID NO: 3211525 - RNA, 18 nt, Mycobacterium bovis subsp bovis AF2122/97
cgcauuccggcgccagga

SEQ ID NO: 3211526 - RNA, 14 nt, Mycobacterium bovis subsp bovis AF2122/97
cgcauucgccgggc

SEQ ID NO: 3211527 - RNA, 15 nt, Mycobacterium bovis subsp bovis AF2122/97
cgcauucgccgggcg

SEQ ID NO: 3211528 - RNA, 19 nt, Mycobacterium bovis subsp bovis AF2122/97
cgcauucggacgccacgga

SEQ ID NO: 3211529 - RNA, 16 nt, Mycobacterium bovis subsp bovis AF2122/97
cgcauucguggagccg

SEQ ID NO: 3211530 - RNA, 20 nt, Mycobacterium bovis subsp bovis AF2122/97
cgcauucguggagccggccg

SEQ ID NO: 3211531 - RNA, 22 nt, Mycobacterium bovis subsp bovis AF2122/97
cgcauucguggagccggccgug

SEQ ID NO: 3211532 - RNA, 22 nt, Mycobacterium bovis subsp bovis AF2122/97
cgcauugaacagcggaucccgc

SEQ ID NO: 3211533 - RNA, 21 nt, Mycobacterium bovis subsp bovis AF2122/97
cgcauugagcuggcgcccggg

SEQ ID NO: 3211534 - RNA, 16 nt, Mycobacterium bovis subsp bovis AF2122/97
cgcauugcagaaccgc

SEQ ID NO: 3211535 - RNA, 20 nt, Mycobacterium bovis subsp bovis AF2122/97
cgcauugcagcguccccaug

SEQ ID NO: 3211536 - RNA, 19 nt, Mycobacterium bovis subsp bovis AF2122/97
cgcauugccgacgcgcggc

SEQ ID NO: 3211537 - RNA, 20 nt, Mycobacterium bovis subsp bovis AF2122/97
cgcauugccgacgcgcggcc

SEQ ID NO: 3211538 - RNA, 23 nt, Mycobacterium bovis subsp bovis AF2122/97
cgcauuguugaagaaagcggccg

SEQ ID NO: 3211539 - RNA, 18 nt, Mycobacterium bovis subsp bovis AF2122/97
cgcauuucgacgagacga

SEQ ID NO: 3211540 - RNA, 17 nt, Mycobacterium bovis subsp bovis AF2122/97
cgcauuucggaucucga

SEQ ID NO: 3211541 - RNA, 17 nt, Mycobacterium bovis subsp bovis AF2122/97
cgcauuucguggcgcgc

SEQ ID NO: 3211542 - RNA, 20 nt, Mycobacterium bovis subsp bovis AF2122/97
cgcauuuguugcugcugccg

SEQ ID NO: 3211543 - RNA, 20 nt, Mycobacterium bovis subsp bovis AF2122/97
cgcauuuuccacauccuggc

SEQ ID NO: 3211544 - RNA, 18 nt, Mycobacterium bovis subsp bovis AF2122/97
cgcauuuuucgccagcug

SEQ ID NO: 3211545 - RNA, 17 nt, Mycobacterium bovis subsp bovis AF2122/97
cgccaaaaacgccccgg

SEQ ID NO: 3211546 - RNA, 15 nt, Mycobacterium bovis subsp bovis AF2122/97
cgccaaaacggucga

SEQ ID NO: 3211547 - RNA, 19 nt, Mycobacterium bovis subsp bovis AF2122/97
cgccaaaacggucgaccgu

SEQ ID NO: 3211548 - RNA, 21 nt, Mycobacterium bovis subsp bovis AF2122/97
cgccaaaaguacuggcguugc

SEQ ID NO: 3211549 - RNA, 10 nt, Mycobacterium bovis subsp bovis AF2122/97
cgccaaaauc

SEQ ID NO: 3211550 - RNA, 23 nt, Mycobacterium bovis subsp bovis AF2122/97
cgccaaaauccgcccaccggucg

SEQ ID NO: 3211551 - RNA, 15 nt, Mycobacterium bovis subsp bovis AF2122/97
cgccaaacaccccgg

SEQ ID NO: 3211552 - RNA, 23 nt, Mycobacterium bovis subsp bovis AF2122/97
cgccaaacccaugucggcgcgcc

SEQ ID NO: 3211553 - RNA, 24 nt, Mycobacterium bovis subsp bovis AF2122/97
cgccaaacccaugucggcgcgccg

SEQ ID NO: 3211554 - RNA, 14 nt, Mycobacterium bovis subsp bovis AF2122/97
cgccaaacccggcg

SEQ ID NO: 3211555 - RNA, 23 nt, Mycobacterium bovis subsp bovis AF2122/97
cgccaaaccuggguuugcacggc

SEQ ID NO: 3211556 - RNA, 14 nt, Mycobacterium bovis subsp bovis AF2122/97
cgccaaacgcugcg

SEQ ID NO: 3211557 - RNA, 18 nt, Mycobacterium bovis subsp bovis AF2122/97
cgccaaacgcugcgcccg

SEQ ID NO: 3211558 - RNA, 20 nt, Mycobacterium bovis subsp bovis AF2122/97
cgccaaacgcugcgcccgga

SEQ ID NO: 3211559 - RNA, 21 nt, Mycobacterium bovis subsp bovis AF2122/97
cgccaaauccggugcccgcac

SEQ ID NO: 3211560 - RNA, 20 nt, Mycobacterium bovis subsp bovis AF2122/97
cgccaacaacuucucgucga

SEQ ID NO: 3211561 - RNA, 14 nt, Mycobacterium bovis subsp bovis AF2122/97
cgccaacaccaacc

SEQ ID NO: 3211562 - RNA, 18 nt, Mycobacterium bovis subsp bovis AF2122/97
cgccaacaccaaccagug

SEQ ID NO: 3211563 - RNA, 18 nt, Mycobacterium bovis subsp bovis AF2122/97
cgccaacaucuccgcguc

SEQ ID NO: 3211564 - RNA, 19 nt, Mycobacterium bovis subsp bovis AF2122/97
cgccaacaucuccgcgucg

SEQ ID NO: 3211565 - RNA, 20 nt, Mycobacterium bovis subsp bovis AF2122/97
cgccaacaucuccgcgucgg

SEQ ID NO: 3211566 - RNA, 20 nt, Mycobacterium bovis subsp bovis AF2122/97
cgccaaccacuuuccggccg

SEQ ID NO: 3211567 - RNA, 17 nt, Mycobacterium bovis subsp bovis AF2122/97
cgccaaccccaacaucc

SEQ ID NO: 3211568 - RNA, 14 nt, Mycobacterium bovis subsp bovis AF2122/97
cgccaacccggcca

SEQ ID NO: 3211569 - RNA, 15 nt, Mycobacterium bovis subsp bovis AF2122/97
cgccaaccgcaggcc

SEQ ID NO: 3211570 - RNA, 17 nt, Mycobacterium bovis subsp bovis AF2122/97
cgccaaccgugcgcacu

SEQ ID NO: 3211571 - RNA, 21 nt, Mycobacterium bovis subsp bovis AF2122/97
cgccaacgccaaaacggucga

SEQ ID NO: 3211572 - RNA, 15 nt, Mycobacterium bovis subsp bovis AF2122/97
cgccaacgccagcac

SEQ ID NO: 3211573 - RNA, 19 nt, Mycobacterium bovis subsp bovis AF2122/97
cgccaacgcccccauccgg

SEQ ID NO: 3211574 - RNA, 15 nt, Mycobacterium bovis subsp bovis AF2122/97
cgccaacgugacgcc

SEQ ID NO: 3211575 - RNA, 17 nt, Mycobacterium bovis subsp bovis AF2122/97
cgccaacgugacgccgg

SEQ ID NO: 3211576 - RNA, 22 nt, Mycobacterium bovis subsp bovis AF2122/97
cgccaacguugcgccagcggug

SEQ ID NO: 3211577 - RNA, 20 nt, Mycobacterium bovis subsp bovis AF2122/97
cgccaacuccucagccgccu

SEQ ID NO: 3211578 - RNA, 15 nt, Mycobacterium bovis subsp bovis AF2122/97
cgccaacuucaccac

SEQ ID NO: 3211579 - RNA, 18 nt, Mycobacterium bovis subsp bovis AF2122/97
cgccaacuucaccacccu

SEQ ID NO: 3211580 - RNA, 19 nt, Mycobacterium bovis subsp bovis AF2122/97
cgccaacuucaccacccug

SEQ ID NO: 3211581 - RNA, 22 nt, Mycobacterium bovis subsp bovis AF2122/97
cgccaacuugcgagguaagcga

SEQ ID NO: 3211582 - RNA, 13 nt, Mycobacterium bovis subsp bovis AF2122/97
cgccaagacgucg

SEQ ID NO: 3211583 - RNA, 21 nt, Mycobacterium bovis subsp bovis AF2122/97
cgccaagacgucggcgugguc

SEQ ID NO: 3211584 - RNA, 15 nt, Mycobacterium bovis subsp bovis AF2122/97
cgccaagaucgggug

SEQ ID NO: 3211585 - RNA, 20 nt, Mycobacterium bovis subsp bovis AF2122/97
cgccaagaucggguggcggg

SEQ ID NO: 3211586 - RNA, 14 nt, Mycobacterium bovis subsp bovis AF2122/97
cgccaagcucggcc

SEQ ID NO: 3211587 - RNA, 13 nt, Mycobacterium bovis subsp bovis AF2122/97
cgccaaggcgaug

SEQ ID NO: 3211588 - RNA, 14 nt, Mycobacterium bovis subsp bovis AF2122/97
cgccaagggccccu

SEQ ID NO: 3211589 - RNA, 15 nt, Mycobacterium bovis subsp bovis AF2122/97
cgccaaguacgcgac

SEQ ID NO: 3211590 - RNA, 17 nt, Mycobacterium bovis subsp bovis AF2122/97
cgccaaguacgcgaccg

SEQ ID NO: 3211591 - RNA, 19 nt, Mycobacterium bovis subsp bovis AF2122/97
cgccaaguccgcucaccuu

SEQ ID NO: 3211592 - RNA, 21 nt, Mycobacterium bovis subsp bovis AF2122/97
cgccaaguccgcucaccuuug

SEQ ID NO: 3211593 - RNA, 13 nt, Mycobacterium bovis subsp bovis AF2122/97
cgccaagucucgg

SEQ ID NO: 3211594 - RNA, 14 nt, Mycobacterium bovis subsp bovis AF2122/97
cgccaagugcaggg

SEQ ID NO: 3211595 - RNA, 19 nt, Mycobacterium bovis subsp bovis AF2122/97
cgccaagugcagggcugcu

SEQ ID NO: 3211596 - RNA, 12 nt, Mycobacterium bovis subsp bovis AF2122/97
cgccaauccacc

SEQ ID NO: 3211597 - RNA, 18 nt, Mycobacterium bovis subsp bovis AF2122/97
cgccaauccaccggugcc

SEQ ID NO: 3211598 - RNA, 21 nt, Mycobacterium bovis subsp bovis AF2122/97
cgccaaucgaguagcugaccg

SEQ ID NO: 3211599 - RNA, 22 nt, Mycobacterium bovis subsp bovis AF2122/97
cgccaaucugcgcgaggggccg

SEQ ID NO: 3211600 - RNA, 15 nt, Mycobacterium bovis subsp bovis AF2122/97
cgccaaugccgcgga

SEQ ID NO: 3211601 - RNA, 18 nt, Mycobacterium bovis subsp bovis AF2122/97
cgccaaugccgcggaggc

SEQ ID NO: 3211602 - RNA, 13 nt, Mycobacterium bovis subsp bovis AF2122/97
cgccaauggcgcg

SEQ ID NO: 3211603 - RNA, 23 nt, Mycobacterium bovis subsp bovis AF2122/97
cgccaauuacagcuugcgcagcc

SEQ ID NO: 3211604 - RNA, 18 nt, Mycobacterium bovis subsp bovis AF2122/97
cgccaauugugcugaccg

SEQ ID NO: 3211605 - RNA, 17 nt, Mycobacterium bovis subsp bovis AF2122/97
cgccacaaacccgauga

SEQ ID NO: 3211606 - RNA, 14 nt, Mycobacterium bovis subsp bovis AF2122/97
cgccacaccaacgu

SEQ ID NO: 3211607 - RNA, 13 nt, Mycobacterium bovis subsp bovis AF2122/97
cgccacaccauga

SEQ ID NO: 3211608 - RNA, 14 nt, Mycobacterium bovis subsp bovis AF2122/97
cgccacaccaugau

SEQ ID NO: 3211609 - RNA, 20 nt, Mycobacterium bovis subsp bovis AF2122/97
cgccacaccaugauugccag

SEQ ID NO: 3211610 - RNA, 23 nt, Mycobacterium bovis subsp bovis AF2122/97
cgccacaccaugauugccaggac

SEQ ID NO: 3211611 - RNA, 22 nt, Mycobacterium bovis subsp bovis AF2122/97
cgccacacccaaaccggcccgc

SEQ ID NO: 3211612 - RNA, 22 nt, Mycobacterium bovis subsp bovis AF2122/97
cgccacaccggggcggccgacc

SEQ ID NO: 3211613 - RNA, 14 nt, Mycobacterium bovis subsp bovis AF2122/97
cgccacacggggcc

SEQ ID NO: 3211614 - RNA, 15 nt, Mycobacterium bovis subsp bovis AF2122/97
cgccacacggggccg

SEQ ID NO: 3211615 - RNA, 17 nt, Mycobacterium bovis subsp bovis AF2122/97
cgccacacggggccgcc

SEQ ID NO: 3211616 - RNA, 18 nt, Mycobacterium bovis subsp bovis AF2122/97
cgccacacggggccgcca

SEQ ID NO: 3211617 - RNA, 20 nt, Mycobacterium bovis subsp bovis AF2122/97
cgccacacggggccgccagc

SEQ ID NO: 3211618 - RNA, 18 nt, Mycobacterium bovis subsp bovis AF2122/97
cgccacacucccgcgccc

SEQ ID NO: 3211619 - RNA, 16 nt, Mycobacterium bovis subsp bovis AF2122/97
cgccacagcacccacg

SEQ ID NO: 3211620 - RNA, 19 nt, Mycobacterium bovis subsp bovis AF2122/97
cgccacagcagcguugacg

SEQ ID NO: 3211621 - RNA, 16 nt, Mycobacterium bovis subsp bovis AF2122/97
cgccacagccguauug

SEQ ID NO: 3211622 - RNA, 15 nt, Mycobacterium bovis subsp bovis AF2122/97
cgccacagucgucga

SEQ ID NO: 3211623 - RNA, 19 nt, Mycobacterium bovis subsp bovis AF2122/97
cgccacauacaccggccgg

SEQ ID NO: 3211624 - RNA, 22 nt, Mycobacterium bovis subsp bovis AF2122/97
cgccacauacaccggccggucc

SEQ ID NO: 3211625 - RNA, 13 nt, Mycobacterium bovis subsp bovis AF2122/97
cgccaccaaaucc

SEQ ID NO: 3211626 - RNA, 23 nt, Mycobacterium bovis subsp bovis AF2122/97
cgccaccacaugcgagucgcacu

SEQ ID NO: 3211627 - RNA, 16 nt, Mycobacterium bovis subsp bovis AF2122/97
cgccaccaccagggca

SEQ ID NO: 3211628 - RNA, 14 nt, Mycobacterium bovis subsp bovis AF2122/97
cgccaccacccagg

SEQ ID NO: 3211629 - RNA, 18 nt, Mycobacterium bovis subsp bovis AF2122/97
cgccaccacccaggccau

SEQ ID NO: 3211630 - RNA, 16 nt, Mycobacterium bovis subsp bovis AF2122/97
cgccaccaccccgucg

SEQ ID NO: 3211631 - RNA, 13 nt, Mycobacterium bovis subsp bovis AF2122/97
cgccaccacccgg

SEQ ID NO: 3211632 - RNA, 13 nt, Mycobacterium bovis subsp bovis AF2122/97
cgccaccaccggc

SEQ ID NO: 3211633 - RNA, 14 nt, Mycobacterium bovis subsp bovis AF2122/97
cgccaccaccggcg

SEQ ID NO: 3211634 - RNA, 15 nt, Mycobacterium bovis subsp bovis AF2122/97
cgccaccaccggcgc

SEQ ID NO: 3211635 - RNA, 12 nt, Mycobacterium bovis subsp bovis AF2122/97
cgccaccaccuc

SEQ ID NO: 3211636 - RNA, 13 nt, Mycobacterium bovis subsp bovis AF2122/97
cgccaccacgccg

SEQ ID NO: 3211637 - RNA, 21 nt, Mycobacterium bovis subsp bovis AF2122/97
cgccaccacgccgucgacaac

SEQ ID NO: 3211638 - RNA, 23 nt, Mycobacterium bovis subsp bovis AF2122/97
cgccaccacggucaagccggcgc

SEQ ID NO: 3211639 - RNA, 15 nt, Mycobacterium bovis subsp bovis AF2122/97
cgccaccagcaccgc

SEQ ID NO: 3211640 - RNA, 16 nt, Mycobacterium bovis subsp bovis AF2122/97
cgccaccagggcggcc

SEQ ID NO: 3211641 - RNA, 17 nt, Mycobacterium bovis subsp bovis AF2122/97
cgccaccagggcggccu

SEQ ID NO: 3211642 - RNA, 13 nt, Mycobacterium bovis subsp bovis AF2122/97
cgccaccaucccc

SEQ ID NO: 3211643 - RNA, 23 nt, Mycobacterium bovis subsp bovis AF2122/97
cgccaccauccccggcaacaaag

SEQ ID NO: 3211644 - RNA, 13 nt, Mycobacterium bovis subsp bovis AF2122/97
cgccaccaucguu

SEQ ID NO: 3211645 - RNA, 17 nt, Mycobacterium bovis subsp bovis AF2122/97
cgccaccaucguugccg

SEQ ID NO: 3211646 - RNA, 17 nt, Mycobacterium bovis subsp bovis AF2122/97
cgccacccagcaccagg

SEQ ID NO: 3211647 - RNA, 19 nt, Mycobacterium bovis subsp bovis AF2122/97
cgccacccccaaccgccgg

SEQ ID NO: 3211648 - RNA, 20 nt, Mycobacterium bovis subsp bovis AF2122/97
cgccacccccaccgucgcgg

SEQ ID NO: 3211649 - RNA, 15 nt, Mycobacterium bovis subsp bovis AF2122/97
cgccaccccgcgcgc

SEQ ID NO: 3211650 - RNA, 17 nt, Mycobacterium bovis subsp bovis AF2122/97
cgccaccccgcgcgcca

SEQ ID NO: 3211651 - RNA, 19 nt, Mycobacterium bovis subsp bovis AF2122/97
cgccaccccgcgcgccagc

SEQ ID NO: 3211652 - RNA, 23 nt, Mycobacterium bovis subsp bovis AF2122/97
cgccaccccgcguaugccaggac

SEQ ID NO: 3211653 - RNA, 18 nt, Mycobacterium bovis subsp bovis AF2122/97
cgccacccgaucgggcgu

SEQ ID NO: 3211654 - RNA, 18 nt, Mycobacterium bovis subsp bovis AF2122/97
cgccacccgcgccgcccg

SEQ ID NO: 3211655 - RNA, 19 nt, Mycobacterium bovis subsp bovis AF2122/97
cgccacccgcgccgcccgc

SEQ ID NO: 3211656 - RNA, 21 nt, Mycobacterium bovis subsp bovis AF2122/97
cgccacccgcgccgcccgcuc

SEQ ID NO: 3211657 - RNA, 14 nt, Mycobacterium bovis subsp bovis AF2122/97
cgccacccgcguca

SEQ ID NO: 3211658 - RNA, 12 nt, Mycobacterium bovis subsp bovis AF2122/97
cgccacccggcg

SEQ ID NO: 3211659 - RNA, 13 nt, Mycobacterium bovis subsp bovis AF2122/97
cgccacccggcgg

SEQ ID NO: 3211660 - RNA, 20 nt, Mycobacterium bovis subsp bovis AF2122/97
cgccacccggcgggcggugg

SEQ ID NO: 3211661 - RNA, 11 nt, Mycobacterium bovis subsp bovis AF2122/97
cgccacccggu

SEQ ID NO: 3211662 - RNA, 19 nt, Mycobacterium bovis subsp bovis AF2122/97
cgccacccgguccggcccg

SEQ ID NO: 3211663 - RNA, 21 nt, Mycobacterium bovis subsp bovis AF2122/97
cgccacccuuggcccggugca

SEQ ID NO: 3211664 - RNA, 19 nt, Mycobacterium bovis subsp bovis AF2122/97
cgccaccgaacagucgagu

SEQ ID NO: 3211665 - RNA, 16 nt, Mycobacterium bovis subsp bovis AF2122/97
cgccaccgaacgcacc

SEQ ID NO: 3211666 - RNA, 21 nt, Mycobacterium bovis subsp bovis AF2122/97
cgccaccgaacgcaccgaaac

SEQ ID NO: 3211667 - RNA, 22 nt, Mycobacterium bovis subsp bovis AF2122/97
cgccaccgaagccgccgggugc

SEQ ID NO: 3211668 - RNA, 18 nt, Mycobacterium bovis subsp bovis AF2122/97
cgccaccgagaucggaca

SEQ ID NO: 3211669 - RNA, 19 nt, Mycobacterium bovis subsp bovis AF2122/97
cgccaccgagaucggacag

SEQ ID NO: 3211670 - RNA, 19 nt, Mycobacterium bovis subsp bovis AF2122/97
cgccaccgauaccgucagc

SEQ ID NO: 3211671 - RNA, 14 nt, Mycobacterium bovis subsp bovis AF2122/97
cgccaccgauggcg

SEQ ID NO: 3211672 - RNA, 21 nt, Mycobacterium bovis subsp bovis AF2122/97
cgccaccgcaagaaucagcag

SEQ ID NO: 3211673 - RNA, 15 nt, Mycobacterium bovis subsp bovis AF2122/97
cgccaccgcacgcac

SEQ ID NO: 3211674 - RNA, 16 nt, Mycobacterium bovis subsp bovis AF2122/97
cgccaccgcacgcacg

SEQ ID NO: 3211675 - RNA, 14 nt, Mycobacterium bovis subsp bovis AF2122/97
cgccaccgccagcg

SEQ ID NO: 3211676 - RNA, 17 nt, Mycobacterium bovis subsp bovis AF2122/97
cgccaccgccagcgucg

SEQ ID NO: 3211677 - RNA, 21 nt, Mycobacterium bovis subsp bovis AF2122/97
cgccaccgccgcugccggugu

SEQ ID NO: 3211678 - RNA, 15 nt, Mycobacterium bovis subsp bovis AF2122/97
cgccaccgccggcag

SEQ ID NO: 3211679 - RNA, 16 nt, Mycobacterium bovis subsp bovis AF2122/97
cgccaccgccggcagc

SEQ ID NO: 3211680 - RNA, 22 nt, Mycobacterium bovis subsp bovis AF2122/97
cgccaccgccggcagcaucggc

SEQ ID NO: 3211681 - RNA, 17 nt, Mycobacterium bovis subsp bovis AF2122/97
cgccaccgcgacgagcg

SEQ ID NO: 3211682 - RNA, 12 nt, Mycobacterium bovis subsp bovis AF2122/97
cgccaccgcggc

SEQ ID NO: 3211683 - RNA, 20 nt, Mycobacterium bovis subsp bovis AF2122/97
cgccaccgcggucaccgacg

SEQ ID NO: 3211684 - RNA, 13 nt, Mycobacterium bovis subsp bovis AF2122/97
cgccaccgcguca

SEQ ID NO: 3211685 - RNA, 21 nt, Mycobacterium bovis subsp bovis AF2122/97
cgccaccggaggugcgccgcg

SEQ ID NO: 3211686 - RNA, 13 nt, Mycobacterium bovis subsp bovis AF2122/97
cgccaccggcaau

SEQ ID NO: 3211687 - RNA, 14 nt, Mycobacterium bovis subsp bovis AF2122/97
cgccaccggcaccg

SEQ ID NO: 3211688 - RNA, 15 nt, Mycobacterium bovis subsp bovis AF2122/97
cgccaccggcaccgc

SEQ ID NO: 3211689 - RNA, 18 nt, Mycobacterium bovis subsp bovis AF2122/97
cgccaccggcaccgccug

SEQ ID NO: 3211690 - RNA, 22 nt, Mycobacterium bovis subsp bovis AF2122/97
cgccaccggcaccgccugcgcc

SEQ ID NO: 3211691 - RNA, 23 nt, Mycobacterium bovis subsp bovis AF2122/97
cgccaccggcaccgccugcgccg

SEQ ID NO: 3211692 - RNA, 14 nt, Mycobacterium bovis subsp bovis AF2122/97
cgccaccggccgcg

SEQ ID NO: 3211693 - RNA, 16 nt, Mycobacterium bovis subsp bovis AF2122/97
cgccaccggccgcggc

SEQ ID NO: 3211694 - RNA, 14 nt, Mycobacterium bovis subsp bovis AF2122/97
cgccaccggcgcca

SEQ ID NO: 3211695 - RNA, 19 nt, Mycobacterium bovis subsp bovis AF2122/97
cgccaccggcgccaccggc

SEQ ID NO: 3211696 - RNA, 24 nt, Mycobacterium bovis subsp bovis AF2122/97
cgccaccggcgccaccggcgccgc

SEQ ID NO: 3211697 - RNA, 14 nt, Mycobacterium bovis subsp bovis AF2122/97
cgccaccggcgccg

SEQ ID NO: 3211698 - RNA, 16 nt, Mycobacterium bovis subsp bovis AF2122/97
cgccaccggcgccgcc

SEQ ID NO: 3211699 - RNA, 19 nt, Mycobacterium bovis subsp bovis AF2122/97
cgccaccggcgccgcccgc

SEQ ID NO: 3211700 - RNA, 13 nt, Mycobacterium bovis subsp bovis AF2122/97
cgccaccggcgcg

SEQ ID NO: 3211701 - RNA, 21 nt, Mycobacterium bovis subsp bovis AF2122/97
cgccaccggcgcgaccgcggc

SEQ ID NO: 3211702 - RNA, 23 nt, Mycobacterium bovis subsp bovis AF2122/97
cgccaccggcgcgaccgcggcga

SEQ ID NO: 3211703 - RNA, 12 nt, Mycobacterium bovis subsp bovis AF2122/97
cgccaccggcgu

SEQ ID NO: 3211704 - RNA, 19 nt, Mycobacterium bovis subsp bovis AF2122/97
cgccaccggcguccagucc

SEQ ID NO: 3211705 - RNA, 21 nt, Mycobacterium bovis subsp bovis AF2122/97
cgccaccggcugauucgagcc

SEQ ID NO: 3211706 - RNA, 13 nt, Mycobacterium bovis subsp bovis AF2122/97
cgccaccgggacg

SEQ ID NO: 3211707 - RNA, 19 nt, Mycobacterium bovis subsp bovis AF2122/97
cgccaccggguucaccgag

SEQ ID NO: 3211708 - RNA, 20 nt, Mycobacterium bovis subsp bovis AF2122/97
cgccaccggguucaccgagg

SEQ ID NO: 3211709 - RNA, 20 nt, Mycobacterium bovis subsp bovis AF2122/97
cgccaccgguaccgaucagc

SEQ ID NO: 3211710 - RNA, 12 nt, Mycobacterium bovis subsp bovis AF2122/97
cgccaccgucac

SEQ ID NO: 3211711 - RNA, 15 nt, Mycobacterium bovis subsp bovis AF2122/97
cgccaccgucaccgc

SEQ ID NO: 3211712 - RNA, 21 nt, Mycobacterium bovis subsp bovis AF2122/97
cgccaccgucaccgccguugc

SEQ ID NO: 3211713 - RNA, 14 nt, Mycobacterium bovis subsp bovis AF2122/97
cgccaccgucaugg

SEQ ID NO: 3211714 - RNA, 21 nt, Mycobacterium bovis subsp bovis AF2122/97
cgccaccgucauggcgggugc

SEQ ID NO: 3211715 - RNA, 19 nt, Mycobacterium bovis subsp bovis AF2122/97
cgccaccgucgcugcccgc

SEQ ID NO: 3211716 - RNA, 23 nt, Mycobacterium bovis subsp bovis AF2122/97
cgccaccgucgcugcccgcgcgg

SEQ ID NO: 3211717 - RNA, 18 nt, Mycobacterium bovis subsp bovis AF2122/97
cgccaccgugguggacga

SEQ ID NO: 3211718 - RNA, 20 nt, Mycobacterium bovis subsp bovis AF2122/97
cgccaccgugguggacgacc

SEQ ID NO: 3211719 - RNA, 22 nt, Mycobacterium bovis subsp bovis AF2122/97
cgccaccguuaccgccguuugc

SEQ ID NO: 3211720 - RNA, 14 nt, Mycobacterium bovis subsp bovis AF2122/97
cgccaccguugccg

SEQ ID NO: 3211721 - RNA, 17 nt, Mycobacterium bovis subsp bovis AF2122/97
cgccaccguuugcgcac

SEQ ID NO: 3211722 - RNA, 19 nt, Mycobacterium bovis subsp bovis AF2122/97
cgccaccguuugcgcaccg

SEQ ID NO: 3211723 - RNA, 19 nt, Mycobacterium bovis subsp bovis AF2122/97
cgccaccucgacgcacacc

SEQ ID NO: 3211724 - RNA, 14 nt, Mycobacterium bovis subsp bovis AF2122/97
cgccaccucgccgg

SEQ ID NO: 3211725 - RNA, 22 nt, Mycobacterium bovis subsp bovis AF2122/97
cgccaccucgccggccgucagc

SEQ ID NO: 3211726 - RNA, 23 nt, Mycobacterium bovis subsp bovis AF2122/97
cgccaccucggaggugccggugc

SEQ ID NO: 3211727 - RNA, 19 nt, Mycobacterium bovis subsp bovis AF2122/97
cgccaccugacgugcggcg

SEQ ID NO: 3211728 - RNA, 21 nt, Mycobacterium bovis subsp bovis AF2122/97
cgccaccugacgugcggcgcg

SEQ ID NO: 3211729 - RNA, 19 nt, Mycobacterium bovis subsp bovis AF2122/97
cgccaccuguugcccuugc

SEQ ID NO: 3211730 - RNA, 16 nt, Mycobacterium bovis subsp bovis AF2122/97
cgccaccuuggcuggg

SEQ ID NO: 3211731 - RNA, 19 nt, Mycobacterium bovis subsp bovis AF2122/97
cgccaccuuggcugggccc

SEQ ID NO: 3211732 - RNA, 22 nt, Mycobacterium bovis subsp bovis AF2122/97
cgccaccuuggcugggcccgcc

SEQ ID NO: 3211733 - RNA, 20 nt, Mycobacterium bovis subsp bovis AF2122/97
cgccacgacgcccaccguug

SEQ ID NO: 3211734 - RNA, 14 nt, Mycobacterium bovis subsp bovis AF2122/97
cgccacgacgucgu

SEQ ID NO: 3211735 - RNA, 15 nt, Mycobacterium bovis subsp bovis AF2122/97
cgccacgaugaccgg

SEQ ID NO: 3211736 - RNA, 15 nt, Mycobacterium bovis subsp bovis AF2122/97
cgccacgaugccggc

SEQ ID NO: 3211737 - RNA, 16 nt, Mycobacterium bovis subsp bovis AF2122/97
cgccacgaugccggcu

SEQ ID NO: 3211738 - RNA, 16 nt, Mycobacterium bovis subsp bovis AF2122/97
cgccacgcacccggca

SEQ ID NO: 3211739 - RNA, 18 nt, Mycobacterium bovis subsp bovis AF2122/97
cgccacgcccgacgccag

SEQ ID NO: 3211740 - RNA, 19 nt, Mycobacterium bovis subsp bovis AF2122/97
cgccacgcccgacgccagc

SEQ ID NO: 3211741 - RNA, 13 nt, Mycobacterium bovis subsp bovis AF2122/97
cgccacgccgaag

SEQ ID NO: 3211742 - RNA, 13 nt, Mycobacterium bovis subsp bovis AF2122/97
cgccacgccgagg

SEQ ID NO: 3211743 - RNA, 19 nt, Mycobacterium bovis subsp bovis AF2122/97
cgccacgccgaggcguucg

SEQ ID NO: 3211744 - RNA, 16 nt, Mycobacterium bovis subsp bovis AF2122/97
cgccacggaucgcggc

SEQ ID NO: 3211745 - RNA, 18 nt, Mycobacterium bovis subsp bovis AF2122/97
cgccacggaucgcggcgg

SEQ ID NO: 3211746 - RNA, 20 nt, Mycobacterium bovis subsp bovis AF2122/97
cgccacggaucgcggcggcg

SEQ ID NO: 3211747 - RNA, 16 nt, Mycobacterium bovis subsp bovis AF2122/97
cgccacggcagcgccc

SEQ ID NO: 3211748 - RNA, 20 nt, Mycobacterium bovis subsp bovis AF2122/97
cgccacggcaucggccaccu

SEQ ID NO: 3211749 - RNA, 14 nt, Mycobacterium bovis subsp bovis AF2122/97
cgccacggcgggcg

SEQ ID NO: 3211750 - RNA, 13 nt, Mycobacterium bovis subsp bovis AF2122/97
cgccacgggcggc

SEQ ID NO: 3211751 - RNA, 19 nt, Mycobacterium bovis subsp bovis AF2122/97
cgccacgggcggccaccgc

SEQ ID NO: 3211752 - RNA, 23 nt, Mycobacterium bovis subsp bovis AF2122/97
cgccacgggcggccaccgcacgc

SEQ ID NO: 3211753 - RNA, 15 nt, Mycobacterium bovis subsp bovis AF2122/97
cgccacggucgccga

SEQ ID NO: 3211754 - RNA, 20 nt, Mycobacterium bovis subsp bovis AF2122/97
cgccacggucgccgaccacu

SEQ ID NO: 3211755 - RNA, 17 nt, Mycobacterium bovis subsp bovis AF2122/97
cgccacgguucgggcag

SEQ ID NO: 3211756 - RNA, 22 nt, Mycobacterium bovis subsp bovis AF2122/97
cgccacgguucgggcagcaccc

SEQ ID NO: 3211757 - RNA, 15 nt, Mycobacterium bovis subsp bovis AF2122/97
cgccacgguuggucc

SEQ ID NO: 3211758 - RNA, 18 nt, Mycobacterium bovis subsp bovis AF2122/97
cgccacguacuccaccgc

SEQ ID NO: 3211759 - RNA, 19 nt, Mycobacterium bovis subsp bovis AF2122/97
cgccacguacuccaccgcg

SEQ ID NO: 3211760 - RNA, 23 nt, Mycobacterium bovis subsp bovis AF2122/97
cgccacguacuccaccgcgccgu

SEQ ID NO: 3211761 - RNA, 14 nt, Mycobacterium bovis subsp bovis AF2122/97
cgccacgucgacgg

SEQ ID NO: 3211762 - RNA, 18 nt, Mycobacterium bovis subsp bovis AF2122/97
cgccacgucgccggcuac

SEQ ID NO: 3211763 - RNA, 21 nt, Mycobacterium bovis subsp bovis AF2122/97
cgccacgucgccggcuaccgc

SEQ ID NO: 3211764 - RNA, 22 nt, Mycobacterium bovis subsp bovis AF2122/97
cgccacgucgccggcuaccgcc

SEQ ID NO: 3211765 - RNA, 20 nt, Mycobacterium bovis subsp bovis AF2122/97
cgccacguggucgagcaggc

SEQ ID NO: 3211766 - RNA, 15 nt, Mycobacterium bovis subsp bovis AF2122/97
cgccacucagcccga

SEQ ID NO: 3211767 - RNA, 15 nt, Mycobacterium bovis subsp bovis AF2122/97
cgccacucgcccgcu

SEQ ID NO: 3211768 - RNA, 20 nt, Mycobacterium bovis subsp bovis AF2122/97
cgccacugaccgcgaucgcc

SEQ ID NO: 3211769 - RNA, 21 nt, Mycobacterium bovis subsp bovis AF2122/97
cgccacugaccgcgaucgccg

SEQ ID NO: 3211770 - RNA, 17 nt, Mycobacterium bovis subsp bovis AF2122/97
cgccacugccggcagcg

SEQ ID NO: 3211771 - RNA, 19 nt, Mycobacterium bovis subsp bovis AF2122/97
cgccacuggaagccaagcu

SEQ ID NO: 3211772 - RNA, 14 nt, Mycobacterium bovis subsp bovis AF2122/97
cgccacuggcgccg

SEQ ID NO: 3211773 - RNA, 16 nt, Mycobacterium bovis subsp bovis AF2122/97
cgccacuggcgccggu

SEQ ID NO: 3211774 - RNA, 18 nt, Mycobacterium bovis subsp bovis AF2122/97
cgccacuggcgccggugc

SEQ ID NO: 3211775 - RNA, 19 nt, Mycobacterium bovis subsp bovis AF2122/97
cgccacuggcgccggugcc

SEQ ID NO: 3211776 - RNA, 23 nt, Mycobacterium bovis subsp bovis AF2122/97
cgccacuggcgccggugccgccg

SEQ ID NO: 3211777 - RNA, 16 nt, Mycobacterium bovis subsp bovis AF2122/97
cgccacuguugaagaa

SEQ ID NO: 3211778 - RNA, 21 nt, Mycobacterium bovis subsp bovis AF2122/97
cgccacuguugaagaagcccg

SEQ ID NO: 3211779 - RNA, 16 nt, Mycobacterium bovis subsp bovis AF2122/97
cgccacuugaugccgc

SEQ ID NO: 3211780 - RNA, 17 nt, Mycobacterium bovis subsp bovis AF2122/97
cgccagaaagcccaggg

SEQ ID NO: 3211781 - RNA, 21 nt, Mycobacterium bovis subsp bovis AF2122/97
cgccagaacguggccauccuc

SEQ ID NO: 3211782 - RNA, 17 nt, Mycobacterium bovis subsp bovis AF2122/97
cgccagaauugccggcg

SEQ ID NO: 3211783 - RNA, 18 nt, Mycobacterium bovis subsp bovis AF2122/97
cgccagaauugccggcga

SEQ ID NO: 3211784 - RNA, 13 nt, Mycobacterium bovis subsp bovis AF2122/97
cgccagaccgcac

SEQ ID NO: 3211785 - RNA, 12 nt, Mycobacterium bovis subsp bovis AF2122/97
cgccagaccgcc

SEQ ID NO: 3211786 - RNA, 16 nt, Mycobacterium bovis subsp bovis AF2122/97
cgccagaccgcggcgg

SEQ ID NO: 3211787 - RNA, 15 nt, Mycobacterium bovis subsp bovis AF2122/97
cgccagagucggaga

SEQ ID NO: 3211788 - RNA, 20 nt, Mycobacterium bovis subsp bovis AF2122/97
cgccagagucggagacccgu

SEQ ID NO: 3211789 - RNA, 14 nt, Mycobacterium bovis subsp bovis AF2122/97
cgccagaucaccgu

SEQ ID NO: 3211790 - RNA, 16 nt, Mycobacterium bovis subsp bovis AF2122/97
cgccagaucaccgucg

SEQ ID NO: 3211791 - RNA, 22 nt, Mycobacterium bovis subsp bovis AF2122/97
cgccagaucucgcgcgcggcga

SEQ ID NO: 3211792 - RNA, 20 nt, Mycobacterium bovis subsp bovis AF2122/97
cgccagaugaugccacccuc

SEQ ID NO: 3211793 - RNA, 14 nt, Mycobacterium bovis subsp bovis AF2122/97
cgccagcaacccug

SEQ ID NO: 3211794 - RNA, 14 nt, Mycobacterium bovis subsp bovis AF2122/97
cgccagcaacgucg

SEQ ID NO: 3211795 - RNA, 14 nt, Mycobacterium bovis subsp bovis AF2122/97
cgccagcaaugccc

SEQ ID NO: 3211796 - RNA, 18 nt, Mycobacterium bovis subsp bovis AF2122/97
cgccagcaaugcccgcac

SEQ ID NO: 3211797 - RNA, 19 nt, Mycobacterium bovis subsp bovis AF2122/97
cgccagcaaugcccgcacc

SEQ ID NO: 3211798 - RNA, 22 nt, Mycobacterium bovis subsp bovis AF2122/97
cgccagcaaugcccgcaccgcg

SEQ ID NO: 3211799 - RNA, 16 nt, Mycobacterium bovis subsp bovis AF2122/97
cgccagcaccaccggc

SEQ ID NO: 3211800 - RNA, 17 nt, Mycobacterium bovis subsp bovis AF2122/97
cgccagcaccaccggcu

SEQ ID NO: 3211801 - RNA, 16 nt, Mycobacterium bovis subsp bovis AF2122/97
cgccagcaccagcguc

SEQ ID NO: 3211802 - RNA, 20 nt, Mycobacterium bovis subsp bovis AF2122/97
cgccagcaccagcgucgcgg

SEQ ID NO: 3211803 - RNA, 22 nt, Mycobacterium bovis subsp bovis AF2122/97
cgccagcaccagcgucgcggcc

SEQ ID NO: 3211804 - RNA, 23 nt, Mycobacterium bovis subsp bovis AF2122/97
cgccagcaccagcgucgcggcca

SEQ ID NO: 3211805 - RNA, 20 nt, Mycobacterium bovis subsp bovis AF2122/97
cgccagcaccucggccagcu

SEQ ID NO: 3211806 - RNA, 23 nt, Mycobacterium bovis subsp bovis AF2122/97
cgccagcagcugugguaccaacg

SEQ ID NO: 3211807 - RNA, 18 nt, Mycobacterium bovis subsp bovis AF2122/97
cgccagcaucagcccggc

SEQ ID NO: 3211808 - RNA, 21 nt, Mycobacterium bovis subsp bovis AF2122/97
cgccagcaucagcccggcgcu

SEQ ID NO: 3211809 - RNA, 14 nt, Mycobacterium bovis subsp bovis AF2122/97
cgccagcaugacac

SEQ ID NO: 3211810 - RNA, 23 nt, Mycobacterium bovis subsp bovis AF2122/97
cgccagcaugacaccggccacca

SEQ ID NO: 3211811 - RNA, 20 nt, Mycobacterium bovis subsp bovis AF2122/97
cgccagcauugaagaagccc

SEQ ID NO: 3211812 - RNA, 17 nt, Mycobacterium bovis subsp bovis AF2122/97
cgccagccaggcgaagu

SEQ ID NO: 3211813 - RNA, 13 nt, Mycobacterium bovis subsp bovis AF2122/97
cgccagcccagca

SEQ ID NO: 3211814 - RNA, 20 nt, Mycobacterium bovis subsp bovis AF2122/97
cgccagcccagcacgcuggc

SEQ ID NO: 3211815 - RNA, 16 nt, Mycobacterium bovis subsp bovis AF2122/97
cgccagccccacccgc

SEQ ID NO: 3211816 - RNA, 23 nt, Mycobacterium bovis subsp bovis AF2122/97
cgccagccccauugccgucgcgg

SEQ ID NO: 3211817 - RNA, 12 nt, Mycobacterium bovis subsp bovis AF2122/97
cgccagccccgc

SEQ ID NO: 3211818 - RNA, 18 nt, Mycobacterium bovis subsp bovis AF2122/97
cgccagccccgcgcccac

SEQ ID NO: 3211819 - RNA, 17 nt, Mycobacterium bovis subsp bovis AF2122/97
cgccagcccggugaugg

SEQ ID NO: 3211820 - RNA, 21 nt, Mycobacterium bovis subsp bovis AF2122/97
cgccagcccggugauggugcc

SEQ ID NO: 3211821 - RNA, 20 nt, Mycobacterium bovis subsp bovis AF2122/97
cgccagccgaccgauggcuc

SEQ ID NO: 3211822 - RNA, 20 nt, Mycobacterium bovis subsp bovis AF2122/97
cgccagccgcgagccgguga

SEQ ID NO: 3211823 - RNA, 13 nt, Mycobacterium bovis subsp bovis AF2122/97
cgccagccggccg

SEQ ID NO: 3211824 - RNA, 20 nt, Mycobacterium bovis subsp bovis AF2122/97
cgccagccggccgcgaccgc

SEQ ID NO: 3211825 - RNA, 13 nt, Mycobacterium bovis subsp bovis AF2122/97
cgccagccggcgc

SEQ ID NO: 3211826 - RNA, 14 nt, Mycobacterium bovis subsp bovis AF2122/97
cgccagccggcgca

SEQ ID NO: 3211827 - RNA, 12 nt, Mycobacterium bovis subsp bovis AF2122/97
cgccagccgugc

SEQ ID NO: 3211828 - RNA, 13 nt, Mycobacterium bovis subsp bovis AF2122/97
cgccagccgugcc

SEQ ID NO: 3211829 - RNA, 16 nt, Mycobacterium bovis subsp bovis AF2122/97
cgccagccgugccggu

SEQ ID NO: 3211830 - RNA, 19 nt, Mycobacterium bovis subsp bovis AF2122/97
cgccagccguuuuccugau

SEQ ID NO: 3211831 - RNA, 14 nt, Mycobacterium bovis subsp bovis AF2122/97
cgccagccuccacc

SEQ ID NO: 3211832 - RNA, 15 nt, Mycobacterium bovis subsp bovis AF2122/97
cgccagccuccacca

SEQ ID NO: 3211833 - RNA, 16 nt, Mycobacterium bovis subsp bovis AF2122/97
cgccagccuccaccag

SEQ ID NO: 3211834 - RNA, 17 nt, Mycobacterium bovis subsp bovis AF2122/97
cgccagccuccaccagg

SEQ ID NO: 3211835 - RNA, 20 nt, Mycobacterium bovis subsp bovis AF2122/97
cgccagccuccaccaggucg

SEQ ID NO: 3211836 - RNA, 17 nt, Mycobacterium bovis subsp bovis AF2122/97
cgccagccugugcugcc

SEQ ID NO: 3211837 - RNA, 20 nt, Mycobacterium bovis subsp bovis AF2122/97
cgccagccugugcugccaac

SEQ ID NO: 3211838 - RNA, 19 nt, Mycobacterium bovis subsp bovis AF2122/97
cgccagcgagcauaccgcc

SEQ ID NO: 3211839 - RNA, 21 nt, Mycobacterium bovis subsp bovis AF2122/97
cgccagcgagcauaccgccgc

SEQ ID NO: 3211840 - RNA, 22 nt, Mycobacterium bovis subsp bovis AF2122/97
cgccagcgagcauaccgccgcu

SEQ ID NO: 3211841 - RNA, 18 nt, Mycobacterium bovis subsp bovis AF2122/97
cgccagcgauaucggcgg

SEQ ID NO: 3211842 - RNA, 23 nt, Mycobacterium bovis subsp bovis AF2122/97
cgccagcgauccaccaagcucgc

SEQ ID NO: 3211843 - RNA, 13 nt, Mycobacterium bovis subsp bovis AF2122/97
cgccagcgccacc

SEQ ID NO: 3211844 - RNA, 17 nt, Mycobacterium bovis subsp bovis AF2122/97
cgccagcgccagugccu

SEQ ID NO: 3211845 - RNA, 19 nt, Mycobacterium bovis subsp bovis AF2122/97
cgccagcgccagugccucg

SEQ ID NO: 3211846 - RNA, 11 nt, Mycobacterium bovis subsp bovis AF2122/97
cgccagcgccg

SEQ ID NO: 3211847 - RNA, 16 nt, Mycobacterium bovis subsp bovis AF2122/97
cgccagcgccgccacc

SEQ ID NO: 3211848 - RNA, 17 nt, Mycobacterium bovis subsp bovis AF2122/97
cgccagcgccgccaggu

SEQ ID NO: 3211849 - RNA, 15 nt, Mycobacterium bovis subsp bovis AF2122/97
cgccagcgccgccga

SEQ ID NO: 3211850 - RNA, 16 nt, Mycobacterium bovis subsp bovis AF2122/97
cgccagcgccgccgag

SEQ ID NO: 3211851 - RNA, 17 nt, Mycobacterium bovis subsp bovis AF2122/97
cgccagcgccgccgcga

SEQ ID NO: 3211852 - RNA, 16 nt, Mycobacterium bovis subsp bovis AF2122/97
cgccagcgccgccgga

SEQ ID NO: 3211853 - RNA, 18 nt, Mycobacterium bovis subsp bovis AF2122/97
cgccagcgccgccggagc

SEQ ID NO: 3211854 - RNA, 19 nt, Mycobacterium bovis subsp bovis AF2122/97
cgccagcgccgccggcgcc

SEQ ID NO: 3211855 - RNA, 22 nt, Mycobacterium bovis subsp bovis AF2122/97
cgccagcgccgccggcgccggc

SEQ ID NO: 3211856 - RNA, 13 nt, Mycobacterium bovis subsp bovis AF2122/97
cgccagcgccggc

SEQ ID NO: 3211857 - RNA, 15 nt, Mycobacterium bovis subsp bovis AF2122/97
cgccagcgccggcca

SEQ ID NO: 3211858 - RNA, 19 nt, Mycobacterium bovis subsp bovis AF2122/97
cgccagcgccugcgcgcau

SEQ ID NO: 3211859 - RNA, 11 nt, Mycobacterium bovis subsp bovis AF2122/97
cgccagcgcga

SEQ ID NO: 3211860 - RNA, 19 nt, Mycobacterium bovis subsp bovis AF2122/97
cgccagcgcgaccaaugcg

SEQ ID NO: 3211861 - RNA, 13 nt, Mycobacterium bovis subsp bovis AF2122/97
cgccagcgcgccg

SEQ ID NO: 3211862 - RNA, 15 nt, Mycobacterium bovis subsp bovis AF2122/97
cgccagcgcgccgau

SEQ ID NO: 3211863 - RNA, 13 nt, Mycobacterium bovis subsp bovis AF2122/97
cgccagcgcggug

SEQ ID NO: 3211864 - RNA, 21 nt, Mycobacterium bovis subsp bovis AF2122/97
cgccagcgcucacauaagcga

SEQ ID NO: 3211865 - RNA, 13 nt, Mycobacterium bovis subsp bovis AF2122/97
cgccagcggcagc

SEQ ID NO: 3211866 - RNA, 14 nt, Mycobacterium bovis subsp bovis AF2122/97
cgccagcggcagcg

SEQ ID NO: 3211867 - RNA, 20 nt, Mycobacterium bovis subsp bovis AF2122/97
cgccagcggcagcggcgucg

SEQ ID NO: 3211868 - RNA, 14 nt, Mycobacterium bovis subsp bovis AF2122/97
cgccagcggccgcu

SEQ ID NO: 3211869 - RNA, 19 nt, Mycobacterium bovis subsp bovis AF2122/97
cgccagcggccgcuccacc

SEQ ID NO: 3211870 - RNA, 12 nt, Mycobacterium bovis subsp bovis AF2122/97
cgccagcggcgc

SEQ ID NO: 3211871 - RNA, 16 nt, Mycobacterium bovis subsp bovis AF2122/97
cgccagcggcgcgacc

SEQ ID NO: 3211872 - RNA, 20 nt, Mycobacterium bovis subsp bovis AF2122/97
cgccagcgggcuguaggcga

SEQ ID NO: 3211873 - RNA, 20 nt, Mycobacterium bovis subsp bovis AF2122/97
cgccagcggggcuagucggg

SEQ ID NO: 3211874 - RNA, 17 nt, Mycobacterium bovis subsp bovis AF2122/97
cgccagcggguccccgg

SEQ ID NO: 3211875 - RNA, 19 nt, Mycobacterium bovis subsp bovis AF2122/97
cgccagcgguggaccaccg

SEQ ID NO: 3211876 - RNA, 15 nt, Mycobacterium bovis subsp bovis AF2122/97
cgccagcgucgacca

SEQ ID NO: 3211877 - RNA, 19 nt, Mycobacterium bovis subsp bovis AF2122/97
cgccagcguuaggucgccg

SEQ ID NO: 3211878 - RNA, 23 nt, Mycobacterium bovis subsp bovis AF2122/97
cgccagcguuaggucgccggcug

SEQ ID NO: 3211879 - RNA, 15 nt, Mycobacterium bovis subsp bovis AF2122/97
cgccagcucaaccac

SEQ ID NO: 3211880 - RNA, 15 nt, Mycobacterium bovis subsp bovis AF2122/97
cgccagcucgccggc

SEQ ID NO: 3211881 - RNA, 17 nt, Mycobacterium bovis subsp bovis AF2122/97
cgccagcucgccggccg

SEQ ID NO: 3211882 - RNA, 16 nt, Mycobacterium bovis subsp bovis AF2122/97
cgccagcucggcggca

SEQ ID NO: 3211883 - RNA, 20 nt, Mycobacterium bovis subsp bovis AF2122/97
cgccagcugacacccgcagc

SEQ ID NO: 3211884 - RNA, 23 nt, Mycobacterium bovis subsp bovis AF2122/97
cgccagcuugucgggcaccgguu

SEQ ID NO: 3211885 - RNA, 14 nt, Mycobacterium bovis subsp bovis AF2122/97
cgccaggaaucccu

SEQ ID NO: 3211886 - RNA, 13 nt, Mycobacterium bovis subsp bovis AF2122/97
cgccaggagcgcg

SEQ ID NO: 3211887 - RNA, 14 nt, Mycobacterium bovis subsp bovis AF2122/97
cgccaggagcgcgg

SEQ ID NO: 3211888 - RNA, 17 nt, Mycobacterium bovis subsp bovis AF2122/97
cgccaggagcgcggccc

SEQ ID NO: 3211889 - RNA, 18 nt, Mycobacterium bovis subsp bovis AF2122/97
cgccaggagcgcggcccg

SEQ ID NO: 3211890 - RNA, 13 nt, Mycobacterium bovis subsp bovis AF2122/97
cgccaggaucugg

SEQ ID NO: 3211891 - RNA, 19 nt, Mycobacterium bovis subsp bovis AF2122/97
cgccaggaucugguugaac

SEQ ID NO: 3211892 - RNA, 13 nt, Mycobacterium bovis subsp bovis AF2122/97
cgccaggcaagcc

SEQ ID NO: 3211893 - RNA, 23 nt, Mycobacterium bovis subsp bovis AF2122/97
cgccaggcaagccagcacugcca

SEQ ID NO: 3211894 - RNA, 14 nt, Mycobacterium bovis subsp bovis AF2122/97
cgccaggcaccacg

SEQ ID NO: 3211895 - RNA, 18 nt, Mycobacterium bovis subsp bovis AF2122/97
cgccaggcaccacgaccg

SEQ ID NO: 3211896 - RNA, 13 nt, Mycobacterium bovis subsp bovis AF2122/97
cgccaggccacgu

SEQ ID NO: 3211897 - RNA, 18 nt, Mycobacterium bovis subsp bovis AF2122/97
cgccaggcccccucggcg

SEQ ID NO: 3211898 - RNA, 19 nt, Mycobacterium bovis subsp bovis AF2122/97
cgccaggcccccucggcgu

SEQ ID NO: 3211899 - RNA, 18 nt, Mycobacterium bovis subsp bovis AF2122/97
cgccaggccgaccgcgca

SEQ ID NO: 3211900 - RNA, 17 nt, Mycobacterium bovis subsp bovis AF2122/97
cgccaggccgagcccgg

SEQ ID NO: 3211901 - RNA, 18 nt, Mycobacterium bovis subsp bovis AF2122/97
cgccaggccgagcccggu

SEQ ID NO: 3211902 - RNA, 20 nt, Mycobacterium bovis subsp bovis AF2122/97
cgccaggccgagcccggugc

SEQ ID NO: 3211903 - RNA, 13 nt, Mycobacterium bovis subsp bovis AF2122/97
cgccaggccgcac

SEQ ID NO: 3211904 - RNA, 15 nt, Mycobacterium bovis subsp bovis AF2122/97
cgccaggccgcgcga

SEQ ID NO: 3211905 - RNA, 17 nt, Mycobacterium bovis subsp bovis AF2122/97
cgccaggccgcgcgaca

SEQ ID NO: 3211906 - RNA, 23 nt, Mycobacterium bovis subsp bovis AF2122/97
cgccaggccgcgcgacaacccgg

SEQ ID NO: 3211907 - RNA, 14 nt, Mycobacterium bovis subsp bovis AF2122/97
cgccaggccgucgg

SEQ ID NO: 3211908 - RNA, 14 nt, Mycobacterium bovis subsp bovis AF2122/97
cgccaggccguggc

SEQ ID NO: 3211909 - RNA, 17 nt, Mycobacterium bovis subsp bovis AF2122/97
cgccaggccguggcacc

SEQ ID NO: 3211910 - RNA, 19 nt, Mycobacterium bovis subsp bovis AF2122/97
cgccaggccuaggccgagg

SEQ ID NO: 3211911 - RNA, 20 nt, Mycobacterium bovis subsp bovis AF2122/97
cgccaggcgcgaucgcgccc

SEQ ID NO: 3211912 - RNA, 23 nt, Mycobacterium bovis subsp bovis AF2122/97
cgccaggcgcgaucgcgcccgcu

SEQ ID NO: 3211913 - RNA, 16 nt, Mycobacterium bovis subsp bovis AF2122/97
cgccaggcgcuuggcc

SEQ ID NO: 3211914 - RNA, 17 nt, Mycobacterium bovis subsp bovis AF2122/97
cgccaggcggcaauucg

SEQ ID NO: 3211915 - RNA, 17 nt, Mycobacterium bovis subsp bovis AF2122/97
cgccaggcuugcggcac

SEQ ID NO: 3211916 - RNA, 19 nt, Mycobacterium bovis subsp bovis AF2122/97
cgccaggcuugcggcaccc

SEQ ID NO: 3211917 - RNA, 23 nt, Mycobacterium bovis subsp bovis AF2122/97
cgccagggaucuagaggcggccc

SEQ ID NO: 3211918 - RNA, 16 nt, Mycobacterium bovis subsp bovis AF2122/97
cgccagggcacguggc

SEQ ID NO: 3211919 - RNA, 21 nt, Mycobacterium bovis subsp bovis AF2122/97
cgccagggcacguggcgguac

SEQ ID NO: 3211920 - RNA, 21 nt, Mycobacterium bovis subsp bovis AF2122/97
cgccagggcccuagccggcgc

SEQ ID NO: 3211921 - RNA, 18 nt, Mycobacterium bovis subsp bovis AF2122/97
cgccagggccgccgaagc

SEQ ID NO: 3211922 - RNA, 11 nt, Mycobacterium bovis subsp bovis AF2122/97
cgccagggcgg

SEQ ID NO: 3211923 - RNA, 12 nt, Mycobacterium bovis subsp bovis AF2122/97
cgccagggcggc

SEQ ID NO: 3211924 - RNA, 16 nt, Mycobacterium bovis subsp bovis AF2122/97
cgccaggggacccggg

SEQ ID NO: 3211925 - RNA, 22 nt, Mycobacterium bovis subsp bovis AF2122/97
cgccaggggugugccguggucg

SEQ ID NO: 3211926 - RNA, 18 nt, Mycobacterium bovis subsp bovis AF2122/97
cgccagguacucggugca

SEQ ID NO: 3211927 - RNA, 21 nt, Mycobacterium bovis subsp bovis AF2122/97
cgccaggucagcuccaucccc

SEQ ID NO: 3211928 - RNA, 19 nt, Mycobacterium bovis subsp bovis AF2122/97
cgccaggucagcucgagcg

SEQ ID NO: 3211929 - RNA, 14 nt, Mycobacterium bovis subsp bovis AF2122/97
cgccaggucgguga

SEQ ID NO: 3211930 - RNA, 17 nt, Mycobacterium bovis subsp bovis AF2122/97
cgccaggugaugccgcc

SEQ ID NO: 3211931 - RNA, 17 nt, Mycobacterium bovis subsp bovis AF2122/97
cgccaggugcagcacca

SEQ ID NO: 3211932 - RNA, 15 nt, Mycobacterium bovis subsp bovis AF2122/97
cgccaggugcucguc

SEQ ID NO: 3211933 - RNA, 15 nt, Mycobacterium bovis subsp bovis AF2122/97
cgccagguggccgcu

SEQ ID NO: 3211934 - RNA, 20 nt, Mycobacterium bovis subsp bovis AF2122/97
cgccagguguucgccggaga

SEQ ID NO: 3211935 - RNA, 22 nt, Mycobacterium bovis subsp bovis AF2122/97
cgccagguguucgccggagacc

SEQ ID NO: 3211936 - RNA, 17 nt, Mycobacterium bovis subsp bovis AF2122/97
cgccaguaacgcccaca

SEQ ID NO: 3211937 - RNA, 21 nt, Mycobacterium bovis subsp bovis AF2122/97
cgccaguaccacuguuacggc

SEQ ID NO: 3211938 - RNA, 14 nt, Mycobacterium bovis subsp bovis AF2122/97
cgccaguagcacgu

SEQ ID NO: 3211939 - RNA, 15 nt, Mycobacterium bovis subsp bovis AF2122/97
cgccaguaggcuucg

SEQ ID NO: 3211940 - RNA, 14 nt, Mycobacterium bovis subsp bovis AF2122/97
cgccaguauggccg

SEQ ID NO: 3211941 - RNA, 16 nt, Mycobacterium bovis subsp bovis AF2122/97
cgccaguauggccgcc

SEQ ID NO: 3211942 - RNA, 19 nt, Mycobacterium bovis subsp bovis AF2122/97
cgccaguauggccgccacc

SEQ ID NO: 3211943 - RNA, 20 nt, Mycobacterium bovis subsp bovis AF2122/97
cgccaguauggccgccaccg

SEQ ID NO: 3211944 - RNA, 21 nt, Mycobacterium bovis subsp bovis AF2122/97
cgccaguauggccgccaccgc

SEQ ID NO: 3211945 - RNA, 18 nt, Mycobacterium bovis subsp bovis AF2122/97
cgccagucccggcgcaca

SEQ ID NO: 3211946 - RNA, 20 nt, Mycobacterium bovis subsp bovis AF2122/97
cgccaguccggacggcagcc

SEQ ID NO: 3211947 - RNA, 21 nt, Mycobacterium bovis subsp bovis AF2122/97
cgccaguccggacggcagccg

SEQ ID NO: 3211948 - RNA, 21 nt, Mycobacterium bovis subsp bovis AF2122/97
cgccagucgcaggaucggcgg

SEQ ID NO: 3211949 - RNA, 22 nt, Mycobacterium bovis subsp bovis AF2122/97
cgccagucgcaggaucggcgga

SEQ ID NO: 3211950 - RNA, 20 nt, Mycobacterium bovis subsp bovis AF2122/97
cgccagugcccgcacugccg

SEQ ID NO: 3211951 - RNA, 23 nt, Mycobacterium bovis subsp bovis AF2122/97
cgccagugcccgcacugccgccg

SEQ ID NO: 3211952 - RNA, 20 nt, Mycobacterium bovis subsp bovis AF2122/97
cgccagugccucgcgggguc

SEQ ID NO: 3211953 - RNA, 22 nt, Mycobacterium bovis subsp bovis AF2122/97
cgccagugccucgcggggucug

SEQ ID NO: 3211954 - RNA, 12 nt, Mycobacterium bovis subsp bovis AF2122/97
cgccaguggcca

SEQ ID NO: 3211955 - RNA, 17 nt, Mycobacterium bovis subsp bovis AF2122/97
cgccaguggccaccauc

SEQ ID NO: 3211956 - RNA, 16 nt, Mycobacterium bovis subsp bovis AF2122/97
cgccaguggugcaccg

SEQ ID NO: 3211957 - RNA, 13 nt, Mycobacterium bovis subsp bovis AF2122/97
cgccaguguggug

SEQ ID NO: 3211958 - RNA, 20 nt, Mycobacterium bovis subsp bovis AF2122/97
cgccaguguggugcggcgcg

SEQ ID NO: 3211959 - RNA, 14 nt, Mycobacterium bovis subsp bovis AF2122/97
cgccaguuccggug

SEQ ID NO: 3211960 - RNA, 16 nt, Mycobacterium bovis subsp bovis AF2122/97
cgccaguuccggugac

SEQ ID NO: 3211961 - RNA, 14 nt, Mycobacterium bovis subsp bovis AF2122/97
cgccaguucgcggc

SEQ ID NO: 3211962 - RNA, 15 nt, Mycobacterium bovis subsp bovis AF2122/97
cgccaguucgcggcu

SEQ ID NO: 3211963 - RNA, 18 nt, Mycobacterium bovis subsp bovis AF2122/97
cgccaguucgcggcugcg

SEQ ID NO: 3211964 - RNA, 15 nt, Mycobacterium bovis subsp bovis AF2122/97
cgccaguucggcguc

SEQ ID NO: 3211965 - RNA, 22 nt, Mycobacterium bovis subsp bovis AF2122/97
cgccaguucuaccaccuugccg

SEQ ID NO: 3211966 - RNA, 20 nt, Mycobacterium bovis subsp bovis AF2122/97
cgccaguugcguuguccacc

SEQ ID NO: 3211967 - RNA, 21 nt, Mycobacterium bovis subsp bovis AF2122/97
cgccaguugcguuguccacca

SEQ ID NO: 3211968 - RNA, 23 nt, Mycobacterium bovis subsp bovis AF2122/97
cagcggcgaucggaggcccgcca

SEQ ID NO: 3211969 - RNA, 23 nt, Mycobacterium bovis subsp bovis AF2122/97
cagcggcgcauaggcggccaucg

SEQ ID NO: 3211970 - RNA, 21 nt, Mycobacterium bovis subsp bovis AF2122/97
cagcggcgccaguauggccgc

SEQ ID NO: 3211971 - RNA, 23 nt, Mycobacterium bovis subsp bovis AF2122/97
cagcggcgccaguauggccgcca

SEQ ID NO: 3211972 - RNA, 13 nt, Mycobacterium bovis subsp bovis AF2122/97
cagcggcgccgcc

SEQ ID NO: 3211973 - RNA, 18 nt, Mycobacterium bovis subsp bovis AF2122/97
cagcggcgccgccaaggg

SEQ ID NO: 3211974 - RNA, 18 nt, Mycobacterium bovis subsp bovis AF2122/97
cagcggcgcgaccgucug

SEQ ID NO: 3211975 - RNA, 22 nt, Mycobacterium bovis subsp bovis AF2122/97
cagcggcgcgaggaacgccggg

SEQ ID NO: 3211976 - RNA, 22 nt, Mycobacterium bovis subsp bovis AF2122/97
cagcggcggaaggacggcagcc

SEQ ID NO: 3211977 - RNA, 23 nt, Mycobacterium bovis subsp bovis AF2122/97
cagcggcggcaacccugcccggc

SEQ ID NO: 3211978 - RNA, 23 nt, Mycobacterium bovis subsp bovis AF2122/97
cagcggcggcaacgguggcaacg

SEQ ID NO: 3211979 - RNA, 14 nt, Mycobacterium bovis subsp bovis AF2122/97
cagcggcggccacg

SEQ ID NO: 3211980 - RNA, 20 nt, Mycobacterium bovis subsp bovis AF2122/97
cagcggcggcgacgagcgca

SEQ ID NO: 3211981 - RNA, 16 nt, Mycobacterium bovis subsp bovis AF2122/97
cagcggcggcggcggc

SEQ ID NO: 3211982 - RNA, 14 nt, Mycobacterium bovis subsp bovis AF2122/97
cagcggcggcgucg

SEQ ID NO: 3211983 - RNA, 17 nt, Mycobacterium bovis subsp bovis AF2122/97
cagcggcggcgucgacg

SEQ ID NO: 3211984 - RNA, 16 nt, Mycobacterium bovis subsp bovis AF2122/97
cagcggcgggcgauga

SEQ ID NO: 3211985 - RNA, 20 nt, Mycobacterium bovis subsp bovis AF2122/97
cagcggcgguaugcucgcug

SEQ ID NO: 3211986 - RNA, 21 nt, Mycobacterium bovis subsp bovis AF2122/97
cagcggcgguaugcucgcugg

SEQ ID NO: 3211987 - RNA, 20 nt, Mycobacterium bovis subsp bovis AF2122/97
cagcggcggucucggcgucg

SEQ ID NO: 3211988 - RNA, 13 nt, Mycobacterium bovis subsp bovis AF2122/97
cagcggcucggcg

SEQ ID NO: 3211989 - RNA, 16 nt, Mycobacterium bovis subsp bovis AF2122/97
cagcggcugaccgggc

SEQ ID NO: 3211990 - RNA, 15 nt, Mycobacterium bovis subsp bovis AF2122/97
cagcggcuugcccag

SEQ ID NO: 3211991 - RNA, 20 nt, Mycobacterium bovis subsp bovis AF2122/97
cagcggcuugcccaggcgca

SEQ ID NO: 3211992 - RNA, 21 nt, Mycobacterium bovis subsp bovis AF2122/97
cagcggcuugcccaggcgcaa

SEQ ID NO: 3211993 - RNA, 22 nt, Mycobacterium bovis subsp bovis AF2122/97
cagcggcuugcccaggcgcaac

SEQ ID NO: 3211994 - RNA, 18 nt, Mycobacterium bovis subsp bovis AF2122/97
cagcgggaacacaccgca

SEQ ID NO: 3211995 - RNA, 21 nt, Mycobacterium bovis subsp bovis AF2122/97
cagcgggacauccagugcggu

SEQ ID NO: 3211996 - RNA, 14 nt, Mycobacterium bovis subsp bovis AF2122/97
cagcgggacugcgg

SEQ ID NO: 3211997 - RNA, 16 nt, Mycobacterium bovis subsp bovis AF2122/97
cagcgggcacgccgcc

SEQ ID NO: 3211998 - RNA, 18 nt, Mycobacterium bovis subsp bovis AF2122/97
cagcgggcacgccgccga

SEQ ID NO: 3211999 - RNA, 19 nt, Mycobacterium bovis subsp bovis AF2122/97
cagcgggcauaacccgcac

SEQ ID NO: 3212000 - RNA, 21 nt, Mycobacterium bovis subsp bovis AF2122/97
cagcgggcauaacccgcaccg

SEQ ID NO: 3212001 - RNA, 22 nt, Mycobacterium bovis subsp bovis AF2122/97
cagcgggcauaacccgcaccgg

SEQ ID NO: 3212002 - RNA, 13 nt, Mycobacterium bovis subsp bovis AF2122/97
cagcgggcaucgc

SEQ ID NO: 3212003 - RNA, 15 nt, Mycobacterium bovis subsp bovis AF2122/97
cagcgggcaucgcga

SEQ ID NO: 3212004 - RNA, 18 nt, Mycobacterium bovis subsp bovis AF2122/97
cagcgggccacugagcca

SEQ ID NO: 3212005 - RNA, 12 nt, Mycobacterium bovis subsp bovis AF2122/97
cagcgggccgcc

SEQ ID NO: 3212006 - RNA, 12 nt, Mycobacterium bovis subsp bovis AF2122/97
cagcgggcgaug

SEQ ID NO: 3212007 - RNA, 13 nt, Mycobacterium bovis subsp bovis AF2122/97
cagcgggcgcgcu

SEQ ID NO: 3212008 - RNA, 14 nt, Mycobacterium bovis subsp bovis AF2122/97
cagcgggcgcgcua

SEQ ID NO: 3212009 - RNA, 23 nt, Mycobacterium bovis subsp bovis AF2122/97
cagcgggcgcuguagucgcgccu

SEQ ID NO: 3212010 - RNA, 22 nt, Mycobacterium bovis subsp bovis AF2122/97
cagcgggcggugucgucaucgg

SEQ ID NO: 3212011 - RNA, 13 nt, Mycobacterium bovis subsp bovis AF2122/97
cagcgggcugcgc

SEQ ID NO: 3212012 - RNA, 17 nt, Mycobacterium bovis subsp bovis AF2122/97
cagcgggcuggcgaagg

SEQ ID NO: 3212013 - RNA, 17 nt, Mycobacterium bovis subsp bovis AF2122/97
cagcgggggcagcgcga

SEQ ID NO: 3212014 - RNA, 21 nt, Mycobacterium bovis subsp bovis AF2122/97
cagcgggggcagcgcgaacac

SEQ ID NO: 3212015 - RNA, 17 nt, Mycobacterium bovis subsp bovis AF2122/97
cagcggggugcugcgca

SEQ ID NO: 3212016 - RNA, 18 nt, Mycobacterium bovis subsp bovis AF2122/97
cagcggguaagacgucgg

SEQ ID NO: 3212017 - RNA, 17 nt, Mycobacterium bovis subsp bovis AF2122/97
cagcgggucgaccccgg

SEQ ID NO: 3212018 - RNA, 23 nt, Mycobacterium bovis subsp bovis AF2122/97
cagcgggucgaccccggccagga

SEQ ID NO: 3212019 - RNA, 18 nt, Mycobacterium bovis subsp bovis AF2122/97
cagcgggucgccgggccc

SEQ ID NO: 3212020 - RNA, 23 nt, Mycobacterium bovis subsp bovis AF2122/97
cagcgggugaaucgacaccgccc

SEQ ID NO: 3212021 - RNA, 23 nt, Mycobacterium bovis subsp bovis AF2122/97
cagcggguucaacgcgcgcacgc

SEQ ID NO: 3212022 - RNA, 20 nt, Mycobacterium bovis subsp bovis AF2122/97
cagcggguugcggucaccgg

SEQ ID NO: 3212023 - RNA, 17 nt, Mycobacterium bovis subsp bovis AF2122/97
cagcgguaagcgcaucg

SEQ ID NO: 3212024 - RNA, 18 nt, Mycobacterium bovis subsp bovis AF2122/97
cagcgguaagcgcaucga

SEQ ID NO: 3212025 - RNA, 17 nt, Mycobacterium bovis subsp bovis AF2122/97
cagcgguaaugccagcg

SEQ ID NO: 3212026 - RNA, 19 nt, Mycobacterium bovis subsp bovis AF2122/97
cagcgguaaugccagcggc

SEQ ID NO: 3212027 - RNA, 13 nt, Mycobacterium bovis subsp bovis AF2122/97
cagcgguagccga

SEQ ID NO: 3212028 - RNA, 16 nt, Mycobacterium bovis subsp bovis AF2122/97
cagcgguagccgagcu

SEQ ID NO: 3212029 - RNA, 16 nt, Mycobacterium bovis subsp bovis AF2122/97
cagcgguaucccccag

SEQ ID NO: 3212030 - RNA, 17 nt, Mycobacterium bovis subsp bovis AF2122/97
cagcggucagccggcca

SEQ ID NO: 3212031 - RNA, 12 nt, Mycobacterium bovis subsp bovis AF2122/97
cagcgguccaga

SEQ ID NO: 3212032 - RNA, 18 nt, Mycobacterium bovis subsp bovis AF2122/97
cagcgguccagacaucag

SEQ ID NO: 3212033 - RNA, 15 nt, Mycobacterium bovis subsp bovis AF2122/97
cagcgguccgccgcc

SEQ ID NO: 3212034 - RNA, 17 nt, Mycobacterium bovis subsp bovis AF2122/97
cagcggucgcagcucgu

SEQ ID NO: 3212035 - RNA, 14 nt, Mycobacterium bovis subsp bovis AF2122/97
cagcggucggcgac

SEQ ID NO: 3212036 - RNA, 15 nt, Mycobacterium bovis subsp bovis AF2122/97
cagcggugcagcccg

SEQ ID NO: 3212037 - RNA, 18 nt, Mycobacterium bovis subsp bovis AF2122/97
cagcggugcagcccgccg

SEQ ID NO: 3212038 - RNA, 17 nt, Mycobacterium bovis subsp bovis AF2122/97
cagcggugcgcgguugu

SEQ ID NO: 3212039 - RNA, 20 nt, Mycobacterium bovis subsp bovis AF2122/97
cagcggugcugguggcggca

SEQ ID NO: 3212040 - RNA, 15 nt, Mycobacterium bovis subsp bovis AF2122/97
cagcgguggcuugcc

SEQ ID NO: 3212041 - RNA, 17 nt, Mycobacterium bovis subsp bovis AF2122/97
cagcgguggcuugcccc

SEQ ID NO: 3212042 - RNA, 14 nt, Mycobacterium bovis subsp bovis AF2122/97
cagcgguggucggc

SEQ ID NO: 3212043 - RNA, 17 nt, Mycobacterium bovis subsp bovis AF2122/97
cagcgguggucggcgcg

SEQ ID NO: 3212044 - RNA, 23 nt, Mycobacterium bovis subsp bovis AF2122/97
cagcgguguagccggcgccgccg

SEQ ID NO: 3212045 - RNA, 13 nt, Mycobacterium bovis subsp bovis AF2122/97
cagcgguugaugc

SEQ ID NO: 3212046 - RNA, 18 nt, Mycobacterium bovis subsp bovis AF2122/97
cagcgguugaugcggccg

SEQ ID NO: 3212047 - RNA, 20 nt, Mycobacterium bovis subsp bovis AF2122/97
cagcgguugaugcggccgcg

SEQ ID NO: 3212048 - RNA, 14 nt, Mycobacterium bovis subsp bovis AF2122/97
cagcgguugggcga

SEQ ID NO: 3212049 - RNA, 18 nt, Mycobacterium bovis subsp bovis AF2122/97
cagcguaaauagcgcccu

SEQ ID NO: 3212050 - RNA, 23 nt, Mycobacterium bovis subsp bovis AF2122/97
cagcguaucggccggcagauugu

SEQ ID NO: 3212051 - RNA, 21 nt, Mycobacterium bovis subsp bovis AF2122/97
cagcguauuggacgcugccgc

SEQ ID NO: 3212052 - RNA, 14 nt, Mycobacterium bovis subsp bovis AF2122/97
cagcgucaacagcg

SEQ ID NO: 3212053 - RNA, 23 nt, Mycobacterium bovis subsp bovis AF2122/97
cagcgucacccugucgcgcaccg

SEQ ID NO: 3212054 - RNA, 19 nt, Mycobacterium bovis subsp bovis AF2122/97
ccagcugucauccccggcc

SEQ ID NO: 3212055 - RNA, 23 nt, Mycobacterium bovis subsp bovis AF2122/97
ccagcugucauccccggccagcc

SEQ ID NO: 3212056 - RNA, 19 nt, Mycobacterium bovis subsp bovis AF2122/97
ccagcugugaacaggccga

SEQ ID NO: 3212057 - RNA, 18 nt, Mycobacterium bovis subsp bovis AF2122/97
ccagcuguucgagccgcg

SEQ ID NO: 3212058 - RNA, 16 nt, Mycobacterium bovis subsp bovis AF2122/97
ccagcuucccgcuggu

SEQ ID NO: 3212059 - RNA, 17 nt, Mycobacterium bovis subsp bovis AF2122/97
ccagcuucggcuggcgu

SEQ ID NO: 3212060 - RNA, 21 nt, Mycobacterium bovis subsp bovis AF2122/97
ccagcuucucagcaccaugcu

SEQ ID NO: 3212061 - RNA, 21 nt, Mycobacterium bovis subsp bovis AF2122/97
ccagcuugaccgaccacgcga

SEQ ID NO: 3212062 - RNA, 20 nt, Mycobacterium bovis subsp bovis AF2122/97
ccagcuugccgaccugcgcg

SEQ ID NO: 3212063 - RNA, 16 nt, Mycobacterium bovis subsp bovis AF2122/97
ccagcuugcgcaacgu

SEQ ID NO: 3212064 - RNA, 15 nt, Mycobacterium bovis subsp bovis AF2122/97
ccagcuugcgccgca

SEQ ID NO: 3212065 - RNA, 16 nt, Mycobacterium bovis subsp bovis AF2122/97
ccagcuugcgccgcag

SEQ ID NO: 3212066 - RNA, 17 nt, Mycobacterium bovis subsp bovis AF2122/97
ccagcuugcgccgcagc

SEQ ID NO: 3212067 - RNA, 19 nt, Mycobacterium bovis subsp bovis AF2122/97
ccagcuugcggagccgccg

SEQ ID NO: 3212068 - RNA, 16 nt, Mycobacterium bovis subsp bovis AF2122/97
ccagcuuggcaaccug

SEQ ID NO: 3212069 - RNA, 14 nt, Mycobacterium bovis subsp bovis AF2122/97
ccagcuugucgggc

SEQ ID NO: 3212070 - RNA, 22 nt, Mycobacterium bovis subsp bovis AF2122/97
ccagcuugucguagcgacgcca

SEQ ID NO: 3212071 - RNA, 13 nt, Mycobacterium bovis subsp bovis AF2122/97
ccaggaacccgug

SEQ ID NO: 3212072 - RNA, 17 nt, Mycobacterium bovis subsp bovis AF2122/97
ccaggaacggcucggcc

SEQ ID NO: 3212073 - RNA, 15 nt, Mycobacterium bovis subsp bovis AF2122/97
ccaggaacgggacgc

SEQ ID NO: 3212074 - RNA, 19 nt, Mycobacterium bovis subsp bovis AF2122/97
ccaggaacgggacgccgug

SEQ ID NO: 3212075 - RNA, 16 nt, Mycobacterium bovis subsp bovis AF2122/97
ccaggaacucggccca

SEQ ID NO: 3212076 - RNA, 12 nt, Mycobacterium bovis subsp bovis AF2122/97
ccaggaaguccc

SEQ ID NO: 3212077 - RNA, 23 nt, Mycobacterium bovis subsp bovis AF2122/97
ccaggaaucccucggccgcaggc

SEQ ID NO: 3212078 - RNA, 17 nt, Mycobacterium bovis subsp bovis AF2122/97
ccaggaaugucuccagu

SEQ ID NO: 3212079 - RNA, 22 nt, Mycobacterium bovis subsp bovis AF2122/97
ccaggaaugucuccaguagccg

SEQ ID NO: 3212080 - RNA, 20 nt, Mycobacterium bovis subsp bovis AF2122/97
ccaggaauuccccaccgucg

SEQ ID NO: 3212081 - RNA, 16 nt, Mycobacterium bovis subsp bovis AF2122/97
ccaggacaacgcaccg

SEQ ID NO: 3212082 - RNA, 12 nt, Mycobacterium bovis subsp bovis AF2122/97
ccaggacaccuu

SEQ ID NO: 3212083 - RNA, 14 nt, Mycobacterium bovis subsp bovis AF2122/97
ccaggacagcagcc

SEQ ID NO: 3212084 - RNA, 19 nt, Mycobacterium bovis subsp bovis AF2122/97
ccaggacagcagccgccgg

SEQ ID NO: 3212085 - RNA, 13 nt, Mycobacterium bovis subsp bovis AF2122/97
ccaggaccaccgc

SEQ ID NO: 3212086 - RNA, 14 nt, Mycobacterium bovis subsp bovis AF2122/97
ccaggaccggcugc

SEQ ID NO: 3212087 - RNA, 16 nt, Mycobacterium bovis subsp bovis AF2122/97
ccaggaccggcugcag

SEQ ID NO: 3212088 - RNA, 17 nt, Mycobacterium bovis subsp bovis AF2122/97
ccaggaccggcugcagg

SEQ ID NO: 3212089 - RNA, 13 nt, Mycobacterium bovis subsp bovis AF2122/97
ccaggacgacgcc

SEQ ID NO: 3212090 - RNA, 19 nt, Mycobacterium bovis subsp bovis AF2122/97
ccaggacgacgccgacgau

SEQ ID NO: 3212091 - RNA, 17 nt, Mycobacterium bovis subsp bovis AF2122/97
ccaggacgaguccuagc

SEQ ID NO: 3212092 - RNA, 20 nt, Mycobacterium bovis subsp bovis AF2122/97
ccaggacggaucgucgugca

SEQ ID NO: 3212093 - RNA, 19 nt, Mycobacterium bovis subsp bovis AF2122/97
ccaggacggcuaccaccgc

SEQ ID NO: 3212094 - RNA, 23 nt, Mycobacterium bovis subsp bovis AF2122/97
ccaggacgguugguccgccgucg

SEQ ID NO: 3212095 - RNA, 16 nt, Mycobacterium bovis subsp bovis AF2122/97
ccaggacguggucggg

SEQ ID NO: 3212096 - RNA, 13 nt, Mycobacterium bovis subsp bovis AF2122/97
ccaggacuccggc

SEQ ID NO: 3212097 - RNA, 16 nt, Mycobacterium bovis subsp bovis AF2122/97
ccaggacuccggccgc

SEQ ID NO: 3212098 - RNA, 19 nt, Mycobacterium bovis subsp bovis AF2122/97
ccaggacuggcaccgccag

SEQ ID NO: 3212099 - RNA, 20 nt, Mycobacterium bovis subsp bovis AF2122/97
ccaggacuggcaccgccagc

SEQ ID NO: 3212100 - RNA, 21 nt, Mycobacterium bovis subsp bovis AF2122/97
ccaggacuggcaccgccagcc

SEQ ID NO: 3212101 - RNA, 22 nt, Mycobacterium bovis subsp bovis AF2122/97
ccaggacuggcaccgccagcca

SEQ ID NO: 3212102 - RNA, 18 nt, Mycobacterium bovis subsp bovis AF2122/97
ccaggagcaccucgaagu

SEQ ID NO: 3212103 - RNA, 16 nt, Mycobacterium bovis subsp bovis AF2122/97
ccaggagccgaggaau

SEQ ID NO: 3212104 - RNA, 17 nt, Mycobacterium bovis subsp bovis AF2122/97
ccaggagcgccgucauc

SEQ ID NO: 3212105 - RNA, 19 nt, Mycobacterium bovis subsp bovis AF2122/97
ccaggagugcgggcaugcc

SEQ ID NO: 3212106 - RNA, 21 nt, Mycobacterium bovis subsp bovis AF2122/97
ccaggagugcgggcaugccgg

SEQ ID NO: 3212107 - RNA, 22 nt, Mycobacterium bovis subsp bovis AF2122/97
ccaggagugcgggcaugccggc

SEQ ID NO: 3212108 - RNA, 24 nt, Mycobacterium bovis subsp bovis AF2122/97
ccaggagugcgggcaugccggcga

SEQ ID NO: 3212109 - RNA, 19 nt, Mycobacterium bovis subsp bovis AF2122/97
ccaggaguuugaccaccug

SEQ ID NO: 3212110 - RNA, 20 nt, Mycobacterium bovis subsp bovis AF2122/97
ccaggauaaguccggacauc

SEQ ID NO: 3212111 - RNA, 19 nt, Mycobacterium bovis subsp bovis AF2122/97
ccaggauccgaccccgcgc

SEQ ID NO: 3212112 - RNA, 15 nt, Mycobacterium bovis subsp bovis AF2122/97
ccaggaucgccgcuu

SEQ ID NO: 3212113 - RNA, 14 nt, Mycobacterium bovis subsp bovis AF2122/97
ccaggaucgcggcg

SEQ ID NO: 3212114 - RNA, 22 nt, Mycobacterium bovis subsp bovis AF2122/97
ccaggaucgcggcgccgucguc

SEQ ID NO: 3212115 - RNA, 12 nt, Mycobacterium bovis subsp bovis AF2122/97
ccaggaucgcgu

SEQ ID NO: 3212116 - RNA, 14 nt, Mycobacterium bovis subsp bovis AF2122/97
ccaggaugagcgcu

SEQ ID NO: 3212117 - RNA, 21 nt, Mycobacterium bovis subsp bovis AF2122/97
ccaggauguguugccagauca

SEQ ID NO: 3212118 - RNA, 22 nt, Mycobacterium bovis subsp bovis AF2122/97
ccaggauuaagguguggucggc

SEQ ID NO: 3212119 - RNA, 17 nt, Mycobacterium bovis subsp bovis AF2122/97
ccaggcaaccggucagc

SEQ ID NO: 3212120 - RNA, 22 nt, Mycobacterium bovis subsp bovis AF2122/97
ccaggcaaccggucagccugcc

SEQ ID NO: 3212121 - RNA, 21 nt, Mycobacterium bovis subsp bovis AF2122/97
ccaggcaagccagcacugcca

SEQ ID NO: 3212122 - RNA, 18 nt, Mycobacterium bovis subsp bovis AF2122/97
ccaggcacaacaucgccg

SEQ ID NO: 3212123 - RNA, 14 nt, Mycobacterium bovis subsp bovis AF2122/97
ccaggcaccacgac

SEQ ID NO: 3212124 - RNA, 18 nt, Mycobacterium bovis subsp bovis AF2122/97
ccaggcacccuguacgaa

SEQ ID NO: 3212125 - RNA, 14 nt, Mycobacterium bovis subsp bovis AF2122/97
ccaggcacguccga

SEQ ID NO: 3212126 - RNA, 21 nt, Mycobacterium bovis subsp bovis AF2122/97
ccaggcacguccgaucggcgc

SEQ ID NO: 3212127 - RNA, 23 nt, Mycobacterium bovis subsp bovis AF2122/97
ccaggcacguccgaucggcgcgc

SEQ ID NO: 3212128 - RNA, 16 nt, Mycobacterium bovis subsp bovis AF2122/97
ccaggcacuccagcgg

SEQ ID NO: 3212129 - RNA, 20 nt, Mycobacterium bovis subsp bovis AF2122/97
ccaggcacuccagcggcggg

SEQ ID NO: 3212130 - RNA, 20 nt, Mycobacterium bovis subsp bovis AF2122/97
ccaggcauuggugaguagau

SEQ ID NO: 3212131 - RNA, 23 nt, Mycobacterium bovis subsp bovis AF2122/97
ccaggccaacggcgcugccggga

SEQ ID NO: 3212132 - RNA, 19 nt, Mycobacterium bovis subsp bovis AF2122/97
ccaggccaagguggccacc

SEQ ID NO: 3212133 - RNA, 20 nt, Mycobacterium bovis subsp bovis AF2122/97
ccaggccaagguggccacca

SEQ ID NO: 3212134 - RNA, 13 nt, Mycobacterium bovis subsp bovis AF2122/97
ccaggccaccccg

SEQ ID NO: 3212135 - RNA, 14 nt, Mycobacterium bovis subsp bovis AF2122/97
ccaggccaccggcu

SEQ ID NO: 3212136 - RNA, 14 nt, Mycobacterium bovis subsp bovis AF2122/97
ccaggccacugccg

SEQ ID NO: 3212137 - RNA, 14 nt, Mycobacterium bovis subsp bovis AF2122/97
ccaggccagggcgg

SEQ ID NO: 3212138 - RNA, 22 nt, Mycobacterium bovis subsp bovis AF2122/97
ccaggccagggcgguggccacc

SEQ ID NO: 3212139 - RNA, 19 nt, Mycobacterium bovis subsp bovis AF2122/97
ccaggcccaagccguggcc

SEQ ID NO: 3212140 - RNA, 17 nt, Mycobacterium bovis subsp bovis AF2122/97
ccagggagcggcugcac

SEQ ID NO: 3212141 - RNA, 18 nt, Mycobacterium bovis subsp bovis AF2122/97
ccagggagugccgcacga

SEQ ID NO: 3212142 - RNA, 22 nt, Mycobacterium bovis subsp bovis AF2122/97
ccagggagugccgcacgauggc

SEQ ID NO: 3212143 - RNA, 16 nt, Mycobacterium bovis subsp bovis AF2122/97
ccagggcaacggccgc

SEQ ID NO: 3212144 - RNA, 19 nt, Mycobacterium bovis subsp bovis AF2122/97
ccagggcacguucggcgca

SEQ ID NO: 3212145 - RNA, 17 nt, Mycobacterium bovis subsp bovis AF2122/97
ccagggcagcggccagg

SEQ ID NO: 3212146 - RNA, 14 nt, Mycobacterium bovis subsp bovis AF2122/97
ccagggcagugcga

SEQ ID NO: 3212147 - RNA, 20 nt, Mycobacterium bovis subsp bovis AF2122/97
ccagggcaucagcagagccc

SEQ ID NO: 3212148 - RNA, 22 nt, Mycobacterium bovis subsp bovis AF2122/97
ccagggcaucagcagagccccg

SEQ ID NO: 3212149 - RNA, 13 nt, Mycobacterium bovis subsp bovis AF2122/97
ccagggccaccgc

SEQ ID NO: 3212150 - RNA, 15 nt, Mycobacterium bovis subsp bovis AF2122/97
ccagggccaccgcgc

SEQ ID NO: 3212151 - RNA, 17 nt, Mycobacterium bovis subsp bovis AF2122/97
ccagggccaccgcgccg

SEQ ID NO: 3212152 - RNA, 14 nt, Mycobacterium bovis subsp bovis AF2122/97
ccagggccaucugg

SEQ ID NO: 3212153 - RNA, 17 nt, Mycobacterium bovis subsp bovis AF2122/97
ccagggcccuagccggc

SEQ ID NO: 3212154 - RNA, 19 nt, Mycobacterium bovis subsp bovis AF2122/97
ccagggcccuagccggcgc

SEQ ID NO: 3212155 - RNA, 17 nt, Mycobacterium bovis subsp bovis AF2122/97
ccagggcccugcuggcc

SEQ ID NO: 3212156 - RNA, 13 nt, Mycobacterium bovis subsp bovis AF2122/97
ccagggccgccgc

SEQ ID NO: 3212157 - RNA, 15 nt, Mycobacterium bovis subsp bovis AF2122/97
ccagggccgccgcug

SEQ ID NO: 3212158 - RNA, 17 nt, Mycobacterium bovis subsp bovis AF2122/97
ccagggccuccacccgc

SEQ ID NO: 3212159 - RNA, 18 nt, Mycobacterium bovis subsp bovis AF2122/97
ccagggccuccacccgcc

SEQ ID NO: 3212160 - RNA, 19 nt, Mycobacterium bovis subsp bovis AF2122/97
ccagggccuccacccgcca

SEQ ID NO: 3212161 - RNA, 16 nt, Mycobacterium bovis subsp bovis AF2122/97
ccagggccucgaccgc

SEQ ID NO: 3212162 - RNA, 17 nt, Mycobacterium bovis subsp bovis AF2122/97
ccagggccucgaccgcc

SEQ ID NO: 3212163 - RNA, 20 nt, Mycobacterium bovis subsp bovis AF2122/97
ccagggccucgaccgccagc

SEQ ID NO: 3212164 - RNA, 17 nt, Mycobacterium bovis subsp bovis AF2122/97
ccagggccuucgggcca

SEQ ID NO: 3212165 - RNA, 18 nt, Mycobacterium bovis subsp bovis AF2122/97
ccagggcgacgagaucug

SEQ ID NO: 3212166 - RNA, 15 nt, Mycobacterium bovis subsp bovis AF2122/97
ccagggcgcaacgga

SEQ ID NO: 3212167 - RNA, 18 nt, Mycobacterium bovis subsp bovis AF2122/97
ccagggcggcauccccag

SEQ ID NO: 3212168 - RNA, 19 nt, Mycobacterium bovis subsp bovis AF2122/97
ccagggcgguggccacccg

SEQ ID NO: 3212169 - RNA, 21 nt, Mycobacterium bovis subsp bovis AF2122/97
ccagggcgguggccacccggc

SEQ ID NO: 3212170 - RNA, 21 nt, Mycobacterium bovis subsp bovis AF2122/97
ccagggcucggcggcccggcc

SEQ ID NO: 3212171 - RNA, 17 nt, Mycobacterium bovis subsp bovis AF2122/97
ccaggggagcugaccac

SEQ ID NO: 3212172 - RNA, 14 nt, Mycobacterium bovis subsp bovis AF2122/97
ccaggggauugccc

SEQ ID NO: 3212173 - RNA, 19 nt, Mycobacterium bovis subsp bovis AF2122/97
ccaggggcaccgagcugag

SEQ ID NO: 3212174 - RNA, 14 nt, Mycobacterium bovis subsp bovis AF2122/97
ccaggggcgcagcg

SEQ ID NO: 3212175 - RNA, 15 nt, Mycobacterium bovis subsp bovis AF2122/97
ccaggggcgcagcgc

SEQ ID NO: 3212176 - RNA, 19 nt, Mycobacterium bovis subsp bovis AF2122/97
ccagggggcgugccgccgc

SEQ ID NO: 3212177 - RNA, 21 nt, Mycobacterium bovis subsp bovis AF2122/97
ccaggggugugccguggucga

SEQ ID NO: 3212178 - RNA, 22 nt, Mycobacterium bovis subsp bovis AF2122/97
ccagggucaccucgucgccuag

SEQ ID NO: 3212179 - RNA, 14 nt, Mycobacterium bovis subsp bovis AF2122/97
ccagggucccgccg

SEQ ID NO: 3212180 - RNA, 21 nt, Mycobacterium bovis subsp bovis AF2122/97
ccagggucccgccgccuggaa

SEQ ID NO: 3212181 - RNA, 18 nt, Mycobacterium bovis subsp bovis AF2122/97
ccagggucgaugucgucg

SEQ ID NO: 3212182 - RNA, 17 nt, Mycobacterium bovis subsp bovis AF2122/97
ccagggucugcucaucc

SEQ ID NO: 3212183 - RNA, 12 nt, Mycobacterium bovis subsp bovis AF2122/97
ccagggugacca

SEQ ID NO: 3212184 - RNA, 19 nt, Mycobacterium bovis subsp bovis AF2122/97
ccagggugcccucggccgc

SEQ ID NO: 3212185 - RNA, 23 nt, Mycobacterium bovis subsp bovis AF2122/97
ccagggugcccucggccgccuga

SEQ ID NO: 3212186 - RNA, 21 nt, Mycobacterium bovis subsp bovis AF2122/97
ccagggugccggucacgucga

SEQ ID NO: 3212187 - RNA, 14 nt, Mycobacterium bovis subsp bovis AF2122/97
ccaggguggucagu

SEQ ID NO: 3212188 - RNA, 22 nt, Mycobacterium bovis subsp bovis AF2122/97
ccaggguggucaguccgucggc

SEQ ID NO: 3212189 - RNA, 13 nt, Mycobacterium bovis subsp bovis AF2122/97
ccaggguggucgu

SEQ ID NO: 3212190 - RNA, 18 nt, Mycobacterium bovis subsp bovis AF2122/97
ccaggguguauggccacc

SEQ ID NO: 3212191 - RNA, 21 nt, Mycobacterium bovis subsp bovis AF2122/97
ccaggguguauggccaccacg

SEQ ID NO: 3212192 - RNA, 23 nt, Mycobacterium bovis subsp bovis AF2122/97
ccaggguguauggccaccacgca

SEQ ID NO: 3212193 - RNA, 22 nt, Mycobacterium bovis subsp bovis AF2122/97
ccaggguguccgucgaaccuac

SEQ ID NO: 3212194 - RNA, 18 nt, Mycobacterium bovis subsp bovis AF2122/97
ccagggugucgucuugcg

SEQ ID NO: 3212195 - RNA, 14 nt, Mycobacterium bovis subsp bovis AF2122/97
ccagguaaccccgc

SEQ ID NO: 3212196 - RNA, 16 nt, Mycobacterium bovis subsp bovis AF2122/97
ccagguaaccccgcac

SEQ ID NO: 3212197 - RNA, 17 nt, Mycobacterium bovis subsp bovis AF2122/97
ccagguaaugguggcgu

SEQ ID NO: 3212198 - RNA, 19 nt, Mycobacterium bovis subsp bovis AF2122/97
ccagguacgcgaucagcgc

SEQ ID NO: 3212199 - RNA, 22 nt, Mycobacterium bovis subsp bovis AF2122/97
ccagguacgcgaucagcgcgca

SEQ ID NO: 3212200 - RNA, 19 nt, Mycobacterium bovis subsp bovis AF2122/97
ccagguacgggagcccgag

SEQ ID NO: 3212201 - RNA, 19 nt, Mycobacterium bovis subsp bovis AF2122/97
ccagguagaccaggugcag

SEQ ID NO: 3212202 - RNA, 15 nt, Mycobacterium bovis subsp bovis AF2122/97
ccagguagugcacac

SEQ ID NO: 3212203 - RNA, 16 nt, Mycobacterium bovis subsp bovis AF2122/97
ccagguauguccgcca

SEQ ID NO: 3212204 - RNA, 19 nt, Mycobacterium bovis subsp bovis AF2122/97
ccaggucaacgacguugau

SEQ ID NO: 3212205 - RNA, 19 nt, Mycobacterium bovis subsp bovis AF2122/97
ccaggucagccgcgcgggu

SEQ ID NO: 3212206 - RNA, 20 nt, Mycobacterium bovis subsp bovis AF2122/97
ccaggucauauugcggugca

SEQ ID NO: 3212207 - RNA, 22 nt, Mycobacterium bovis subsp bovis AF2122/97
ccaggucauauugugggugcga

SEQ ID NO: 3212208 - RNA, 14 nt, Mycobacterium bovis subsp bovis AF2122/97
ccaggucaugccgu

SEQ ID NO: 3212209 - RNA, 15 nt, Mycobacterium bovis subsp bovis AF2122/97
ccagguccaccccgc

SEQ ID NO: 3212210 - RNA, 19 nt, Mycobacterium bovis subsp bovis AF2122/97
ccagguccgccggugccgc

SEQ ID NO: 3212211 - RNA, 20 nt, Mycobacterium bovis subsp bovis AF2122/97
ccaggucgagcaccggcugc

SEQ ID NO: 3212212 - RNA, 18 nt, Mycobacterium bovis subsp bovis AF2122/97
ccaggucgauaccggcgu

SEQ ID NO: 3212213 - RNA, 21 nt, Mycobacterium bovis subsp bovis AF2122/97
ccaggucgauaccggcgugca

SEQ ID NO: 3212214 - RNA, 20 nt, Mycobacterium bovis subsp bovis AF2122/97
ccaggucgccagcucggcac

SEQ ID NO: 3212215 - RNA, 21 nt, Mycobacterium bovis subsp bovis AF2122/97
ccaggucgccagcucggcacc

SEQ ID NO: 3212216 - RNA, 22 nt, Mycobacterium bovis subsp bovis AF2122/97
ccaggucgccuuucauagcuga

SEQ ID NO: 3212217 - RNA, 12 nt, Mycobacterium bovis subsp bovis AF2122/97
ccaggucggcca

SEQ ID NO: 3212218 - RNA, 16 nt, Mycobacterium bovis subsp bovis AF2122/97
ccaggucggccaccgu

SEQ ID NO: 3212219 - RNA, 18 nt, Mycobacterium bovis subsp bovis AF2122/97
ccaggucggccaccgugg

SEQ ID NO: 3212220 - RNA, 15 nt, Mycobacterium bovis subsp bovis AF2122/97
ccaggucggccgccu

SEQ ID NO: 3212221 - RNA, 16 nt, Mycobacterium bovis subsp bovis AF2122/97
ccaggucggcguugau

SEQ ID NO: 3212222 - RNA, 20 nt, Mycobacterium bovis subsp bovis AF2122/97
ccaggucggcuucgacaacc

SEQ ID NO: 3212223 - RNA, 14 nt, Mycobacterium bovis subsp bovis AF2122/97
ccaggucggucagg

SEQ ID NO: 3212224 - RNA, 18 nt, Mycobacterium bovis subsp bovis AF2122/97
ccaggucggugacgaaga

SEQ ID NO: 3212225 - RNA, 21 nt, Mycobacterium bovis subsp bovis AF2122/97
ccaggucggugugcaucgccg

SEQ ID NO: 3212226 - RNA, 15 nt, Mycobacterium bovis subsp bovis AF2122/97
ccagugagcaugcga

SEQ ID NO: 3212227 - RNA, 12 nt, Mycobacterium bovis subsp bovis AF2122/97
ccagugagcccg

SEQ ID NO: 3212228 - RNA, 20 nt, Mycobacterium bovis subsp bovis AF2122/97
ccagugagguaucccggucu

SEQ ID NO: 3212229 - RNA, 14 nt, Mycobacterium bovis subsp bovis AF2122/97
ccagugcacgcucg

SEQ ID NO: 3212230 - RNA, 13 nt, Mycobacterium bovis subsp bovis AF2122/97
ccagugccacgcc

SEQ ID NO: 3212231 - RNA, 13 nt, Mycobacterium bovis subsp bovis AF2122/97
ccagugccccgcc

SEQ ID NO: 3212232 - RNA, 15 nt, Mycobacterium bovis subsp bovis AF2122/97
ccagugccccgccga

SEQ ID NO: 3212233 - RNA, 16 nt, Mycobacterium bovis subsp bovis AF2122/97
ccagugccccgccgag

SEQ ID NO: 3212234 - RNA, 13 nt, Mycobacterium bovis subsp bovis AF2122/97
ccagugcccgcac

SEQ ID NO: 3212235 - RNA, 18 nt, Mycobacterium bovis subsp bovis AF2122/97
ccagugcccgcacugccg

SEQ ID NO: 3212236 - RNA, 20 nt, Mycobacterium bovis subsp bovis AF2122/97
ccagugcccgcacugccgcc

SEQ ID NO: 3212237 - RNA, 15 nt, Mycobacterium bovis subsp bovis AF2122/97
ccagugccgcccacc

SEQ ID NO: 3212238 - RNA, 22 nt, Mycobacterium bovis subsp bovis AF2122/97
ccagugccguuucgaucugcac

SEQ ID NO: 3212239 - RNA, 20 nt, Mycobacterium bovis subsp bovis AF2122/97
ccagugcgcaacccagccgc

SEQ ID NO: 3212240 - RNA, 22 nt, Mycobacterium bovis subsp bovis AF2122/97
ccagugcgcaacccagccgcgc

SEQ ID NO: 3212241 - RNA, 23 nt, Mycobacterium bovis subsp bovis AF2122/97
ccagugcgcaacccagccgcgcc

SEQ ID NO: 3212242 - RNA, 20 nt, Mycobacterium bovis subsp bovis AF2122/97
ccagugcgcagaacaccacc

SEQ ID NO: 3212243 - RNA, 17 nt, Mycobacterium bovis subsp bovis AF2122/97
ccagugcgcagcccgca

SEQ ID NO: 3212244 - RNA, 22 nt, Mycobacterium bovis subsp bovis AF2122/97
ccagugcggccuuggcgacguc

SEQ ID NO: 3212245 - RNA, 16 nt, Mycobacterium bovis subsp bovis AF2122/97
ccagugcgguggcagg

SEQ ID NO: 3212246 - RNA, 18 nt, Mycobacterium bovis subsp bovis AF2122/97
ccagugcgguggcaggug

SEQ ID NO: 3212247 - RNA, 14 nt, Mycobacterium bovis subsp bovis AF2122/97
ccagugcugcaccg

SEQ ID NO: 3212248 - RNA, 12 nt, Mycobacterium bovis subsp bovis AF2122/97
ccaguggcagcc

SEQ ID NO: 3212249 - RNA, 18 nt, Mycobacterium bovis subsp bovis AF2122/97
ccaguggccaccaucacc

SEQ ID NO: 3212250 - RNA, 22 nt, Mycobacterium bovis subsp bovis AF2122/97
ccaguggccaccaucaccucgc

SEQ ID NO: 3212251 - RNA, 20 nt, Mycobacterium bovis subsp bovis AF2122/97
ccaguggcgcccauggccac

SEQ ID NO: 3212252 - RNA, 15 nt, Mycobacterium bovis subsp bovis AF2122/97
ccaguggcgcgugca

SEQ ID NO: 3212253 - RNA, 19 nt, Mycobacterium bovis subsp bovis AF2122/97
ccaguggcgcgugcagcgg

SEQ ID NO: 3212254 - RNA, 14 nt, Mycobacterium bovis subsp bovis AF2122/97
ccagugggccgacg

SEQ ID NO: 3212255 - RNA, 20 nt, Mycobacterium bovis subsp bovis AF2122/97
ccagugucagcacgacgaca

SEQ ID NO: 3212256 - RNA, 22 nt, Mycobacterium bovis subsp bovis AF2122/97
ccagugugcgguuggaucggcg

SEQ ID NO: 3212257 - RNA, 16 nt, Mycobacterium bovis subsp bovis AF2122/97
ccaguguguccugucg

SEQ ID NO: 3212258 - RNA, 15 nt, Mycobacterium bovis subsp bovis AF2122/97
ccaguguugcgcugc

SEQ ID NO: 3212259 - RNA, 19 nt, Mycobacterium bovis subsp bovis AF2122/97
ccaguguugcgcugcggcc

SEQ ID NO: 3212260 - RNA, 12 nt, Mycobacterium bovis subsp bovis AF2122/97
ccaguuacguug

SEQ ID NO: 3212261 - RNA, 22 nt, Mycobacterium bovis subsp bovis AF2122/97
ccaguucgcgccacgcacccgg

SEQ ID NO: 3212262 - RNA, 12 nt, Mycobacterium bovis subsp bovis AF2122/97
ccaguucggcgg

SEQ ID NO: 3212263 - RNA, 17 nt, Mycobacterium bovis subsp bovis AF2122/97
ccaguucggcggccgcc

SEQ ID NO: 3212264 - RNA, 13 nt, Mycobacterium bovis subsp bovis AF2122/97
ccaguucggcguc

SEQ ID NO: 3212265 - RNA, 21 nt, Mycobacterium bovis subsp bovis AF2122/97
ccaguucggugagccgggcgg

SEQ ID NO: 3212266 - RNA, 13 nt, Mycobacterium bovis subsp bovis AF2122/97
ccaguugcacauc

SEQ ID NO: 3212267 - RNA, 21 nt, Mycobacterium bovis subsp bovis AF2122/97
ccaguugcguuguccaccauc

SEQ ID NO: 3212268 - RNA, 23 nt, Mycobacterium bovis subsp bovis AF2122/97
ccaguuggccggccagccauggc

SEQ ID NO: 3212269 - RNA, 14 nt, Mycobacterium bovis subsp bovis AF2122/97
ccaguugugcggcc

SEQ ID NO: 3212270 - RNA, 19 nt, Mycobacterium bovis subsp bovis AF2122/97
ccaguugugcggccaggcg

SEQ ID NO: 3212271 - RNA, 19 nt, Mycobacterium bovis subsp bovis AF2122/97
ccaguuucaucaugugguc

SEQ ID NO: 3212272 - RNA, 16 nt, Mycobacterium bovis subsp bovis AF2122/97
ccaguuugugccgccg

SEQ ID NO: 3212273 - RNA, 20 nt, Mycobacterium bovis subsp bovis AF2122/97
ccauaagcucguagagcacc

SEQ ID NO: 3212274 - RNA, 15 nt, Mycobacterium bovis subsp bovis AF2122/97
ccauaaucacaucgc

SEQ ID NO: 3212275 - RNA, 14 nt, Mycobacterium bovis subsp bovis AF2122/97
ccauacagcacccc

SEQ ID NO: 3212276 - RNA, 19 nt, Mycobacterium bovis subsp bovis AF2122/97
ccauacagcaccccgccgg

SEQ ID NO: 3212277 - RNA, 21 nt, Mycobacterium bovis subsp bovis AF2122/97
ccauacagcaccccgccgggg

SEQ ID NO: 3212278 - RNA, 14 nt, Mycobacterium bovis subsp bovis AF2122/97
ccauacccgcgcgc

SEQ ID NO: 3212279 - RNA, 13 nt, Mycobacterium bovis subsp bovis AF2122/97
ccauaccggccgc

SEQ ID NO: 3212280 - RNA, 21 nt, Mycobacterium bovis subsp bovis AF2122/97
ccauaccggccgccaucaucg

SEQ ID NO: 3212281 - RNA, 16 nt, Mycobacterium bovis subsp bovis AF2122/97
ccauaccuucggcgau

SEQ ID NO: 3212282 - RNA, 15 nt, Mycobacterium bovis subsp bovis AF2122/97
ccauacgccggccgc

SEQ ID NO: 3212283 - RNA, 14 nt, Mycobacterium bovis subsp bovis AF2122/97
ccauacgcgcgcgg

SEQ ID NO: 3212284 - RNA, 20 nt, Mycobacterium bovis subsp bovis AF2122/97
ccauacggaagggcccggug

SEQ ID NO: 3212285 - RNA, 18 nt, Mycobacterium bovis subsp bovis AF2122/97
ccauacggcaauacccgc

SEQ ID NO: 3212286 - RNA, 21 nt, Mycobacterium bovis subsp bovis AF2122/97
ccauacggcaauacccgccgc

SEQ ID NO: 3212287 - RNA, 23 nt, Mycobacterium bovis subsp bovis AF2122/97
ccauacggcaauacccgccgcga

SEQ ID NO: 3212288 - RNA, 16 nt, Mycobacterium bovis subsp bovis AF2122/97
ccauacgugccgccga

SEQ ID NO: 3212289 - RNA, 15 nt, Mycobacterium bovis subsp bovis AF2122/97
ccauacucggcggcu

SEQ ID NO: 3212290 - RNA, 14 nt, Mycobacterium bovis subsp bovis AF2122/97
ccauagaugcccgc

SEQ ID NO: 3212291 - RNA, 20 nt, Mycobacterium bovis subsp bovis AF2122/97
ccauagaugcccgcgaucau

SEQ ID NO: 3212292 - RNA, 19 nt, Mycobacterium bovis subsp bovis AF2122/97
ccauagcaccucgaugaug

SEQ ID NO: 3212293 - RNA, 16 nt, Mycobacterium bovis subsp bovis AF2122/97
ccauagccgcgacccg

SEQ ID NO: 3212294 - RNA, 19 nt, Mycobacterium bovis subsp bovis AF2122/97
ccauagccgcgacccgcgc

SEQ ID NO: 3212295 - RNA, 20 nt, Mycobacterium bovis subsp bovis AF2122/97
ccauagccgcgacccgcgca

SEQ ID NO: 3212296 - RNA, 21 nt, Mycobacterium bovis subsp bovis AF2122/97
ccauagccgguggucgcgccc

SEQ ID NO: 3212297 - RNA, 20 nt, Mycobacterium bovis subsp bovis AF2122/97
ccauagccugcgccgacccg

SEQ ID NO: 3212298 - RNA, 14 nt, Mycobacterium bovis subsp bovis AF2122/97
ccauagcugccggc

SEQ ID NO: 3212299 - RNA, 16 nt, Mycobacterium bovis subsp bovis AF2122/97
ccauagcugccggccc

SEQ ID NO: 3212300 - RNA, 16 nt, Mycobacterium bovis subsp bovis AF2122/97
ccauaggcguaaugcg

SEQ ID NO: 3212301 - RNA, 18 nt, Mycobacterium bovis subsp bovis AF2122/97
ccauagugcggcagcggu

SEQ ID NO: 3212302 - RNA, 20 nt, Mycobacterium bovis subsp bovis AF2122/97
ccauagugcggcagcggugg

SEQ ID NO: 3212303 - RNA, 13 nt, Mycobacterium bovis subsp bovis AF2122/97
ccauauagaucac

SEQ ID NO: 3212304 - RNA, 21 nt, Mycobacterium bovis subsp bovis AF2122/97
ccauaucgaucggaucggcac

SEQ ID NO: 3212305 - RNA, 21 nt, Mycobacterium bovis subsp bovis AF2122/97
ccauaucgcagcguuggccgc

SEQ ID NO: 3212306 - RNA, 15 nt, Mycobacterium bovis subsp bovis AF2122/97
ccauaucgcccacca

SEQ ID NO: 3212307 - RNA, 22 nt, Mycobacterium bovis subsp bovis AF2122/97
ccauaugggggaaagcuugacc

SEQ ID NO: 3212308 - RNA, 13 nt, Mycobacterium bovis subsp bovis AF2122/97
ccauauuggcgcg

SEQ ID NO: 3212309 - RNA, 11 nt, Mycobacterium bovis subsp bovis AF2122/97
ccaucaacaag

SEQ ID NO: 3212310 - RNA, 17 nt, Mycobacterium bovis subsp bovis AF2122/97
ccaucaacaucggcccg

SEQ ID NO: 3212311 - RNA, 19 nt, Mycobacterium bovis subsp bovis AF2122/97
ccaucaacaucggcccgcu

SEQ ID NO: 3212312 - RNA, 20 nt, Mycobacterium bovis subsp bovis AF2122/97
ccaucaacaucggcccgcug

SEQ ID NO: 3212313 - RNA, 20 nt, Mycobacterium bovis subsp bovis AF2122/97
ccaucgccucggcgcugcgc

SEQ ID NO: 3212314 - RNA, 15 nt, Mycobacterium bovis subsp bovis AF2122/97
ccaucgcgacaucgg

SEQ ID NO: 3212315 - RNA, 13 nt, Mycobacterium bovis subsp bovis AF2122/97
ccaucgcgacggc

SEQ ID NO: 3212316 - RNA, 17 nt, Mycobacterium bovis subsp bovis AF2122/97
ccaucgcgacggcaagc

SEQ ID NO: 3212317 - RNA, 19 nt, Mycobacterium bovis subsp bovis AF2122/97
ccaucgcgacuagacgccg

SEQ ID NO: 3212318 - RNA, 22 nt, Mycobacterium bovis subsp bovis AF2122/97
ccaucgcgacuagacgccgccg

SEQ ID NO: 3212319 - RNA, 18 nt, Mycobacterium bovis subsp bovis AF2122/97
ccaucgcgcugcggccca

SEQ ID NO: 3212320 - RNA, 15 nt, Mycobacterium bovis subsp bovis AF2122/97
ccaucgcggaaccgu

SEQ ID NO: 3212321 - RNA, 13 nt, Mycobacterium bovis subsp bovis AF2122/97
ccaucgcgucggc

SEQ ID NO: 3212322 - RNA, 15 nt, Mycobacterium bovis subsp bovis AF2122/97
ccaucgcgucggcga

SEQ ID NO: 3212323 - RNA, 19 nt, Mycobacterium bovis subsp bovis AF2122/97
ccaucgcgucgucuucuuc

SEQ ID NO: 3212324 - RNA, 21 nt, Mycobacterium bovis subsp bovis AF2122/97
ccaucgcgucgucuucuucgc

SEQ ID NO: 3212325 - RNA, 15 nt, Mycobacterium bovis subsp bovis AF2122/97
ccaucgcuugcgcac

SEQ ID NO: 3212326 - RNA, 18 nt, Mycobacterium bovis subsp bovis AF2122/97
ccaucggcuaggccggcc

SEQ ID NO: 3212327 - RNA, 21 nt, Mycobacterium bovis subsp bovis AF2122/97
ccaucggcuaggccggccgga

SEQ ID NO: 3212328 - RNA, 13 nt, Mycobacterium bovis subsp bovis AF2122/97
ccaucgggcgcgg

SEQ ID NO: 3212329 - RNA, 19 nt, Mycobacterium bovis subsp bovis AF2122/97
ccaucgggcgcgguaacca

SEQ ID NO: 3212330 - RNA, 16 nt, Mycobacterium bovis subsp bovis AF2122/97
ccaucggggaaggggc

SEQ ID NO: 3212331 - RNA, 21 nt, Mycobacterium bovis subsp bovis AF2122/97
ccaucggggaaggggcucagc

SEQ ID NO: 3212332 - RNA, 20 nt, Mycobacterium bovis subsp bovis AF2122/97
ccaucggguccgaaguacug

SEQ ID NO: 3212333 - RNA, 16 nt, Mycobacterium bovis subsp bovis AF2122/97
ccaucggugcgcacgg

SEQ ID NO: 3212334 - RNA, 17 nt, Mycobacterium bovis subsp bovis AF2122/97
ccaucggugcgcacggc

SEQ ID NO: 3212335 - RNA, 16 nt, Mycobacterium bovis subsp bovis AF2122/97
ccaucggugguggcgu

SEQ ID NO: 3212336 - RNA, 20 nt, Mycobacterium bovis subsp bovis AF2122/97
ccaucggugguggcgucgau

SEQ ID NO: 3212337 - RNA, 13 nt, Mycobacterium bovis subsp bovis AF2122/97
ccaucgguugacc

SEQ ID NO: 3212338 - RNA, 19 nt, Mycobacterium bovis subsp bovis AF2122/97
ccaucgguuugcacucguc

SEQ ID NO: 3212339 - RNA, 15 nt, Mycobacterium bovis subsp bovis AF2122/97
ccaucguccagcagg

SEQ ID NO: 3212340 - RNA, 16 nt, Mycobacterium bovis subsp bovis AF2122/97
ccaucgucgagccgcc

SEQ ID NO: 3212341 - RNA, 14 nt, Mycobacterium bovis subsp bovis AF2122/97
ccaucgucgcgccg

SEQ ID NO: 3212342 - RNA, 15 nt, Mycobacterium bovis subsp bovis AF2122/97
ccaucgucgcgccgc

SEQ ID NO: 3212343 - RNA, 15 nt, Mycobacterium bovis subsp bovis AF2122/97
ccaucgucugguggc

SEQ ID NO: 3212344 - RNA, 17 nt, Mycobacterium bovis subsp bovis AF2122/97
ccaucgucugguggcag

SEQ ID NO: 3212345 - RNA, 20 nt, Mycobacterium bovis subsp bovis AF2122/97
ccaucguguacuggucugga

SEQ ID NO: 3212346 - RNA, 19 nt, Mycobacterium bovis subsp bovis AF2122/97
ccaucguuucacccgggcu

SEQ ID NO: 3212347 - RNA, 17 nt, Mycobacterium bovis subsp bovis AF2122/97
ccaucuaccagcucacc

SEQ ID NO: 3212348 - RNA, 14 nt, Mycobacterium bovis subsp bovis AF2122/97
ccaucuccaacagg

SEQ ID NO: 3212349 - RNA, 19 nt, Mycobacterium bovis subsp bovis AF2122/97
ccaucucgacgucggugaa

SEQ ID NO: 3212350 - RNA, 15 nt, Mycobacterium bovis subsp bovis AF2122/97
ccaucucgcaagggg

SEQ ID NO: 3212351 - RNA, 15 nt, Mycobacterium bovis subsp bovis AF2122/97
ccaucucggaccaca

SEQ ID NO: 3212352 - RNA, 16 nt, Mycobacterium bovis subsp bovis AF2122/97
ccaucucggaccacau

SEQ ID NO: 3212353 - RNA, 17 nt, Mycobacterium bovis subsp bovis AF2122/97
ccaucucuugcaaccug

SEQ ID NO: 3212354 - RNA, 15 nt, Mycobacterium bovis subsp bovis AF2122/97
ccaucugccugccug

SEQ ID NO: 3212355 - RNA, 16 nt, Mycobacterium bovis subsp bovis AF2122/97
ccaucuggccgcgggc

SEQ ID NO: 3212356 - RNA, 22 nt, Mycobacterium bovis subsp bovis AF2122/97
ccaucuggccgcgggcgcggcc

SEQ ID NO: 3212357 - RNA, 20 nt, Mycobacterium bovis subsp bovis AF2122/97
ccaucuggcugagcagacug

SEQ ID NO: 3212358 - RNA, 20 nt, Mycobacterium bovis subsp bovis AF2122/97
ccaucugugcgcggacaccu

SEQ ID NO: 3212359 - RNA, 16 nt, Mycobacterium bovis subsp bovis AF2122/97
ccaucuuaacgucggc

SEQ ID NO: 3212360 - RNA, 14 nt, Mycobacterium bovis subsp bovis AF2122/97
ccaucuucgggccg

SEQ ID NO: 3212361 - RNA, 16 nt, Mycobacterium bovis subsp bovis AF2122/97
ccaucuugaccaaugu

SEQ ID NO: 3212362 - RNA, 13 nt, Mycobacterium bovis subsp bovis AF2122/97
ccaugaaaucacc

SEQ ID NO: 3212363 - RNA, 18 nt, Mycobacterium bovis subsp bovis AF2122/97
ccaugaacucgaacuggg

SEQ ID NO: 3212364 - RNA, 21 nt, Mycobacterium bovis subsp bovis AF2122/97
ccaugaagaacuggcugcugu

SEQ ID NO: 3212365 - RNA, 16 nt, Mycobacterium bovis subsp bovis AF2122/97
ccaugaaggagauccc

SEQ ID NO: 3212366 - RNA, 12 nt, Mycobacterium bovis subsp bovis AF2122/97
ccaugaccggcc

SEQ ID NO: 3212367 - RNA, 14 nt, Mycobacterium bovis subsp bovis AF2122/97
ccaugaccggccgc

SEQ ID NO: 3212368 - RNA, 16 nt, Mycobacterium bovis subsp bovis AF2122/97
ccaugaccgggcuggc

SEQ ID NO: 3212369 - RNA, 20 nt, Mycobacterium bovis subsp bovis AF2122/97
ccaugaccgggcuggccagc

SEQ ID NO: 3212370 - RNA, 20 nt, Mycobacterium bovis subsp bovis AF2122/97
ccaugagcgcgcccaaccug

SEQ ID NO: 3212371 - RNA, 21 nt, Mycobacterium bovis subsp bovis AF2122/97
ccaugagcgcgcccaaccugg

SEQ ID NO: 3212372 - RNA, 17 nt, Mycobacterium bovis subsp bovis AF2122/97
ccaugaucacaccgcug

SEQ ID NO: 3212373 - RNA, 18 nt, Mycobacterium bovis subsp bovis AF2122/97
ccaugaucacaccgcugc

SEQ ID NO: 3212374 - RNA, 14 nt, Mycobacterium bovis subsp bovis AF2122/97
ccaugaucccgcug

SEQ ID NO: 3212375 - RNA, 16 nt, Mycobacterium bovis subsp bovis AF2122/97
ccaugaucccgcugac

SEQ ID NO: 3212376 - RNA, 14 nt, Mycobacterium bovis subsp bovis AF2122/97
ccaugaugaccggc

SEQ ID NO: 3212377 - RNA, 20 nt, Mycobacterium bovis subsp bovis AF2122/97
ccaugaugccuaccgggccc

SEQ ID NO: 3212378 - RNA, 13 nt, Mycobacterium bovis subsp bovis AF2122/97
ccaugauggacag

SEQ ID NO: 3212379 - RNA, 16 nt, Mycobacterium bovis subsp bovis AF2122/97
ccaugauggccgucag

SEQ ID NO: 3212380 - RNA, 20 nt, Mycobacterium bovis subsp bovis AF2122/97
ccaugauggccgucagccag

SEQ ID NO: 3212381 - RNA, 18 nt, Mycobacterium bovis subsp bovis AF2122/97
ccaugcaacacaccgcgg

SEQ ID NO: 3212382 - RNA, 15 nt, Mycobacterium bovis subsp bovis AF2122/97
ccaugcccgcacgcu

SEQ ID NO: 3212383 - RNA, 19 nt, Mycobacterium bovis subsp bovis AF2122/97
ccaugcccgcacgcucggc

SEQ ID NO: 3212384 - RNA, 23 nt, Mycobacterium bovis subsp bovis AF2122/97
ccaugcccgugggugcgucuggg

SEQ ID NO: 3212385 - RNA, 19 nt, Mycobacterium bovis subsp bovis AF2122/97
ccaugccgaauaccggugg

SEQ ID NO: 3212386 - RNA, 14 nt, Mycobacterium bovis subsp bovis AF2122/97
ccaugccgacgacg

SEQ ID NO: 3212387 - RNA, 17 nt, Mycobacterium bovis subsp bovis AF2122/97
ccaugccgaucggccug

SEQ ID NO: 3212388 - RNA, 19 nt, Mycobacterium bovis subsp bovis AF2122/97
ccaugccgccgaagccgcg

SEQ ID NO: 3212389 - RNA, 17 nt, Mycobacterium bovis subsp bovis AF2122/97
ccaugccgcucggcaac

SEQ ID NO: 3212390 - RNA, 20 nt, Mycobacterium bovis subsp bovis AF2122/97
ccaugccgcucggcaaccug

SEQ ID NO: 3212391 - RNA, 15 nt, Mycobacterium bovis subsp bovis AF2122/97
ccaugccgggaacca

SEQ ID NO: 3212392 - RNA, 12 nt, Mycobacterium bovis subsp bovis AF2122/97
ccaugccuccag

SEQ ID NO: 3212393 - RNA, 15 nt, Mycobacterium bovis subsp bovis AF2122/97
ccaugcgcaccaguc

SEQ ID NO: 3212394 - RNA, 16 nt, Mycobacterium bovis subsp bovis AF2122/97
ccaugcgcaccagucc

SEQ ID NO: 3212395 - RNA, 22 nt, Mycobacterium bovis subsp bovis AF2122/97
ccaugcgcaccaguccagcggg

SEQ ID NO: 3212396 - RNA, 21 nt, Mycobacterium bovis subsp bovis AF2122/97
ccaugcgccaacccggccaaa

SEQ ID NO: 3212397 - RNA, 15 nt, Mycobacterium bovis subsp bovis AF2122/97
ccaugcgccacgcca

SEQ ID NO: 3212398 - RNA, 17 nt, Mycobacterium bovis subsp bovis AF2122/97
ccaugcgccacgccacu

SEQ ID NO: 3212399 - RNA, 21 nt, Mycobacterium bovis subsp bovis AF2122/97
ccaugcgggugucgggcagca

SEQ ID NO: 3212400 - RNA, 19 nt, Mycobacterium bovis subsp bovis AF2122/97
ccauuguuccguccccgac

SEQ ID NO: 3212401 - RNA, 18 nt, Mycobacterium bovis subsp bovis AF2122/97
ccauuguugggccgccag

SEQ ID NO: 3212402 - RNA, 13 nt, Mycobacterium bovis subsp bovis AF2122/97
cccaaaaacggca

SEQ ID NO: 3212403 - RNA, 15 nt, Mycobacterium bovis subsp bovis AF2122/97
cccaaaaagaccgcc

SEQ ID NO: 3212404 - RNA, 15 nt, Mycobacterium bovis subsp bovis AF2122/97
cccaaaccggcccgc

SEQ ID NO: 3212405 - RNA, 14 nt, Mycobacterium bovis subsp bovis AF2122/97
cccaaagcgccagc

SEQ ID NO: 3212406 - RNA, 17 nt, Mycobacterium bovis subsp bovis AF2122/97
cccaacacagccgucgc

SEQ ID NO: 3212407 - RNA, 13 nt, Mycobacterium bovis subsp bovis AF2122/97
cccaacaccagca

SEQ ID NO: 3212408 - RNA, 17 nt, Mycobacterium bovis subsp bovis AF2122/97
cccaacaccagcagcac

SEQ ID NO: 3212409 - RNA, 15 nt, Mycobacterium bovis subsp bovis AF2122/97
cccaacaccgcgccg

SEQ ID NO: 3212410 - RNA, 13 nt, Mycobacterium bovis subsp bovis AF2122/97
cccaacagcaacc

SEQ ID NO: 3212411 - RNA, 23 nt, Mycobacterium bovis subsp bovis AF2122/97
cccaacagcccaccggugccgcc

SEQ ID NO: 3212412 - RNA, 12 nt, Mycobacterium bovis subsp bovis AF2122/97
cccaacaggcgg

SEQ ID NO: 3212413 - RNA, 15 nt, Mycobacterium bovis subsp bovis AF2122/97
cccaacaggcgggac

SEQ ID NO: 3212414 - RNA, 16 nt, Mycobacterium bovis subsp bovis AF2122/97
cccaacagggcggcag

SEQ ID NO: 3212415 - RNA, 21 nt, Mycobacterium bovis subsp bovis AF2122/97
cccaacagggcggcagggugu

SEQ ID NO: 3212416 - RNA, 17 nt, Mycobacterium bovis subsp bovis AF2122/97
cccaacaucccggaccg

SEQ ID NO: 3212417 - RNA, 16 nt, Mycobacterium bovis subsp bovis AF2122/97
cccaaccccgccggcc

SEQ ID NO: 3212418 - RNA, 12 nt, Mycobacterium bovis subsp bovis AF2122/97
cccaacccggau

SEQ ID NO: 3212419 - RNA, 16 nt, Mycobacterium bovis subsp bovis AF2122/97
cccaacccggcggcag

SEQ ID NO: 3212420 - RNA, 18 nt, Mycobacterium bovis subsp bovis AF2122/97
cccaaccgcgccaccucc

SEQ ID NO: 3212421 - RNA, 13 nt, Mycobacterium bovis subsp bovis AF2122/97
cccaaccugggaa

SEQ ID NO: 3212422 - RNA, 15 nt, Mycobacterium bovis subsp bovis AF2122/97
cccaacgaccaccac

SEQ ID NO: 3212423 - RNA, 16 nt, Mycobacterium bovis subsp bovis AF2122/97
cccaacgaccaccacc

SEQ ID NO: 3212424 - RNA, 19 nt, Mycobacterium bovis subsp bovis AF2122/97
cccaacgagaugugagcac

SEQ ID NO: 3212425 - RNA, 14 nt, Mycobacterium bovis subsp bovis AF2122/97
cccaacgccacugc

SEQ ID NO: 3212426 - RNA, 19 nt, Mycobacterium bovis subsp bovis AF2122/97
cccaacgcccgggcgaauc

SEQ ID NO: 3212427 - RNA, 16 nt, Mycobacterium bovis subsp bovis AF2122/97
cccaacgcgggugccg

SEQ ID NO: 3212428 - RNA, 20 nt, Mycobacterium bovis subsp bovis AF2122/97
cccaacgcgguaaagccccg

SEQ ID NO: 3212429 - RNA, 16 nt, Mycobacterium bovis subsp bovis AF2122/97
cccaacgcggugggca

SEQ ID NO: 3212430 - RNA, 16 nt, Mycobacterium bovis subsp bovis AF2122/97
cccaacggaagaccgc

SEQ ID NO: 3212431 - RNA, 21 nt, Mycobacterium bovis subsp bovis AF2122/97
cccaacggugggugggcgccg

SEQ ID NO: 3212432 - RNA, 14 nt, Mycobacterium bovis subsp bovis AF2122/97
cccaacgucgccag

SEQ ID NO: 3212433 - RNA, 22 nt, Mycobacterium bovis subsp bovis AF2122/97
cccaacugcgaaacgccaccgu

SEQ ID NO: 3212434 - RNA, 21 nt, Mycobacterium bovis subsp bovis AF2122/97
cccaagaccaagugucgccgc

SEQ ID NO: 3212435 - RNA, 12 nt, Mycobacterium bovis subsp bovis AF2122/97
cccaagaucucg

SEQ ID NO: 3212436 - RNA, 21 nt, Mycobacterium bovis subsp bovis AF2122/97
cccaagccauguggcgucgcu

SEQ ID NO: 3212437 - RNA, 17 nt, Mycobacterium bovis subsp bovis AF2122/97
cccaagcccgauucagc

SEQ ID NO: 3212438 - RNA, 21 nt, Mycobacterium bovis subsp bovis AF2122/97
cccaagcccgauucagcgccc

SEQ ID NO: 3212439 - RNA, 20 nt, Mycobacterium bovis subsp bovis AF2122/97
cccaagcgccugagcggccu

SEQ ID NO: 3212440 - RNA, 17 nt, Mycobacterium bovis subsp bovis AF2122/97
cccaagcguccgcugca

SEQ ID NO: 3212441 - RNA, 16 nt, Mycobacterium bovis subsp bovis AF2122/97
cccaagcucagggugg

SEQ ID NO: 3212442 - RNA, 18 nt, Mycobacterium bovis subsp bovis AF2122/97
cccaagcucggucaacgc

SEQ ID NO: 3212443 - RNA, 13 nt, Mycobacterium bovis subsp bovis AF2122/97
cccaaggccagga

SEQ ID NO: 3212444 - RNA, 18 nt, Mycobacterium bovis subsp bovis AF2122/97
cccaagguggcggccagu

SEQ ID NO: 3212445 - RNA, 21 nt, Mycobacterium bovis subsp bovis AF2122/97
cccaagucgacgguggcgccg

SEQ ID NO: 3212446 - RNA, 14 nt, Mycobacterium bovis subsp bovis AF2122/97
cccaagucgccgag

SEQ ID NO: 3212447 - RNA, 21 nt, Mycobacterium bovis subsp bovis AF2122/97
cccaauaguccuugcgccagc

SEQ ID NO: 3212448 - RNA, 17 nt, Mycobacterium bovis subsp bovis AF2122/97
cccaaucagugcagcgu

SEQ ID NO: 3212449 - RNA, 22 nt, Mycobacterium bovis subsp bovis AF2122/97
cccaauccaccgaagccccucc

SEQ ID NO: 3212450 - RNA, 22 nt, Mycobacterium bovis subsp bovis AF2122/97
cccaaucgaccgcccgccaacu

SEQ ID NO: 3212451 - RNA, 18 nt, Mycobacterium bovis subsp bovis AF2122/97
cccaaucgucggccagca

SEQ ID NO: 3212452 - RNA, 15 nt, Mycobacterium bovis subsp bovis AF2122/97
cccaaugccaccgcg

SEQ ID NO: 3212453 - RNA, 17 nt, Mycobacterium bovis subsp bovis AF2122/97
cccaauggagccgcgac

SEQ ID NO: 3212454 - RNA, 21 nt, Mycobacterium bovis subsp bovis AF2122/97
cccaauucacgacgccgagca

SEQ ID NO: 3212455 - RNA, 18 nt, Mycobacterium bovis subsp bovis AF2122/97
cccaauucgacugcaacu

SEQ ID NO: 3212456 - RNA, 22 nt, Mycobacterium bovis subsp bovis AF2122/97
cccaauuucgugccgaaauggg

SEQ ID NO: 3212457 - RNA, 15 nt, Mycobacterium bovis subsp bovis AF2122/97
cccacaacaugcugg

SEQ ID NO: 3212458 - RNA, 15 nt, Mycobacterium bovis subsp bovis AF2122/97
cccacaaucagcccg

SEQ ID NO: 3212459 - RNA, 14 nt, Mycobacterium bovis subsp bovis AF2122/97
cccacacacccgac

SEQ ID NO: 3212460 - RNA, 17 nt, Mycobacterium bovis subsp bovis AF2122/97
cccacacacccgacacg

SEQ ID NO: 3212461 - RNA, 13 nt, Mycobacterium bovis subsp bovis AF2122/97
cccacacagucgg

SEQ ID NO: 3212462 - RNA, 12 nt, Mycobacterium bovis subsp bovis AF2122/97
cccacaccagcg

SEQ ID NO: 3212463 - RNA, 16 nt, Mycobacterium bovis subsp bovis AF2122/97
cccacaccagcgcagc

SEQ ID NO: 3212464 - RNA, 14 nt, Mycobacterium bovis subsp bovis AF2122/97
cccacaccuuggcg

SEQ ID NO: 3212465 - RNA, 15 nt, Mycobacterium bovis subsp bovis AF2122/97
cccacaccuuggcgg

SEQ ID NO: 3212466 - RNA, 23 nt, Mycobacterium bovis subsp bovis AF2122/97
cccacacgcccucgacgccgcgc

SEQ ID NO: 3212467 - RNA, 15 nt, Mycobacterium bovis subsp bovis AF2122/97
cccacacgccgaacg

SEQ ID NO: 3212468 - RNA, 20 nt, Mycobacterium bovis subsp bovis AF2122/97
cccacacuaggccccaccau

SEQ ID NO: 3212469 - RNA, 12 nt, Mycobacterium bovis subsp bovis AF2122/97
cccacagcgugc

SEQ ID NO: 3212470 - RNA, 21 nt, Mycobacterium bovis subsp bovis AF2122/97
cccacagcgugcgggucuuug

SEQ ID NO: 3212471 - RNA, 14 nt, Mycobacterium bovis subsp bovis AF2122/97
cccacaggcggcgc

SEQ ID NO: 3212472 - RNA, 15 nt, Mycobacterium bovis subsp bovis AF2122/97
cccacaggcuuuucc

SEQ ID NO: 3212473 - RNA, 19 nt, Mycobacterium bovis subsp bovis AF2122/97
cccacaggcuuuuccggcg

SEQ ID NO: 3212474 - RNA, 22 nt, Mycobacterium bovis subsp bovis AF2122/97
cccacaggggcagcgcggccac

SEQ ID NO: 3212475 - RNA, 23 nt, Mycobacterium bovis subsp bovis AF2122/97
cccacaggggcagcgcggccacc

SEQ ID NO: 3212476 - RNA, 19 nt, Mycobacterium bovis subsp bovis AF2122/97
cccacagguuugcgccgcg

SEQ ID NO: 3212477 - RNA, 18 nt, Mycobacterium bovis subsp bovis AF2122/97
cccacagucgccggccgg

SEQ ID NO: 3212478 - RNA, 19 nt, Mycobacterium bovis subsp bovis AF2122/97
cccacagucgccggccggc

SEQ ID NO: 3212479 - RNA, 20 nt, Mycobacterium bovis subsp bovis AF2122/97
cccacagucgccggccggcc

SEQ ID NO: 3212480 - RNA, 17 nt, Mycobacterium bovis subsp bovis AF2122/97
cccacagucgugagcca

SEQ ID NO: 3212481 - RNA, 17 nt, Mycobacterium bovis subsp bovis AF2122/97
cccacaguuaucagccg

SEQ ID NO: 3212482 - RNA, 17 nt, Mycobacterium bovis subsp bovis AF2122/97
cccacauccaucgccag

SEQ ID NO: 3212483 - RNA, 16 nt, Mycobacterium bovis subsp bovis AF2122/97
cccacaucgucggcgg

SEQ ID NO: 3212484 - RNA, 18 nt, Mycobacterium bovis subsp bovis AF2122/97
cccacaugacgaucgcgg

SEQ ID NO: 3212485 - RNA, 21 nt, Mycobacterium bovis subsp bovis AF2122/97
cccacaugacgaucgcggcgg

SEQ ID NO: 3212486 - RNA, 16 nt, Mycobacterium bovis subsp bovis AF2122/97
cccacaugcgcucgcg

SEQ ID NO: 3212487 - RNA, 19 nt, Mycobacterium bovis subsp bovis AF2122/97
cccacgggccggccgagcg

SEQ ID NO: 3212488 - RNA, 14 nt, Mycobacterium bovis subsp bovis AF2122/97
cccacgugcugccu

SEQ ID NO: 3212489 - RNA, 14 nt, Mycobacterium bovis subsp bovis AF2122/97
cccacguggggccg

SEQ ID NO: 3212490 - RNA, 16 nt, Mycobacterium bovis subsp bovis AF2122/97
cccacguggggccggg

SEQ ID NO: 3212491 - RNA, 14 nt, Mycobacterium bovis subsp bovis AF2122/97
cccacguugacggc

SEQ ID NO: 3212492 - RNA, 20 nt, Mycobacterium bovis subsp bovis AF2122/97
cccacguugaugaugccggc

SEQ ID NO: 3212493 - RNA, 23 nt, Mycobacterium bovis subsp bovis AF2122/97
cccacguugaugaugccggcguu

SEQ ID NO: 3212494 - RNA, 16 nt, Mycobacterium bovis subsp bovis AF2122/97
cccacguuggccccgc

SEQ ID NO: 3212495 - RNA, 18 nt, Mycobacterium bovis subsp bovis AF2122/97
cccacucaucagagcgcu

SEQ ID NO: 3212496 - RNA, 18 nt, Mycobacterium bovis subsp bovis AF2122/97
cccacucccgccccgcuc

SEQ ID NO: 3212497 - RNA, 21 nt, Mycobacterium bovis subsp bovis AF2122/97
cccacucggacccgcaauucc

SEQ ID NO: 3212498 - RNA, 17 nt, Mycobacterium bovis subsp bovis AF2122/97
cccacucggggacggcg

SEQ ID NO: 3212499 - RNA, 18 nt, Mycobacterium bovis subsp bovis AF2122/97
cccacucucgccacgccg

SEQ ID NO: 3212500 - RNA, 23 nt, Mycobacterium bovis subsp bovis AF2122/97
cccacugaccgaacgcaacagcc

SEQ ID NO: 3212501 - RNA, 15 nt, Mycobacterium bovis subsp bovis AF2122/97
cccacugccacuccu

SEQ ID NO: 3212502 - RNA, 13 nt, Mycobacterium bovis subsp bovis AF2122/97
cccacugccgugc

SEQ ID NO: 3212503 - RNA, 15 nt, Mycobacterium bovis subsp bovis AF2122/97
cccacugccgugccg

SEQ ID NO: 3212504 - RNA, 22 nt, Mycobacterium bovis subsp bovis AF2122/97
cccacugccgugccgguguguc

SEQ ID NO: 3212505 - RNA, 12 nt, Mycobacterium bovis subsp bovis AF2122/97
cccacuggaggu

SEQ ID NO: 3212506 - RNA, 17 nt, Mycobacterium bovis subsp bovis AF2122/97
cccacuggugcagcgcc

SEQ ID NO: 3212507 - RNA, 18 nt, Mycobacterium bovis subsp bovis AF2122/97
cccacuggugcagcgccg

SEQ ID NO: 3212508 - RNA, 20 nt, Mycobacterium bovis subsp bovis AF2122/97
cccacuggugcagcgccgac

SEQ ID NO: 3212509 - RNA, 23 nt, Mycobacterium bovis subsp bovis AF2122/97
cccacuggugcagcgccgacagc

SEQ ID NO: 3212510 - RNA, 22 nt, Mycobacterium bovis subsp bovis AF2122/97
cccacuugauuuggggcagucc

SEQ ID NO: 3212511 - RNA, 15 nt, Mycobacterium bovis subsp bovis AF2122/97
cccacuugccgggca

SEQ ID NO: 3212512 - RNA, 21 nt, Mycobacterium bovis subsp bovis AF2122/97
cccacuuuucgguggcggcag

SEQ ID NO: 3212513 - RNA, 22 nt, Mycobacterium bovis subsp bovis AF2122/97
cccacuuuucgguggcggcagc

SEQ ID NO: 3212514 - RNA, 22 nt, Mycobacterium bovis subsp bovis AF2122/97
cccagaaguagguuuucggcgg

SEQ ID NO: 3212515 - RNA, 19 nt, Mycobacterium bovis subsp bovis AF2122/97
cccagacaauccgccgccg

SEQ ID NO: 3212516 - RNA, 14 nt, Mycobacterium bovis subsp bovis AF2122/97
cccagacaccggcu

SEQ ID NO: 3212517 - RNA, 18 nt, Mycobacterium bovis subsp bovis AF2122/97
cccagaccgccgacgccg

SEQ ID NO: 3212518 - RNA, 24 nt, Mycobacterium bovis subsp bovis AF2122/97
cccagaccgccgacgccguugccc

SEQ ID NO: 3212519 - RNA, 15 nt, Mycobacterium bovis subsp bovis AF2122/97
cccagaccggcggcu

SEQ ID NO: 3212520 - RNA, 16 nt, Mycobacterium bovis subsp bovis AF2122/97
cccagacugucgagcg

SEQ ID NO: 3212521 - RNA, 17 nt, Mycobacterium bovis subsp bovis AF2122/97
cccagagaaucagcgug

SEQ ID NO: 3212522 - RNA, 19 nt, Mycobacterium bovis subsp bovis AF2122/97
cccagagugaauccggcau

SEQ ID NO: 3212523 - RNA, 21 nt, Mycobacterium bovis subsp bovis AF2122/97
cccagauagagcuggugcaga

SEQ ID NO: 3212524 - RNA, 17 nt, Mycobacterium bovis subsp bovis AF2122/97
cccagauauugaaccgg

SEQ ID NO: 3212525 - RNA, 16 nt, Mycobacterium bovis subsp bovis AF2122/97
cccagauccgcagcgu

SEQ ID NO: 3212526 - RNA, 18 nt, Mycobacterium bovis subsp bovis AF2122/97
cccagaucggcgacgccg

SEQ ID NO: 3212527 - RNA, 22 nt, Mycobacterium bovis subsp bovis AF2122/97
cccagaucgguugaucggccac

SEQ ID NO: 3212528 - RNA, 19 nt, Mycobacterium bovis subsp bovis AF2122/97
cccagaugcagcgguccag

SEQ ID NO: 3212529 - RNA, 19 nt, Mycobacterium bovis subsp bovis AF2122/97
cccagaugcaggcuuucau

SEQ ID NO: 3212530 - RNA, 18 nt, Mycobacterium bovis subsp bovis AF2122/97
cccagauugcccaacacc

SEQ ID NO: 3212531 - RNA, 21 nt, Mycobacterium bovis subsp bovis AF2122/97
cccagauugcccaacacccac

SEQ ID NO: 3212532 - RNA, 19 nt, Mycobacterium bovis subsp bovis AF2122/97
cccagcaaaggggugugug

SEQ ID NO: 3212533 - RNA, 18 nt, Mycobacterium bovis subsp bovis AF2122/97
cccagcaaccgcucggcg

SEQ ID NO: 3212534 - RNA, 14 nt, Mycobacterium bovis subsp bovis AF2122/97
cccagcaccaccgc

SEQ ID NO: 3212535 - RNA, 22 nt, Mycobacterium bovis subsp bovis AF2122/97
cccagcaccaccgcggugugcg

SEQ ID NO: 3212536 - RNA, 15 nt, Mycobacterium bovis subsp bovis AF2122/97
cccagcaccacggug

SEQ ID NO: 3212537 - RNA, 12 nt, Mycobacterium bovis subsp bovis AF2122/97
cccagcacccgg

SEQ ID NO: 3212538 - RNA, 14 nt, Mycobacterium bovis subsp bovis AF2122/97
cccagcacccggcu

SEQ ID NO: 3212539 - RNA, 12 nt, Mycobacterium bovis subsp bovis AF2122/97
cccagcagacca

SEQ ID NO: 3212540 - RNA, 18 nt, Mycobacterium bovis subsp bovis AF2122/97
cccagcagcaccugcacc

SEQ ID NO: 3212541 - RNA, 20 nt, Mycobacterium bovis subsp bovis AF2122/97
cccagcagcaccugcaccgc

SEQ ID NO: 3212542 - RNA, 21 nt, Mycobacterium bovis subsp bovis AF2122/97
cccagcagcaccugcaccgca

SEQ ID NO: 3212543 - RNA, 15 nt, Mycobacterium bovis subsp bovis AF2122/97
cccagcagcgcgacg

SEQ ID NO: 3212544 - RNA, 15 nt, Mycobacterium bovis subsp bovis AF2122/97
cccagcagggugugc

SEQ ID NO: 3212545 - RNA, 19 nt, Mycobacterium bovis subsp bovis AF2122/97
cccagcagggugugcgucu

SEQ ID NO: 3212546 - RNA, 23 nt, Mycobacterium bovis subsp bovis AF2122/97
cccagcagguuccacggccaggu

SEQ ID NO: 3212547 - RNA, 22 nt, Mycobacterium bovis subsp bovis AF2122/97
cccagcagguuuucgaucuggc

SEQ ID NO: 3212548 - RNA, 17 nt, Mycobacterium bovis subsp bovis AF2122/97
cccagcaguucgccgcg

SEQ ID NO: 3212549 - RNA, 20 nt, Mycobacterium bovis subsp bovis AF2122/97
cccagcaguucgccgcgcag

SEQ ID NO: 3212550 - RNA, 22 nt, Mycobacterium bovis subsp bovis AF2122/97
cccagcaguucgccgcgcagcg

SEQ ID NO: 3212551 - RNA, 15 nt, Mycobacterium bovis subsp bovis AF2122/97
cccagcaucucggcg

SEQ ID NO: 3212552 - RNA, 21 nt, Mycobacterium bovis subsp bovis AF2122/97
cccagcaucucggcggccaac

SEQ ID NO: 3212553 - RNA, 20 nt, Mycobacterium bovis subsp bovis AF2122/97
cccagcaucuuuggcggccg

SEQ ID NO: 3212554 - RNA, 18 nt, Mycobacterium bovis subsp bovis AF2122/97
cccagcaugaagucccgg

SEQ ID NO: 3212555 - RNA, 13 nt, Mycobacterium bovis subsp bovis AF2122/97
cccagccaacccg

SEQ ID NO: 3212556 - RNA, 20 nt, Mycobacterium bovis subsp bovis AF2122/97
cccagccagcagcggcgagc

SEQ ID NO: 3212557 - RNA, 14 nt, Mycobacterium bovis subsp bovis AF2122/97
cccagccagcugga

SEQ ID NO: 3212558 - RNA, 16 nt, Mycobacterium bovis subsp bovis AF2122/97
cccagcccagccguuc

SEQ ID NO: 3212559 - RNA, 18 nt, Mycobacterium bovis subsp bovis AF2122/97
cccagcccuuggcgcgca

SEQ ID NO: 3212560 - RNA, 23 nt, Mycobacterium bovis subsp bovis AF2122/97
cccagcccuuggcgcgcagguag

SEQ ID NO: 3212561 - RNA, 15 nt, Mycobacterium bovis subsp bovis AF2122/97
cccagccgagcggcg

SEQ ID NO: 3212562 - RNA, 18 nt, Mycobacterium bovis subsp bovis AF2122/97
cccagccgagcggcggca

SEQ ID NO: 3212563 - RNA, 17 nt, Mycobacterium bovis subsp bovis AF2122/97
cccagccgagcguggcg

SEQ ID NO: 3212564 - RNA, 19 nt, Mycobacterium bovis subsp bovis AF2122/97
cccagccgcagcaccucgg

SEQ ID NO: 3212565 - RNA, 15 nt, Mycobacterium bovis subsp bovis AF2122/97
cccagccgccagccc

SEQ ID NO: 3212566 - RNA, 12 nt, Mycobacterium bovis subsp bovis AF2122/97
cccagccgcgcc

SEQ ID NO: 3212567 - RNA, 15 nt, Mycobacterium bovis subsp bovis AF2122/97
cccagccgcgccagc

SEQ ID NO: 3212568 - RNA, 19 nt, Mycobacterium bovis subsp bovis AF2122/97
cccagccgcgccagcuccg

SEQ ID NO: 3212569 - RNA, 13 nt, Mycobacterium bovis subsp bovis AF2122/97
cccagccgcggcg

SEQ ID NO: 3212570 - RNA, 16 nt, Mycobacterium bovis subsp bovis AF2122/97
cccagccgcggcgcca

SEQ ID NO: 3212571 - RNA, 15 nt, Mycobacterium bovis subsp bovis AF2122/97
cccagccgcgggccg

SEQ ID NO: 3212572 - RNA, 14 nt, Mycobacterium bovis subsp bovis AF2122/97
cccagccggcagca

SEQ ID NO: 3212573 - RNA, 12 nt, Mycobacterium bovis subsp bovis AF2122/97
cccagggcugcc

SEQ ID NO: 3212574 - RNA, 16 nt, Mycobacterium bovis subsp bovis AF2122/97
cccaggggagcugacc

SEQ ID NO: 3212575 - RNA, 13 nt, Mycobacterium bovis subsp bovis AF2122/97
cccaggggcaccg

SEQ ID NO: 3212576 - RNA, 18 nt, Mycobacterium bovis subsp bovis AF2122/97
cccagggggcgugccgcc

SEQ ID NO: 3212577 - RNA, 19 nt, Mycobacterium bovis subsp bovis AF2122/97
cccagggggcgugccgccg

SEQ ID NO: 3212578 - RNA, 16 nt, Mycobacterium bovis subsp bovis AF2122/97
cccagggugucuguga

SEQ ID NO: 3212579 - RNA, 20 nt, Mycobacterium bovis subsp bovis AF2122/97
cccaggucgaugcgggcgac

SEQ ID NO: 3212580 - RNA, 22 nt, Mycobacterium bovis subsp bovis AF2122/97
cccaggugacgcccgcuccgcg

SEQ ID NO: 3212581 - RNA, 15 nt, Mycobacterium bovis subsp bovis AF2122/97
cccaggugcaagcgg

SEQ ID NO: 3212582 - RNA, 13 nt, Mycobacterium bovis subsp bovis AF2122/97
cccaggugggcag

SEQ ID NO: 3212583 - RNA, 14 nt, Mycobacterium bovis subsp bovis AF2122/97
cccaggugggcagc

SEQ ID NO: 3212584 - RNA, 13 nt, Mycobacterium bovis subsp bovis AF2122/97
cccaggugggccg

SEQ ID NO: 3212585 - RNA, 18 nt, Mycobacterium bovis subsp bovis AF2122/97
cccaggugguucaaccgg

SEQ ID NO: 3212586 - RNA, 17 nt, Mycobacterium bovis subsp bovis AF2122/97
cccagguguguggcggc

SEQ ID NO: 3212587 - RNA, 17 nt, Mycobacterium bovis subsp bovis AF2122/97
cccaguaaguccucgau

SEQ ID NO: 3212588 - RNA, 23 nt, Mycobacterium bovis subsp bovis AF2122/97
cccaguacgaucgugagacgccg

SEQ ID NO: 3212589 - RNA, 20 nt, Mycobacterium bovis subsp bovis AF2122/97
cccaguagaucgccucgacg

SEQ ID NO: 3212590 - RNA, 17 nt, Mycobacterium bovis subsp bovis AF2122/97
cccaguauaauucgaga

SEQ ID NO: 3212591 - RNA, 13 nt, Mycobacterium bovis subsp bovis AF2122/97
cccaguccaggac

SEQ ID NO: 3212592 - RNA, 14 nt, Mycobacterium bovis subsp bovis AF2122/97
cccaguccaggacg

SEQ ID NO: 3212593 - RNA, 21 nt, Mycobacterium bovis subsp bovis AF2122/97
cccagucccaacacggcgaca

SEQ ID NO: 3212594 - RNA, 17 nt, Mycobacterium bovis subsp bovis AF2122/97
cccaguccgaagcugcu

SEQ ID NO: 3212595 - RNA, 19 nt, Mycobacterium bovis subsp bovis AF2122/97
cccaguccgaagcugcugc

SEQ ID NO: 3212596 - RNA, 20 nt, Mycobacterium bovis subsp bovis AF2122/97
cccaguccgaagcugcugcu

SEQ ID NO: 3212597 - RNA, 16 nt, Mycobacterium bovis subsp bovis AF2122/97
cccagucggcgccgcc

SEQ ID NO: 3212598 - RNA, 20 nt, Mycobacterium bovis subsp bovis AF2122/97
cccagucguuccgccgccuc

SEQ ID NO: 3212599 - RNA, 19 nt, Mycobacterium bovis subsp bovis AF2122/97
cccagugcacgcucggcgc

SEQ ID NO: 3212600 - RNA, 21 nt, Mycobacterium bovis subsp bovis AF2122/97
cccagugcacgcucggcgccg

SEQ ID NO: 3212601 - RNA, 22 nt, Mycobacterium bovis subsp bovis AF2122/97
cccagugcgcaacccagccgcg

SEQ ID NO: 3212602 - RNA, 15 nt, Mycobacterium bovis subsp bovis AF2122/97
cccagugggacaggu

SEQ ID NO: 3212603 - RNA, 13 nt, Mycobacterium bovis subsp bovis AF2122/97
cccagugucagca

SEQ ID NO: 3212604 - RNA, 21 nt, Mycobacterium bovis subsp bovis AF2122/97
cccagugucagcaagaucggc

SEQ ID NO: 3212605 - RNA, 22 nt, Mycobacterium bovis subsp bovis AF2122/97
cccagugugcgguuggaucggc

SEQ ID NO: 3212606 - RNA, 15 nt, Mycobacterium bovis subsp bovis AF2122/97
cccaguguucgacga

SEQ ID NO: 3212607 - RNA, 15 nt, Mycobacterium bovis subsp bovis AF2122/97
cccaguuccacccgg

SEQ ID NO: 3212608 - RNA, 18 nt, Mycobacterium bovis subsp bovis AF2122/97
cccaguucguugguguug

SEQ ID NO: 3212609 - RNA, 13 nt, Mycobacterium bovis subsp bovis AF2122/97
cccaguucugcag

SEQ ID NO: 3212610 - RNA, 16 nt, Mycobacterium bovis subsp bovis AF2122/97
cccaguugugcggcca

SEQ ID NO: 3212611 - RNA, 15 nt, Mycobacterium bovis subsp bovis AF2122/97
cccauaacugcggcc

SEQ ID NO: 3212612 - RNA, 21 nt, Mycobacterium bovis subsp bovis AF2122/97
cccauacggcaauacccgccg

SEQ ID NO: 3212613 - RNA, 16 nt, Mycobacterium bovis subsp bovis AF2122/97
cccauacgugccgccg

SEQ ID NO: 3212614 - RNA, 22 nt, Mycobacterium bovis subsp bovis AF2122/97
cccauacgugccgccgaugucg

SEQ ID NO: 3212615 - RNA, 14 nt, Mycobacterium bovis subsp bovis AF2122/97
cccauagccggugg

SEQ ID NO: 3212616 - RNA, 19 nt, Mycobacterium bovis subsp bovis AF2122/97
cccaucaacaucggcccgc

SEQ ID NO: 3212617 - RNA, 22 nt, Mycobacterium bovis subsp bovis AF2122/97
cccaucaacgccggcgacggcg

SEQ ID NO: 3212618 - RNA, 14 nt, Mycobacterium bovis subsp bovis AF2122/97
cccaucacacccgg

SEQ ID NO: 3212619 - RNA, 15 nt, Mycobacterium bovis subsp bovis AF2122/97
cccaucacacccggu

SEQ ID NO: 3212620 - RNA, 15 nt, Mycobacterium bovis subsp bovis AF2122/97
cccaucaccaccggc

SEQ ID NO: 3212621 - RNA, 13 nt, Mycobacterium bovis subsp bovis AF2122/97
cccaucaccagcg

SEQ ID NO: 3212622 - RNA, 14 nt, Mycobacterium bovis subsp bovis AF2122/97
cccaucaccagcgg

SEQ ID NO: 3212623 - RNA, 12 nt, Mycobacterium bovis subsp bovis AF2122/97
cccaucaccccg

SEQ ID NO: 3212624 - RNA, 13 nt, Mycobacterium bovis subsp bovis AF2122/97
cccaucacccugu

SEQ ID NO: 3212625 - RNA, 15 nt, Mycobacterium bovis subsp bovis AF2122/97
cccaucaccgccagc

SEQ ID NO: 3212626 - RNA, 14 nt, Mycobacterium bovis subsp bovis AF2122/97
cccaucaucgccac

SEQ ID NO: 3212627 - RNA, 17 nt, Mycobacterium bovis subsp bovis AF2122/97
cccaucaucgccaccac

SEQ ID NO: 3212628 - RNA, 17 nt, Mycobacterium bovis subsp bovis AF2122/97
cccauccccgcucgauc

SEQ ID NO: 3212629 - RNA, 17 nt, Mycobacterium bovis subsp bovis AF2122/97
cccauccggucgauguc

SEQ ID NO: 3212630 - RNA, 20 nt, Mycobacterium bovis subsp bovis AF2122/97
cccaucgaaaaaccucgacg

SEQ ID NO: 3212631 - RNA, 16 nt, Mycobacterium bovis subsp bovis AF2122/97
cccaucgaccgcccgc

SEQ ID NO: 3212632 - RNA, 17 nt, Mycobacterium bovis subsp bovis AF2122/97
cccaucgaccgcccgcc

SEQ ID NO: 3212633 - RNA, 18 nt, Mycobacterium bovis subsp bovis AF2122/97
cccaucgaccgcccgcca

SEQ ID NO: 3212634 - RNA, 20 nt, Mycobacterium bovis subsp bovis AF2122/97
cccaucgaccgcccgccagc

SEQ ID NO: 3212635 - RNA, 12 nt, Mycobacterium bovis subsp bovis AF2122/97
cccaucgccaca

SEQ ID NO: 3212636 - RNA, 16 nt, Mycobacterium bovis subsp bovis AF2122/97
cccaucgccacaccca

SEQ ID NO: 3212637 - RNA, 16 nt, Mycobacterium bovis subsp bovis AF2122/97
cccaucgccuggaugc

SEQ ID NO: 3212638 - RNA, 19 nt, Mycobacterium bovis subsp bovis AF2122/97
cccaucgccuggaugccga

SEQ ID NO: 3212639 - RNA, 18 nt, Mycobacterium bovis subsp bovis AF2122/97
cccaucgcgacggcccga

SEQ ID NO: 3212640 - RNA, 13 nt, Mycobacterium bovis subsp bovis AF2122/97
cccaucgcgucgg

SEQ ID NO: 3212641 - RNA, 13 nt, Mycobacterium bovis subsp bovis AF2122/97
cccaucgggcgcc

SEQ ID NO: 3212642 - RNA, 17 nt, Mycobacterium bovis subsp bovis AF2122/97
cccaucgucgagccgcc

SEQ ID NO: 3212643 - RNA, 19 nt, Mycobacterium bovis subsp bovis AF2122/97
cccaucuaccagcucaccc

SEQ ID NO: 3212644 - RNA, 16 nt, Mycobacterium bovis subsp bovis AF2122/97
cccaucucgucgucgg

SEQ ID NO: 3212645 - RNA, 16 nt, Mycobacterium bovis subsp bovis AF2122/97
cccaucugcucagggc

SEQ ID NO: 3212646 - RNA, 19 nt, Mycobacterium bovis subsp bovis AF2122/97
cccaucuucggacgccagc

SEQ ID NO: 3212647 - RNA, 14 nt, Mycobacterium bovis subsp bovis AF2122/97
cccaugaaggagau

SEQ ID NO: 3212648 - RNA, 17 nt, Mycobacterium bovis subsp bovis AF2122/97
cccaugaccuucaugcc

SEQ ID NO: 3212649 - RNA, 13 nt, Mycobacterium bovis subsp bovis AF2122/97
cccaugaucuggu

SEQ ID NO: 3212650 - RNA, 17 nt, Mycobacterium bovis subsp bovis AF2122/97
cccaugauggccgcggc

SEQ ID NO: 3212651 - RNA, 16 nt, Mycobacterium bovis subsp bovis AF2122/97
cccaugcaacacaccg

SEQ ID NO: 3212652 - RNA, 18 nt, Mycobacterium bovis subsp bovis AF2122/97
cccaugcaacacaccgcg

SEQ ID NO: 3212653 - RNA, 15 nt, Mycobacterium bovis subsp bovis AF2122/97
cccaugcccggcggg

SEQ ID NO: 3212654 - RNA, 18 nt, Mycobacterium bovis subsp bovis AF2122/97
cccaugcgccagcgagcg

SEQ ID NO: 3212655 - RNA, 20 nt, Mycobacterium bovis subsp bovis AF2122/97
cccaugcggcaggugcccau

SEQ ID NO: 3212656 - RNA, 23 nt, Mycobacterium bovis subsp bovis AF2122/97
cccaugcuucggagaccgccucg

SEQ ID NO: 3212657 - RNA, 12 nt, Mycobacterium bovis subsp bovis AF2122/97
cccauggcauuc

SEQ ID NO: 3212658 - RNA, 17 nt, Mycobacterium bovis subsp bovis AF2122/97
cccauggccaccgaacg

SEQ ID NO: 3212659 - RNA, 14 nt, Mycobacterium bovis subsp bovis AF2122/97
cccauggccagcgc

SEQ ID NO: 3212660 - RNA, 16 nt, Mycobacterium bovis subsp bovis AF2122/97
ccccaucaccaccggc

SEQ ID NO: 3212661 - RNA, 18 nt, Mycobacterium bovis subsp bovis AF2122/97
ccccaucaccaccggcac

SEQ ID NO: 3212662 - RNA, 18 nt, Mycobacterium bovis subsp bovis AF2122/97
ccccaucgcaucucgcag

SEQ ID NO: 3212663 - RNA, 19 nt, Mycobacterium bovis subsp bovis AF2122/97
ccccaugaccgggaggcgg

SEQ ID NO: 3212664 - RNA, 12 nt, Mycobacterium bovis subsp bovis AF2122/97
ccccauugccgc

SEQ ID NO: 3212665 - RNA, 17 nt, Mycobacterium bovis subsp bovis AF2122/97
ccccauugccgucgcgg

SEQ ID NO: 3212666 - RNA, 19 nt, Mycobacterium bovis subsp bovis AF2122/97
ccccauugccgucgcgguc

SEQ ID NO: 3212667 - RNA, 18 nt, Mycobacterium bovis subsp bovis AF2122/97
cccccaccagggacgaug

SEQ ID NO: 3212668 - RNA, 22 nt, Mycobacterium bovis subsp bovis AF2122/97
cccccagacaauccgccgccgg

SEQ ID NO: 3212669 - RNA, 15 nt, Mycobacterium bovis subsp bovis AF2122/97
cccccagcacccggc

SEQ ID NO: 3212670 - RNA, 16 nt, Mycobacterium bovis subsp bovis AF2122/97
cccccagcacccggcu

SEQ ID NO: 3212671 - RNA, 12 nt, Mycobacterium bovis subsp bovis AF2122/97
cccccagcagcu

SEQ ID NO: 3212672 - RNA, 14 nt, Mycobacterium bovis subsp bovis AF2122/97
cccccagccgcggc

SEQ ID NO: 3212673 - RNA, 12 nt, Mycobacterium bovis subsp bovis AF2122/97
cccccagcgccc

SEQ ID NO: 3212674 - RNA, 15 nt, Mycobacterium bovis subsp bovis AF2122/97
cccccagcgcccgcc

SEQ ID NO: 3212675 - RNA, 17 nt, Mycobacterium bovis subsp bovis AF2122/97
cccccagcgccgccgcg

SEQ ID NO: 3212676 - RNA, 13 nt, Mycobacterium bovis subsp bovis AF2122/97
cccccccacccac

SEQ ID NO: 3212677 - RNA, 13 nt, Mycobacterium bovis subsp bovis AF2122/97
ccccccccaccca

SEQ ID NO: 3212678 - RNA, 13 nt, Mycobacterium bovis subsp bovis AF2122/97
ccccccgaccccg

SEQ ID NO: 3212679 - RNA, 12 nt, Mycobacterium bovis subsp bovis AF2122/97
ccccccgugcgg

SEQ ID NO: 3212680 - RNA, 13 nt, Mycobacterium bovis subsp bovis AF2122/97
ccccccguugccg

SEQ ID NO: 3212681 - RNA, 16 nt, Mycobacterium bovis subsp bovis AF2122/97
ccccccguugccgccg

SEQ ID NO: 3212682 - RNA, 22 nt, Mycobacterium bovis subsp bovis AF2122/97
cccccgaaguggugaccgacgc

SEQ ID NO: 3212683 - RNA, 14 nt, Mycobacterium bovis subsp bovis AF2122/97
cccccgacacgccg

SEQ ID NO: 3212684 - RNA, 20 nt, Mycobacterium bovis subsp bovis AF2122/97
cccccgacuccggcaggccc

SEQ ID NO: 3212685 - RNA, 22 nt, Mycobacterium bovis subsp bovis AF2122/97
cccccgauagcgaccgcggccc

SEQ ID NO: 3212686 - RNA, 21 nt, Mycobacterium bovis subsp bovis AF2122/97
cccccgaucaggccgacgucg

SEQ ID NO: 3212687 - RNA, 20 nt, Mycobacterium bovis subsp bovis AF2122/97
cccccgauggcgucgccggc

SEQ ID NO: 3212688 - RNA, 14 nt, Mycobacterium bovis subsp bovis AF2122/97
cccccgcacgcucg

SEQ ID NO: 3212689 - RNA, 12 nt, Mycobacterium bovis subsp bovis AF2122/97
cccccgccgcgc

SEQ ID NO: 3212690 - RNA, 12 nt, Mycobacterium bovis subsp bovis AF2122/97
cccccgccggcc

SEQ ID NO: 3212691 - RNA, 14 nt, Mycobacterium bovis subsp bovis AF2122/97
cccccgccggccgc

SEQ ID NO: 3212692 - RNA, 16 nt, Mycobacterium bovis subsp bovis AF2122/97
cccccgccggccgcgc

SEQ ID NO: 3212693 - RNA, 13 nt, Mycobacterium bovis subsp bovis AF2122/97
cccccgccggcgc

SEQ ID NO: 3212694 - RNA, 11 nt, Mycobacterium bovis subsp bovis AF2122/97
cccccgcgcga

SEQ ID NO: 3212695 - RNA, 12 nt, Mycobacterium bovis subsp bovis AF2122/97
cccccgcgcgaa

SEQ ID NO: 3212696 - RNA, 20 nt, Mycobacterium bovis subsp bovis AF2122/97
cccccgcgggggcggccggc

SEQ ID NO: 3212697 - RNA, 16 nt, Mycobacterium bovis subsp bovis AF2122/97
cccccggcaccgccgg

SEQ ID NO: 3212698 - RNA, 17 nt, Mycobacterium bovis subsp bovis AF2122/97
cccccggcaccgccggc

SEQ ID NO: 3212699 - RNA, 23 nt, Mycobacterium bovis subsp bovis AF2122/97
cccccggcagcgugcggggcgcc

SEQ ID NO: 3212700 - RNA, 14 nt, Mycobacterium bovis subsp bovis AF2122/97
cccccggcgacggc

SEQ ID NO: 3212701 - RNA, 13 nt, Mycobacterium bovis subsp bovis AF2122/97
cccccgggcccgc

SEQ ID NO: 3212702 - RNA, 16 nt, Mycobacterium bovis subsp bovis AF2122/97
cccccggguccgccgu

SEQ ID NO: 3212703 - RNA, 21 nt, Mycobacterium bovis subsp bovis AF2122/97
cccccggguccgccguugccg

SEQ ID NO: 3212704 - RNA, 12 nt, Mycobacterium bovis subsp bovis AF2122/97
cccccggugccg

SEQ ID NO: 3212705 - RNA, 15 nt, Mycobacterium bovis subsp bovis AF2122/97
cccccggugccgccc

SEQ ID NO: 3212706 - RNA, 18 nt, Mycobacterium bovis subsp bovis AF2122/97
cccccuagaccgggcggu

SEQ ID NO: 3212707 - RNA, 15 nt, Mycobacterium bovis subsp bovis AF2122/97
cccccucggcgugau

SEQ ID NO: 3212708 - RNA, 12 nt, Mycobacterium bovis subsp bovis AF2122/97
cccccugccaca

SEQ ID NO: 3212709 - RNA, 18 nt, Mycobacterium bovis subsp bovis AF2122/97
ccccgaacauccgccgcc

SEQ ID NO: 3212710 - RNA, 18 nt, Mycobacterium bovis subsp bovis AF2122/97
ccccgaacauugcgccca

SEQ ID NO: 3212711 - RNA, 13 nt, Mycobacterium bovis subsp bovis AF2122/97
ccccgaaccgcgc

SEQ ID NO: 3212712 - RNA, 16 nt, Mycobacterium bovis subsp bovis AF2122/97
ccccgaagaugaccuc

SEQ ID NO: 3212713 - RNA, 18 nt, Mycobacterium bovis subsp bovis AF2122/97
ccccgaagcucaucaccg

SEQ ID NO: 3212714 - RNA, 21 nt, Mycobacterium bovis subsp bovis AF2122/97
ccccgaaguggugaccgacgc

SEQ ID NO: 3212715 - RNA, 13 nt, Mycobacterium bovis subsp bovis AF2122/97
ccccgaccagcag

SEQ ID NO: 3212716 - RNA, 14 nt, Mycobacterium bovis subsp bovis AF2122/97
ccccgaccccgacg

SEQ ID NO: 3212717 - RNA, 15 nt, Mycobacterium bovis subsp bovis AF2122/97
ccccgaccgaaccgu

SEQ ID NO: 3212718 - RNA, 15 nt, Mycobacterium bovis subsp bovis AF2122/97
ccccgaccgccgugg

SEQ ID NO: 3212719 - RNA, 18 nt, Mycobacterium bovis subsp bovis AF2122/97
ccccgaccgccguggccg

SEQ ID NO: 3212720 - RNA, 21 nt, Mycobacterium bovis subsp bovis AF2122/97
ccccgacgagauacggccacc

SEQ ID NO: 3212721 - RNA, 17 nt, Mycobacterium bovis subsp bovis AF2122/97
ccccgacggacuccggc

SEQ ID NO: 3212722 - RNA, 22 nt, Mycobacterium bovis subsp bovis AF2122/97
ccccgacggacuccggccggcc

SEQ ID NO: 3212723 - RNA, 21 nt, Mycobacterium bovis subsp bovis AF2122/97
ccccgacggcaaugcggggca

SEQ ID NO: 3212724 - RNA, 13 nt, Mycobacterium bovis subsp bovis AF2122/97
ccccgacugccgc

SEQ ID NO: 3212725 - RNA, 17 nt, Mycobacterium bovis subsp bovis AF2122/97
ccccgacugcgcccaua

SEQ ID NO: 3212726 - RNA, 13 nt, Mycobacterium bovis subsp bovis AF2122/97
ccccgagauccgu

SEQ ID NO: 3212727 - RNA, 23 nt, Mycobacterium bovis subsp bovis AF2122/97
ccccgagauccguccgcuggugg

SEQ ID NO: 3212728 - RNA, 19 nt, Mycobacterium bovis subsp bovis AF2122/97
ccccgagcggagccgccga

SEQ ID NO: 3212729 - RNA, 20 nt, Mycobacterium bovis subsp bovis AF2122/97
ccccgagcugccgucgcugc

SEQ ID NO: 3212730 - RNA, 16 nt, Mycobacterium bovis subsp bovis AF2122/97
ccccgagcugucggcu

SEQ ID NO: 3212731 - RNA, 22 nt, Mycobacterium bovis subsp bovis AF2122/97
ccccgagcugucggcuuccucc

SEQ ID NO: 3212732 - RNA, 15 nt, Mycobacterium bovis subsp bovis AF2122/97
ccccgaggaugccga

SEQ ID NO: 3212733 - RNA, 23 nt, Mycobacterium bovis subsp bovis AF2122/97
ccccgauaaaaaccacccccacc

SEQ ID NO: 3212734 - RNA, 22 nt, Mycobacterium bovis subsp bovis AF2122/97
ccccgauagcgaccgcggcccc

SEQ ID NO: 3212735 - RNA, 13 nt, Mycobacterium bovis subsp bovis AF2122/97
ccccgaucagcac

SEQ ID NO: 3212736 - RNA, 18 nt, Mycobacterium bovis subsp bovis AF2122/97
ccccgaucagcaccgacg

SEQ ID NO: 3212737 - RNA, 12 nt, Mycobacterium bovis subsp bovis AF2122/97
ccccgaucaggc

SEQ ID NO: 3212738 - RNA, 15 nt, Mycobacterium bovis subsp bovis AF2122/97
ccccgaucaggccga

SEQ ID NO: 3212739 - RNA, 15 nt, Mycobacterium bovis subsp bovis AF2122/97
ccccgaucaucgacg

SEQ ID NO: 3212740 - RNA, 14 nt, Mycobacterium bovis subsp bovis AF2122/97
ccccgaucccgagg

SEQ ID NO: 3212741 - RNA, 12 nt, Mycobacterium bovis subsp bovis AF2122/97
ccccgaucggcc

SEQ ID NO: 3212742 - RNA, 13 nt, Mycobacterium bovis subsp bovis AF2122/97
ccccgaucugcuc

SEQ ID NO: 3212743 - RNA, 17 nt, Mycobacterium bovis subsp bovis AF2122/97
ccccgcacgaguuaccg

SEQ ID NO: 3212744 - RNA, 17 nt, Mycobacterium bovis subsp bovis AF2122/97
ccccgcacgcgggaggu

SEQ ID NO: 3212745 - RNA, 11 nt, Mycobacterium bovis subsp bovis AF2122/97
ccccgcacgcu

SEQ ID NO: 3212746 - RNA, 21 nt, Mycobacterium bovis subsp bovis AF2122/97
ccccgcagccagaucuccccg

SEQ ID NO: 3212747 - RNA, 22 nt, Mycobacterium bovis subsp bovis AF2122/97
ccccgcagccagaucuccccga

SEQ ID NO: 3212748 - RNA, 12 nt, Mycobacterium bovis subsp bovis AF2122/97
ccccgcagcgcc

SEQ ID NO: 3212749 - RNA, 13 nt, Mycobacterium bovis subsp bovis AF2122/97
ccccgcagcgccu

SEQ ID NO: 3212750 - RNA, 22 nt, Mycobacterium bovis subsp bovis AF2122/97
ccccgcagcgccuaccagcacc

SEQ ID NO: 3212751 - RNA, 11 nt, Mycobacterium bovis subsp bovis AF2122/97
ccccgcagcuc

SEQ ID NO: 3212752 - RNA, 23 nt, Mycobacterium bovis subsp bovis AF2122/97
ccccgcaggggguggugucgcgg

SEQ ID NO: 3212753 - RNA, 15 nt, Mycobacterium bovis subsp bovis AF2122/97
ccccgcaucgcccaa

SEQ ID NO: 3212754 - RNA, 16 nt, Mycobacterium bovis subsp bovis AF2122/97
ccccgccacgccgaag

SEQ ID NO: 3212755 - RNA, 13 nt, Mycobacterium bovis subsp bovis AF2122/97
ccccgccagcgcc

SEQ ID NO: 3212756 - RNA, 14 nt, Mycobacterium bovis subsp bovis AF2122/97
ccccgccagcgccg

SEQ ID NO: 3212757 - RNA, 13 nt, Mycobacterium bovis subsp bovis AF2122/97
ccccgccaggauc

SEQ ID NO: 3212758 - RNA, 19 nt, Mycobacterium bovis subsp bovis AF2122/97
ccccgccauugccgccggc

SEQ ID NO: 3212759 - RNA, 13 nt, Mycobacterium bovis subsp bovis AF2122/97
ccccgcccgcgcg

SEQ ID NO: 3212760 - RNA, 17 nt, Mycobacterium bovis subsp bovis AF2122/97
ccccgccgagcggugcc

SEQ ID NO: 3212761 - RNA, 14 nt, Mycobacterium bovis subsp bovis AF2122/97
ccccgccgaucacc

SEQ ID NO: 3212762 - RNA, 12 nt, Mycobacterium bovis subsp bovis AF2122/97
ccccgccgcacg

SEQ ID NO: 3212763 - RNA, 12 nt, Mycobacterium bovis subsp bovis AF2122/97
ccccgccgccac

SEQ ID NO: 3212764 - RNA, 13 nt, Mycobacterium bovis subsp bovis AF2122/97
ccccgccgccacg

SEQ ID NO: 3212765 - RNA, 11 nt, Mycobacterium bovis subsp bovis AF2122/97
ccccgccgccc

SEQ ID NO: 3212766 - RNA, 13 nt, Mycobacterium bovis subsp bovis AF2122/97
ccccgccgcgacg

SEQ ID NO: 3212767 - RNA, 11 nt, Mycobacterium bovis subsp bovis AF2122/97
ccccgccgcua

SEQ ID NO: 3212768 - RNA, 12 nt, Mycobacterium bovis subsp bovis AF2122/97
ccccgccggcca

SEQ ID NO: 3212769 - RNA, 14 nt, Mycobacterium bovis subsp bovis AF2122/97
ccccgccggccgcg

SEQ ID NO: 3212770 - RNA, 13 nt, Mycobacterium bovis subsp bovis AF2122/97
ccccgccggccgg

SEQ ID NO: 3212771 - RNA, 16 nt, Mycobacterium bovis subsp bovis AF2122/97
ccccgccggcgccacc

SEQ ID NO: 3212772 - RNA, 17 nt, Mycobacterium bovis subsp bovis AF2122/97
ccccgccggcgccgccc

SEQ ID NO: 3212773 - RNA, 17 nt, Mycobacterium bovis subsp bovis AF2122/97
ccccgccggcugcggag

SEQ ID NO: 3212774 - RNA, 13 nt, Mycobacterium bovis subsp bovis AF2122/97
ccccgccgucacc

SEQ ID NO: 3212775 - RNA, 15 nt, Mycobacterium bovis subsp bovis AF2122/97
ccccgccgucaccgc

SEQ ID NO: 3212776 - RNA, 16 nt, Mycobacterium bovis subsp bovis AF2122/97
ccccgccgucgccacc

SEQ ID NO: 3212777 - RNA, 15 nt, Mycobacterium bovis subsp bovis AF2122/97
ccccgccguugccgc

SEQ ID NO: 3212778 - RNA, 21 nt, Mycobacterium bovis subsp bovis AF2122/97
ccccgccguugccgccgacgc

SEQ ID NO: 3212779 - RNA, 17 nt, Mycobacterium bovis subsp bovis AF2122/97
ccccgcgaaguugcggg

SEQ ID NO: 3212780 - RNA, 15 nt, Mycobacterium bovis subsp bovis AF2122/97
ccccgcgccggccgc

SEQ ID NO: 3212781 - RNA, 15 nt, Mycobacterium bovis subsp bovis AF2122/97
ccccgcgccugccuc

SEQ ID NO: 3212782 - RNA, 18 nt, Mycobacterium bovis subsp bovis AF2122/97
ccccgcgccugccucacc

SEQ ID NO: 3212783 - RNA, 13 nt, Mycobacterium bovis subsp bovis AF2122/97
ccccgcgcgccag

SEQ ID NO: 3212784 - RNA, 14 nt, Mycobacterium bovis subsp bovis AF2122/97
ccccgcgcgccagc

SEQ ID NO: 3212785 - RNA, 12 nt, Mycobacterium bovis subsp bovis AF2122/97
ccccgcgcggug

SEQ ID NO: 3212786 - RNA, 14 nt, Mycobacterium bovis subsp bovis AF2122/97
ccccgcgcggugcc

SEQ ID NO: 3212787 - RNA, 20 nt, Mycobacterium bovis subsp bovis AF2122/97
ccccgcgcggugcccugccg

SEQ ID NO: 3212788 - RNA, 14 nt, Mycobacterium bovis subsp bovis AF2122/97
ccccgcggcgccgc

SEQ ID NO: 3212789 - RNA, 11 nt, Mycobacterium bovis subsp bovis AF2122/97
ccccgcggcgg

SEQ ID NO: 3212790 - RNA, 15 nt, Mycobacterium bovis subsp bovis AF2122/97
ccccgcgggggcggc

SEQ ID NO: 3212791 - RNA, 23 nt, Mycobacterium bovis subsp bovis AF2122/97
ccccgcgguagccgaccgaccgc

SEQ ID NO: 3212792 - RNA, 13 nt, Mycobacterium bovis subsp bovis AF2122/97
ccccgcuacgcgc

SEQ ID NO: 3212793 - RNA, 14 nt, Mycobacterium bovis subsp bovis AF2122/97
ccccgcuacgcgcg

SEQ ID NO: 3212794 - RNA, 15 nt, Mycobacterium bovis subsp bovis AF2122/97
ccccgcuccgcgccg

SEQ ID NO: 3212795 - RNA, 21 nt, Mycobacterium bovis subsp bovis AF2122/97
ccccgcucgaucugcccggug

SEQ ID NO: 3212796 - RNA, 21 nt, Mycobacterium bovis subsp bovis AF2122/97
ccccgcuuggcgagccacggc

SEQ ID NO: 3212797 - RNA, 20 nt, Mycobacterium bovis subsp bovis AF2122/97
ccccggacggcaggcuggcg

SEQ ID NO: 3212798 - RNA, 22 nt, Mycobacterium bovis subsp bovis AF2122/97
ccccggauuccagcagccugcg

SEQ ID NO: 3212799 - RNA, 21 nt, Mycobacterium bovis subsp bovis AF2122/97
ccccggauuccucgucaccgc

SEQ ID NO: 3212800 - RNA, 11 nt, Mycobacterium bovis subsp bovis AF2122/97
ccccggcaccg

SEQ ID NO: 3212801 - RNA, 22 nt, Mycobacterium bovis subsp bovis AF2122/97
ccccggcaccgccggcuccgcc

SEQ ID NO: 3212802 - RNA, 14 nt, Mycobacterium bovis subsp bovis AF2122/97
ccccggcagcgccc

SEQ ID NO: 3212803 - RNA, 23 nt, Mycobacterium bovis subsp bovis AF2122/97
ccccggccacuugguaguccugc

SEQ ID NO: 3212804 - RNA, 13 nt, Mycobacterium bovis subsp bovis AF2122/97
ccccggccaggac

SEQ ID NO: 3212805 - RNA, 17 nt, Mycobacterium bovis subsp bovis AF2122/97
ccccggccauggcgcgc

SEQ ID NO: 3212806 - RNA, 18 nt, Mycobacterium bovis subsp bovis AF2122/97
ccccggccccgacgguca

SEQ ID NO: 3212807 - RNA, 19 nt, Mycobacterium bovis subsp bovis AF2122/97
ccccggcccgaucggcaac

SEQ ID NO: 3212808 - RNA, 14 nt, Mycobacterium bovis subsp bovis AF2122/97
ccccggccgcaucg

SEQ ID NO: 3212809 - RNA, 13 nt, Mycobacterium bovis subsp bovis AF2122/97
ccccggcgacccg

SEQ ID NO: 3212810 - RNA, 18 nt, Mycobacterium bovis subsp bovis AF2122/97
ccccggcgacggcguagc

SEQ ID NO: 3212811 - RNA, 23 nt, Mycobacterium bovis subsp bovis AF2122/97
ccccggcgagcagacgcauaagc

SEQ ID NO: 3212812 - RNA, 14 nt, Mycobacterium bovis subsp bovis AF2122/97
ccccggcgcggcgg

SEQ ID NO: 3212813 - RNA, 20 nt, Mycobacterium bovis subsp bovis AF2122/97
ccccggcgcuggugcgccac

SEQ ID NO: 3212814 - RNA, 13 nt, Mycobacterium bovis subsp bovis AF2122/97
ccccggcgguacc

SEQ ID NO: 3212815 - RNA, 19 nt, Mycobacterium bovis subsp bovis AF2122/97
ccccggcgguaccggagca

SEQ ID NO: 3212816 - RNA, 16 nt, Mycobacterium bovis subsp bovis AF2122/97
ccccggcuccgcaacc

SEQ ID NO: 3212817 - RNA, 13 nt, Mycobacterium bovis subsp bovis AF2122/97
ccccggcucggcc

SEQ ID NO: 3212818 - RNA, 23 nt, Mycobacterium bovis subsp bovis AF2122/97
ccccggcucucuucgcgcgcugg

SEQ ID NO: 3212819 - RNA, 19 nt, Mycobacterium bovis subsp bovis AF2122/97
ccccggcugccagcgccgc

SEQ ID NO: 3212820 - RNA, 12 nt, Mycobacterium bovis subsp bovis AF2122/97
ccccgggcccgc

SEQ ID NO: 3212821 - RNA, 19 nt, Mycobacterium bovis subsp bovis AF2122/97
ccccgggcggugaggcagc

SEQ ID NO: 3212822 - RNA, 16 nt, Mycobacterium bovis subsp bovis AF2122/97
ccccggggcgcucgcg

SEQ ID NO: 3212823 - RNA, 18 nt, Mycobacterium bovis subsp bovis AF2122/97
ccccgguagcguucggcg

SEQ ID NO: 3212824 - RNA, 13 nt, Mycobacterium bovis subsp bovis AF2122/97
ccccggucccgcc

SEQ ID NO: 3212825 - RNA, 16 nt, Mycobacterium bovis subsp bovis AF2122/97
ccccggucccgccgac

SEQ ID NO: 3212826 - RNA, 13 nt, Mycobacterium bovis subsp bovis AF2122/97
ccccggucgccgc

SEQ ID NO: 3212827 - RNA, 13 nt, Mycobacterium bovis subsp bovis AF2122/97
ccccggucggcga

SEQ ID NO: 3212828 - RNA, 14 nt, Mycobacterium bovis subsp bovis AF2122/97
ccccggugccgccc

SEQ ID NO: 3212829 - RNA, 16 nt, Mycobacterium bovis subsp bovis AF2122/97
ccccggugccgcccgc

SEQ ID NO: 3212830 - RNA, 14 nt, Mycobacterium bovis subsp bovis AF2122/97
ccccgguucaccuc

SEQ ID NO: 3212831 - RNA, 16 nt, Mycobacterium bovis subsp bovis AF2122/97
ccccgguuccgcgaug

SEQ ID NO: 3212832 - RNA, 22 nt, Mycobacterium bovis subsp bovis AF2122/97
ccccgguugacucgcuccgacc

SEQ ID NO: 3212833 - RNA, 22 nt, Mycobacterium bovis subsp bovis AF2122/97
ccccguagauggugguggcccg

SEQ ID NO: 3212834 - RNA, 13 nt, Mycobacterium bovis subsp bovis AF2122/97
ccccguaggcgcc

SEQ ID NO: 3212835 - RNA, 20 nt, Mycobacterium bovis subsp bovis AF2122/97
ccccguaggugcacaacccg

SEQ ID NO: 3212836 - RNA, 23 nt, Mycobacterium bovis subsp bovis AF2122/97
cccgacgagauugccgggccgcc

SEQ ID NO: 3212837 - RNA, 17 nt, Mycobacterium bovis subsp bovis AF2122/97
cccgacgaggaugucga

SEQ ID NO: 3212838 - RNA, 15 nt, Mycobacterium bovis subsp bovis AF2122/97
cccgacgagucgccg

SEQ ID NO: 3212839 - RNA, 22 nt, Mycobacterium bovis subsp bovis AF2122/97
cccgacgaugcgggcgaucucg

SEQ ID NO: 3212840 - RNA, 17 nt, Mycobacterium bovis subsp bovis AF2122/97
cccgacgcagcuugccc

SEQ ID NO: 3212841 - RNA, 23 nt, Mycobacterium bovis subsp bovis AF2122/97
cccgacgcagcuugcccgacggc

SEQ ID NO: 3212842 - RNA, 13 nt, Mycobacterium bovis subsp bovis AF2122/97
cccgacgccacgc

SEQ ID NO: 3212843 - RNA, 15 nt, Mycobacterium bovis subsp bovis AF2122/97
cccgacgccagcugc

SEQ ID NO: 3212844 - RNA, 17 nt, Mycobacterium bovis subsp bovis AF2122/97
cccgacgccagcugccc

SEQ ID NO: 3212845 - RNA, 21 nt, Mycobacterium bovis subsp bovis AF2122/97
cccgacgccagcugcccgacg

SEQ ID NO: 3212846 - RNA, 20 nt, Mycobacterium bovis subsp bovis AF2122/97
cccgacggacuccggccggc

SEQ ID NO: 3212847 - RNA, 20 nt, Mycobacterium bovis subsp bovis AF2122/97
cccgacggaguucgacgucg

SEQ ID NO: 3212848 - RNA, 20 nt, Mycobacterium bovis subsp bovis AF2122/97
cccgacggguaucccguccc

SEQ ID NO: 3212849 - RNA, 22 nt, Mycobacterium bovis subsp bovis AF2122/97
cccgacgucaggcagcuccgcc

SEQ ID NO: 3212850 - RNA, 17 nt, Mycobacterium bovis subsp bovis AF2122/97
cccgacgucgcggagua

SEQ ID NO: 3212851 - RNA, 18 nt, Mycobacterium bovis subsp bovis AF2122/97
cccgacgugaagccaagc

SEQ ID NO: 3212852 - RNA, 12 nt, Mycobacterium bovis subsp bovis AF2122/97
cccgacguucgu

SEQ ID NO: 3212853 - RNA, 18 nt, Mycobacterium bovis subsp bovis AF2122/97
cccgacucggccgugacc

SEQ ID NO: 3212854 - RNA, 24 nt, Mycobacterium bovis subsp bovis AF2122/97
cccgacucggccgugaccgagccg

SEQ ID NO: 3212855 - RNA, 13 nt, Mycobacterium bovis subsp bovis AF2122/97
cccgacucgucgg

SEQ ID NO: 3212856 - RNA, 16 nt, Mycobacterium bovis subsp bovis AF2122/97
cccgacugcgcccaua

SEQ ID NO: 3212857 - RNA, 17 nt, Mycobacterium bovis subsp bovis AF2122/97
cccgacuggucacugcc

SEQ ID NO: 3212858 - RNA, 20 nt, Mycobacterium bovis subsp bovis AF2122/97
cccgacuguagaaaacccgu

SEQ ID NO: 3212859 - RNA, 13 nt, Mycobacterium bovis subsp bovis AF2122/97
cccgagaucaccg

SEQ ID NO: 3212860 - RNA, 18 nt, Mycobacterium bovis subsp bovis AF2122/97
cccgagcaacggcggcag

SEQ ID NO: 3212861 - RNA, 21 nt, Mycobacterium bovis subsp bovis AF2122/97
cccgagcaacggcggcaggcc

SEQ ID NO: 3212862 - RNA, 15 nt, Mycobacterium bovis subsp bovis AF2122/97
cccgagcccagcgcc

SEQ ID NO: 3212863 - RNA, 20 nt, Mycobacterium bovis subsp bovis AF2122/97
cccgagcccagcgccuccag

SEQ ID NO: 3212864 - RNA, 18 nt, Mycobacterium bovis subsp bovis AF2122/97
cccgagcccgcugcgccg

SEQ ID NO: 3212865 - RNA, 13 nt, Mycobacterium bovis subsp bovis AF2122/97
cccgagcccguca

SEQ ID NO: 3212866 - RNA, 17 nt, Mycobacterium bovis subsp bovis AF2122/97
cccgagcccgucagcuc

SEQ ID NO: 3212867 - RNA, 15 nt, Mycobacterium bovis subsp bovis AF2122/97
cccgagccgcagcuc

SEQ ID NO: 3212868 - RNA, 16 nt, Mycobacterium bovis subsp bovis AF2122/97
cccgagccgcugcgac

SEQ ID NO: 3212869 - RNA, 15 nt, Mycobacterium bovis subsp bovis AF2122/97
cccgagccggggaac

SEQ ID NO: 3212870 - RNA, 14 nt, Mycobacterium bovis subsp bovis AF2122/97
cccgagccgguaac

SEQ ID NO: 3212871 - RNA, 20 nt, Mycobacterium bovis subsp bovis AF2122/97
cccgagccggugccacugcc

SEQ ID NO: 3212872 - RNA, 11 nt, Mycobacterium bovis subsp bovis AF2122/97
cccgagccugg

SEQ ID NO: 3212873 - RNA, 23 nt, Mycobacterium bovis subsp bovis AF2122/97
cccgagccuugagcgcggcuacg

SEQ ID NO: 3212874 - RNA, 21 nt, Mycobacterium bovis subsp bovis AF2122/97
cccgagcgaugcgaccgacuu

SEQ ID NO: 3212875 - RNA, 21 nt, Mycobacterium bovis subsp bovis AF2122/97
cccgagcgcucgaucacggcg

SEQ ID NO: 3212876 - RNA, 16 nt, Mycobacterium bovis subsp bovis AF2122/97
cccgagcggagccgcc

SEQ ID NO: 3212877 - RNA, 21 nt, Mycobacterium bovis subsp bovis AF2122/97
cccgagcggcugagccgcauc

SEQ ID NO: 3212878 - RNA, 15 nt, Mycobacterium bovis subsp bovis AF2122/97
cccgagcucaccgca

SEQ ID NO: 3212879 - RNA, 16 nt, Mycobacterium bovis subsp bovis AF2122/97
cccgagcucaccgcac

SEQ ID NO: 3212880 - RNA, 12 nt, Mycobacterium bovis subsp bovis AF2122/97
cccgagcucgaa

SEQ ID NO: 3212881 - RNA, 16 nt, Mycobacterium bovis subsp bovis AF2122/97
cccgagcucgccgcag

SEQ ID NO: 3212882 - RNA, 14 nt, Mycobacterium bovis subsp bovis AF2122/97
cccgaggcaacaag

SEQ ID NO: 3212883 - RNA, 16 nt, Mycobacterium bovis subsp bovis AF2122/97
cccgaggcgcccaaca

SEQ ID NO: 3212884 - RNA, 13 nt, Mycobacterium bovis subsp bovis AF2122/97
cccgaggcucggg

SEQ ID NO: 3212885 - RNA, 22 nt, Mycobacterium bovis subsp bovis AF2122/97
cccgagggcagagcggcaguca

SEQ ID NO: 3212886 - RNA, 14 nt, Mycobacterium bovis subsp bovis AF2122/97
cccgagggcggcag

SEQ ID NO: 3212887 - RNA, 15 nt, Mycobacterium bovis subsp bovis AF2122/97
cccgagggcggcagc

SEQ ID NO: 3212888 - RNA, 20 nt, Mycobacterium bovis subsp bovis AF2122/97
cccgaggugccggggcccca

SEQ ID NO: 3212889 - RNA, 19 nt, Mycobacterium bovis subsp bovis AF2122/97
cccgagucgugcguugccg

SEQ ID NO: 3212890 - RNA, 16 nt, Mycobacterium bovis subsp bovis AF2122/97
cccgagucugcgagca

SEQ ID NO: 3212891 - RNA, 22 nt, Mycobacterium bovis subsp bovis AF2122/97
cccgagugaccaggguggcauc

SEQ ID NO: 3212892 - RNA, 17 nt, Mycobacterium bovis subsp bovis AF2122/97
cccgaguuaaacgcagc

SEQ ID NO: 3212893 - RNA, 18 nt, Mycobacterium bovis subsp bovis AF2122/97
cccgaguuaaacgcagcg

SEQ ID NO: 3212894 - RNA, 21 nt, Mycobacterium bovis subsp bovis AF2122/97
cccgaguuaaacgcagcggug

SEQ ID NO: 3212895 - RNA, 16 nt, Mycobacterium bovis subsp bovis AF2122/97
cccgaguuaccgguga

SEQ ID NO: 3212896 - RNA, 17 nt, Mycobacterium bovis subsp bovis AF2122/97
cccgaguucgcaaugcc

SEQ ID NO: 3212897 - RNA, 15 nt, Mycobacterium bovis subsp bovis AF2122/97
cccgaguugaagaau

SEQ ID NO: 3212898 - RNA, 18 nt, Mycobacterium bovis subsp bovis AF2122/97
cccgaguugaaggugccg

SEQ ID NO: 3212899 - RNA, 19 nt, Mycobacterium bovis subsp bovis AF2122/97
cccgaguuguugcugcccc

SEQ ID NO: 3212900 - RNA, 13 nt, Mycobacterium bovis subsp bovis AF2122/97
cccgauacccggu

SEQ ID NO: 3212901 - RNA, 16 nt, Mycobacterium bovis subsp bovis AF2122/97
cccgauacggccggcc

SEQ ID NO: 3212902 - RNA, 17 nt, Mycobacterium bovis subsp bovis AF2122/97
cccgauacggccggccg

SEQ ID NO: 3212903 - RNA, 13 nt, Mycobacterium bovis subsp bovis AF2122/97
cccgauacgggug

SEQ ID NO: 3212904 - RNA, 18 nt, Mycobacterium bovis subsp bovis AF2122/97
cccgauagcgaccgcggc

SEQ ID NO: 3212905 - RNA, 19 nt, Mycobacterium bovis subsp bovis AF2122/97
cccgauagcgaccgcggcc

SEQ ID NO: 3212906 - RNA, 20 nt, Mycobacterium bovis subsp bovis AF2122/97
cccgauagcgaccgcggccc

SEQ ID NO: 3212907 - RNA, 21 nt, Mycobacterium bovis subsp bovis AF2122/97
cccgauagcgaccgcggcccc

SEQ ID NO: 3212908 - RNA, 22 nt, Mycobacterium bovis subsp bovis AF2122/97
cccgauagcgaccgcggccccg

SEQ ID NO: 3212909 - RNA, 14 nt, Mycobacterium bovis subsp bovis AF2122/97
cccgaucaccagcc

SEQ ID NO: 3212910 - RNA, 17 nt, Mycobacterium bovis subsp bovis AF2122/97
cccgaucaccagcccca

SEQ ID NO: 3212911 - RNA, 13 nt, Mycobacterium bovis subsp bovis AF2122/97
cccgaucaccccg

SEQ ID NO: 3212912 - RNA, 19 nt, Mycobacterium bovis subsp bovis AF2122/97
cccgaucaccccggucggc

SEQ ID NO: 3212913 - RNA, 20 nt, Mycobacterium bovis subsp bovis AF2122/97
cccgaucaccccggucggcc

SEQ ID NO: 3212914 - RNA, 12 nt, Mycobacterium bovis subsp bovis AF2122/97
cccgaucacgcu

SEQ ID NO: 3212915 - RNA, 21 nt, Mycobacterium bovis subsp bovis AF2122/97
cccgaucagguacgccaggug

SEQ ID NO: 3212916 - RNA, 14 nt, Mycobacterium bovis subsp bovis AF2122/97
cccgaucaucgacg

SEQ ID NO: 3212917 - RNA, 13 nt, Mycobacterium bovis subsp bovis AF2122/97
cccgauccagugg

SEQ ID NO: 3212918 - RNA, 23 nt, Mycobacterium bovis subsp bovis AF2122/97
cccgauccagugguaggccgccg

SEQ ID NO: 3212919 - RNA, 14 nt, Mycobacterium bovis subsp bovis AF2122/97
cccgauccgccacg

SEQ ID NO: 3212920 - RNA, 18 nt, Mycobacterium bovis subsp bovis AF2122/97
cccgauccugcccaccau

SEQ ID NO: 3212921 - RNA, 14 nt, Mycobacterium bovis subsp bovis AF2122/97
cccgauccuggcca

SEQ ID NO: 3212922 - RNA, 20 nt, Mycobacterium bovis subsp bovis AF2122/97
cccgauccuggccacuccca

SEQ ID NO: 3212923 - RNA, 18 nt, Mycobacterium bovis subsp bovis AF2122/97
cccgcaggucgcaccaca

SEQ ID NO: 3212924 - RNA, 18 nt, Mycobacterium bovis subsp bovis AF2122/97
cccgcaggucgcuggccg

SEQ ID NO: 3212925 - RNA, 17 nt, Mycobacterium bovis subsp bovis AF2122/97
cccgcaggucggccacc

SEQ ID NO: 3212926 - RNA, 20 nt, Mycobacterium bovis subsp bovis AF2122/97
cccgcagguggcuguucacc

SEQ ID NO: 3212927 - RNA, 22 nt, Mycobacterium bovis subsp bovis AF2122/97
cccgcagguggcuguucaccuc

SEQ ID NO: 3212928 - RNA, 21 nt, Mycobacterium bovis subsp bovis AF2122/97
cccgcaguggucggcuccgcg

SEQ ID NO: 3212929 - RNA, 17 nt, Mycobacterium bovis subsp bovis AF2122/97
cccgcauaccguucacc

SEQ ID NO: 3212930 - RNA, 14 nt, Mycobacterium bovis subsp bovis AF2122/97
cccgcauccgcacc

SEQ ID NO: 3212931 - RNA, 15 nt, Mycobacterium bovis subsp bovis AF2122/97
cccgcaucgcaccag

SEQ ID NO: 3212932 - RNA, 14 nt, Mycobacterium bovis subsp bovis AF2122/97
cccgcaucgcccaa

SEQ ID NO: 3212933 - RNA, 16 nt, Mycobacterium bovis subsp bovis AF2122/97
cccgcaucgcggcauc

SEQ ID NO: 3212934 - RNA, 18 nt, Mycobacterium bovis subsp bovis AF2122/97
cccgcaucgcggcaucga

SEQ ID NO: 3212935 - RNA, 22 nt, Mycobacterium bovis subsp bovis AF2122/97
cccgcaucgcggcaucgacgcg

SEQ ID NO: 3212936 - RNA, 14 nt, Mycobacterium bovis subsp bovis AF2122/97
cccgcaucggcacg

SEQ ID NO: 3212937 - RNA, 16 nt, Mycobacterium bovis subsp bovis AF2122/97
cccgcaucggcacgcc

SEQ ID NO: 3212938 - RNA, 18 nt, Mycobacterium bovis subsp bovis AF2122/97
cccgcaucggcacgccau

SEQ ID NO: 3212939 - RNA, 14 nt, Mycobacterium bovis subsp bovis AF2122/97
cccgcaugacgccg

SEQ ID NO: 3212940 - RNA, 18 nt, Mycobacterium bovis subsp bovis AF2122/97
cccgcaugcacgucaucg

SEQ ID NO: 3212941 - RNA, 18 nt, Mycobacterium bovis subsp bovis AF2122/97
cccgcaugcccuggacca

SEQ ID NO: 3212942 - RNA, 14 nt, Mycobacterium bovis subsp bovis AF2122/97
cccgcaugccggcg

SEQ ID NO: 3212943 - RNA, 15 nt, Mycobacterium bovis subsp bovis AF2122/97
cccgcaugccggcgc

SEQ ID NO: 3212944 - RNA, 17 nt, Mycobacterium bovis subsp bovis AF2122/97
cccgcauggacgcgaug

SEQ ID NO: 3212945 - RNA, 16 nt, Mycobacterium bovis subsp bovis AF2122/97
cccgcauggcagcggc

SEQ ID NO: 3212946 - RNA, 19 nt, Mycobacterium bovis subsp bovis AF2122/97
cccgcauggcagcggcggu

SEQ ID NO: 3212947 - RNA, 17 nt, Mycobacterium bovis subsp bovis AF2122/97
cccgcauggcgcggguc

SEQ ID NO: 3212948 - RNA, 21 nt, Mycobacterium bovis subsp bovis AF2122/97
cccgcauugaucucgaccggc

SEQ ID NO: 3212949 - RNA, 18 nt, Mycobacterium bovis subsp bovis AF2122/97
cccgcauugccaacgccc

SEQ ID NO: 3212950 - RNA, 14 nt, Mycobacterium bovis subsp bovis AF2122/97
cccgccaaccccaa

SEQ ID NO: 3212951 - RNA, 16 nt, Mycobacterium bovis subsp bovis AF2122/97
cccgccacaacggcgg

SEQ ID NO: 3212952 - RNA, 12 nt, Mycobacterium bovis subsp bovis AF2122/97
cccgccaccgaa

SEQ ID NO: 3212953 - RNA, 18 nt, Mycobacterium bovis subsp bovis AF2122/97
cccgccaccgaacgcacc

SEQ ID NO: 3212954 - RNA, 12 nt, Mycobacterium bovis subsp bovis AF2122/97
cccgccaccgcg

SEQ ID NO: 3212955 - RNA, 14 nt, Mycobacterium bovis subsp bovis AF2122/97
cccgccaccggagg

SEQ ID NO: 3212956 - RNA, 13 nt, Mycobacterium bovis subsp bovis AF2122/97
cccgccaccggcg

SEQ ID NO: 3212957 - RNA, 17 nt, Mycobacterium bovis subsp bovis AF2122/97
cccgccaccggcgcgac

SEQ ID NO: 3212958 - RNA, 14 nt, Mycobacterium bovis subsp bovis AF2122/97
cccgccaccggguu

SEQ ID NO: 3212959 - RNA, 16 nt, Mycobacterium bovis subsp bovis AF2122/97
cccgccacgaugucgu

SEQ ID NO: 3212960 - RNA, 20 nt, Mycobacterium bovis subsp bovis AF2122/97
cccgccacgguucgggcagc

SEQ ID NO: 3212961 - RNA, 20 nt, Mycobacterium bovis subsp bovis AF2122/97
cccgccacguacuccaccgc

SEQ ID NO: 3212962 - RNA, 24 nt, Mycobacterium bovis subsp bovis AF2122/97
cccgccacgucgccggcuaccgcc

SEQ ID NO: 3212963 - RNA, 20 nt, Mycobacterium bovis subsp bovis AF2122/97
cccgccagcgauccaccaag

SEQ ID NO: 3212964 - RNA, 15 nt, Mycobacterium bovis subsp bovis AF2122/97
cccgccagcgccgcc

SEQ ID NO: 3212965 - RNA, 16 nt, Mycobacterium bovis subsp bovis AF2122/97
cccgccagcgccgccg

SEQ ID NO: 3212966 - RNA, 17 nt, Mycobacterium bovis subsp bovis AF2122/97
cccgccagcgccgccgc

SEQ ID NO: 3212967 - RNA, 15 nt, Mycobacterium bovis subsp bovis AF2122/97
cccgccagcggcagc

SEQ ID NO: 3212968 - RNA, 11 nt, Mycobacterium bovis subsp bovis AF2122/97
cccgccagggc

SEQ ID NO: 3212969 - RNA, 21 nt, Mycobacterium bovis subsp bovis AF2122/97
cccgccagggcggcaucccca

SEQ ID NO: 3212970 - RNA, 21 nt, Mycobacterium bovis subsp bovis AF2122/97
cccgccaucagcccggcgcgc

SEQ ID NO: 3212971 - RNA, 22 nt, Mycobacterium bovis subsp bovis AF2122/97
cccgccaucagcccggcgcgcc

SEQ ID NO: 3212972 - RNA, 15 nt, Mycobacterium bovis subsp bovis AF2122/97
cccgccaucugccug

SEQ ID NO: 3212973 - RNA, 20 nt, Mycobacterium bovis subsp bovis AF2122/97
cccgccaucugccugccugc

SEQ ID NO: 3212974 - RNA, 15 nt, Mycobacterium bovis subsp bovis AF2122/97
cccgccaugcggcgc

SEQ ID NO: 3212975 - RNA, 16 nt, Mycobacterium bovis subsp bovis AF2122/97
cccgccauugccgccg

SEQ ID NO: 3212976 - RNA, 21 nt, Mycobacterium bovis subsp bovis AF2122/97
cccgccauugccgccggcgcc

SEQ ID NO: 3212977 - RNA, 18 nt, Mycobacterium bovis subsp bovis AF2122/97
cccgccauugccgccguc

SEQ ID NO: 3212978 - RNA, 21 nt, Mycobacterium bovis subsp bovis AF2122/97
cccgcccaagguggcggccag

SEQ ID NO: 3212979 - RNA, 13 nt, Mycobacterium bovis subsp bovis AF2122/97
cccgcccaaugcg

SEQ ID NO: 3212980 - RNA, 22 nt, Mycobacterium bovis subsp bovis AF2122/97
cccgcccaccucgaucgcgccg

SEQ ID NO: 3212981 - RNA, 13 nt, Mycobacterium bovis subsp bovis AF2122/97
cccgcccacggca

SEQ ID NO: 3212982 - RNA, 18 nt, Mycobacterium bovis subsp bovis AF2122/97
cccgccccgggccaccag

SEQ ID NO: 3212983 - RNA, 21 nt, Mycobacterium bovis subsp bovis AF2122/97
cccgcccgacgugaagccaag

SEQ ID NO: 3212984 - RNA, 12 nt, Mycobacterium bovis subsp bovis AF2122/97
cccgcccgagcc

SEQ ID NO: 3212985 - RNA, 13 nt, Mycobacterium bovis subsp bovis AF2122/97
cccgcccgagccg

SEQ ID NO: 3212986 - RNA, 19 nt, Mycobacterium bovis subsp bovis AF2122/97
cccgcccgagccgcugcga

SEQ ID NO: 3212987 - RNA, 22 nt, Mycobacterium bovis subsp bovis AF2122/97
cccgcccggaacggguuggcga

SEQ ID NO: 3212988 - RNA, 19 nt, Mycobacterium bovis subsp bovis AF2122/97
cccgcccggacgcaacacc

SEQ ID NO: 3212989 - RNA, 14 nt, Mycobacterium bovis subsp bovis AF2122/97
cccgcccggcaguu

SEQ ID NO: 3212990 - RNA, 22 nt, Mycobacterium bovis subsp bovis AF2122/97
cccgcccuggcaacgacacgcc

SEQ ID NO: 3212991 - RNA, 19 nt, Mycobacterium bovis subsp bovis AF2122/97
cccgcccuugccgccagcc

SEQ ID NO: 3212992 - RNA, 22 nt, Mycobacterium bovis subsp bovis AF2122/97
cccgcccuugccgccagcccca

SEQ ID NO: 3212993 - RNA, 20 nt, Mycobacterium bovis subsp bovis AF2122/97
cccgcccuugcggcgugaug

SEQ ID NO: 3212994 - RNA, 13 nt, Mycobacterium bovis subsp bovis AF2122/97
cccgccgaccgac

SEQ ID NO: 3212995 - RNA, 14 nt, Mycobacterium bovis subsp bovis AF2122/97
cccgccgaccgaca

SEQ ID NO: 3212996 - RNA, 20 nt, Mycobacterium bovis subsp bovis AF2122/97
cccgccgaccgacaccacca

SEQ ID NO: 3212997 - RNA, 13 nt, Mycobacterium bovis subsp bovis AF2122/97
cccgccgacgcca

SEQ ID NO: 3212998 - RNA, 18 nt, Mycobacterium bovis subsp bovis AF2122/97
cccgccgacgccagaucc

SEQ ID NO: 3212999 - RNA, 13 nt, Mycobacterium bovis subsp bovis AF2122/97
cccgccgacgccg

SEQ ID NO: 3213000 - RNA, 16 nt, Mycobacterium bovis subsp bovis AF2122/97
cccgccgacgccgccg

SEQ ID NO: 3213001 - RNA, 22 nt, Mycobacterium bovis subsp bovis AF2122/97
cccgccgacgccgccggccccg

SEQ ID NO: 3213002 - RNA, 13 nt, Mycobacterium bovis subsp bovis AF2122/97
cccgccgaugccg

SEQ ID NO: 3213003 - RNA, 19 nt, Mycobacterium bovis subsp bovis AF2122/97
cccgccgaugcugccgccg

SEQ ID NO: 3213004 - RNA, 22 nt, Mycobacterium bovis subsp bovis AF2122/97
cccgccgaugcugccgccgccg

SEQ ID NO: 3213005 - RNA, 15 nt, Mycobacterium bovis subsp bovis AF2122/97
cccgccgccaccagc

SEQ ID NO: 3213006 - RNA, 17 nt, Mycobacterium bovis subsp bovis AF2122/97
cccgccgccaccagcug

SEQ ID NO: 3213007 - RNA, 20 nt, Mycobacterium bovis subsp bovis AF2122/97
cccgccgccaccagcugcgc

SEQ ID NO: 3213008 - RNA, 13 nt, Mycobacterium bovis subsp bovis AF2122/97
cccgccgccgccc

SEQ ID NO: 3213009 - RNA, 16 nt, Mycobacterium bovis subsp bovis AF2122/97
cccgccgccgcccggg

SEQ ID NO: 3213010 - RNA, 19 nt, Mycobacterium bovis subsp bovis AF2122/97
cccgcgccgccgccaccac

SEQ ID NO: 3213011 - RNA, 23 nt, Mycobacterium bovis subsp bovis AF2122/97
cccgcgccgccggacccaccguc

SEQ ID NO: 3213012 - RNA, 15 nt, Mycobacterium bovis subsp bovis AF2122/97
cccgcgccgcgcauc

SEQ ID NO: 3213013 - RNA, 15 nt, Mycobacterium bovis subsp bovis AF2122/97
cccgcgccggccgca

SEQ ID NO: 3213014 - RNA, 12 nt, Mycobacterium bovis subsp bovis AF2122/97
cccgcgccggcg

SEQ ID NO: 3213015 - RNA, 18 nt, Mycobacterium bovis subsp bovis AF2122/97
cccgcgccuccguugccc

SEQ ID NO: 3213016 - RNA, 17 nt, Mycobacterium bovis subsp bovis AF2122/97
cccgcgccuuggcaccc

SEQ ID NO: 3213017 - RNA, 15 nt, Mycobacterium bovis subsp bovis AF2122/97
cccgcgcgagccgcu

SEQ ID NO: 3213018 - RNA, 16 nt, Mycobacterium bovis subsp bovis AF2122/97
cccgcgcgccagcucg

SEQ ID NO: 3213019 - RNA, 14 nt, Mycobacterium bovis subsp bovis AF2122/97
cccgcgcgccggcg

SEQ ID NO: 3213020 - RNA, 14 nt, Mycobacterium bovis subsp bovis AF2122/97
cccgcgcggcgcau

SEQ ID NO: 3213021 - RNA, 16 nt, Mycobacterium bovis subsp bovis AF2122/97
cccgcgcgggcggauc

SEQ ID NO: 3213022 - RNA, 20 nt, Mycobacterium bovis subsp bovis AF2122/97
cccgcgcgguggcggucgcc

SEQ ID NO: 3213023 - RNA, 21 nt, Mycobacterium bovis subsp bovis AF2122/97
cccgcgcgguggcggucgcca

SEQ ID NO: 3213024 - RNA, 11 nt, Mycobacterium bovis subsp bovis AF2122/97
cccgcgcgucg

SEQ ID NO: 3213025 - RNA, 13 nt, Mycobacterium bovis subsp bovis AF2122/97
cccgcgcgucgcc

SEQ ID NO: 3213026 - RNA, 16 nt, Mycobacterium bovis subsp bovis AF2122/97
cccgcgcgucgcccag

SEQ ID NO: 3213027 - RNA, 17 nt, Mycobacterium bovis subsp bovis AF2122/97
cccgcgcgucgcccagu

SEQ ID NO: 3213028 - RNA, 18 nt, Mycobacterium bovis subsp bovis AF2122/97
cccgcgcguucggcgagc

SEQ ID NO: 3213029 - RNA, 13 nt, Mycobacterium bovis subsp bovis AF2122/97
cccgcgcucgcac

SEQ ID NO: 3213030 - RNA, 17 nt, Mycobacterium bovis subsp bovis AF2122/97
cccgcgcucgcacccgc

SEQ ID NO: 3213031 - RNA, 18 nt, Mycobacterium bovis subsp bovis AF2122/97
cccgcgcucgcacccgcu

SEQ ID NO: 3213032 - RNA, 15 nt, Mycobacterium bovis subsp bovis AF2122/97
cccgcggacagcccg

SEQ ID NO: 3213033 - RNA, 16 nt, Mycobacterium bovis subsp bovis AF2122/97
cccgcggacagcccgg

SEQ ID NO: 3213034 - RNA, 13 nt, Mycobacterium bovis subsp bovis AF2122/97
cccgcggaccgca

SEQ ID NO: 3213035 - RNA, 23 nt, Mycobacterium bovis subsp bovis AF2122/97
cccgcggaccgcaacgacggccg

SEQ ID NO: 3213036 - RNA, 15 nt, Mycobacterium bovis subsp bovis AF2122/97
cccgcggacgugccg

SEQ ID NO: 3213037 - RNA, 13 nt, Mycobacterium bovis subsp bovis AF2122/97
cccgcggccgcca

SEQ ID NO: 3213038 - RNA, 14 nt, Mycobacterium bovis subsp bovis AF2122/97
cccgcggccgccag

SEQ ID NO: 3213039 - RNA, 15 nt, Mycobacterium bovis subsp bovis AF2122/97
cccgcggccgggccg

SEQ ID NO: 3213040 - RNA, 12 nt, Mycobacterium bovis subsp bovis AF2122/97
cccgcggcgaac

SEQ ID NO: 3213041 - RNA, 14 nt, Mycobacterium bovis subsp bovis AF2122/97
cccgcggcgccgcc

SEQ ID NO: 3213042 - RNA, 17 nt, Mycobacterium bovis subsp bovis AF2122/97
cccgcggcgccgccacg

SEQ ID NO: 3213043 - RNA, 17 nt, Mycobacterium bovis subsp bovis AF2122/97
cccgcgggcaagccgga

SEQ ID NO: 3213044 - RNA, 20 nt, Mycobacterium bovis subsp bovis AF2122/97
cccgcgggcaguggcagccc

SEQ ID NO: 3213045 - RNA, 19 nt, Mycobacterium bovis subsp bovis AF2122/97
cccgcggggaaucacccac

SEQ ID NO: 3213046 - RNA, 23 nt, Mycobacterium bovis subsp bovis AF2122/97
cccgcggggaaucacccacucgc

SEQ ID NO: 3213047 - RNA, 16 nt, Mycobacterium bovis subsp bovis AF2122/97
cccgcgggggcggccg

SEQ ID NO: 3213048 - RNA, 18 nt, Mycobacterium bovis subsp bovis AF2122/97
cccgcgggggcggccggc

SEQ ID NO: 3213049 - RNA, 19 nt, Mycobacterium bovis subsp bovis AF2122/97
cccgcgguagccgaccgac

SEQ ID NO: 3213050 - RNA, 13 nt, Mycobacterium bovis subsp bovis AF2122/97
cccgcgguccggc

SEQ ID NO: 3213051 - RNA, 13 nt, Mycobacterium bovis subsp bovis AF2122/97
cccgcggugacgc

SEQ ID NO: 3213052 - RNA, 15 nt, Mycobacterium bovis subsp bovis AF2122/97
cccgcggugacgcca

SEQ ID NO: 3213053 - RNA, 17 nt, Mycobacterium bovis subsp bovis AF2122/97
cccgcggugacgccagc

SEQ ID NO: 3213054 - RNA, 18 nt, Mycobacterium bovis subsp bovis AF2122/97
cccgcggugacgccagcc

SEQ ID NO: 3213055 - RNA, 21 nt, Mycobacterium bovis subsp bovis AF2122/97
cccgcgguuugcacgucacgc

SEQ ID NO: 3213056 - RNA, 24 nt, Mycobacterium bovis subsp bovis AF2122/97
cccgcgguuugcacgucacgcgga

SEQ ID NO: 3213057 - RNA, 16 nt, Mycobacterium bovis subsp bovis AF2122/97
cccgcguaugccagga

SEQ ID NO: 3213058 - RNA, 17 nt, Mycobacterium bovis subsp bovis AF2122/97
cccgcguaugccaggac

SEQ ID NO: 3213059 - RNA, 20 nt, Mycobacterium bovis subsp bovis AF2122/97
cccgcgucgagugccgccac

SEQ ID NO: 3213060 - RNA, 21 nt, Mycobacterium bovis subsp bovis AF2122/97
cccgcgucuacgucguccagc

SEQ ID NO: 3213061 - RNA, 16 nt, Mycobacterium bovis subsp bovis AF2122/97
cccgcguggccgguca

SEQ ID NO: 3213062 - RNA, 18 nt, Mycobacterium bovis subsp bovis AF2122/97
cccgcguggccggucacg

SEQ ID NO: 3213063 - RNA, 23 nt, Mycobacterium bovis subsp bovis AF2122/97
cccgcguguccuuugccaccucg

SEQ ID NO: 3213064 - RNA, 14 nt, Mycobacterium bovis subsp bovis AF2122/97
cccgcguucgagag

SEQ ID NO: 3213065 - RNA, 16 nt, Mycobacterium bovis subsp bovis AF2122/97
cccgcguucgagagcc

SEQ ID NO: 3213066 - RNA, 21 nt, Mycobacterium bovis subsp bovis AF2122/97
cccgcguucgagagccccgac

SEQ ID NO: 3213067 - RNA, 19 nt, Mycobacterium bovis subsp bovis AF2122/97
cccgcguucucggcacccu

SEQ ID NO: 3213068 - RNA, 22 nt, Mycobacterium bovis subsp bovis AF2122/97
cccgcguugaaggcgccggugu

SEQ ID NO: 3213069 - RNA, 23 nt, Mycobacterium bovis subsp bovis AF2122/97
cccgcuaacuggcccggacaugc

SEQ ID NO: 3213070 - RNA, 14 nt, Mycobacterium bovis subsp bovis AF2122/97
cccgcuacgcgcgc

SEQ ID NO: 3213071 - RNA, 15 nt, Mycobacterium bovis subsp bovis AF2122/97
cccgcuacggcagcc

SEQ ID NO: 3213072 - RNA, 20 nt, Mycobacterium bovis subsp bovis AF2122/97
cccgcuaggcgaagcgucug

SEQ ID NO: 3213073 - RNA, 20 nt, Mycobacterium bovis subsp bovis AF2122/97
cccgcucaacgggccgcauc

SEQ ID NO: 3213074 - RNA, 13 nt, Mycobacterium bovis subsp bovis AF2122/97
cccgcucagcauu

SEQ ID NO: 3213075 - RNA, 18 nt, Mycobacterium bovis subsp bovis AF2122/97
cccgcucagcauucacca

SEQ ID NO: 3213076 - RNA, 22 nt, Mycobacterium bovis subsp bovis AF2122/97
cccgcucauccauucggcggcg

SEQ ID NO: 3213077 - RNA, 13 nt, Mycobacterium bovis subsp bovis AF2122/97
cccgcuccacccc

SEQ ID NO: 3213078 - RNA, 16 nt, Mycobacterium bovis subsp bovis AF2122/97
cccgcucccugcaccc

SEQ ID NO: 3213079 - RNA, 15 nt, Mycobacterium bovis subsp bovis AF2122/97
cccgcuccgccgucg

SEQ ID NO: 3213080 - RNA, 17 nt, Mycobacterium bovis subsp bovis AF2122/97
cccgcuccgccgucgcc

SEQ ID NO: 3213081 - RNA, 20 nt, Mycobacterium bovis subsp bovis AF2122/97
cccgcuccgccgucgccgcc

SEQ ID NO: 3213082 - RNA, 21 nt, Mycobacterium bovis subsp bovis AF2122/97
cccgcuccgccgucgccgccg

SEQ ID NO: 3213083 - RNA, 14 nt, Mycobacterium bovis subsp bovis AF2122/97
cccgcuccgcgccg

SEQ ID NO: 3213084 - RNA, 13 nt, Mycobacterium bovis subsp bovis AF2122/97
cccgcuccgcggc

SEQ ID NO: 3213085 - RNA, 14 nt, Mycobacterium bovis subsp bovis AF2122/97
cccgcuccgcggcu

SEQ ID NO: 3213086 - RNA, 15 nt, Mycobacterium bovis subsp bovis AF2122/97
cccgcuccgcggcuc

SEQ ID NO: 3213087 - RNA, 23 nt, Mycobacterium bovis subsp bovis AF2122/97
cccgcuccuccggcaccaacgcc

SEQ ID NO: 3213088 - RNA, 19 nt, Mycobacterium bovis subsp bovis AF2122/97
cccgcucgagcagcgcgcc

SEQ ID NO: 3213089 - RNA, 18 nt, Mycobacterium bovis subsp bovis AF2122/97
cccgcucgaucggcagcc

SEQ ID NO: 3213090 - RNA, 14 nt, Mycobacterium bovis subsp bovis AF2122/97
cccgcucgaugucg

SEQ ID NO: 3213091 - RNA, 15 nt, Mycobacterium bovis subsp bovis AF2122/97
cccgcucgcaggccg

SEQ ID NO: 3213092 - RNA, 23 nt, Mycobacterium bovis subsp bovis AF2122/97
cccgcucgcccgccgccaccagc

SEQ ID NO: 3213093 - RNA, 18 nt, Mycobacterium bovis subsp bovis AF2122/97
cccgcucgcgagcggcug

SEQ ID NO: 3213094 - RNA, 15 nt, Mycobacterium bovis subsp bovis AF2122/97
cccgcucggccgccg

SEQ ID NO: 3213095 - RNA, 19 nt, Mycobacterium bovis subsp bovis AF2122/97
cccgcucggccgccggguc

SEQ ID NO: 3213096 - RNA, 14 nt, Mycobacterium bovis subsp bovis AF2122/97
cccgcucggcgcgc

SEQ ID NO: 3213097 - RNA, 12 nt, Mycobacterium bovis subsp bovis AF2122/97
cccggccagcug

SEQ ID NO: 3213098 - RNA, 21 nt, Mycobacterium bovis subsp bovis AF2122/97
cccggccagcugcguggcgaa

SEQ ID NO: 3213099 - RNA, 11 nt, Mycobacterium bovis subsp bovis AF2122/97
cccggccaggc

SEQ ID NO: 3213100 - RNA, 13 nt, Mycobacterium bovis subsp bovis AF2122/97
cccggccaggccg

SEQ ID NO: 3213101 - RNA, 15 nt, Mycobacterium bovis subsp bovis AF2122/97
cccggccaggggcgc

SEQ ID NO: 3213102 - RNA, 21 nt, Mycobacterium bovis subsp bovis AF2122/97
cccggccaggggcgcagcgcg

SEQ ID NO: 3213103 - RNA, 13 nt, Mycobacterium bovis subsp bovis AF2122/97
cccggccaggucg

SEQ ID NO: 3213104 - RNA, 15 nt, Mycobacterium bovis subsp bovis AF2122/97
cccggcccagcgccc

SEQ ID NO: 3213105 - RNA, 21 nt, Mycobacterium bovis subsp bovis AF2122/97
cccggcccagugggacagguc

SEQ ID NO: 3213106 - RNA, 22 nt, Mycobacterium bovis subsp bovis AF2122/97
cccggccccgcggccagcaccg

SEQ ID NO: 3213107 - RNA, 22 nt, Mycobacterium bovis subsp bovis AF2122/97
cccggcccgaucggcaacccgc

SEQ ID NO: 3213108 - RNA, 15 nt, Mycobacterium bovis subsp bovis AF2122/97
cccggcccgccaccc

SEQ ID NO: 3213109 - RNA, 15 nt, Mycobacterium bovis subsp bovis AF2122/97
cccggcccgcucagc

SEQ ID NO: 3213110 - RNA, 17 nt, Mycobacterium bovis subsp bovis AF2122/97
cccggcccgcucagccg

SEQ ID NO: 3213111 - RNA, 13 nt, Mycobacterium bovis subsp bovis AF2122/97
cccggcccggcuc

SEQ ID NO: 3213112 - RNA, 23 nt, Mycobacterium bovis subsp bovis AF2122/97
cccggcccguagcguccgcgccc

SEQ ID NO: 3213113 - RNA, 13 nt, Mycobacterium bovis subsp bovis AF2122/97
cccggccgaguac

SEQ ID NO: 3213114 - RNA, 14 nt, Mycobacterium bovis subsp bovis AF2122/97
cccggccgcacccg

SEQ ID NO: 3213115 - RNA, 14 nt, Mycobacterium bovis subsp bovis AF2122/97
cccggccgccagcg

SEQ ID NO: 3213116 - RNA, 19 nt, Mycobacterium bovis subsp bovis AF2122/97
cccggccgccagcgcgccg

SEQ ID NO: 3213117 - RNA, 11 nt, Mycobacterium bovis subsp bovis AF2122/97
cccggccgccg

SEQ ID NO: 3213118 - RNA, 13 nt, Mycobacterium bovis subsp bovis AF2122/97
cccggccgccgag

SEQ ID NO: 3213119 - RNA, 13 nt, Mycobacterium bovis subsp bovis AF2122/97
cccggccgcgcac

SEQ ID NO: 3213120 - RNA, 18 nt, Mycobacterium bovis subsp bovis AF2122/97
cccggccgcgcacccguc

SEQ ID NO: 3213121 - RNA, 12 nt, Mycobacterium bovis subsp bovis AF2122/97
cccggccgcgcc

SEQ ID NO: 3213122 - RNA, 13 nt, Mycobacterium bovis subsp bovis AF2122/97
cccggccgcgccc

SEQ ID NO: 3213123 - RNA, 15 nt, Mycobacterium bovis subsp bovis AF2122/97
cccggccgcgcccca

SEQ ID NO: 3213124 - RNA, 14 nt, Mycobacterium bovis subsp bovis AF2122/97
cccggccgcgcggg

SEQ ID NO: 3213125 - RNA, 17 nt, Mycobacterium bovis subsp bovis AF2122/97
cccggccgcgcggggug

SEQ ID NO: 3213126 - RNA, 22 nt, Mycobacterium bovis subsp bovis AF2122/97
cccggccgcgucacggaccugg

SEQ ID NO: 3213127 - RNA, 23 nt, Mycobacterium bovis subsp bovis AF2122/97
cccggccggacgggugcgggccg

SEQ ID NO: 3213128 - RNA, 12 nt, Mycobacterium bovis subsp bovis AF2122/97
cccggccggccc

SEQ ID NO: 3213129 - RNA, 14 nt, Mycobacterium bovis subsp bovis AF2122/97
cccggccgucgccg

SEQ ID NO: 3213130 - RNA, 19 nt, Mycobacterium bovis subsp bovis AF2122/97
cccggccguugggccaccg

SEQ ID NO: 3213131 - RNA, 21 nt, Mycobacterium bovis subsp bovis AF2122/97
cccggccguugggccaccggc

SEQ ID NO: 3213132 - RNA, 22 nt, Mycobacterium bovis subsp bovis AF2122/97
cccggccguugggccaccggcg

SEQ ID NO: 3213133 - RNA, 14 nt, Mycobacterium bovis subsp bovis AF2122/97
cccggccugcgucg

SEQ ID NO: 3213134 - RNA, 13 nt, Mycobacterium bovis subsp bovis AF2122/97
cccggccugcugg

SEQ ID NO: 3213135 - RNA, 14 nt, Mycobacterium bovis subsp bovis AF2122/97
cccggccugcuggu

SEQ ID NO: 3213136 - RNA, 16 nt, Mycobacterium bovis subsp bovis AF2122/97
cccggccugcugguca

SEQ ID NO: 3213137 - RNA, 17 nt, Mycobacterium bovis subsp bovis AF2122/97
cccggccuggagcagcc

SEQ ID NO: 3213138 - RNA, 22 nt, Mycobacterium bovis subsp bovis AF2122/97
cccggccuugccaccgguaccg

SEQ ID NO: 3213139 - RNA, 16 nt, Mycobacterium bovis subsp bovis AF2122/97
cccggccuugccgccg

SEQ ID NO: 3213140 - RNA, 20 nt, Mycobacterium bovis subsp bovis AF2122/97
cccggccuugccgccggccc

SEQ ID NO: 3213141 - RNA, 19 nt, Mycobacterium bovis subsp bovis AF2122/97
cccggccuugccgccggcg

SEQ ID NO: 3213142 - RNA, 19 nt, Mycobacterium bovis subsp bovis AF2122/97
cccggccuuggcggcggca

SEQ ID NO: 3213143 - RNA, 21 nt, Mycobacterium bovis subsp bovis AF2122/97
cccggccuuggcggcggcaua

SEQ ID NO: 3213144 - RNA, 21 nt, Mycobacterium bovis subsp bovis AF2122/97
cccggcgaauacgaccgucgc

SEQ ID NO: 3213145 - RNA, 23 nt, Mycobacterium bovis subsp bovis AF2122/97
cccggcgaauacgaccgucgcgc

SEQ ID NO: 3213146 - RNA, 15 nt, Mycobacterium bovis subsp bovis AF2122/97
cccggcgaccacggc

SEQ ID NO: 3213147 - RNA, 15 nt, Mycobacterium bovis subsp bovis AF2122/97
cccggcgacccgguc

SEQ ID NO: 3213148 - RNA, 16 nt, Mycobacterium bovis subsp bovis AF2122/97
cccggcgacccgguca

SEQ ID NO: 3213149 - RNA, 19 nt, Mycobacterium bovis subsp bovis AF2122/97
cccggcgacccggucacuc

SEQ ID NO: 3213150 - RNA, 19 nt, Mycobacterium bovis subsp bovis AF2122/97
cccggcgacggcguagccg

SEQ ID NO: 3213151 - RNA, 16 nt, Mycobacterium bovis subsp bovis AF2122/97
cccggcgagcacccgc

SEQ ID NO: 3213152 - RNA, 21 nt, Mycobacterium bovis subsp bovis AF2122/97
cccggcgaugagcaugcccag

SEQ ID NO: 3213153 - RNA, 18 nt, Mycobacterium bovis subsp bovis AF2122/97
cccggcgaugcagccggg

SEQ ID NO: 3213154 - RNA, 15 nt, Mycobacterium bovis subsp bovis AF2122/97
cccggcgcaacaacc

SEQ ID NO: 3213155 - RNA, 16 nt, Mycobacterium bovis subsp bovis AF2122/97
cccggcgcaagcgccg

SEQ ID NO: 3213156 - RNA, 18 nt, Mycobacterium bovis subsp bovis AF2122/97
cccggcgcaagcgccgcg

SEQ ID NO: 3213157 - RNA, 22 nt, Mycobacterium bovis subsp bovis AF2122/97
cccggcgcacaaacauacgcca

SEQ ID NO: 3213158 - RNA, 23 nt, Mycobacterium bovis subsp bovis AF2122/97
cccggcgccgcgggugcggcaug

SEQ ID NO: 3213159 - RNA, 17 nt, Mycobacterium bovis subsp bovis AF2122/97
cccggcgccgucgauga

SEQ ID NO: 3213160 - RNA, 12 nt, Mycobacterium bovis subsp bovis AF2122/97
cccggcgcgcca

SEQ ID NO: 3213161 - RNA, 13 nt, Mycobacterium bovis subsp bovis AF2122/97
cccggcgcggcca

SEQ ID NO: 3213162 - RNA, 13 nt, Mycobacterium bovis subsp bovis AF2122/97
cccggcgcggccg

SEQ ID NO: 3213163 - RNA, 14 nt, Mycobacterium bovis subsp bovis AF2122/97
cccggcgcggccgc

SEQ ID NO: 3213164 - RNA, 15 nt, Mycobacterium bovis subsp bovis AF2122/97
cccggcgcggccgca

SEQ ID NO: 3213165 - RNA, 22 nt, Mycobacterium bovis subsp bovis AF2122/97
cccggcgcggccgcaagccgcg

SEQ ID NO: 3213166 - RNA, 14 nt, Mycobacterium bovis subsp bovis AF2122/97
cccggcgcggcgga

SEQ ID NO: 3213167 - RNA, 13 nt, Mycobacterium bovis subsp bovis AF2122/97
cccggcgcgguca

SEQ ID NO: 3213168 - RNA, 14 nt, Mycobacterium bovis subsp bovis AF2122/97
cccggcgcgguggc

SEQ ID NO: 3213169 - RNA, 16 nt, Mycobacterium bovis subsp bovis AF2122/97
cccggcgcuagcgccg

SEQ ID NO: 3213170 - RNA, 18 nt, Mycobacterium bovis subsp bovis AF2122/97
cccggcgcuagcgccgcg

SEQ ID NO: 3213171 - RNA, 14 nt, Mycobacterium bovis subsp bovis AF2122/97
cccggcgcuccaac

SEQ ID NO: 3213172 - RNA, 18 nt, Mycobacterium bovis subsp bovis AF2122/97
cccggcgcuggugcgcca

SEQ ID NO: 3213173 - RNA, 20 nt, Mycobacterium bovis subsp bovis AF2122/97
cccggcgcuggugcgccacg

SEQ ID NO: 3213174 - RNA, 22 nt, Mycobacterium bovis subsp bovis AF2122/97
cccggcgcuggugcgccacgcc

SEQ ID NO: 3213175 - RNA, 17 nt, Mycobacterium bovis subsp bovis AF2122/97
cccggcggacgacgucg

SEQ ID NO: 3213176 - RNA, 22 nt, Mycobacterium bovis subsp bovis AF2122/97
cccggcggaucccgaggcgccc

SEQ ID NO: 3213177 - RNA, 11 nt, Mycobacterium bovis subsp bovis AF2122/97
cccggcggcca

SEQ ID NO: 3213178 - RNA, 14 nt, Mycobacterium bovis subsp bovis AF2122/97
cccggcggcgcgcc

SEQ ID NO: 3213179 - RNA, 20 nt, Mycobacterium bovis subsp bovis AF2122/97
cccggcggcggucaccaccg

SEQ ID NO: 3213180 - RNA, 16 nt, Mycobacterium bovis subsp bovis AF2122/97
cccggcgggcccgccg

SEQ ID NO: 3213181 - RNA, 18 nt, Mycobacterium bovis subsp bovis AF2122/97
cccggcgggcggugggca

SEQ ID NO: 3213182 - RNA, 20 nt, Mycobacterium bovis subsp bovis AF2122/97
cccggcgggcggugggcagc

SEQ ID NO: 3213183 - RNA, 14 nt, Mycobacterium bovis subsp bovis AF2122/97
cccggcggucaggc

SEQ ID NO: 3213184 - RNA, 14 nt, Mycobacterium bovis subsp bovis AF2122/97
cccggggcgcucgc

SEQ ID NO: 3213185 - RNA, 15 nt, Mycobacterium bovis subsp bovis AF2122/97
cccggggcgcucgcg

SEQ ID NO: 3213186 - RNA, 16 nt, Mycobacterium bovis subsp bovis AF2122/97
cccggggcgcucgcgc

SEQ ID NO: 3213187 - RNA, 20 nt, Mycobacterium bovis subsp bovis AF2122/97
cccggggcgcucgcgcgcug

SEQ ID NO: 3213188 - RNA, 18 nt, Mycobacterium bovis subsp bovis AF2122/97
cccggggguccaccuugg

SEQ ID NO: 3213189 - RNA, 18 nt, Mycobacterium bovis subsp bovis AF2122/97
cccgggguccaucggggc

SEQ ID NO: 3213190 - RNA, 17 nt, Mycobacterium bovis subsp bovis AF2122/97
cccggggugcccggccg

SEQ ID NO: 3213191 - RNA, 18 nt, Mycobacterium bovis subsp bovis AF2122/97
cccggggugcccggccgc

SEQ ID NO: 3213192 - RNA, 17 nt, Mycobacterium bovis subsp bovis AF2122/97
cccggguagacaccgcg

SEQ ID NO: 3213193 - RNA, 21 nt, Mycobacterium bovis subsp bovis AF2122/97
cccggguccaagaaccacgac

SEQ ID NO: 3213194 - RNA, 22 nt, Mycobacterium bovis subsp bovis AF2122/97
cccggguccaagaaccacgacg

SEQ ID NO: 3213195 - RNA, 12 nt, Mycobacterium bovis subsp bovis AF2122/97
cccgggucccau

SEQ ID NO: 3213196 - RNA, 13 nt, Mycobacterium bovis subsp bovis AF2122/97
cccggguccgccg

SEQ ID NO: 3213197 - RNA, 13 nt, Mycobacterium bovis subsp bovis AF2122/97
cccggguccugga

SEQ ID NO: 3213198 - RNA, 19 nt, Mycobacterium bovis subsp bovis AF2122/97
cccgggucggcacgacccg

SEQ ID NO: 3213199 - RNA, 13 nt, Mycobacterium bovis subsp bovis AF2122/97
cccgggucggccg

SEQ ID NO: 3213200 - RNA, 19 nt, Mycobacterium bovis subsp bovis AF2122/97
cccgggucuccggcgcacc

SEQ ID NO: 3213201 - RNA, 17 nt, Mycobacterium bovis subsp bovis AF2122/97
cccgggugggccaguga

SEQ ID NO: 3213202 - RNA, 22 nt, Mycobacterium bovis subsp bovis AF2122/97
cccggguuggccgaacagcugc

SEQ ID NO: 3213203 - RNA, 20 nt, Mycobacterium bovis subsp bovis AF2122/97
cccgguaauccacuccagcg

SEQ ID NO: 3213204 - RNA, 24 nt, Mycobacterium bovis subsp bovis AF2122/97
cccgguaauccacuccagcgaacc

SEQ ID NO: 3213205 - RNA, 14 nt, Mycobacterium bovis subsp bovis AF2122/97
cccgguacgccgcg

SEQ ID NO: 3213206 - RNA, 16 nt, Mycobacterium bovis subsp bovis AF2122/97
cccgguacgccgcgcc

SEQ ID NO: 3213207 - RNA, 19 nt, Mycobacterium bovis subsp bovis AF2122/97
cccgguacgucgaggguga

SEQ ID NO: 3213208 - RNA, 15 nt, Mycobacterium bovis subsp bovis AF2122/97
cccgguagccccguc

SEQ ID NO: 3213209 - RNA, 18 nt, Mycobacterium bovis subsp bovis AF2122/97
cccgguagcggcggcaug

SEQ ID NO: 3213210 - RNA, 15 nt, Mycobacterium bovis subsp bovis AF2122/97
cccgguagcguucgg

SEQ ID NO: 3213211 - RNA, 16 nt, Mycobacterium bovis subsp bovis AF2122/97
cccgguagcguucggc

SEQ ID NO: 3213212 - RNA, 18 nt, Mycobacterium bovis subsp bovis AF2122/97
cccgguagcguucggcga

SEQ ID NO: 3213213 - RNA, 20 nt, Mycobacterium bovis subsp bovis AF2122/97
cccgguaugcgcguccccag

SEQ ID NO: 3213214 - RNA, 14 nt, Mycobacterium bovis subsp bovis AF2122/97
cccggucaacguga

SEQ ID NO: 3213215 - RNA, 22 nt, Mycobacterium bovis subsp bovis AF2122/97
cccggucacgcugugcgguauc

SEQ ID NO: 3213216 - RNA, 23 nt, Mycobacterium bovis subsp bovis AF2122/97
cccggucacgcugugcgguaucg

SEQ ID NO: 3213217 - RNA, 19 nt, Mycobacterium bovis subsp bovis AF2122/97
cccggucaggacggcaccc

SEQ ID NO: 3213218 - RNA, 16 nt, Mycobacterium bovis subsp bovis AF2122/97
cccgguccacgccagg

SEQ ID NO: 3213219 - RNA, 17 nt, Mycobacterium bovis subsp bovis AF2122/97
cccgguccacgccagga

SEQ ID NO: 3213220 - RNA, 18 nt, Mycobacterium bovis subsp bovis AF2122/97
cccgguccacgccaggag

SEQ ID NO: 3213221 - RNA, 19 nt, Mycobacterium bovis subsp bovis AF2122/97
cccgguccgccauuggcgc

SEQ ID NO: 3213222 - RNA, 21 nt, Mycobacterium bovis subsp bovis AF2122/97
cccgguccgccauuggcgccg

SEQ ID NO: 3213223 - RNA, 14 nt, Mycobacterium bovis subsp bovis AF2122/97
cccgguccugcucg

SEQ ID NO: 3213224 - RNA, 12 nt, Mycobacterium bovis subsp bovis AF2122/97
cccggucgacgg

SEQ ID NO: 3213225 - RNA, 17 nt, Mycobacterium bovis subsp bovis AF2122/97
cccggucgacgggucgg

SEQ ID NO: 3213226 - RNA, 23 nt, Mycobacterium bovis subsp bovis AF2122/97
cccggucgagccagcggagcagc

SEQ ID NO: 3213227 - RNA, 18 nt, Mycobacterium bovis subsp bovis AF2122/97
cccggucgagcguuuugg

SEQ ID NO: 3213228 - RNA, 15 nt, Mycobacterium bovis subsp bovis AF2122/97
cccggucgaggucgg

SEQ ID NO: 3213229 - RNA, 17 nt, Mycobacterium bovis subsp bovis AF2122/97
cccggucgaggucggcg

SEQ ID NO: 3213230 - RNA, 21 nt, Mycobacterium bovis subsp bovis AF2122/97
cccggucgcacuuggcccccg

SEQ ID NO: 3213231 - RNA, 18 nt, Mycobacterium bovis subsp bovis AF2122/97
cccggucgcugauccggg

SEQ ID NO: 3213232 - RNA, 22 nt, Mycobacterium bovis subsp bovis AF2122/97
cccggucggagcggugccgacg

SEQ ID NO: 3213233 - RNA, 16 nt, Mycobacterium bovis subsp bovis AF2122/97
cccggucggcccgcgc

SEQ ID NO: 3213234 - RNA, 12 nt, Mycobacterium bovis subsp bovis AF2122/97
cccggucggcga

SEQ ID NO: 3213235 - RNA, 18 nt, Mycobacterium bovis subsp bovis AF2122/97
cccggucgguguggacug

SEQ ID NO: 3213236 - RNA, 18 nt, Mycobacterium bovis subsp bovis AF2122/97
cccggucuacgacgucgc

SEQ ID NO: 3213237 - RNA, 23 nt, Mycobacterium bovis subsp bovis AF2122/97
cccggucuacgccaccgagaucg

SEQ ID NO: 3213238 - RNA, 20 nt, Mycobacterium bovis subsp bovis AF2122/97
cccggucuauuugccugccg

SEQ ID NO: 3213239 - RNA, 20 nt, Mycobacterium bovis subsp bovis AF2122/97
cccggucucgacggcggccg

SEQ ID NO: 3213240 - RNA, 20 nt, Mycobacterium bovis subsp bovis AF2122/97
cccggucuugggcgcgggug

SEQ ID NO: 3213241 - RNA, 22 nt, Mycobacterium bovis subsp bovis AF2122/97
cccggucuuuaauccagcgccg

SEQ ID NO: 3213242 - RNA, 16 nt, Mycobacterium bovis subsp bovis AF2122/97
cccggugaccagcaac

SEQ ID NO: 3213243 - RNA, 20 nt, Mycobacterium bovis subsp bovis AF2122/97
cccggugagcucuucggaca

SEQ ID NO: 3213244 - RNA, 24 nt, Mycobacterium bovis subsp bovis AF2122/97
cccggugcaaccccaaguccagca

SEQ ID NO: 3213245 - RNA, 14 nt, Mycobacterium bovis subsp bovis AF2122/97
cccggugccgaccg

SEQ ID NO: 3213246 - RNA, 16 nt, Mycobacterium bovis subsp bovis AF2122/97
cccggugccgcagcag

SEQ ID NO: 3213247 - RNA, 22 nt, Mycobacterium bovis subsp bovis AF2122/97
cccggugccgcccgcgccuccg

SEQ ID NO: 3213248 - RNA, 14 nt, Mycobacterium bovis subsp bovis AF2122/97
cccggugcggugca

SEQ ID NO: 3213249 - RNA, 12 nt, Mycobacterium bovis subsp bovis AF2122/97
cccggugcgucg

SEQ ID NO: 3213250 - RNA, 19 nt, Mycobacterium bovis subsp bovis AF2122/97
cccggugcgucgugguggc

SEQ ID NO: 3213251 - RNA, 16 nt, Mycobacterium bovis subsp bovis AF2122/97
cccggugcuaaccgac

SEQ ID NO: 3213252 - RNA, 17 nt, Mycobacterium bovis subsp bovis AF2122/97
cccggugcucaagcgcg

SEQ ID NO: 3213253 - RNA, 21 nt, Mycobacterium bovis subsp bovis AF2122/97
cccgguggaaugccaagcgcg

SEQ ID NO: 3213254 - RNA, 13 nt, Mycobacterium bovis subsp bovis AF2122/97
cccggugggcggc

SEQ ID NO: 3213255 - RNA, 23 nt, Mycobacterium bovis subsp bovis AF2122/97
cccgguggucgucccgcccaucc

SEQ ID NO: 3213256 - RNA, 15 nt, Mycobacterium bovis subsp bovis AF2122/97
cccgguggugcugcc

SEQ ID NO: 3213257 - RNA, 18 nt, Mycobacterium bovis subsp bovis AF2122/97
cccgguggugcugucgug

SEQ ID NO: 3213258 - RNA, 16 nt, Mycobacterium bovis subsp bovis AF2122/97
cccgguguccagccac

SEQ ID NO: 3213259 - RNA, 18 nt, Mycobacterium bovis subsp bovis AF2122/97
cccggugucgaugcgcag

SEQ ID NO: 3213260 - RNA, 21 nt, Mycobacterium bovis subsp bovis AF2122/97
cccggugucgaugcgcagccc

SEQ ID NO: 3213261 - RNA, 21 nt, Mycobacterium bovis subsp bovis AF2122/97
cccgguguguauucgccgacg

SEQ ID NO: 3213262 - RNA, 16 nt, Mycobacterium bovis subsp bovis AF2122/97
cccgguguguucggcc

SEQ ID NO: 3213263 - RNA, 22 nt, Mycobacterium bovis subsp bovis AF2122/97
cccgguguucaucacgccgccg

SEQ ID NO: 3213264 - RNA, 23 nt, Mycobacterium bovis subsp bovis AF2122/97
cccgguguugagcgaacccgcgu

SEQ ID NO: 3213265 - RNA, 18 nt, Mycobacterium bovis subsp bovis AF2122/97
cccgguguugccgugacg

SEQ ID NO: 3213266 - RNA, 19 nt, Mycobacterium bovis subsp bovis AF2122/97
cccgguguugccgugacga

SEQ ID NO: 3213267 - RNA, 18 nt, Mycobacterium bovis subsp bovis AF2122/97
cccgguuauggcaagccg

SEQ ID NO: 3213268 - RNA, 23 nt, Mycobacterium bovis subsp bovis AF2122/97
cccgguuccggcgaucaacgcgc

SEQ ID NO: 3213269 - RNA, 20 nt, Mycobacterium bovis subsp bovis AF2122/97
cccgguucugcgcccacccg

SEQ ID NO: 3213270 - RNA, 22 nt, Mycobacterium bovis subsp bovis AF2122/97
cccguugccgccguugccgccg

SEQ ID NO: 3213271 - RNA, 17 nt, Mycobacterium bovis subsp bovis AF2122/97
cccguugcucccacggc

SEQ ID NO: 3213272 - RNA, 15 nt, Mycobacterium bovis subsp bovis AF2122/97
cccguuggccaagaa

SEQ ID NO: 3213273 - RNA, 23 nt, Mycobacterium bovis subsp bovis AF2122/97
cccguuguccagaacggcgauca

SEQ ID NO: 3213274 - RNA, 18 nt, Mycobacterium bovis subsp bovis AF2122/97
cccguuuacggcccggca

SEQ ID NO: 3213275 - RNA, 21 nt, Mycobacterium bovis subsp bovis AF2122/97
cccguuuacggcccggcaccc

SEQ ID NO: 3213276 - RNA, 20 nt, Mycobacterium bovis subsp bovis AF2122/97
cccguuucaagucccuucau

SEQ ID NO: 3213277 - RNA, 17 nt, Mycobacterium bovis subsp bovis AF2122/97
cccuacgcagcgcggcu

SEQ ID NO: 3213278 - RNA, 18 nt, Mycobacterium bovis subsp bovis AF2122/97
cccuagcuggugcgcccg

SEQ ID NO: 3213279 - RNA, 19 nt, Mycobacterium bovis subsp bovis AF2122/97
cccuagcuggugcgcccga

SEQ ID NO: 3213280 - RNA, 19 nt, Mycobacterium bovis subsp bovis AF2122/97
cccuagggcggugccgccg

SEQ ID NO: 3213281 - RNA, 21 nt, Mycobacterium bovis subsp bovis AF2122/97
cccuagggcggugccgccgga

SEQ ID NO: 3213282 - RNA, 12 nt, Mycobacterium bovis subsp bovis AF2122/97
cccuaucagccg

SEQ ID NO: 3213283 - RNA, 23 nt, Mycobacterium bovis subsp bovis AF2122/97
cccuaucguuaucgacaccacca

SEQ ID NO: 3213284 - RNA, 19 nt, Mycobacterium bovis subsp bovis AF2122/97
cccucaacgaucgcgccgu

SEQ ID NO: 3213285 - RNA, 13 nt, Mycobacterium bovis subsp bovis AF2122/97
cccucaacggcgg

SEQ ID NO: 3213286 - RNA, 17 nt, Mycobacterium bovis subsp bovis AF2122/97
cccucaacggcggcaac

SEQ ID NO: 3213287 - RNA, 18 nt, Mycobacterium bovis subsp bovis AF2122/97
cccucaacggcggcaacg

SEQ ID NO: 3213288 - RNA, 23 nt, Mycobacterium bovis subsp bovis AF2122/97
cccucaaggucuuuagccgccgc

SEQ ID NO: 3213289 - RNA, 23 nt, Mycobacterium bovis subsp bovis AF2122/97
cccucaccgccugugccgccggc

SEQ ID NO: 3213290 - RNA, 13 nt, Mycobacterium bovis subsp bovis AF2122/97
cccucaccucggc

SEQ ID NO: 3213291 - RNA, 12 nt, Mycobacterium bovis subsp bovis AF2122/97
cccucagccgcg

SEQ ID NO: 3213292 - RNA, 15 nt, Mycobacterium bovis subsp bovis AF2122/97
cccucagccgcgccg

SEQ ID NO: 3213293 - RNA, 17 nt, Mycobacterium bovis subsp bovis AF2122/97
cccucagccgcggccac

SEQ ID NO: 3213294 - RNA, 19 nt, Mycobacterium bovis subsp bovis AF2122/97
cccucagcuagcgcgggcu

SEQ ID NO: 3213295 - RNA, 18 nt, Mycobacterium bovis subsp bovis AF2122/97
cccucaguguacaccgcg

SEQ ID NO: 3213296 - RNA, 23 nt, Mycobacterium bovis subsp bovis AF2122/97
cccucaguguacaccgcgcccgc

SEQ ID NO: 3213297 - RNA, 20 nt, Mycobacterium bovis subsp bovis AF2122/97
cccucaguucacgcucgacg

SEQ ID NO: 3213298 - RNA, 22 nt, Mycobacterium bovis subsp bovis AF2122/97
cccucaguucacguucggcgac

SEQ ID NO: 3213299 - RNA, 14 nt, Mycobacterium bovis subsp bovis AF2122/97
cccuccacagcggc

SEQ ID NO: 3213300 - RNA, 15 nt, Mycobacterium bovis subsp bovis AF2122/97
cccucccgggcccgc

SEQ ID NO: 3213301 - RNA, 16 nt, Mycobacterium bovis subsp bovis AF2122/97
cccucccgggcccgcu

SEQ ID NO: 3213302 - RNA, 16 nt, Mycobacterium bovis subsp bovis AF2122/97
cccuccgagcacagga

SEQ ID NO: 3213303 - RNA, 15 nt, Mycobacterium bovis subsp bovis AF2122/97
cccuccgcgaugccg

SEQ ID NO: 3213304 - RNA, 16 nt, Mycobacterium bovis subsp bovis AF2122/97
cccuccgcgccgauca

SEQ ID NO: 3213305 - RNA, 18 nt, Mycobacterium bovis subsp bovis AF2122/97
cccuccggacccacccgc

SEQ ID NO: 3213306 - RNA, 19 nt, Mycobacterium bovis subsp bovis AF2122/97
cccuccggacccacccgca

SEQ ID NO: 3213307 - RNA, 22 nt, Mycobacterium bovis subsp bovis AF2122/97
cccuccggacccacccgcaccg

SEQ ID NO: 3213308 - RNA, 12 nt, Mycobacterium bovis subsp bovis AF2122/97
cccuccggccac

SEQ ID NO: 3213309 - RNA, 15 nt, Mycobacterium bovis subsp bovis AF2122/97
cccuccggcgcagcg

SEQ ID NO: 3213310 - RNA, 15 nt, Mycobacterium bovis subsp bovis AF2122/97
cccuccgugggcagc

SEQ ID NO: 3213311 - RNA, 23 nt, Mycobacterium bovis subsp bovis AF2122/97
cccuccgugggcagcgcgcccga

SEQ ID NO: 3213312 - RNA, 20 nt, Mycobacterium bovis subsp bovis AF2122/97
cccucgaauucggccggcgc

SEQ ID NO: 3213313 - RNA, 12 nt, Mycobacterium bovis subsp bovis AF2122/97
cccucgaucacg

SEQ ID NO: 3213314 - RNA, 20 nt, Mycobacterium bovis subsp bovis AF2122/97
cccucgaugccgcguagcug

SEQ ID NO: 3213315 - RNA, 13 nt, Mycobacterium bovis subsp bovis AF2122/97
cccucgcaaccgg

SEQ ID NO: 3213316 - RNA, 14 nt, Mycobacterium bovis subsp bovis AF2122/97
cccucgccggucag

SEQ ID NO: 3213317 - RNA, 15 nt, Mycobacterium bovis subsp bovis AF2122/97
cccucgccggucagc

SEQ ID NO: 3213318 - RNA, 24 nt, Mycobacterium bovis subsp bovis AF2122/97
cccucgcgaaauaacggagcggcc

SEQ ID NO: 3213319 - RNA, 20 nt, Mycobacterium bovis subsp bovis AF2122/97
cccucgcuaauugcggccgc

SEQ ID NO: 3213320 - RNA, 21 nt, Mycobacterium bovis subsp bovis AF2122/97
cccucgcuaauugcggccgcc

SEQ ID NO: 3213321 - RNA, 13 nt, Mycobacterium bovis subsp bovis AF2122/97
cccucgcugcggu

SEQ ID NO: 3213322 - RNA, 22 nt, Mycobacterium bovis subsp bovis AF2122/97
cccucgcuguuggccgguccca

SEQ ID NO: 3213323 - RNA, 16 nt, Mycobacterium bovis subsp bovis AF2122/97
cccucggcacggucgc

SEQ ID NO: 3213324 - RNA, 18 nt, Mycobacterium bovis subsp bovis AF2122/97
cccucggcacggucgccc

SEQ ID NO: 3213325 - RNA, 13 nt, Mycobacterium bovis subsp bovis AF2122/97
cccucggccgcag

SEQ ID NO: 3213326 - RNA, 13 nt, Mycobacterium bovis subsp bovis AF2122/97
cccucggccgccc

SEQ ID NO: 3213327 - RNA, 14 nt, Mycobacterium bovis subsp bovis AF2122/97
cccucggcgaccug

SEQ ID NO: 3213328 - RNA, 12 nt, Mycobacterium bovis subsp bovis AF2122/97
cccucggcgccg

SEQ ID NO: 3213329 - RNA, 12 nt, Mycobacterium bovis subsp bovis AF2122/97
cccucggugcca

SEQ ID NO: 3213330 - RNA, 13 nt, Mycobacterium bovis subsp bovis AF2122/97
cccucggugccac

SEQ ID NO: 3213331 - RNA, 18 nt, Mycobacterium bovis subsp bovis AF2122/97
cccucguaauccacgccg

SEQ ID NO: 3213332 - RNA, 20 nt, Mycobacterium bovis subsp bovis AF2122/97
cccucguuaucgaccgccgc

SEQ ID NO: 3213333 - RNA, 14 nt, Mycobacterium bovis subsp bovis AF2122/97
cccucuagcgccuc

SEQ ID NO: 3213334 - RNA, 22 nt, Mycobacterium bovis subsp bovis AF2122/97
cccugaaauaccaguccggcgg

SEQ ID NO: 3213335 - RNA, 17 nt, Mycobacterium bovis subsp bovis AF2122/97
cccugaagccagcgcaa

SEQ ID NO: 3213336 - RNA, 17 nt, Mycobacterium bovis subsp bovis AF2122/97
cccugacagcgagcgac

SEQ ID NO: 3213337 - RNA, 20 nt, Mycobacterium bovis subsp bovis AF2122/97
cccugacccggagccgccag

SEQ ID NO: 3213338 - RNA, 18 nt, Mycobacterium bovis subsp bovis AF2122/97
cccugacggcaucugaaa

SEQ ID NO: 3213339 - RNA, 14 nt, Mycobacterium bovis subsp bovis AF2122/97
cccugacgguggug

SEQ ID NO: 3213340 - RNA, 14 nt, Mycobacterium bovis subsp bovis AF2122/97
cccugagcucccgc

SEQ ID NO: 3213341 - RNA, 22 nt, Mycobacterium bovis subsp bovis AF2122/97
cccugaucaaggaccgcucugc

SEQ ID NO: 3213342 - RNA, 21 nt, Mycobacterium bovis subsp bovis AF2122/97
cccugaucgugaacacgucgc

SEQ ID NO: 3213343 - RNA, 15 nt, Mycobacterium bovis subsp bovis AF2122/97
cccugaugaucgucc

SEQ ID NO: 3213344 - RNA, 19 nt, Mycobacterium bovis subsp bovis AF2122/97
cccugaugaucguccagcc

SEQ ID NO: 3213345 - RNA, 20 nt, Mycobacterium bovis subsp bovis AF2122/97
cccugaugugaguccagccg

SEQ ID NO: 3213346 - RNA, 13 nt, Mycobacterium bovis subsp bovis AF2122/97
cccugcacagcag

SEQ ID NO: 3213347 - RNA, 15 nt, Mycobacterium bovis subsp bovis AF2122/97
cccugcacagcaggc

SEQ ID NO: 3213348 - RNA, 14 nt, Mycobacterium bovis subsp bovis AF2122/97
cccugcacccagcc

SEQ ID NO: 3213349 - RNA, 18 nt, Mycobacterium bovis subsp bovis AF2122/97
cccugcacccagccgugc

SEQ ID NO: 3213350 - RNA, 14 nt, Mycobacterium bovis subsp bovis AF2122/97
cccugcacccgacc

SEQ ID NO: 3213351 - RNA, 15 nt, Mycobacterium bovis subsp bovis AF2122/97
cccugcacggugccc

SEQ ID NO: 3213352 - RNA, 22 nt, Mycobacterium bovis subsp bovis AF2122/97
cccugcacggugcccagggcga

SEQ ID NO: 3213353 - RNA, 22 nt, Mycobacterium bovis subsp bovis AF2122/97
cccugcaguccacugaucaggc

SEQ ID NO: 3213354 - RNA, 19 nt, Mycobacterium bovis subsp bovis AF2122/97
cccugcauaggcgcgguca

SEQ ID NO: 3213355 - RNA, 23 nt, Mycobacterium bovis subsp bovis AF2122/97
cccugccacgacgaacaccagcg

SEQ ID NO: 3213356 - RNA, 19 nt, Mycobacterium bovis subsp bovis AF2122/97
cccuuguucccgaaacccg

SEQ ID NO: 3213357 - RNA, 16 nt, Mycobacterium bovis subsp bovis AF2122/97
cccuuucccaccuuca

SEQ ID NO: 3213358 - RNA, 23 nt, Mycobacterium bovis subsp bovis AF2122/97
cccuuucgcgccgcgaggcaccg

SEQ ID NO: 3213359 - RNA, 18 nt, Mycobacterium bovis subsp bovis AF2122/97
cccuuuggguagcaaacc

SEQ ID NO: 3213360 - RNA, 19 nt, Mycobacterium bovis subsp bovis AF2122/97
cccuuuucccugccuucuu

SEQ ID NO: 3213361 - RNA, 14 nt, Mycobacterium bovis subsp bovis AF2122/97
ccgaaaaacaccag

SEQ ID NO: 3213362 - RNA, 15 nt, Mycobacterium bovis subsp bovis AF2122/97
ccgaaaaacaccagc

SEQ ID NO: 3213363 - RNA, 19 nt, Mycobacterium bovis subsp bovis AF2122/97
ccgaaaaacaccagcgagg

SEQ ID NO: 3213364 - RNA, 20 nt, Mycobacterium bovis subsp bovis AF2122/97
ccgaaaacgacaucaccacc

SEQ ID NO: 3213365 - RNA, 23 nt, Mycobacterium bovis subsp bovis AF2122/97
ccgaaaacgacaucaccaccgca

SEQ ID NO: 3213366 - RNA, 16 nt, Mycobacterium bovis subsp bovis AF2122/97
ccgaaaacugaccccc

SEQ ID NO: 3213367 - RNA, 16 nt, Mycobacterium bovis subsp bovis AF2122/97
ccgaaaagccguucgc

SEQ ID NO: 3213368 - RNA, 15 nt, Mycobacterium bovis subsp bovis AF2122/97
ccgaaaagcgccucg

SEQ ID NO: 3213369 - RNA, 14 nt, Mycobacterium bovis subsp bovis AF2122/97
ccgaaaaugccgcc

SEQ ID NO: 3213370 - RNA, 17 nt, Mycobacterium bovis subsp bovis AF2122/97
ccgaaaauucaggcgcc

SEQ ID NO: 3213371 - RNA, 20 nt, Mycobacterium bovis subsp bovis AF2122/97
ccgaaacaccgucuggccgu

SEQ ID NO: 3213372 - RNA, 14 nt, Mycobacterium bovis subsp bovis AF2122/97
ccgaaacccgaugu

SEQ ID NO: 3213373 - RNA, 15 nt, Mycobacterium bovis subsp bovis AF2122/97
ccgaaaccggucagc

SEQ ID NO: 3213374 - RNA, 13 nt, Mycobacterium bovis subsp bovis AF2122/97
ccgaaacgauggc

SEQ ID NO: 3213375 - RNA, 15 nt, Mycobacterium bovis subsp bovis AF2122/97
ccgaaacgauggccg

SEQ ID NO: 3213376 - RNA, 17 nt, Mycobacterium bovis subsp bovis AF2122/97
ccgaaacgauggccggg

SEQ ID NO: 3213377 - RNA, 16 nt, Mycobacterium bovis subsp bovis AF2122/97
ccgaaacucgacguga

SEQ ID NO: 3213378 - RNA, 16 nt, Mycobacterium bovis subsp bovis AF2122/97
ccgaaacuucgcccgg

SEQ ID NO: 3213379 - RNA, 19 nt, Mycobacterium bovis subsp bovis AF2122/97
ccgaaacuucgcccgggcc

SEQ ID NO: 3213380 - RNA, 21 nt, Mycobacterium bovis subsp bovis AF2122/97
ccgaaacuucgcccgggccgc

SEQ ID NO: 3213381 - RNA, 22 nt, Mycobacterium bovis subsp bovis AF2122/97
ccgaaacuucgcccgggccgcg

SEQ ID NO: 3213382 - RNA, 18 nt, Mycobacterium bovis subsp bovis AF2122/97
ccgaaauacccagcgcag

SEQ ID NO: 3213383 - RNA, 20 nt, Mycobacterium bovis subsp bovis AF2122/97
ccgaaaucaccucaccaguc

SEQ ID NO: 3213384 - RNA, 21 nt, Mycobacterium bovis subsp bovis AF2122/97
ccgaaaucaguugcgcuccaa

SEQ ID NO: 3213385 - RNA, 14 nt, Mycobacterium bovis subsp bovis AF2122/97
ccgaaaucggccag

SEQ ID NO: 3213386 - RNA, 15 nt, Mycobacterium bovis subsp bovis AF2122/97
ccgaacaacaucacu

SEQ ID NO: 3213387 - RNA, 17 nt, Mycobacterium bovis subsp bovis AF2122/97
ccgaacaauuucugcag

SEQ ID NO: 3213388 - RNA, 17 nt, Mycobacterium bovis subsp bovis AF2122/97
ccgaacacaccgggcgg

SEQ ID NO: 3213389 - RNA, 18 nt, Mycobacterium bovis subsp bovis AF2122/97
ccgaacaccacaccgagc

SEQ ID NO: 3213390 - RNA, 22 nt, Mycobacterium bovis subsp bovis AF2122/97
ccgaacaccgagugcggugugu

SEQ ID NO: 3213391 - RNA, 18 nt, Mycobacterium bovis subsp bovis AF2122/97
ccgaacaccgccgcgucg

SEQ ID NO: 3213392 - RNA, 19 nt, Mycobacterium bovis subsp bovis AF2122/97
ccgaacaccggcuccagca

SEQ ID NO: 3213393 - RNA, 17 nt, Mycobacterium bovis subsp bovis AF2122/97
ccgaacaccgucagcgu

SEQ ID NO: 3213394 - RNA, 13 nt, Mycobacterium bovis subsp bovis AF2122/97
ccgaacaccucgg

SEQ ID NO: 3213395 - RNA, 13 nt, Mycobacterium bovis subsp bovis AF2122/97
ccgaacagcaggc

SEQ ID NO: 3213396 - RNA, 17 nt, Mycobacterium bovis subsp bovis AF2122/97
ccgaacagcaggccucc

SEQ ID NO: 3213397 - RNA, 16 nt, Mycobacterium bovis subsp bovis AF2122/97
ccgaacagccgagcca

SEQ ID NO: 3213398 - RNA, 16 nt, Mycobacterium bovis subsp bovis AF2122/97
ccgaacagcggcagcu

SEQ ID NO: 3213399 - RNA, 12 nt, Mycobacterium bovis subsp bovis AF2122/97
ccgaacagcugg

SEQ ID NO: 3213400 - RNA, 17 nt, Mycobacterium bovis subsp bovis AF2122/97
ccgaacagcuggacggc

SEQ ID NO: 3213401 - RNA, 13 nt, Mycobacterium bovis subsp bovis AF2122/97
ccgaacaggauga

SEQ ID NO: 3213402 - RNA, 21 nt, Mycobacterium bovis subsp bovis AF2122/97
ccgaacaggaugauguuggcg

SEQ ID NO: 3213403 - RNA, 21 nt, Mycobacterium bovis subsp bovis AF2122/97
ccgaacagggaggucgccgca

SEQ ID NO: 3213404 - RNA, 23 nt, Mycobacterium bovis subsp bovis AF2122/97
ccgaacagggaggucgccgcauc

SEQ ID NO: 3213405 - RNA, 17 nt, Mycobacterium bovis subsp bovis AF2122/97
ccgaacagucgcagcca

SEQ ID NO: 3213406 - RNA, 21 nt, Mycobacterium bovis subsp bovis AF2122/97
ccgaacaguggggguccggcg

SEQ ID NO: 3213407 - RNA, 17 nt, Mycobacterium bovis subsp bovis AF2122/97
ccgaacaguucggcgag

SEQ ID NO: 3213408 - RNA, 14 nt, Mycobacterium bovis subsp bovis AF2122/97
ccgaacauccgccg

SEQ ID NO: 3213409 - RNA, 15 nt, Mycobacterium bovis subsp bovis AF2122/97
ccgaacauccgccgc

SEQ ID NO: 3213410 - RNA, 19 nt, Mycobacterium bovis subsp bovis AF2122/97
ccgaacauccgccgccccc

SEQ ID NO: 3213411 - RNA, 11 nt, Mycobacterium bovis subsp bovis AF2122/97
ccgaacauggc

SEQ ID NO: 3213412 - RNA, 16 nt, Mycobacterium bovis subsp bovis AF2122/97
ccgaacauggccagca

SEQ ID NO: 3213413 - RNA, 17 nt, Mycobacterium bovis subsp bovis AF2122/97
ccgaaccaccaccggca

SEQ ID NO: 3213414 - RNA, 15 nt, Mycobacterium bovis subsp bovis AF2122/97
ccgaaccaccgcguu

SEQ ID NO: 3213415 - RNA, 19 nt, Mycobacterium bovis subsp bovis AF2122/97
ccgaaccaccgcguuggcc

SEQ ID NO: 3213416 - RNA, 18 nt, Mycobacterium bovis subsp bovis AF2122/97
ccgaaccaccuguccggu

SEQ ID NO: 3213417 - RNA, 20 nt, Mycobacterium bovis subsp bovis AF2122/97
ccgaaccaccuguccggugg

SEQ ID NO: 3213418 - RNA, 15 nt, Mycobacterium bovis subsp bovis AF2122/97
ccgaaccacgcgccc

SEQ ID NO: 3213419 - RNA, 18 nt, Mycobacterium bovis subsp bovis AF2122/97
ccgaaccacgcgcccgca

SEQ ID NO: 3213420 - RNA, 14 nt, Mycobacterium bovis subsp bovis AF2122/97
ccgaacccacccau

SEQ ID NO: 3213421 - RNA, 15 nt, Mycobacterium bovis subsp bovis AF2122/97
ccgaaccccgaccgc

SEQ ID NO: 3213422 - RNA, 15 nt, Mycobacterium bovis subsp bovis AF2122/97
ccgaacccgccaccg

SEQ ID NO: 3213423 - RNA, 18 nt, Mycobacterium bovis subsp bovis AF2122/97
ccgaacccgccaccgcga

SEQ ID NO: 3213424 - RNA, 15 nt, Mycobacterium bovis subsp bovis AF2122/97
ccgaacccggcggac

SEQ ID NO: 3213425 - RNA, 16 nt, Mycobacterium bovis subsp bovis AF2122/97
ccgaaccgcaaggccc

SEQ ID NO: 3213426 - RNA, 17 nt, Mycobacterium bovis subsp bovis AF2122/97
ccgaaccgccgcugccg

SEQ ID NO: 3213427 - RNA, 22 nt, Mycobacterium bovis subsp bovis AF2122/97
ccgaaccgccgcugccgcgcgg

SEQ ID NO: 3213428 - RNA, 13 nt, Mycobacterium bovis subsp bovis AF2122/97
ccgaaccgcgcgu

SEQ ID NO: 3213429 - RNA, 21 nt, Mycobacterium bovis subsp bovis AF2122/97
ccgaaccgcguuaugccaggc

SEQ ID NO: 3213430 - RNA, 14 nt, Mycobacterium bovis subsp bovis AF2122/97
ccgaaccggcacca

SEQ ID NO: 3213431 - RNA, 16 nt, Mycobacterium bovis subsp bovis AF2122/97
ccgaaccggcaccagc

SEQ ID NO: 3213432 - RNA, 18 nt, Mycobacterium bovis subsp bovis AF2122/97
ccgaaccggcaccagcgg

SEQ ID NO: 3213433 - RNA, 12 nt, Mycobacterium bovis subsp bovis AF2122/97
ccgaaccggcgc

SEQ ID NO: 3213434 - RNA, 18 nt, Mycobacterium bovis subsp bovis AF2122/97
ccgaaccggcgcauuccc

SEQ ID NO: 3213435 - RNA, 23 nt, Mycobacterium bovis subsp bovis AF2122/97
ccgaaccgguguagcagcgccag

SEQ ID NO: 3213436 - RNA, 16 nt, Mycobacterium bovis subsp bovis AF2122/97
ccgaaccugcggcagc

SEQ ID NO: 3213437 - RNA, 19 nt, Mycobacterium bovis subsp bovis AF2122/97
ccgaaccugcggcagcgga

SEQ ID NO: 3213438 - RNA, 15 nt, Mycobacterium bovis subsp bovis AF2122/97
ccgaacgacccuggc

SEQ ID NO: 3213439 - RNA, 21 nt, Mycobacterium bovis subsp bovis AF2122/97
ccgaacgacccuggccuuuga

SEQ ID NO: 3213440 - RNA, 21 nt, Mycobacterium bovis subsp bovis AF2122/97
ccgaacgacggguccgggcca

SEQ ID NO: 3213441 - RNA, 14 nt, Mycobacterium bovis subsp bovis AF2122/97
ccgaacgacucgac

SEQ ID NO: 3213442 - RNA, 17 nt, Mycobacterium bovis subsp bovis AF2122/97
ccgaacgacucgacgua

SEQ ID NO: 3213443 - RNA, 15 nt, Mycobacterium bovis subsp bovis AF2122/97
ccgaauuggcggaac

SEQ ID NO: 3213444 - RNA, 19 nt, Mycobacterium bovis subsp bovis AF2122/97
ccgaauuguuguaacccgu

SEQ ID NO: 3213445 - RNA, 14 nt, Mycobacterium bovis subsp bovis AF2122/97
ccgaauuugucggc

SEQ ID NO: 3213446 - RNA, 16 nt, Mycobacterium bovis subsp bovis AF2122/97
ccgaauuugucggcga

SEQ ID NO: 3213447 - RNA, 18 nt, Mycobacterium bovis subsp bovis AF2122/97
ccgaauuugucggcgaag

SEQ ID NO: 3213448 - RNA, 16 nt, Mycobacterium bovis subsp bovis AF2122/97
ccgacaaccccgccag

SEQ ID NO: 3213449 - RNA, 17 nt, Mycobacterium bovis subsp bovis AF2122/97
ccgacaacccggccggg

SEQ ID NO: 3213450 - RNA, 22 nt, Mycobacterium bovis subsp bovis AF2122/97
ccgacaacccggccgggccugc

SEQ ID NO: 3213451 - RNA, 20 nt, Mycobacterium bovis subsp bovis AF2122/97
ccgacaaccuuggcgacugu

SEQ ID NO: 3213452 - RNA, 21 nt, Mycobacterium bovis subsp bovis AF2122/97
ccgacaacgacgucgccgacc

SEQ ID NO: 3213453 - RNA, 22 nt, Mycobacterium bovis subsp bovis AF2122/97
ccgacaacgacgucgccgaccc

SEQ ID NO: 3213454 - RNA, 17 nt, Mycobacterium bovis subsp bovis AF2122/97
ccgacaacggcggcaug

SEQ ID NO: 3213455 - RNA, 17 nt, Mycobacterium bovis subsp bovis AF2122/97
ccgacaagaauggccgc

SEQ ID NO: 3213456 - RNA, 18 nt, Mycobacterium bovis subsp bovis AF2122/97
ccgacaagaauggccgcc

SEQ ID NO: 3213457 - RNA, 16 nt, Mycobacterium bovis subsp bovis AF2122/97
ccgacaaugucggcga

SEQ ID NO: 3213458 - RNA, 17 nt, Mycobacterium bovis subsp bovis AF2122/97
ccgacacagcggcgggu

SEQ ID NO: 3213459 - RNA, 18 nt, Mycobacterium bovis subsp bovis AF2122/97
ccgacacagcggcggguc

SEQ ID NO: 3213460 - RNA, 17 nt, Mycobacterium bovis subsp bovis AF2122/97
ccgacaccaccaggucc

SEQ ID NO: 3213461 - RNA, 16 nt, Mycobacterium bovis subsp bovis AF2122/97
ccgacaccaccggcgc

SEQ ID NO: 3213462 - RNA, 18 nt, Mycobacterium bovis subsp bovis AF2122/97
ccgacaccaccggcgccg

SEQ ID NO: 3213463 - RNA, 12 nt, Mycobacterium bovis subsp bovis AF2122/97
ccgacacccgua

SEQ ID NO: 3213464 - RNA, 22 nt, Mycobacterium bovis subsp bovis AF2122/97
ccgacaccgccccgccgcgacg

SEQ ID NO: 3213465 - RNA, 11 nt, Mycobacterium bovis subsp bovis AF2122/97
ccgacaccggc

SEQ ID NO: 3213466 - RNA, 17 nt, Mycobacterium bovis subsp bovis AF2122/97
ccgacaccggccgcgac

SEQ ID NO: 3213467 - RNA, 19 nt, Mycobacterium bovis subsp bovis AF2122/97
ccgacaccggccgcgacgg

SEQ ID NO: 3213468 - RNA, 14 nt, Mycobacterium bovis subsp bovis AF2122/97
ccgacaccggcggc

SEQ ID NO: 3213469 - RNA, 15 nt, Mycobacterium bovis subsp bovis AF2122/97
ccgacaccggcggca

SEQ ID NO: 3213470 - RNA, 16 nt, Mycobacterium bovis subsp bovis AF2122/97
ccgacaccggcggcau

SEQ ID NO: 3213471 - RNA, 23 nt, Mycobacterium bovis subsp bovis AF2122/97
ccgacaccggcugaccgacccgg

SEQ ID NO: 3213472 - RNA, 15 nt, Mycobacterium bovis subsp bovis AF2122/97
ccgacaccguccagc

SEQ ID NO: 3213473 - RNA, 21 nt, Mycobacterium bovis subsp bovis AF2122/97
ccgacaccguccagcagcucg

SEQ ID NO: 3213474 - RNA, 14 nt, Mycobacterium bovis subsp bovis AF2122/97
ccgacaccgugccg

SEQ ID NO: 3213475 - RNA, 20 nt, Mycobacterium bovis subsp bovis AF2122/97
ccgacaccguguugcugccc

SEQ ID NO: 3213476 - RNA, 16 nt, Mycobacterium bovis subsp bovis AF2122/97
ccgacacgccguuggg

SEQ ID NO: 3213477 - RNA, 15 nt, Mycobacterium bovis subsp bovis AF2122/97
ccgacacggcggcug

SEQ ID NO: 3213478 - RNA, 13 nt, Mycobacterium bovis subsp bovis AF2122/97
ccgacacggcucg

SEQ ID NO: 3213479 - RNA, 22 nt, Mycobacterium bovis subsp bovis AF2122/97
ccgacacggcucgccggcucgg

SEQ ID NO: 3213480 - RNA, 17 nt, Mycobacterium bovis subsp bovis AF2122/97
ccgacacggugcugccg

SEQ ID NO: 3213481 - RNA, 21 nt, Mycobacterium bovis subsp bovis AF2122/97
ccgacacggugcugccguugg

SEQ ID NO: 3213482 - RNA, 22 nt, Mycobacterium bovis subsp bovis AF2122/97
ccgacacggugcugccguuggg

SEQ ID NO: 3213483 - RNA, 15 nt, Mycobacterium bovis subsp bovis AF2122/97
ccgacacguugcagc

SEQ ID NO: 3213484 - RNA, 19 nt, Mycobacterium bovis subsp bovis AF2122/97
ccgacacguuucacguggu

SEQ ID NO: 3213485 - RNA, 18 nt, Mycobacterium bovis subsp bovis AF2122/97
ccgacacucaaccugaac

SEQ ID NO: 3213486 - RNA, 21 nt, Mycobacterium bovis subsp bovis AF2122/97
ccgacacucaaccugaaccgg

SEQ ID NO: 3213487 - RNA, 20 nt, Mycobacterium bovis subsp bovis AF2122/97
ccgacacugggaucccgacg

SEQ ID NO: 3213488 - RNA, 14 nt, Mycobacterium bovis subsp bovis AF2122/97
ccgacagcacccgg

SEQ ID NO: 3213489 - RNA, 19 nt, Mycobacterium bovis subsp bovis AF2122/97
ccgacagcaguuucaccuu

SEQ ID NO: 3213490 - RNA, 14 nt, Mycobacterium bovis subsp bovis AF2122/97
ccgacagccccauc

SEQ ID NO: 3213491 - RNA, 20 nt, Mycobacterium bovis subsp bovis AF2122/97
ccgacagccgauccgaucgc

SEQ ID NO: 3213492 - RNA, 20 nt, Mycobacterium bovis subsp bovis AF2122/97
ccgacagcgccuuguuggcg

SEQ ID NO: 3213493 - RNA, 18 nt, Mycobacterium bovis subsp bovis AF2122/97
ccgacaggccggccacca

SEQ ID NO: 3213494 - RNA, 22 nt, Mycobacterium bovis subsp bovis AF2122/97
ccgacagggccuugaucggcac

SEQ ID NO: 3213495 - RNA, 21 nt, Mycobacterium bovis subsp bovis AF2122/97
ccgacaggugcucgucaucca

SEQ ID NO: 3213496 - RNA, 15 nt, Mycobacterium bovis subsp bovis AF2122/97
ccgacaguccgcgcc

SEQ ID NO: 3213497 - RNA, 16 nt, Mycobacterium bovis subsp bovis AF2122/97
ccgacaguccgcgccg

SEQ ID NO: 3213498 - RNA, 20 nt, Mycobacterium bovis subsp bovis AF2122/97
ccgacaguccgcgccggcgg

SEQ ID NO: 3213499 - RNA, 18 nt, Mycobacterium bovis subsp bovis AF2122/97
ccgacaguugugcguacu

SEQ ID NO: 3213500 - RNA, 22 nt, Mycobacterium bovis subsp bovis AF2122/97
ccgacaguuuaccgugccgccc

SEQ ID NO: 3213501 - RNA, 18 nt, Mycobacterium bovis subsp bovis AF2122/97
ccgacaucccaacccaug

SEQ ID NO: 3213502 - RNA, 18 nt, Mycobacterium bovis subsp bovis AF2122/97
ccgacaucgugauccccg

SEQ ID NO: 3213503 - RNA, 23 nt, Mycobacterium bovis subsp bovis AF2122/97
ccgacauggcggugcgcagcuug

SEQ ID NO: 3213504 - RNA, 22 nt, Mycobacterium bovis subsp bovis AF2122/97
ccgacaugguccgaccagcggc

SEQ ID NO: 3213505 - RNA, 13 nt, Mycobacterium bovis subsp bovis AF2122/97
ccgaccacaccgg

SEQ ID NO: 3213506 - RNA, 13 nt, Mycobacterium bovis subsp bovis AF2122/97
ccgaccacauucc

SEQ ID NO: 3213507 - RNA, 12 nt, Mycobacterium bovis subsp bovis AF2122/97
ccgaccaccaga

SEQ ID NO: 3213508 - RNA, 13 nt, Mycobacterium bovis subsp bovis AF2122/97
ccgaccaccgccg

SEQ ID NO: 3213509 - RNA, 16 nt, Mycobacterium bovis subsp bovis AF2122/97
ccgaccaccgccgggc

SEQ ID NO: 3213510 - RNA, 14 nt, Mycobacterium bovis subsp bovis AF2122/97
ccgaccaccgcgaa

SEQ ID NO: 3213511 - RNA, 19 nt, Mycobacterium bovis subsp bovis AF2122/97
ccgaccacgcgagggcauc

SEQ ID NO: 3213512 - RNA, 21 nt, Mycobacterium bovis subsp bovis AF2122/97
ccgaccacuccacgcagcccg

SEQ ID NO: 3213513 - RNA, 23 nt, Mycobacterium bovis subsp bovis AF2122/97
ccgaccacuccacgcagcccguc

SEQ ID NO: 3213514 - RNA, 20 nt, Mycobacterium bovis subsp bovis AF2122/97
ccgaccagagcuucgccgcg

SEQ ID NO: 3213515 - RNA, 22 nt, Mycobacterium bovis subsp bovis AF2122/97
ccgaccagagcuucgccgcgca

SEQ ID NO: 3213516 - RNA, 23 nt, Mycobacterium bovis subsp bovis AF2122/97
ccgaccagagcuucgccgcgcag

SEQ ID NO: 3213517 - RNA, 15 nt, Mycobacterium bovis subsp bovis AF2122/97
ccgaccagcacccgc

SEQ ID NO: 3213518 - RNA, 12 nt, Mycobacterium bovis subsp bovis AF2122/97
ccgaccagcaga

SEQ ID NO: 3213519 - RNA, 12 nt, Mycobacterium bovis subsp bovis AF2122/97
ccgaccagccgu

SEQ ID NO: 3213520 - RNA, 13 nt, Mycobacterium bovis subsp bovis AF2122/97
ccgaccagcgcgc

SEQ ID NO: 3213521 - RNA, 16 nt, Mycobacterium bovis subsp bovis AF2122/97
ccgaccagcgcgcugc

SEQ ID NO: 3213522 - RNA, 18 nt, Mycobacterium bovis subsp bovis AF2122/97
ccgaccagcgcgcugcgc

SEQ ID NO: 3213523 - RNA, 14 nt, Mycobacterium bovis subsp bovis AF2122/97
ccgaccagcggccg

SEQ ID NO: 3213524 - RNA, 16 nt, Mycobacterium bovis subsp bovis AF2122/97
ccgaccagcggccgac

SEQ ID NO: 3213525 - RNA, 20 nt, Mycobacterium bovis subsp bovis AF2122/97
ccgaccagcuugaccgacca

SEQ ID NO: 3213526 - RNA, 17 nt, Mycobacterium bovis subsp bovis AF2122/97
ccgaccaggaccaccgc

SEQ ID NO: 3213527 - RNA, 13 nt, Mycobacterium bovis subsp bovis AF2122/97
ccgaccagggccg

SEQ ID NO: 3213528 - RNA, 22 nt, Mycobacterium bovis subsp bovis AF2122/97
ccgaccagggccgccgcugccg

SEQ ID NO: 3213529 - RNA, 12 nt, Mycobacterium bovis subsp bovis AF2122/97
ccgacgaccagc

SEQ ID NO: 3213530 - RNA, 15 nt, Mycobacterium bovis subsp bovis AF2122/97
ccgacgaccagcaga

SEQ ID NO: 3213531 - RNA, 13 nt, Mycobacterium bovis subsp bovis AF2122/97
ccgacgacgcgcg

SEQ ID NO: 3213532 - RNA, 14 nt, Mycobacterium bovis subsp bovis AF2122/97
ccgacgacgcgcgc

SEQ ID NO: 3213533 - RNA, 16 nt, Mycobacterium bovis subsp bovis AF2122/97
ccgacgacggcgacgg

SEQ ID NO: 3213534 - RNA, 19 nt, Mycobacterium bovis subsp bovis AF2122/97
ccgacgacggcgacggcgc

SEQ ID NO: 3213535 - RNA, 21 nt, Mycobacterium bovis subsp bovis AF2122/97
ccgacgacggcgacggcgccc

SEQ ID NO: 3213536 - RNA, 20 nt, Mycobacterium bovis subsp bovis AF2122/97
ccgacgacggguuggcgucg

SEQ ID NO: 3213537 - RNA, 22 nt, Mycobacterium bovis subsp bovis AF2122/97
ccgacgacggguuggcgucgcu

SEQ ID NO: 3213538 - RNA, 12 nt, Mycobacterium bovis subsp bovis AF2122/97
ccgacgacguau

SEQ ID NO: 3213539 - RNA, 20 nt, Mycobacterium bovis subsp bovis AF2122/97
ccgacgacguauucguuggg

SEQ ID NO: 3213540 - RNA, 18 nt, Mycobacterium bovis subsp bovis AF2122/97
ccgacgacuccggcaagc

SEQ ID NO: 3213541 - RNA, 18 nt, Mycobacterium bovis subsp bovis AF2122/97
ccgacgagauacggccac

SEQ ID NO: 3213542 - RNA, 22 nt, Mycobacterium bovis subsp bovis AF2122/97
ccgacgagauacggccaccagg

SEQ ID NO: 3213543 - RNA, 20 nt, Mycobacterium bovis subsp bovis AF2122/97
ccgacgagauugccgggccg

SEQ ID NO: 3213544 - RNA, 21 nt, Mycobacterium bovis subsp bovis AF2122/97
ccgacgagauugccgggccgc

SEQ ID NO: 3213545 - RNA, 17 nt, Mycobacterium bovis subsp bovis AF2122/97
ccgacgaggacgucacc

SEQ ID NO: 3213546 - RNA, 15 nt, Mycobacterium bovis subsp bovis AF2122/97
ccgacgagucgccgc

SEQ ID NO: 3213547 - RNA, 19 nt, Mycobacterium bovis subsp bovis AF2122/97
ccgacgagucgccgcgggc

SEQ ID NO: 3213548 - RNA, 20 nt, Mycobacterium bovis subsp bovis AF2122/97
ccgacgagucgccgcgggca

SEQ ID NO: 3213549 - RNA, 21 nt, Mycobacterium bovis subsp bovis AF2122/97
ccgacgagucgccgcgggcag

SEQ ID NO: 3213550 - RNA, 22 nt, Mycobacterium bovis subsp bovis AF2122/97
ccgacgagucgccgcgggcagc

SEQ ID NO: 3213551 - RNA, 15 nt, Mycobacterium bovis subsp bovis AF2122/97
ccgacgaucaacgga

SEQ ID NO: 3213552 - RNA, 19 nt, Mycobacterium bovis subsp bovis AF2122/97
ccgacgaucauauggccgc

SEQ ID NO: 3213553 - RNA, 17 nt, Mycobacterium bovis subsp bovis AF2122/97
ccgacgaucgacgccgc

SEQ ID NO: 3213554 - RNA, 19 nt, Mycobacterium bovis subsp bovis AF2122/97
ccgacgaucgacgccgcca

SEQ ID NO: 3213555 - RNA, 20 nt, Mycobacterium bovis subsp bovis AF2122/97
ccgacgaucgacgccgccac

SEQ ID NO: 3213556 - RNA, 15 nt, Mycobacterium bovis subsp bovis AF2122/97
ccgacgaugcgcacu

SEQ ID NO: 3213557 - RNA, 15 nt, Mycobacterium bovis subsp bovis AF2122/97
ccgacgaugcgggcg

SEQ ID NO: 3213558 - RNA, 19 nt, Mycobacterium bovis subsp bovis AF2122/97
ccgacgaugugcacggugu

SEQ ID NO: 3213559 - RNA, 18 nt, Mycobacterium bovis subsp bovis AF2122/97
ccgacgauuaccagcggc

SEQ ID NO: 3213560 - RNA, 14 nt, Mycobacterium bovis subsp bovis AF2122/97
ccgacgcaccaacg

SEQ ID NO: 3213561 - RNA, 20 nt, Mycobacterium bovis subsp bovis AF2122/97
ccgacgcaccucgguggcug

SEQ ID NO: 3213562 - RNA, 20 nt, Mycobacterium bovis subsp bovis AF2122/97
ccgacgcagcuugcccgacg

SEQ ID NO: 3213563 - RNA, 22 nt, Mycobacterium bovis subsp bovis AF2122/97
ccgacgcagcuugcccgacggc

SEQ ID NO: 3213564 - RNA, 17 nt, Mycobacterium bovis subsp bovis AF2122/97
ccgacgccaacgccagc

SEQ ID NO: 3213565 - RNA, 19 nt, Mycobacterium bovis subsp bovis AF2122/97
ccgacgccaacgccagcgg

SEQ ID NO: 3213566 - RNA, 15 nt, Mycobacterium bovis subsp bovis AF2122/97
ccgacgccaccgcca

SEQ ID NO: 3213567 - RNA, 16 nt, Mycobacterium bovis subsp bovis AF2122/97
ccgacgccaccgccac

SEQ ID NO: 3213568 - RNA, 18 nt, Mycobacterium bovis subsp bovis AF2122/97
ccgacgccaccgccacca

SEQ ID NO: 3213569 - RNA, 19 nt, Mycobacterium bovis subsp bovis AF2122/97
ccgacgccagaacguggcc

SEQ ID NO: 3213570 - RNA, 16 nt, Mycobacterium bovis subsp bovis AF2122/97
ccgacgccauuggccu

SEQ ID NO: 3213571 - RNA, 20 nt, Mycobacterium bovis subsp bovis AF2122/97
ccgacgcccaggcauggccu

SEQ ID NO: 3213572 - RNA, 17 nt, Mycobacterium bovis subsp bovis AF2122/97
ccgacgccccgaucggc

SEQ ID NO: 3213573 - RNA, 20 nt, Mycobacterium bovis subsp bovis AF2122/97
ccgacgccccgaucggccac

SEQ ID NO: 3213574 - RNA, 14 nt, Mycobacterium bovis subsp bovis AF2122/97
ccgacgcccgacug

SEQ ID NO: 3213575 - RNA, 12 nt, Mycobacterium bovis subsp bovis AF2122/97
ccgacgccgcca

SEQ ID NO: 3213576 - RNA, 13 nt, Mycobacterium bovis subsp bovis AF2122/97
ccgacgccgccag

SEQ ID NO: 3213577 - RNA, 19 nt, Mycobacterium bovis subsp bovis AF2122/97
ccgacgccgccagguccgc

SEQ ID NO: 3213578 - RNA, 22 nt, Mycobacterium bovis subsp bovis AF2122/97
ccgacgccgccagguccgccgg

SEQ ID NO: 3213579 - RNA, 12 nt, Mycobacterium bovis subsp bovis AF2122/97
ccgacgccgccg

SEQ ID NO: 3213580 - RNA, 13 nt, Mycobacterium bovis subsp bovis AF2122/97
ccgacgccgccgg

SEQ ID NO: 3213581 - RNA, 14 nt, Mycobacterium bovis subsp bovis AF2122/97
ccgacgccgccggc

SEQ ID NO: 3213582 - RNA, 15 nt, Mycobacterium bovis subsp bovis AF2122/97
ccgacgccgccggca

SEQ ID NO: 3213583 - RNA, 17 nt, Mycobacterium bovis subsp bovis AF2122/97
ccgacgccgccggcccc

SEQ ID NO: 3213584 - RNA, 19 nt, Mycobacterium bovis subsp bovis AF2122/97
ccgacgccgccggcgccac

SEQ ID NO: 3213585 - RNA, 21 nt, Mycobacterium bovis subsp bovis AF2122/97
ccgacgccgccggcgccaccg

SEQ ID NO: 3213586 - RNA, 22 nt, Mycobacterium bovis subsp bovis AF2122/97
ccgacgccgccggcgccaccgu

SEQ ID NO: 3213587 - RNA, 11 nt, Mycobacterium bovis subsp bovis AF2122/97
ccgacgccggu

SEQ ID NO: 3213588 - RNA, 14 nt, Mycobacterium bovis subsp bovis AF2122/97
ccgacgccggucac

SEQ ID NO: 3213589 - RNA, 16 nt, Mycobacterium bovis subsp bovis AF2122/97
ccgacgccggugccgg

SEQ ID NO: 3213590 - RNA, 21 nt, Mycobacterium bovis subsp bovis AF2122/97
ccgacgccggugccggccaga

SEQ ID NO: 3213591 - RNA, 13 nt, Mycobacterium bovis subsp bovis AF2122/97
ccgacgccggugg

SEQ ID NO: 3213592 - RNA, 14 nt, Mycobacterium bovis subsp bovis AF2122/97
ccgacgccgguggc

SEQ ID NO: 3213593 - RNA, 18 nt, Mycobacterium bovis subsp bovis AF2122/97
ccgacgccggugucggcu

SEQ ID NO: 3213594 - RNA, 14 nt, Mycobacterium bovis subsp bovis AF2122/97
ccgacgccguugcc

SEQ ID NO: 3213595 - RNA, 18 nt, Mycobacterium bovis subsp bovis AF2122/97
ccgacgccugggcacggc

SEQ ID NO: 3213596 - RNA, 23 nt, Mycobacterium bovis subsp bovis AF2122/97
ccgacgcgaucuguccgcgaacg

SEQ ID NO: 3213597 - RNA, 14 nt, Mycobacterium bovis subsp bovis AF2122/97
ccgacgcgcggcca

SEQ ID NO: 3213598 - RNA, 17 nt, Mycobacterium bovis subsp bovis AF2122/97
ccgacgcgcggccagcc

SEQ ID NO: 3213599 - RNA, 18 nt, Mycobacterium bovis subsp bovis AF2122/97
ccgacgcgcggccagccc

SEQ ID NO: 3213600 - RNA, 14 nt, Mycobacterium bovis subsp bovis AF2122/97
ccgacgcgcucggc

SEQ ID NO: 3213601 - RNA, 13 nt, Mycobacterium bovis subsp bovis AF2122/97
ccgacgcgggccg

SEQ ID NO: 3213602 - RNA, 16 nt, Mycobacterium bovis subsp bovis AF2122/97
ccgacgcggucggcgg

SEQ ID NO: 3213603 - RNA, 19 nt, Mycobacterium bovis subsp bovis AF2122/97
ccgacgcggucggcggccg

SEQ ID NO: 3213604 - RNA, 20 nt, Mycobacterium bovis subsp bovis AF2122/97
ccgacgcggucggcggccgc

SEQ ID NO: 3213605 - RNA, 13 nt, Mycobacterium bovis subsp bovis AF2122/97
ccgacgcguccgg

SEQ ID NO: 3213606 - RNA, 18 nt, Mycobacterium bovis subsp bovis AF2122/97
ccgacgcguccggugcac

SEQ ID NO: 3213607 - RNA, 19 nt, Mycobacterium bovis subsp bovis AF2122/97
ccgacgcguccggugcacc

SEQ ID NO: 3213608 - RNA, 20 nt, Mycobacterium bovis subsp bovis AF2122/97
ccgacgcguccggugcacca

SEQ ID NO: 3213609 - RNA, 16 nt, Mycobacterium bovis subsp bovis AF2122/97
ccgacgcgucggcgac

SEQ ID NO: 3213610 - RNA, 17 nt, Mycobacterium bovis subsp bovis AF2122/97
ccgacgcgucggcgacg

SEQ ID NO: 3213611 - RNA, 16 nt, Mycobacterium bovis subsp bovis AF2122/97
ccgacgcuaagucccc

SEQ ID NO: 3213612 - RNA, 24 nt, Mycobacterium bovis subsp bovis AF2122/97
ccgacgcuaaguccccgcuuggcg

SEQ ID NO: 3213613 - RNA, 23 nt, Mycobacterium bovis subsp bovis AF2122/97
ccgacgcuggucggcggcuucgu

SEQ ID NO: 3213614 - RNA, 18 nt, Mycobacterium bovis subsp bovis AF2122/97
ccgacggaaugucagccg

SEQ ID NO: 3213615 - RNA, 17 nt, Mycobacterium bovis subsp bovis AF2122/97
ccgacggacuucccgcg

SEQ ID NO: 3213616 - RNA, 21 nt, Mycobacterium bovis subsp bovis AF2122/97
ccgacuucgucaaccaccagg

SEQ ID NO: 3213617 - RNA, 16 nt, Mycobacterium bovis subsp bovis AF2122/97
ccgacuucuccaggcu

SEQ ID NO: 3213618 - RNA, 20 nt, Mycobacterium bovis subsp bovis AF2122/97
ccgacuugauuucgaucgcg

SEQ ID NO: 3213619 - RNA, 22 nt, Mycobacterium bovis subsp bovis AF2122/97
ccgacuugauuucgaucgcggc

SEQ ID NO: 3213620 - RNA, 23 nt, Mycobacterium bovis subsp bovis AF2122/97
ccgacuuggugaccccguaggcg

SEQ ID NO: 3213621 - RNA, 22 nt, Mycobacterium bovis subsp bovis AF2122/97
ccgacuuguacgcaucgccguc

SEQ ID NO: 3213622 - RNA, 15 nt, Mycobacterium bovis subsp bovis AF2122/97
ccgagaacaccacgc

SEQ ID NO: 3213623 - RNA, 14 nt, Mycobacterium bovis subsp bovis AF2122/97
ccgagaaccagcga

SEQ ID NO: 3213624 - RNA, 20 nt, Mycobacterium bovis subsp bovis AF2122/97
ccgagaacgauguccgcgcg

SEQ ID NO: 3213625 - RNA, 14 nt, Mycobacterium bovis subsp bovis AF2122/97
ccgagaacgcccga

SEQ ID NO: 3213626 - RNA, 20 nt, Mycobacterium bovis subsp bovis AF2122/97
ccgagaacgcccgagugacc

SEQ ID NO: 3213627 - RNA, 16 nt, Mycobacterium bovis subsp bovis AF2122/97
ccgagaacggcgggcg

SEQ ID NO: 3213628 - RNA, 16 nt, Mycobacterium bovis subsp bovis AF2122/97
ccgagaauuccccagc

SEQ ID NO: 3213629 - RNA, 20 nt, Mycobacterium bovis subsp bovis AF2122/97
ccgagaauuccccagccgca

SEQ ID NO: 3213630 - RNA, 14 nt, Mycobacterium bovis subsp bovis AF2122/97
ccgagaccacgcgc

SEQ ID NO: 3213631 - RNA, 16 nt, Mycobacterium bovis subsp bovis AF2122/97
ccgagaccacgcgcgu

SEQ ID NO: 3213632 - RNA, 18 nt, Mycobacterium bovis subsp bovis AF2122/97
ccgagaccacgcgcgucg

SEQ ID NO: 3213633 - RNA, 23 nt, Mycobacterium bovis subsp bovis AF2122/97
ccgagaccacgcgcgucggugug

SEQ ID NO: 3213634 - RNA, 20 nt, Mycobacterium bovis subsp bovis AF2122/97
ccgagaccaugccgacgacg

SEQ ID NO: 3213635 - RNA, 13 nt, Mycobacterium bovis subsp bovis AF2122/97
ccgagaccgccgc

SEQ ID NO: 3213636 - RNA, 22 nt, Mycobacterium bovis subsp bovis AF2122/97
ccgagaccgcgugcucgagcac

SEQ ID NO: 3213637 - RNA, 14 nt, Mycobacterium bovis subsp bovis AF2122/97
ccgagaccgcgugg

SEQ ID NO: 3213638 - RNA, 20 nt, Mycobacterium bovis subsp bovis AF2122/97
ccgagaccgcguggucggcg

SEQ ID NO: 3213639 - RNA, 19 nt, Mycobacterium bovis subsp bovis AF2122/97
ccgagaccggccaguccgg

SEQ ID NO: 3213640 - RNA, 21 nt, Mycobacterium bovis subsp bovis AF2122/97
ccgagaccgggcaacggcggg

SEQ ID NO: 3213641 - RNA, 17 nt, Mycobacterium bovis subsp bovis AF2122/97
ccgagacgccccauucg

SEQ ID NO: 3213642 - RNA, 23 nt, Mycobacterium bovis subsp bovis AF2122/97
ccgagacgccccauucguauccc

SEQ ID NO: 3213643 - RNA, 16 nt, Mycobacterium bovis subsp bovis AF2122/97
ccgagacgucggcgua

SEQ ID NO: 3213644 - RNA, 19 nt, Mycobacterium bovis subsp bovis AF2122/97
ccgagacuugcuggcccgc

SEQ ID NO: 3213645 - RNA, 20 nt, Mycobacterium bovis subsp bovis AF2122/97
ccgagacuugcuggcccgca

SEQ ID NO: 3213646 - RNA, 22 nt, Mycobacterium bovis subsp bovis AF2122/97
ccgagacuugcuggcccgcacg

SEQ ID NO: 3213647 - RNA, 14 nt, Mycobacterium bovis subsp bovis AF2122/97
ccgagagcaccgcu

SEQ ID NO: 3213648 - RNA, 13 nt, Mycobacterium bovis subsp bovis AF2122/97
ccgagagcagcca

SEQ ID NO: 3213649 - RNA, 15 nt, Mycobacterium bovis subsp bovis AF2122/97
ccgagagcagccagc

SEQ ID NO: 3213650 - RNA, 16 nt, Mycobacterium bovis subsp bovis AF2122/97
ccgagagcagccagcc

SEQ ID NO: 3213651 - RNA, 17 nt, Mycobacterium bovis subsp bovis AF2122/97
ccgagagcagccagcca

SEQ ID NO: 3213652 - RNA, 15 nt, Mycobacterium bovis subsp bovis AF2122/97
ccgagauagcaacga

SEQ ID NO: 3213653 - RNA, 14 nt, Mycobacterium bovis subsp bovis AF2122/97
ccgagaucaccgcc

SEQ ID NO: 3213654 - RNA, 15 nt, Mycobacterium bovis subsp bovis AF2122/97
ccgagaucaccgcca

SEQ ID NO: 3213655 - RNA, 18 nt, Mycobacterium bovis subsp bovis AF2122/97
ccgagaucaccgguacgc

SEQ ID NO: 3213656 - RNA, 20 nt, Mycobacterium bovis subsp bovis AF2122/97
ccgagaucaugccggcgaac

SEQ ID NO: 3213657 - RNA, 16 nt, Mycobacterium bovis subsp bovis AF2122/97
ccgagauccguccgcu

SEQ ID NO: 3213658 - RNA, 20 nt, Mycobacterium bovis subsp bovis AF2122/97
ccgagauccguccgcuggug

SEQ ID NO: 3213659 - RNA, 16 nt, Mycobacterium bovis subsp bovis AF2122/97
ccgagaucggacaggu

SEQ ID NO: 3213660 - RNA, 16 nt, Mycobacterium bovis subsp bovis AF2122/97
ccgagaucgucgcgac

SEQ ID NO: 3213661 - RNA, 23 nt, Mycobacterium bovis subsp bovis AF2122/97
ccgagaugaugcugccggcacca

SEQ ID NO: 3213662 - RNA, 23 nt, Mycobacterium bovis subsp bovis AF2122/97
ccgagauugggcugggauagcgc

SEQ ID NO: 3213663 - RNA, 16 nt, Mycobacterium bovis subsp bovis AF2122/97
ccgagauuggugcaga

SEQ ID NO: 3213664 - RNA, 22 nt, Mycobacterium bovis subsp bovis AF2122/97
ccgagcaaacauccacccgcgg

SEQ ID NO: 3213665 - RNA, 22 nt, Mycobacterium bovis subsp bovis AF2122/97
ccgagcaacaccccuggguuga

SEQ ID NO: 3213666 - RNA, 15 nt, Mycobacterium bovis subsp bovis AF2122/97
ccgagcaacggcggc

SEQ ID NO: 3213667 - RNA, 17 nt, Mycobacterium bovis subsp bovis AF2122/97
ccgagcaacggcggcag

SEQ ID NO: 3213668 - RNA, 18 nt, Mycobacterium bovis subsp bovis AF2122/97
ccgagcaacggcggcagg

SEQ ID NO: 3213669 - RNA, 23 nt, Mycobacterium bovis subsp bovis AF2122/97
ccgagcaacggcggcaggccggc

SEQ ID NO: 3213670 - RNA, 15 nt, Mycobacterium bovis subsp bovis AF2122/97
ccgagcaaggggauc

SEQ ID NO: 3213671 - RNA, 13 nt, Mycobacterium bovis subsp bovis AF2122/97
ccgagcaccgggc

SEQ ID NO: 3213672 - RNA, 17 nt, Mycobacterium bovis subsp bovis AF2122/97
ccgagcacgacgacguc

SEQ ID NO: 3213673 - RNA, 18 nt, Mycobacterium bovis subsp bovis AF2122/97
ccgagcacgccgagcccg

SEQ ID NO: 3213674 - RNA, 16 nt, Mycobacterium bovis subsp bovis AF2122/97
ccgagcacgggcagau

SEQ ID NO: 3213675 - RNA, 22 nt, Mycobacterium bovis subsp bovis AF2122/97
ccgagcacgggcagauacgcca

SEQ ID NO: 3213676 - RNA, 22 nt, Mycobacterium bovis subsp bovis AF2122/97
ccgagcacggguagcguccagg

SEQ ID NO: 3213677 - RNA, 16 nt, Mycobacterium bovis subsp bovis AF2122/97
ccgagcacucggccac

SEQ ID NO: 3213678 - RNA, 17 nt, Mycobacterium bovis subsp bovis AF2122/97
ccgagcacucggccacg

SEQ ID NO: 3213679 - RNA, 20 nt, Mycobacterium bovis subsp bovis AF2122/97
ccgagcagacacagaaucgc

SEQ ID NO: 3213680 - RNA, 20 nt, Mycobacterium bovis subsp bovis AF2122/97
ccgagcagacgcaaaaucgc

SEQ ID NO: 3213681 - RNA, 17 nt, Mycobacterium bovis subsp bovis AF2122/97
ccgagcagacgcagaau

SEQ ID NO: 3213682 - RNA, 19 nt, Mycobacterium bovis subsp bovis AF2122/97
ccgagcagacgcagaaucg

SEQ ID NO: 3213683 - RNA, 17 nt, Mycobacterium bovis subsp bovis AF2122/97
ccgagcagacgcggaau

SEQ ID NO: 3213684 - RNA, 19 nt, Mycobacterium bovis subsp bovis AF2122/97
ccgagcagauacuccgcgg

SEQ ID NO: 3213685 - RNA, 16 nt, Mycobacterium bovis subsp bovis AF2122/97
ccgagcagcagaaacg

SEQ ID NO: 3213686 - RNA, 18 nt, Mycobacterium bovis subsp bovis AF2122/97
ccgagcagcccgcggauc

SEQ ID NO: 3213687 - RNA, 13 nt, Mycobacterium bovis subsp bovis AF2122/97
ccgagcagcuccu

SEQ ID NO: 3213688 - RNA, 21 nt, Mycobacterium bovis subsp bovis AF2122/97
ccgagcagcuccuugagguca

SEQ ID NO: 3213689 - RNA, 18 nt, Mycobacterium bovis subsp bovis AF2122/97
ccgagcagcuucucggcg

SEQ ID NO: 3213690 - RNA, 15 nt, Mycobacterium bovis subsp bovis AF2122/97
ccgagcagggccggc

SEQ ID NO: 3213691 - RNA, 17 nt, Mycobacterium bovis subsp bovis AF2122/97
ccgagcagggccggcac

SEQ ID NO: 3213692 - RNA, 19 nt, Mycobacterium bovis subsp bovis AF2122/97
ccgagcagggccggcaccg

SEQ ID NO: 3213693 - RNA, 20 nt, Mycobacterium bovis subsp bovis AF2122/97
ccgagcagggccggcaccgc

SEQ ID NO: 3213694 - RNA, 22 nt, Mycobacterium bovis subsp bovis AF2122/97
ccgagcagggccggcaccgcag

SEQ ID NO: 3213695 - RNA, 17 nt, Mycobacterium bovis subsp bovis AF2122/97
ccgagcagguuccgcac

SEQ ID NO: 3213696 - RNA, 18 nt, Mycobacterium bovis subsp bovis AF2122/97
ccgagcagguuccgcacg

SEQ ID NO: 3213697 - RNA, 16 nt, Mycobacterium bovis subsp bovis AF2122/97
ccgagcaucucgucgu

SEQ ID NO: 3213698 - RNA, 16 nt, Mycobacterium bovis subsp bovis AF2122/97
ccgagccagcacccgc

SEQ ID NO: 3213699 - RNA, 17 nt, Mycobacterium bovis subsp bovis AF2122/97
ccgagccagcuccggcg

SEQ ID NO: 3213700 - RNA, 17 nt, Mycobacterium bovis subsp bovis AF2122/97
ccgagcccaauccgcaa

SEQ ID NO: 3213701 - RNA, 15 nt, Mycobacterium bovis subsp bovis AF2122/97
ccgagcccgaucgcg

SEQ ID NO: 3213702 - RNA, 22 nt, Mycobacterium bovis subsp bovis AF2122/97
ccgagcucguugcuggcggcca

SEQ ID NO: 3213703 - RNA, 18 nt, Mycobacterium bovis subsp bovis AF2122/97
ccgagcucuaucgggaag

SEQ ID NO: 3213704 - RNA, 21 nt, Mycobacterium bovis subsp bovis AF2122/97
ccgagcucuuggagcuuggcc

SEQ ID NO: 3213705 - RNA, 23 nt, Mycobacterium bovis subsp bovis AF2122/97
ccgagcucuuggagcuuggccca

SEQ ID NO: 3213706 - RNA, 20 nt, Mycobacterium bovis subsp bovis AF2122/97
ccgagcugacgccgagcugg

SEQ ID NO: 3213707 - RNA, 19 nt, Mycobacterium bovis subsp bovis AF2122/97
ccgagcugagcggccagca

SEQ ID NO: 3213708 - RNA, 21 nt, Mycobacterium bovis subsp bovis AF2122/97
ccgagcugauccggguggcgu

SEQ ID NO: 3213709 - RNA, 20 nt, Mycobacterium bovis subsp bovis AF2122/97
ccgagcugccaacgcccgug

SEQ ID NO: 3213710 - RNA, 20 nt, Mycobacterium bovis subsp bovis AF2122/97
ccgagcuggcaacgccgcgc

SEQ ID NO: 3213711 - RNA, 21 nt, Mycobacterium bovis subsp bovis AF2122/97
ccgagcuggcaacgccgcgcc

SEQ ID NO: 3213712 - RNA, 14 nt, Mycobacterium bovis subsp bovis AF2122/97
ccgagcuggccguc

SEQ ID NO: 3213713 - RNA, 16 nt, Mycobacterium bovis subsp bovis AF2122/97
ccgagcuggccgucag

SEQ ID NO: 3213714 - RNA, 18 nt, Mycobacterium bovis subsp bovis AF2122/97
ccgagcuggccgucagcg

SEQ ID NO: 3213715 - RNA, 15 nt, Mycobacterium bovis subsp bovis AF2122/97
ccgagcuggcgcgcg

SEQ ID NO: 3213716 - RNA, 16 nt, Mycobacterium bovis subsp bovis AF2122/97
ccgagcuggcgcgcgg

SEQ ID NO: 3213717 - RNA, 16 nt, Mycobacterium bovis subsp bovis AF2122/97
ccgagcugguuggcgc

SEQ ID NO: 3213718 - RNA, 23 nt, Mycobacterium bovis subsp bovis AF2122/97
ccgagcugguuggcgccgaaaag

SEQ ID NO: 3213719 - RNA, 14 nt, Mycobacterium bovis subsp bovis AF2122/97
ccgagcugucggcu

SEQ ID NO: 3213720 - RNA, 21 nt, Mycobacterium bovis subsp bovis AF2122/97
ccgagcugugcgcagacaucg

SEQ ID NO: 3213721 - RNA, 20 nt, Mycobacterium bovis subsp bovis AF2122/97
ccgagcuguggucacccgug

SEQ ID NO: 3213722 - RNA, 12 nt, Mycobacterium bovis subsp bovis AF2122/97
ccgagcuucagc

SEQ ID NO: 3213723 - RNA, 23 nt, Mycobacterium bovis subsp bovis AF2122/97
ccgagcuugagcgugagcgccgc

SEQ ID NO: 3213724 - RNA, 15 nt, Mycobacterium bovis subsp bovis AF2122/97
ccgagcuuggccgcc

SEQ ID NO: 3213725 - RNA, 17 nt, Mycobacterium bovis subsp bovis AF2122/97
ccgagcuuggccgccgc

SEQ ID NO: 3213726 - RNA, 22 nt, Mycobacterium bovis subsp bovis AF2122/97
ccgagcuuggccgccgccaccu

SEQ ID NO: 3213727 - RNA, 22 nt, Mycobacterium bovis subsp bovis AF2122/97
ccgagcuugggccggugcagca

SEQ ID NO: 3213728 - RNA, 18 nt, Mycobacterium bovis subsp bovis AF2122/97
ccgagcuugucgagcagg

SEQ ID NO: 3213729 - RNA, 19 nt, Mycobacterium bovis subsp bovis AF2122/97
ccgaggaaaccaccagugg

SEQ ID NO: 3213730 - RNA, 18 nt, Mycobacterium bovis subsp bovis AF2122/97
ccgaggaaguccagcugg

SEQ ID NO: 3213731 - RNA, 21 nt, Mycobacterium bovis subsp bovis AF2122/97
ccgaggacacauugaccaggu

SEQ ID NO: 3213732 - RNA, 18 nt, Mycobacterium bovis subsp bovis AF2122/97
ccgaggaccucgucaccg

SEQ ID NO: 3213733 - RNA, 14 nt, Mycobacterium bovis subsp bovis AF2122/97
ccgaggacgccggc

SEQ ID NO: 3213734 - RNA, 15 nt, Mycobacterium bovis subsp bovis AF2122/97
ccgaggacgccggcg

SEQ ID NO: 3213735 - RNA, 21 nt, Mycobacterium bovis subsp bovis AF2122/97
ccgaggacuggaaagcagcag

SEQ ID NO: 3213736 - RNA, 23 nt, Mycobacterium bovis subsp bovis AF2122/97
ccgaggacuggaaagcagcagcg

SEQ ID NO: 3213737 - RNA, 14 nt, Mycobacterium bovis subsp bovis AF2122/97
ccgaggagggccgc

SEQ ID NO: 3213738 - RNA, 20 nt, Mycobacterium bovis subsp bovis AF2122/97
ccgaggaucucgcgguccag

SEQ ID NO: 3213739 - RNA, 23 nt, Mycobacterium bovis subsp bovis AF2122/97
ccgaggaugugguuggugcuggc

SEQ ID NO: 3213740 - RNA, 23 nt, Mycobacterium bovis subsp bovis AF2122/97
ccgaggcagacacgagucgccag

SEQ ID NO: 3213741 - RNA, 18 nt, Mycobacterium bovis subsp bovis AF2122/97
ccgaggccaugcucgcca

SEQ ID NO: 3213742 - RNA, 20 nt, Mycobacterium bovis subsp bovis AF2122/97
ccgaggccgaccucguucgu

SEQ ID NO: 3213743 - RNA, 18 nt, Mycobacterium bovis subsp bovis AF2122/97
ccgaggccgccaucgccg

SEQ ID NO: 3213744 - RNA, 20 nt, Mycobacterium bovis subsp bovis AF2122/97
ccgaggccgccaucgccgcc

SEQ ID NO: 3213745 - RNA, 15 nt, Mycobacterium bovis subsp bovis AF2122/97
ccgaggccgccgaga

SEQ ID NO: 3213746 - RNA, 16 nt, Mycobacterium bovis subsp bovis AF2122/97
ccgaggccgcugccag

SEQ ID NO: 3213747 - RNA, 13 nt, Mycobacterium bovis subsp bovis AF2122/97
ccgaggccgucgc

SEQ ID NO: 3213748 - RNA, 17 nt, Mycobacterium bovis subsp bovis AF2122/97
ccgaggccuaccaggcg

SEQ ID NO: 3213749 - RNA, 22 nt, Mycobacterium bovis subsp bovis AF2122/97
ccgaggccuaccaggcgcggcc

SEQ ID NO: 3213750 - RNA, 16 nt, Mycobacterium bovis subsp bovis AF2122/97
ccgaggccucggccag

SEQ ID NO: 3213751 - RNA, 18 nt, Mycobacterium bovis subsp bovis AF2122/97
ccgaggccucggccagcg

SEQ ID NO: 3213752 - RNA, 14 nt, Mycobacterium bovis subsp bovis AF2122/97
ccgaggcgaccgga

SEQ ID NO: 3213753 - RNA, 17 nt, Mycobacterium bovis subsp bovis AF2122/97
ccgaggcgaguucgcgc

SEQ ID NO: 3213754 - RNA, 17 nt, Mycobacterium bovis subsp bovis AF2122/97
ccgaggcucgggccgca

SEQ ID NO: 3213755 - RNA, 15 nt, Mycobacterium bovis subsp bovis AF2122/97
ccgaggcuggcaucc

SEQ ID NO: 3213756 - RNA, 18 nt, Mycobacterium bovis subsp bovis AF2122/97
ccgaggcuggcaucccgg

SEQ ID NO: 3213757 - RNA, 21 nt, Mycobacterium bovis subsp bovis AF2122/97
ccgaggcuggcaucccgggca

SEQ ID NO: 3213758 - RNA, 18 nt, Mycobacterium bovis subsp bovis AF2122/97
ccgagggaacggugcaca

SEQ ID NO: 3213759 - RNA, 15 nt, Mycobacterium bovis subsp bovis AF2122/97
ccgagggccgucaca

SEQ ID NO: 3213760 - RNA, 14 nt, Mycobacterium bovis subsp bovis AF2122/97
ccgagggcggcagc

SEQ ID NO: 3213761 - RNA, 15 nt, Mycobacterium bovis subsp bovis AF2122/97
ccgagggcgucgccg

SEQ ID NO: 3213762 - RNA, 18 nt, Mycobacterium bovis subsp bovis AF2122/97
ccgagggcgucgccgccg

SEQ ID NO: 3213763 - RNA, 20 nt, Mycobacterium bovis subsp bovis AF2122/97
ccgagggcugcguggcgggc

SEQ ID NO: 3213764 - RNA, 17 nt, Mycobacterium bovis subsp bovis AF2122/97
ccgaggucgaaccgccg

SEQ ID NO: 3213765 - RNA, 17 nt, Mycobacterium bovis subsp bovis AF2122/97
ccgaggucggccagcag

SEQ ID NO: 3213766 - RNA, 17 nt, Mycobacterium bovis subsp bovis AF2122/97
ccgaggucgguucggcc

SEQ ID NO: 3213767 - RNA, 17 nt, Mycobacterium bovis subsp bovis AF2122/97
ccgaggugccgcgcagc

SEQ ID NO: 3213768 - RNA, 18 nt, Mycobacterium bovis subsp bovis AF2122/97
ccgaggugccggggcccc

SEQ ID NO: 3213769 - RNA, 21 nt, Mycobacterium bovis subsp bovis AF2122/97
ccgaggugcuuggggucaccc

SEQ ID NO: 3213770 - RNA, 20 nt, Mycobacterium bovis subsp bovis AF2122/97
ccgagguucaaagcagcgca

SEQ ID NO: 3213771 - RNA, 23 nt, Mycobacterium bovis subsp bovis AF2122/97
ccgagguucaaagcagcgcacca

SEQ ID NO: 3213772 - RNA, 22 nt, Mycobacterium bovis subsp bovis AF2122/97
ccgagguuguuggagaugucga

SEQ ID NO: 3213773 - RNA, 20 nt, Mycobacterium bovis subsp bovis AF2122/97
ccgaguaccagcccaccggc

SEQ ID NO: 3213774 - RNA, 21 nt, Mycobacterium bovis subsp bovis AF2122/97
ccgaguaccgauagccugcgg

SEQ ID NO: 3213775 - RNA, 16 nt, Mycobacterium bovis subsp bovis AF2122/97
ccgaguaccggccagc

SEQ ID NO: 3213776 - RNA, 17 nt, Mycobacterium bovis subsp bovis AF2122/97
ccgaguaccggccagcc

SEQ ID NO: 3213777 - RNA, 23 nt, Mycobacterium bovis subsp bovis AF2122/97
ccgaguagaagauggcaccgccc

SEQ ID NO: 3213778 - RNA, 23 nt, Mycobacterium bovis subsp bovis AF2122/97
ccgaguauuggucggugggguau

SEQ ID NO: 3213779 - RNA, 17 nt, Mycobacterium bovis subsp bovis AF2122/97
ccgagucgaaaccgccc

SEQ ID NO: 3213780 - RNA, 18 nt, Mycobacterium bovis subsp bovis AF2122/97
ccgagucgaaaccgcccg

SEQ ID NO: 3213781 - RNA, 19 nt, Mycobacterium bovis subsp bovis AF2122/97
ccgagucgauugccaccga

SEQ ID NO: 3213782 - RNA, 16 nt, Mycobacterium bovis subsp bovis AF2122/97
ccgagucucgucgggu

SEQ ID NO: 3213783 - RNA, 17 nt, Mycobacterium bovis subsp bovis AF2122/97
ccgagucucgucgggua

SEQ ID NO: 3213784 - RNA, 15 nt, Mycobacterium bovis subsp bovis AF2122/97
ccgagucugcgagca

SEQ ID NO: 3213785 - RNA, 16 nt, Mycobacterium bovis subsp bovis AF2122/97
ccgagucugcgagcag

SEQ ID NO: 3213786 - RNA, 17 nt, Mycobacterium bovis subsp bovis AF2122/97
ccgagugaccagggugg

SEQ ID NO: 3213787 - RNA, 14 nt, Mycobacterium bovis subsp bovis AF2122/97
ccgagugcggugug

SEQ ID NO: 3213788 - RNA, 18 nt, Mycobacterium bovis subsp bovis AF2122/97
ccgauccacaacagcccg

SEQ ID NO: 3213789 - RNA, 20 nt, Mycobacterium bovis subsp bovis AF2122/97
ccgauccacaacagcccgua

SEQ ID NO: 3213790 - RNA, 23 nt, Mycobacterium bovis subsp bovis AF2122/97
ccgauccacauggugaccauggc

SEQ ID NO: 3213791 - RNA, 22 nt, Mycobacterium bovis subsp bovis AF2122/97
ccgauccacuguagggccggug

SEQ ID NO: 3213792 - RNA, 14 nt, Mycobacterium bovis subsp bovis AF2122/97
ccgauccagcaggc

SEQ ID NO: 3213793 - RNA, 16 nt, Mycobacterium bovis subsp bovis AF2122/97
ccgauccagcaggccg

SEQ ID NO: 3213794 - RNA, 23 nt, Mycobacterium bovis subsp bovis AF2122/97
ccgauccagugguaggccgccgg

SEQ ID NO: 3213795 - RNA, 12 nt, Mycobacterium bovis subsp bovis AF2122/97
ccgaucccaccg

SEQ ID NO: 3213796 - RNA, 13 nt, Mycobacterium bovis subsp bovis AF2122/97
ccgauccccaggc

SEQ ID NO: 3213797 - RNA, 15 nt, Mycobacterium bovis subsp bovis AF2122/97
ccgaucccggccagc

SEQ ID NO: 3213798 - RNA, 16 nt, Mycobacterium bovis subsp bovis AF2122/97
ccgaucccggccagcu

SEQ ID NO: 3213799 - RNA, 16 nt, Mycobacterium bovis subsp bovis AF2122/97
ccgaucccggcgagca

SEQ ID NO: 3213800 - RNA, 13 nt, Mycobacterium bovis subsp bovis AF2122/97
ccgaucccgucgg

SEQ ID NO: 3213801 - RNA, 21 nt, Mycobacterium bovis subsp bovis AF2122/97
ccgaucccgucgggcacaccg

SEQ ID NO: 3213802 - RNA, 15 nt, Mycobacterium bovis subsp bovis AF2122/97
ccgauccgcacagca

SEQ ID NO: 3213803 - RNA, 16 nt, Mycobacterium bovis subsp bovis AF2122/97
ccgauccgcacagcaa

SEQ ID NO: 3213804 - RNA, 17 nt, Mycobacterium bovis subsp bovis AF2122/97
ccgauccgcucacccgc

SEQ ID NO: 3213805 - RNA, 18 nt, Mycobacterium bovis subsp bovis AF2122/97
ccgauccggaucccacca

SEQ ID NO: 3213806 - RNA, 13 nt, Mycobacterium bovis subsp bovis AF2122/97
ccgauccggccgc

SEQ ID NO: 3213807 - RNA, 16 nt, Mycobacterium bovis subsp bovis AF2122/97
ccgauccggccgccga

SEQ ID NO: 3213808 - RNA, 13 nt, Mycobacterium bovis subsp bovis AF2122/97
ccgauccgguggc

SEQ ID NO: 3213809 - RNA, 15 nt, Mycobacterium bovis subsp bovis AF2122/97
ccgauccgguggcug

SEQ ID NO: 3213810 - RNA, 19 nt, Mycobacterium bovis subsp bovis AF2122/97
ccgauccgguggcuggccg

SEQ ID NO: 3213811 - RNA, 23 nt, Mycobacterium bovis subsp bovis AF2122/97
ccgauccgguggcuggccgccac

SEQ ID NO: 3213812 - RNA, 16 nt, Mycobacterium bovis subsp bovis AF2122/97
ccgauccugcccacca

SEQ ID NO: 3213813 - RNA, 18 nt, Mycobacterium bovis subsp bovis AF2122/97
ccgauccugcccaccauc

SEQ ID NO: 3213814 - RNA, 19 nt, Mycobacterium bovis subsp bovis AF2122/97
ccgauccugcccaccaucc

SEQ ID NO: 3213815 - RNA, 15 nt, Mycobacterium bovis subsp bovis AF2122/97
ccgauccuggccacu

SEQ ID NO: 3213816 - RNA, 23 nt, Mycobacterium bovis subsp bovis AF2122/97
ccgauccuggccacucccagcca

SEQ ID NO: 3213817 - RNA, 21 nt, Mycobacterium bovis subsp bovis AF2122/97
ccgaucgaaccgcugcuccuc

SEQ ID NO: 3213818 - RNA, 15 nt, Mycobacterium bovis subsp bovis AF2122/97
ccgaucgacacccgc

SEQ ID NO: 3213819 - RNA, 21 nt, Mycobacterium bovis subsp bovis AF2122/97
ccgaucgacacccgcucggcc

SEQ ID NO: 3213820 - RNA, 15 nt, Mycobacterium bovis subsp bovis AF2122/97
ccgaucgaccgcugg

SEQ ID NO: 3213821 - RNA, 18 nt, Mycobacterium bovis subsp bovis AF2122/97
ccgaucgacugcagcccg

SEQ ID NO: 3213822 - RNA, 14 nt, Mycobacterium bovis subsp bovis AF2122/97
ccgaucgauaucgg

SEQ ID NO: 3213823 - RNA, 15 nt, Mycobacterium bovis subsp bovis AF2122/97
ccgaucgaugccacg

SEQ ID NO: 3213824 - RNA, 17 nt, Mycobacterium bovis subsp bovis AF2122/97
ccgaucgaugccacguc

SEQ ID NO: 3213825 - RNA, 20 nt, Mycobacterium bovis subsp bovis AF2122/97
ccgaucgccgaggcuagcag

SEQ ID NO: 3213826 - RNA, 15 nt, Mycobacterium bovis subsp bovis AF2122/97
ccgaucgccgcgaag

SEQ ID NO: 3213827 - RNA, 19 nt, Mycobacterium bovis subsp bovis AF2122/97
ccgaucggcaaaccgucgg

SEQ ID NO: 3213828 - RNA, 15 nt, Mycobacterium bovis subsp bovis AF2122/97
ccgaucggcaggccg

SEQ ID NO: 3213829 - RNA, 14 nt, Mycobacterium bovis subsp bovis AF2122/97
ccgaucggccugca

SEQ ID NO: 3213830 - RNA, 14 nt, Mycobacterium bovis subsp bovis AF2122/97
ccgaucggcgcgcc

SEQ ID NO: 3213831 - RNA, 16 nt, Mycobacterium bovis subsp bovis AF2122/97
ccgaucggcgcgccga

SEQ ID NO: 3213832 - RNA, 14 nt, Mycobacterium bovis subsp bovis AF2122/97
ccgaucggcggauc

SEQ ID NO: 3213833 - RNA, 15 nt, Mycobacterium bovis subsp bovis AF2122/97
ccgaucggcggaucg

SEQ ID NO: 3213834 - RNA, 16 nt, Mycobacterium bovis subsp bovis AF2122/97
ccgaucgggcccaccg

SEQ ID NO: 3213835 - RNA, 21 nt, Mycobacterium bovis subsp bovis AF2122/97
ccgaucgggcucacucgccga

SEQ ID NO: 3213836 - RNA, 20 nt, Mycobacterium bovis subsp bovis AF2122/97
ccgaucgggcuucggccaga

SEQ ID NO: 3213837 - RNA, 15 nt, Mycobacterium bovis subsp bovis AF2122/97
ccgaucggucgaucg

SEQ ID NO: 3213838 - RNA, 13 nt, Mycobacterium bovis subsp bovis AF2122/97
ccgaucggucguc

SEQ ID NO: 3213839 - RNA, 18 nt, Mycobacterium bovis subsp bovis AF2122/97
ccgaucggucguccggau

SEQ ID NO: 3213840 - RNA, 18 nt, Mycobacterium bovis subsp bovis AF2122/97
ccgaucggugacgcgccg

SEQ ID NO: 3213841 - RNA, 19 nt, Mycobacterium bovis subsp bovis AF2122/97
ccgaucggugacgcgccgu

SEQ ID NO: 3213842 - RNA, 20 nt, Mycobacterium bovis subsp bovis AF2122/97
ccgaucggugacgcgccgua

SEQ ID NO: 3213843 - RNA, 14 nt, Mycobacterium bovis subsp bovis AF2122/97
ccgaucggugccgg

SEQ ID NO: 3213844 - RNA, 15 nt, Mycobacterium bovis subsp bovis AF2122/97
ccgaucggugccggc

SEQ ID NO: 3213845 - RNA, 16 nt, Mycobacterium bovis subsp bovis AF2122/97
ccgaucggugucgggc

SEQ ID NO: 3213846 - RNA, 17 nt, Mycobacterium bovis subsp bovis AF2122/97
ccgaucgucucggccac

SEQ ID NO: 3213847 - RNA, 18 nt, Mycobacterium bovis subsp bovis AF2122/97
ccgaucgucucggccacg

SEQ ID NO: 3213848 - RNA, 22 nt, Mycobacterium bovis subsp bovis AF2122/97
ccgaucgugacguuguaggaga

SEQ ID NO: 3213849 - RNA, 16 nt, Mycobacterium bovis subsp bovis AF2122/97
ccgaucucaagggcau

SEQ ID NO: 3213850 - RNA, 14 nt, Mycobacterium bovis subsp bovis AF2122/97
ccgaucucgaccag

SEQ ID NO: 3213851 - RNA, 19 nt, Mycobacterium bovis subsp bovis AF2122/97
ccgaucucgaccagcgccg

SEQ ID NO: 3213852 - RNA, 14 nt, Mycobacterium bovis subsp bovis AF2122/97
ccgaucucgcccag

SEQ ID NO: 3213853 - RNA, 15 nt, Mycobacterium bovis subsp bovis AF2122/97
ccgaucucuccggcg

SEQ ID NO: 3213854 - RNA, 18 nt, Mycobacterium bovis subsp bovis AF2122/97
ccgaucucuccggcggcg

SEQ ID NO: 3213855 - RNA, 21 nt, Mycobacterium bovis subsp bovis AF2122/97
ccgaucugcuccucggucagc

SEQ ID NO: 3213856 - RNA, 14 nt, Mycobacterium bovis subsp bovis AF2122/97
ccgaucugcucgcc

SEQ ID NO: 3213857 - RNA, 16 nt, Mycobacterium bovis subsp bovis AF2122/97
ccgaucugcucgccga

SEQ ID NO: 3213858 - RNA, 15 nt, Mycobacterium bovis subsp bovis AF2122/97
ccgaucugcugucgg

SEQ ID NO: 3213859 - RNA, 20 nt, Mycobacterium bovis subsp bovis AF2122/97
ccgaucuggaugucccaugc

SEQ ID NO: 3213860 - RNA, 21 nt, Mycobacterium bovis subsp bovis AF2122/97
ccgaucugguaagucagcucg

SEQ ID NO: 3213861 - RNA, 15 nt, Mycobacterium bovis subsp bovis AF2122/97
ccgaucuuggccacc

SEQ ID NO: 3213862 - RNA, 16 nt, Mycobacterium bovis subsp bovis AF2122/97
ccgaucuuggccaccg

SEQ ID NO: 3213863 - RNA, 19 nt, Mycobacterium bovis subsp bovis AF2122/97
ccgaucuuggccaccgccg

SEQ ID NO: 3213864 - RNA, 19 nt, Mycobacterium bovis subsp bovis AF2122/97
ccgaugaaccaggcggccg

SEQ ID NO: 3213865 - RNA, 17 nt, Mycobacterium bovis subsp bovis AF2122/97
ccgaugacccacugcag

SEQ ID NO: 3213866 - RNA, 19 nt, Mycobacterium bovis subsp bovis AF2122/97
ccgaugacccacugcaggc

SEQ ID NO: 3213867 - RNA, 13 nt, Mycobacterium bovis subsp bovis AF2122/97
ccgaugaccugcc

SEQ ID NO: 3213868 - RNA, 15 nt, Mycobacterium bovis subsp bovis AF2122/97
ccgaugaccugcccg

SEQ ID NO: 3213869 - RNA, 22 nt, Mycobacterium bovis subsp bovis AF2122/97
ccgaugaccuguagaucagcag

SEQ ID NO: 3213870 - RNA, 17 nt, Mycobacterium bovis subsp bovis AF2122/97
ccgaugacgaagugcag

SEQ ID NO: 3213871 - RNA, 18 nt, Mycobacterium bovis subsp bovis AF2122/97
ccgaugacgaucggcggc

SEQ ID NO: 3213872 - RNA, 22 nt, Mycobacterium bovis subsp bovis AF2122/97
ccgaugacgaucggcggcgcgc

SEQ ID NO: 3213873 - RNA, 18 nt, Mycobacterium bovis subsp bovis AF2122/97
ccgaugacgaugccgccg

SEQ ID NO: 3213874 - RNA, 17 nt, Mycobacterium bovis subsp bovis AF2122/97
ccgaugacgauggccgc

SEQ ID NO: 3213875 - RNA, 18 nt, Mycobacterium bovis subsp bovis AF2122/97
ccgcaacgcgucggucgc

SEQ ID NO: 3213876 - RNA, 15 nt, Mycobacterium bovis subsp bovis AF2122/97
ccgcaacgcuucggc

SEQ ID NO: 3213877 - RNA, 18 nt, Mycobacterium bovis subsp bovis AF2122/97
ccgcaacgcuucggcagc

SEQ ID NO: 3213878 - RNA, 22 nt, Mycobacterium bovis subsp bovis AF2122/97
ccgcaacggauaacccguggcg

SEQ ID NO: 3213879 - RNA, 23 nt, Mycobacterium bovis subsp bovis AF2122/97
ccgcaacggauaacccguggcgg

SEQ ID NO: 3213880 - RNA, 12 nt, Mycobacterium bovis subsp bovis AF2122/97
ccgcaacggaug

SEQ ID NO: 3213881 - RNA, 14 nt, Mycobacterium bovis subsp bovis AF2122/97
ccgcaacucgccga

SEQ ID NO: 3213882 - RNA, 16 nt, Mycobacterium bovis subsp bovis AF2122/97
ccgcaacucgccgaaa

SEQ ID NO: 3213883 - RNA, 23 nt, Mycobacterium bovis subsp bovis AF2122/97
ccgcaacucgccgaaaucggcca

SEQ ID NO: 3213884 - RNA, 17 nt, Mycobacterium bovis subsp bovis AF2122/97
ccgcaagaaucagcagc

SEQ ID NO: 3213885 - RNA, 18 nt, Mycobacterium bovis subsp bovis AF2122/97
ccgcaagaaucagcagca

SEQ ID NO: 3213886 - RNA, 14 nt, Mycobacterium bovis subsp bovis AF2122/97
ccgcaagccgcgag

SEQ ID NO: 3213887 - RNA, 17 nt, Mycobacterium bovis subsp bovis AF2122/97
ccgcaagccucguggug

SEQ ID NO: 3213888 - RNA, 21 nt, Mycobacterium bovis subsp bovis AF2122/97
ccgcaaggaccugugcggccg

SEQ ID NO: 3213889 - RNA, 23 nt, Mycobacterium bovis subsp bovis AF2122/97
ccgcaaggaccugugcggccgac

SEQ ID NO: 3213890 - RNA, 13 nt, Mycobacterium bovis subsp bovis AF2122/97
ccgcaaggcgccg

SEQ ID NO: 3213891 - RNA, 24 nt, Mycobacterium bovis subsp bovis AF2122/97
ccgcaagugucuccggcaacagca

SEQ ID NO: 3213892 - RNA, 20 nt, Mycobacterium bovis subsp bovis AF2122/97
ccgcaaguucacccaucauc

SEQ ID NO: 3213893 - RNA, 18 nt, Mycobacterium bovis subsp bovis AF2122/97
ccgcaaucaugucagcgc

SEQ ID NO: 3213894 - RNA, 12 nt, Mycobacterium bovis subsp bovis AF2122/97
ccgcaaucgcga

SEQ ID NO: 3213895 - RNA, 19 nt, Mycobacterium bovis subsp bovis AF2122/97
ccgcaaucggaugauuucg

SEQ ID NO: 3213896 - RNA, 14 nt, Mycobacterium bovis subsp bovis AF2122/97
ccgcaaugaccgcg

SEQ ID NO: 3213897 - RNA, 18 nt, Mycobacterium bovis subsp bovis AF2122/97
ccgcaaugacgucgucgg

SEQ ID NO: 3213898 - RNA, 20 nt, Mycobacterium bovis subsp bovis AF2122/97
ccgcaaugacgucgucggcc

SEQ ID NO: 3213899 - RNA, 19 nt, Mycobacterium bovis subsp bovis AF2122/97
ccgcaaugcgagcgcgccg

SEQ ID NO: 3213900 - RNA, 16 nt, Mycobacterium bovis subsp bovis AF2122/97
ccgcaaugcguugacc

SEQ ID NO: 3213901 - RNA, 14 nt, Mycobacterium bovis subsp bovis AF2122/97
ccgcaauggaccga

SEQ ID NO: 3213902 - RNA, 17 nt, Mycobacterium bovis subsp bovis AF2122/97
ccgcaauggaccgaacg

SEQ ID NO: 3213903 - RNA, 20 nt, Mycobacterium bovis subsp bovis AF2122/97
ccgcaauucccaucggccug

SEQ ID NO: 3213904 - RNA, 19 nt, Mycobacterium bovis subsp bovis AF2122/97
ccgcaauuguucgcggccg

SEQ ID NO: 3213905 - RNA, 17 nt, Mycobacterium bovis subsp bovis AF2122/97
ccgcacaagcccagccc

SEQ ID NO: 3213906 - RNA, 16 nt, Mycobacterium bovis subsp bovis AF2122/97
ccgcacaccugcgcgg

SEQ ID NO: 3213907 - RNA, 22 nt, Mycobacterium bovis subsp bovis AF2122/97
ccgcacaccugcgcggcgugcg

SEQ ID NO: 3213908 - RNA, 12 nt, Mycobacterium bovis subsp bovis AF2122/97
ccgcacagcgac

SEQ ID NO: 3213909 - RNA, 13 nt, Mycobacterium bovis subsp bovis AF2122/97
ccgcacagcgacg

SEQ ID NO: 3213910 - RNA, 17 nt, Mycobacterium bovis subsp bovis AF2122/97
ccgcacagcgacgagau

SEQ ID NO: 3213911 - RNA, 16 nt, Mycobacterium bovis subsp bovis AF2122/97
ccgcacagguccgggu

SEQ ID NO: 3213912 - RNA, 22 nt, Mycobacterium bovis subsp bovis AF2122/97
ccgcacaucgcucaucgucacc

SEQ ID NO: 3213913 - RNA, 21 nt, Mycobacterium bovis subsp bovis AF2122/97
ccgcacaugagcuggaaucga

SEQ ID NO: 3213914 - RNA, 19 nt, Mycobacterium bovis subsp bovis AF2122/97
ccgcaccaagcagcgacca

SEQ ID NO: 3213915 - RNA, 20 nt, Mycobacterium bovis subsp bovis AF2122/97
ccgcaccaagcagcgaccag

SEQ ID NO: 3213916 - RNA, 22 nt, Mycobacterium bovis subsp bovis AF2122/97
ccgcaccacaccgugggcgacg

SEQ ID NO: 3213917 - RNA, 10 nt, Mycobacterium bovis subsp bovis AF2122/97
ccgcaccacc

SEQ ID NO: 3213918 - RNA, 12 nt, Mycobacterium bovis subsp bovis AF2122/97
ccgcaccaccgg

SEQ ID NO: 3213919 - RNA, 13 nt, Mycobacterium bovis subsp bovis AF2122/97
ccgcaccaccggc

SEQ ID NO: 3213920 - RNA, 14 nt, Mycobacterium bovis subsp bovis AF2122/97
ccgcaccaccggcc

SEQ ID NO: 3213921 - RNA, 17 nt, Mycobacterium bovis subsp bovis AF2122/97
ccgcaccaccggcccca

SEQ ID NO: 3213922 - RNA, 18 nt, Mycobacterium bovis subsp bovis AF2122/97
ccgcaccaccggccccac

SEQ ID NO: 3213923 - RNA, 19 nt, Mycobacterium bovis subsp bovis AF2122/97
ccgcaccaccggccccacc

SEQ ID NO: 3213924 - RNA, 19 nt, Mycobacterium bovis subsp bovis AF2122/97
ccgcaccagaucgucgggc

SEQ ID NO: 3213925 - RNA, 23 nt, Mycobacterium bovis subsp bovis AF2122/97
ccgcaccagcauucucgccgacg

SEQ ID NO: 3213926 - RNA, 16 nt, Mycobacterium bovis subsp bovis AF2122/97
ccgcaccaggguugcc

SEQ ID NO: 3213927 - RNA, 15 nt, Mycobacterium bovis subsp bovis AF2122/97
ccgcaccagucgcgc

SEQ ID NO: 3213928 - RNA, 19 nt, Mycobacterium bovis subsp bovis AF2122/97
ccgcaccagucgcgcagcg

SEQ ID NO: 3213929 - RNA, 12 nt, Mycobacterium bovis subsp bovis AF2122/97
ccgcaccagugg

SEQ ID NO: 3213930 - RNA, 15 nt, Mycobacterium bovis subsp bovis AF2122/97
ccgcaccaguggcgc

SEQ ID NO: 3213931 - RNA, 17 nt, Mycobacterium bovis subsp bovis AF2122/97
ccgcaccaguggcgccc

SEQ ID NO: 3213932 - RNA, 18 nt, Mycobacterium bovis subsp bovis AF2122/97
ccgcaccaucggcgaggc

SEQ ID NO: 3213933 - RNA, 19 nt, Mycobacterium bovis subsp bovis AF2122/97
ccgcaccaucggcgaggcc

SEQ ID NO: 3213934 - RNA, 22 nt, Mycobacterium bovis subsp bovis AF2122/97
ccgcaccccauacucggcggcu

SEQ ID NO: 3213935 - RNA, 15 nt, Mycobacterium bovis subsp bovis AF2122/97
ccgcacccccgucga

SEQ ID NO: 3213936 - RNA, 21 nt, Mycobacterium bovis subsp bovis AF2122/97
ccgcacccccgucgaucagcg

SEQ ID NO: 3213937 - RNA, 21 nt, Mycobacterium bovis subsp bovis AF2122/97
ccgcaccccgcccgacgugaa

SEQ ID NO: 3213938 - RNA, 19 nt, Mycobacterium bovis subsp bovis AF2122/97
ccgcaccccggccgcgcgc

SEQ ID NO: 3213939 - RNA, 15 nt, Mycobacterium bovis subsp bovis AF2122/97
ccgcacccgcucccg

SEQ ID NO: 3213940 - RNA, 14 nt, Mycobacterium bovis subsp bovis AF2122/97
ccgcacccggccgc

SEQ ID NO: 3213941 - RNA, 15 nt, Mycobacterium bovis subsp bovis AF2122/97
ccgcacccgggacgu

SEQ ID NO: 3213942 - RNA, 14 nt, Mycobacterium bovis subsp bovis AF2122/97
ccgcacccggucga

SEQ ID NO: 3213943 - RNA, 12 nt, Mycobacterium bovis subsp bovis AF2122/97
ccgcacccgucc

SEQ ID NO: 3213944 - RNA, 14 nt, Mycobacterium bovis subsp bovis AF2122/97
ccgcacccguugcg

SEQ ID NO: 3213945 - RNA, 22 nt, Mycobacterium bovis subsp bovis AF2122/97
ccgcaccgaccugagucggcau

SEQ ID NO: 3213946 - RNA, 17 nt, Mycobacterium bovis subsp bovis AF2122/97
ccgcaccgccugcucgg

SEQ ID NO: 3213947 - RNA, 23 nt, Mycobacterium bovis subsp bovis AF2122/97
ccgcaccgccugcucggcgaccg

SEQ ID NO: 3213948 - RNA, 22 nt, Mycobacterium bovis subsp bovis AF2122/97
ccgcaccgcuguugcaucgccg

SEQ ID NO: 3213949 - RNA, 15 nt, Mycobacterium bovis subsp bovis AF2122/97
ccgcaccggaucggc

SEQ ID NO: 3213950 - RNA, 13 nt, Mycobacterium bovis subsp bovis AF2122/97
ccgcaccggccgc

SEQ ID NO: 3213951 - RNA, 22 nt, Mycobacterium bovis subsp bovis AF2122/97
ccgcaccggccgcuauggcccg

SEQ ID NO: 3213952 - RNA, 18 nt, Mycobacterium bovis subsp bovis AF2122/97
ccgcaccggggugugcgg

SEQ ID NO: 3213953 - RNA, 19 nt, Mycobacterium bovis subsp bovis AF2122/97
ccgcaccggugacgcacag

SEQ ID NO: 3213954 - RNA, 17 nt, Mycobacterium bovis subsp bovis AF2122/97
ccgcaccggugcucguc

SEQ ID NO: 3213955 - RNA, 21 nt, Mycobacterium bovis subsp bovis AF2122/97
ccgcaccguagccgcugcacg

SEQ ID NO: 3213956 - RNA, 15 nt, Mycobacterium bovis subsp bovis AF2122/97
ccgcaccgucccagu

SEQ ID NO: 3213957 - RNA, 16 nt, Mycobacterium bovis subsp bovis AF2122/97
ccgcaccgucccagug

SEQ ID NO: 3213958 - RNA, 13 nt, Mycobacterium bovis subsp bovis AF2122/97
ccgcaccgugccg

SEQ ID NO: 3213959 - RNA, 19 nt, Mycobacterium bovis subsp bovis AF2122/97
ccgcaccgugccgacgccc

SEQ ID NO: 3213960 - RNA, 20 nt, Mycobacterium bovis subsp bovis AF2122/97
ccgcaccuacccugcgcguu

SEQ ID NO: 3213961 - RNA, 14 nt, Mycobacterium bovis subsp bovis AF2122/97
ccgcagcgugaucu

SEQ ID NO: 3213962 - RNA, 21 nt, Mycobacterium bovis subsp bovis AF2122/97
ccgcagcguguaguggcccgc

SEQ ID NO: 3213963 - RNA, 17 nt, Mycobacterium bovis subsp bovis AF2122/97
ccgcagcuauuucgcga

SEQ ID NO: 3213964 - RNA, 12 nt, Mycobacterium bovis subsp bovis AF2122/97
ccgcagcucgcc

SEQ ID NO: 3213965 - RNA, 14 nt, Mycobacterium bovis subsp bovis AF2122/97
ccgcagcuguggcc

SEQ ID NO: 3213966 - RNA, 14 nt, Mycobacterium bovis subsp bovis AF2122/97
ccgcagcuuguccg

SEQ ID NO: 3213967 - RNA, 16 nt, Mycobacterium bovis subsp bovis AF2122/97
ccgcagcuuguccggu

SEQ ID NO: 3213968 - RNA, 13 nt, Mycobacterium bovis subsp bovis AF2122/97
ccgcaggcccgcc

SEQ ID NO: 3213969 - RNA, 21 nt, Mycobacterium bovis subsp bovis AF2122/97
ccgcaggccgaagacgugccg

SEQ ID NO: 3213970 - RNA, 22 nt, Mycobacterium bovis subsp bovis AF2122/97
ccgcaggcgauugcagcuucgg

SEQ ID NO: 3213971 - RNA, 18 nt, Mycobacterium bovis subsp bovis AF2122/97
ccgcaggcuugccgaugg

SEQ ID NO: 3213972 - RNA, 21 nt, Mycobacterium bovis subsp bovis AF2122/97
ccgcaggcuugccgauggcgg

SEQ ID NO: 3213973 - RNA, 17 nt, Mycobacterium bovis subsp bovis AF2122/97
ccgcagggcaucggucu

SEQ ID NO: 3213974 - RNA, 13 nt, Mycobacterium bovis subsp bovis AF2122/97
ccgcagggccgcc

SEQ ID NO: 3213975 - RNA, 15 nt, Mycobacterium bovis subsp bovis AF2122/97
ccgcagggccgccgc

SEQ ID NO: 3213976 - RNA, 19 nt, Mycobacterium bovis subsp bovis AF2122/97
ccgcagggccgccgcgaac

SEQ ID NO: 3213977 - RNA, 15 nt, Mycobacterium bovis subsp bovis AF2122/97
ccgcagggccgcgcg

SEQ ID NO: 3213978 - RNA, 17 nt, Mycobacterium bovis subsp bovis AF2122/97
ccgcagggccgcgcgca

SEQ ID NO: 3213979 - RNA, 18 nt, Mycobacterium bovis subsp bovis AF2122/97
ccgcagggucccgucauc

SEQ ID NO: 3213980 - RNA, 19 nt, Mycobacterium bovis subsp bovis AF2122/97
ccgcaggucgaucugcgcc

SEQ ID NO: 3213981 - RNA, 14 nt, Mycobacterium bovis subsp bovis AF2122/97
ccgcaggucgcacc

SEQ ID NO: 3213982 - RNA, 18 nt, Mycobacterium bovis subsp bovis AF2122/97
ccgcaggucgcuggccgu

SEQ ID NO: 3213983 - RNA, 13 nt, Mycobacterium bovis subsp bovis AF2122/97
ccgcaggucggcc

SEQ ID NO: 3213984 - RNA, 13 nt, Mycobacterium bovis subsp bovis AF2122/97
ccgcagucccagc

SEQ ID NO: 3213985 - RNA, 15 nt, Mycobacterium bovis subsp bovis AF2122/97
ccgcagucccagcac

SEQ ID NO: 3213986 - RNA, 14 nt, Mycobacterium bovis subsp bovis AF2122/97
ccgcaguccggggc

SEQ ID NO: 3213987 - RNA, 15 nt, Mycobacterium bovis subsp bovis AF2122/97
ccgcaguccggggcg

SEQ ID NO: 3213988 - RNA, 17 nt, Mycobacterium bovis subsp bovis AF2122/97
ccgcaguccggggcgca

SEQ ID NO: 3213989 - RNA, 21 nt, Mycobacterium bovis subsp bovis AF2122/97
ccgcaguccggggcgcagguc

SEQ ID NO: 3213990 - RNA, 16 nt, Mycobacterium bovis subsp bovis AF2122/97
ccgcagucgcggcaga

SEQ ID NO: 3213991 - RNA, 17 nt, Mycobacterium bovis subsp bovis AF2122/97
ccgcagucgcggcagac

SEQ ID NO: 3213992 - RNA, 21 nt, Mycobacterium bovis subsp bovis AF2122/97
ccgcagucgcuggguggcggg

SEQ ID NO: 3213993 - RNA, 22 nt, Mycobacterium bovis subsp bovis AF2122/97
ccgcagucgcuggguggcgggc

SEQ ID NO: 3213994 - RNA, 24 nt, Mycobacterium bovis subsp bovis AF2122/97
ccgcagucgcuggguggcgggccg

SEQ ID NO: 3213995 - RNA, 21 nt, Mycobacterium bovis subsp bovis AF2122/97
ccgcagugagcaaugccaacg

SEQ ID NO: 3213996 - RNA, 16 nt, Mycobacterium bovis subsp bovis AF2122/97
ccgcaguggucggcuc

SEQ ID NO: 3213997 - RNA, 23 nt, Mycobacterium bovis subsp bovis AF2122/97
ccgcaguggucggcuccgcgacg

SEQ ID NO: 3213998 - RNA, 22 nt, Mycobacterium bovis subsp bovis AF2122/97
ccgcaguuauccgguguccugg

SEQ ID NO: 3213999 - RNA, 15 nt, Mycobacterium bovis subsp bovis AF2122/97
ccgcauaaaucgggg

SEQ ID NO: 3214000 - RNA, 20 nt, Mycobacterium bovis subsp bovis AF2122/97
ccgcauaaggcccaugccgu

SEQ ID NO: 3214001 - RNA, 23 nt, Mycobacterium bovis subsp bovis AF2122/97
ccgcauaaggcccaugccgucgg

SEQ ID NO: 3214002 - RNA, 19 nt, Mycobacterium bovis subsp bovis AF2122/97
ccgcauaccuaacgagccg

SEQ ID NO: 3214003 - RNA, 23 nt, Mycobacterium bovis subsp bovis AF2122/97
ccgcauaccuuccagaucgcggu

SEQ ID NO: 3214004 - RNA, 16 nt, Mycobacterium bovis subsp bovis AF2122/97
ccgcauaggccccgcc

SEQ ID NO: 3214005 - RNA, 19 nt, Mycobacterium bovis subsp bovis AF2122/97
ccgcauaggccccgccagc

SEQ ID NO: 3214006 - RNA, 20 nt, Mycobacterium bovis subsp bovis AF2122/97
ccgcauaggccccgccagcg

SEQ ID NO: 3214007 - RNA, 16 nt, Mycobacterium bovis subsp bovis AF2122/97
ccgcaucacccgggau

SEQ ID NO: 3214008 - RNA, 15 nt, Mycobacterium bovis subsp bovis AF2122/97
ccgcaucaugucgaa

SEQ ID NO: 3214009 - RNA, 12 nt, Mycobacterium bovis subsp bovis AF2122/97
ccgcauccacgu

SEQ ID NO: 3214010 - RNA, 20 nt, Mycobacterium bovis subsp bovis AF2122/97
ccgcauccacgucgcccagg

SEQ ID NO: 3214011 - RNA, 17 nt, Mycobacterium bovis subsp bovis AF2122/97
ccgcauccagccgugcg

SEQ ID NO: 3214012 - RNA, 18 nt, Mycobacterium bovis subsp bovis AF2122/97
ccgcauccagccgugcgg

SEQ ID NO: 3214013 - RNA, 14 nt, Mycobacterium bovis subsp bovis AF2122/97
ccgcauccggucuc

SEQ ID NO: 3214014 - RNA, 14 nt, Mycobacterium bovis subsp bovis AF2122/97
ccgcaucgccgaac

SEQ ID NO: 3214015 - RNA, 15 nt, Mycobacterium bovis subsp bovis AF2122/97
ccgcaucgcggcauc

SEQ ID NO: 3214016 - RNA, 19 nt, Mycobacterium bovis subsp bovis AF2122/97
ccgcaucggaaucgcgagc

SEQ ID NO: 3214017 - RNA, 13 nt, Mycobacterium bovis subsp bovis AF2122/97
ccgcaucggcacg

SEQ ID NO: 3214018 - RNA, 15 nt, Mycobacterium bovis subsp bovis AF2122/97
ccgcaucggcagcca

SEQ ID NO: 3214019 - RNA, 15 nt, Mycobacterium bovis subsp bovis AF2122/97
ccgcaucggccccca

SEQ ID NO: 3214020 - RNA, 16 nt, Mycobacterium bovis subsp bovis AF2122/97
ccgcaucggcccccaa

SEQ ID NO: 3214021 - RNA, 19 nt, Mycobacterium bovis subsp bovis AF2122/97
ccgcaucggugucuuccuc

SEQ ID NO: 3214022 - RNA, 17 nt, Mycobacterium bovis subsp bovis AF2122/97
ccgcaucgucgccgcgc

SEQ ID NO: 3214023 - RNA, 22 nt, Mycobacterium bovis subsp bovis AF2122/97
ccgcaucgucgccgcgcagaaa

SEQ ID NO: 3214024 - RNA, 18 nt, Mycobacterium bovis subsp bovis AF2122/97
ccgcaugacgccggcggg

SEQ ID NO: 3214025 - RNA, 14 nt, Mycobacterium bovis subsp bovis AF2122/97
ccgcaugccacggc

SEQ ID NO: 3214026 - RNA, 14 nt, Mycobacterium bovis subsp bovis AF2122/97
ccgcaugcccugga

SEQ ID NO: 3214027 - RNA, 22 nt, Mycobacterium bovis subsp bovis AF2122/97
ccgcaugcccuggaccagcggg

SEQ ID NO: 3214028 - RNA, 17 nt, Mycobacterium bovis subsp bovis AF2122/97
ccgcaugcgcuccggcg

SEQ ID NO: 3214029 - RNA, 18 nt, Mycobacterium bovis subsp bovis AF2122/97
ccgcaugcgcuccggcgc

SEQ ID NO: 3214030 - RNA, 21 nt, Mycobacterium bovis subsp bovis AF2122/97
ccgcaugcgcuccggcgcgac

SEQ ID NO: 3214031 - RNA, 15 nt, Mycobacterium bovis subsp bovis AF2122/97
ccgcaugcucagcau

SEQ ID NO: 3214032 - RNA, 22 nt, Mycobacterium bovis subsp bovis AF2122/97
ccgcauggacgcgaugaccgca

SEQ ID NO: 3214033 - RNA, 15 nt, Mycobacterium bovis subsp bovis AF2122/97
ccgcauggcagcggc

SEQ ID NO: 3214034 - RNA, 19 nt, Mycobacterium bovis subsp bovis AF2122/97
ccgcauggugggugccggc

SEQ ID NO: 3214035 - RNA, 22 nt, Mycobacterium bovis subsp bovis AF2122/97
ccgcauggugggugccggcguc

SEQ ID NO: 3214036 - RNA, 18 nt, Mycobacterium bovis subsp bovis AF2122/97
ccgcauucguggagccgg

SEQ ID NO: 3214037 - RNA, 20 nt, Mycobacterium bovis subsp bovis AF2122/97
ccgcauucguggagccggcc

SEQ ID NO: 3214038 - RNA, 21 nt, Mycobacterium bovis subsp bovis AF2122/97
ccgcauucguggagccggccg

SEQ ID NO: 3214039 - RNA, 22 nt, Mycobacterium bovis subsp bovis AF2122/97
ccgcauucguggagccggccgu

SEQ ID NO: 3214040 - RNA, 13 nt, Mycobacterium bovis subsp bovis AF2122/97
ccgcauugacgaa

SEQ ID NO: 3214041 - RNA, 17 nt, Mycobacterium bovis subsp bovis AF2122/97
ccgcauugagcuggcgc

SEQ ID NO: 3214042 - RNA, 19 nt, Mycobacterium bovis subsp bovis AF2122/97
ccgcauugagcuggcgccc

SEQ ID NO: 3214043 - RNA, 20 nt, Mycobacterium bovis subsp bovis AF2122/97
ccgcauugagcuggcgcccg

SEQ ID NO: 3214044 - RNA, 20 nt, Mycobacterium bovis subsp bovis AF2122/97
ccgcauugaucucgaccggc

SEQ ID NO: 3214045 - RNA, 21 nt, Mycobacterium bovis subsp bovis AF2122/97
ccgcauugaucucgaccggcu

SEQ ID NO: 3214046 - RNA, 22 nt, Mycobacterium bovis subsp bovis AF2122/97
ccgcauugcagaaccgccaaca

SEQ ID NO: 3214047 - RNA, 15 nt, Mycobacterium bovis subsp bovis AF2122/97
ccgccagccaccaca

SEQ ID NO: 3214048 - RNA, 15 nt, Mycobacterium bovis subsp bovis AF2122/97
ccgccagcccagccc

SEQ ID NO: 3214049 - RNA, 13 nt, Mycobacterium bovis subsp bovis AF2122/97
ccgccagccccac

SEQ ID NO: 3214050 - RNA, 21 nt, Mycobacterium bovis subsp bovis AF2122/97
ccgccagccccacccgcaugc

SEQ ID NO: 3214051 - RNA, 22 nt, Mycobacterium bovis subsp bovis AF2122/97
ccgccagccccagcguucccgc

SEQ ID NO: 3214052 - RNA, 12 nt, Mycobacterium bovis subsp bovis AF2122/97
ccgccagccccg

SEQ ID NO: 3214053 - RNA, 17 nt, Mycobacterium bovis subsp bovis AF2122/97
ccgccagccccgcgccc

SEQ ID NO: 3214054 - RNA, 18 nt, Mycobacterium bovis subsp bovis AF2122/97
ccgccagccccgcgccca

SEQ ID NO: 3214055 - RNA, 22 nt, Mycobacterium bovis subsp bovis AF2122/97
ccgccagccccgcgcccacccc

SEQ ID NO: 3214056 - RNA, 14 nt, Mycobacterium bovis subsp bovis AF2122/97
ccgccagccgcgag

SEQ ID NO: 3214057 - RNA, 16 nt, Mycobacterium bovis subsp bovis AF2122/97
ccgccagccgcgagcc

SEQ ID NO: 3214058 - RNA, 15 nt, Mycobacterium bovis subsp bovis AF2122/97
ccgccagccuggucu

SEQ ID NO: 3214059 - RNA, 20 nt, Mycobacterium bovis subsp bovis AF2122/97
ccgccagccuggucuuguug

SEQ ID NO: 3214060 - RNA, 13 nt, Mycobacterium bovis subsp bovis AF2122/97
ccgccagcgccgc

SEQ ID NO: 3214061 - RNA, 16 nt, Mycobacterium bovis subsp bovis AF2122/97
ccgccagcgccgccga

SEQ ID NO: 3214062 - RNA, 17 nt, Mycobacterium bovis subsp bovis AF2122/97
ccgccagcgccgccgag

SEQ ID NO: 3214063 - RNA, 17 nt, Mycobacterium bovis subsp bovis AF2122/97
ccgccagcgccgccgcg

SEQ ID NO: 3214064 - RNA, 16 nt, Mycobacterium bovis subsp bovis AF2122/97
ccgccagcgccgccgg

SEQ ID NO: 3214065 - RNA, 18 nt, Mycobacterium bovis subsp bovis AF2122/97
ccgccagcgccgccggag

SEQ ID NO: 3214066 - RNA, 19 nt, Mycobacterium bovis subsp bovis AF2122/97
ccgccagcgccgccggcgc

SEQ ID NO: 3214067 - RNA, 15 nt, Mycobacterium bovis subsp bovis AF2122/97
ccgccagcgccgguc

SEQ ID NO: 3214068 - RNA, 16 nt, Mycobacterium bovis subsp bovis AF2122/97
ccgccagcgccgguca

SEQ ID NO: 3214069 - RNA, 13 nt, Mycobacterium bovis subsp bovis AF2122/97
ccgccagcgcgaa

SEQ ID NO: 3214070 - RNA, 14 nt, Mycobacterium bovis subsp bovis AF2122/97
ccgccagcgcgccg

SEQ ID NO: 3214071 - RNA, 23 nt, Mycobacterium bovis subsp bovis AF2122/97
ccgccagcgcgccgaucacggug

SEQ ID NO: 3214072 - RNA, 14 nt, Mycobacterium bovis subsp bovis AF2122/97
ccgccagcggcaau

SEQ ID NO: 3214073 - RNA, 23 nt, Mycobacterium bovis subsp bovis AF2122/97
ccgccagcggcaauggccagcac

SEQ ID NO: 3214074 - RNA, 14 nt, Mycobacterium bovis subsp bovis AF2122/97
ccgccagcggcagc

SEQ ID NO: 3214075 - RNA, 13 nt, Mycobacterium bovis subsp bovis AF2122/97
ccgccagcggccg

SEQ ID NO: 3214076 - RNA, 16 nt, Mycobacterium bovis subsp bovis AF2122/97
ccgccagcgucgacac

SEQ ID NO: 3214077 - RNA, 13 nt, Mycobacterium bovis subsp bovis AF2122/97
ccgccagcucacg

SEQ ID NO: 3214078 - RNA, 19 nt, Mycobacterium bovis subsp bovis AF2122/97
ccgccaggaacucggccca

SEQ ID NO: 3214079 - RNA, 20 nt, Mycobacterium bovis subsp bovis AF2122/97
ccgccaggaacucggcccac

SEQ ID NO: 3214080 - RNA, 14 nt, Mycobacterium bovis subsp bovis AF2122/97
ccgccaggccgacc

SEQ ID NO: 3214081 - RNA, 14 nt, Mycobacterium bovis subsp bovis AF2122/97
ccgccaggcggccg

SEQ ID NO: 3214082 - RNA, 16 nt, Mycobacterium bovis subsp bovis AF2122/97
ccgccaggcggccggg

SEQ ID NO: 3214083 - RNA, 17 nt, Mycobacterium bovis subsp bovis AF2122/97
ccgccagggcggcaucc

SEQ ID NO: 3214084 - RNA, 20 nt, Mycobacterium bovis subsp bovis AF2122/97
ccgccagguccccgacaacg

SEQ ID NO: 3214085 - RNA, 21 nt, Mycobacterium bovis subsp bovis AF2122/97
ccgccaggucgaggcaggccu

SEQ ID NO: 3214086 - RNA, 16 nt, Mycobacterium bovis subsp bovis AF2122/97
ccgccaggugcucguc

SEQ ID NO: 3214087 - RNA, 18 nt, Mycobacterium bovis subsp bovis AF2122/97
ccgccagguguucgccgg

SEQ ID NO: 3214088 - RNA, 17 nt, Mycobacterium bovis subsp bovis AF2122/97
ccgccagucccccgcuc

SEQ ID NO: 3214089 - RNA, 23 nt, Mycobacterium bovis subsp bovis AF2122/97
ccgccagucguccucaucguucc

SEQ ID NO: 3214090 - RNA, 21 nt, Mycobacterium bovis subsp bovis AF2122/97
ccgccagugcccgcacugccg

SEQ ID NO: 3214091 - RNA, 15 nt, Mycobacterium bovis subsp bovis AF2122/97
ccgccaucaccgccg

SEQ ID NO: 3214092 - RNA, 16 nt, Mycobacterium bovis subsp bovis AF2122/97
ccgccaucaccgccgu

SEQ ID NO: 3214093 - RNA, 14 nt, Mycobacterium bovis subsp bovis AF2122/97
ccgccaucagcccg

SEQ ID NO: 3214094 - RNA, 22 nt, Mycobacterium bovis subsp bovis AF2122/97
ccgccaucagcccggcgcgccg

SEQ ID NO: 3214095 - RNA, 14 nt, Mycobacterium bovis subsp bovis AF2122/97
ccgccaucagccgc

SEQ ID NO: 3214096 - RNA, 15 nt, Mycobacterium bovis subsp bovis AF2122/97
ccgccaucagccgcu

SEQ ID NO: 3214097 - RNA, 19 nt, Mycobacterium bovis subsp bovis AF2122/97
ccgccaucaucgcuuggcc

SEQ ID NO: 3214098 - RNA, 20 nt, Mycobacterium bovis subsp bovis AF2122/97
ccgccaucaucgcuuggccu

SEQ ID NO: 3214099 - RNA, 20 nt, Mycobacterium bovis subsp bovis AF2122/97
ccgccauccgauggcccggc

SEQ ID NO: 3214100 - RNA, 16 nt, Mycobacterium bovis subsp bovis AF2122/97
ccgccaucgccaacac

SEQ ID NO: 3214101 - RNA, 13 nt, Mycobacterium bovis subsp bovis AF2122/97
ccgccaucgccga

SEQ ID NO: 3214102 - RNA, 15 nt, Mycobacterium bovis subsp bovis AF2122/97
ccgccaucgccgaug

SEQ ID NO: 3214103 - RNA, 18 nt, Mycobacterium bovis subsp bovis AF2122/97
ccgccaucgccgccaacc

SEQ ID NO: 3214104 - RNA, 16 nt, Mycobacterium bovis subsp bovis AF2122/97
ccgccaucgccgccgg

SEQ ID NO: 3214105 - RNA, 19 nt, Mycobacterium bovis subsp bovis AF2122/97
ccgccaucgccgccggugc

SEQ ID NO: 3214106 - RNA, 20 nt, Mycobacterium bovis subsp bovis AF2122/97
ccgccaucgucgaagaccuc

SEQ ID NO: 3214107 - RNA, 17 nt, Mycobacterium bovis subsp bovis AF2122/97
ccgccaucugccugccu

SEQ ID NO: 3214108 - RNA, 17 nt, Mycobacterium bovis subsp bovis AF2122/97
ccgccaugaaaucaccc

SEQ ID NO: 3214109 - RNA, 22 nt, Mycobacterium bovis subsp bovis AF2122/97
ccgccaugagguaggucgccgc

SEQ ID NO: 3214110 - RNA, 13 nt, Mycobacterium bovis subsp bovis AF2122/97
ccgccaugcggcg

SEQ ID NO: 3214111 - RNA, 18 nt, Mycobacterium bovis subsp bovis AF2122/97
ccgccauguacaggcccc

SEQ ID NO: 3214112 - RNA, 20 nt, Mycobacterium bovis subsp bovis AF2122/97
ccgccauguacaggccccac

SEQ ID NO: 3214113 - RNA, 21 nt, Mycobacterium bovis subsp bovis AF2122/97
ccgccauugacgccguugccg

SEQ ID NO: 3214114 - RNA, 17 nt, Mycobacterium bovis subsp bovis AF2122/97
ccgccauugagcucccg

SEQ ID NO: 3214115 - RNA, 15 nt, Mycobacterium bovis subsp bovis AF2122/97
ccgccauugccgccg

SEQ ID NO: 3214116 - RNA, 19 nt, Mycobacterium bovis subsp bovis AF2122/97
ccgccauugccgccggugc

SEQ ID NO: 3214117 - RNA, 22 nt, Mycobacterium bovis subsp bovis AF2122/97
ccgccauugccgccggugccgc

SEQ ID NO: 3214118 - RNA, 22 nt, Mycobacterium bovis subsp bovis AF2122/97
ccgccauugccgccgucgccgc

SEQ ID NO: 3214119 - RNA, 18 nt, Mycobacterium bovis subsp bovis AF2122/97
ccgccauuggcaggcaug

SEQ ID NO: 3214120 - RNA, 15 nt, Mycobacterium bovis subsp bovis AF2122/97
ccgccauuggcgccg

SEQ ID NO: 3214121 - RNA, 16 nt, Mycobacterium bovis subsp bovis AF2122/97
ccgccauuucgcccga

SEQ ID NO: 3214122 - RNA, 16 nt, Mycobacterium bovis subsp bovis AF2122/97
ccgcccaagccgccgg

SEQ ID NO: 3214123 - RNA, 19 nt, Mycobacterium bovis subsp bovis AF2122/97
ccgcccaagguggcggcca

SEQ ID NO: 3214124 - RNA, 16 nt, Mycobacterium bovis subsp bovis AF2122/97
ccgcccaccacacagc

SEQ ID NO: 3214125 - RNA, 20 nt, Mycobacterium bovis subsp bovis AF2122/97
ccgcccaccacacagccgcg

SEQ ID NO: 3214126 - RNA, 12 nt, Mycobacterium bovis subsp bovis AF2122/97
ccgcccaccggu

SEQ ID NO: 3214127 - RNA, 16 nt, Mycobacterium bovis subsp bovis AF2122/97
ccgcccaccggucgcc

SEQ ID NO: 3214128 - RNA, 17 nt, Mycobacterium bovis subsp bovis AF2122/97
ccgcccaccggucgccg

SEQ ID NO: 3214129 - RNA, 15 nt, Mycobacterium bovis subsp bovis AF2122/97
ccgcccacgcugccc

SEQ ID NO: 3214130 - RNA, 17 nt, Mycobacterium bovis subsp bovis AF2122/97
ccgcccacggcaccacc

SEQ ID NO: 3214131 - RNA, 13 nt, Mycobacterium bovis subsp bovis AF2122/97
ccgcccagaccgc

SEQ ID NO: 3214132 - RNA, 14 nt, Mycobacterium bovis subsp bovis AF2122/97
ccgcccagaccgcc

SEQ ID NO: 3214133 - RNA, 17 nt, Mycobacterium bovis subsp bovis AF2122/97
ccgcccagaccgccgac

SEQ ID NO: 3214134 - RNA, 18 nt, Mycobacterium bovis subsp bovis AF2122/97
ccgcccuggccgccggcc

SEQ ID NO: 3214135 - RNA, 20 nt, Mycobacterium bovis subsp bovis AF2122/97
ccgcccuggccgccggcccc

SEQ ID NO: 3214136 - RNA, 15 nt, Mycobacterium bovis subsp bovis AF2122/97
ccgcccugguccagg

SEQ ID NO: 3214137 - RNA, 17 nt, Mycobacterium bovis subsp bovis AF2122/97
ccgcccuugauguccgc

SEQ ID NO: 3214138 - RNA, 12 nt, Mycobacterium bovis subsp bovis AF2122/97
ccgcccuugccg

SEQ ID NO: 3214139 - RNA, 17 nt, Mycobacterium bovis subsp bovis AF2122/97
ccgcccuugccgccagc

SEQ ID NO: 3214140 - RNA, 17 nt, Mycobacterium bovis subsp bovis AF2122/97
ccgcccuugccgcccgc

SEQ ID NO: 3214141 - RNA, 20 nt, Mycobacterium bovis subsp bovis AF2122/97
ccgcccuugccgccgagggc

SEQ ID NO: 3214142 - RNA, 19 nt, Mycobacterium bovis subsp bovis AF2122/97
ccgcccuugccgccggccc

SEQ ID NO: 3214143 - RNA, 20 nt, Mycobacterium bovis subsp bovis AF2122/97
ccgcccuugccgccggcccc

SEQ ID NO: 3214144 - RNA, 20 nt, Mycobacterium bovis subsp bovis AF2122/97
ccgccgaaacucaccagcac

SEQ ID NO: 3214145 - RNA, 13 nt, Mycobacterium bovis subsp bovis AF2122/97
ccgccgaacgccu

SEQ ID NO: 3214146 - RNA, 22 nt, Mycobacterium bovis subsp bovis AF2122/97
ccgccgaacgccucugcgauca

SEQ ID NO: 3214147 - RNA, 20 nt, Mycobacterium bovis subsp bovis AF2122/97
ccgccgaagaaggugacgau

SEQ ID NO: 3214148 - RNA, 15 nt, Mycobacterium bovis subsp bovis AF2122/97
ccgccgaagccgcgc

SEQ ID NO: 3214149 - RNA, 16 nt, Mycobacterium bovis subsp bovis AF2122/97
ccgccgaagccgcgca

SEQ ID NO: 3214150 - RNA, 19 nt, Mycobacterium bovis subsp bovis AF2122/97
ccgccgaagcucaucgccg

SEQ ID NO: 3214151 - RNA, 18 nt, Mycobacterium bovis subsp bovis AF2122/97
ccgccgaauccgacgucg

SEQ ID NO: 3214152 - RNA, 17 nt, Mycobacterium bovis subsp bovis AF2122/97
ccgccgacaaccccgcc

SEQ ID NO: 3214153 - RNA, 15 nt, Mycobacterium bovis subsp bovis AF2122/97
ccgccgacaccaccg

SEQ ID NO: 3214154 - RNA, 17 nt, Mycobacterium bovis subsp bovis AF2122/97
ccgccgacaccaccggc

SEQ ID NO: 3214155 - RNA, 22 nt, Mycobacterium bovis subsp bovis AF2122/97
ccgccgacaccaccggcgccgc

SEQ ID NO: 3214156 - RNA, 14 nt, Mycobacterium bovis subsp bovis AF2122/97
ccgccgacaggccg

SEQ ID NO: 3214157 - RNA, 15 nt, Mycobacterium bovis subsp bovis AF2122/97
ccgccgaccgacacc

SEQ ID NO: 3214158 - RNA, 12 nt, Mycobacterium bovis subsp bovis AF2122/97
ccgccgaccgga

SEQ ID NO: 3214159 - RNA, 13 nt, Mycobacterium bovis subsp bovis AF2122/97
ccgccgaccggac

SEQ ID NO: 3214160 - RNA, 13 nt, Mycobacterium bovis subsp bovis AF2122/97
ccgccgacgccgc

SEQ ID NO: 3214161 - RNA, 15 nt, Mycobacterium bovis subsp bovis AF2122/97
ccgccgacgccgccg

SEQ ID NO: 3214162 - RNA, 12 nt, Mycobacterium bovis subsp bovis AF2122/97
ccgccgacggau

SEQ ID NO: 3214163 - RNA, 15 nt, Mycobacterium bovis subsp bovis AF2122/97
ccgccgacgggaacc

SEQ ID NO: 3214164 - RNA, 14 nt, Mycobacterium bovis subsp bovis AF2122/97
ccgccgacguuggg

SEQ ID NO: 3214165 - RNA, 14 nt, Mycobacterium bovis subsp bovis AF2122/97
ccgccgacuccccg

SEQ ID NO: 3214166 - RNA, 15 nt, Mycobacterium bovis subsp bovis AF2122/97
ccgccgacuccccgc

SEQ ID NO: 3214167 - RNA, 20 nt, Mycobacterium bovis subsp bovis AF2122/97
ccgccgacuccccgccgggc

SEQ ID NO: 3214168 - RNA, 20 nt, Mycobacterium bovis subsp bovis AF2122/97
ccgccgacuuccgcgucgcc

SEQ ID NO: 3214169 - RNA, 15 nt, Mycobacterium bovis subsp bovis AF2122/97
ccgccgagauagcaa

SEQ ID NO: 3214170 - RNA, 23 nt, Mycobacterium bovis subsp bovis AF2122/97
ccgccgagauagcaacgaagccg

SEQ ID NO: 3214171 - RNA, 20 nt, Mycobacterium bovis subsp bovis AF2122/97
ccgccgagaugaugcugccg

SEQ ID NO: 3214172 - RNA, 21 nt, Mycobacterium bovis subsp bovis AF2122/97
ccgccgagaugaugcugccgg

SEQ ID NO: 3214173 - RNA, 18 nt, Mycobacterium bovis subsp bovis AF2122/97
ccgccgagaugcuggucg

SEQ ID NO: 3214174 - RNA, 13 nt, Mycobacterium bovis subsp bovis AF2122/97
ccgccgagcaccg

SEQ ID NO: 3214175 - RNA, 12 nt, Mycobacterium bovis subsp bovis AF2122/97
ccgccgagcaga

SEQ ID NO: 3214176 - RNA, 12 nt, Mycobacterium bovis subsp bovis AF2122/97
ccgccgagcgca

SEQ ID NO: 3214177 - RNA, 22 nt, Mycobacterium bovis subsp bovis AF2122/97
ccgccgagcggaccaccgcucg

SEQ ID NO: 3214178 - RNA, 18 nt, Mycobacterium bovis subsp bovis AF2122/97
ccgccgagcggugccggc

SEQ ID NO: 3214179 - RNA, 18 nt, Mycobacterium bovis subsp bovis AF2122/97
ccgccgagcucggucacc

SEQ ID NO: 3214180 - RNA, 21 nt, Mycobacterium bovis subsp bovis AF2122/97
ccgccgagcucggucaccacg

SEQ ID NO: 3214181 - RNA, 13 nt, Mycobacterium bovis subsp bovis AF2122/97
ccgccgagcuggc

SEQ ID NO: 3214182 - RNA, 21 nt, Mycobacterium bovis subsp bovis AF2122/97
ccgccgagcuggcgcgcgggg

SEQ ID NO: 3214183 - RNA, 22 nt, Mycobacterium bovis subsp bovis AF2122/97
ccgccgagcuggcgcgcggggu

SEQ ID NO: 3214184 - RNA, 20 nt, Mycobacterium bovis subsp bovis AF2122/97
ccgccgaggccgccguugcc

SEQ ID NO: 3214185 - RNA, 21 nt, Mycobacterium bovis subsp bovis AF2122/97
ccgccgaggccgccguugccg

SEQ ID NO: 3214186 - RNA, 16 nt, Mycobacterium bovis subsp bovis AF2122/97
ccgccgagggcgccgg

SEQ ID NO: 3214187 - RNA, 21 nt, Mycobacterium bovis subsp bovis AF2122/97
ccgccgaggucgguucggccg

SEQ ID NO: 3214188 - RNA, 22 nt, Mycobacterium bovis subsp bovis AF2122/97
ccgccgaggucgguucggccgg

SEQ ID NO: 3214189 - RNA, 15 nt, Mycobacterium bovis subsp bovis AF2122/97
ccgccgauaccgccg

SEQ ID NO: 3214190 - RNA, 15 nt, Mycobacterium bovis subsp bovis AF2122/97
ccgccgaucaccagg

SEQ ID NO: 3214191 - RNA, 16 nt, Mycobacterium bovis subsp bovis AF2122/97
ccgccgaucaccgcug

SEQ ID NO: 3214192 - RNA, 12 nt, Mycobacterium bovis subsp bovis AF2122/97
ccgccgaucacu

SEQ ID NO: 3214193 - RNA, 18 nt, Mycobacterium bovis subsp bovis AF2122/97
ccgccgaucgaaccgcug

SEQ ID NO: 3214194 - RNA, 15 nt, Mycobacterium bovis subsp bovis AF2122/97
ccgccgaucugcugc

SEQ ID NO: 3214195 - RNA, 19 nt, Mycobacterium bovis subsp bovis AF2122/97
ccgccgaucugcugcagcg

SEQ ID NO: 3214196 - RNA, 12 nt, Mycobacterium bovis subsp bovis AF2122/97
ccgccgaugcca

SEQ ID NO: 3214197 - RNA, 18 nt, Mycobacterium bovis subsp bovis AF2122/97
ccgccgaugccaccgcuu

SEQ ID NO: 3214198 - RNA, 20 nt, Mycobacterium bovis subsp bovis AF2122/97
ccgccgaugccaccgcuuga

SEQ ID NO: 3214199 - RNA, 17 nt, Mycobacterium bovis subsp bovis AF2122/97
ccgccgaugcccgacac

SEQ ID NO: 3214200 - RNA, 13 nt, Mycobacterium bovis subsp bovis AF2122/97
ccgccgaugccgc

SEQ ID NO: 3214201 - RNA, 15 nt, Mycobacterium bovis subsp bovis AF2122/97
ccgccgaugccgccg

SEQ ID NO: 3214202 - RNA, 17 nt, Mycobacterium bovis subsp bovis AF2122/97
ccgccgaugccgccggc

SEQ ID NO: 3214203 - RNA, 19 nt, Mycobacterium bovis subsp bovis AF2122/97
ccgccgaugcugccgccgc

SEQ ID NO: 3214204 - RNA, 20 nt, Mycobacterium bovis subsp bovis AF2122/97
ccgccgcaaccgcgaagccg

SEQ ID NO: 3214205 - RNA, 14 nt, Mycobacterium bovis subsp bovis AF2122/97
ccgccgcaccgccg

SEQ ID NO: 3214206 - RNA, 12 nt, Mycobacterium bovis subsp bovis AF2122/97
ccgccgcacgca

SEQ ID NO: 3214207 - RNA, 19 nt, Mycobacterium bovis subsp bovis AF2122/97
ccgccgcacgcuagccgac

SEQ ID NO: 3214208 - RNA, 15 nt, Mycobacterium bovis subsp bovis AF2122/97
ccgccgcagacgccg

SEQ ID NO: 3214209 - RNA, 19 nt, Mycobacterium bovis subsp bovis AF2122/97
ccgccgcagacgccgacuc

SEQ ID NO: 3214210 - RNA, 21 nt, Mycobacterium bovis subsp bovis AF2122/97
ccgccgcagacgccgacuccg

SEQ ID NO: 3214211 - RNA, 19 nt, Mycobacterium bovis subsp bovis AF2122/97
ccgccgcagcuccccgacc

SEQ ID NO: 3214212 - RNA, 21 nt, Mycobacterium bovis subsp bovis AF2122/97
ccgccgccaccaccgcugccg

SEQ ID NO: 3214213 - RNA, 15 nt, Mycobacterium bovis subsp bovis AF2122/97
ccgccgccaccaggg

SEQ ID NO: 3214214 - RNA, 23 nt, Mycobacterium bovis subsp bovis AF2122/97
ccgccgccaccagggcggccucc

SEQ ID NO: 3214215 - RNA, 14 nt, Mycobacterium bovis subsp bovis AF2122/97
ccgccgccaccggc

SEQ ID NO: 3214216 - RNA, 16 nt, Mycobacterium bovis subsp bovis AF2122/97
ccgccgccaccggcgc

SEQ ID NO: 3214217 - RNA, 19 nt, Mycobacterium bovis subsp bovis AF2122/97
ccgccgccaccggcgccgc

SEQ ID NO: 3214218 - RNA, 21 nt, Mycobacterium bovis subsp bovis AF2122/97
ccgccgccaccggcgccgccg

SEQ ID NO: 3214219 - RNA, 13 nt, Mycobacterium bovis subsp bovis AF2122/97
ccgccgccacggc

SEQ ID NO: 3214220 - RNA, 15 nt, Mycobacterium bovis subsp bovis AF2122/97
ccgccgccaguccgg

SEQ ID NO: 3214221 - RNA, 17 nt, Mycobacterium bovis subsp bovis AF2122/97
ccgccgcugccgccugc

SEQ ID NO: 3214222 - RNA, 15 nt, Mycobacterium bovis subsp bovis AF2122/97
ccgccgcugccgcgc

SEQ ID NO: 3214223 - RNA, 16 nt, Mycobacterium bovis subsp bovis AF2122/97
ccgccgcugccgcgcg

SEQ ID NO: 3214224 - RNA, 17 nt, Mycobacterium bovis subsp bovis AF2122/97
ccgccgcugccgcgcgg

SEQ ID NO: 3214225 - RNA, 16 nt, Mycobacterium bovis subsp bovis AF2122/97
ccgccgcugccggugg

SEQ ID NO: 3214226 - RNA, 18 nt, Mycobacterium bovis subsp bovis AF2122/97
ccgccgcugccgguggcg

SEQ ID NO: 3214227 - RNA, 22 nt, Mycobacterium bovis subsp bovis AF2122/97
ccgccgcuguugaucgacaccg

SEQ ID NO: 3214228 - RNA, 19 nt, Mycobacterium bovis subsp bovis AF2122/97
ccgccggaagcgccggccg

SEQ ID NO: 3214229 - RNA, 15 nt, Mycobacterium bovis subsp bovis AF2122/97
ccgccggacccaccg

SEQ ID NO: 3214230 - RNA, 20 nt, Mycobacterium bovis subsp bovis AF2122/97
ccgccggacccaccgucacc

SEQ ID NO: 3214231 - RNA, 14 nt, Mycobacterium bovis subsp bovis AF2122/97
ccgccggacccgcc

SEQ ID NO: 3214232 - RNA, 15 nt, Mycobacterium bovis subsp bovis AF2122/97
ccgccggacccgccc

SEQ ID NO: 3214233 - RNA, 20 nt, Mycobacterium bovis subsp bovis AF2122/97
ccgccggacccgcccuugcc

SEQ ID NO: 3214234 - RNA, 18 nt, Mycobacterium bovis subsp bovis AF2122/97
ccgccggacccgccgggu

SEQ ID NO: 3214235 - RNA, 14 nt, Mycobacterium bovis subsp bovis AF2122/97
ccgccggacccguc

SEQ ID NO: 3214236 - RNA, 19 nt, Mycobacterium bovis subsp bovis AF2122/97
ccgccggacccgucgagca

SEQ ID NO: 3214237 - RNA, 23 nt, Mycobacterium bovis subsp bovis AF2122/97
ccgccggacccgucgagcagcau

SEQ ID NO: 3214238 - RNA, 15 nt, Mycobacterium bovis subsp bovis AF2122/97
ccgccggaccgccgc

SEQ ID NO: 3214239 - RNA, 16 nt, Mycobacterium bovis subsp bovis AF2122/97
ccgccggauagcaccg

SEQ ID NO: 3214240 - RNA, 19 nt, Mycobacterium bovis subsp bovis AF2122/97
ccgccggauagcaccggca

SEQ ID NO: 3214241 - RNA, 20 nt, Mycobacterium bovis subsp bovis AF2122/97
ccgccggauagcaccggcac

SEQ ID NO: 3214242 - RNA, 21 nt, Mycobacterium bovis subsp bovis AF2122/97
ccgccggaucaggaucgacag

SEQ ID NO: 3214243 - RNA, 16 nt, Mycobacterium bovis subsp bovis AF2122/97
ccgccggaucgccacg

SEQ ID NO: 3214244 - RNA, 22 nt, Mycobacterium bovis subsp bovis AF2122/97
ccgccggaucgccacgguggug

SEQ ID NO: 3214245 - RNA, 17 nt, Mycobacterium bovis subsp bovis AF2122/97
ccgccggauucgcccgg

SEQ ID NO: 3214246 - RNA, 19 nt, Mycobacterium bovis subsp bovis AF2122/97
ccgccggauucgcccgggc

SEQ ID NO: 3214247 - RNA, 23 nt, Mycobacterium bovis subsp bovis AF2122/97
ccgccggcaaaggacgucgaccu

SEQ ID NO: 3214248 - RNA, 23 nt, Mycobacterium bovis subsp bovis AF2122/97
ccgccggcaauaccgccagcgcc

SEQ ID NO: 3214249 - RNA, 13 nt, Mycobacterium bovis subsp bovis AF2122/97
ccgccggcaccgc

SEQ ID NO: 3214250 - RNA, 14 nt, Mycobacterium bovis subsp bovis AF2122/97
ccgccggcaccgcc

SEQ ID NO: 3214251 - RNA, 15 nt, Mycobacterium bovis subsp bovis AF2122/97
ccgccggcaccgccg

SEQ ID NO: 3214252 - RNA, 16 nt, Mycobacterium bovis subsp bovis AF2122/97
ccgccggcaccgccgc

SEQ ID NO: 3214253 - RNA, 19 nt, Mycobacterium bovis subsp bovis AF2122/97
ccgccggcaccgccgcccc

SEQ ID NO: 3214254 - RNA, 23 nt, Mycobacterium bovis subsp bovis AF2122/97
ccgccggcaccgccggcaccgcc

SEQ ID NO: 3214255 - RNA, 19 nt, Mycobacterium bovis subsp bovis AF2122/97
ccgccggcaccgccggugg

SEQ ID NO: 3214256 - RNA, 21 nt, Mycobacterium bovis subsp bovis AF2122/97
ccgccggcaccgccgguggcg

SEQ ID NO: 3214257 - RNA, 13 nt, Mycobacterium bovis subsp bovis AF2122/97
ccgccggcaccgu

SEQ ID NO: 3214258 - RNA, 21 nt, Mycobacterium bovis subsp bovis AF2122/97
ccgccggcagugagucgguga

SEQ ID NO: 3214259 - RNA, 12 nt, Mycobacterium bovis subsp bovis AF2122/97
ccgccggccagg

SEQ ID NO: 3214260 - RNA, 15 nt, Mycobacterium bovis subsp bovis AF2122/97
ccgccggccagguga

SEQ ID NO: 3214261 - RNA, 13 nt, Mycobacterium bovis subsp bovis AF2122/97
ccgccggccaguc

SEQ ID NO: 3214262 - RNA, 16 nt, Mycobacterium bovis subsp bovis AF2122/97
ccgccggccaguccgc

SEQ ID NO: 3214263 - RNA, 19 nt, Mycobacterium bovis subsp bovis AF2122/97
ccgccggccaguccgcgcg

SEQ ID NO: 3214264 - RNA, 14 nt, Mycobacterium bovis subsp bovis AF2122/97
ccgccggccccacc

SEQ ID NO: 3214265 - RNA, 19 nt, Mycobacterium bovis subsp bovis AF2122/97
ccgccggccccaccgguac

SEQ ID NO: 3214266 - RNA, 13 nt, Mycobacterium bovis subsp bovis AF2122/97
ccgccggccccgc

SEQ ID NO: 3214267 - RNA, 14 nt, Mycobacterium bovis subsp bovis AF2122/97
ccgccggccccgcc

SEQ ID NO: 3214268 - RNA, 18 nt, Mycobacterium bovis subsp bovis AF2122/97
ccgccggccccgccagcg

SEQ ID NO: 3214269 - RNA, 20 nt, Mycobacterium bovis subsp bovis AF2122/97
ccgccggccccgccagcgcc

SEQ ID NO: 3214270 - RNA, 21 nt, Mycobacterium bovis subsp bovis AF2122/97
ccgccggccccgccagcgccg

SEQ ID NO: 3214271 - RNA, 22 nt, Mycobacterium bovis subsp bovis AF2122/97
ccgccggccccgccagcgccgc

SEQ ID NO: 3214272 - RNA, 21 nt, Mycobacterium bovis subsp bovis AF2122/97
ccgccggccccgccgaugccg

SEQ ID NO: 3214273 - RNA, 16 nt, Mycobacterium bovis subsp bovis AF2122/97
ccgccggccccgccgc

SEQ ID NO: 3214274 - RNA, 19 nt, Mycobacterium bovis subsp bovis AF2122/97
ccgccggccccgccgcuac

SEQ ID NO: 3214275 - RNA, 20 nt, Mycobacterium bovis subsp bovis AF2122/97
ccgccggccccgccggcccc

SEQ ID NO: 3214276 - RNA, 22 nt, Mycobacterium bovis subsp bovis AF2122/97
ccgccggccccgccgucaccgc

SEQ ID NO: 3214277 - RNA, 22 nt, Mycobacterium bovis subsp bovis AF2122/97
ccgccggccccgccgucgccgc

SEQ ID NO: 3214278 - RNA, 20 nt, Mycobacterium bovis subsp bovis AF2122/97
ccgccggccccgccguuacc

SEQ ID NO: 3214279 - RNA, 12 nt, Mycobacterium bovis subsp bovis AF2122/97
ccgccggccgcc

SEQ ID NO: 3214280 - RNA, 14 nt, Mycobacterium bovis subsp bovis AF2122/97
ccgccggccgcgca

SEQ ID NO: 3214281 - RNA, 15 nt, Mycobacterium bovis subsp bovis AF2122/97
ccgccggccgcgcag

SEQ ID NO: 3214282 - RNA, 14 nt, Mycobacterium bovis subsp bovis AF2122/97
ccgccggccgcgcc

SEQ ID NO: 3214283 - RNA, 17 nt, Mycobacterium bovis subsp bovis AF2122/97
ccgccggccggaacgcc

SEQ ID NO: 3214284 - RNA, 22 nt, Mycobacterium bovis subsp bovis AF2122/97
ccgccggccggaacgcccggcu

SEQ ID NO: 3214285 - RNA, 24 nt, Mycobacterium bovis subsp bovis AF2122/97
ccgccggccggaacgcccggcuga

SEQ ID NO: 3214286 - RNA, 14 nt, Mycobacterium bovis subsp bovis AF2122/97
ccgccggccgucgg

SEQ ID NO: 3214287 - RNA, 13 nt, Mycobacterium bovis subsp bovis AF2122/97
ccgccggcgccac

SEQ ID NO: 3214288 - RNA, 15 nt, Mycobacterium bovis subsp bovis AF2122/97
ccgccggcgccaccc

SEQ ID NO: 3214289 - RNA, 16 nt, Mycobacterium bovis subsp bovis AF2122/97
ccgccggcgccaccgu

SEQ ID NO: 3214290 - RNA, 15 nt, Mycobacterium bovis subsp bovis AF2122/97
ccgccggcgccagcg

SEQ ID NO: 3214291 - RNA, 19 nt, Mycobacterium bovis subsp bovis AF2122/97
ccgccggcgccagcgccgc

SEQ ID NO: 3214292 - RNA, 13 nt, Mycobacterium bovis subsp bovis AF2122/97
ccgccggcgccgc

SEQ ID NO: 3214293 - RNA, 17 nt, Mycobacterium bovis subsp bovis AF2122/97
ccgccggcgccgcccgc

SEQ ID NO: 3214294 - RNA, 15 nt, Mycobacterium bovis subsp bovis AF2122/97
ccgccggcgccgccg

SEQ ID NO: 3214295 - RNA, 20 nt, Mycobacterium bovis subsp bovis AF2122/97
ccgccggcgccgccgaugcc

SEQ ID NO: 3214296 - RNA, 16 nt, Mycobacterium bovis subsp bovis AF2122/97
ccgccggcgccgccgg

SEQ ID NO: 3214297 - RNA, 22 nt, Mycobacterium bovis subsp bovis AF2122/97
ccgccggcgccgccggcgccgc

SEQ ID NO: 3214298 - RNA, 15 nt, Mycobacterium bovis subsp bovis AF2122/97
ccgccggcgccggag

SEQ ID NO: 3214299 - RNA, 14 nt, Mycobacterium bovis subsp bovis AF2122/97
ccgccggcgcgagc

SEQ ID NO: 3214300 - RNA, 21 nt, Mycobacterium bovis subsp bovis AF2122/97
ccgccggcgcugaucgcgaag

SEQ ID NO: 3214301 - RNA, 17 nt, Mycobacterium bovis subsp bovis AF2122/97
ccgccggcgcuggcggg

SEQ ID NO: 3214302 - RNA, 12 nt, Mycobacterium bovis subsp bovis AF2122/97
ccgccggcggcg

SEQ ID NO: 3214303 - RNA, 13 nt, Mycobacterium bovis subsp bovis AF2122/97
ccgccggcggucg

SEQ ID NO: 3214304 - RNA, 18 nt, Mycobacterium bovis subsp bovis AF2122/97
ccgccggcggucgcguac

SEQ ID NO: 3214305 - RNA, 23 nt, Mycobacterium bovis subsp bovis AF2122/97
ccgccggcuccgccacuggcgcc

SEQ ID NO: 3214306 - RNA, 15 nt, Mycobacterium bovis subsp bovis AF2122/97
ccgccggcuccggcg

SEQ ID NO: 3214307 - RNA, 21 nt, Mycobacterium bovis subsp bovis AF2122/97
ccgccggcuccggcggugccg

SEQ ID NO: 3214308 - RNA, 13 nt, Mycobacterium bovis subsp bovis AF2122/97
ccgccgucgccac

SEQ ID NO: 3214309 - RNA, 15 nt, Mycobacterium bovis subsp bovis AF2122/97
ccgccgucgccaccg

SEQ ID NO: 3214310 - RNA, 17 nt, Mycobacterium bovis subsp bovis AF2122/97
ccgccgucgccacgccc

SEQ ID NO: 3214311 - RNA, 13 nt, Mycobacterium bovis subsp bovis AF2122/97
ccgccgucgccgc

SEQ ID NO: 3214312 - RNA, 14 nt, Mycobacterium bovis subsp bovis AF2122/97
ccgccgucgccgcc

SEQ ID NO: 3214313 - RNA, 18 nt, Mycobacterium bovis subsp bovis AF2122/97
ccgccgucgccgccaaag

SEQ ID NO: 3214314 - RNA, 15 nt, Mycobacterium bovis subsp bovis AF2122/97
ccgccgucgccgccg

SEQ ID NO: 3214315 - RNA, 16 nt, Mycobacterium bovis subsp bovis AF2122/97
ccgccgucgccgccgc

SEQ ID NO: 3214316 - RNA, 17 nt, Mycobacterium bovis subsp bovis AF2122/97
ccgccgucgccgccguc

SEQ ID NO: 3214317 - RNA, 18 nt, Mycobacterium bovis subsp bovis AF2122/97
ccgccgucgccggugccg

SEQ ID NO: 3214318 - RNA, 16 nt, Mycobacterium bovis subsp bovis AF2122/97
ccgccgucggcgagca

SEQ ID NO: 3214319 - RNA, 23 nt, Mycobacterium bovis subsp bovis AF2122/97
ccgccgucggcgagcagacgccg

SEQ ID NO: 3214320 - RNA, 17 nt, Mycobacterium bovis subsp bovis AF2122/97
ccgccgucguacaccuc

SEQ ID NO: 3214321 - RNA, 19 nt, Mycobacterium bovis subsp bovis AF2122/97
ccgccgucguugcccgacc

SEQ ID NO: 3214322 - RNA, 21 nt, Mycobacterium bovis subsp bovis AF2122/97
ccgccgucguugcccgacccg

SEQ ID NO: 3214323 - RNA, 22 nt, Mycobacterium bovis subsp bovis AF2122/97
ccgccgucguugcccgacccgc

SEQ ID NO: 3214324 - RNA, 19 nt, Mycobacterium bovis subsp bovis AF2122/97
ccgccgucuuggcccgguc

SEQ ID NO: 3214325 - RNA, 13 nt, Mycobacterium bovis subsp bovis AF2122/97
ccgccgugccccc

SEQ ID NO: 3214326 - RNA, 14 nt, Mycobacterium bovis subsp bovis AF2122/97
ccgccgugcccccg

SEQ ID NO: 3214327 - RNA, 14 nt, Mycobacterium bovis subsp bovis AF2122/97
ccgccgugccgcgg

SEQ ID NO: 3214328 - RNA, 15 nt, Mycobacterium bovis subsp bovis AF2122/97
ccgccgugccgcggc

SEQ ID NO: 3214329 - RNA, 16 nt, Mycobacterium bovis subsp bovis AF2122/97
ccgccgugccgcggcg

SEQ ID NO: 3214330 - RNA, 17 nt, Mycobacterium bovis subsp bovis AF2122/97
ccgccgugccgcggcga

SEQ ID NO: 3214331 - RNA, 21 nt, Mycobacterium bovis subsp bovis AF2122/97
ccgccgugccgcggcgacggu

SEQ ID NO: 3214332 - RNA, 19 nt, Mycobacterium bovis subsp bovis AF2122/97
ccgccguggaacacgaagu

SEQ ID NO: 3214333 - RNA, 19 nt, Mycobacterium bovis subsp bovis AF2122/97
ccgccguggcgucggcguc

SEQ ID NO: 3214334 - RNA, 14 nt, Mycobacterium bovis subsp bovis AF2122/97
ccgccgugugcucu

SEQ ID NO: 3214335 - RNA, 17 nt, Mycobacterium bovis subsp bovis AF2122/97
ccgccguuaccgagccc

SEQ ID NO: 3214336 - RNA, 16 nt, Mycobacterium bovis subsp bovis AF2122/97
ccgccguuaccgccgc

SEQ ID NO: 3214337 - RNA, 17 nt, Mycobacterium bovis subsp bovis AF2122/97
ccgccguuaccgccgcu

SEQ ID NO: 3214338 - RNA, 21 nt, Mycobacterium bovis subsp bovis AF2122/97
ccgccguuaccgccgcugccg

SEQ ID NO: 3214339 - RNA, 16 nt, Mycobacterium bovis subsp bovis AF2122/97
ccgccguuaccgccgg

SEQ ID NO: 3214340 - RNA, 16 nt, Mycobacterium bovis subsp bovis AF2122/97
ccgccguuaccgccgu

SEQ ID NO: 3214341 - RNA, 21 nt, Mycobacterium bovis subsp bovis AF2122/97
ccgccguuaccgccguugccg

SEQ ID NO: 3214342 - RNA, 18 nt, Mycobacterium bovis subsp bovis AF2122/97
ccgccguuacggagggca

SEQ ID NO: 3214343 - RNA, 17 nt, Mycobacterium bovis subsp bovis AF2122/97
ccgccguucccaccacc

SEQ ID NO: 3214344 - RNA, 19 nt, Mycobacterium bovis subsp bovis AF2122/97
ccgccguucccaccaccac

SEQ ID NO: 3214345 - RNA, 21 nt, Mycobacterium bovis subsp bovis AF2122/97
ccgccguucccaccaccaccg

SEQ ID NO: 3214346 - RNA, 22 nt, Mycobacterium bovis subsp bovis AF2122/97
ccgccguucccaccaccaccgc

SEQ ID NO: 3214347 - RNA, 21 nt, Mycobacterium bovis subsp bovis AF2122/97
ccgccguucccacccacgccg

SEQ ID NO: 3214348 - RNA, 16 nt, Mycobacterium bovis subsp bovis AF2122/97
ccgccguucccgccgg

SEQ ID NO: 3214349 - RNA, 22 nt, Mycobacterium bovis subsp bovis AF2122/97
ccgccguugaacggcaccagcg

SEQ ID NO: 3214350 - RNA, 16 nt, Mycobacterium bovis subsp bovis AF2122/97
ccgccguugccaccgg

SEQ ID NO: 3214351 - RNA, 21 nt, Mycobacterium bovis subsp bovis AF2122/97
ccgccguugccaccggugccg

SEQ ID NO: 3214352 - RNA, 22 nt, Mycobacterium bovis subsp bovis AF2122/97
ccgccguugccauugccucccg

SEQ ID NO: 3214353 - RNA, 23 nt, Mycobacterium bovis subsp bovis AF2122/97
ccgccguugccgaucaccacggc

SEQ ID NO: 3214354 - RNA, 18 nt, Mycobacterium bovis subsp bovis AF2122/97
ccgccguugccgaucagc

SEQ ID NO: 3214355 - RNA, 14 nt, Mycobacterium bovis subsp bovis AF2122/97
ccgccguugccgcc

SEQ ID NO: 3214356 - RNA, 18 nt, Mycobacterium bovis subsp bovis AF2122/97
ccgccguugccgccgaag

SEQ ID NO: 3214357 - RNA, 16 nt, Mycobacterium bovis subsp bovis AF2122/97
ccgccguugccgccgg

SEQ ID NO: 3214358 - RNA, 20 nt, Mycobacterium bovis subsp bovis AF2122/97
ccgccguugccgccggcgcc

SEQ ID NO: 3214359 - RNA, 21 nt, Mycobacterium bovis subsp bovis AF2122/97
ccgccguugccgccggcgccg

SEQ ID NO: 3214360 - RNA, 22 nt, Mycobacterium bovis subsp bovis AF2122/97
ccgccguugccgccggcgccgc

SEQ ID NO: 3214361 - RNA, 17 nt, Mycobacterium bovis subsp bovis AF2122/97
ccgccguugccgccggu

SEQ ID NO: 3214362 - RNA, 19 nt, Mycobacterium bovis subsp bovis AF2122/97
ccgccguugccgccgucac

SEQ ID NO: 3214363 - RNA, 22 nt, Mycobacterium bovis subsp bovis AF2122/97
ccgccguugccgccgucaccgc

SEQ ID NO: 3214364 - RNA, 18 nt, Mycobacterium bovis subsp bovis AF2122/97
ccgccguugccgccgucg

SEQ ID NO: 3214365 - RNA, 21 nt, Mycobacterium bovis subsp bovis AF2122/97
ccgccguugccgccguuaccg

SEQ ID NO: 3214366 - RNA, 21 nt, Mycobacterium bovis subsp bovis AF2122/97
ccgccguugccgccguugccg

SEQ ID NO: 3214367 - RNA, 22 nt, Mycobacterium bovis subsp bovis AF2122/97
ccgccguugccgccguugccgc

SEQ ID NO: 3214368 - RNA, 16 nt, Mycobacterium bovis subsp bovis AF2122/97
ccgccguugccguaca

SEQ ID NO: 3214369 - RNA, 23 nt, Mycobacterium bovis subsp bovis AF2122/97
ccgccguugccguacagcccggc

SEQ ID NO: 3214370 - RNA, 15 nt, Mycobacterium bovis subsp bovis AF2122/97
ccgccguugccgucg

SEQ ID NO: 3214371 - RNA, 22 nt, Mycobacterium bovis subsp bovis AF2122/97
ccgccguugccguuggugccgc

SEQ ID NO: 3214372 - RNA, 22 nt, Mycobacterium bovis subsp bovis AF2122/97
ccgccguuggcucgagccgccc

SEQ ID NO: 3214373 - RNA, 20 nt, Mycobacterium bovis subsp bovis AF2122/97
ccgccguugucgaccuccuc

SEQ ID NO: 3214374 - RNA, 16 nt, Mycobacterium bovis subsp bovis AF2122/97
ccgccguuuccgccgc

SEQ ID NO: 3214375 - RNA, 17 nt, Mycobacterium bovis subsp bovis AF2122/97
ccgccguuuccgccgcc

SEQ ID NO: 3214376 - RNA, 18 nt, Mycobacterium bovis subsp bovis AF2122/97
ccgccguuuccgccgccg

SEQ ID NO: 3214377 - RNA, 18 nt, Mycobacterium bovis subsp bovis AF2122/97
ccgccuaaucggccugcc

SEQ ID NO: 3214378 - RNA, 13 nt, Mycobacterium bovis subsp bovis AF2122/97
ccgccuacgacgc

SEQ ID NO: 3214379 - RNA, 15 nt, Mycobacterium bovis subsp bovis AF2122/97
ccgccuacgacgcag

SEQ ID NO: 3214380 - RNA, 22 nt, Mycobacterium bovis subsp bovis AF2122/97
ccgccuaggaguuccucgaucg

SEQ ID NO: 3214381 - RNA, 21 nt, Mycobacterium bovis subsp bovis AF2122/97
ccgccucaaugaccaccgggc

SEQ ID NO: 3214382 - RNA, 14 nt, Mycobacterium bovis subsp bovis AF2122/97
ccgccuccaccgcc

SEQ ID NO: 3214383 - RNA, 16 nt, Mycobacterium bovis subsp bovis AF2122/97
ccgccuccaccgccgc

SEQ ID NO: 3214384 - RNA, 17 nt, Mycobacterium bovis subsp bovis AF2122/97
ccgccuccaccgccgcg

SEQ ID NO: 3214385 - RNA, 18 nt, Mycobacterium bovis subsp bovis AF2122/97
ccgccuccaccgccgcgc

SEQ ID NO: 3214386 - RNA, 19 nt, Mycobacterium bovis subsp bovis AF2122/97
ccgccuccgccgaggccgc

SEQ ID NO: 3214387 - RNA, 20 nt, Mycobacterium bovis subsp bovis AF2122/97
ccgccuccgccgaggccgcc

SEQ ID NO: 3214388 - RNA, 16 nt, Mycobacterium bovis subsp bovis AF2122/97
ccgccuccgccugccc

SEQ ID NO: 3214389 - RNA, 23 nt, Mycobacterium bovis subsp bovis AF2122/97
ccgccuccgccugccccacccgc

SEQ ID NO: 3214390 - RNA, 12 nt, Mycobacterium bovis subsp bovis AF2122/97
ccgccuccgcgg

SEQ ID NO: 3214391 - RNA, 15 nt, Mycobacterium bovis subsp bovis AF2122/97
ccgccucgaccgcca

SEQ ID NO: 3214392 - RNA, 16 nt, Mycobacterium bovis subsp bovis AF2122/97
ccgccucgaccgccag

SEQ ID NO: 3214393 - RNA, 17 nt, Mycobacterium bovis subsp bovis AF2122/97
ccgccucgaccgccagc

SEQ ID NO: 3214394 - RNA, 23 nt, Mycobacterium bovis subsp bovis AF2122/97
ccgcgaauucggcauaacccugg

SEQ ID NO: 3214395 - RNA, 22 nt, Mycobacterium bovis subsp bovis AF2122/97
ccgcgacaacaacucuucggcg

SEQ ID NO: 3214396 - RNA, 13 nt, Mycobacterium bovis subsp bovis AF2122/97
ccgcgacaccccg

SEQ ID NO: 3214397 - RNA, 15 nt, Mycobacterium bovis subsp bovis AF2122/97
ccgcgacauccgcgg

SEQ ID NO: 3214398 - RNA, 20 nt, Mycobacterium bovis subsp bovis AF2122/97
ccgcgacauccgcggcaugc

SEQ ID NO: 3214399 - RNA, 18 nt, Mycobacterium bovis subsp bovis AF2122/97
ccgcgaccaaaccgcugu

SEQ ID NO: 3214400 - RNA, 17 nt, Mycobacterium bovis subsp bovis AF2122/97
ccgcgaccacgcaccgc

SEQ ID NO: 3214401 - RNA, 19 nt, Mycobacterium bovis subsp bovis AF2122/97
ccgcgaccacgcaccgccc

SEQ ID NO: 3214402 - RNA, 20 nt, Mycobacterium bovis subsp bovis AF2122/97
ccgcgaccacgcaccgcccc

SEQ ID NO: 3214403 - RNA, 13 nt, Mycobacterium bovis subsp bovis AF2122/97
ccgcgaccagcgc

SEQ ID NO: 3214404 - RNA, 14 nt, Mycobacterium bovis subsp bovis AF2122/97
ccgcgaccagcgcc

SEQ ID NO: 3214405 - RNA, 13 nt, Mycobacterium bovis subsp bovis AF2122/97
ccgcgaccaucgc

SEQ ID NO: 3214406 - RNA, 12 nt, Mycobacterium bovis subsp bovis AF2122/97
ccgcgacccggc

SEQ ID NO: 3214407 - RNA, 21 nt, Mycobacterium bovis subsp bovis AF2122/97
ccgcgacccggcccagcgccc

SEQ ID NO: 3214408 - RNA, 22 nt, Mycobacterium bovis subsp bovis AF2122/97
ccgcgaccgcauugagcuggcg

SEQ ID NO: 3214409 - RNA, 17 nt, Mycobacterium bovis subsp bovis AF2122/97
ccgcgaccgccucgccg

SEQ ID NO: 3214410 - RNA, 19 nt, Mycobacterium bovis subsp bovis AF2122/97
ccgcgaccgcgaccgcauu

SEQ ID NO: 3214411 - RNA, 14 nt, Mycobacterium bovis subsp bovis AF2122/97
ccgcgaccgcgcac

SEQ ID NO: 3214412 - RNA, 17 nt, Mycobacterium bovis subsp bovis AF2122/97
ccgcgaccgcgcacggc

SEQ ID NO: 3214413 - RNA, 17 nt, Mycobacterium bovis subsp bovis AF2122/97
ccgcgaccucgcggcgc

SEQ ID NO: 3214414 - RNA, 18 nt, Mycobacterium bovis subsp bovis AF2122/97
ccgcgaccucgcggcgcu

SEQ ID NO: 3214415 - RNA, 13 nt, Mycobacterium bovis subsp bovis AF2122/97
ccgcgacgacacg

SEQ ID NO: 3214416 - RNA, 15 nt, Mycobacterium bovis subsp bovis AF2122/97
ccgcgacgacgaggu

SEQ ID NO: 3214417 - RNA, 16 nt, Mycobacterium bovis subsp bovis AF2122/97
ccgcgacgagcggccg

SEQ ID NO: 3214418 - RNA, 13 nt, Mycobacterium bovis subsp bovis AF2122/97
ccgcgacgcucgc

SEQ ID NO: 3214419 - RNA, 18 nt, Mycobacterium bovis subsp bovis AF2122/97
ccgcgacgcucgcugcag

SEQ ID NO: 3214420 - RNA, 14 nt, Mycobacterium bovis subsp bovis AF2122/97
ccgcgacggaacca

SEQ ID NO: 3214421 - RNA, 18 nt, Mycobacterium bovis subsp bovis AF2122/97
ccgcgacggcaggcucgg

SEQ ID NO: 3214422 - RNA, 13 nt, Mycobacterium bovis subsp bovis AF2122/97
ccgcgacggccuu

SEQ ID NO: 3214423 - RNA, 15 nt, Mycobacterium bovis subsp bovis AF2122/97
ccgcgacggcgcccu

SEQ ID NO: 3214424 - RNA, 14 nt, Mycobacterium bovis subsp bovis AF2122/97
ccgcgacggcgccg

SEQ ID NO: 3214425 - RNA, 13 nt, Mycobacterium bovis subsp bovis AF2122/97
ccgcgacggcggc

SEQ ID NO: 3214426 - RNA, 14 nt, Mycobacterium bovis subsp bovis AF2122/97
ccgcgacggcggcu

SEQ ID NO: 3214427 - RNA, 18 nt, Mycobacterium bovis subsp bovis AF2122/97
ccgcgacggcggcucccg

SEQ ID NO: 3214428 - RNA, 21 nt, Mycobacterium bovis subsp bovis AF2122/97
ccgcgacgggcacccgagccg

SEQ ID NO: 3214429 - RNA, 21 nt, Mycobacterium bovis subsp bovis AF2122/97
ccgcgacguugaacucgaguu

SEQ ID NO: 3214430 - RNA, 15 nt, Mycobacterium bovis subsp bovis AF2122/97
ccgcgacugcaccug

SEQ ID NO: 3214431 - RNA, 23 nt, Mycobacterium bovis subsp bovis AF2122/97
ccgcgacugcaccuggccgcccg

SEQ ID NO: 3214432 - RNA, 22 nt, Mycobacterium bovis subsp bovis AF2122/97
ccgcgacuuccuguacaaccug

SEQ ID NO: 3214433 - RNA, 15 nt, Mycobacterium bovis subsp bovis AF2122/97
ccgcgacuuugccuu

SEQ ID NO: 3214434 - RNA, 18 nt, Mycobacterium bovis subsp bovis AF2122/97
ccgcgagaucgggccggc

SEQ ID NO: 3214435 - RNA, 14 nt, Mycobacterium bovis subsp bovis AF2122/97
ccgcgagcccggcc

SEQ ID NO: 3214436 - RNA, 17 nt, Mycobacterium bovis subsp bovis AF2122/97
ccgcgagccggugaucc

SEQ ID NO: 3214437 - RNA, 21 nt, Mycobacterium bovis subsp bovis AF2122/97
ccgcgagggggguguugaggc

SEQ ID NO: 3214438 - RNA, 17 nt, Mycobacterium bovis subsp bovis AF2122/97
ccgcgagguugaccacc

SEQ ID NO: 3214439 - RNA, 21 nt, Mycobacterium bovis subsp bovis AF2122/97
ccgcgagguugaccaccagcg

SEQ ID NO: 3214440 - RNA, 13 nt, Mycobacterium bovis subsp bovis AF2122/97
ccgcgaucaccac

SEQ ID NO: 3214441 - RNA, 15 nt, Mycobacterium bovis subsp bovis AF2122/97
ccgcgaucaccaccg

SEQ ID NO: 3214442 - RNA, 20 nt, Mycobacterium bovis subsp bovis AF2122/97
ccgcgauccagcgcugaccg

SEQ ID NO: 3214443 - RNA, 13 nt, Mycobacterium bovis subsp bovis AF2122/97
ccgcgauccccac

SEQ ID NO: 3214444 - RNA, 14 nt, Mycobacterium bovis subsp bovis AF2122/97
ccgcgaucccggcc

SEQ ID NO: 3214445 - RNA, 16 nt, Mycobacterium bovis subsp bovis AF2122/97
ccgcgaucgacggugu

SEQ ID NO: 3214446 - RNA, 16 nt, Mycobacterium bovis subsp bovis AF2122/97
ccgcgaucgccgacgc

SEQ ID NO: 3214447 - RNA, 15 nt, Mycobacterium bovis subsp bovis AF2122/97
ccgcgaucgcgacac

SEQ ID NO: 3214448 - RNA, 16 nt, Mycobacterium bovis subsp bovis AF2122/97
ccgcgaucgcgacacg

SEQ ID NO: 3214449 - RNA, 19 nt, Mycobacterium bovis subsp bovis AF2122/97
ccgcgaucgcgacacggcc

SEQ ID NO: 3214450 - RNA, 17 nt, Mycobacterium bovis subsp bovis AF2122/97
ccgcgaucgcggcaucg

SEQ ID NO: 3214451 - RNA, 17 nt, Mycobacterium bovis subsp bovis AF2122/97
ccgcgaucgggccgauc

SEQ ID NO: 3214452 - RNA, 14 nt, Mycobacterium bovis subsp bovis AF2122/97
ccgcgaugacgacc

SEQ ID NO: 3214453 - RNA, 21 nt, Mycobacterium bovis subsp bovis AF2122/97
ccgcgaugauaccugcccacg

SEQ ID NO: 3214454 - RNA, 20 nt, Mycobacterium bovis subsp bovis AF2122/97
ccgcgaugaucgcaucgacg

SEQ ID NO: 3214455 - RNA, 18 nt, Mycobacterium bovis subsp bovis AF2122/97
ccgcgaugauggcgguac

SEQ ID NO: 3214456 - RNA, 14 nt, Mycobacterium bovis subsp bovis AF2122/97
ccgcgaugcgcacc

SEQ ID NO: 3214457 - RNA, 17 nt, Mycobacterium bovis subsp bovis AF2122/97
ccgcgauggccgcgugc

SEQ ID NO: 3214458 - RNA, 20 nt, Mycobacterium bovis subsp bovis AF2122/97
ccgcgauggccgcgugcagc

SEQ ID NO: 3214459 - RNA, 20 nt, Mycobacterium bovis subsp bovis AF2122/97
ccgcgauggugcgcccgccg

SEQ ID NO: 3214460 - RNA, 21 nt, Mycobacterium bovis subsp bovis AF2122/97
ccgcgauggugcgccgggcgu

SEQ ID NO: 3214461 - RNA, 14 nt, Mycobacterium bovis subsp bovis AF2122/97
ccgcgaugugccca

SEQ ID NO: 3214462 - RNA, 20 nt, Mycobacterium bovis subsp bovis AF2122/97
ccgcgaugugggcuaacgac

SEQ ID NO: 3214463 - RNA, 21 nt, Mycobacterium bovis subsp bovis AF2122/97
ccgcgauuagcaaaccgaccg

SEQ ID NO: 3214464 - RNA, 12 nt, Mycobacterium bovis subsp bovis AF2122/97
ccgcgauucgcg

SEQ ID NO: 3214465 - RNA, 19 nt, Mycobacterium bovis subsp bovis AF2122/97
ccgcgauucgcggcagccg

SEQ ID NO: 3214466 - RNA, 15 nt, Mycobacterium bovis subsp bovis AF2122/97
ccgcgcaacccggac

SEQ ID NO: 3214467 - RNA, 22 nt, Mycobacterium bovis subsp bovis AF2122/97
ccgcgcaacuaucgcaccuccg

SEQ ID NO: 3214468 - RNA, 20 nt, Mycobacterium bovis subsp bovis AF2122/97
ccgcgcaccaacaccagcgc

SEQ ID NO: 3214469 - RNA, 21 nt, Mycobacterium bovis subsp bovis AF2122/97
ccgcgcacccguccgccgcag

SEQ ID NO: 3214470 - RNA, 14 nt, Mycobacterium bovis subsp bovis AF2122/97
ccgcgcaccgaccg

SEQ ID NO: 3214471 - RNA, 15 nt, Mycobacterium bovis subsp bovis AF2122/97
ccgcgcaccgaccgc

SEQ ID NO: 3214472 - RNA, 12 nt, Mycobacterium bovis subsp bovis AF2122/97
ccgcgcacggcg

SEQ ID NO: 3214473 - RNA, 13 nt, Mycobacterium bovis subsp bovis AF2122/97
ccgcgcacggcug

SEQ ID NO: 3214474 - RNA, 17 nt, Mycobacterium bovis subsp bovis AF2122/97
ccgcgcagauucccggc

SEQ ID NO: 3214475 - RNA, 20 nt, Mycobacterium bovis subsp bovis AF2122/97
ccgcgcagcacugcggcagc

SEQ ID NO: 3214476 - RNA, 15 nt, Mycobacterium bovis subsp bovis AF2122/97
ccgcgcagccaggga

SEQ ID NO: 3214477 - RNA, 14 nt, Mycobacterium bovis subsp bovis AF2122/97
ccgcgcagccggcc

SEQ ID NO: 3214478 - RNA, 18 nt, Mycobacterium bovis subsp bovis AF2122/97
ccgcgcagccggcccguc

SEQ ID NO: 3214479 - RNA, 16 nt, Mycobacterium bovis subsp bovis AF2122/97
ccgcgcagcgcggcgg

SEQ ID NO: 3214480 - RNA, 16 nt, Mycobacterium bovis subsp bovis AF2122/97
ccgcgcagcgguccgc

SEQ ID NO: 3214481 - RNA, 15 nt, Mycobacterium bovis subsp bovis AF2122/97
ccgcgcgacaggccc

SEQ ID NO: 3214482 - RNA, 17 nt, Mycobacterium bovis subsp bovis AF2122/97
ccgcgcgagagccucca

SEQ ID NO: 3214483 - RNA, 12 nt, Mycobacterium bovis subsp bovis AF2122/97
ccgcgcgagccg

SEQ ID NO: 3214484 - RNA, 16 nt, Mycobacterium bovis subsp bovis AF2122/97
ccgcgcgagccucgcg

SEQ ID NO: 3214485 - RNA, 20 nt, Mycobacterium bovis subsp bovis AF2122/97
ccgcgcgagccucgcgcgug

SEQ ID NO: 3214486 - RNA, 22 nt, Mycobacterium bovis subsp bovis AF2122/97
ccgcgcgagccucgcgcgugug

SEQ ID NO: 3214487 - RNA, 19 nt, Mycobacterium bovis subsp bovis AF2122/97
ccgcgcgaugcuggcgaac

SEQ ID NO: 3214488 - RNA, 14 nt, Mycobacterium bovis subsp bovis AF2122/97
ccgcgcgcaagcca

SEQ ID NO: 3214489 - RNA, 13 nt, Mycobacterium bovis subsp bovis AF2122/97
ccgcgcgcaccgg

SEQ ID NO: 3214490 - RNA, 20 nt, Mycobacterium bovis subsp bovis AF2122/97
ccgcgcgcacggcgucggcc

SEQ ID NO: 3214491 - RNA, 20 nt, Mycobacterium bovis subsp bovis AF2122/97
ccgcgcgcacuugcguggcg

SEQ ID NO: 3214492 - RNA, 23 nt, Mycobacterium bovis subsp bovis AF2122/97
ccgcgcgcauauccgcaggcccg

SEQ ID NO: 3214493 - RNA, 21 nt, Mycobacterium bovis subsp bovis AF2122/97
ccgcgcgcaucgcgccuuuga

SEQ ID NO: 3214494 - RNA, 15 nt, Mycobacterium bovis subsp bovis AF2122/97
ccgcgcgccagcucg

SEQ ID NO: 3214495 - RNA, 16 nt, Mycobacterium bovis subsp bovis AF2122/97
ccgcgcgccagcucgg

SEQ ID NO: 3214496 - RNA, 17 nt, Mycobacterium bovis subsp bovis AF2122/97
ccgcgcgccagcucggc

SEQ ID NO: 3214497 - RNA, 15 nt, Mycobacterium bovis subsp bovis AF2122/97
ccgcgcgccggccau

SEQ ID NO: 3214498 - RNA, 14 nt, Mycobacterium bovis subsp bovis AF2122/97
ccgcgcgccggcga

SEQ ID NO: 3214499 - RNA, 19 nt, Mycobacterium bovis subsp bovis AF2122/97
ccgcgcgccggcgacccgg

SEQ ID NO: 3214500 - RNA, 13 nt, Mycobacterium bovis subsp bovis AF2122/97
ccgcgcgcgccgc

SEQ ID NO: 3214501 - RNA, 22 nt, Mycobacterium bovis subsp bovis AF2122/97
ccgcgcgcgccgcauccagccg

SEQ ID NO: 3214502 - RNA, 14 nt, Mycobacterium bovis subsp bovis AF2122/97
ccgcgcgcggcgua

SEQ ID NO: 3214503 - RNA, 19 nt, Mycobacterium bovis subsp bovis AF2122/97
ccgcgcgcuccagaugggg

SEQ ID NO: 3214504 - RNA, 13 nt, Mycobacterium bovis subsp bovis AF2122/97
ccgcgcgcugccg

SEQ ID NO: 3214505 - RNA, 20 nt, Mycobacterium bovis subsp bovis AF2122/97
ccgcgcgcuggaccugauga

SEQ ID NO: 3214506 - RNA, 12 nt, Mycobacterium bovis subsp bovis AF2122/97
ccgcgcggcagg

SEQ ID NO: 3214507 - RNA, 15 nt, Mycobacterium bovis subsp bovis AF2122/97
ccgcgcggcgacagc

SEQ ID NO: 3214508 - RNA, 12 nt, Mycobacterium bovis subsp bovis AF2122/97
ccgcgcggcgag

SEQ ID NO: 3214509 - RNA, 18 nt, Mycobacterium bovis subsp bovis AF2122/97
ccgcgcggcgagagccuc

SEQ ID NO: 3214510 - RNA, 19 nt, Mycobacterium bovis subsp bovis AF2122/97
ccgcgcggcgagagccucg

SEQ ID NO: 3214511 - RNA, 21 nt, Mycobacterium bovis subsp bovis AF2122/97
ccgcgcggcgagagccucggc

SEQ ID NO: 3214512 - RNA, 14 nt, Mycobacterium bovis subsp bovis AF2122/97
ccgcgcggcgcagc

SEQ ID NO: 3214513 - RNA, 17 nt, Mycobacterium bovis subsp bovis AF2122/97
ccgcgcggcgcagcacc

SEQ ID NO: 3214514 - RNA, 13 nt, Mycobacterium bovis subsp bovis AF2122/97
ccgcgcggcgcau

SEQ ID NO: 3214515 - RNA, 19 nt, Mycobacterium bovis subsp bovis AF2122/97
ccgcgcggcgcauuccggc

SEQ ID NO: 3214516 - RNA, 22 nt, Mycobacterium bovis subsp bovis AF2122/97
ccgcgcggcgcauuccggcgcc

SEQ ID NO: 3214517 - RNA, 14 nt, Mycobacterium bovis subsp bovis AF2122/97
ccgcgcggcggcgc

SEQ ID NO: 3214518 - RNA, 16 nt, Mycobacterium bovis subsp bovis AF2122/97
ccgcgcgggccgccgc

SEQ ID NO: 3214519 - RNA, 15 nt, Mycobacterium bovis subsp bovis AF2122/97
ccgcgcgggcggauc

SEQ ID NO: 3214520 - RNA, 18 nt, Mycobacterium bovis subsp bovis AF2122/97
ccgcgcgguacugcgcag

SEQ ID NO: 3214521 - RNA, 19 nt, Mycobacterium bovis subsp bovis AF2122/97
ccgcgcgguacugcgcagc

SEQ ID NO: 3214522 - RNA, 14 nt, Mycobacterium bovis subsp bovis AF2122/97
ccgcgcggugcccu

SEQ ID NO: 3214523 - RNA, 18 nt, Mycobacterium bovis subsp bovis AF2122/97
ccgcgcggugcccugccg

SEQ ID NO: 3214524 - RNA, 20 nt, Mycobacterium bovis subsp bovis AF2122/97
ccgcgcggugcccugccggc

SEQ ID NO: 3214525 - RNA, 22 nt, Mycobacterium bovis subsp bovis AF2122/97
ccgcgcggugcccugccggcag

SEQ ID NO: 3214526 - RNA, 13 nt, Mycobacterium bovis subsp bovis AF2122/97
ccgcgcgguggcg

SEQ ID NO: 3214527 - RNA, 19 nt, Mycobacterium bovis subsp bovis AF2122/97
ccgcgcgguggcggucgcc

SEQ ID NO: 3214528 - RNA, 23 nt, Mycobacterium bovis subsp bovis AF2122/97
ccgcgcguacccgaucagcgacg

SEQ ID NO: 3214529 - RNA, 11 nt, Mycobacterium bovis subsp bovis AF2122/97
ccgcgcgucgc

SEQ ID NO: 3214530 - RNA, 13 nt, Mycobacterium bovis subsp bovis AF2122/97
ccgcgcgucgccc

SEQ ID NO: 3214531 - RNA, 22 nt, Mycobacterium bovis subsp bovis AF2122/97
ccgcgcuacgucaagccgugcu

SEQ ID NO: 3214532 - RNA, 23 nt, Mycobacterium bovis subsp bovis AF2122/97
ccgcgcuacgucaagccgugcug

SEQ ID NO: 3214533 - RNA, 18 nt, Mycobacterium bovis subsp bovis AF2122/97
ccgcgcucaccggggccg

SEQ ID NO: 3214534 - RNA, 20 nt, Mycobacterium bovis subsp bovis AF2122/97
ccgcgcucaccggggccguc

SEQ ID NO: 3214535 - RNA, 21 nt, Mycobacterium bovis subsp bovis AF2122/97
ccgcgcucaccggggccgucg

SEQ ID NO: 3214536 - RNA, 18 nt, Mycobacterium bovis subsp bovis AF2122/97
ccgcgcucaucgcggcga

SEQ ID NO: 3214537 - RNA, 17 nt, Mycobacterium bovis subsp bovis AF2122/97
ccgcgcucaucugcgcg

SEQ ID NO: 3214538 - RNA, 18 nt, Mycobacterium bovis subsp bovis AF2122/97
ccgcgcucaucugcgcgc

SEQ ID NO: 3214539 - RNA, 23 nt, Mycobacterium bovis subsp bovis AF2122/97
ccgcgcucaucugcgcgcggaag

SEQ ID NO: 3214540 - RNA, 17 nt, Mycobacterium bovis subsp bovis AF2122/97
ccgcgcucgacgagcac

SEQ ID NO: 3214541 - RNA, 20 nt, Mycobacterium bovis subsp bovis AF2122/97
ccgcgcucgacgagcacgcc

SEQ ID NO: 3214542 - RNA, 18 nt, Mycobacterium bovis subsp bovis AF2122/97
ccgcgcucgcacccgcuc

SEQ ID NO: 3214543 - RNA, 23 nt, Mycobacterium bovis subsp bovis AF2122/97
ccgcgcucgcacccgcucggcgc

SEQ ID NO: 3214544 - RNA, 17 nt, Mycobacterium bovis subsp bovis AF2122/97
ccgcgcucgccgauauc

SEQ ID NO: 3214545 - RNA, 14 nt, Mycobacterium bovis subsp bovis AF2122/97
ccgcgcugagcacg

SEQ ID NO: 3214546 - RNA, 20 nt, Mycobacterium bovis subsp bovis AF2122/97
ccgcgcugccgacuccucgu

SEQ ID NO: 3214547 - RNA, 14 nt, Mycobacterium bovis subsp bovis AF2122/97
ccgcgcugcgacgu

SEQ ID NO: 3214548 - RNA, 15 nt, Mycobacterium bovis subsp bovis AF2122/97
ccgcgcuggucagcc

SEQ ID NO: 3214549 - RNA, 16 nt, Mycobacterium bovis subsp bovis AF2122/97
ccgcgcuggucagccg

SEQ ID NO: 3214550 - RNA, 21 nt, Mycobacterium bovis subsp bovis AF2122/97
ccgcgcuggucagccgugccg

SEQ ID NO: 3214551 - RNA, 23 nt, Mycobacterium bovis subsp bovis AF2122/97
ccgcgcuggucagccgugccgug

SEQ ID NO: 3214552 - RNA, 22 nt, Mycobacterium bovis subsp bovis AF2122/97
ccgcgcuggucggagaccagcg

SEQ ID NO: 3214553 - RNA, 18 nt, Mycobacterium bovis subsp bovis AF2122/97
ccgcgcuggugauucgca

SEQ ID NO: 3214554 - RNA, 24 nt, Mycobacterium bovis subsp bovis AF2122/97
ccgcgcuguugccaucgacgccgc

SEQ ID NO: 3214555 - RNA, 22 nt, Mycobacterium bovis subsp bovis AF2122/97
ccgcgcuucacagccaccagcc

SEQ ID NO: 3214556 - RNA, 21 nt, Mycobacterium bovis subsp bovis AF2122/97
ccgcgcuugauccacccgacg

SEQ ID NO: 3214557 - RNA, 20 nt, Mycobacterium bovis subsp bovis AF2122/97
ccgcgcuugcgaucgccgcu

SEQ ID NO: 3214558 - RNA, 19 nt, Mycobacterium bovis subsp bovis AF2122/97
ccgcgcuugcgaucggcac

SEQ ID NO: 3214559 - RNA, 18 nt, Mycobacterium bovis subsp bovis AF2122/97
ccgcgcuuucgagugcag

SEQ ID NO: 3214560 - RNA, 22 nt, Mycobacterium bovis subsp bovis AF2122/97
ccgcgcuuucgagugcagcggc

SEQ ID NO: 3214561 - RNA, 15 nt, Mycobacterium bovis subsp bovis AF2122/97
ccgcggaacccagca

SEQ ID NO: 3214562 - RNA, 16 nt, Mycobacterium bovis subsp bovis AF2122/97
ccgcggaacccagcac

SEQ ID NO: 3214563 - RNA, 18 nt, Mycobacterium bovis subsp bovis AF2122/97
ccgcggacccgcagcugc

SEQ ID NO: 3214564 - RNA, 13 nt, Mycobacterium bovis subsp bovis AF2122/97
ccgcggaccgcga

SEQ ID NO: 3214565 - RNA, 15 nt, Mycobacterium bovis subsp bovis AF2122/97
ccgcggacgugccgg

SEQ ID NO: 3214566 - RNA, 19 nt, Mycobacterium bovis subsp bovis AF2122/97
ccgcggacguggucggagc

SEQ ID NO: 3214567 - RNA, 16 nt, Mycobacterium bovis subsp bovis AF2122/97
ccgcggcgucgugaga

SEQ ID NO: 3214568 - RNA, 19 nt, Mycobacterium bovis subsp bovis AF2122/97
ccgcggcuacaucggcggc

SEQ ID NO: 3214569 - RNA, 19 nt, Mycobacterium bovis subsp bovis AF2122/97
ccgcggcuaggccaagccg

SEQ ID NO: 3214570 - RNA, 23 nt, Mycobacterium bovis subsp bovis AF2122/97
ccgcggcuaggccagcacggcga

SEQ ID NO: 3214571 - RNA, 17 nt, Mycobacterium bovis subsp bovis AF2122/97
ccgcggcugccaucccg

SEQ ID NO: 3214572 - RNA, 20 nt, Mycobacterium bovis subsp bovis AF2122/97
ccgcggcugcuccgucgccg

SEQ ID NO: 3214573 - RNA, 15 nt, Mycobacterium bovis subsp bovis AF2122/97
ccgcggcugucacgc

SEQ ID NO: 3214574 - RNA, 18 nt, Mycobacterium bovis subsp bovis AF2122/97
ccgcgggaaguucgccgg

SEQ ID NO: 3214575 - RNA, 18 nt, Mycobacterium bovis subsp bovis AF2122/97
ccgcgggacaccaccgcc

SEQ ID NO: 3214576 - RNA, 20 nt, Mycobacterium bovis subsp bovis AF2122/97
ccgcgggacaccaccgcccg

SEQ ID NO: 3214577 - RNA, 21 nt, Mycobacterium bovis subsp bovis AF2122/97
ccgcgggacaccaccgcccgc

SEQ ID NO: 3214578 - RNA, 20 nt, Mycobacterium bovis subsp bovis AF2122/97
ccgcgggaccuucgagccgc

SEQ ID NO: 3214579 - RNA, 21 nt, Mycobacterium bovis subsp bovis AF2122/97
ccgcgggaucgguggcggcac

SEQ ID NO: 3214580 - RNA, 20 nt, Mycobacterium bovis subsp bovis AF2122/97
ccgcgggcagcguguaaccg

SEQ ID NO: 3214581 - RNA, 13 nt, Mycobacterium bovis subsp bovis AF2122/97
ccgcgggcaguag

SEQ ID NO: 3214582 - RNA, 18 nt, Mycobacterium bovis subsp bovis AF2122/97
ccgcgggcaguggcagcc

SEQ ID NO: 3214583 - RNA, 13 nt, Mycobacterium bovis subsp bovis AF2122/97
ccgcgggccagca

SEQ ID NO: 3214584 - RNA, 15 nt, Mycobacterium bovis subsp bovis AF2122/97
ccgcgggccagcacc

SEQ ID NO: 3214585 - RNA, 12 nt, Mycobacterium bovis subsp bovis AF2122/97
ccgcgggccgcg

SEQ ID NO: 3214586 - RNA, 14 nt, Mycobacterium bovis subsp bovis AF2122/97
ccgcgggccgcgcg

SEQ ID NO: 3214587 - RNA, 21 nt, Mycobacterium bovis subsp bovis AF2122/97
ccgcgggcgccuuccaggcgg

SEQ ID NO: 3214588 - RNA, 14 nt, Mycobacterium bovis subsp bovis AF2122/97
ccgcgggcggcauc

SEQ ID NO: 3214589 - RNA, 19 nt, Mycobacterium bovis subsp bovis AF2122/97
ccgcgggcggcaucgccga

SEQ ID NO: 3214590 - RNA, 16 nt, Mycobacterium bovis subsp bovis AF2122/97
ccgcgggcuccccggc

SEQ ID NO: 3214591 - RNA, 14 nt, Mycobacterium bovis subsp bovis AF2122/97
ccgcgggcugacca

SEQ ID NO: 3214592 - RNA, 19 nt, Mycobacterium bovis subsp bovis AF2122/97
ccgcggggcaucggugcgg

SEQ ID NO: 3214593 - RNA, 17 nt, Mycobacterium bovis subsp bovis AF2122/97
ccgcgggggaccgcccg

SEQ ID NO: 3214594 - RNA, 18 nt, Mycobacterium bovis subsp bovis AF2122/97
ccgcgggggaccgcccga

SEQ ID NO: 3214595 - RNA, 15 nt, Mycobacterium bovis subsp bovis AF2122/97
ccgcgggggcggccg

SEQ ID NO: 3214596 - RNA, 17 nt, Mycobacterium bovis subsp bovis AF2122/97
ccgcgggguaguucguu

SEQ ID NO: 3214597 - RNA, 12 nt, Mycobacterium bovis subsp bovis AF2122/97
ccgcgggucccg

SEQ ID NO: 3214598 - RNA, 20 nt, Mycobacterium bovis subsp bovis AF2122/97
ccgcgggucguccggcggca

SEQ ID NO: 3214599 - RNA, 19 nt, Mycobacterium bovis subsp bovis AF2122/97
ccgcgggucgugccagcag

SEQ ID NO: 3214600 - RNA, 18 nt, Mycobacterium bovis subsp bovis AF2122/97
ccgcgggugcggcauggc

SEQ ID NO: 3214601 - RNA, 21 nt, Mycobacterium bovis subsp bovis AF2122/97
ccgcggguuugaucuccaccu

SEQ ID NO: 3214602 - RNA, 18 nt, Mycobacterium bovis subsp bovis AF2122/97
ccgcgguaauggcgugca

SEQ ID NO: 3214603 - RNA, 19 nt, Mycobacterium bovis subsp bovis AF2122/97
ccgcgguacccaccucccg

SEQ ID NO: 3214604 - RNA, 15 nt, Mycobacterium bovis subsp bovis AF2122/97
ccgcgguagacggca

SEQ ID NO: 3214605 - RNA, 17 nt, Mycobacterium bovis subsp bovis AF2122/97
ccgcgguagccgaccga

SEQ ID NO: 3214606 - RNA, 17 nt, Mycobacterium bovis subsp bovis AF2122/97
ccgcgguaggugcaugu

SEQ ID NO: 3214607 - RNA, 14 nt, Mycobacterium bovis subsp bovis AF2122/97
ccgcggucagaucc

SEQ ID NO: 3214608 - RNA, 17 nt, Mycobacterium bovis subsp bovis AF2122/97
ccgcggucauggcgacg

SEQ ID NO: 3214609 - RNA, 14 nt, Mycobacterium bovis subsp bovis AF2122/97
ccgcgguccuggug

SEQ ID NO: 3214610 - RNA, 23 nt, Mycobacterium bovis subsp bovis AF2122/97
ccgcggucgaucaggccguguac

SEQ ID NO: 3214611 - RNA, 12 nt, Mycobacterium bovis subsp bovis AF2122/97
ccgcggucgcca

SEQ ID NO: 3214612 - RNA, 22 nt, Mycobacterium bovis subsp bovis AF2122/97
ccgcggucgccaagaucgggug

SEQ ID NO: 3214613 - RNA, 14 nt, Mycobacterium bovis subsp bovis AF2122/97
ccgcggucggacca

SEQ ID NO: 3214614 - RNA, 12 nt, Mycobacterium bovis subsp bovis AF2122/97
ccgcggucggcc

SEQ ID NO: 3214615 - RNA, 14 nt, Mycobacterium bovis subsp bovis AF2122/97
ccgcggucggccac

SEQ ID NO: 3214616 - RNA, 19 nt, Mycobacterium bovis subsp bovis AF2122/97
ccgcggucggccaccaacu

SEQ ID NO: 3214617 - RNA, 19 nt, Mycobacterium bovis subsp bovis AF2122/97
ccgcggucggcgacguaga

SEQ ID NO: 3214618 - RNA, 13 nt, Mycobacterium bovis subsp bovis AF2122/97
ccgcggucggcgu

SEQ ID NO: 3214619 - RNA, 13 nt, Mycobacterium bovis subsp bovis AF2122/97
ccgcggucugcgc

SEQ ID NO: 3214620 - RNA, 21 nt, Mycobacterium bovis subsp bovis AF2122/97
ccgcggucugcgccuucgcca

SEQ ID NO: 3214621 - RNA, 15 nt, Mycobacterium bovis subsp bovis AF2122/97
ccgcggucugcgcgu

SEQ ID NO: 3214622 - RNA, 20 nt, Mycobacterium bovis subsp bovis AF2122/97
ccgcggucuucuucaccgcc

SEQ ID NO: 3214623 - RNA, 22 nt, Mycobacterium bovis subsp bovis AF2122/97
ccgcggugaccaccccggccaa

SEQ ID NO: 3214624 - RNA, 14 nt, Mycobacterium bovis subsp bovis AF2122/97
ccgcggugacccgg

SEQ ID NO: 3214625 - RNA, 17 nt, Mycobacterium bovis subsp bovis AF2122/97
ccgcggugacggcggcu

SEQ ID NO: 3214626 - RNA, 22 nt, Mycobacterium bovis subsp bovis AF2122/97
ccgcggugaguucgccggaggc

SEQ ID NO: 3214627 - RNA, 16 nt, Mycobacterium bovis subsp bovis AF2122/97
ccgcggugccccggau

SEQ ID NO: 3214628 - RNA, 16 nt, Mycobacterium bovis subsp bovis AF2122/97
ccgcggugccugcagc

SEQ ID NO: 3214629 - RNA, 19 nt, Mycobacterium bovis subsp bovis AF2122/97
ccgcggugccugcagcuug

SEQ ID NO: 3214630 - RNA, 21 nt, Mycobacterium bovis subsp bovis AF2122/97
ccgcgguggaugcgaugcgcg

SEQ ID NO: 3214631 - RNA, 15 nt, Mycobacterium bovis subsp bovis AF2122/97
ccgcgguggcggcga

SEQ ID NO: 3214632 - RNA, 16 nt, Mycobacterium bovis subsp bovis AF2122/97
ccgcgguggcggcgag

SEQ ID NO: 3214633 - RNA, 17 nt, Mycobacterium bovis subsp bovis AF2122/97
ccgcgguggcggcgagc

SEQ ID NO: 3214634 - RNA, 17 nt, Mycobacterium bovis subsp bovis AF2122/97
ccgcgguguauccgacg

SEQ ID NO: 3214635 - RNA, 20 nt, Mycobacterium bovis subsp bovis AF2122/97
ccgcgguguucguggccgac

SEQ ID NO: 3214636 - RNA, 22 nt, Mycobacterium bovis subsp bovis AF2122/97
ccgcgguguuggacgcgggccg

SEQ ID NO: 3214637 - RNA, 23 nt, Mycobacterium bovis subsp bovis AF2122/97
ccgcgguguuggacgcgggccga

SEQ ID NO: 3214638 - RNA, 22 nt, Mycobacterium bovis subsp bovis AF2122/97
ccgcgguuggcaguggcgcggc

SEQ ID NO: 3214639 - RNA, 22 nt, Mycobacterium bovis subsp bovis AF2122/97
ccgcgguugugcugggugccgc

SEQ ID NO: 3214640 - RNA, 21 nt, Mycobacterium bovis subsp bovis AF2122/97
ccgcgguuugcacgucacgcg

SEQ ID NO: 3214641 - RNA, 13 nt, Mycobacterium bovis subsp bovis AF2122/97
ccgcguaaaccgg

SEQ ID NO: 3214642 - RNA, 20 nt, Mycobacterium bovis subsp bovis AF2122/97
ccgcguaaaggccuugggcg

SEQ ID NO: 3214643 - RNA, 22 nt, Mycobacterium bovis subsp bovis AF2122/97
ccgcguaaaggccuugggcggc

SEQ ID NO: 3214644 - RNA, 18 nt, Mycobacterium bovis subsp bovis AF2122/97
ccgcguaauucgacuucg

SEQ ID NO: 3214645 - RNA, 17 nt, Mycobacterium bovis subsp bovis AF2122/97
ccgcguacaggccggcc

SEQ ID NO: 3214646 - RNA, 23 nt, Mycobacterium bovis subsp bovis AF2122/97
ccgcguaccaauucccgcgcggc

SEQ ID NO: 3214647 - RNA, 16 nt, Mycobacterium bovis subsp bovis AF2122/97
ccgcguaccacggugg

SEQ ID NO: 3214648 - RNA, 19 nt, Mycobacterium bovis subsp bovis AF2122/97
ccgcguagaacccaggccg

SEQ ID NO: 3214649 - RNA, 15 nt, Mycobacterium bovis subsp bovis AF2122/97
ccgcguagaccagug

SEQ ID NO: 3214650 - RNA, 14 nt, Mycobacterium bovis subsp bovis AF2122/97
ccgcguagacccca

SEQ ID NO: 3214651 - RNA, 15 nt, Mycobacterium bovis subsp bovis AF2122/97
ccgcguagagcagca

SEQ ID NO: 3214652 - RNA, 17 nt, Mycobacterium bovis subsp bovis AF2122/97
ccgcguagagcagcagc

SEQ ID NO: 3214653 - RNA, 19 nt, Mycobacterium bovis subsp bovis AF2122/97
ccgcuaggugacgccgcca

SEQ ID NO: 3214654 - RNA, 21 nt, Mycobacterium bovis subsp bovis AF2122/97
ccgcuaggugacgccgccagc

SEQ ID NO: 3214655 - RNA, 18 nt, Mycobacterium bovis subsp bovis AF2122/97
ccgcuagucgucggcgcu

SEQ ID NO: 3214656 - RNA, 21 nt, Mycobacterium bovis subsp bovis AF2122/97
ccgcuauccaggccgucaggc

SEQ ID NO: 3214657 - RNA, 20 nt, Mycobacterium bovis subsp bovis AF2122/97
ccgcuaucgaggaggcgguc

SEQ ID NO: 3214658 - RNA, 16 nt, Mycobacterium bovis subsp bovis AF2122/97
ccgcuaugaugccgcc

SEQ ID NO: 3214659 - RNA, 16 nt, Mycobacterium bovis subsp bovis AF2122/97
ccgcuauggcccgggc

SEQ ID NO: 3214660 - RNA, 20 nt, Mycobacterium bovis subsp bovis AF2122/97
ccgcuauggcccgggccgaa

SEQ ID NO: 3214661 - RNA, 16 nt, Mycobacterium bovis subsp bovis AF2122/97
ccgcucaacgggccgc

SEQ ID NO: 3214662 - RNA, 18 nt, Mycobacterium bovis subsp bovis AF2122/97
ccgcucacaagccgugca

SEQ ID NO: 3214663 - RNA, 21 nt, Mycobacterium bovis subsp bovis AF2122/97
ccgcucacauacagcaggccg

SEQ ID NO: 3214664 - RNA, 15 nt, Mycobacterium bovis subsp bovis AF2122/97
ccgcucaccccgcgc

SEQ ID NO: 3214665 - RNA, 20 nt, Mycobacterium bovis subsp bovis AF2122/97
ccgcucaccccgcgcuccuc

SEQ ID NO: 3214666 - RNA, 13 nt, Mycobacterium bovis subsp bovis AF2122/97
ccgcucacccgcc

SEQ ID NO: 3214667 - RNA, 15 nt, Mycobacterium bovis subsp bovis AF2122/97
ccgcucagccguccg

SEQ ID NO: 3214668 - RNA, 19 nt, Mycobacterium bovis subsp bovis AF2122/97
ccgcucagccguccgggcg

SEQ ID NO: 3214669 - RNA, 23 nt, Mycobacterium bovis subsp bovis AF2122/97
ccgcucagccguccgggcggccu

SEQ ID NO: 3214670 - RNA, 15 nt, Mycobacterium bovis subsp bovis AF2122/97
ccgcucagcgcagca

SEQ ID NO: 3214671 - RNA, 15 nt, Mycobacterium bovis subsp bovis AF2122/97
ccgcucagggugcgc

SEQ ID NO: 3214672 - RNA, 17 nt, Mycobacterium bovis subsp bovis AF2122/97
ccgcucagggugcgccg

SEQ ID NO: 3214673 - RNA, 18 nt, Mycobacterium bovis subsp bovis AF2122/97
ccgcucagggugcgccgc

SEQ ID NO: 3214674 - RNA, 19 nt, Mycobacterium bovis subsp bovis AF2122/97
ccgcucagggugcgccgca

SEQ ID NO: 3214675 - RNA, 21 nt, Mycobacterium bovis subsp bovis AF2122/97
ccgcucaucgaucccguucgg

SEQ ID NO: 3214676 - RNA, 18 nt, Mycobacterium bovis subsp bovis AF2122/97
ccgcucauuagcccccgc

SEQ ID NO: 3214677 - RNA, 22 nt, Mycobacterium bovis subsp bovis AF2122/97
ccgcuccaaaagccucagccgc

SEQ ID NO: 3214678 - RNA, 12 nt, Mycobacterium bovis subsp bovis AF2122/97
ccgcuccaccac

SEQ ID NO: 3214679 - RNA, 17 nt, Mycobacterium bovis subsp bovis AF2122/97
ccgcuccaccacgaccg

SEQ ID NO: 3214680 - RNA, 21 nt, Mycobacterium bovis subsp bovis AF2122/97
ccgcuccacguacgcggcugc

SEQ ID NO: 3214681 - RNA, 14 nt, Mycobacterium bovis subsp bovis AF2122/97
ccgcuccagcucgg

SEQ ID NO: 3214682 - RNA, 17 nt, Mycobacterium bovis subsp bovis AF2122/97
ccgcuccaugacaaacc

SEQ ID NO: 3214683 - RNA, 20 nt, Mycobacterium bovis subsp bovis AF2122/97
ccgcucccgugcuggcgccg

SEQ ID NO: 3214684 - RNA, 14 nt, Mycobacterium bovis subsp bovis AF2122/97
ccgcuccgagcacc

SEQ ID NO: 3214685 - RNA, 17 nt, Mycobacterium bovis subsp bovis AF2122/97
ccgcuccgccgucgccg

SEQ ID NO: 3214686 - RNA, 20 nt, Mycobacterium bovis subsp bovis AF2122/97
ccgcuccgccgucgccgccg

SEQ ID NO: 3214687 - RNA, 13 nt, Mycobacterium bovis subsp bovis AF2122/97
ccgcuccugcucg

SEQ ID NO: 3214688 - RNA, 18 nt, Mycobacterium bovis subsp bovis AF2122/97
ccgcucgaccagacgcug

SEQ ID NO: 3214689 - RNA, 16 nt, Mycobacterium bovis subsp bovis AF2122/97
ccgcucgacggcccgc

SEQ ID NO: 3214690 - RNA, 20 nt, Mycobacterium bovis subsp bovis AF2122/97
ccgcucgacggcccgccguc

SEQ ID NO: 3214691 - RNA, 22 nt, Mycobacterium bovis subsp bovis AF2122/97
ccgcucgacggcccgccguccg

SEQ ID NO: 3214692 - RNA, 20 nt, Mycobacterium bovis subsp bovis AF2122/97
ccgcucgagcagcgcgccgu

SEQ ID NO: 3214693 - RNA, 23 nt, Mycobacterium bovis subsp bovis AF2122/97
ccgcucgagcuacgacgaguggu

SEQ ID NO: 3214694 - RNA, 16 nt, Mycobacterium bovis subsp bovis AF2122/97
ccgcucgaucggcagc

SEQ ID NO: 3214695 - RNA, 19 nt, Mycobacterium bovis subsp bovis AF2122/97
ccgcucgaucggcagccag

SEQ ID NO: 3214696 - RNA, 15 nt, Mycobacterium bovis subsp bovis AF2122/97
ccgcucgcaggccgg

SEQ ID NO: 3214697 - RNA, 18 nt, Mycobacterium bovis subsp bovis AF2122/97
ccgcucgcaggccggcgg

SEQ ID NO: 3214698 - RNA, 14 nt, Mycobacterium bovis subsp bovis AF2122/97
ccgcucgcccgccg

SEQ ID NO: 3214699 - RNA, 18 nt, Mycobacterium bovis subsp bovis AF2122/97
ccgcucgccgguaggcgg

SEQ ID NO: 3214700 - RNA, 20 nt, Mycobacterium bovis subsp bovis AF2122/97
ccgcucgccgguaggcggcc

SEQ ID NO: 3214701 - RNA, 21 nt, Mycobacterium bovis subsp bovis AF2122/97
ccgcucgccgguaggcggcca

SEQ ID NO: 3214702 - RNA, 16 nt, Mycobacterium bovis subsp bovis AF2122/97
ccgcucggaguugagc

SEQ ID NO: 3214703 - RNA, 18 nt, Mycobacterium bovis subsp bovis AF2122/97
ccgcucggcaaccugcga

SEQ ID NO: 3214704 - RNA, 21 nt, Mycobacterium bovis subsp bovis AF2122/97
ccgcucggcaaccugcgacca

SEQ ID NO: 3214705 - RNA, 14 nt, Mycobacterium bovis subsp bovis AF2122/97
ccgcucggccgcag

SEQ ID NO: 3214706 - RNA, 17 nt, Mycobacterium bovis subsp bovis AF2122/97
ccgcucggccgcagcca

SEQ ID NO: 3214707 - RNA, 15 nt, Mycobacterium bovis subsp bovis AF2122/97
ccgcucggcgcgcgg

SEQ ID NO: 3214708 - RNA, 14 nt, Mycobacterium bovis subsp bovis AF2122/97
ccgcucggcggucg

SEQ ID NO: 3214709 - RNA, 23 nt, Mycobacterium bovis subsp bovis AF2122/97
ccgcucgggcaacgccucgagca

SEQ ID NO: 3214710 - RNA, 19 nt, Mycobacterium bovis subsp bovis AF2122/97
ccgcucgggcgcgaggacg

SEQ ID NO: 3214711 - RNA, 23 nt, Mycobacterium bovis subsp bovis AF2122/97
ccgcucgggguugcucgcgaucg

SEQ ID NO: 3214712 - RNA, 18 nt, Mycobacterium bovis subsp bovis AF2122/97
ccgcucgguaccggucga

SEQ ID NO: 3214713 - RNA, 17 nt, Mycobacterium bovis subsp bovis AF2122/97
ccgcucgguccagccgg

SEQ ID NO: 3214714 - RNA, 18 nt, Mycobacterium bovis subsp bovis AF2122/97
ccgcucgguccagccggu

SEQ ID NO: 3214715 - RNA, 13 nt, Mycobacterium bovis subsp bovis AF2122/97
ccgcucggucgcc

SEQ ID NO: 3214716 - RNA, 11 nt, Mycobacterium bovis subsp bovis AF2122/97
ccgcucgucgc

SEQ ID NO: 3214717 - RNA, 15 nt, Mycobacterium bovis subsp bovis AF2122/97
ccgcucgucguccgg

SEQ ID NO: 3214718 - RNA, 22 nt, Mycobacterium bovis subsp bovis AF2122/97
ccgcucgucguccggccacggu

SEQ ID NO: 3214719 - RNA, 21 nt, Mycobacterium bovis subsp bovis AF2122/97
ccgcucguuacgccgagcaca

SEQ ID NO: 3214720 - RNA, 22 nt, Mycobacterium bovis subsp bovis AF2122/97
ccgcucguuacgccgagcacac

SEQ ID NO: 3214721 - RNA, 18 nt, Mycobacterium bovis subsp bovis AF2122/97
ccgcucguucgugcagcc

SEQ ID NO: 3214722 - RNA, 13 nt, Mycobacterium bovis subsp bovis AF2122/97
ccgcucucggcga

SEQ ID NO: 3214723 - RNA, 18 nt, Mycobacterium bovis subsp bovis AF2122/97
ccgcucucggcgauuuug

SEQ ID NO: 3214724 - RNA, 12 nt, Mycobacterium bovis subsp bovis AF2122/97
ccgcucugcggc

SEQ ID NO: 3214725 - RNA, 23 nt, Mycobacterium bovis subsp bovis AF2122/97
ccgcugaacucaacgggaccgau

SEQ ID NO: 3214726 - RNA, 17 nt, Mycobacterium bovis subsp bovis AF2122/97
ccgcugaauuggcgccg

SEQ ID NO: 3214727 - RNA, 13 nt, Mycobacterium bovis subsp bovis AF2122/97
ccgcugaccauca

SEQ ID NO: 3214728 - RNA, 21 nt, Mycobacterium bovis subsp bovis AF2122/97
ccgcugaccccggcagcgccc

SEQ ID NO: 3214729 - RNA, 15 nt, Mycobacterium bovis subsp bovis AF2122/97
ccgcugacgguucgg

SEQ ID NO: 3214730 - RNA, 14 nt, Mycobacterium bovis subsp bovis AF2122/97
ccgcugacuccugc

SEQ ID NO: 3214731 - RNA, 21 nt, Mycobacterium bovis subsp bovis AF2122/97
ccgcugacuccugcggcaccg

SEQ ID NO: 3214732 - RNA, 18 nt, Mycobacterium bovis subsp bovis AF2122/97
ccgcugagccagcuccac

SEQ ID NO: 3214733 - RNA, 14 nt, Mycobacterium bovis subsp bovis AF2122/97
ccgcugagcccugc

SEQ ID NO: 3214734 - RNA, 16 nt, Mycobacterium bovis subsp bovis AF2122/97
ccgcugagcccugcgc

SEQ ID NO: 3214735 - RNA, 22 nt, Mycobacterium bovis subsp bovis AF2122/97
ccgcugagcccugcgccucggc

SEQ ID NO: 3214736 - RNA, 24 nt, Mycobacterium bovis subsp bovis AF2122/97
ccgcugagguauugggcgcggcag

SEQ ID NO: 3214737 - RNA, 17 nt, Mycobacterium bovis subsp bovis AF2122/97
ccgcugauagcggucgg

SEQ ID NO: 3214738 - RNA, 15 nt, Mycobacterium bovis subsp bovis AF2122/97
ccgcugaucugccgc

SEQ ID NO: 3214739 - RNA, 18 nt, Mycobacterium bovis subsp bovis AF2122/97
ccgcuuagcaaucggcag

SEQ ID NO: 3214740 - RNA, 13 nt, Mycobacterium bovis subsp bovis AF2122/97
ccgcuucagcacg

SEQ ID NO: 3214741 - RNA, 16 nt, Mycobacterium bovis subsp bovis AF2122/97
ccgcuucaggcgccac

SEQ ID NO: 3214742 - RNA, 22 nt, Mycobacterium bovis subsp bovis AF2122/97
ccgcuuccaaaaucaucugcac

SEQ ID NO: 3214743 - RNA, 22 nt, Mycobacterium bovis subsp bovis AF2122/97
ccgcuugaccccuggccgccgg

SEQ ID NO: 3214744 - RNA, 18 nt, Mycobacterium bovis subsp bovis AF2122/97
ccgcuugacgcagcucgu

SEQ ID NO: 3214745 - RNA, 22 nt, Mycobacterium bovis subsp bovis AF2122/97
ccgcuugaucugggcugcggcc

SEQ ID NO: 3214746 - RNA, 14 nt, Mycobacterium bovis subsp bovis AF2122/97
ccgcuugccccgcc

SEQ ID NO: 3214747 - RNA, 15 nt, Mycobacterium bovis subsp bovis AF2122/97
ccgcuugccccgccu

SEQ ID NO: 3214748 - RNA, 14 nt, Mycobacterium bovis subsp bovis AF2122/97
ccgcuugcccgcgc

SEQ ID NO: 3214749 - RNA, 17 nt, Mycobacterium bovis subsp bovis AF2122/97
ccgcuugcccgcgcagc

SEQ ID NO: 3214750 - RNA, 14 nt, Mycobacterium bovis subsp bovis AF2122/97
ccgcuugcgcggcu

SEQ ID NO: 3214751 - RNA, 15 nt, Mycobacterium bovis subsp bovis AF2122/97
ccgcuugcggggccg

SEQ ID NO: 3214752 - RNA, 16 nt, Mycobacterium bovis subsp bovis AF2122/97
ccgcuugcggggccgg

SEQ ID NO: 3214753 - RNA, 21 nt, Mycobacterium bovis subsp bovis AF2122/97
ccgcuuggaccguugccgaug

SEQ ID NO: 3214754 - RNA, 16 nt, Mycobacterium bovis subsp bovis AF2122/97
ccgcuuggcccggcaa

SEQ ID NO: 3214755 - RNA, 16 nt, Mycobacterium bovis subsp bovis AF2122/97
ccgcuuggccgcugcc

SEQ ID NO: 3214756 - RNA, 19 nt, Mycobacterium bovis subsp bovis AF2122/97
ccgcuuggcgagccacggc

SEQ ID NO: 3214757 - RNA, 13 nt, Mycobacterium bovis subsp bovis AF2122/97
ccgcuugggccug

SEQ ID NO: 3214758 - RNA, 13 nt, Mycobacterium bovis subsp bovis AF2122/97
ccgcuugguguga

SEQ ID NO: 3214759 - RNA, 19 nt, Mycobacterium bovis subsp bovis AF2122/97
ccgcuuguccaccgugcgg

SEQ ID NO: 3214760 - RNA, 19 nt, Mycobacterium bovis subsp bovis AF2122/97
ccgcuugugacaccacauc

SEQ ID NO: 3214761 - RNA, 23 nt, Mycobacterium bovis subsp bovis AF2122/97
ccgcuuucggaaaaccgcaccgu

SEQ ID NO: 3214762 - RNA, 17 nt, Mycobacterium bovis subsp bovis AF2122/97
ccgcuuucuuggcgggc

SEQ ID NO: 3214763 - RNA, 18 nt, Mycobacterium bovis subsp bovis AF2122/97
ccgcuuucuuggcgggcg

SEQ ID NO: 3214764 - RNA, 20 nt, Mycobacterium bovis subsp bovis AF2122/97
ccgcuuugaauugcgcgccc

SEQ ID NO: 3214765 - RNA, 18 nt, Mycobacterium bovis subsp bovis AF2122/97
ccgcuuugcgcggucagc

SEQ ID NO: 3214766 - RNA, 18 nt, Mycobacterium bovis subsp bovis AF2122/97
ccgcuuuuucccggcggc

SEQ ID NO: 3214767 - RNA, 19 nt, Mycobacterium bovis subsp bovis AF2122/97
ccgcuuuuucccggcggcg

SEQ ID NO: 3214768 - RNA, 15 nt, Mycobacterium bovis subsp bovis AF2122/97
ccggaaaccacagcg

SEQ ID NO: 3214769 - RNA, 23 nt, Mycobacterium bovis subsp bovis AF2122/97
ccggaaacuggggguuguucaac

SEQ ID NO: 3214770 - RNA, 19 nt, Mycobacterium bovis subsp bovis AF2122/97
ccggaaagcccgucgucgg

SEQ ID NO: 3214771 - RNA, 16 nt, Mycobacterium bovis subsp bovis AF2122/97
ccggaaagcucucggc

SEQ ID NO: 3214772 - RNA, 19 nt, Mycobacterium bovis subsp bovis AF2122/97
ccggaaauuccggcgcggc

SEQ ID NO: 3214773 - RNA, 20 nt, Mycobacterium bovis subsp bovis AF2122/97
ccggaacaccgacgucaggc

SEQ ID NO: 3214774 - RNA, 16 nt, Mycobacterium bovis subsp bovis AF2122/97
ccggaaccagccgcgg

SEQ ID NO: 3214775 - RNA, 17 nt, Mycobacterium bovis subsp bovis AF2122/97
ccggaacccccagcugc

SEQ ID NO: 3214776 - RNA, 16 nt, Mycobacterium bovis subsp bovis AF2122/97
ccggaaccggcgugca

SEQ ID NO: 3214777 - RNA, 14 nt, Mycobacterium bovis subsp bovis AF2122/97
ccggaaccgguauc

SEQ ID NO: 3214778 - RNA, 20 nt, Mycobacterium bovis subsp bovis AF2122/97
ccggaacgagcggccgcgcg

SEQ ID NO: 3214779 - RNA, 13 nt, Mycobacterium bovis subsp bovis AF2122/97
ccggaacgccguc

SEQ ID NO: 3214780 - RNA, 14 nt, Mycobacterium bovis subsp bovis AF2122/97
ccggaacgccgucg

SEQ ID NO: 3214781 - RNA, 23 nt, Mycobacterium bovis subsp bovis AF2122/97
ccggaacgccgucgagcauccac

SEQ ID NO: 3214782 - RNA, 22 nt, Mycobacterium bovis subsp bovis AF2122/97
ccggaacggguuggcgaucauc

SEQ ID NO: 3214783 - RNA, 21 nt, Mycobacterium bovis subsp bovis AF2122/97
ccggaacuguggugccugcgg

SEQ ID NO: 3214784 - RNA, 17 nt, Mycobacterium bovis subsp bovis AF2122/97
ccggaagauccgggccu

SEQ ID NO: 3214785 - RNA, 13 nt, Mycobacterium bovis subsp bovis AF2122/97
ccggaagcgccgg

SEQ ID NO: 3214786 - RNA, 14 nt, Mycobacterium bovis subsp bovis AF2122/97
ccggaagcgccggc

SEQ ID NO: 3214787 - RNA, 14 nt, Mycobacterium bovis subsp bovis AF2122/97
ccggaagcggcguu

SEQ ID NO: 3214788 - RNA, 16 nt, Mycobacterium bovis subsp bovis AF2122/97
ccggaagcggcguucg

SEQ ID NO: 3214789 - RNA, 21 nt, Mycobacterium bovis subsp bovis AF2122/97
ccggaagcggcguucgaugcc

SEQ ID NO: 3214790 - RNA, 16 nt, Mycobacterium bovis subsp bovis AF2122/97
ccggaaggcucgccag

SEQ ID NO: 3214791 - RNA, 23 nt, Mycobacterium bovis subsp bovis AF2122/97
ccggaaguugaucuugccgcccu

SEQ ID NO: 3214792 - RNA, 12 nt, Mycobacterium bovis subsp bovis AF2122/97
ccggaauacacc

SEQ ID NO: 3214793 - RNA, 16 nt, Mycobacterium bovis subsp bovis AF2122/97
ccggaauacccgcugg

SEQ ID NO: 3214794 - RNA, 20 nt, Mycobacterium bovis subsp bovis AF2122/97
ccggaauacccgcuggcccg

SEQ ID NO: 3214795 - RNA, 16 nt, Mycobacterium bovis subsp bovis AF2122/97
ccggaauacgcgccgc

SEQ ID NO: 3214796 - RNA, 24 nt, Mycobacterium bovis subsp bovis AF2122/97
ccggaauacgcgccgccggcucgc

SEQ ID NO: 3214797 - RNA, 21 nt, Mycobacterium bovis subsp bovis AF2122/97
ccggaauagcaacgcugcggc

SEQ ID NO: 3214798 - RNA, 15 nt, Mycobacterium bovis subsp bovis AF2122/97
ccggaaucgcccggg

SEQ ID NO: 3214799 - RNA, 13 nt, Mycobacterium bovis subsp bovis AF2122/97
ccggaaucggcgg

SEQ ID NO: 3214800 - RNA, 21 nt, Mycobacterium bovis subsp bovis AF2122/97
ccggaaucgucgcggccgucg

SEQ ID NO: 3214801 - RNA, 22 nt, Mycobacterium bovis subsp bovis AF2122/97
ccggacaaagcugcucgucggc

SEQ ID NO: 3214802 - RNA, 23 nt, Mycobacterium bovis subsp bovis AF2122/97
ccggacaaccuggggccaccaga

SEQ ID NO: 3214803 - RNA, 14 nt, Mycobacterium bovis subsp bovis AF2122/97
ccggacacgaucag

SEQ ID NO: 3214804 - RNA, 13 nt, Mycobacterium bovis subsp bovis AF2122/97
ccggacacuccug

SEQ ID NO: 3214805 - RNA, 15 nt, Mycobacterium bovis subsp bovis AF2122/97
ccggacagcucgcgc

SEQ ID NO: 3214806 - RNA, 18 nt, Mycobacterium bovis subsp bovis AF2122/97
ccggacagggugggggca

SEQ ID NO: 3214807 - RNA, 14 nt, Mycobacterium bovis subsp bovis AF2122/97
ccggacauagccgc

SEQ ID NO: 3214808 - RNA, 22 nt, Mycobacterium bovis subsp bovis AF2122/97
ccggacauagccgcgcucgaac

SEQ ID NO: 3214809 - RNA, 17 nt, Mycobacterium bovis subsp bovis AF2122/97
ccggacaugcgggcagc

SEQ ID NO: 3214810 - RNA, 11 nt, Mycobacterium bovis subsp bovis AF2122/97
ccggaccaccg

SEQ ID NO: 3214811 - RNA, 12 nt, Mycobacterium bovis subsp bovis AF2122/97
ccggaccaccgc

SEQ ID NO: 3214812 - RNA, 22 nt, Mycobacterium bovis subsp bovis AF2122/97
ccggaccacuguuggugccgcc

SEQ ID NO: 3214813 - RNA, 20 nt, Mycobacterium bovis subsp bovis AF2122/97
ccggaccaucagcgucgacg

SEQ ID NO: 3214814 - RNA, 21 nt, Mycobacterium bovis subsp bovis AF2122/97
ccggaccaucgacaacgccuu

SEQ ID NO: 3214815 - RNA, 18 nt, Mycobacterium bovis subsp bovis AF2122/97
ccggacccaaagcacuuc

SEQ ID NO: 3214816 - RNA, 13 nt, Mycobacterium bovis subsp bovis AF2122/97
ccggacccaccaa

SEQ ID NO: 3214817 - RNA, 18 nt, Mycobacterium bovis subsp bovis AF2122/97
ccggacccacccgcaccg

SEQ ID NO: 3214818 - RNA, 19 nt, Mycobacterium bovis subsp bovis AF2122/97
ccggacccacccgcaccgc

SEQ ID NO: 3214819 - RNA, 16 nt, Mycobacterium bovis subsp bovis AF2122/97
ccggacccaccgucac

SEQ ID NO: 3214820 - RNA, 15 nt, Mycobacterium bovis subsp bovis AF2122/97
ccggacccgccgggu

SEQ ID NO: 3214821 - RNA, 19 nt, Mycobacterium bovis subsp bovis AF2122/97
ccggacccgccggguccgc

SEQ ID NO: 3214822 - RNA, 16 nt, Mycobacterium bovis subsp bovis AF2122/97
ccggacccggucgccg

SEQ ID NO: 3214823 - RNA, 18 nt, Mycobacterium bovis subsp bovis AF2122/97
ccggacccggucgccggg

SEQ ID NO: 3214824 - RNA, 21 nt, Mycobacterium bovis subsp bovis AF2122/97
ccggaccgaagaccuccucgg

SEQ ID NO: 3214825 - RNA, 19 nt, Mycobacterium bovis subsp bovis AF2122/97
ccggauagcgucuggcgac

SEQ ID NO: 3214826 - RNA, 20 nt, Mycobacterium bovis subsp bovis AF2122/97
ccggauagcgucuggcgaca

SEQ ID NO: 3214827 - RNA, 14 nt, Mycobacterium bovis subsp bovis AF2122/97
ccggauaucgacca

SEQ ID NO: 3214828 - RNA, 18 nt, Mycobacterium bovis subsp bovis AF2122/97
ccggauaucgaccaccgg

SEQ ID NO: 3214829 - RNA, 19 nt, Mycobacterium bovis subsp bovis AF2122/97
ccggauaucgaccaccggg

SEQ ID NO: 3214830 - RNA, 13 nt, Mycobacterium bovis subsp bovis AF2122/97
ccggaucaccgcg

SEQ ID NO: 3214831 - RNA, 14 nt, Mycobacterium bovis subsp bovis AF2122/97
ccggaucccaccac

SEQ ID NO: 3214832 - RNA, 17 nt, Mycobacterium bovis subsp bovis AF2122/97
ccggaucccaccaccgc

SEQ ID NO: 3214833 - RNA, 16 nt, Mycobacterium bovis subsp bovis AF2122/97
ccggaucccagugcca

SEQ ID NO: 3214834 - RNA, 21 nt, Mycobacterium bovis subsp bovis AF2122/97
ccggaucccugugccagcagc

SEQ ID NO: 3214835 - RNA, 20 nt, Mycobacterium bovis subsp bovis AF2122/97
ccggauccgccagaccgcgg

SEQ ID NO: 3214836 - RNA, 16 nt, Mycobacterium bovis subsp bovis AF2122/97
ccggaucgaagaccag

SEQ ID NO: 3214837 - RNA, 21 nt, Mycobacterium bovis subsp bovis AF2122/97
ccggaucgaagaccagcaacg

SEQ ID NO: 3214838 - RNA, 22 nt, Mycobacterium bovis subsp bovis AF2122/97
ccggaucgaccaauucgaccgc

SEQ ID NO: 3214839 - RNA, 15 nt, Mycobacterium bovis subsp bovis AF2122/97
ccggaucgccgucgc

SEQ ID NO: 3214840 - RNA, 16 nt, Mycobacterium bovis subsp bovis AF2122/97
ccggaucgccgucggc

SEQ ID NO: 3214841 - RNA, 20 nt, Mycobacterium bovis subsp bovis AF2122/97
ccggaucgccuuggcgcccg

SEQ ID NO: 3214842 - RNA, 21 nt, Mycobacterium bovis subsp bovis AF2122/97
ccggaucgccuuggcgcccgc

SEQ ID NO: 3214843 - RNA, 13 nt, Mycobacterium bovis subsp bovis AF2122/97
ccggaucggccug

SEQ ID NO: 3214844 - RNA, 20 nt, Mycobacterium bovis subsp bovis AF2122/97
ccggaucggccuguccaccg

SEQ ID NO: 3214845 - RNA, 16 nt, Mycobacterium bovis subsp bovis AF2122/97
ccggaucggucggcac

SEQ ID NO: 3214846 - RNA, 14 nt, Mycobacterium bovis subsp bovis AF2122/97
ccggaucgucgaac

SEQ ID NO: 3214847 - RNA, 22 nt, Mycobacterium bovis subsp bovis AF2122/97
ccggaucgucgaacagcaccgc

SEQ ID NO: 3214848 - RNA, 16 nt, Mycobacterium bovis subsp bovis AF2122/97
ccggaucguucgcgug

SEQ ID NO: 3214849 - RNA, 18 nt, Mycobacterium bovis subsp bovis AF2122/97
ccggaucugacggcgccg

SEQ ID NO: 3214850 - RNA, 21 nt, Mycobacterium bovis subsp bovis AF2122/97
ccggaucugacggcgccgucg

SEQ ID NO: 3214851 - RNA, 17 nt, Mycobacterium bovis subsp bovis AF2122/97
ccggaugacaccgaccg

SEQ ID NO: 3214852 - RNA, 18 nt, Mycobacterium bovis subsp bovis AF2122/97
ccggaugacaccgaccgg

SEQ ID NO: 3214853 - RNA, 20 nt, Mycobacterium bovis subsp bovis AF2122/97
ccggaugacaccgaccgggu

SEQ ID NO: 3214854 - RNA, 23 nt, Mycobacterium bovis subsp bovis AF2122/97
ccggaugacaccgaccgggucgc

SEQ ID NO: 3214855 - RNA, 19 nt, Mycobacterium bovis subsp bovis AF2122/97
ccggaugagcgaacgccag

SEQ ID NO: 3214856 - RNA, 15 nt, Mycobacterium bovis subsp bovis AF2122/97
ccggaugcgcaaccg

SEQ ID NO: 3214857 - RNA, 18 nt, Mycobacterium bovis subsp bovis AF2122/97
ccggaugcugucagcagc

SEQ ID NO: 3214858 - RNA, 19 nt, Mycobacterium bovis subsp bovis AF2122/97
ccggaugcugucagcagcc

SEQ ID NO: 3214859 - RNA, 23 nt, Mycobacterium bovis subsp bovis AF2122/97
ccggauggaacuggacaccgugg

SEQ ID NO: 3214860 - RNA, 18 nt, Mycobacterium bovis subsp bovis AF2122/97
ccggauggguggccagca

SEQ ID NO: 3214861 - RNA, 19 nt, Mycobacterium bovis subsp bovis AF2122/97
ccggauguauuccaggcgu

SEQ ID NO: 3214862 - RNA, 15 nt, Mycobacterium bovis subsp bovis AF2122/97
ccggauguccgccga

SEQ ID NO: 3214863 - RNA, 14 nt, Mycobacterium bovis subsp bovis AF2122/97
ccggaugucgacga

SEQ ID NO: 3214864 - RNA, 18 nt, Mycobacterium bovis subsp bovis AF2122/97
ccggaugucgacgagcac

SEQ ID NO: 3214865 - RNA, 23 nt, Mycobacterium bovis subsp bovis AF2122/97
ccggaugucgacgagcaccgcgc

SEQ ID NO: 3214866 - RNA, 15 nt, Mycobacterium bovis subsp bovis AF2122/97
ccggauguugaccgg

SEQ ID NO: 3214867 - RNA, 23 nt, Mycobacterium bovis subsp bovis AF2122/97
ccggauguugaccggcucgaucu

SEQ ID NO: 3214868 - RNA, 14 nt, Mycobacterium bovis subsp bovis AF2122/97
ccggauucgcccgg

SEQ ID NO: 3214869 - RNA, 15 nt, Mycobacterium bovis subsp bovis AF2122/97
ccggauucgcccggg

SEQ ID NO: 3214870 - RNA, 18 nt, Mycobacterium bovis subsp bovis AF2122/97
ccggauucgcccgggcgu

SEQ ID NO: 3214871 - RNA, 18 nt, Mycobacterium bovis subsp bovis AF2122/97
ccggauugaagucgucgg

SEQ ID NO: 3214872 - RNA, 19 nt, Mycobacterium bovis subsp bovis AF2122/97
ccggauugaagucgucggc

SEQ ID NO: 3214873 - RNA, 15 nt, Mycobacterium bovis subsp bovis AF2122/97
ccggauugagcacgc

SEQ ID NO: 3214874 - RNA, 15 nt, Mycobacterium bovis subsp bovis AF2122/97
ccggauuggcgauga

SEQ ID NO: 3214875 - RNA, 16 nt, Mycobacterium bovis subsp bovis AF2122/97
ccggauuucgucgggc

SEQ ID NO: 3214876 - RNA, 22 nt, Mycobacterium bovis subsp bovis AF2122/97
ccggauuucgucgggcaccgcc

SEQ ID NO: 3214877 - RNA, 17 nt, Mycobacterium bovis subsp bovis AF2122/97
ccggauuugggucagug

SEQ ID NO: 3214878 - RNA, 18 nt, Mycobacterium bovis subsp bovis AF2122/97
ccggauuuguauuagacu

SEQ ID NO: 3214879 - RNA, 20 nt, Mycobacterium bovis subsp bovis AF2122/97
ccggcaaacgauauccgaac

SEQ ID NO: 3214880 - RNA, 14 nt, Mycobacterium bovis subsp bovis AF2122/97
ccggcaaacuccag

SEQ ID NO: 3214881 - RNA, 15 nt, Mycobacterium bovis subsp bovis AF2122/97
ccggcaacagcucgc

SEQ ID NO: 3214882 - RNA, 19 nt, Mycobacterium bovis subsp bovis AF2122/97
ccggcaacaucagcaggac

SEQ ID NO: 3214883 - RNA, 23 nt, Mycobacterium bovis subsp bovis AF2122/97
ccggcaacauuggccuguucaac

SEQ ID NO: 3214884 - RNA, 14 nt, Mycobacterium bovis subsp bovis AF2122/97
ccggcaaccaccgg

SEQ ID NO: 3214885 - RNA, 15 nt, Mycobacterium bovis subsp bovis AF2122/97
ccggcaaccaccggc

SEQ ID NO: 3214886 - RNA, 17 nt, Mycobacterium bovis subsp bovis AF2122/97
ccggcaaccaccggccg

SEQ ID NO: 3214887 - RNA, 19 nt, Mycobacterium bovis subsp bovis AF2122/97
ccggcaaccaccggccgcg

SEQ ID NO: 3214888 - RNA, 22 nt, Mycobacterium bovis subsp bovis AF2122/97
ccggcaaccaccggccgcgcag

SEQ ID NO: 3214889 - RNA, 15 nt, Mycobacterium bovis subsp bovis AF2122/97
ccggcaaccgacucg

SEQ ID NO: 3214890 - RNA, 22 nt, Mycobacterium bovis subsp bovis AF2122/97
ccggcaaccgacucgacaaggc

SEQ ID NO: 3214891 - RNA, 16 nt, Mycobacterium bovis subsp bovis AF2122/97
ccggcaaccgggaucu

SEQ ID NO: 3214892 - RNA, 21 nt, Mycobacterium bovis subsp bovis AF2122/97
ccggcaaccgggaucugcucc

SEQ ID NO: 3214893 - RNA, 15 nt, Mycobacterium bovis subsp bovis AF2122/97
ccggcaacgcggccu

SEQ ID NO: 3214894 - RNA, 15 nt, Mycobacterium bovis subsp bovis AF2122/97
ccggcaacgcggcuc

SEQ ID NO: 3214895 - RNA, 18 nt, Mycobacterium bovis subsp bovis AF2122/97
ccggcaacggcgcgccga

SEQ ID NO: 3214896 - RNA, 19 nt, Mycobacterium bovis subsp bovis AF2122/97
ccggcaacggcgcgccgac

SEQ ID NO: 3214897 - RNA, 23 nt, Mycobacterium bovis subsp bovis AF2122/97
ccggcaacggcgcgccgaccacc

SEQ ID NO: 3214898 - RNA, 22 nt, Mycobacterium bovis subsp bovis AF2122/97
ccggcaagaccgaacagcggca

SEQ ID NO: 3214899 - RNA, 19 nt, Mycobacterium bovis subsp bovis AF2122/97
ccggcaagcacaccgccag

SEQ ID NO: 3214900 - RNA, 22 nt, Mycobacterium bovis subsp bovis AF2122/97
ccggcaagcacaccgccagcgg

SEQ ID NO: 3214901 - RNA, 11 nt, Mycobacterium bovis subsp bovis AF2122/97
ccggcaagcag

SEQ ID NO: 3214902 - RNA, 14 nt, Mycobacterium bovis subsp bovis AF2122/97
ccggcaagcgcaga

SEQ ID NO: 3214903 - RNA, 15 nt, Mycobacterium bovis subsp bovis AF2122/97
ccggcaagcgcagac

SEQ ID NO: 3214904 - RNA, 17 nt, Mycobacterium bovis subsp bovis AF2122/97
ccggcaaucggcggcac

SEQ ID NO: 3214905 - RNA, 21 nt, Mycobacterium bovis subsp bovis AF2122/97
ccggcaaucggcggcacccgg

SEQ ID NO: 3214906 - RNA, 16 nt, Mycobacterium bovis subsp bovis AF2122/97
ccggcaaugccacggu

SEQ ID NO: 3214907 - RNA, 15 nt, Mycobacterium bovis subsp bovis AF2122/97
ccggcaaugccgcgg

SEQ ID NO: 3214908 - RNA, 20 nt, Mycobacterium bovis subsp bovis AF2122/97
ccggcaauugugcugcgcgu

SEQ ID NO: 3214909 - RNA, 18 nt, Mycobacterium bovis subsp bovis AF2122/97
ccggcaauuuucugcugc

SEQ ID NO: 3214910 - RNA, 14 nt, Mycobacterium bovis subsp bovis AF2122/97
ccggcacacccucc

SEQ ID NO: 3214911 - RNA, 21 nt, Mycobacterium bovis subsp bovis AF2122/97
ccggcagcugcucggucaggc

SEQ ID NO: 3214912 - RNA, 19 nt, Mycobacterium bovis subsp bovis AF2122/97
ccggcagcuugcagugccg

SEQ ID NO: 3214913 - RNA, 21 nt, Mycobacterium bovis subsp bovis AF2122/97
ccggcaggaaacucagguccg

SEQ ID NO: 3214914 - RNA, 17 nt, Mycobacterium bovis subsp bovis AF2122/97
ccggcaggcccgacggc

SEQ ID NO: 3214915 - RNA, 22 nt, Mycobacterium bovis subsp bovis AF2122/97
ccggcaggcccgacggcgccca

SEQ ID NO: 3214916 - RNA, 14 nt, Mycobacterium bovis subsp bovis AF2122/97
ccggcaggccggcg

SEQ ID NO: 3214917 - RNA, 16 nt, Mycobacterium bovis subsp bovis AF2122/97
ccggcaggccggcguc

SEQ ID NO: 3214918 - RNA, 17 nt, Mycobacterium bovis subsp bovis AF2122/97
ccggcaggccggcgucg

SEQ ID NO: 3214919 - RNA, 21 nt, Mycobacterium bovis subsp bovis AF2122/97
ccggcaggcuaaucagccagg

SEQ ID NO: 3214920 - RNA, 21 nt, Mycobacterium bovis subsp bovis AF2122/97
ccggcaggguuccggauccga

SEQ ID NO: 3214921 - RNA, 23 nt, Mycobacterium bovis subsp bovis AF2122/97
ccggcagguccaucuggcgcgcc

SEQ ID NO: 3214922 - RNA, 15 nt, Mycobacterium bovis subsp bovis AF2122/97
ccggcagugagucgg

SEQ ID NO: 3214923 - RNA, 20 nt, Mycobacterium bovis subsp bovis AF2122/97
ccggcauaaaccgcguccgc

SEQ ID NO: 3214924 - RNA, 21 nt, Mycobacterium bovis subsp bovis AF2122/97
ccggcauacaacuggugggcc

SEQ ID NO: 3214925 - RNA, 14 nt, Mycobacterium bovis subsp bovis AF2122/97
ccggcauacagccg

SEQ ID NO: 3214926 - RNA, 15 nt, Mycobacterium bovis subsp bovis AF2122/97
ccggcauacagccgg

SEQ ID NO: 3214927 - RNA, 16 nt, Mycobacterium bovis subsp bovis AF2122/97
ccggcauacagccggc

SEQ ID NO: 3214928 - RNA, 17 nt, Mycobacterium bovis subsp bovis AF2122/97
ccggcauacaucgccuu

SEQ ID NO: 3214929 - RNA, 20 nt, Mycobacterium bovis subsp bovis AF2122/97
ccggcauacaucgccuugcc

SEQ ID NO: 3214930 - RNA, 17 nt, Mycobacterium bovis subsp bovis AF2122/97
ccggcauaccgaacagc

SEQ ID NO: 3214931 - RNA, 19 nt, Mycobacterium bovis subsp bovis AF2122/97
ccggcauaccgaacagcac

SEQ ID NO: 3214932 - RNA, 22 nt, Mycobacterium bovis subsp bovis AF2122/97
ccggcauaccgaacagcaccuc

SEQ ID NO: 3214933 - RNA, 23 nt, Mycobacterium bovis subsp bovis AF2122/97
ccggcauacucuuugugcccaau

SEQ ID NO: 3214934 - RNA, 17 nt, Mycobacterium bovis subsp bovis AF2122/97
ccggcauagaucggguc

SEQ ID NO: 3214935 - RNA, 15 nt, Mycobacterium bovis subsp bovis AF2122/97
ccggcauagaugccg

SEQ ID NO: 3214936 - RNA, 20 nt, Mycobacterium bovis subsp bovis AF2122/97
ccggcauagccacgcaagca

SEQ ID NO: 3214937 - RNA, 15 nt, Mycobacterium bovis subsp bovis AF2122/97
ccggcauagcggccc

SEQ ID NO: 3214938 - RNA, 16 nt, Mycobacterium bovis subsp bovis AF2122/97
ccggcauagcggccca

SEQ ID NO: 3214939 - RNA, 17 nt, Mycobacterium bovis subsp bovis AF2122/97
ccggcauagcggcccau

SEQ ID NO: 3214940 - RNA, 20 nt, Mycobacterium bovis subsp bovis AF2122/97
ccggcaucccggaacgccgc

SEQ ID NO: 3214941 - RNA, 16 nt, Mycobacterium bovis subsp bovis AF2122/97
ccggcauccgguucgc

SEQ ID NO: 3214942 - RNA, 21 nt, Mycobacterium bovis subsp bovis AF2122/97
ccggcauccgguucgccgccg

SEQ ID NO: 3214943 - RNA, 20 nt, Mycobacterium bovis subsp bovis AF2122/97
ccggcaucgagacgcacggc

SEQ ID NO: 3214944 - RNA, 23 nt, Mycobacterium bovis subsp bovis AF2122/97
ccggcaucgagacgcacggccac

SEQ ID NO: 3214945 - RNA, 22 nt, Mycobacterium bovis subsp bovis AF2122/97
ccggcaucgcgcaaccgggcgg

SEQ ID NO: 3214946 - RNA, 17 nt, Mycobacterium bovis subsp bovis AF2122/97
ccggcaucggucagcgc

SEQ ID NO: 3214947 - RNA, 22 nt, Mycobacterium bovis subsp bovis AF2122/97
ccggcaucggugaucaaaccgg

SEQ ID NO: 3214948 - RNA, 16 nt, Mycobacterium bovis subsp bovis AF2122/97
ccggcaucgucgacgc

SEQ ID NO: 3214949 - RNA, 19 nt, Mycobacterium bovis subsp bovis AF2122/97
ccggcaucuccaccgucgc

SEQ ID NO: 3214950 - RNA, 20 nt, Mycobacterium bovis subsp bovis AF2122/97
ccggcaucuccaccgucgcc

SEQ ID NO: 3214951 - RNA, 22 nt, Mycobacterium bovis subsp bovis AF2122/97
ccggcaucuccaccgucgccgc

SEQ ID NO: 3214952 - RNA, 12 nt, Mycobacterium bovis subsp bovis AF2122/97
ccggcaugccag

SEQ ID NO: 3214953 - RNA, 15 nt, Mycobacterium bovis subsp bovis AF2122/97
ccggcaugccagcca

SEQ ID NO: 3214954 - RNA, 17 nt, Mycobacterium bovis subsp bovis AF2122/97
ccggcaugccagccacg

SEQ ID NO: 3214955 - RNA, 16 nt, Mycobacterium bovis subsp bovis AF2122/97
ccggcaugcccgcggu

SEQ ID NO: 3214956 - RNA, 19 nt, Mycobacterium bovis subsp bovis AF2122/97
ccggcaugcccgcggugac

SEQ ID NO: 3214957 - RNA, 21 nt, Mycobacterium bovis subsp bovis AF2122/97
ccggcaugcccgcggugacca

SEQ ID NO: 3214958 - RNA, 17 nt, Mycobacterium bovis subsp bovis AF2122/97
ccggcaugcgugccggc

SEQ ID NO: 3214959 - RNA, 24 nt, Mycobacterium bovis subsp bovis AF2122/97
ccggcaugcuggcgaucgcgacga

SEQ ID NO: 3214960 - RNA, 16 nt, Mycobacterium bovis subsp bovis AF2122/97
ccggcauggcggcaua

SEQ ID NO: 3214961 - RNA, 18 nt, Mycobacterium bovis subsp bovis AF2122/97
ccggcauuaggccggggu

SEQ ID NO: 3214962 - RNA, 21 nt, Mycobacterium bovis subsp bovis AF2122/97
ccggcauuaggccggggucga

SEQ ID NO: 3214963 - RNA, 18 nt, Mycobacterium bovis subsp bovis AF2122/97
ccggcauugcccgagccc

SEQ ID NO: 3214964 - RNA, 19 nt, Mycobacterium bovis subsp bovis AF2122/97
ccggcauugccgccguugc

SEQ ID NO: 3214965 - RNA, 19 nt, Mycobacterium bovis subsp bovis AF2122/97
ccggccaaaauuuugucgg

SEQ ID NO: 3214966 - RNA, 16 nt, Mycobacterium bovis subsp bovis AF2122/97
ccggccaaccaccaac

SEQ ID NO: 3214967 - RNA, 14 nt, Mycobacterium bovis subsp bovis AF2122/97
ccggccaacgccgc

SEQ ID NO: 3214968 - RNA, 17 nt, Mycobacterium bovis subsp bovis AF2122/97
ccggccaacgccgccgc

SEQ ID NO: 3214969 - RNA, 19 nt, Mycobacterium bovis subsp bovis AF2122/97
ccggccaacgccgccgcaa

SEQ ID NO: 3214970 - RNA, 17 nt, Mycobacterium bovis subsp bovis AF2122/97
ccggccaacggcacccu

SEQ ID NO: 3214971 - RNA, 14 nt, Mycobacterium bovis subsp bovis AF2122/97
ccggccaacugggc

SEQ ID NO: 3214972 - RNA, 19 nt, Mycobacterium bovis subsp bovis AF2122/97
ccggccaacugggccgagc

SEQ ID NO: 3214973 - RNA, 23 nt, Mycobacterium bovis subsp bovis AF2122/97
ccggccaacugggccgagcgcgc

SEQ ID NO: 3214974 - RNA, 24 nt, Mycobacterium bovis subsp bovis AF2122/97
ccggccaacugggccgagcgcgcc

SEQ ID NO: 3214975 - RNA, 22 nt, Mycobacterium bovis subsp bovis AF2122/97
ccggccaagggugcuugucgcc

SEQ ID NO: 3214976 - RNA, 16 nt, Mycobacterium bovis subsp bovis AF2122/97
ccggccaauggccugc

SEQ ID NO: 3214977 - RNA, 20 nt, Mycobacterium bovis subsp bovis AF2122/97
ccggccacacucgccagggc

SEQ ID NO: 3214978 - RNA, 20 nt, Mycobacterium bovis subsp bovis AF2122/97
ccggccacaggaagcgaccg

SEQ ID NO: 3214979 - RNA, 21 nt, Mycobacterium bovis subsp bovis AF2122/97
ccggccacaggaagcgaccgu

SEQ ID NO: 3214980 - RNA, 14 nt, Mycobacterium bovis subsp bovis AF2122/97
ccggccaccaccgc

SEQ ID NO: 3214981 - RNA, 16 nt, Mycobacterium bovis subsp bovis AF2122/97
ccggccaccaccgcgc

SEQ ID NO: 3214982 - RNA, 12 nt, Mycobacterium bovis subsp bovis AF2122/97
ccggccaccacg

SEQ ID NO: 3214983 - RNA, 20 nt, Mycobacterium bovis subsp bovis AF2122/97
ccggccaccagcaugccugc

SEQ ID NO: 3214984 - RNA, 14 nt, Mycobacterium bovis subsp bovis AF2122/97
ccggccaccagccc

SEQ ID NO: 3214985 - RNA, 15 nt, Mycobacterium bovis subsp bovis AF2122/97
ccggccaccagcccg

SEQ ID NO: 3214986 - RNA, 15 nt, Mycobacterium bovis subsp bovis AF2122/97
ccggccaccagccgg

SEQ ID NO: 3214987 - RNA, 12 nt, Mycobacterium bovis subsp bovis AF2122/97
ccggccaccagg

SEQ ID NO: 3214988 - RNA, 14 nt, Mycobacterium bovis subsp bovis AF2122/97
ccggccaccagggc

SEQ ID NO: 3214989 - RNA, 16 nt, Mycobacterium bovis subsp bovis AF2122/97
ccggccaccagggcca

SEQ ID NO: 3214990 - RNA, 22 nt, Mycobacterium bovis subsp bovis AF2122/97
ccggccacccacauggcggccc

SEQ ID NO: 3214991 - RNA, 13 nt, Mycobacterium bovis subsp bovis AF2122/97
ccggccacccgcg

SEQ ID NO: 3214992 - RNA, 18 nt, Mycobacterium bovis subsp bovis AF2122/97
ccggccaccgagucgauc

SEQ ID NO: 3214993 - RNA, 18 nt, Mycobacterium bovis subsp bovis AF2122/97
ccggccaccucggugcgg

SEQ ID NO: 3214994 - RNA, 13 nt, Mycobacterium bovis subsp bovis AF2122/97
ccggccacgaccu

SEQ ID NO: 3214995 - RNA, 17 nt, Mycobacterium bovis subsp bovis AF2122/97
ccggccacgaccucggg

SEQ ID NO: 3214996 - RNA, 17 nt, Mycobacterium bovis subsp bovis AF2122/97
ccggccacuacggccug

SEQ ID NO: 3214997 - RNA, 22 nt, Mycobacterium bovis subsp bovis AF2122/97
ccggcccggguaucgccagugg

SEQ ID NO: 3214998 - RNA, 23 nt, Mycobacterium bovis subsp bovis AF2122/97
ccggcccggguaucgccaguggu

SEQ ID NO: 3214999 - RNA, 13 nt, Mycobacterium bovis subsp bovis AF2122/97
ccggcccggugau

SEQ ID NO: 3215000 - RNA, 14 nt, Mycobacterium bovis subsp bovis AF2122/97
ccggcccggugaug

SEQ ID NO: 3215001 - RNA, 23 nt, Mycobacterium bovis subsp bovis AF2122/97
ccggcccguagcguccgcgcccg

SEQ ID NO: 3215002 - RNA, 20 nt, Mycobacterium bovis subsp bovis AF2122/97
ccggcccguagcugcgcagc

SEQ ID NO: 3215003 - RNA, 14 nt, Mycobacterium bovis subsp bovis AF2122/97
ccggcccuccgggc

SEQ ID NO: 3215004 - RNA, 16 nt, Mycobacterium bovis subsp bovis AF2122/97
ccggcccuccgggccc

SEQ ID NO: 3215005 - RNA, 23 nt, Mycobacterium bovis subsp bovis AF2122/97
ccggcccucgccagagucggaga

SEQ ID NO: 3215006 - RNA, 18 nt, Mycobacterium bovis subsp bovis AF2122/97
ccggcccugagcugccga

SEQ ID NO: 3215007 - RNA, 22 nt, Mycobacterium bovis subsp bovis AF2122/97
ccggcccugagcugccgagcgg

SEQ ID NO: 3215008 - RNA, 23 nt, Mycobacterium bovis subsp bovis AF2122/97
ccggcccugagcugccgagcggu

SEQ ID NO: 3215009 - RNA, 15 nt, Mycobacterium bovis subsp bovis AF2122/97
ccggcccugccgccg

SEQ ID NO: 3215010 - RNA, 17 nt, Mycobacterium bovis subsp bovis AF2122/97
ccggcccugccgccggc

SEQ ID NO: 3215011 - RNA, 19 nt, Mycobacterium bovis subsp bovis AF2122/97
ccggcccugccgccggccc

SEQ ID NO: 3215012 - RNA, 13 nt, Mycobacterium bovis subsp bovis AF2122/97
ccggcccugcggc

SEQ ID NO: 3215013 - RNA, 21 nt, Mycobacterium bovis subsp bovis AF2122/97
ccggccgaacgccucgccggc

SEQ ID NO: 3215014 - RNA, 14 nt, Mycobacterium bovis subsp bovis AF2122/97
ccggccgacacgcc

SEQ ID NO: 3215015 - RNA, 15 nt, Mycobacterium bovis subsp bovis AF2122/97
ccggccgacacgccg

SEQ ID NO: 3215016 - RNA, 14 nt, Mycobacterium bovis subsp bovis AF2122/97
ccggccgacccgga

SEQ ID NO: 3215017 - RNA, 13 nt, Mycobacterium bovis subsp bovis AF2122/97
ccggccgacgaac

SEQ ID NO: 3215018 - RNA, 15 nt, Mycobacterium bovis subsp bovis AF2122/97
ccggccgacgcuggc

SEQ ID NO: 3215019 - RNA, 16 nt, Mycobacterium bovis subsp bovis AF2122/97
ccggccgacgcuggcg

SEQ ID NO: 3215020 - RNA, 17 nt, Mycobacterium bovis subsp bovis AF2122/97
ccggccgacgugacaac

SEQ ID NO: 3215021 - RNA, 16 nt, Mycobacterium bovis subsp bovis AF2122/97
ccggccgagcgcacug

SEQ ID NO: 3215022 - RNA, 21 nt, Mycobacterium bovis subsp bovis AF2122/97
ccggccgaguaccagcccacc

SEQ ID NO: 3215023 - RNA, 17 nt, Mycobacterium bovis subsp bovis AF2122/97
ccggccgaugcgacccg

SEQ ID NO: 3215024 - RNA, 14 nt, Mycobacterium bovis subsp bovis AF2122/97
ccggccgcacgccg

SEQ ID NO: 3215025 - RNA, 21 nt, Mycobacterium bovis subsp bovis AF2122/97
ccggccgccaacuccagcacc

SEQ ID NO: 3215026 - RNA, 15 nt, Mycobacterium bovis subsp bovis AF2122/97
ccggccgccaucauc

SEQ ID NO: 3215027 - RNA, 13 nt, Mycobacterium bovis subsp bovis AF2122/97
ccggccgcccgcu

SEQ ID NO: 3215028 - RNA, 14 nt, Mycobacterium bovis subsp bovis AF2122/97
ccggccgcccgcuc

SEQ ID NO: 3215029 - RNA, 11 nt, Mycobacterium bovis subsp bovis AF2122/97
ccggccgccga

SEQ ID NO: 3215030 - RNA, 13 nt, Mycobacterium bovis subsp bovis AF2122/97
ccggccgccgaaa

SEQ ID NO: 3215031 - RNA, 15 nt, Mycobacterium bovis subsp bovis AF2122/97
ccggccgccgacagg

SEQ ID NO: 3215032 - RNA, 13 nt, Mycobacterium bovis subsp bovis AF2122/97
ccggccgccgaga

SEQ ID NO: 3215033 - RNA, 22 nt, Mycobacterium bovis subsp bovis AF2122/97
ccggccgccgcgggacaccacc

SEQ ID NO: 3215034 - RNA, 16 nt, Mycobacterium bovis subsp bovis AF2122/97
ccggccgcgaccgcga

SEQ ID NO: 3215035 - RNA, 12 nt, Mycobacterium bovis subsp bovis AF2122/97
ccggccgcgacg

SEQ ID NO: 3215036 - RNA, 16 nt, Mycobacterium bovis subsp bovis AF2122/97
ccggccgcgacgacac

SEQ ID NO: 3215037 - RNA, 13 nt, Mycobacterium bovis subsp bovis AF2122/97
ccggccgcgaucc

SEQ ID NO: 3215038 - RNA, 13 nt, Mycobacterium bovis subsp bovis AF2122/97
ccggccgcgcacc

SEQ ID NO: 3215039 - RNA, 23 nt, Mycobacterium bovis subsp bovis AF2122/97
ccggccgcgcacccguccgccgc

SEQ ID NO: 3215040 - RNA, 14 nt, Mycobacterium bovis subsp bovis AF2122/97
ccggccgcgcagau

SEQ ID NO: 3215041 - RNA, 12 nt, Mycobacterium bovis subsp bovis AF2122/97
ccggccgcgccc

SEQ ID NO: 3215042 - RNA, 13 nt, Mycobacterium bovis subsp bovis AF2122/97
ccggccgcgccgg

SEQ ID NO: 3215043 - RNA, 16 nt, Mycobacterium bovis subsp bovis AF2122/97
ccggccgcgccggccc

SEQ ID NO: 3215044 - RNA, 11 nt, Mycobacterium bovis subsp bovis AF2122/97
ccggccgcgcg

SEQ ID NO: 3215045 - RNA, 12 nt, Mycobacterium bovis subsp bovis AF2122/97
ccggccgcgcgc

SEQ ID NO: 3215046 - RNA, 15 nt, Mycobacterium bovis subsp bovis AF2122/97
ccggccgcggcggcc

SEQ ID NO: 3215047 - RNA, 18 nt, Mycobacterium bovis subsp bovis AF2122/97
ccggccgcggcggccccg

SEQ ID NO: 3215048 - RNA, 14 nt, Mycobacterium bovis subsp bovis AF2122/97
ccggccgcgucacg

SEQ ID NO: 3215049 - RNA, 14 nt, Mycobacterium bovis subsp bovis AF2122/97
ccggccgcgugacg

SEQ ID NO: 3215050 - RNA, 15 nt, Mycobacterium bovis subsp bovis AF2122/97
ccggccgcguugggg

SEQ ID NO: 3215051 - RNA, 17 nt, Mycobacterium bovis subsp bovis AF2122/97
ccggccgcuauggcccg

SEQ ID NO: 3215052 - RNA, 15 nt, Mycobacterium bovis subsp bovis AF2122/97
ccggccgcucacccc

SEQ ID NO: 3215053 - RNA, 19 nt, Mycobacterium bovis subsp bovis AF2122/97
ccggccggacgggugcggg

SEQ ID NO: 3215054 - RNA, 18 nt, Mycobacterium bovis subsp bovis AF2122/97
ccggccggaguccgucgg

SEQ ID NO: 3215055 - RNA, 13 nt, Mycobacterium bovis subsp bovis AF2122/97
ccggccggcagga

SEQ ID NO: 3215056 - RNA, 14 nt, Mycobacterium bovis subsp bovis AF2122/97
ccggccggcauccg

SEQ ID NO: 3215057 - RNA, 15 nt, Mycobacterium bovis subsp bovis AF2122/97
ccggccggcccgggu

SEQ ID NO: 3215058 - RNA, 15 nt, Mycobacterium bovis subsp bovis AF2122/97
ccggccggccuagcc

SEQ ID NO: 3215059 - RNA, 14 nt, Mycobacterium bovis subsp bovis AF2122/97
ccggccggcgggcc

SEQ ID NO: 3215060 - RNA, 17 nt, Mycobacterium bovis subsp bovis AF2122/97
ccggccggcgggccugc

SEQ ID NO: 3215061 - RNA, 21 nt, Mycobacterium bovis subsp bovis AF2122/97
ccggccggcgggccugcccgg

SEQ ID NO: 3215062 - RNA, 12 nt, Mycobacterium bovis subsp bovis AF2122/97
ccggccgggccu

SEQ ID NO: 3215063 - RNA, 21 nt, Mycobacterium bovis subsp bovis AF2122/97
ccggccggguguagcucggac

SEQ ID NO: 3215064 - RNA, 23 nt, Mycobacterium bovis subsp bovis AF2122/97
ccggccggguguagcucggaccc

SEQ ID NO: 3215065 - RNA, 19 nt, Mycobacterium bovis subsp bovis AF2122/97
ccggccgguaguagcugac

SEQ ID NO: 3215066 - RNA, 13 nt, Mycobacterium bovis subsp bovis AF2122/97
ccggccgguggcc

SEQ ID NO: 3215067 - RNA, 17 nt, Mycobacterium bovis subsp bovis AF2122/97
ccggccgguggccagca

SEQ ID NO: 3215068 - RNA, 22 nt, Mycobacterium bovis subsp bovis AF2122/97
ccggccgguggccagcacgugc

SEQ ID NO: 3215069 - RNA, 22 nt, Mycobacterium bovis subsp bovis AF2122/97
ccggccgguucuuggcguugau

SEQ ID NO: 3215070 - RNA, 12 nt, Mycobacterium bovis subsp bovis AF2122/97
ccggccgguugg

SEQ ID NO: 3215071 - RNA, 20 nt, Mycobacterium bovis subsp bovis AF2122/97
ccggccgguuggccagccac

SEQ ID NO: 3215072 - RNA, 23 nt, Mycobacterium bovis subsp bovis AF2122/97
ccggccgguuggccagccacagc

SEQ ID NO: 3215073 - RNA, 15 nt, Mycobacterium bovis subsp bovis AF2122/97
ccggccgucaucugg

SEQ ID NO: 3215074 - RNA, 14 nt, Mycobacterium bovis subsp bovis AF2122/97
ccggccgucccgcg

SEQ ID NO: 3215075 - RNA, 20 nt, Mycobacterium bovis subsp bovis AF2122/97
ccggccgucccgcgagcagc

SEQ ID NO: 3215076 - RNA, 20 nt, Mycobacterium bovis subsp bovis AF2122/97
ccggccgucgacgcaugggu

SEQ ID NO: 3215077 - RNA, 14 nt, Mycobacterium bovis subsp bovis AF2122/97
ccggccgucgaucu

SEQ ID NO: 3215078 - RNA, 15 nt, Mycobacterium bovis subsp bovis AF2122/97
ccggccgucgccggg

SEQ ID NO: 3215079 - RNA, 20 nt, Mycobacterium bovis subsp bovis AF2122/97
ccggccgugccgccgacacc

SEQ ID NO: 3215080 - RNA, 17 nt, Mycobacterium bovis subsp bovis AF2122/97
ccggccguugggccacc

SEQ ID NO: 3215081 - RNA, 20 nt, Mycobacterium bovis subsp bovis AF2122/97
ccggccguugggccaccggc

SEQ ID NO: 3215082 - RNA, 20 nt, Mycobacterium bovis subsp bovis AF2122/97
ccggccuaccgagcuacgac

SEQ ID NO: 3215083 - RNA, 18 nt, Mycobacterium bovis subsp bovis AF2122/97
ccggccucaacacccggc

SEQ ID NO: 3215084 - RNA, 17 nt, Mycobacterium bovis subsp bovis AF2122/97
ccggcgcagcgaccggu

SEQ ID NO: 3215085 - RNA, 22 nt, Mycobacterium bovis subsp bovis AF2122/97
ccggcgcagguucucggugccg

SEQ ID NO: 3215086 - RNA, 23 nt, Mycobacterium bovis subsp bovis AF2122/97
ccggcgcagguucucggugccga

SEQ ID NO: 3215087 - RNA, 18 nt, Mycobacterium bovis subsp bovis AF2122/97
ccggcgcaguagccgacc

SEQ ID NO: 3215088 - RNA, 14 nt, Mycobacterium bovis subsp bovis AF2122/97
ccggcgcagugcag

SEQ ID NO: 3215089 - RNA, 18 nt, Mycobacterium bovis subsp bovis AF2122/97
ccggcgcagugcgacucu

SEQ ID NO: 3215090 - RNA, 24 nt, Mycobacterium bovis subsp bovis AF2122/97
ccggcgcagugcgacucugcgucu

SEQ ID NO: 3215091 - RNA, 19 nt, Mycobacterium bovis subsp bovis AF2122/97
ccggcgcauaccggcgucg

SEQ ID NO: 3215092 - RNA, 16 nt, Mycobacterium bovis subsp bovis AF2122/97
ccggcgccacccccac

SEQ ID NO: 3215093 - RNA, 21 nt, Mycobacterium bovis subsp bovis AF2122/97
ccggcgccacccccaccgucg

SEQ ID NO: 3215094 - RNA, 22 nt, Mycobacterium bovis subsp bovis AF2122/97
ccggcgccacccccaccgucgc

SEQ ID NO: 3215095 - RNA, 24 nt, Mycobacterium bovis subsp bovis AF2122/97
ccggcgccacccccaccgucgcgg

SEQ ID NO: 3215096 - RNA, 14 nt, Mycobacterium bovis subsp bovis AF2122/97
ccggcgccacccgc

SEQ ID NO: 3215097 - RNA, 18 nt, Mycobacterium bovis subsp bovis AF2122/97
ccggcgccacccgcgccg

SEQ ID NO: 3215098 - RNA, 19 nt, Mycobacterium bovis subsp bovis AF2122/97
ccggcgccacccgcgccgc

SEQ ID NO: 3215099 - RNA, 23 nt, Mycobacterium bovis subsp bovis AF2122/97
ccggcgccacccgcgccgcccgc

SEQ ID NO: 3215100 - RNA, 14 nt, Mycobacterium bovis subsp bovis AF2122/97
ccggcgccaccgcc

SEQ ID NO: 3215101 - RNA, 15 nt, Mycobacterium bovis subsp bovis AF2122/97
ccggcgccaccgccg

SEQ ID NO: 3215102 - RNA, 20 nt, Mycobacterium bovis subsp bovis AF2122/97
ccggcgccaccggcgccgcc

SEQ ID NO: 3215103 - RNA, 21 nt, Mycobacterium bovis subsp bovis AF2122/97
ccggcgccaccggcgccgccc

SEQ ID NO: 3215104 - RNA, 15 nt, Mycobacterium bovis subsp bovis AF2122/97
ccggcgccaccgucg

SEQ ID NO: 3215105 - RNA, 15 nt, Mycobacterium bovis subsp bovis AF2122/97
ccggcgccagcgccg

SEQ ID NO: 3215106 - RNA, 17 nt, Mycobacterium bovis subsp bovis AF2122/97
ccggcgccagcgccgcc

SEQ ID NO: 3215107 - RNA, 18 nt, Mycobacterium bovis subsp bovis AF2122/97
ccggcgccagcgccgcca

SEQ ID NO: 3215108 - RNA, 21 nt, Mycobacterium bovis subsp bovis AF2122/97
ccggcgccagcgccgccaccg

SEQ ID NO: 3215109 - RNA, 15 nt, Mycobacterium bovis subsp bovis AF2122/97
ccggcgccaggaucg

SEQ ID NO: 3215110 - RNA, 16 nt, Mycobacterium bovis subsp bovis AF2122/97
ccggcgccaucggguc

SEQ ID NO: 3215111 - RNA, 22 nt, Mycobacterium bovis subsp bovis AF2122/97
ccggcgccaucgggucaccccc

SEQ ID NO: 3215112 - RNA, 22 nt, Mycobacterium bovis subsp bovis AF2122/97
ccggcgcccacaucgucggcgg

SEQ ID NO: 3215113 - RNA, 13 nt, Mycobacterium bovis subsp bovis AF2122/97
ccggcgcccagcg

SEQ ID NO: 3215114 - RNA, 17 nt, Mycobacterium bovis subsp bovis AF2122/97
ccggcgcccagcgccuc

SEQ ID NO: 3215115 - RNA, 15 nt, Mycobacterium bovis subsp bovis AF2122/97
ccggcgcccaggccg

SEQ ID NO: 3215116 - RNA, 16 nt, Mycobacterium bovis subsp bovis AF2122/97
ccggcgcccaggccga

SEQ ID NO: 3215117 - RNA, 13 nt, Mycobacterium bovis subsp bovis AF2122/97
ccggcgcccgccg

SEQ ID NO: 3215118 - RNA, 14 nt, Mycobacterium bovis subsp bovis AF2122/97
ccggcgcccgccgc

SEQ ID NO: 3215119 - RNA, 16 nt, Mycobacterium bovis subsp bovis AF2122/97
ccggcgcccggggcgg

SEQ ID NO: 3215120 - RNA, 19 nt, Mycobacterium bovis subsp bovis AF2122/97
ccggcgcccggggcggugg

SEQ ID NO: 3215121 - RNA, 23 nt, Mycobacterium bovis subsp bovis AF2122/97
ccggcgcccggggcggugggcgc

SEQ ID NO: 3215122 - RNA, 13 nt, Mycobacterium bovis subsp bovis AF2122/97
ccggcgccgcacc

SEQ ID NO: 3215123 - RNA, 17 nt, Mycobacterium bovis subsp bovis AF2122/97
ccggcgccgcaccaagc

SEQ ID NO: 3215124 - RNA, 12 nt, Mycobacterium bovis subsp bovis AF2122/97
ccggcgccgcca

SEQ ID NO: 3215125 - RNA, 13 nt, Mycobacterium bovis subsp bovis AF2122/97
ccggcgccgccac

SEQ ID NO: 3215126 - RNA, 16 nt, Mycobacterium bovis subsp bovis AF2122/97
ccggcgccgccacugc

SEQ ID NO: 3215127 - RNA, 18 nt, Mycobacterium bovis subsp bovis AF2122/97
ccggcgccgccacugccg

SEQ ID NO: 3215128 - RNA, 20 nt, Mycobacterium bovis subsp bovis AF2122/97
ccggcgccgccacugccggc

SEQ ID NO: 3215129 - RNA, 21 nt, Mycobacterium bovis subsp bovis AF2122/97
ccggcgccgccacugccggca

SEQ ID NO: 3215130 - RNA, 13 nt, Mycobacterium bovis subsp bovis AF2122/97
ccggcgccgccag

SEQ ID NO: 3215131 - RNA, 14 nt, Mycobacterium bovis subsp bovis AF2122/97
ccggcgccgccagc

SEQ ID NO: 3215132 - RNA, 18 nt, Mycobacterium bovis subsp bovis AF2122/97
ccggcgccgccagcacca

SEQ ID NO: 3215133 - RNA, 20 nt, Mycobacterium bovis subsp bovis AF2122/97
ccggcgccgccauugucgcc

SEQ ID NO: 3215134 - RNA, 21 nt, Mycobacterium bovis subsp bovis AF2122/97
ccggcgccgcccgcgccacca

SEQ ID NO: 3215135 - RNA, 12 nt, Mycobacterium bovis subsp bovis AF2122/97
ccggcgccgccg

SEQ ID NO: 3215136 - RNA, 24 nt, Mycobacterium bovis subsp bovis AF2122/97
ccggcgccgccgaugccgaugccc

SEQ ID NO: 3215137 - RNA, 13 nt, Mycobacterium bovis subsp bovis AF2122/97
ccggcgccgccgg

SEQ ID NO: 3215138 - RNA, 14 nt, Mycobacterium bovis subsp bovis AF2122/97
ccggcgccgccggc

SEQ ID NO: 3215139 - RNA, 17 nt, Mycobacterium bovis subsp bovis AF2122/97
ccggcgccgccggcacc

SEQ ID NO: 3215140 - RNA, 20 nt, Mycobacterium bovis subsp bovis AF2122/97
ccggcgccgccggcaccggg

SEQ ID NO: 3215141 - RNA, 19 nt, Mycobacterium bovis subsp bovis AF2122/97
ccggcgccgccggcgccgc

SEQ ID NO: 3215142 - RNA, 21 nt, Mycobacterium bovis subsp bovis AF2122/97
ccggcgccgccggcgccgccc

SEQ ID NO: 3215143 - RNA, 15 nt, Mycobacterium bovis subsp bovis AF2122/97
ccggcgccgccgucg

SEQ ID NO: 3215144 - RNA, 18 nt, Mycobacterium bovis subsp bovis AF2122/97
ccggcgccgccgucgccg

SEQ ID NO: 3215145 - RNA, 19 nt, Mycobacterium bovis subsp bovis AF2122/97
ccggcgccgccgucgccgc

SEQ ID NO: 3215146 - RNA, 17 nt, Mycobacterium bovis subsp bovis AF2122/97
ccggcgccgccgugcgg

SEQ ID NO: 3215147 - RNA, 17 nt, Mycobacterium bovis subsp bovis AF2122/97
ccggcgccgccguuacc

SEQ ID NO: 3215148 - RNA, 23 nt, Mycobacterium bovis subsp bovis AF2122/97
ccggcgccgccguuaccgccggc

SEQ ID NO: 3215149 - RNA, 16 nt, Mycobacterium bovis subsp bovis AF2122/97
ccggcgccgccguucc

SEQ ID NO: 3215150 - RNA, 16 nt, Mycobacterium bovis subsp bovis AF2122/97
ccggcgccgccguugc

SEQ ID NO: 3215151 - RNA, 12 nt, Mycobacterium bovis subsp bovis AF2122/97
ccggcgccgcgc

SEQ ID NO: 3215152 - RNA, 14 nt, Mycobacterium bovis subsp bovis AF2122/97
ccggcgccgcgcgg

SEQ ID NO: 3215153 - RNA, 16 nt, Mycobacterium bovis subsp bovis AF2122/97
ccggcgccgcgcggcu

SEQ ID NO: 3215154 - RNA, 14 nt, Mycobacterium bovis subsp bovis AF2122/97
ccggcgccgcgggu

SEQ ID NO: 3215155 - RNA, 13 nt, Mycobacterium bovis subsp bovis AF2122/97
ccggcgccggcgc

SEQ ID NO: 3215156 - RNA, 17 nt, Mycobacterium bovis subsp bovis AF2122/97
ccggcgccggcgcugcu

SEQ ID NO: 3215157 - RNA, 14 nt, Mycobacterium bovis subsp bovis AF2122/97
ccggcgccgggucg

SEQ ID NO: 3215158 - RNA, 16 nt, Mycobacterium bovis subsp bovis AF2122/97
ccggcgccggugccgc

SEQ ID NO: 3215159 - RNA, 17 nt, Mycobacterium bovis subsp bovis AF2122/97
ccggcgccggugccgcc

SEQ ID NO: 3215160 - RNA, 13 nt, Mycobacterium bovis subsp bovis AF2122/97
ccggcgccguagc

SEQ ID NO: 3215161 - RNA, 12 nt, Mycobacterium bovis subsp bovis AF2122/97
ccggcgccgucg

SEQ ID NO: 3215162 - RNA, 22 nt, Mycobacterium bovis subsp bovis AF2122/97
ccggcgccgucgaugaccagca

SEQ ID NO: 3215163 - RNA, 18 nt, Mycobacterium bovis subsp bovis AF2122/97
ccggcgccucaucggaca

SEQ ID NO: 3215164 - RNA, 23 nt, Mycobacterium bovis subsp bovis AF2122/97
ccggcgccucaucggacagcgcc

SEQ ID NO: 3215165 - RNA, 14 nt, Mycobacterium bovis subsp bovis AF2122/97
ccggcgccuccggc

SEQ ID NO: 3215166 - RNA, 14 nt, Mycobacterium bovis subsp bovis AF2122/97
ccggcgccuugguc

SEQ ID NO: 3215167 - RNA, 15 nt, Mycobacterium bovis subsp bovis AF2122/97
ccggcgccuuggucg

SEQ ID NO: 3215168 - RNA, 19 nt, Mycobacterium bovis subsp bovis AF2122/97
ccggcgccuuggucgccgc

SEQ ID NO: 3215169 - RNA, 17 nt, Mycobacterium bovis subsp bovis AF2122/97
ccggcgcgaccgcggcg

SEQ ID NO: 3215170 - RNA, 14 nt, Mycobacterium bovis subsp bovis AF2122/97
ccggcgcgacgccc

SEQ ID NO: 3215171 - RNA, 12 nt, Mycobacterium bovis subsp bovis AF2122/97
ccggcggcggcc

SEQ ID NO: 3215172 - RNA, 15 nt, Mycobacterium bovis subsp bovis AF2122/97
ccggcggcggccagg

SEQ ID NO: 3215173 - RNA, 21 nt, Mycobacterium bovis subsp bovis AF2122/97
ccggcggcggcgcucggccau

SEQ ID NO: 3215174 - RNA, 23 nt, Mycobacterium bovis subsp bovis AF2122/97
ccggcggcggcggcccguuugcc

SEQ ID NO: 3215175 - RNA, 14 nt, Mycobacterium bovis subsp bovis AF2122/97
ccggcggcgguacc

SEQ ID NO: 3215176 - RNA, 14 nt, Mycobacterium bovis subsp bovis AF2122/97
ccggcggcggucug

SEQ ID NO: 3215177 - RNA, 19 nt, Mycobacterium bovis subsp bovis AF2122/97
ccggcggcggugcgccccg

SEQ ID NO: 3215178 - RNA, 19 nt, Mycobacterium bovis subsp bovis AF2122/97
ccggcggcguccaucgcgc

SEQ ID NO: 3215179 - RNA, 23 nt, Mycobacterium bovis subsp bovis AF2122/97
ccggcggcguccaucgcgcgccg

SEQ ID NO: 3215180 - RNA, 23 nt, Mycobacterium bovis subsp bovis AF2122/97
ccggcggcucgggugcgcccggc

SEQ ID NO: 3215181 - RNA, 13 nt, Mycobacterium bovis subsp bovis AF2122/97
ccggcggcuucgc

SEQ ID NO: 3215182 - RNA, 18 nt, Mycobacterium bovis subsp bovis AF2122/97
ccggcgggaugcgcgccc

SEQ ID NO: 3215183 - RNA, 20 nt, Mycobacterium bovis subsp bovis AF2122/97
ccggcgggaugcgcgcccga

SEQ ID NO: 3215184 - RNA, 22 nt, Mycobacterium bovis subsp bovis AF2122/97
ccggcgggaugcgcgcccgacg

SEQ ID NO: 3215185 - RNA, 18 nt, Mycobacterium bovis subsp bovis AF2122/97
ccggcgggcacaccgcac

SEQ ID NO: 3215186 - RNA, 19 nt, Mycobacterium bovis subsp bovis AF2122/97
ccggcgggcacaccgcacc

SEQ ID NO: 3215187 - RNA, 23 nt, Mycobacterium bovis subsp bovis AF2122/97
ccggcgggcacaccgcaccuggg

SEQ ID NO: 3215188 - RNA, 13 nt, Mycobacterium bovis subsp bovis AF2122/97
ccggcgggcccgc

SEQ ID NO: 3215189 - RNA, 14 nt, Mycobacterium bovis subsp bovis AF2122/97
ccggcgggcccgcc

SEQ ID NO: 3215190 - RNA, 15 nt, Mycobacterium bovis subsp bovis AF2122/97
ccggcgggcccgccg

SEQ ID NO: 3215191 - RNA, 17 nt, Mycobacterium bovis subsp bovis AF2122/97
ccggcgggcccgccggc

SEQ ID NO: 3215192 - RNA, 19 nt, Mycobacterium bovis subsp bovis AF2122/97
ccggcgggcccgccggccc

SEQ ID NO: 3215193 - RNA, 21 nt, Mycobacterium bovis subsp bovis AF2122/97
ccggcgggcccgccggccccg

SEQ ID NO: 3215194 - RNA, 14 nt, Mycobacterium bovis subsp bovis AF2122/97
ccggcgggcggugg

SEQ ID NO: 3215195 - RNA, 19 nt, Mycobacterium bovis subsp bovis AF2122/97
ccggcgggcggugggcagc

SEQ ID NO: 3215196 - RNA, 23 nt, Mycobacterium bovis subsp bovis AF2122/97
ccggcgggcggugggcagcagcu

SEQ ID NO: 3215197 - RNA, 14 nt, Mycobacterium bovis subsp bovis AF2122/97
ccggcgggcucgcc

SEQ ID NO: 3215198 - RNA, 20 nt, Mycobacterium bovis subsp bovis AF2122/97
ccggcgggcucgcccgcuac

SEQ ID NO: 3215199 - RNA, 14 nt, Mycobacterium bovis subsp bovis AF2122/97
ccggcgggugccga

SEQ ID NO: 3215200 - RNA, 17 nt, Mycobacterium bovis subsp bovis AF2122/97
ccggcgggugccgagcu

SEQ ID NO: 3215201 - RNA, 19 nt, Mycobacterium bovis subsp bovis AF2122/97
ccggcgggugccgagcugg

SEQ ID NO: 3215202 - RNA, 20 nt, Mycobacterium bovis subsp bovis AF2122/97
ccggcgggugccgagcuggc

SEQ ID NO: 3215203 - RNA, 20 nt, Mycobacterium bovis subsp bovis AF2122/97
ccggcggguggcccccgccg

SEQ ID NO: 3215204 - RNA, 21 nt, Mycobacterium bovis subsp bovis AF2122/97
ccggcggguuugcccaucccc

SEQ ID NO: 3215205 - RNA, 15 nt, Mycobacterium bovis subsp bovis AF2122/97
ccggcgguagucggc

SEQ ID NO: 3215206 - RNA, 17 nt, Mycobacterium bovis subsp bovis AF2122/97
ccggcgguagucggcca

SEQ ID NO: 3215207 - RNA, 19 nt, Mycobacterium bovis subsp bovis AF2122/97
ccggcgguagucggccagc

SEQ ID NO: 3215208 - RNA, 17 nt, Mycobacterium bovis subsp bovis AF2122/97
ccggcggucagcagcgc

SEQ ID NO: 3215209 - RNA, 20 nt, Mycobacterium bovis subsp bovis AF2122/97
ccggcggucgggcccggcga

SEQ ID NO: 3215210 - RNA, 18 nt, Mycobacterium bovis subsp bovis AF2122/97
ccggcggucugcagugca

SEQ ID NO: 3215211 - RNA, 17 nt, Mycobacterium bovis subsp bovis AF2122/97
ccggcggugacggcggc

SEQ ID NO: 3215212 - RNA, 23 nt, Mycobacterium bovis subsp bovis AF2122/97
ccggcggugacggcggcaacggc

SEQ ID NO: 3215213 - RNA, 17 nt, Mycobacterium bovis subsp bovis AF2122/97
ccggcggugccgucagc

SEQ ID NO: 3215214 - RNA, 19 nt, Mycobacterium bovis subsp bovis AF2122/97
ccggcggugccgucagcgg

SEQ ID NO: 3215215 - RNA, 17 nt, Mycobacterium bovis subsp bovis AF2122/97
ccggcggugccgucgcc

SEQ ID NO: 3215216 - RNA, 19 nt, Mycobacterium bovis subsp bovis AF2122/97
ccggcggugccgucgccgc

SEQ ID NO: 3215217 - RNA, 21 nt, Mycobacterium bovis subsp bovis AF2122/97
ccggcggugccgucgccgccc

SEQ ID NO: 3215218 - RNA, 17 nt, Mycobacterium bovis subsp bovis AF2122/97
ccggcgguggggccggc

SEQ ID NO: 3215219 - RNA, 20 nt, Mycobacterium bovis subsp bovis AF2122/97
ccggcgguggggccggcguc

SEQ ID NO: 3215220 - RNA, 13 nt, Mycobacterium bovis subsp bovis AF2122/97
ccggcgguggugu

SEQ ID NO: 3215221 - RNA, 12 nt, Mycobacterium bovis subsp bovis AF2122/97
ccggcgguguug

SEQ ID NO: 3215222 - RNA, 23 nt, Mycobacterium bovis subsp bovis AF2122/97
ccggcguaaccggcagcgguaag

SEQ ID NO: 3215223 - RNA, 19 nt, Mycobacterium bovis subsp bovis AF2122/97
ccggcguacucggugaucg

SEQ ID NO: 3215224 - RNA, 23 nt, Mycobacterium bovis subsp bovis AF2122/97
ccggcguacuucgacagcggcga

SEQ ID NO: 3215225 - RNA, 15 nt, Mycobacterium bovis subsp bovis AF2122/97
ccggcguagcggcga

SEQ ID NO: 3215226 - RNA, 17 nt, Mycobacterium bovis subsp bovis AF2122/97
ccggcguaggcaggauc

SEQ ID NO: 3215227 - RNA, 22 nt, Mycobacterium bovis subsp bovis AF2122/97
ccggcguaggcaggaucgccug

SEQ ID NO: 3215228 - RNA, 20 nt, Mycobacterium bovis subsp bovis AF2122/97
ccggcguauagcccguagcc

SEQ ID NO: 3215229 - RNA, 18 nt, Mycobacterium bovis subsp bovis AF2122/97
ccggcguauugcaccgcc

SEQ ID NO: 3215230 - RNA, 13 nt, Mycobacterium bovis subsp bovis AF2122/97
ccggcgucacggc

SEQ ID NO: 3215231 - RNA, 13 nt, Mycobacterium bovis subsp bovis AF2122/97
ccggcguccgacc

SEQ ID NO: 3215232 - RNA, 18 nt, Mycobacterium bovis subsp bovis AF2122/97
ccggcgucgaaggugacc

SEQ ID NO: 3215233 - RNA, 19 nt, Mycobacterium bovis subsp bovis AF2122/97
ccggcgucgaaggugacca

SEQ ID NO: 3215234 - RNA, 22 nt, Mycobacterium bovis subsp bovis AF2122/97
ccggcgucgaaggugaccaggc

SEQ ID NO: 3215235 - RNA, 13 nt, Mycobacterium bovis subsp bovis AF2122/97
ccggcgucgagcc

SEQ ID NO: 3215236 - RNA, 23 nt, Mycobacterium bovis subsp bovis AF2122/97
ccggcgucgaugacgacgccguc

SEQ ID NO: 3215237 - RNA, 15 nt, Mycobacterium bovis subsp bovis AF2122/97
ccggcgucgcugccu

SEQ ID NO: 3215238 - RNA, 23 nt, Mycobacterium bovis subsp bovis AF2122/97
ccggcgucgcuggccaggccggc

SEQ ID NO: 3215239 - RNA, 13 nt, Mycobacterium bovis subsp bovis AF2122/97
ccggcgucggcgc

SEQ ID NO: 3215240 - RNA, 15 nt, Mycobacterium bovis subsp bovis AF2122/97
ccggcgucggcgccc

SEQ ID NO: 3215241 - RNA, 16 nt, Mycobacterium bovis subsp bovis AF2122/97
ccggcgucggcgccca

SEQ ID NO: 3215242 - RNA, 18 nt, Mycobacterium bovis subsp bovis AF2122/97
ccggcgucggcgcccagc

SEQ ID NO: 3215243 - RNA, 19 nt, Mycobacterium bovis subsp bovis AF2122/97
ccggcgucggcgcccagcu

SEQ ID NO: 3215244 - RNA, 17 nt, Mycobacterium bovis subsp bovis AF2122/97
ccggcgucggcgcggcc

SEQ ID NO: 3215245 - RNA, 19 nt, Mycobacterium bovis subsp bovis AF2122/97
ccggcgucggcgcggccgu

SEQ ID NO: 3215246 - RNA, 21 nt, Mycobacterium bovis subsp bovis AF2122/97
ccggcgucguaggagccguca

SEQ ID NO: 3215247 - RNA, 21 nt, Mycobacterium bovis subsp bovis AF2122/97
ccggcgucgugaugggucacc

SEQ ID NO: 3215248 - RNA, 23 nt, Mycobacterium bovis subsp bovis AF2122/97
ccggcgucucgcagcaacggcgg

SEQ ID NO: 3215249 - RNA, 17 nt, Mycobacterium bovis subsp bovis AF2122/97
ccggcgucugcccgccc

SEQ ID NO: 3215250 - RNA, 20 nt, Mycobacterium bovis subsp bovis AF2122/97
ccggcgucugcccgcccagc

SEQ ID NO: 3215251 - RNA, 16 nt, Mycobacterium bovis subsp bovis AF2122/97
ccggcgugcagaaucc

SEQ ID NO: 3215252 - RNA, 13 nt, Mycobacterium bovis subsp bovis AF2122/97
ccggcgugcagua

SEQ ID NO: 3215253 - RNA, 13 nt, Mycobacterium bovis subsp bovis AF2122/97
ccggcgugcauga

SEQ ID NO: 3215254 - RNA, 23 nt, Mycobacterium bovis subsp bovis AF2122/97
ccggcgugcugugcucacgagca

SEQ ID NO: 3215255 - RNA, 22 nt, Mycobacterium bovis subsp bovis AF2122/97
ccggcguggauccguagaaggc

SEQ ID NO: 3215256 - RNA, 16 nt, Mycobacterium bovis subsp bovis AF2122/97
ccggcguggccccacc

SEQ ID NO: 3215257 - RNA, 18 nt, Mycobacterium bovis subsp bovis AF2122/97
ccggcugcaggugcuggu

SEQ ID NO: 3215258 - RNA, 12 nt, Mycobacterium bovis subsp bovis AF2122/97
ccggcugcaucc

SEQ ID NO: 3215259 - RNA, 17 nt, Mycobacterium bovis subsp bovis AF2122/97
ccggcugcauccuccuc

SEQ ID NO: 3215260 - RNA, 19 nt, Mycobacterium bovis subsp bovis AF2122/97
ccggcugcauccuccucgu

SEQ ID NO: 3215261 - RNA, 21 nt, Mycobacterium bovis subsp bovis AF2122/97
ccggcugcauccuccucgucg

SEQ ID NO: 3215262 - RNA, 13 nt, Mycobacterium bovis subsp bovis AF2122/97
ccggcugccacac

SEQ ID NO: 3215263 - RNA, 14 nt, Mycobacterium bovis subsp bovis AF2122/97
ccggcugccagcgc

SEQ ID NO: 3215264 - RNA, 16 nt, Mycobacterium bovis subsp bovis AF2122/97
ccggcugccagcgccg

SEQ ID NO: 3215265 - RNA, 17 nt, Mycobacterium bovis subsp bovis AF2122/97
ccggcugccagcgccgc

SEQ ID NO: 3215266 - RNA, 13 nt, Mycobacterium bovis subsp bovis AF2122/97
ccggcugccgcac

SEQ ID NO: 3215267 - RNA, 23 nt, Mycobacterium bovis subsp bovis AF2122/97
ccggcugccgcaccaaggccgcc

SEQ ID NO: 3215268 - RNA, 15 nt, Mycobacterium bovis subsp bovis AF2122/97
ccggcugccgucagc

SEQ ID NO: 3215269 - RNA, 23 nt, Mycobacterium bovis subsp bovis AF2122/97
ccggcugcgccaguaggcuucga

SEQ ID NO: 3215270 - RNA, 18 nt, Mycobacterium bovis subsp bovis AF2122/97
ccggcugcggggcgaucc

SEQ ID NO: 3215271 - RNA, 22 nt, Mycobacterium bovis subsp bovis AF2122/97
ccggcugcgguaaucgccaccg

SEQ ID NO: 3215272 - RNA, 23 nt, Mycobacterium bovis subsp bovis AF2122/97
ccggcugcgguaaucgccaccgc

SEQ ID NO: 3215273 - RNA, 14 nt, Mycobacterium bovis subsp bovis AF2122/97
ccggcuggccaggu

SEQ ID NO: 3215274 - RNA, 21 nt, Mycobacterium bovis subsp bovis AF2122/97
ccggcuggccagguggccgca

SEQ ID NO: 3215275 - RNA, 15 nt, Mycobacterium bovis subsp bovis AF2122/97
ccggcuggcccagcg

SEQ ID NO: 3215276 - RNA, 17 nt, Mycobacterium bovis subsp bovis AF2122/97
ccggcuggcccagcgac

SEQ ID NO: 3215277 - RNA, 13 nt, Mycobacterium bovis subsp bovis AF2122/97
ccggcuggcggcc

SEQ ID NO: 3215278 - RNA, 15 nt, Mycobacterium bovis subsp bovis AF2122/97
ccggcuggcggcgug

SEQ ID NO: 3215279 - RNA, 14 nt, Mycobacterium bovis subsp bovis AF2122/97
ccggcuggcuagca

SEQ ID NO: 3215280 - RNA, 15 nt, Mycobacterium bovis subsp bovis AF2122/97
ccggcuggggccgcu

SEQ ID NO: 3215281 - RNA, 18 nt, Mycobacterium bovis subsp bovis AF2122/97
ccggcuggucacccguau

SEQ ID NO: 3215282 - RNA, 21 nt, Mycobacterium bovis subsp bovis AF2122/97
ccggcuggugccaacugcgcc

SEQ ID NO: 3215283 - RNA, 23 nt, Mycobacterium bovis subsp bovis AF2122/97
ccggcuggugccuuaccaccguc

SEQ ID NO: 3215284 - RNA, 22 nt, Mycobacterium bovis subsp bovis AF2122/97
ccggcuggugggacgcggccga

SEQ ID NO: 3215285 - RNA, 13 nt, Mycobacterium bovis subsp bovis AF2122/97
ccggcugucgguc

SEQ ID NO: 3215286 - RNA, 17 nt, Mycobacterium bovis subsp bovis AF2122/97
ccggcugucggucaucc

SEQ ID NO: 3215287 - RNA, 21 nt, Mycobacterium bovis subsp bovis AF2122/97
ccggcugucggucauccggau

SEQ ID NO: 3215288 - RNA, 17 nt, Mycobacterium bovis subsp bovis AF2122/97
ccggcuguucucgccga

SEQ ID NO: 3215289 - RNA, 20 nt, Mycobacterium bovis subsp bovis AF2122/97
ccggcuguucucgccgaagc

SEQ ID NO: 3215290 - RNA, 19 nt, Mycobacterium bovis subsp bovis AF2122/97
ccggcuuaaggcccuggcc

SEQ ID NO: 3215291 - RNA, 21 nt, Mycobacterium bovis subsp bovis AF2122/97
ccggcuuaaggcccuggccgc

SEQ ID NO: 3215292 - RNA, 22 nt, Mycobacterium bovis subsp bovis AF2122/97
ccggcuuaaggcccuggccgcg

SEQ ID NO: 3215293 - RNA, 14 nt, Mycobacterium bovis subsp bovis AF2122/97
ccggcuuaccggcg

SEQ ID NO: 3215294 - RNA, 15 nt, Mycobacterium bovis subsp bovis AF2122/97
ccggcuuaccggcgg

SEQ ID NO: 3215295 - RNA, 18 nt, Mycobacterium bovis subsp bovis AF2122/97
ccggcuuaccggcgggcg

SEQ ID NO: 3215296 - RNA, 12 nt, Mycobacterium bovis subsp bovis AF2122/97
ccggcuucgccg

SEQ ID NO: 3215297 - RNA, 15 nt, Mycobacterium bovis subsp bovis AF2122/97
ccggcuucgccgcgc

SEQ ID NO: 3215298 - RNA, 16 nt, Mycobacterium bovis subsp bovis AF2122/97
ccggcuucgccgcgcu

SEQ ID NO: 3215299 - RNA, 15 nt, Mycobacterium bovis subsp bovis AF2122/97
ccggcuucggccagc

SEQ ID NO: 3215300 - RNA, 13 nt, Mycobacterium bovis subsp bovis AF2122/97
ccggcuucggcga

SEQ ID NO: 3215301 - RNA, 22 nt, Mycobacterium bovis subsp bovis AF2122/97
ccggcuucggcgaacccuccgc

SEQ ID NO: 3215302 - RNA, 18 nt, Mycobacterium bovis subsp bovis AF2122/97
ccggcuucguccaccgcg

SEQ ID NO: 3215303 - RNA, 15 nt, Mycobacterium bovis subsp bovis AF2122/97
ccggcuucgucggcc

SEQ ID NO: 3215304 - RNA, 18 nt, Mycobacterium bovis subsp bovis AF2122/97
ccggcuucgucggccagc

SEQ ID NO: 3215305 - RNA, 14 nt, Mycobacterium bovis subsp bovis AF2122/97
ccggcuuggcggcg

SEQ ID NO: 3215306 - RNA, 16 nt, Mycobacterium bovis subsp bovis AF2122/97
ccggcuuggcggcgau

SEQ ID NO: 3215307 - RNA, 20 nt, Mycobacterium bovis subsp bovis AF2122/97
ccggcuugggccaggcccag

SEQ ID NO: 3215308 - RNA, 21 nt, Mycobacterium bovis subsp bovis AF2122/97
ccggcuugggccaggcccagc

SEQ ID NO: 3215309 - RNA, 24 nt, Mycobacterium bovis subsp bovis AF2122/97
ccggcuugggcgguagccgacgac

SEQ ID NO: 3215310 - RNA, 14 nt, Mycobacterium bovis subsp bovis AF2122/97
ccggcuuggugaac

SEQ ID NO: 3215311 - RNA, 21 nt, Mycobacterium bovis subsp bovis AF2122/97
ccggcuuggugaaccgcgcgg

SEQ ID NO: 3215312 - RNA, 22 nt, Mycobacterium bovis subsp bovis AF2122/97
ccggcuuggugaaccgcgcggc

SEQ ID NO: 3215313 - RNA, 20 nt, Mycobacterium bovis subsp bovis AF2122/97
ccggcuugucgaccacgacc

SEQ ID NO: 3215314 - RNA, 18 nt, Mycobacterium bovis subsp bovis AF2122/97
ccggcuuucccaccgcuu

SEQ ID NO: 3215315 - RNA, 21 nt, Mycobacterium bovis subsp bovis AF2122/97
ccggcuuuuccacgaguccgc

SEQ ID NO: 3215316 - RNA, 23 nt, Mycobacterium bovis subsp bovis AF2122/97
ccggcuuuuccggcauugccgcc

SEQ ID NO: 3215317 - RNA, 19 nt, Mycobacterium bovis subsp bovis AF2122/97
ccggcuuuugcgcccagca

SEQ ID NO: 3215318 - RNA, 13 nt, Mycobacterium bovis subsp bovis AF2122/97
ccgggaaacaccg

SEQ ID NO: 3215319 - RNA, 14 nt, Mycobacterium bovis subsp bovis AF2122/97
ccgggaaacaccgg

SEQ ID NO: 3215320 - RNA, 15 nt, Mycobacterium bovis subsp bovis AF2122/97
ccgggaaacaccggc

SEQ ID NO: 3215321 - RNA, 21 nt, Mycobacterium bovis subsp bovis AF2122/97
ccgggaaacaccggcuuggug

SEQ ID NO: 3215322 - RNA, 22 nt, Mycobacterium bovis subsp bovis AF2122/97
ccgggaacaucccagcgaaugc

SEQ ID NO: 3215323 - RNA, 20 nt, Mycobacterium bovis subsp bovis AF2122/97
ccgggaaccacggucagcac

SEQ ID NO: 3215324 - RNA, 13 nt, Mycobacterium bovis subsp bovis AF2122/97
ccgggaacgaggu

SEQ ID NO: 3215325 - RNA, 20 nt, Mycobacterium bovis subsp bovis AF2122/97
ccgggaacgccucaggggcg

SEQ ID NO: 3215326 - RNA, 22 nt, Mycobacterium bovis subsp bovis AF2122/97
ccgggaacgccucaggggcgcc

SEQ ID NO: 3215327 - RNA, 16 nt, Mycobacterium bovis subsp bovis AF2122/97
ccgggaacgcugacgc

SEQ ID NO: 3215328 - RNA, 22 nt, Mycobacterium bovis subsp bovis AF2122/97
ccgggaagccccuuuugccgca

SEQ ID NO: 3215329 - RNA, 15 nt, Mycobacterium bovis subsp bovis AF2122/97
ccgggaaggaaccgg

SEQ ID NO: 3215330 - RNA, 21 nt, Mycobacterium bovis subsp bovis AF2122/97
ccgggaauggacaggucgggc

SEQ ID NO: 3215331 - RNA, 23 nt, Mycobacterium bovis subsp bovis AF2122/97
ccgggaauggacaggucgggcag

SEQ ID NO: 3215332 - RNA, 14 nt, Mycobacterium bovis subsp bovis AF2122/97
ccgggaauggcgac

SEQ ID NO: 3215333 - RNA, 16 nt, Mycobacterium bovis subsp bovis AF2122/97
ccgggaauuucgacac

SEQ ID NO: 3215334 - RNA, 20 nt, Mycobacterium bovis subsp bovis AF2122/97
ccgggacaaucucggccgca

SEQ ID NO: 3215335 - RNA, 22 nt, Mycobacterium bovis subsp bovis AF2122/97
ccgggaccaggccaacggcgcu

SEQ ID NO: 3215336 - RNA, 22 nt, Mycobacterium bovis subsp bovis AF2122/97
ccgggaccauagccugcgccga

SEQ ID NO: 3215337 - RNA, 21 nt, Mycobacterium bovis subsp bovis AF2122/97
ccgggaccauagucgccgucg

SEQ ID NO: 3215338 - RNA, 16 nt, Mycobacterium bovis subsp bovis AF2122/97
ccgggaccgccccggc

SEQ ID NO: 3215339 - RNA, 21 nt, Mycobacterium bovis subsp bovis AF2122/97
ccgggaccggugugcacgcgg

SEQ ID NO: 3215340 - RNA, 17 nt, Mycobacterium bovis subsp bovis AF2122/97
ccgggacgaaccggccg

SEQ ID NO: 3215341 - RNA, 17 nt, Mycobacterium bovis subsp bovis AF2122/97
ccgggacgaaucccgcg

SEQ ID NO: 3215342 - RNA, 23 nt, Mycobacterium bovis subsp bovis AF2122/97
ccgggacgaaucccgcgcccggc

SEQ ID NO: 3215343 - RNA, 21 nt, Mycobacterium bovis subsp bovis AF2122/97
ccgggccgagugcccagcgau

SEQ ID NO: 3215344 - RNA, 14 nt, Mycobacterium bovis subsp bovis AF2122/97
ccgggccgaucacc

SEQ ID NO: 3215345 - RNA, 21 nt, Mycobacterium bovis subsp bovis AF2122/97
ccgggccgaucaccccggugg

SEQ ID NO: 3215346 - RNA, 23 nt, Mycobacterium bovis subsp bovis AF2122/97
ccgggccgaucaccccgguggac

SEQ ID NO: 3215347 - RNA, 15 nt, Mycobacterium bovis subsp bovis AF2122/97
ccgggccgccagggc

SEQ ID NO: 3215348 - RNA, 16 nt, Mycobacterium bovis subsp bovis AF2122/97
ccgggccgccagggcc

SEQ ID NO: 3215349 - RNA, 12 nt, Mycobacterium bovis subsp bovis AF2122/97
ccgggccgccga

SEQ ID NO: 3215350 - RNA, 15 nt, Mycobacterium bovis subsp bovis AF2122/97
ccgggccgccgcgau

SEQ ID NO: 3215351 - RNA, 20 nt, Mycobacterium bovis subsp bovis AF2122/97
ccgggccgccgcgauggccc

SEQ ID NO: 3215352 - RNA, 20 nt, Mycobacterium bovis subsp bovis AF2122/97
ccgggccgccucgaucgacu

SEQ ID NO: 3215353 - RNA, 14 nt, Mycobacterium bovis subsp bovis AF2122/97
ccgggccgcggcca

SEQ ID NO: 3215354 - RNA, 15 nt, Mycobacterium bovis subsp bovis AF2122/97
ccgggccgcggcggc

SEQ ID NO: 3215355 - RNA, 16 nt, Mycobacterium bovis subsp bovis AF2122/97
ccgggccgcggcggcc

SEQ ID NO: 3215356 - RNA, 22 nt, Mycobacterium bovis subsp bovis AF2122/97
ccgggccgcggcggccagcgca

SEQ ID NO: 3215357 - RNA, 15 nt, Mycobacterium bovis subsp bovis AF2122/97
ccgggccgcguagug

SEQ ID NO: 3215358 - RNA, 12 nt, Mycobacterium bovis subsp bovis AF2122/97
ccgggccggcca

SEQ ID NO: 3215359 - RNA, 14 nt, Mycobacterium bovis subsp bovis AF2122/97
ccgggccggccacg

SEQ ID NO: 3215360 - RNA, 17 nt, Mycobacterium bovis subsp bovis AF2122/97
ccgggccggccacgucg

SEQ ID NO: 3215361 - RNA, 16 nt, Mycobacterium bovis subsp bovis AF2122/97
ccgggccguacggcgc

SEQ ID NO: 3215362 - RNA, 16 nt, Mycobacterium bovis subsp bovis AF2122/97
ccgggccguguccgcc

SEQ ID NO: 3215363 - RNA, 15 nt, Mycobacterium bovis subsp bovis AF2122/97
ccgggccucggcgcc

SEQ ID NO: 3215364 - RNA, 18 nt, Mycobacterium bovis subsp bovis AF2122/97
ccgggccugaaccacgcg

SEQ ID NO: 3215365 - RNA, 19 nt, Mycobacterium bovis subsp bovis AF2122/97
ccgggccugcaccacggcg

SEQ ID NO: 3215366 - RNA, 21 nt, Mycobacterium bovis subsp bovis AF2122/97
ccgggccugcaccacggcggc

SEQ ID NO: 3215367 - RNA, 17 nt, Mycobacterium bovis subsp bovis AF2122/97
ccgggcgaauccggcgg

SEQ ID NO: 3215368 - RNA, 20 nt, Mycobacterium bovis subsp bovis AF2122/97
ccgggcgaauccggcgggug

SEQ ID NO: 3215369 - RNA, 16 nt, Mycobacterium bovis subsp bovis AF2122/97
ccgggcgaccaccacc

SEQ ID NO: 3215370 - RNA, 17 nt, Mycobacterium bovis subsp bovis AF2122/97
ccgggcgaccaccaccg

SEQ ID NO: 3215371 - RNA, 19 nt, Mycobacterium bovis subsp bovis AF2122/97
ccgggcgaccaccaccgcc

SEQ ID NO: 3215372 - RNA, 20 nt, Mycobacterium bovis subsp bovis AF2122/97
ccgggcgaccaccaccgccg

SEQ ID NO: 3215373 - RNA, 19 nt, Mycobacterium bovis subsp bovis AF2122/97
ccgggcgaguacaggcgca

SEQ ID NO: 3215374 - RNA, 20 nt, Mycobacterium bovis subsp bovis AF2122/97
ccgggcgaguacaggcgcag

SEQ ID NO: 3215375 - RNA, 16 nt, Mycobacterium bovis subsp bovis AF2122/97
ccgggcgagucccggc

SEQ ID NO: 3215376 - RNA, 18 nt, Mycobacterium bovis subsp bovis AF2122/97
ccgggcgagucccggcgg

SEQ ID NO: 3215377 - RNA, 20 nt, Mycobacterium bovis subsp bovis AF2122/97
ccgggcgaucaaagccagca

SEQ ID NO: 3215378 - RNA, 17 nt, Mycobacterium bovis subsp bovis AF2122/97
ccgggcgaugcugggcg

SEQ ID NO: 3215379 - RNA, 23 nt, Mycobacterium bovis subsp bovis AF2122/97
ccgggcgauucgcaaucagcugg

SEQ ID NO: 3215380 - RNA, 17 nt, Mycobacterium bovis subsp bovis AF2122/97
ccgggcgcaagcagccc

SEQ ID NO: 3215381 - RNA, 16 nt, Mycobacterium bovis subsp bovis AF2122/97
ccgggcgcgccggcca

SEQ ID NO: 3215382 - RNA, 18 nt, Mycobacterium bovis subsp bovis AF2122/97
ccgggcgcuugcaccagg

SEQ ID NO: 3215383 - RNA, 17 nt, Mycobacterium bovis subsp bovis AF2122/97
ccgggcggaacgccggc

SEQ ID NO: 3215384 - RNA, 14 nt, Mycobacterium bovis subsp bovis AF2122/97
ccgggcggacagga

SEQ ID NO: 3215385 - RNA, 13 nt, Mycobacterium bovis subsp bovis AF2122/97
ccgggcggccgcc

SEQ ID NO: 3215386 - RNA, 15 nt, Mycobacterium bovis subsp bovis AF2122/97
ccgggcggccucccg

SEQ ID NO: 3215387 - RNA, 19 nt, Mycobacterium bovis subsp bovis AF2122/97
ccgggcggccucccgggcc

SEQ ID NO: 3215388 - RNA, 22 nt, Mycobacterium bovis subsp bovis AF2122/97
ccgggcggccucccgggccgcc

SEQ ID NO: 3215389 - RNA, 15 nt, Mycobacterium bovis subsp bovis AF2122/97
ccgggcggcggccug

SEQ ID NO: 3215390 - RNA, 18 nt, Mycobacterium bovis subsp bovis AF2122/97
ccgggcggcggccugggc

SEQ ID NO: 3215391 - RNA, 13 nt, Mycobacterium bovis subsp bovis AF2122/97
ccgggcggcggcg

SEQ ID NO: 3215392 - RNA, 14 nt, Mycobacterium bovis subsp bovis AF2122/97
ccgggcggcggcga

SEQ ID NO: 3215393 - RNA, 14 nt, Mycobacterium bovis subsp bovis AF2122/97
ccgggcggcggcgg

SEQ ID NO: 3215394 - RNA, 19 nt, Mycobacterium bovis subsp bovis AF2122/97
ccgggcggcgucggugagc

SEQ ID NO: 3215395 - RNA, 22 nt, Mycobacterium bovis subsp bovis AF2122/97
ccgggcggcgucggugagcgcg

SEQ ID NO: 3215396 - RNA, 18 nt, Mycobacterium bovis subsp bovis AF2122/97
ccgggcgggagucgucga

SEQ ID NO: 3215397 - RNA, 12 nt, Mycobacterium bovis subsp bovis AF2122/97
ccgggcgggcug

SEQ ID NO: 3215398 - RNA, 20 nt, Mycobacterium bovis subsp bovis AF2122/97
ccgggcgggcuggugucagc

SEQ ID NO: 3215399 - RNA, 23 nt, Mycobacterium bovis subsp bovis AF2122/97
ccgggcgggcuggugucagcuga

SEQ ID NO: 3215400 - RNA, 15 nt, Mycobacterium bovis subsp bovis AF2122/97
ccgggcggucgagau

SEQ ID NO: 3215401 - RNA, 17 nt, Mycobacterium bovis subsp bovis AF2122/97
ccgggcgucgucgguga

SEQ ID NO: 3215402 - RNA, 11 nt, Mycobacterium bovis subsp bovis AF2122/97
ccgggcgugcc

SEQ ID NO: 3215403 - RNA, 16 nt, Mycobacterium bovis subsp bovis AF2122/97
ccgggcgugcggcggc

SEQ ID NO: 3215404 - RNA, 19 nt, Mycobacterium bovis subsp bovis AF2122/97
ccgggcgugcggcggccca

SEQ ID NO: 3215405 - RNA, 20 nt, Mycobacterium bovis subsp bovis AF2122/97
ccgggcgugcggcggcccau

SEQ ID NO: 3215406 - RNA, 13 nt, Mycobacterium bovis subsp bovis AF2122/97
ccgggcgugggug

SEQ ID NO: 3215407 - RNA, 15 nt, Mycobacterium bovis subsp bovis AF2122/97
ccgggcuauccgcgg

SEQ ID NO: 3215408 - RNA, 23 nt, Mycobacterium bovis subsp bovis AF2122/97
ccgggcucagacuuucgcccagu

SEQ ID NO: 3215409 - RNA, 22 nt, Mycobacterium bovis subsp bovis AF2122/97
ccgggcuccaauugcggccgcg

SEQ ID NO: 3215410 - RNA, 12 nt, Mycobacterium bovis subsp bovis AF2122/97
ccgggcucgcau

SEQ ID NO: 3215411 - RNA, 14 nt, Mycobacterium bovis subsp bovis AF2122/97
ccgggcucggcgaa

SEQ ID NO: 3215412 - RNA, 15 nt, Mycobacterium bovis subsp bovis AF2122/97
ccgggcucggcgaag

SEQ ID NO: 3215413 - RNA, 22 nt, Mycobacterium bovis subsp bovis AF2122/97
ccgggcucggcgaaggccgcgc

SEQ ID NO: 3215414 - RNA, 19 nt, Mycobacterium bovis subsp bovis AF2122/97
ccgggcucggcgucgccgc

SEQ ID NO: 3215415 - RNA, 21 nt, Mycobacterium bovis subsp bovis AF2122/97
ccgggcucggcgucgccgcca

SEQ ID NO: 3215416 - RNA, 22 nt, Mycobacterium bovis subsp bovis AF2122/97
ccgggcucggcgucgccgccau

SEQ ID NO: 3215417 - RNA, 15 nt, Mycobacterium bovis subsp bovis AF2122/97
ccgggcucggugacc

SEQ ID NO: 3215418 - RNA, 19 nt, Mycobacterium bovis subsp bovis AF2122/97
ccgggcucuggccaguccg

SEQ ID NO: 3215419 - RNA, 15 nt, Mycobacterium bovis subsp bovis AF2122/97
ccgggcugccaaggc

SEQ ID NO: 3215420 - RNA, 19 nt, Mycobacterium bovis subsp bovis AF2122/97
ccgggcugccaaggccuuc

SEQ ID NO: 3215421 - RNA, 20 nt, Mycobacterium bovis subsp bovis AF2122/97
ccgggcugcuugcgcccggc

SEQ ID NO: 3215422 - RNA, 12 nt, Mycobacterium bovis subsp bovis AF2122/97
ccgggcuggcca

SEQ ID NO: 3215423 - RNA, 16 nt, Mycobacterium bovis subsp bovis AF2122/97
ccgggcuggccagcgc

SEQ ID NO: 3215424 - RNA, 18 nt, Mycobacterium bovis subsp bovis AF2122/97
ccgggcuggccagcgcgc

SEQ ID NO: 3215425 - RNA, 17 nt, Mycobacterium bovis subsp bovis AF2122/97
ccgggcuggccgacucg

SEQ ID NO: 3215426 - RNA, 22 nt, Mycobacterium bovis subsp bovis AF2122/97
ccgggcuggguaugcacccagg

SEQ ID NO: 3215427 - RNA, 17 nt, Mycobacterium bovis subsp bovis AF2122/97
ccgggcuguucggccau

SEQ ID NO: 3215428 - RNA, 20 nt, Mycobacterium bovis subsp bovis AF2122/97
ccgggcuguucggccauggc

SEQ ID NO: 3215429 - RNA, 18 nt, Mycobacterium bovis subsp bovis AF2122/97
ccgggcuuaggccgcggc

SEQ ID NO: 3215430 - RNA, 15 nt, Mycobacterium bovis subsp bovis AF2122/97
ccggguccaccgcac

SEQ ID NO: 3215431 - RNA, 16 nt, Mycobacterium bovis subsp bovis AF2122/97
ccggguccaccgcacg

SEQ ID NO: 3215432 - RNA, 13 nt, Mycobacterium bovis subsp bovis AF2122/97
ccggguccgccgg

SEQ ID NO: 3215433 - RNA, 17 nt, Mycobacterium bovis subsp bovis AF2122/97
ccggguccgccgggccc

SEQ ID NO: 3215434 - RNA, 17 nt, Mycobacterium bovis subsp bovis AF2122/97
ccggguccggaaccggu

SEQ ID NO: 3215435 - RNA, 15 nt, Mycobacterium bovis subsp bovis AF2122/97
ccggguccggcguac

SEQ ID NO: 3215436 - RNA, 16 nt, Mycobacterium bovis subsp bovis AF2122/97
ccggguccggugaacc

SEQ ID NO: 3215437 - RNA, 14 nt, Mycobacterium bovis subsp bovis AF2122/97
ccgggucgaacagg

SEQ ID NO: 3215438 - RNA, 21 nt, Mycobacterium bovis subsp bovis AF2122/97
ccgggucgaacaggccggccg

SEQ ID NO: 3215439 - RNA, 22 nt, Mycobacterium bovis subsp bovis AF2122/97
ccgggucgaacaggccggccgc

SEQ ID NO: 3215440 - RNA, 23 nt, Mycobacterium bovis subsp bovis AF2122/97
ccgggucgaacaggccggccgcg

SEQ ID NO: 3215441 - RNA, 22 nt, Mycobacterium bovis subsp bovis AF2122/97
ccgggucgaacuugaucaccgc

SEQ ID NO: 3215442 - RNA, 23 nt, Mycobacterium bovis subsp bovis AF2122/97
ccgggucgaacuugaucaccgcg

SEQ ID NO: 3215443 - RNA, 14 nt, Mycobacterium bovis subsp bovis AF2122/97
ccgggucgacgacg

SEQ ID NO: 3215444 - RNA, 20 nt, Mycobacterium bovis subsp bovis AF2122/97
ccgggucgacgacgucgcgc

SEQ ID NO: 3215445 - RNA, 12 nt, Mycobacterium bovis subsp bovis AF2122/97
ccgggucgauca

SEQ ID NO: 3215446 - RNA, 14 nt, Mycobacterium bovis subsp bovis AF2122/97
ccgggucgaucacc

SEQ ID NO: 3215447 - RNA, 18 nt, Mycobacterium bovis subsp bovis AF2122/97
ccgggucgaugucggggc

SEQ ID NO: 3215448 - RNA, 20 nt, Mycobacterium bovis subsp bovis AF2122/97
ccgggucgaugucggggccg

SEQ ID NO: 3215449 - RNA, 22 nt, Mycobacterium bovis subsp bovis AF2122/97
ccgggucgaugucggggccguc

SEQ ID NO: 3215450 - RNA, 18 nt, Mycobacterium bovis subsp bovis AF2122/97
ccgggucgcaaccgccgc

SEQ ID NO: 3215451 - RNA, 16 nt, Mycobacterium bovis subsp bovis AF2122/97
ccgggucgccgaugac

SEQ ID NO: 3215452 - RNA, 20 nt, Mycobacterium bovis subsp bovis AF2122/97
ccgggucgcgggauggggcc

SEQ ID NO: 3215453 - RNA, 13 nt, Mycobacterium bovis subsp bovis AF2122/97
ccgggucggcacg

SEQ ID NO: 3215454 - RNA, 17 nt, Mycobacterium bovis subsp bovis AF2122/97
ccgggucggcacgaccc

SEQ ID NO: 3215455 - RNA, 19 nt, Mycobacterium bovis subsp bovis AF2122/97
ccgggucggcacgacccgg

SEQ ID NO: 3215456 - RNA, 13 nt, Mycobacterium bovis subsp bovis AF2122/97
ccgggucggccgg

SEQ ID NO: 3215457 - RNA, 12 nt, Mycobacterium bovis subsp bovis AF2122/97
ccgggucggcga

SEQ ID NO: 3215458 - RNA, 15 nt, Mycobacterium bovis subsp bovis AF2122/97
ccgggucgggcaccg

SEQ ID NO: 3215459 - RNA, 21 nt, Mycobacterium bovis subsp bovis AF2122/97
ccgggucgggcaccgcgcgcu

SEQ ID NO: 3215460 - RNA, 15 nt, Mycobacterium bovis subsp bovis AF2122/97
ccgggucggugacga

SEQ ID NO: 3215461 - RNA, 22 nt, Mycobacterium bovis subsp bovis AF2122/97
ccgggucgucauacagcgcccu

SEQ ID NO: 3215462 - RNA, 20 nt, Mycobacterium bovis subsp bovis AF2122/97
ccgggugaaguuggcguggu

SEQ ID NO: 3215463 - RNA, 23 nt, Mycobacterium bovis subsp bovis AF2122/97
ccgggugagcuacucacggugau

SEQ ID NO: 3215464 - RNA, 18 nt, Mycobacterium bovis subsp bovis AF2122/97
ccgggugaggcgggucgc

SEQ ID NO: 3215465 - RNA, 21 nt, Mycobacterium bovis subsp bovis AF2122/97
ccgggugaggcgggucgccgc

SEQ ID NO: 3215466 - RNA, 22 nt, Mycobacterium bovis subsp bovis AF2122/97
ccgggugaggcgggucgccgcc

SEQ ID NO: 3215467 - RNA, 19 nt, Mycobacterium bovis subsp bovis AF2122/97
ccgggugaggcggugacga

SEQ ID NO: 3215468 - RNA, 23 nt, Mycobacterium bovis subsp bovis AF2122/97
ccgggugcaacggcguuggcgcc

SEQ ID NO: 3215469 - RNA, 15 nt, Mycobacterium bovis subsp bovis AF2122/97
ccgggugcagaucgc

SEQ ID NO: 3215470 - RNA, 15 nt, Mycobacterium bovis subsp bovis AF2122/97
ccgggugccacaacc

SEQ ID NO: 3215471 - RNA, 15 nt, Mycobacterium bovis subsp bovis AF2122/97
ccgggugccgccacg

SEQ ID NO: 3215472 - RNA, 14 nt, Mycobacterium bovis subsp bovis AF2122/97
ccgggugccggugc

SEQ ID NO: 3215473 - RNA, 14 nt, Mycobacterium bovis subsp bovis AF2122/97
ccgggugcgacgcg

SEQ ID NO: 3215474 - RNA, 23 nt, Mycobacterium bovis subsp bovis AF2122/97
ccgggugcgcacccgggugcgcu

SEQ ID NO: 3215475 - RNA, 16 nt, Mycobacterium bovis subsp bovis AF2122/97
ccgggugcgccguugc

SEQ ID NO: 3215476 - RNA, 13 nt, Mycobacterium bovis subsp bovis AF2122/97
ccgggugcgggug

SEQ ID NO: 3215477 - RNA, 21 nt, Mycobacterium bovis subsp bovis AF2122/97
ccggguggccacgcccaggca

SEQ ID NO: 3215478 - RNA, 23 nt, Mycobacterium bovis subsp bovis AF2122/97
ccggguggcccggaacaccgacg

SEQ ID NO: 3215479 - RNA, 19 nt, Mycobacterium bovis subsp bovis AF2122/97
ccggguggcgucaccgccg

SEQ ID NO: 3215480 - RNA, 19 nt, Mycobacterium bovis subsp bovis AF2122/97
ccggguggcgucgaucucg

SEQ ID NO: 3215481 - RNA, 17 nt, Mycobacterium bovis subsp bovis AF2122/97
ccgggugggagcagccg

SEQ ID NO: 3215482 - RNA, 20 nt, Mycobacterium bovis subsp bovis AF2122/97
ccgggugggagcagccgaac

SEQ ID NO: 3215483 - RNA, 22 nt, Mycobacterium bovis subsp bovis AF2122/97
ccggguguagcucggacccuca

SEQ ID NO: 3215484 - RNA, 15 nt, Mycobacterium bovis subsp bovis AF2122/97
ccggguguggucggu

SEQ ID NO: 3215485 - RNA, 20 nt, Mycobacterium bovis subsp bovis AF2122/97
ccggguguggucgguggcgg

SEQ ID NO: 3215486 - RNA, 19 nt, Mycobacterium bovis subsp bovis AF2122/97
ccggguguuggggaucgca

SEQ ID NO: 3215487 - RNA, 13 nt, Mycobacterium bovis subsp bovis AF2122/97
ccggguucgccgg

SEQ ID NO: 3215488 - RNA, 14 nt, Mycobacterium bovis subsp bovis AF2122/97
ccggguugagccgc

SEQ ID NO: 3215489 - RNA, 16 nt, Mycobacterium bovis subsp bovis AF2122/97
ccggguugagccgccg

SEQ ID NO: 3215490 - RNA, 17 nt, Mycobacterium bovis subsp bovis AF2122/97
ccggguugagccgccgc

SEQ ID NO: 3215491 - RNA, 19 nt, Mycobacterium bovis subsp bovis AF2122/97
ccggguugagccgccgcga

SEQ ID NO: 3215492 - RNA, 20 nt, Mycobacterium bovis subsp bovis AF2122/97
ccggguugagccgccgcgac

SEQ ID NO: 3215493 - RNA, 23 nt, Mycobacterium bovis subsp bovis AF2122/97
ccggguugagccgccgcgacggc

SEQ ID NO: 3215494 - RNA, 17 nt, Mycobacterium bovis subsp bovis AF2122/97
ccggguuggccggcgcu

SEQ ID NO: 3215495 - RNA, 20 nt, Mycobacterium bovis subsp bovis AF2122/97
ccggguugguacccaccagg

SEQ ID NO: 3215496 - RNA, 18 nt, Mycobacterium bovis subsp bovis AF2122/97
ccggguuuugcgcggcca

SEQ ID NO: 3215497 - RNA, 16 nt, Mycobacterium bovis subsp bovis AF2122/97
ccgguaaccgcgucga

SEQ ID NO: 3215498 - RNA, 14 nt, Mycobacterium bovis subsp bovis AF2122/97
ccgguaacgaacag

SEQ ID NO: 3215499 - RNA, 17 nt, Mycobacterium bovis subsp bovis AF2122/97
ccgguaacgccaacacc

SEQ ID NO: 3215500 - RNA, 17 nt, Mycobacterium bovis subsp bovis AF2122/97
ccgguaacuguccgccc

SEQ ID NO: 3215501 - RNA, 20 nt, Mycobacterium bovis subsp bovis AF2122/97
ccgguaacuguccgcccgga

SEQ ID NO: 3215502 - RNA, 20 nt, Mycobacterium bovis subsp bovis AF2122/97
ccgguacaacccccaggcgc

SEQ ID NO: 3215503 - RNA, 16 nt, Mycobacterium bovis subsp bovis AF2122/97
ccgguacacguccagu

SEQ ID NO: 3215504 - RNA, 13 nt, Mycobacterium bovis subsp bovis AF2122/97
ccgguaccgacgg

SEQ ID NO: 3215505 - RNA, 14 nt, Mycobacterium bovis subsp bovis AF2122/97
ccgguaccgccggc

SEQ ID NO: 3215506 - RNA, 14 nt, Mycobacterium bovis subsp bovis AF2122/97
ccgguaccggcgac

SEQ ID NO: 3215507 - RNA, 18 nt, Mycobacterium bovis subsp bovis AF2122/97
ccgguaccggcgacgaau

SEQ ID NO: 3215508 - RNA, 18 nt, Mycobacterium bovis subsp bovis AF2122/97
ccgguaccucaacaccag

SEQ ID NO: 3215509 - RNA, 12 nt, Mycobacterium bovis subsp bovis AF2122/97
ccgguacgccgc

SEQ ID NO: 3215510 - RNA, 14 nt, Mycobacterium bovis subsp bovis AF2122/97
ccgguacgccgcgc

SEQ ID NO: 3215511 - RNA, 17 nt, Mycobacterium bovis subsp bovis AF2122/97
ccgguacgccgcgccga

SEQ ID NO: 3215512 - RNA, 23 nt, Mycobacterium bovis subsp bovis AF2122/97
ccgguagagcgggccaacucggc

SEQ ID NO: 3215513 - RNA, 20 nt, Mycobacterium bovis subsp bovis AF2122/97
ccgguagaucuucggccgca

SEQ ID NO: 3215514 - RNA, 14 nt, Mycobacterium bovis subsp bovis AF2122/97
ccgguagcacagca

SEQ ID NO: 3215515 - RNA, 22 nt, Mycobacterium bovis subsp bovis AF2122/97
ccgguagcacagcagcaacgcg

SEQ ID NO: 3215516 - RNA, 17 nt, Mycobacterium bovis subsp bovis AF2122/97
ccggucgaugucggcga

SEQ ID NO: 3215517 - RNA, 16 nt, Mycobacterium bovis subsp bovis AF2122/97
ccggucgcagugcacc

SEQ ID NO: 3215518 - RNA, 23 nt, Mycobacterium bovis subsp bovis AF2122/97
ccggucgcagugcacccgggccg

SEQ ID NO: 3215519 - RNA, 19 nt, Mycobacterium bovis subsp bovis AF2122/97
ccggucgcauggucgacga

SEQ ID NO: 3215520 - RNA, 19 nt, Mycobacterium bovis subsp bovis AF2122/97
ccggucgccaaauccgacg

SEQ ID NO: 3215521 - RNA, 15 nt, Mycobacterium bovis subsp bovis AF2122/97
ccggucgccgacggc

SEQ ID NO: 3215522 - RNA, 13 nt, Mycobacterium bovis subsp bovis AF2122/97
ccggucgccgcga

SEQ ID NO: 3215523 - RNA, 13 nt, Mycobacterium bovis subsp bovis AF2122/97
ccggucgccgcgu

SEQ ID NO: 3215524 - RNA, 15 nt, Mycobacterium bovis subsp bovis AF2122/97
ccggucgccgcgucu

SEQ ID NO: 3215525 - RNA, 16 nt, Mycobacterium bovis subsp bovis AF2122/97
ccggucgccggcuggg

SEQ ID NO: 3215526 - RNA, 15 nt, Mycobacterium bovis subsp bovis AF2122/97
ccggucgccgggacg

SEQ ID NO: 3215527 - RNA, 14 nt, Mycobacterium bovis subsp bovis AF2122/97
ccggucgccgguca

SEQ ID NO: 3215528 - RNA, 20 nt, Mycobacterium bovis subsp bovis AF2122/97
ccggucgccggucaucgccg

SEQ ID NO: 3215529 - RNA, 14 nt, Mycobacterium bovis subsp bovis AF2122/97
ccggucgccucacc

SEQ ID NO: 3215530 - RNA, 16 nt, Mycobacterium bovis subsp bovis AF2122/97
ccggucgccucaccgg

SEQ ID NO: 3215531 - RNA, 17 nt, Mycobacterium bovis subsp bovis AF2122/97
ccggucgccucaccggc

SEQ ID NO: 3215532 - RNA, 23 nt, Mycobacterium bovis subsp bovis AF2122/97
ccggucgcgcauuucguggcgcg

SEQ ID NO: 3215533 - RNA, 14 nt, Mycobacterium bovis subsp bovis AF2122/97
ccggucgcggaacu

SEQ ID NO: 3215534 - RNA, 21 nt, Mycobacterium bovis subsp bovis AF2122/97
ccggucgcuccggguagcgga

SEQ ID NO: 3215535 - RNA, 20 nt, Mycobacterium bovis subsp bovis AF2122/97
ccggucgcuguccacugcca

SEQ ID NO: 3215536 - RNA, 19 nt, Mycobacterium bovis subsp bovis AF2122/97
ccggucggagcggugccga

SEQ ID NO: 3215537 - RNA, 20 nt, Mycobacterium bovis subsp bovis AF2122/97
ccggucggagcggugccgac

SEQ ID NO: 3215538 - RNA, 21 nt, Mycobacterium bovis subsp bovis AF2122/97
ccggucggagcggugccgacg

SEQ ID NO: 3215539 - RNA, 12 nt, Mycobacterium bovis subsp bovis AF2122/97
ccggucggcacc

SEQ ID NO: 3215540 - RNA, 13 nt, Mycobacterium bovis subsp bovis AF2122/97
ccggucggcacca

SEQ ID NO: 3215541 - RNA, 17 nt, Mycobacterium bovis subsp bovis AF2122/97
ccggucggcaccaccac

SEQ ID NO: 3215542 - RNA, 13 nt, Mycobacterium bovis subsp bovis AF2122/97
ccggucggcagcu

SEQ ID NO: 3215543 - RNA, 14 nt, Mycobacterium bovis subsp bovis AF2122/97
ccggucggccaggc

SEQ ID NO: 3215544 - RNA, 15 nt, Mycobacterium bovis subsp bovis AF2122/97
ccggucggccaggcc

SEQ ID NO: 3215545 - RNA, 12 nt, Mycobacterium bovis subsp bovis AF2122/97
ccggucggccau

SEQ ID NO: 3215546 - RNA, 17 nt, Mycobacterium bovis subsp bovis AF2122/97
ccggucggccauccacc

SEQ ID NO: 3215547 - RNA, 14 nt, Mycobacterium bovis subsp bovis AF2122/97
ccggucggcccaca

SEQ ID NO: 3215548 - RNA, 15 nt, Mycobacterium bovis subsp bovis AF2122/97
ccggucggcccgcgc

SEQ ID NO: 3215549 - RNA, 16 nt, Mycobacterium bovis subsp bovis AF2122/97
ccggucggcccgcgcu

SEQ ID NO: 3215550 - RNA, 19 nt, Mycobacterium bovis subsp bovis AF2122/97
ccggucggcgaaaggccag

SEQ ID NO: 3215551 - RNA, 13 nt, Mycobacterium bovis subsp bovis AF2122/97
ccggucggcggca

SEQ ID NO: 3215552 - RNA, 21 nt, Mycobacterium bovis subsp bovis AF2122/97
ccggucggcgggcaccuccgc

SEQ ID NO: 3215553 - RNA, 18 nt, Mycobacterium bovis subsp bovis AF2122/97
ccggucggcgguagccga

SEQ ID NO: 3215554 - RNA, 22 nt, Mycobacterium bovis subsp bovis AF2122/97
ccggucggcgguagccgaccag

SEQ ID NO: 3215555 - RNA, 21 nt, Mycobacterium bovis subsp bovis AF2122/97
ccggucgggggcguccuccug

SEQ ID NO: 3215556 - RNA, 19 nt, Mycobacterium bovis subsp bovis AF2122/97
ccggucggugagccgugcc

SEQ ID NO: 3215557 - RNA, 21 nt, Mycobacterium bovis subsp bovis AF2122/97
ccggucggugagccgugccgc

SEQ ID NO: 3215558 - RNA, 21 nt, Mycobacterium bovis subsp bovis AF2122/97
ccggucguagcuuccggucca

SEQ ID NO: 3215559 - RNA, 18 nt, Mycobacterium bovis subsp bovis AF2122/97
ccggucguuugcgccagg

SEQ ID NO: 3215560 - RNA, 15 nt, Mycobacterium bovis subsp bovis AF2122/97
ccggucuacgacguc

SEQ ID NO: 3215561 - RNA, 16 nt, Mycobacterium bovis subsp bovis AF2122/97
ccggucuacgccaccg

SEQ ID NO: 3215562 - RNA, 22 nt, Mycobacterium bovis subsp bovis AF2122/97
ccggucuauuugccugccgcgc

SEQ ID NO: 3215563 - RNA, 19 nt, Mycobacterium bovis subsp bovis AF2122/97
ccggucucgacggcggccg

SEQ ID NO: 3215564 - RNA, 23 nt, Mycobacterium bovis subsp bovis AF2122/97
ccggucucgacggcggccgcgau

SEQ ID NO: 3215565 - RNA, 14 nt, Mycobacterium bovis subsp bovis AF2122/97
ccggucucggccga

SEQ ID NO: 3215566 - RNA, 20 nt, Mycobacterium bovis subsp bovis AF2122/97
ccggucugcugggcacgaug

SEQ ID NO: 3215567 - RNA, 16 nt, Mycobacterium bovis subsp bovis AF2122/97
ccggucuuggacagca

SEQ ID NO: 3215568 - RNA, 21 nt, Mycobacterium bovis subsp bovis AF2122/97
ccggucuuuaauccagcgccg

SEQ ID NO: 3215569 - RNA, 22 nt, Mycobacterium bovis subsp bovis AF2122/97
ccggugaacgguagcacugucg

SEQ ID NO: 3215570 - RNA, 19 nt, Mycobacterium bovis subsp bovis AF2122/97
ccggugacaaauucggcgu

SEQ ID NO: 3215571 - RNA, 23 nt, Mycobacterium bovis subsp bovis AF2122/97
ccggugacaaguggugcccuuga

SEQ ID NO: 3215572 - RNA, 17 nt, Mycobacterium bovis subsp bovis AF2122/97
ccggugaccacuugcag

SEQ ID NO: 3215573 - RNA, 13 nt, Mycobacterium bovis subsp bovis AF2122/97
ccggugaccagca

SEQ ID NO: 3215574 - RNA, 21 nt, Mycobacterium bovis subsp bovis AF2122/97
ccggugacccgcugggccgca

SEQ ID NO: 3215575 - RNA, 19 nt, Mycobacterium bovis subsp bovis AF2122/97
ccggugacgacgucgccgc

SEQ ID NO: 3215576 - RNA, 20 nt, Mycobacterium bovis subsp bovis AF2122/97
ccggugacgacgucgccgcc

SEQ ID NO: 3215577 - RNA, 19 nt, Mycobacterium bovis subsp bovis AF2122/97
ccggugacgaugaccgcgc

SEQ ID NO: 3215578 - RNA, 19 nt, Mycobacterium bovis subsp bovis AF2122/97
ccggugacgcacagcagca

SEQ ID NO: 3215579 - RNA, 20 nt, Mycobacterium bovis subsp bovis AF2122/97
ccggugacgcacagcagcac

SEQ ID NO: 3215580 - RNA, 22 nt, Mycobacterium bovis subsp bovis AF2122/97
ccggugacgcacagcagcaccg

SEQ ID NO: 3215581 - RNA, 24 nt, Mycobacterium bovis subsp bovis AF2122/97
ccggugacgcacagcagcaccgcg

SEQ ID NO: 3215582 - RNA, 13 nt, Mycobacterium bovis subsp bovis AF2122/97
ccggugacgccgu

SEQ ID NO: 3215583 - RNA, 16 nt, Mycobacterium bovis subsp bovis AF2122/97
ccggugacgccgucga

SEQ ID NO: 3215584 - RNA, 15 nt, Mycobacterium bovis subsp bovis AF2122/97
ccggugacggggcug

SEQ ID NO: 3215585 - RNA, 18 nt, Mycobacterium bovis subsp bovis AF2122/97
ccggugacgggguugacc

SEQ ID NO: 3215586 - RNA, 14 nt, Mycobacterium bovis subsp bovis AF2122/97
ccggugagccggau

SEQ ID NO: 3215587 - RNA, 18 nt, Mycobacterium bovis subsp bovis AF2122/97
ccggugagcgagcgcgcg

SEQ ID NO: 3215588 - RNA, 14 nt, Mycobacterium bovis subsp bovis AF2122/97
ccggugagcgcagc

SEQ ID NO: 3215589 - RNA, 15 nt, Mycobacterium bovis subsp bovis AF2122/97
ccggugagcgcagcu

SEQ ID NO: 3215590 - RNA, 22 nt, Mycobacterium bovis subsp bovis AF2122/97
ccggugagcgcagcuugauccc

SEQ ID NO: 3215591 - RNA, 23 nt, Mycobacterium bovis subsp bovis AF2122/97
ccggugagcuuagcgcaugggcc

SEQ ID NO: 3215592 - RNA, 18 nt, Mycobacterium bovis subsp bovis AF2122/97
ccggugaggaucagcgug

SEQ ID NO: 3215593 - RNA, 17 nt, Mycobacterium bovis subsp bovis AF2122/97
ccggugaucaccgacac

SEQ ID NO: 3215594 - RNA, 22 nt, Mycobacterium bovis subsp bovis AF2122/97
ccggugauccaacuggccgcgu

SEQ ID NO: 3215595 - RNA, 14 nt, Mycobacterium bovis subsp bovis AF2122/97
ccggugauccgguc

SEQ ID NO: 3215596 - RNA, 16 nt, Mycobacterium bovis subsp bovis AF2122/97
ccggugauccggucgu

SEQ ID NO: 3215597 - RNA, 17 nt, Mycobacterium bovis subsp bovis AF2122/97
ccggugaucgcgguggc

SEQ ID NO: 3215598 - RNA, 18 nt, Mycobacterium bovis subsp bovis AF2122/97
ccggugaucgcgguggcg

SEQ ID NO: 3215599 - RNA, 16 nt, Mycobacterium bovis subsp bovis AF2122/97
ccggugaucggcggca

SEQ ID NO: 3215600 - RNA, 19 nt, Mycobacterium bovis subsp bovis AF2122/97
ccggugaugaccgcguaga

SEQ ID NO: 3215601 - RNA, 13 nt, Mycobacterium bovis subsp bovis AF2122/97
ccggugauggccg

SEQ ID NO: 3215602 - RNA, 19 nt, Mycobacterium bovis subsp bovis AF2122/97
ccgguggaaaagccacggc

SEQ ID NO: 3215603 - RNA, 17 nt, Mycobacterium bovis subsp bovis AF2122/97
ccgguggaauccaccag

SEQ ID NO: 3215604 - RNA, 18 nt, Mycobacterium bovis subsp bovis AF2122/97
ccgguggacagaugcauc

SEQ ID NO: 3215605 - RNA, 14 nt, Mycobacterium bovis subsp bovis AF2122/97
ccgguggacccggc

SEQ ID NO: 3215606 - RNA, 23 nt, Mycobacterium bovis subsp bovis AF2122/97
ccgguggacgaucuggcagccga

SEQ ID NO: 3215607 - RNA, 23 nt, Mycobacterium bovis subsp bovis AF2122/97
ccgguggacgcagagucaacaga

SEQ ID NO: 3215608 - RNA, 14 nt, Mycobacterium bovis subsp bovis AF2122/97
ccgguggcacccgc

SEQ ID NO: 3215609 - RNA, 13 nt, Mycobacterium bovis subsp bovis AF2122/97
ccgguggcacggc

SEQ ID NO: 3215610 - RNA, 15 nt, Mycobacterium bovis subsp bovis AF2122/97
ccgguggcagagccg

SEQ ID NO: 3215611 - RNA, 23 nt, Mycobacterium bovis subsp bovis AF2122/97
ccgguggcagagccgccguugcc

SEQ ID NO: 3215612 - RNA, 12 nt, Mycobacterium bovis subsp bovis AF2122/97
ccgguggcagcc

SEQ ID NO: 3215613 - RNA, 19 nt, Mycobacterium bovis subsp bovis AF2122/97
ccgguggcagccugcugca

SEQ ID NO: 3215614 - RNA, 16 nt, Mycobacterium bovis subsp bovis AF2122/97
ccgguggcagggaacc

SEQ ID NO: 3215615 - RNA, 13 nt, Mycobacterium bovis subsp bovis AF2122/97
ccgguggcauucg

SEQ ID NO: 3215616 - RNA, 13 nt, Mycobacterium bovis subsp bovis AF2122/97
ccgguggccaaca

SEQ ID NO: 3215617 - RNA, 14 nt, Mycobacterium bovis subsp bovis AF2122/97
ccgguggccaacac

SEQ ID NO: 3215618 - RNA, 15 nt, Mycobacterium bovis subsp bovis AF2122/97
ccgguggccaacacc

SEQ ID NO: 3215619 - RNA, 19 nt, Mycobacterium bovis subsp bovis AF2122/97
ccgguggccaacaccgcca

SEQ ID NO: 3215620 - RNA, 21 nt, Mycobacterium bovis subsp bovis AF2122/97
ccgguggccaacaccgccagc

SEQ ID NO: 3215621 - RNA, 16 nt, Mycobacterium bovis subsp bovis AF2122/97
ccgguggccagcacgu

SEQ ID NO: 3215622 - RNA, 16 nt, Mycobacterium bovis subsp bovis AF2122/97
ccgguggccaucgcgc

SEQ ID NO: 3215623 - RNA, 14 nt, Mycobacterium bovis subsp bovis AF2122/97
ccgguggcccgccg

SEQ ID NO: 3215624 - RNA, 19 nt, Mycobacterium bovis subsp bovis AF2122/97
ccgguggcgccggggccgc

SEQ ID NO: 3215625 - RNA, 20 nt, Mycobacterium bovis subsp bovis AF2122/97
ccgguggcgccggggccgcc

SEQ ID NO: 3215626 - RNA, 15 nt, Mycobacterium bovis subsp bovis AF2122/97
ccgguggcggcggcg

SEQ ID NO: 3215627 - RNA, 18 nt, Mycobacterium bovis subsp bovis AF2122/97
ccgguggcggcggcggca

SEQ ID NO: 3215628 - RNA, 22 nt, Mycobacterium bovis subsp bovis AF2122/97
ccgguggcggcucacgaccggc

SEQ ID NO: 3215629 - RNA, 13 nt, Mycobacterium bovis subsp bovis AF2122/97
ccgguggcguuug

SEQ ID NO: 3215630 - RNA, 21 nt, Mycobacterium bovis subsp bovis AF2122/97
ccgguggcugaucaccguugc

SEQ ID NO: 3215631 - RNA, 16 nt, Mycobacterium bovis subsp bovis AF2122/97
ccgguggcuggccgcc

SEQ ID NO: 3215632 - RNA, 17 nt, Mycobacterium bovis subsp bovis AF2122/97
ccgguggcuggccgcca

SEQ ID NO: 3215633 - RNA, 18 nt, Mycobacterium bovis subsp bovis AF2122/97
ccgguggcuggccgccac

SEQ ID NO: 3215634 - RNA, 20 nt, Mycobacterium bovis subsp bovis AF2122/97
ccgguggcuggccgccaccg

SEQ ID NO: 3215635 - RNA, 21 nt, Mycobacterium bovis subsp bovis AF2122/97
ccgguggcuggccgccaccgc

SEQ ID NO: 3215636 - RNA, 23 nt, Mycobacterium bovis subsp bovis AF2122/97
ccgguggcuggccgccaccgcac

SEQ ID NO: 3215637 - RNA, 24 nt, Mycobacterium bovis subsp bovis AF2122/97
ccgguggcuggccgccaccgcacg

SEQ ID NO: 3215638 - RNA, 15 nt, Mycobacterium bovis subsp bovis AF2122/97
ccggugggccgccca

SEQ ID NO: 3215639 - RNA, 19 nt, Mycobacterium bovis subsp bovis AF2122/97
ccggugggccgcccaaaga

SEQ ID NO: 3215640 - RNA, 22 nt, Mycobacterium bovis subsp bovis AF2122/97
ccgguggggacccgcuccaagc

SEQ ID NO: 3215641 - RNA, 19 nt, Mycobacterium bovis subsp bovis AF2122/97
ccgguggggucggucuggc

SEQ ID NO: 3215642 - RNA, 21 nt, Mycobacterium bovis subsp bovis AF2122/97
ccggugggguugcgcgguagc

SEQ ID NO: 3215643 - RNA, 14 nt, Mycobacterium bovis subsp bovis AF2122/97
ccgguggguagcca

SEQ ID NO: 3215644 - RNA, 22 nt, Mycobacterium bovis subsp bovis AF2122/97
ccggugggucugcucagcgcgg

SEQ ID NO: 3215645 - RNA, 23 nt, Mycobacterium bovis subsp bovis AF2122/97
ccggugguaacggcggccauggc

SEQ ID NO: 3215646 - RNA, 18 nt, Mycobacterium bovis subsp bovis AF2122/97
ccggugguaccggcggcg

SEQ ID NO: 3215647 - RNA, 19 nt, Mycobacterium bovis subsp bovis AF2122/97
ccggugguaccggcggcgc

SEQ ID NO: 3215648 - RNA, 19 nt, Mycobacterium bovis subsp bovis AF2122/97
ccggugguagcgacgaugu

SEQ ID NO: 3215649 - RNA, 15 nt, Mycobacterium bovis subsp bovis AF2122/97
ccgguggucaggaac

SEQ ID NO: 3215650 - RNA, 22 nt, Mycobacterium bovis subsp bovis AF2122/97
ccgguggucgucccgcccaucc

SEQ ID NO: 3215651 - RNA, 15 nt, Mycobacterium bovis subsp bovis AF2122/97
ccggugguggcgacc

SEQ ID NO: 3215652 - RNA, 17 nt, Mycobacterium bovis subsp bovis AF2122/97
ccgguggugggccgugg

SEQ ID NO: 3215653 - RNA, 19 nt, Mycobacterium bovis subsp bovis AF2122/97
ccgguguagcagcgccagc

SEQ ID NO: 3215654 - RNA, 20 nt, Mycobacterium bovis subsp bovis AF2122/97
ccgguguagcagcgccagca

SEQ ID NO: 3215655 - RNA, 20 nt, Mycobacterium bovis subsp bovis AF2122/97
ccgguguagcguucccacac

SEQ ID NO: 3215656 - RNA, 21 nt, Mycobacterium bovis subsp bovis AF2122/97
ccgguguaggccucggcagca

SEQ ID NO: 3215657 - RNA, 18 nt, Mycobacterium bovis subsp bovis AF2122/97
ccgguguccuuggccgcc

SEQ ID NO: 3215658 - RNA, 13 nt, Mycobacterium bovis subsp bovis AF2122/97
ccggugucgaugc

SEQ ID NO: 3215659 - RNA, 24 nt, Mycobacterium bovis subsp bovis AF2122/97
ccggugucgaugcgcagcccgucg

SEQ ID NO: 3215660 - RNA, 12 nt, Mycobacterium bovis subsp bovis AF2122/97
ccggugucggcc

SEQ ID NO: 3215661 - RNA, 14 nt, Mycobacterium bovis subsp bovis AF2122/97
ccggugucggccag

SEQ ID NO: 3215662 - RNA, 15 nt, Mycobacterium bovis subsp bovis AF2122/97
ccggugucggccagc

SEQ ID NO: 3215663 - RNA, 19 nt, Mycobacterium bovis subsp bovis AF2122/97
ccggugucggccagcaacu

SEQ ID NO: 3215664 - RNA, 17 nt, Mycobacterium bovis subsp bovis AF2122/97
ccggugucggcuggucg

SEQ ID NO: 3215665 - RNA, 16 nt, Mycobacterium bovis subsp bovis AF2122/97
ccggugucggugcgcg

SEQ ID NO: 3215666 - RNA, 17 nt, Mycobacterium bovis subsp bovis AF2122/97
ccggugucgugggcacc

SEQ ID NO: 3215667 - RNA, 17 nt, Mycobacterium bovis subsp bovis AF2122/97
ccggugucucccuugcc

SEQ ID NO: 3215668 - RNA, 22 nt, Mycobacterium bovis subsp bovis AF2122/97
ccggugucucccuugccgccau

SEQ ID NO: 3215669 - RNA, 21 nt, Mycobacterium bovis subsp bovis AF2122/97
ccggugucuggguggacaggu

SEQ ID NO: 3215670 - RNA, 17 nt, Mycobacterium bovis subsp bovis AF2122/97
ccggugugcccgccugg

SEQ ID NO: 3215671 - RNA, 14 nt, Mycobacterium bovis subsp bovis AF2122/97
ccggugugcgcacc

SEQ ID NO: 3215672 - RNA, 17 nt, Mycobacterium bovis subsp bovis AF2122/97
ccggugugcgcaccccg

SEQ ID NO: 3215673 - RNA, 18 nt, Mycobacterium bovis subsp bovis AF2122/97
ccggugugcgcaccccgc

SEQ ID NO: 3215674 - RNA, 16 nt, Mycobacterium bovis subsp bovis AF2122/97
ccggugugcugcacgg

SEQ ID NO: 3215675 - RNA, 18 nt, Mycobacterium bovis subsp bovis AF2122/97
ccgguguguucggcccgc

SEQ ID NO: 3215676 - RNA, 16 nt, Mycobacterium bovis subsp bovis AF2122/97
ccgguguguuuggcau

SEQ ID NO: 3215677 - RNA, 19 nt, Mycobacterium bovis subsp bovis AF2122/97
ccgguguucaucacgccgc

SEQ ID NO: 3215678 - RNA, 22 nt, Mycobacterium bovis subsp bovis AF2122/97
ccgguguucaucacgccgccgg

SEQ ID NO: 3215679 - RNA, 11 nt, Mycobacterium bovis subsp bovis AF2122/97
ccgguguugau

SEQ ID NO: 3215680 - RNA, 15 nt, Mycobacterium bovis subsp bovis AF2122/97
ccgguguugccgccg

SEQ ID NO: 3215681 - RNA, 22 nt, Mycobacterium bovis subsp bovis AF2122/97
ccgguguugccguuaccgccaa

SEQ ID NO: 3215682 - RNA, 19 nt, Mycobacterium bovis subsp bovis AF2122/97
ccgguguuuccgaaacccg

SEQ ID NO: 3215683 - RNA, 22 nt, Mycobacterium bovis subsp bovis AF2122/97
ccgguguuuccgaaacccgccg

SEQ ID NO: 3215684 - RNA, 24 nt, Mycobacterium bovis subsp bovis AF2122/97
ccgguuaauggaaugaucggcguc

SEQ ID NO: 3215685 - RNA, 14 nt, Mycobacterium bovis subsp bovis AF2122/97
ccgguuacccggac

SEQ ID NO: 3215686 - RNA, 20 nt, Mycobacterium bovis subsp bovis AF2122/97
ccgguuaugcgguacccgau

SEQ ID NO: 3215687 - RNA, 23 nt, Mycobacterium bovis subsp bovis AF2122/97
ccgguuauggcauucgauaccgc

SEQ ID NO: 3215688 - RNA, 19 nt, Mycobacterium bovis subsp bovis AF2122/97
ccguauugaugcugcccga

SEQ ID NO: 3215689 - RNA, 22 nt, Mycobacterium bovis subsp bovis AF2122/97
ccgucaaccagggugccggcgg

SEQ ID NO: 3215690 - RNA, 19 nt, Mycobacterium bovis subsp bovis AF2122/97
ccgucaaccugcugcagaa

SEQ ID NO: 3215691 - RNA, 13 nt, Mycobacterium bovis subsp bovis AF2122/97
ccgucacaggccg

SEQ ID NO: 3215692 - RNA, 15 nt, Mycobacterium bovis subsp bovis AF2122/97
ccgucacaggccgcc

SEQ ID NO: 3215693 - RNA, 14 nt, Mycobacterium bovis subsp bovis AF2122/97
ccgucaccaccgcc

SEQ ID NO: 3215694 - RNA, 15 nt, Mycobacterium bovis subsp bovis AF2122/97
ccgucaccaccgccg

SEQ ID NO: 3215695 - RNA, 14 nt, Mycobacterium bovis subsp bovis AF2122/97
ccgucacccccgau

SEQ ID NO: 3215696 - RNA, 23 nt, Mycobacterium bovis subsp bovis AF2122/97
ccgucacccccgauagcgaccgc

SEQ ID NO: 3215697 - RNA, 14 nt, Mycobacterium bovis subsp bovis AF2122/97
ccgucaccgacugc

SEQ ID NO: 3215698 - RNA, 12 nt, Mycobacterium bovis subsp bovis AF2122/97
ccgucaccgccc

SEQ ID NO: 3215699 - RNA, 17 nt, Mycobacterium bovis subsp bovis AF2122/97
ccgucaccgcccuugcc

SEQ ID NO: 3215700 - RNA, 14 nt, Mycobacterium bovis subsp bovis AF2122/97
ccgucaccgccguc

SEQ ID NO: 3215701 - RNA, 18 nt, Mycobacterium bovis subsp bovis AF2122/97
ccgucaccgccguugccg

SEQ ID NO: 3215702 - RNA, 16 nt, Mycobacterium bovis subsp bovis AF2122/97
ccgucaccgcgacccc

SEQ ID NO: 3215703 - RNA, 13 nt, Mycobacterium bovis subsp bovis AF2122/97
ccgucacgcccgc

SEQ ID NO: 3215704 - RNA, 16 nt, Mycobacterium bovis subsp bovis AF2122/97
ccgucacgcccgcgaa

SEQ ID NO: 3215705 - RNA, 23 nt, Mycobacterium bovis subsp bovis AF2122/97
ccgucacgcguacgucgguccac

SEQ ID NO: 3215706 - RNA, 17 nt, Mycobacterium bovis subsp bovis AF2122/97
ccgucacgucguuuggc

SEQ ID NO: 3215707 - RNA, 14 nt, Mycobacterium bovis subsp bovis AF2122/97
ccgucagaacaccg

SEQ ID NO: 3215708 - RNA, 13 nt, Mycobacterium bovis subsp bovis AF2122/97
ccgucagaccauc

SEQ ID NO: 3215709 - RNA, 18 nt, Mycobacterium bovis subsp bovis AF2122/97
ccgucagccaggugccca

SEQ ID NO: 3215710 - RNA, 17 nt, Mycobacterium bovis subsp bovis AF2122/97
ccgucagcccgaaccgu

SEQ ID NO: 3215711 - RNA, 16 nt, Mycobacterium bovis subsp bovis AF2122/97
ccgucagcgccgcgcg

SEQ ID NO: 3215712 - RNA, 22 nt, Mycobacterium bovis subsp bovis AF2122/97
ccgucagcgccgcugacuccug

SEQ ID NO: 3215713 - RNA, 14 nt, Mycobacterium bovis subsp bovis AF2122/97
ccgucagcgcgccg

SEQ ID NO: 3215714 - RNA, 15 nt, Mycobacterium bovis subsp bovis AF2122/97
ccgucagcgcgccgu

SEQ ID NO: 3215715 - RNA, 16 nt, Mycobacterium bovis subsp bovis AF2122/97
ccgucagcgcgccguc

SEQ ID NO: 3215716 - RNA, 12 nt, Mycobacterium bovis subsp bovis AF2122/97
ccgucagcggcg

SEQ ID NO: 3215717 - RNA, 17 nt, Mycobacterium bovis subsp bovis AF2122/97
ccgucagcggcggccac

SEQ ID NO: 3215718 - RNA, 18 nt, Mycobacterium bovis subsp bovis AF2122/97
ccgucagcggcggccacg

SEQ ID NO: 3215719 - RNA, 17 nt, Mycobacterium bovis subsp bovis AF2122/97
ccgucagcgucggcgca

SEQ ID NO: 3215720 - RNA, 19 nt, Mycobacterium bovis subsp bovis AF2122/97
ccgucagcgucggcgcauc

SEQ ID NO: 3215721 - RNA, 20 nt, Mycobacterium bovis subsp bovis AF2122/97
ccgucagcgucugagcgccg

SEQ ID NO: 3215722 - RNA, 23 nt, Mycobacterium bovis subsp bovis AF2122/97
ccgucagcuuggacccugcgccg

SEQ ID NO: 3215723 - RNA, 14 nt, Mycobacterium bovis subsp bovis AF2122/97
ccgucaggcgugcc

SEQ ID NO: 3215724 - RNA, 18 nt, Mycobacterium bovis subsp bovis AF2122/97
ccgucagggucaccugcg

SEQ ID NO: 3215725 - RNA, 17 nt, Mycobacterium bovis subsp bovis AF2122/97
ccgucagggucagcugg

SEQ ID NO: 3215726 - RNA, 19 nt, Mycobacterium bovis subsp bovis AF2122/97
ccgucagggucagcuggga

SEQ ID NO: 3215727 - RNA, 23 nt, Mycobacterium bovis subsp bovis AF2122/97
ccgucaguucggugugcggcgca

SEQ ID NO: 3215728 - RNA, 15 nt, Mycobacterium bovis subsp bovis AF2122/97
ccgucauacucgaca

SEQ ID NO: 3215729 - RNA, 21 nt, Mycobacterium bovis subsp bovis AF2122/97
ccgucauacucgacaccgacu

SEQ ID NO: 3215730 - RNA, 20 nt, Mycobacterium bovis subsp bovis AF2122/97
ccgucaucgcggugugccgg

SEQ ID NO: 3215731 - RNA, 21 nt, Mycobacterium bovis subsp bovis AF2122/97
ccgucaucgcggugugccggu

SEQ ID NO: 3215732 - RNA, 19 nt, Mycobacterium bovis subsp bovis AF2122/97
ccgucaucgugcccgcguc

SEQ ID NO: 3215733 - RNA, 16 nt, Mycobacterium bovis subsp bovis AF2122/97
ccgucaucuggaagua

SEQ ID NO: 3215734 - RNA, 20 nt, Mycobacterium bovis subsp bovis AF2122/97
ccgucaugcccaccgccugg

SEQ ID NO: 3215735 - RNA, 15 nt, Mycobacterium bovis subsp bovis AF2122/97
ccgucaugccgacga

SEQ ID NO: 3215736 - RNA, 15 nt, Mycobacterium bovis subsp bovis AF2122/97
ccgucaugccguuga

SEQ ID NO: 3215737 - RNA, 13 nt, Mycobacterium bovis subsp bovis AF2122/97
ccgucauggcccg

SEQ ID NO: 3215738 - RNA, 23 nt, Mycobacterium bovis subsp bovis AF2122/97
ccgucauggcgaaccgucagcgc

SEQ ID NO: 3215739 - RNA, 19 nt, Mycobacterium bovis subsp bovis AF2122/97
ccgucauggcgggugcggc

SEQ ID NO: 3215740 - RNA, 18 nt, Mycobacterium bovis subsp bovis AF2122/97
ccgucaugggcggcuucg

SEQ ID NO: 3215741 - RNA, 14 nt, Mycobacterium bovis subsp bovis AF2122/97
ccgucauuggcuug

SEQ ID NO: 3215742 - RNA, 15 nt, Mycobacterium bovis subsp bovis AF2122/97
ccguccaagccggcu

SEQ ID NO: 3215743 - RNA, 18 nt, Mycobacterium bovis subsp bovis AF2122/97
ccguccaagccggcugca

SEQ ID NO: 3215744 - RNA, 16 nt, Mycobacterium bovis subsp bovis AF2122/97
ccguccaauagcugac

SEQ ID NO: 3215745 - RNA, 14 nt, Mycobacterium bovis subsp bovis AF2122/97
ccguccaccgucac

SEQ ID NO: 3215746 - RNA, 15 nt, Mycobacterium bovis subsp bovis AF2122/97
ccguccagcaacagc

SEQ ID NO: 3215747 - RNA, 22 nt, Mycobacterium bovis subsp bovis AF2122/97
ccguccagcaacagcgagcggu

SEQ ID NO: 3215748 - RNA, 16 nt, Mycobacterium bovis subsp bovis AF2122/97
ccguccagcagcucgg

SEQ ID NO: 3215749 - RNA, 13 nt, Mycobacterium bovis subsp bovis AF2122/97
ccguccagcgccg

SEQ ID NO: 3215750 - RNA, 19 nt, Mycobacterium bovis subsp bovis AF2122/97
ccguccagcgccgcggccc

SEQ ID NO: 3215751 - RNA, 12 nt, Mycobacterium bovis subsp bovis AF2122/97
ccguccaggacg

SEQ ID NO: 3215752 - RNA, 17 nt, Mycobacterium bovis subsp bovis AF2122/97
ccguccaggcgcugcag

SEQ ID NO: 3215753 - RNA, 20 nt, Mycobacterium bovis subsp bovis AF2122/97
ccguccaggcgcugcagcau

SEQ ID NO: 3215754 - RNA, 13 nt, Mycobacterium bovis subsp bovis AF2122/97
ccgucccaccagc

SEQ ID NO: 3215755 - RNA, 15 nt, Mycobacterium bovis subsp bovis AF2122/97
ccgucccacugaccg

SEQ ID NO: 3215756 - RNA, 14 nt, Mycobacterium bovis subsp bovis AF2122/97
ccgucccagcgccg

SEQ ID NO: 3215757 - RNA, 14 nt, Mycobacterium bovis subsp bovis AF2122/97
ccgucccagcugac

SEQ ID NO: 3215758 - RNA, 20 nt, Mycobacterium bovis subsp bovis AF2122/97
ccgucccaggugcaagcggu

SEQ ID NO: 3215759 - RNA, 14 nt, Mycobacterium bovis subsp bovis AF2122/97
ccguccccgcagcg

SEQ ID NO: 3215760 - RNA, 16 nt, Mycobacterium bovis subsp bovis AF2122/97
ccguccccggcguccg

SEQ ID NO: 3215761 - RNA, 17 nt, Mycobacterium bovis subsp bovis AF2122/97
ccguccccggcguccga

SEQ ID NO: 3215762 - RNA, 18 nt, Mycobacterium bovis subsp bovis AF2122/97
ccgucccgaaacgccggg

SEQ ID NO: 3215763 - RNA, 13 nt, Mycobacterium bovis subsp bovis AF2122/97
ccgucccggccuc

SEQ ID NO: 3215764 - RNA, 14 nt, Mycobacterium bovis subsp bovis AF2122/97
ccgucccggccucg

SEQ ID NO: 3215765 - RNA, 21 nt, Mycobacterium bovis subsp bovis AF2122/97
ccgucccggcucgagcucggc

SEQ ID NO: 3215766 - RNA, 18 nt, Mycobacterium bovis subsp bovis AF2122/97
ccgucccugugucgccgu

SEQ ID NO: 3215767 - RNA, 21 nt, Mycobacterium bovis subsp bovis AF2122/97
ccguccgaccgauaacacccg

SEQ ID NO: 3215768 - RNA, 16 nt, Mycobacterium bovis subsp bovis AF2122/97
ccguccgccgcagacg

SEQ ID NO: 3215769 - RNA, 18 nt, Mycobacterium bovis subsp bovis AF2122/97
ccguccgccguaugccgc

SEQ ID NO: 3215770 - RNA, 19 nt, Mycobacterium bovis subsp bovis AF2122/97
ccguccgcggguagcgguu

SEQ ID NO: 3215771 - RNA, 23 nt, Mycobacterium bovis subsp bovis AF2122/97
ccguccgcggguagcgguucauc

SEQ ID NO: 3215772 - RNA, 14 nt, Mycobacterium bovis subsp bovis AF2122/97
ccguccggccgggc

SEQ ID NO: 3215773 - RNA, 15 nt, Mycobacterium bovis subsp bovis AF2122/97
ccguccggcuuggcg

SEQ ID NO: 3215774 - RNA, 17 nt, Mycobacterium bovis subsp bovis AF2122/97
ccguccggcuuggcggc

SEQ ID NO: 3215775 - RNA, 22 nt, Mycobacterium bovis subsp bovis AF2122/97
ccgucgcuagggugagcccggg

SEQ ID NO: 3215776 - RNA, 18 nt, Mycobacterium bovis subsp bovis AF2122/97
ccgucgcugcccgcgcgg

SEQ ID NO: 3215777 - RNA, 19 nt, Mycobacterium bovis subsp bovis AF2122/97
ccgucgcugcccgcgcggc

SEQ ID NO: 3215778 - RNA, 12 nt, Mycobacterium bovis subsp bovis AF2122/97
ccgucgcuggcc

SEQ ID NO: 3215779 - RNA, 17 nt, Mycobacterium bovis subsp bovis AF2122/97
ccgucgcuggccggcac

SEQ ID NO: 3215780 - RNA, 21 nt, Mycobacterium bovis subsp bovis AF2122/97
ccgucgcugggaggcgcgguc

SEQ ID NO: 3215781 - RNA, 20 nt, Mycobacterium bovis subsp bovis AF2122/97
ccgucgcugguggcggucac

SEQ ID NO: 3215782 - RNA, 13 nt, Mycobacterium bovis subsp bovis AF2122/97
ccgucggaacuga

SEQ ID NO: 3215783 - RNA, 17 nt, Mycobacterium bovis subsp bovis AF2122/97
ccgucggacauaccgcg

SEQ ID NO: 3215784 - RNA, 15 nt, Mycobacterium bovis subsp bovis AF2122/97
ccgucggagccggcc

SEQ ID NO: 3215785 - RNA, 22 nt, Mycobacterium bovis subsp bovis AF2122/97
ccgucggagccggccaccucgg

SEQ ID NO: 3215786 - RNA, 22 nt, Mycobacterium bovis subsp bovis AF2122/97
ccgucggaggugaaccccgccg

SEQ ID NO: 3215787 - RNA, 21 nt, Mycobacterium bovis subsp bovis AF2122/97
ccgucggauggaaggcggcca

SEQ ID NO: 3215788 - RNA, 22 nt, Mycobacterium bovis subsp bovis AF2122/97
ccgucggauggaaggcggccag

SEQ ID NO: 3215789 - RNA, 23 nt, Mycobacterium bovis subsp bovis AF2122/97
ccgucggcaauacuccgcugacg

SEQ ID NO: 3215790 - RNA, 14 nt, Mycobacterium bovis subsp bovis AF2122/97
ccgucggcaccagc

SEQ ID NO: 3215791 - RNA, 19 nt, Mycobacterium bovis subsp bovis AF2122/97
ccgucggcaccagcagcca

SEQ ID NO: 3215792 - RNA, 12 nt, Mycobacterium bovis subsp bovis AF2122/97
ccgucggcagca

SEQ ID NO: 3215793 - RNA, 14 nt, Mycobacterium bovis subsp bovis AF2122/97
ccgucggcagcagc

SEQ ID NO: 3215794 - RNA, 14 nt, Mycobacterium bovis subsp bovis AF2122/97
ccgucggccggcaa

SEQ ID NO: 3215795 - RNA, 13 nt, Mycobacterium bovis subsp bovis AF2122/97
ccgucggcgaagg

SEQ ID NO: 3215796 - RNA, 14 nt, Mycobacterium bovis subsp bovis AF2122/97
ccgucggcgacucc

SEQ ID NO: 3215797 - RNA, 17 nt, Mycobacterium bovis subsp bovis AF2122/97
ccgucggcgacuccucu

SEQ ID NO: 3215798 - RNA, 21 nt, Mycobacterium bovis subsp bovis AF2122/97
ccgucggcgagcagacgccgc

SEQ ID NO: 3215799 - RNA, 16 nt, Mycobacterium bovis subsp bovis AF2122/97
ccgucggcgaugaagu

SEQ ID NO: 3215800 - RNA, 14 nt, Mycobacterium bovis subsp bovis AF2122/97
ccgucggcgcccgg

SEQ ID NO: 3215801 - RNA, 20 nt, Mycobacterium bovis subsp bovis AF2122/97
ccgucggcgccucggaccag

SEQ ID NO: 3215802 - RNA, 18 nt, Mycobacterium bovis subsp bovis AF2122/97
ccgucggcgcgcaccucg

SEQ ID NO: 3215803 - RNA, 11 nt, Mycobacterium bovis subsp bovis AF2122/97
ccgucggcgcu

SEQ ID NO: 3215804 - RNA, 20 nt, Mycobacterium bovis subsp bovis AF2122/97
ccgucggcgcucgucgcggc

SEQ ID NO: 3215805 - RNA, 12 nt, Mycobacterium bovis subsp bovis AF2122/97
ccgucggcggcg

SEQ ID NO: 3215806 - RNA, 14 nt, Mycobacterium bovis subsp bovis AF2122/97
ccgucggcggcguu

SEQ ID NO: 3215807 - RNA, 20 nt, Mycobacterium bovis subsp bovis AF2122/97
ccgucggcgugcagcagcuu

SEQ ID NO: 3215808 - RNA, 14 nt, Mycobacterium bovis subsp bovis AF2122/97
ccgucggcguggcu

SEQ ID NO: 3215809 - RNA, 19 nt, Mycobacterium bovis subsp bovis AF2122/97
ccgucgggaccaccgaccg

SEQ ID NO: 3215810 - RNA, 21 nt, Mycobacterium bovis subsp bovis AF2122/97
ccgucgggacggccaacaggg

SEQ ID NO: 3215811 - RNA, 22 nt, Mycobacterium bovis subsp bovis AF2122/97
ccgucgggauggacggcagcca

SEQ ID NO: 3215812 - RNA, 24 nt, Mycobacterium bovis subsp bovis AF2122/97
ccgucgggauggacggcagccagc

SEQ ID NO: 3215813 - RNA, 19 nt, Mycobacterium bovis subsp bovis AF2122/97
ccgucgggcacaccgacgc

SEQ ID NO: 3215814 - RNA, 21 nt, Mycobacterium bovis subsp bovis AF2122/97
ccgucgggcacaccgacgccg

SEQ ID NO: 3215815 - RNA, 22 nt, Mycobacterium bovis subsp bovis AF2122/97
ccgucgggcacaccgacgccgc

SEQ ID NO: 3215816 - RNA, 14 nt, Mycobacterium bovis subsp bovis AF2122/97
ccgucgggcccagc

SEQ ID NO: 3215817 - RNA, 16 nt, Mycobacterium bovis subsp bovis AF2122/97
ccgucgggcccagccg

SEQ ID NO: 3215818 - RNA, 18 nt, Mycobacterium bovis subsp bovis AF2122/97
ccgucgggcccagccgga

SEQ ID NO: 3215819 - RNA, 19 nt, Mycobacterium bovis subsp bovis AF2122/97
ccgucggggacauccgcuu

SEQ ID NO: 3215820 - RNA, 22 nt, Mycobacterium bovis subsp bovis AF2122/97
ccgucggggaguucgcgcagca

SEQ ID NO: 3215821 - RNA, 18 nt, Mycobacterium bovis subsp bovis AF2122/97
ccgucggggaugccgaac

SEQ ID NO: 3215822 - RNA, 22 nt, Mycobacterium bovis subsp bovis AF2122/97
ccgucggggguaauugccagcc

SEQ ID NO: 3215823 - RNA, 20 nt, Mycobacterium bovis subsp bovis AF2122/97
ccgucggggucaacaggccg

SEQ ID NO: 3215824 - RNA, 14 nt, Mycobacterium bovis subsp bovis AF2122/97
ccgucggggucggg

SEQ ID NO: 3215825 - RNA, 19 nt, Mycobacterium bovis subsp bovis AF2122/97
ccgucggggucguugaggc

SEQ ID NO: 3215826 - RNA, 23 nt, Mycobacterium bovis subsp bovis AF2122/97
ccgucggguaggccgccguggug

SEQ ID NO: 3215827 - RNA, 12 nt, Mycobacterium bovis subsp bovis AF2122/97
ccgucgggugca

SEQ ID NO: 3215828 - RNA, 23 nt, Mycobacterium bovis subsp bovis AF2122/97
ccgucgggugcagcacggcgccg

SEQ ID NO: 3215829 - RNA, 23 nt, Mycobacterium bovis subsp bovis AF2122/97
ccgucgggugcugaugggucagg

SEQ ID NO: 3215830 - RNA, 22 nt, Mycobacterium bovis subsp bovis AF2122/97
ccgucgguaaagggcucgaugg

SEQ ID NO: 3215831 - RNA, 22 nt, Mycobacterium bovis subsp bovis AF2122/97
ccgucggugaaauucgcggcgg

SEQ ID NO: 3215832 - RNA, 22 nt, Mycobacterium bovis subsp bovis AF2122/97
ccgucggugauggagccgguga

SEQ ID NO: 3215833 - RNA, 14 nt, Mycobacterium bovis subsp bovis AF2122/97
ccgucggugccgcc

SEQ ID NO: 3215834 - RNA, 15 nt, Mycobacterium bovis subsp bovis AF2122/97
ccgucggugccgccg

SEQ ID NO: 3215835 - RNA, 16 nt, Mycobacterium bovis subsp bovis AF2122/97
ccgucggugccgccgc

SEQ ID NO: 3215836 - RNA, 18 nt, Mycobacterium bovis subsp bovis AF2122/97
ccgucggugccgccgccg

SEQ ID NO: 3215837 - RNA, 21 nt, Mycobacterium bovis subsp bovis AF2122/97
ccgucggugccgccgccggcg

SEQ ID NO: 3215838 - RNA, 17 nt, Mycobacterium bovis subsp bovis AF2122/97
ccgucggugccgcggac

SEQ ID NO: 3215839 - RNA, 18 nt, Mycobacterium bovis subsp bovis AF2122/97
ccgucggugccgcggacg

SEQ ID NO: 3215840 - RNA, 14 nt, Mycobacterium bovis subsp bovis AF2122/97
ccgucggugccggg

SEQ ID NO: 3215841 - RNA, 20 nt, Mycobacterium bovis subsp bovis AF2122/97
ccgucggugggugccagccg

SEQ ID NO: 3215842 - RNA, 23 nt, Mycobacterium bovis subsp bovis AF2122/97
ccgucggugguguuccaggucau

SEQ ID NO: 3215843 - RNA, 20 nt, Mycobacterium bovis subsp bovis AF2122/97
ccgucguacucgaccgcgag

SEQ ID NO: 3215844 - RNA, 15 nt, Mycobacterium bovis subsp bovis AF2122/97
ccgucguacucggcg

SEQ ID NO: 3215845 - RNA, 17 nt, Mycobacterium bovis subsp bovis AF2122/97
ccgucguacucggcggc

SEQ ID NO: 3215846 - RNA, 19 nt, Mycobacterium bovis subsp bovis AF2122/97
ccgucguacucggcggcca

SEQ ID NO: 3215847 - RNA, 16 nt, Mycobacterium bovis subsp bovis AF2122/97
ccgucguagguggccg

SEQ ID NO: 3215848 - RNA, 19 nt, Mycobacterium bovis subsp bovis AF2122/97
ccgucguaguuggugaaca

SEQ ID NO: 3215849 - RNA, 20 nt, Mycobacterium bovis subsp bovis AF2122/97
ccgucguaugcggugacgac

SEQ ID NO: 3215850 - RNA, 14 nt, Mycobacterium bovis subsp bovis AF2122/97
ccgucgucaccgcg

SEQ ID NO: 3215851 - RNA, 15 nt, Mycobacterium bovis subsp bovis AF2122/97
ccgucgucaccgcga

SEQ ID NO: 3215852 - RNA, 17 nt, Mycobacterium bovis subsp bovis AF2122/97
ccgucgucaccgcgacg

SEQ ID NO: 3215853 - RNA, 15 nt, Mycobacterium bovis subsp bovis AF2122/97
ccgucgucagcgggu

SEQ ID NO: 3215854 - RNA, 21 nt, Mycobacterium bovis subsp bovis AF2122/97
ccgucguccgcugacccgcca

SEQ ID NO: 3215855 - RNA, 21 nt, Mycobacterium bovis subsp bovis AF2122/97
ccgucgucgaccacgacguuc

SEQ ID NO: 3215856 - RNA, 16 nt, Mycobacterium bovis subsp bovis AF2122/97
ccgucgucgagcacca

SEQ ID NO: 3215857 - RNA, 22 nt, Mycobacterium bovis subsp bovis AF2122/97
ccgucgucgagcaccacccggg

SEQ ID NO: 3215858 - RNA, 20 nt, Mycobacterium bovis subsp bovis AF2122/97
ccgucgucgccgucggugcc

SEQ ID NO: 3215859 - RNA, 21 nt, Mycobacterium bovis subsp bovis AF2122/97
ccgucgucgccgucggugccg

SEQ ID NO: 3215860 - RNA, 14 nt, Mycobacterium bovis subsp bovis AF2122/97
ccgucgucggucac

SEQ ID NO: 3215861 - RNA, 15 nt, Mycobacterium bovis subsp bovis AF2122/97
ccgugcccccggcuu

SEQ ID NO: 3215862 - RNA, 15 nt, Mycobacterium bovis subsp bovis AF2122/97
ccgugcccggugcgg

SEQ ID NO: 3215863 - RNA, 17 nt, Mycobacterium bovis subsp bovis AF2122/97
ccgugccgcaucacccg

SEQ ID NO: 3215864 - RNA, 18 nt, Mycobacterium bovis subsp bovis AF2122/97
ccgugccgcaucacccgg

SEQ ID NO: 3215865 - RNA, 19 nt, Mycobacterium bovis subsp bovis AF2122/97
ccgugccgcccucaccgcc

SEQ ID NO: 3215866 - RNA, 14 nt, Mycobacterium bovis subsp bovis AF2122/97
ccgugccgccgaca

SEQ ID NO: 3215867 - RNA, 20 nt, Mycobacterium bovis subsp bovis AF2122/97
ccgugccgccgacaccaccg

SEQ ID NO: 3215868 - RNA, 22 nt, Mycobacterium bovis subsp bovis AF2122/97
ccgugccgccgacaccaccggc

SEQ ID NO: 3215869 - RNA, 16 nt, Mycobacterium bovis subsp bovis AF2122/97
ccgugccgggcgacgg

SEQ ID NO: 3215870 - RNA, 19 nt, Mycobacterium bovis subsp bovis AF2122/97
ccgugccgucaacgauggu

SEQ ID NO: 3215871 - RNA, 15 nt, Mycobacterium bovis subsp bovis AF2122/97
ccgugccgucggcgu

SEQ ID NO: 3215872 - RNA, 18 nt, Mycobacterium bovis subsp bovis AF2122/97
ccgugccgucggcgugca

SEQ ID NO: 3215873 - RNA, 18 nt, Mycobacterium bovis subsp bovis AF2122/97
ccgugccucgaggacggc

SEQ ID NO: 3215874 - RNA, 15 nt, Mycobacterium bovis subsp bovis AF2122/97
ccgugccuggccggu

SEQ ID NO: 3215875 - RNA, 16 nt, Mycobacterium bovis subsp bovis AF2122/97
ccgugcgaucaccucc

SEQ ID NO: 3215876 - RNA, 17 nt, Mycobacterium bovis subsp bovis AF2122/97
ccgugcgaucaccuccg

SEQ ID NO: 3215877 - RNA, 21 nt, Mycobacterium bovis subsp bovis AF2122/97
ccgugcgaucaccuccgcgac

SEQ ID NO: 3215878 - RNA, 18 nt, Mycobacterium bovis subsp bovis AF2122/97
ccgugcgaucgucaacga

SEQ ID NO: 3215879 - RNA, 15 nt, Mycobacterium bovis subsp bovis AF2122/97
ccgugcgcgcgcagc

SEQ ID NO: 3215880 - RNA, 18 nt, Mycobacterium bovis subsp bovis AF2122/97
ccgugcggaucgcgcugc

SEQ ID NO: 3215881 - RNA, 14 nt, Mycobacterium bovis subsp bovis AF2122/97
ccgugcggcggcug

SEQ ID NO: 3215882 - RNA, 19 nt, Mycobacterium bovis subsp bovis AF2122/97
ccgugcggcggcugccggu

SEQ ID NO: 3215883 - RNA, 18 nt, Mycobacterium bovis subsp bovis AF2122/97
ccgugcggcucgccggcg

SEQ ID NO: 3215884 - RNA, 19 nt, Mycobacterium bovis subsp bovis AF2122/97
ccgugcggcucgccggcgg

SEQ ID NO: 3215885 - RNA, 16 nt, Mycobacterium bovis subsp bovis AF2122/97
ccgugcggggggcagc

SEQ ID NO: 3215886 - RNA, 19 nt, Mycobacterium bovis subsp bovis AF2122/97
ccgugcgggucguccgccu

SEQ ID NO: 3215887 - RNA, 19 nt, Mycobacterium bovis subsp bovis AF2122/97
ccgugcggguucacugccg

SEQ ID NO: 3215888 - RNA, 22 nt, Mycobacterium bovis subsp bovis AF2122/97
ccgugcggguucacugccggcc

SEQ ID NO: 3215889 - RNA, 23 nt, Mycobacterium bovis subsp bovis AF2122/97
ccgugcggguucacugccggcca

SEQ ID NO: 3215890 - RNA, 23 nt, Mycobacterium bovis subsp bovis AF2122/97
ccgugcgguauuugaacgcccgc

SEQ ID NO: 3215891 - RNA, 15 nt, Mycobacterium bovis subsp bovis AF2122/97
ccgugcggucgcgcc

SEQ ID NO: 3215892 - RNA, 16 nt, Mycobacterium bovis subsp bovis AF2122/97
ccgugcggucgcgccc

SEQ ID NO: 3215893 - RNA, 21 nt, Mycobacterium bovis subsp bovis AF2122/97
ccgugcggucgugccccgcgg

SEQ ID NO: 3215894 - RNA, 20 nt, Mycobacterium bovis subsp bovis AF2122/97
ccgugcgucgauggcgucgg

SEQ ID NO: 3215895 - RNA, 18 nt, Mycobacterium bovis subsp bovis AF2122/97
ccgugcugcccaucccgg

SEQ ID NO: 3215896 - RNA, 20 nt, Mycobacterium bovis subsp bovis AF2122/97
ccgugcugcccaucccggcc

SEQ ID NO: 3215897 - RNA, 15 nt, Mycobacterium bovis subsp bovis AF2122/97
ccgugcuggcgccga

SEQ ID NO: 3215898 - RNA, 17 nt, Mycobacterium bovis subsp bovis AF2122/97
ccgugcugggccgacgg

SEQ ID NO: 3215899 - RNA, 18 nt, Mycobacterium bovis subsp bovis AF2122/97
ccgugcugggcgccgcgc

SEQ ID NO: 3215900 - RNA, 20 nt, Mycobacterium bovis subsp bovis AF2122/97
ccgugcuuguugcgcgacgc

SEQ ID NO: 3215901 - RNA, 21 nt, Mycobacterium bovis subsp bovis AF2122/97
ccgugcuuuccuugcgcgcca

SEQ ID NO: 3215902 - RNA, 22 nt, Mycobacterium bovis subsp bovis AF2122/97
ccguggaagauguugccgccgg

SEQ ID NO: 3215903 - RNA, 18 nt, Mycobacterium bovis subsp bovis AF2122/97
ccguggacaagcacagcg

SEQ ID NO: 3215904 - RNA, 18 nt, Mycobacterium bovis subsp bovis AF2122/97
ccguggaggcccgucaca

SEQ ID NO: 3215905 - RNA, 14 nt, Mycobacterium bovis subsp bovis AF2122/97
ccguggaucggcag

SEQ ID NO: 3215906 - RNA, 19 nt, Mycobacterium bovis subsp bovis AF2122/97
ccguggaucggcagcccgg

SEQ ID NO: 3215907 - RNA, 23 nt, Mycobacterium bovis subsp bovis AF2122/97
ccguggcacccgcaguggucggc

SEQ ID NO: 3215908 - RNA, 14 nt, Mycobacterium bovis subsp bovis AF2122/97
ccguggccaucgau

SEQ ID NO: 3215909 - RNA, 12 nt, Mycobacterium bovis subsp bovis AF2122/97
ccguggcccgcu

SEQ ID NO: 3215910 - RNA, 18 nt, Mycobacterium bovis subsp bovis AF2122/97
ccguggccgcacugcugg

SEQ ID NO: 3215911 - RNA, 18 nt, Mycobacterium bovis subsp bovis AF2122/97
ccguggccggacccauug

SEQ ID NO: 3215912 - RNA, 19 nt, Mycobacterium bovis subsp bovis AF2122/97
ccguggccugaaacggcug

SEQ ID NO: 3215913 - RNA, 21 nt, Mycobacterium bovis subsp bovis AF2122/97
ccguggcgaaugacggccagu

SEQ ID NO: 3215914 - RNA, 15 nt, Mycobacterium bovis subsp bovis AF2122/97
ccguggcgcggucgg

SEQ ID NO: 3215915 - RNA, 17 nt, Mycobacterium bovis subsp bovis AF2122/97
ccguggcggacggcguc

SEQ ID NO: 3215916 - RNA, 19 nt, Mycobacterium bovis subsp bovis AF2122/97
ccguggcggacggcgucga

SEQ ID NO: 3215917 - RNA, 22 nt, Mycobacterium bovis subsp bovis AF2122/97
ccguggcggccuccuccccgac

SEQ ID NO: 3215918 - RNA, 23 nt, Mycobacterium bovis subsp bovis AF2122/97
ccguggcggcgggccucggcgac

SEQ ID NO: 3215919 - RNA, 23 nt, Mycobacterium bovis subsp bovis AF2122/97
ccguggcggggaaaccggccagc

SEQ ID NO: 3215920 - RNA, 16 nt, Mycobacterium bovis subsp bovis AF2122/97
ccguggcugcgcucgc

SEQ ID NO: 3215921 - RNA, 14 nt, Mycobacterium bovis subsp bovis AF2122/97
ccgugggcagcgcg

SEQ ID NO: 3215922 - RNA, 20 nt, Mycobacterium bovis subsp bovis AF2122/97
ccgugggcagcgcgcccgac

SEQ ID NO: 3215923 - RNA, 17 nt, Mycobacterium bovis subsp bovis AF2122/97
ccgugggccugcccggc

SEQ ID NO: 3215924 - RNA, 21 nt, Mycobacterium bovis subsp bovis AF2122/97
ccgugggccugcccggcgccg

SEQ ID NO: 3215925 - RNA, 20 nt, Mycobacterium bovis subsp bovis AF2122/97
ccgugggguaucgccagcca

SEQ ID NO: 3215926 - RNA, 20 nt, Mycobacterium bovis subsp bovis AF2122/97
ccgugggguguggcggcggg

SEQ ID NO: 3215927 - RNA, 20 nt, Mycobacterium bovis subsp bovis AF2122/97
ccgugggugucgguggccgc

SEQ ID NO: 3215928 - RNA, 23 nt, Mycobacterium bovis subsp bovis AF2122/97
ccguggguguugaugggcagccg

SEQ ID NO: 3215929 - RNA, 10 nt, Mycobacterium bovis subsp bovis AF2122/97
ccguggucga

SEQ ID NO: 3215930 - RNA, 19 nt, Mycobacterium bovis subsp bovis AF2122/97
ccguggugcuagcgccgcc

SEQ ID NO: 3215931 - RNA, 20 nt, Mycobacterium bovis subsp bovis AF2122/97
ccguggugcuagcgccgcca

SEQ ID NO: 3215932 - RNA, 22 nt, Mycobacterium bovis subsp bovis AF2122/97
ccgugguggacgaccgcgcggc

SEQ ID NO: 3215933 - RNA, 19 nt, Mycobacterium bovis subsp bovis AF2122/97
ccgugguggacgaugcggu

SEQ ID NO: 3215934 - RNA, 19 nt, Mycobacterium bovis subsp bovis AF2122/97
ccgugguggcguaucgggc

SEQ ID NO: 3215935 - RNA, 18 nt, Mycobacterium bovis subsp bovis AF2122/97
ccgugguggucgggcgca

SEQ ID NO: 3215936 - RNA, 22 nt, Mycobacterium bovis subsp bovis AF2122/97
ccgugguugcacguucggcgug

SEQ ID NO: 3215937 - RNA, 17 nt, Mycobacterium bovis subsp bovis AF2122/97
ccguguaugcauccacu

SEQ ID NO: 3215938 - RNA, 17 nt, Mycobacterium bovis subsp bovis AF2122/97
ccgugucaaccggucgg

SEQ ID NO: 3215939 - RNA, 14 nt, Mycobacterium bovis subsp bovis AF2122/97
ccgugucaccgccg

SEQ ID NO: 3215940 - RNA, 15 nt, Mycobacterium bovis subsp bovis AF2122/97
ccgugucaccgccgg

SEQ ID NO: 3215941 - RNA, 13 nt, Mycobacterium bovis subsp bovis AF2122/97
ccgugucaccggg

SEQ ID NO: 3215942 - RNA, 16 nt, Mycobacterium bovis subsp bovis AF2122/97
ccgugucacgcgacca

SEQ ID NO: 3215943 - RNA, 22 nt, Mycobacterium bovis subsp bovis AF2122/97
ccgugucacgcgaccaccgccg

SEQ ID NO: 3215944 - RNA, 13 nt, Mycobacterium bovis subsp bovis AF2122/97
ccguguccagcau

SEQ ID NO: 3215945 - RNA, 16 nt, Mycobacterium bovis subsp bovis AF2122/97
ccgugucgagaucuca

SEQ ID NO: 3215946 - RNA, 20 nt, Mycobacterium bovis subsp bovis AF2122/97
ccgugucgagaucucacgug

SEQ ID NO: 3215947 - RNA, 15 nt, Mycobacterium bovis subsp bovis AF2122/97
ccguugccgccgccu

SEQ ID NO: 3215948 - RNA, 14 nt, Mycobacterium bovis subsp bovis AF2122/97
ccguugccgccggc

SEQ ID NO: 3215949 - RNA, 15 nt, Mycobacterium bovis subsp bovis AF2122/97
ccguugccgccggcg

SEQ ID NO: 3215950 - RNA, 14 nt, Mycobacterium bovis subsp bovis AF2122/97
ccguugccgccggu

SEQ ID NO: 3215951 - RNA, 22 nt, Mycobacterium bovis subsp bovis AF2122/97
ccguugccgccggugccacccu

SEQ ID NO: 3215952 - RNA, 14 nt, Mycobacterium bovis subsp bovis AF2122/97
ccguugccgccguc

SEQ ID NO: 3215953 - RNA, 16 nt, Mycobacterium bovis subsp bovis AF2122/97
ccguugccgccgucgc

SEQ ID NO: 3215954 - RNA, 17 nt, Mycobacterium bovis subsp bovis AF2122/97
ccguugccgccgucgcc

SEQ ID NO: 3215955 - RNA, 18 nt, Mycobacterium bovis subsp bovis AF2122/97
ccguugccgccgucgccg

SEQ ID NO: 3215956 - RNA, 20 nt, Mycobacterium bovis subsp bovis AF2122/97
ccguugccgccguugccggc

SEQ ID NO: 3215957 - RNA, 12 nt, Mycobacterium bovis subsp bovis AF2122/97
ccguugccgccu

SEQ ID NO: 3215958 - RNA, 21 nt, Mycobacterium bovis subsp bovis AF2122/97
ccguugccgccugucccgccg

SEQ ID NO: 3215959 - RNA, 21 nt, Mycobacterium bovis subsp bovis AF2122/97
ccguugccggcguugccgccg

SEQ ID NO: 3215960 - RNA, 23 nt, Mycobacterium bovis subsp bovis AF2122/97
ccguugccggcguugccgccguc

SEQ ID NO: 3215961 - RNA, 21 nt, Mycobacterium bovis subsp bovis AF2122/97
ccguugccguacagcccggcc

SEQ ID NO: 3215962 - RNA, 17 nt, Mycobacterium bovis subsp bovis AF2122/97
ccguugcgaauccccaa

SEQ ID NO: 3215963 - RNA, 17 nt, Mycobacterium bovis subsp bovis AF2122/97
ccguugcgaucgcgugc

SEQ ID NO: 3215964 - RNA, 14 nt, Mycobacterium bovis subsp bovis AF2122/97
ccguugcgggccag

SEQ ID NO: 3215965 - RNA, 17 nt, Mycobacterium bovis subsp bovis AF2122/97
ccguugcuauucgccag

SEQ ID NO: 3215966 - RNA, 21 nt, Mycobacterium bovis subsp bovis AF2122/97
ccguugcugagcguaggccag

SEQ ID NO: 3215967 - RNA, 21 nt, Mycobacterium bovis subsp bovis AF2122/97
ccguuggcgacguuggcggga

SEQ ID NO: 3215968 - RNA, 20 nt, Mycobacterium bovis subsp bovis AF2122/97
ccguuggcggcgguggccag

SEQ ID NO: 3215969 - RNA, 22 nt, Mycobacterium bovis subsp bovis AF2122/97
ccguuggcggcgguggccagcg

SEQ ID NO: 3215970 - RNA, 14 nt, Mycobacterium bovis subsp bovis AF2122/97
ccguuggcgguggu

SEQ ID NO: 3215971 - RNA, 15 nt, Mycobacterium bovis subsp bovis AF2122/97
ccguuggggccguuc

SEQ ID NO: 3215972 - RNA, 22 nt, Mycobacterium bovis subsp bovis AF2122/97
ccguuggugaggccccccgcgc

SEQ ID NO: 3215973 - RNA, 15 nt, Mycobacterium bovis subsp bovis AF2122/97
ccguuggugccgccu

SEQ ID NO: 3215974 - RNA, 22 nt, Mycobacterium bovis subsp bovis AF2122/97
ccguuggugccgccugugccac

SEQ ID NO: 3215975 - RNA, 16 nt, Mycobacterium bovis subsp bovis AF2122/97
ccguuguccagaacgg

SEQ ID NO: 3215976 - RNA, 19 nt, Mycobacterium bovis subsp bovis AF2122/97
ccguuguccagcgcgacgu

SEQ ID NO: 3215977 - RNA, 16 nt, Mycobacterium bovis subsp bovis AF2122/97
ccguugugucaccggc

SEQ ID NO: 3215978 - RNA, 23 nt, Mycobacterium bovis subsp bovis AF2122/97
ccguuguucccauagccagccga

SEQ ID NO: 3215979 - RNA, 13 nt, Mycobacterium bovis subsp bovis AF2122/97
ccguuguugagga

SEQ ID NO: 3215980 - RNA, 18 nt, Mycobacterium bovis subsp bovis AF2122/97
ccguuuccucagcugcuc

SEQ ID NO: 3215981 - RNA, 14 nt, Mycobacterium bovis subsp bovis AF2122/97
ccguuuccugcguc

SEQ ID NO: 3215982 - RNA, 16 nt, Mycobacterium bovis subsp bovis AF2122/97
ccguuucggcgccguc

SEQ ID NO: 3215983 - RNA, 22 nt, Mycobacterium bovis subsp bovis AF2122/97
ccguuucgggaagucgggccgg

SEQ ID NO: 3215984 - RNA, 14 nt, Mycobacterium bovis subsp bovis AF2122/97
ccguuugacgcgcu

SEQ ID NO: 3215985 - RNA, 15 nt, Mycobacterium bovis subsp bovis AF2122/97
ccguuugcgcaccgg

SEQ ID NO: 3215986 - RNA, 15 nt, Mycobacterium bovis subsp bovis AF2122/97
ccguuugggcgccgg

SEQ ID NO: 3215987 - RNA, 15 nt, Mycobacterium bovis subsp bovis AF2122/97
ccguuuuaccucggc

SEQ ID NO: 3215988 - RNA, 12 nt, Mycobacterium bovis subsp bovis AF2122/97
ccuaaacaccgc

SEQ ID NO: 3215989 - RNA, 18 nt, Mycobacterium bovis subsp bovis AF2122/97
ccuaaaccagccaccacc

SEQ ID NO: 3215990 - RNA, 17 nt, Mycobacterium bovis subsp bovis AF2122/97
ccuaacaucguugaucu

SEQ ID NO: 3215991 - RNA, 15 nt, Mycobacterium bovis subsp bovis AF2122/97
ccuaacccgcgccgg

SEQ ID NO: 3215992 - RNA, 17 nt, Mycobacterium bovis subsp bovis AF2122/97
ccuaacccgcgccggcc

SEQ ID NO: 3215993 - RNA, 14 nt, Mycobacterium bovis subsp bovis AF2122/97
ccuaacucgccugc

SEQ ID NO: 3215994 - RNA, 18 nt, Mycobacterium bovis subsp bovis AF2122/97
ccuaaggcucaccaggcg

SEQ ID NO: 3215995 - RNA, 18 nt, Mycobacterium bovis subsp bovis AF2122/97
ccuaaguucgccacgccc

SEQ ID NO: 3215996 - RNA, 17 nt, Mycobacterium bovis subsp bovis AF2122/97
ccuaauucggggccgcg

SEQ ID NO: 3215997 - RNA, 21 nt, Mycobacterium bovis subsp bovis AF2122/97
ccuacaccggcaagccacgcc

SEQ ID NO: 3215998 - RNA, 13 nt, Mycobacterium bovis subsp bovis AF2122/97
ccuacaccggcgc

SEQ ID NO: 3215999 - RNA, 12 nt, Mycobacterium bovis subsp bovis AF2122/97
ccuaccaggcgc

SEQ ID NO: 3216000 - RNA, 19 nt, Mycobacterium bovis subsp bovis AF2122/97
ccuaccgagaucaccgcca

SEQ ID NO: 3216001 - RNA, 12 nt, Mycobacterium bovis subsp bovis AF2122/97
ccuaccgagcua

SEQ ID NO: 3216002 - RNA, 19 nt, Mycobacterium bovis subsp bovis AF2122/97
ccuaccgaugaaccaggcg

SEQ ID NO: 3216003 - RNA, 20 nt, Mycobacterium bovis subsp bovis AF2122/97
ccuaccgaugaaccaggcgg

SEQ ID NO: 3216004 - RNA, 12 nt, Mycobacterium bovis subsp bovis AF2122/97
ccuaccgggccc

SEQ ID NO: 3216005 - RNA, 20 nt, Mycobacterium bovis subsp bovis AF2122/97
ccuaccuccucggcguggca

SEQ ID NO: 3216006 - RNA, 15 nt, Mycobacterium bovis subsp bovis AF2122/97
ccuacgaugacguuu

SEQ ID NO: 3216007 - RNA, 14 nt, Mycobacterium bovis subsp bovis AF2122/97
ccuacgcagcgcgg

SEQ ID NO: 3216008 - RNA, 14 nt, Mycobacterium bovis subsp bovis AF2122/97
ccuacggugcaguc

SEQ ID NO: 3216009 - RNA, 18 nt, Mycobacterium bovis subsp bovis AF2122/97
ccuacggugcagucgauu

SEQ ID NO: 3216010 - RNA, 15 nt, Mycobacterium bovis subsp bovis AF2122/97
ccuagaccgggcggu

SEQ ID NO: 3216011 - RNA, 21 nt, Mycobacterium bovis subsp bovis AF2122/97
ccuagcagggugccggcgccg

SEQ ID NO: 3216012 - RNA, 22 nt, Mycobacterium bovis subsp bovis AF2122/97
ccuagcagggugccggcgccgc

SEQ ID NO: 3216013 - RNA, 23 nt, Mycobacterium bovis subsp bovis AF2122/97
ccuagcagggugccggcgccgcc

SEQ ID NO: 3216014 - RNA, 19 nt, Mycobacterium bovis subsp bovis AF2122/97
ccuagccccugaaggccag

SEQ ID NO: 3216015 - RNA, 20 nt, Mycobacterium bovis subsp bovis AF2122/97
ccuagccccugaaggccagc

SEQ ID NO: 3216016 - RNA, 20 nt, Mycobacterium bovis subsp bovis AF2122/97
ccuagccgcagccccgacag

SEQ ID NO: 3216017 - RNA, 18 nt, Mycobacterium bovis subsp bovis AF2122/97
ccuagccggcgcgcccca

SEQ ID NO: 3216018 - RNA, 20 nt, Mycobacterium bovis subsp bovis AF2122/97
ccuagcgagcgcacaccggc

SEQ ID NO: 3216019 - RNA, 17 nt, Mycobacterium bovis subsp bovis AF2122/97
ccuagcgagcggcacca

SEQ ID NO: 3216020 - RNA, 21 nt, Mycobacterium bovis subsp bovis AF2122/97
ccuagcgcaugucgauccggc

SEQ ID NO: 3216021 - RNA, 18 nt, Mycobacterium bovis subsp bovis AF2122/97
ccuagcgcgggcucggug

SEQ ID NO: 3216022 - RNA, 22 nt, Mycobacterium bovis subsp bovis AF2122/97
ccuaggccgaggccgcugccag

SEQ ID NO: 3216023 - RNA, 13 nt, Mycobacterium bovis subsp bovis AF2122/97
ccuagggcggcgg

SEQ ID NO: 3216024 - RNA, 18 nt, Mycobacterium bovis subsp bovis AF2122/97
ccuagguagucggccucc

SEQ ID NO: 3216025 - RNA, 15 nt, Mycobacterium bovis subsp bovis AF2122/97
ccuaggucgacgccg

SEQ ID NO: 3216026 - RNA, 17 nt, Mycobacterium bovis subsp bovis AF2122/97
ccuaggucgacgccgac

SEQ ID NO: 3216027 - RNA, 22 nt, Mycobacterium bovis subsp bovis AF2122/97
ccuaggugaguaagcccggucg

SEQ ID NO: 3216028 - RNA, 20 nt, Mycobacterium bovis subsp bovis AF2122/97
ccuagguucgcccagcccga

SEQ ID NO: 3216029 - RNA, 18 nt, Mycobacterium bovis subsp bovis AF2122/97
ccuaguccuggcucggca

SEQ ID NO: 3216030 - RNA, 21 nt, Mycobacterium bovis subsp bovis AF2122/97
ccuaucagccgagacaccacg

SEQ ID NO: 3216031 - RNA, 17 nt, Mycobacterium bovis subsp bovis AF2122/97
ccuaucagugagccgcc

SEQ ID NO: 3216032 - RNA, 16 nt, Mycobacterium bovis subsp bovis AF2122/97
ccuaucccgaaucuca

SEQ ID NO: 3216033 - RNA, 14 nt, Mycobacterium bovis subsp bovis AF2122/97
ccucccacccccgg

SEQ ID NO: 3216034 - RNA, 16 nt, Mycobacterium bovis subsp bovis AF2122/97
ccucccacgccgccgu

SEQ ID NO: 3216035 - RNA, 22 nt, Mycobacterium bovis subsp bovis AF2122/97
ccucccagggcucggcggcccg

SEQ ID NO: 3216036 - RNA, 23 nt, Mycobacterium bovis subsp bovis AF2122/97
ccucccagggcucggcggcccgg

SEQ ID NO: 3216037 - RNA, 20 nt, Mycobacterium bovis subsp bovis AF2122/97
ccucccauucccaacacagc

SEQ ID NO: 3216038 - RNA, 21 nt, Mycobacterium bovis subsp bovis AF2122/97
ccucccauucccaacacagcc

SEQ ID NO: 3216039 - RNA, 22 nt, Mycobacterium bovis subsp bovis AF2122/97
ccuccccaacgucgucauccaa

SEQ ID NO: 3216040 - RNA, 15 nt, Mycobacterium bovis subsp bovis AF2122/97
ccuccccgaccgcca

SEQ ID NO: 3216041 - RNA, 17 nt, Mycobacterium bovis subsp bovis AF2122/97
ccuccccgaccgccacc

SEQ ID NO: 3216042 - RNA, 20 nt, Mycobacterium bovis subsp bovis AF2122/97
ccuccccgaccgccaccgcc

SEQ ID NO: 3216043 - RNA, 20 nt, Mycobacterium bovis subsp bovis AF2122/97
ccucccgauucucgaucugg

SEQ ID NO: 3216044 - RNA, 21 nt, Mycobacterium bovis subsp bovis AF2122/97
ccucccgcaaugcgagcgcgc

SEQ ID NO: 3216045 - RNA, 19 nt, Mycobacterium bovis subsp bovis AF2122/97
ccucccgcagccgggcacc

SEQ ID NO: 3216046 - RNA, 12 nt, Mycobacterium bovis subsp bovis AF2122/97
ccucccgcgccg

SEQ ID NO: 3216047 - RNA, 13 nt, Mycobacterium bovis subsp bovis AF2122/97
ccucccgcgccgg

SEQ ID NO: 3216048 - RNA, 13 nt, Mycobacterium bovis subsp bovis AF2122/97
ccucccgcggcac

SEQ ID NO: 3216049 - RNA, 14 nt, Mycobacterium bovis subsp bovis AF2122/97
ccucccgcggcacc

SEQ ID NO: 3216050 - RNA, 12 nt, Mycobacterium bovis subsp bovis AF2122/97
ccucccgcgugc

SEQ ID NO: 3216051 - RNA, 14 nt, Mycobacterium bovis subsp bovis AF2122/97
ccucccgcgugcgg

SEQ ID NO: 3216052 - RNA, 14 nt, Mycobacterium bovis subsp bovis AF2122/97
ccucccgggccgcc

SEQ ID NO: 3216053 - RNA, 15 nt, Mycobacterium bovis subsp bovis AF2122/97
ccucccgggccgccg

SEQ ID NO: 3216054 - RNA, 16 nt, Mycobacterium bovis subsp bovis AF2122/97
ccucccgggccgccgc

SEQ ID NO: 3216055 - RNA, 17 nt, Mycobacterium bovis subsp bovis AF2122/97
ccucccgggccgccgcg

SEQ ID NO: 3216056 - RNA, 15 nt, Mycobacterium bovis subsp bovis AF2122/97
ccucccuuccgcgcu

SEQ ID NO: 3216057 - RNA, 14 nt, Mycobacterium bovis subsp bovis AF2122/97
ccuccgacgcgauc

SEQ ID NO: 3216058 - RNA, 15 nt, Mycobacterium bovis subsp bovis AF2122/97
ccuccgacggccgcg

SEQ ID NO: 3216059 - RNA, 17 nt, Mycobacterium bovis subsp bovis AF2122/97
ccuccgacggccgcggc

SEQ ID NO: 3216060 - RNA, 22 nt, Mycobacterium bovis subsp bovis AF2122/97
ccuccgacgggacaaggucauc

SEQ ID NO: 3216061 - RNA, 13 nt, Mycobacterium bovis subsp bovis AF2122/97
ccuccgacgugcc

SEQ ID NO: 3216062 - RNA, 13 nt, Mycobacterium bovis subsp bovis AF2122/97
ccuccgagcacag

SEQ ID NO: 3216063 - RNA, 20 nt, Mycobacterium bovis subsp bovis AF2122/97
ccuccgaggaauacagcuug

SEQ ID NO: 3216064 - RNA, 21 nt, Mycobacterium bovis subsp bovis AF2122/97
ccuccgaggaauacagcuuga

SEQ ID NO: 3216065 - RNA, 13 nt, Mycobacterium bovis subsp bovis AF2122/97
ccuccgaggccgc

SEQ ID NO: 3216066 - RNA, 12 nt, Mycobacterium bovis subsp bovis AF2122/97
ccuccgaucacg

SEQ ID NO: 3216067 - RNA, 13 nt, Mycobacterium bovis subsp bovis AF2122/97
ccuccgaucacgc

SEQ ID NO: 3216068 - RNA, 14 nt, Mycobacterium bovis subsp bovis AF2122/97
ccuccgcaaucgcg

SEQ ID NO: 3216069 - RNA, 20 nt, Mycobacterium bovis subsp bovis AF2122/97
ccuccgcaaucgcgacgggg

SEQ ID NO: 3216070 - RNA, 21 nt, Mycobacterium bovis subsp bovis AF2122/97
ccuccgccgaggaaaccacca

SEQ ID NO: 3216071 - RNA, 17 nt, Mycobacterium bovis subsp bovis AF2122/97
ccuccgccgaggccgcc

SEQ ID NO: 3216072 - RNA, 17 nt, Mycobacterium bovis subsp bovis AF2122/97
ccuccgcguccaaggcg

SEQ ID NO: 3216073 - RNA, 23 nt, Mycobacterium bovis subsp bovis AF2122/97
ccuccgcucacggauucgggcga

SEQ ID NO: 3216074 - RNA, 14 nt, Mycobacterium bovis subsp bovis AF2122/97
ccuccgcugccgcc

SEQ ID NO: 3216075 - RNA, 16 nt, Mycobacterium bovis subsp bovis AF2122/97
ccuccgcugccgcccg

SEQ ID NO: 3216076 - RNA, 17 nt, Mycobacterium bovis subsp bovis AF2122/97
ccuccgcugccgcccgc

SEQ ID NO: 3216077 - RNA, 20 nt, Mycobacterium bovis subsp bovis AF2122/97
ccuccgcugccgcccgcgcc

SEQ ID NO: 3216078 - RNA, 23 nt, Mycobacterium bovis subsp bovis AF2122/97
ccuccggaaagcucucggcaccc

SEQ ID NO: 3216079 - RNA, 17 nt, Mycobacterium bovis subsp bovis AF2122/97
ccuccggaaucgcccgg

SEQ ID NO: 3216080 - RNA, 20 nt, Mycobacterium bovis subsp bovis AF2122/97
ccuccggauaacccagcggc

SEQ ID NO: 3216081 - RNA, 23 nt, Mycobacterium bovis subsp bovis AF2122/97
ccuccggauaacccagcggcgcc

SEQ ID NO: 3216082 - RNA, 22 nt, Mycobacterium bovis subsp bovis AF2122/97
ccuccggcaccaacgccaccgu

SEQ ID NO: 3216083 - RNA, 12 nt, Mycobacterium bovis subsp bovis AF2122/97
ccuccggcagca

SEQ ID NO: 3216084 - RNA, 17 nt, Mycobacterium bovis subsp bovis AF2122/97
ccuccggcgcagcgacc

SEQ ID NO: 3216085 - RNA, 20 nt, Mycobacterium bovis subsp bovis AF2122/97
ccuccggcgcagcgaccggu

SEQ ID NO: 3216086 - RNA, 23 nt, Mycobacterium bovis subsp bovis AF2122/97
ccuccggugcauauuggaucguc

SEQ ID NO: 3216087 - RNA, 23 nt, Mycobacterium bovis subsp bovis AF2122/97
ccuccguaacgccaagcucggcc

SEQ ID NO: 3216088 - RNA, 14 nt, Mycobacterium bovis subsp bovis AF2122/97
ccuccgucagcgcc

SEQ ID NO: 3216089 - RNA, 15 nt, Mycobacterium bovis subsp bovis AF2122/97
ccuccgucagcgccg

SEQ ID NO: 3216090 - RNA, 16 nt, Mycobacterium bovis subsp bovis AF2122/97
ccuccgucagcgccgc

SEQ ID NO: 3216091 - RNA, 19 nt, Mycobacterium bovis subsp bovis AF2122/97
ccuccgucagcgccgcgcg

SEQ ID NO: 3216092 - RNA, 20 nt, Mycobacterium bovis subsp bovis AF2122/97
ccuccgugggcagcgcgccc

SEQ ID NO: 3216093 - RNA, 16 nt, Mycobacterium bovis subsp bovis AF2122/97
ccuccuccgcaaucgc

SEQ ID NO: 3216094 - RNA, 14 nt, Mycobacterium bovis subsp bovis AF2122/97
ccuccuccguuugg

SEQ ID NO: 3216095 - RNA, 20 nt, Mycobacterium bovis subsp bovis AF2122/97
ccuccucgaccagagccgcg

SEQ ID NO: 3216096 - RNA, 12 nt, Mycobacterium bovis subsp bovis AF2122/97
ccuccucgauag

SEQ ID NO: 3216097 - RNA, 19 nt, Mycobacterium bovis subsp bovis AF2122/97
ccuccucgauagcggcgcc

SEQ ID NO: 3216098 - RNA, 23 nt, Mycobacterium bovis subsp bovis AF2122/97
ccuccucgauagcggcgccugac

SEQ ID NO: 3216099 - RNA, 21 nt, Mycobacterium bovis subsp bovis AF2122/97
ccuccucgcccauuggccagg

SEQ ID NO: 3216100 - RNA, 13 nt, Mycobacterium bovis subsp bovis AF2122/97
ccuccucggcgcg

SEQ ID NO: 3216101 - RNA, 15 nt, Mycobacterium bovis subsp bovis AF2122/97
ccuccucggcgcgaa

SEQ ID NO: 3216102 - RNA, 14 nt, Mycobacterium bovis subsp bovis AF2122/97
ccuccucgucgcuc

SEQ ID NO: 3216103 - RNA, 16 nt, Mycobacterium bovis subsp bovis AF2122/97
ccuccucgugcaggac

SEQ ID NO: 3216104 - RNA, 18 nt, Mycobacterium bovis subsp bovis AF2122/97
ccuccucuuggguccaca

SEQ ID NO: 3216105 - RNA, 12 nt, Mycobacterium bovis subsp bovis AF2122/97
ccuccugccuuu

SEQ ID NO: 3216106 - RNA, 14 nt, Mycobacterium bovis subsp bovis AF2122/97
ccuccugcgagugc

SEQ ID NO: 3216107 - RNA, 21 nt, Mycobacterium bovis subsp bovis AF2122/97
ccucgaaacgcuuacccagcc

SEQ ID NO: 3216108 - RNA, 15 nt, Mycobacterium bovis subsp bovis AF2122/97
ccucgaagaacuggu

SEQ ID NO: 3216109 - RNA, 15 nt, Mycobacterium bovis subsp bovis AF2122/97
ccucgaagcccagca

SEQ ID NO: 3216110 - RNA, 23 nt, Mycobacterium bovis subsp bovis AF2122/97
ccucgaagcccagcaccaccacc

SEQ ID NO: 3216111 - RNA, 20 nt, Mycobacterium bovis subsp bovis AF2122/97
ccucgaaggcacugcgaucg

SEQ ID NO: 3216112 - RNA, 20 nt, Mycobacterium bovis subsp bovis AF2122/97
ccucgaaggcuucgcuggcu

SEQ ID NO: 3216113 - RNA, 20 nt, Mycobacterium bovis subsp bovis AF2122/97
ccucgaagggcuugucgccg

SEQ ID NO: 3216114 - RNA, 17 nt, Mycobacterium bovis subsp bovis AF2122/97
ccucgaauucggccggc

SEQ ID NO: 3216115 - RNA, 13 nt, Mycobacterium bovis subsp bovis AF2122/97
ccucgacacccag

SEQ ID NO: 3216116 - RNA, 17 nt, Mycobacterium bovis subsp bovis AF2122/97
ccucgacacccagccgc

SEQ ID NO: 3216117 - RNA, 21 nt, Mycobacterium bovis subsp bovis AF2122/97
ccucgacacccauccucgcgg

SEQ ID NO: 3216118 - RNA, 14 nt, Mycobacterium bovis subsp bovis AF2122/97
ccucgacacgccgu

SEQ ID NO: 3216119 - RNA, 13 nt, Mycobacterium bovis subsp bovis AF2122/97
ccucgacagcggc

SEQ ID NO: 3216120 - RNA, 21 nt, Mycobacterium bovis subsp bovis AF2122/97
ccucgcuaauugcggccgccg

SEQ ID NO: 3216121 - RNA, 18 nt, Mycobacterium bovis subsp bovis AF2122/97
ccucgcugcgguggaacc

SEQ ID NO: 3216122 - RNA, 13 nt, Mycobacterium bovis subsp bovis AF2122/97
ccucgcuggccgc

SEQ ID NO: 3216123 - RNA, 21 nt, Mycobacterium bovis subsp bovis AF2122/97
ccucgcugucgaucagcgacc

SEQ ID NO: 3216124 - RNA, 16 nt, Mycobacterium bovis subsp bovis AF2122/97
ccucggacugcagcgc

SEQ ID NO: 3216125 - RNA, 23 nt, Mycobacterium bovis subsp bovis AF2122/97
ccucggagaugaacucggcgauc

SEQ ID NO: 3216126 - RNA, 16 nt, Mycobacterium bovis subsp bovis AF2122/97
ccucggaucgccaggc

SEQ ID NO: 3216127 - RNA, 18 nt, Mycobacterium bovis subsp bovis AF2122/97
ccucggauugcagcgcga

SEQ ID NO: 3216128 - RNA, 21 nt, Mycobacterium bovis subsp bovis AF2122/97
ccucggauugcagcgcgaugg

SEQ ID NO: 3216129 - RNA, 19 nt, Mycobacterium bovis subsp bovis AF2122/97
ccucggcaaaccaagcgcg

SEQ ID NO: 3216130 - RNA, 22 nt, Mycobacterium bovis subsp bovis AF2122/97
ccucggcaaaccaagcgcgcca

SEQ ID NO: 3216131 - RNA, 14 nt, Mycobacterium bovis subsp bovis AF2122/97
ccucggcaaccacc

SEQ ID NO: 3216132 - RNA, 15 nt, Mycobacterium bovis subsp bovis AF2122/97
ccucggcacggaccg

SEQ ID NO: 3216133 - RNA, 15 nt, Mycobacterium bovis subsp bovis AF2122/97
ccucggcacggucgc

SEQ ID NO: 3216134 - RNA, 17 nt, Mycobacterium bovis subsp bovis AF2122/97
ccucggcaugcagcccc

SEQ ID NO: 3216135 - RNA, 12 nt, Mycobacterium bovis subsp bovis AF2122/97
ccucggccaccc

SEQ ID NO: 3216136 - RNA, 13 nt, Mycobacterium bovis subsp bovis AF2122/97
ccucggccacccg

SEQ ID NO: 3216137 - RNA, 22 nt, Mycobacterium bovis subsp bovis AF2122/97
ccucggccagcuccgccugccg

SEQ ID NO: 3216138 - RNA, 12 nt, Mycobacterium bovis subsp bovis AF2122/97
ccucggccgcag

SEQ ID NO: 3216139 - RNA, 12 nt, Mycobacterium bovis subsp bovis AF2122/97
ccucggccgcca

SEQ ID NO: 3216140 - RNA, 17 nt, Mycobacterium bovis subsp bovis AF2122/97
ccucggccgccagcccc

SEQ ID NO: 3216141 - RNA, 18 nt, Mycobacterium bovis subsp bovis AF2122/97
ccucggccgccagcccca

SEQ ID NO: 3216142 - RNA, 12 nt, Mycobacterium bovis subsp bovis AF2122/97
ccucggccgccc

SEQ ID NO: 3216143 - RNA, 13 nt, Mycobacterium bovis subsp bovis AF2122/97
ccucggccgcccg

SEQ ID NO: 3216144 - RNA, 22 nt, Mycobacterium bovis subsp bovis AF2122/97
ccucggcgaagucacgcacccg

SEQ ID NO: 3216145 - RNA, 23 nt, Mycobacterium bovis subsp bovis AF2122/97
ccucggcgacgaugucgagcgcg

SEQ ID NO: 3216146 - RNA, 17 nt, Mycobacterium bovis subsp bovis AF2122/97
ccucggcgacgucggcg

SEQ ID NO: 3216147 - RNA, 18 nt, Mycobacterium bovis subsp bovis AF2122/97
ccucggcgaucaauugcc

SEQ ID NO: 3216148 - RNA, 16 nt, Mycobacterium bovis subsp bovis AF2122/97
ccucggcgaugucgcg

SEQ ID NO: 3216149 - RNA, 21 nt, Mycobacterium bovis subsp bovis AF2122/97
ccucggcgcgaaaccagucca

SEQ ID NO: 3216150 - RNA, 15 nt, Mycobacterium bovis subsp bovis AF2122/97
ccucggcgcugcgca

SEQ ID NO: 3216151 - RNA, 18 nt, Mycobacterium bovis subsp bovis AF2122/97
ccucggcgcugcgcaccg

SEQ ID NO: 3216152 - RNA, 22 nt, Mycobacterium bovis subsp bovis AF2122/97
ccucggcggccagcucggccag

SEQ ID NO: 3216153 - RNA, 13 nt, Mycobacterium bovis subsp bovis AF2122/97
ccucggcggcgcc

SEQ ID NO: 3216154 - RNA, 16 nt, Mycobacterium bovis subsp bovis AF2122/97
ccucggcggcguugug

SEQ ID NO: 3216155 - RNA, 19 nt, Mycobacterium bovis subsp bovis AF2122/97
ccucggcgggauccucgaa

SEQ ID NO: 3216156 - RNA, 19 nt, Mycobacterium bovis subsp bovis AF2122/97
ccucggcguaggcgauggc

SEQ ID NO: 3216157 - RNA, 20 nt, Mycobacterium bovis subsp bovis AF2122/97
ccucggcguaggcgauggcg

SEQ ID NO: 3216158 - RNA, 22 nt, Mycobacterium bovis subsp bovis AF2122/97
ccucggcuucggagccgacaac

SEQ ID NO: 3216159 - RNA, 19 nt, Mycobacterium bovis subsp bovis AF2122/97
ccucggcuuugccgcugug

SEQ ID NO: 3216160 - RNA, 15 nt, Mycobacterium bovis subsp bovis AF2122/97
ccucgggacugcgcg

SEQ ID NO: 3216161 - RNA, 15 nt, Mycobacterium bovis subsp bovis AF2122/97
ccucgggcaacucgg

SEQ ID NO: 3216162 - RNA, 18 nt, Mycobacterium bovis subsp bovis AF2122/97
ccucgggcaggcggccag

SEQ ID NO: 3216163 - RNA, 18 nt, Mycobacterium bovis subsp bovis AF2122/97
ccucggguguggucacca

SEQ ID NO: 3216164 - RNA, 20 nt, Mycobacterium bovis subsp bovis AF2122/97
ccucggguguggucaccagg

SEQ ID NO: 3216165 - RNA, 17 nt, Mycobacterium bovis subsp bovis AF2122/97
ccucggucagcggggug

SEQ ID NO: 3216166 - RNA, 21 nt, Mycobacterium bovis subsp bovis AF2122/97
ccucggugagaaucgacuccg

SEQ ID NO: 3216167 - RNA, 15 nt, Mycobacterium bovis subsp bovis AF2122/97
ccucggugagcagcu

SEQ ID NO: 3216168 - RNA, 14 nt, Mycobacterium bovis subsp bovis AF2122/97
ccucggugccggcc

SEQ ID NO: 3216169 - RNA, 15 nt, Mycobacterium bovis subsp bovis AF2122/97
ccucggugccggccg

SEQ ID NO: 3216170 - RNA, 16 nt, Mycobacterium bovis subsp bovis AF2122/97
ccucggugccggccgc

SEQ ID NO: 3216171 - RNA, 14 nt, Mycobacterium bovis subsp bovis AF2122/97
ccucggugcggaac

SEQ ID NO: 3216172 - RNA, 16 nt, Mycobacterium bovis subsp bovis AF2122/97
ccucgguguccucgac

SEQ ID NO: 3216173 - RNA, 17 nt, Mycobacterium bovis subsp bovis AF2122/97
ccucggugugcucgccg

SEQ ID NO: 3216174 - RNA, 18 nt, Mycobacterium bovis subsp bovis AF2122/97
ccucggugugcucgccga

SEQ ID NO: 3216175 - RNA, 20 nt, Mycobacterium bovis subsp bovis AF2122/97
ccucggugugcucgccgacc

SEQ ID NO: 3216176 - RNA, 19 nt, Mycobacterium bovis subsp bovis AF2122/97
ccucgguugguccucggcg

SEQ ID NO: 3216177 - RNA, 20 nt, Mycobacterium bovis subsp bovis AF2122/97
ccucguaauccacgccgacc

SEQ ID NO: 3216178 - RNA, 20 nt, Mycobacterium bovis subsp bovis AF2122/97
ccucguaggcguacaccagg

SEQ ID NO: 3216179 - RNA, 19 nt, Mycobacterium bovis subsp bovis AF2122/97
ccucguagucccacugcca

SEQ ID NO: 3216180 - RNA, 17 nt, Mycobacterium bovis subsp bovis AF2122/97
ccucgucaaucaccacc

SEQ ID NO: 3216181 - RNA, 23 nt, Mycobacterium bovis subsp bovis AF2122/97
ccucgucaaucaccaccgccagc

SEQ ID NO: 3216182 - RNA, 14 nt, Mycobacterium bovis subsp bovis AF2122/97
ccucgucaccgcga

SEQ ID NO: 3216183 - RNA, 16 nt, Mycobacterium bovis subsp bovis AF2122/97
ccucgucccacagguu

SEQ ID NO: 3216184 - RNA, 19 nt, Mycobacterium bovis subsp bovis AF2122/97
ccucgucccacagguuugc

SEQ ID NO: 3216185 - RNA, 12 nt, Mycobacterium bovis subsp bovis AF2122/97
ccucgucgaccg

SEQ ID NO: 3216186 - RNA, 15 nt, Mycobacterium bovis subsp bovis AF2122/97
ccucgucgacgucgg

SEQ ID NO: 3216187 - RNA, 22 nt, Mycobacterium bovis subsp bovis AF2122/97
ccucgucgacgucggcaucggc

SEQ ID NO: 3216188 - RNA, 23 nt, Mycobacterium bovis subsp bovis AF2122/97
ccucgucgacgucggcaucggcg

SEQ ID NO: 3216189 - RNA, 21 nt, Mycobacterium bovis subsp bovis AF2122/97
ccucgucgagagguucgccgu

SEQ ID NO: 3216190 - RNA, 23 nt, Mycobacterium bovis subsp bovis AF2122/97
ccucgucgagagguucgccgucg

SEQ ID NO: 3216191 - RNA, 15 nt, Mycobacterium bovis subsp bovis AF2122/97
ccucgucgaggucag

SEQ ID NO: 3216192 - RNA, 19 nt, Mycobacterium bovis subsp bovis AF2122/97
ccucgucgagguccucguc

SEQ ID NO: 3216193 - RNA, 20 nt, Mycobacterium bovis subsp bovis AF2122/97
ccucgucgagguccucgucg

SEQ ID NO: 3216194 - RNA, 22 nt, Mycobacterium bovis subsp bovis AF2122/97
ccucgucgagguccucgucguc

SEQ ID NO: 3216195 - RNA, 20 nt, Mycobacterium bovis subsp bovis AF2122/97
ccucgucgaucgccgcgaug

SEQ ID NO: 3216196 - RNA, 19 nt, Mycobacterium bovis subsp bovis AF2122/97
ccucgucgaucgccgcgcc

SEQ ID NO: 3216197 - RNA, 20 nt, Mycobacterium bovis subsp bovis AF2122/97
ccucgucgaucgccgcgccg

SEQ ID NO: 3216198 - RNA, 18 nt, Mycobacterium bovis subsp bovis AF2122/97
ccucgucgaucucgaucg

SEQ ID NO: 3216199 - RNA, 12 nt, Mycobacterium bovis subsp bovis AF2122/97
ccucgucgaugu

SEQ ID NO: 3216200 - RNA, 21 nt, Mycobacterium bovis subsp bovis AF2122/97
ccucgucgauguucgccgcgc

SEQ ID NO: 3216201 - RNA, 15 nt, Mycobacterium bovis subsp bovis AF2122/97
ccucgucgccgcggu

SEQ ID NO: 3216202 - RNA, 22 nt, Mycobacterium bovis subsp bovis AF2122/97
ccucgucgccgcgguagacgcc

SEQ ID NO: 3216203 - RNA, 17 nt, Mycobacterium bovis subsp bovis AF2122/97
ccucgucgccuagccgc

SEQ ID NO: 3216204 - RNA, 15 nt, Mycobacterium bovis subsp bovis AF2122/97
ccucgucgcgggcca

SEQ ID NO: 3216205 - RNA, 16 nt, Mycobacterium bovis subsp bovis AF2122/97
ccucgucgcucccggu

SEQ ID NO: 3216206 - RNA, 21 nt, Mycobacterium bovis subsp bovis AF2122/97
ccugauggcgcugcaccguag

SEQ ID NO: 3216207 - RNA, 15 nt, Mycobacterium bovis subsp bovis AF2122/97
ccugauugaagcccc

SEQ ID NO: 3216208 - RNA, 20 nt, Mycobacterium bovis subsp bovis AF2122/97
ccugauuucaacggucaauc

SEQ ID NO: 3216209 - RNA, 21 nt, Mycobacterium bovis subsp bovis AF2122/97
ccugcaacgucuugcuggucg

SEQ ID NO: 3216210 - RNA, 13 nt, Mycobacterium bovis subsp bovis AF2122/97
ccugcaagaacca

SEQ ID NO: 3216211 - RNA, 21 nt, Mycobacterium bovis subsp bovis AF2122/97
ccugcaagacaaagccgucga

SEQ ID NO: 3216212 - RNA, 17 nt, Mycobacterium bovis subsp bovis AF2122/97
ccugcaagacgccgauc

SEQ ID NO: 3216213 - RNA, 17 nt, Mycobacterium bovis subsp bovis AF2122/97
ccugcaccacggcggcc

SEQ ID NO: 3216214 - RNA, 13 nt, Mycobacterium bovis subsp bovis AF2122/97
ccugcacccaggc

SEQ ID NO: 3216215 - RNA, 17 nt, Mycobacterium bovis subsp bovis AF2122/97
ccugcaccgccgccgcc

SEQ ID NO: 3216216 - RNA, 20 nt, Mycobacterium bovis subsp bovis AF2122/97
ccugcaccgccgccgcccgu

SEQ ID NO: 3216217 - RNA, 17 nt, Mycobacterium bovis subsp bovis AF2122/97
ccugcacgacccgcugg

SEQ ID NO: 3216218 - RNA, 14 nt, Mycobacterium bovis subsp bovis AF2122/97
ccugcacgcccggc

SEQ ID NO: 3216219 - RNA, 15 nt, Mycobacterium bovis subsp bovis AF2122/97
ccugcacgcccggcg

SEQ ID NO: 3216220 - RNA, 13 nt, Mycobacterium bovis subsp bovis AF2122/97
ccugcacgccggc

SEQ ID NO: 3216221 - RNA, 22 nt, Mycobacterium bovis subsp bovis AF2122/97
ccugcacgccggcgcuggagac

SEQ ID NO: 3216222 - RNA, 19 nt, Mycobacterium bovis subsp bovis AF2122/97
ccugcacggugcccagggc

SEQ ID NO: 3216223 - RNA, 12 nt, Mycobacterium bovis subsp bovis AF2122/97
ccugcagcacga

SEQ ID NO: 3216224 - RNA, 22 nt, Mycobacterium bovis subsp bovis AF2122/97
ccugcagcacgacgugcgucgg

SEQ ID NO: 3216225 - RNA, 19 nt, Mycobacterium bovis subsp bovis AF2122/97
ccugcagcgaugacgacca

SEQ ID NO: 3216226 - RNA, 20 nt, Mycobacterium bovis subsp bovis AF2122/97
ccugcagcgaugacgaccaa

SEQ ID NO: 3216227 - RNA, 13 nt, Mycobacterium bovis subsp bovis AF2122/97
ccugcagcgcgac

SEQ ID NO: 3216228 - RNA, 14 nt, Mycobacterium bovis subsp bovis AF2122/97
ccugcagcucgggc

SEQ ID NO: 3216229 - RNA, 12 nt, Mycobacterium bovis subsp bovis AF2122/97
ccugcagcuggc

SEQ ID NO: 3216230 - RNA, 17 nt, Mycobacterium bovis subsp bovis AF2122/97
ccugcagcuuggcauug

SEQ ID NO: 3216231 - RNA, 20 nt, Mycobacterium bovis subsp bovis AF2122/97
ccugcaggaucaaaaccucg

SEQ ID NO: 3216232 - RNA, 12 nt, Mycobacterium bovis subsp bovis AF2122/97
ccugcaggccgc

SEQ ID NO: 3216233 - RNA, 15 nt, Mycobacterium bovis subsp bovis AF2122/97
ccugcaguacggcca

SEQ ID NO: 3216234 - RNA, 16 nt, Mycobacterium bovis subsp bovis AF2122/97
ccugcaguucggcgua

SEQ ID NO: 3216235 - RNA, 17 nt, Mycobacterium bovis subsp bovis AF2122/97
ccugcauaggcgcgguc

SEQ ID NO: 3216236 - RNA, 13 nt, Mycobacterium bovis subsp bovis AF2122/97
ccugcaugcccag

SEQ ID NO: 3216237 - RNA, 17 nt, Mycobacterium bovis subsp bovis AF2122/97
ccugccacagcgacagc

SEQ ID NO: 3216238 - RNA, 21 nt, Mycobacterium bovis subsp bovis AF2122/97
ccugccacagcgacagcgugc

SEQ ID NO: 3216239 - RNA, 22 nt, Mycobacterium bovis subsp bovis AF2122/97
ccugccacagcgacagcgugcc

SEQ ID NO: 3216240 - RNA, 21 nt, Mycobacterium bovis subsp bovis AF2122/97
ccugccacgacgaacaccagc

SEQ ID NO: 3216241 - RNA, 21 nt, Mycobacterium bovis subsp bovis AF2122/97
ccugccagugggccgacguga

SEQ ID NO: 3216242 - RNA, 15 nt, Mycobacterium bovis subsp bovis AF2122/97
ccugccauaggccca

SEQ ID NO: 3216243 - RNA, 23 nt, Mycobacterium bovis subsp bovis AF2122/97
ccugcccaacccauaucgauaac

SEQ ID NO: 3216244 - RNA, 17 nt, Mycobacterium bovis subsp bovis AF2122/97
ccugcccaccaucccgc

SEQ ID NO: 3216245 - RNA, 16 nt, Mycobacterium bovis subsp bovis AF2122/97
ccugcccagcaccacc

SEQ ID NO: 3216246 - RNA, 14 nt, Mycobacterium bovis subsp bovis AF2122/97
ccugccccacccgc

SEQ ID NO: 3216247 - RNA, 16 nt, Mycobacterium bovis subsp bovis AF2122/97
ccugccccacccgcgg

SEQ ID NO: 3216248 - RNA, 20 nt, Mycobacterium bovis subsp bovis AF2122/97
ccugccccacccgcggcgcc

SEQ ID NO: 3216249 - RNA, 15 nt, Mycobacterium bovis subsp bovis AF2122/97
ccugcccccgcgcgc

SEQ ID NO: 3216250 - RNA, 20 nt, Mycobacterium bovis subsp bovis AF2122/97
ccugcccccgcgcgcacggc

SEQ ID NO: 3216251 - RNA, 14 nt, Mycobacterium bovis subsp bovis AF2122/97
ccugcccccggcgc

SEQ ID NO: 3216252 - RNA, 17 nt, Mycobacterium bovis subsp bovis AF2122/97
ccugcccgaaccaccac

SEQ ID NO: 3216253 - RNA, 22 nt, Mycobacterium bovis subsp bovis AF2122/97
ccugcccgaaccaccaccggca

SEQ ID NO: 3216254 - RNA, 14 nt, Mycobacterium bovis subsp bovis AF2122/97
ccugcccggcccgc

SEQ ID NO: 3216255 - RNA, 14 nt, Mycobacterium bovis subsp bovis AF2122/97
ccugcccggcgccg

SEQ ID NO: 3216256 - RNA, 12 nt, Mycobacterium bovis subsp bovis AF2122/97
ccugcccuccgu

SEQ ID NO: 3216257 - RNA, 23 nt, Mycobacterium bovis subsp bovis AF2122/97
ccugcccuccgugggcagcgcgc

SEQ ID NO: 3216258 - RNA, 16 nt, Mycobacterium bovis subsp bovis AF2122/97
ccugccgacgcuccag

SEQ ID NO: 3216259 - RNA, 18 nt, Mycobacterium bovis subsp bovis AF2122/97
ccugccgacgcuccaggg

SEQ ID NO: 3216260 - RNA, 20 nt, Mycobacterium bovis subsp bovis AF2122/97
ccugccgacucaucggccgc

SEQ ID NO: 3216261 - RNA, 19 nt, Mycobacterium bovis subsp bovis AF2122/97
ccugccgaucccguggugg

SEQ ID NO: 3216262 - RNA, 15 nt, Mycobacterium bovis subsp bovis AF2122/97
ccugccgaucgggcu

SEQ ID NO: 3216263 - RNA, 18 nt, Mycobacterium bovis subsp bovis AF2122/97
ccugccgaugacgauggc

SEQ ID NO: 3216264 - RNA, 16 nt, Mycobacterium bovis subsp bovis AF2122/97
ccugccgcacgggccc

SEQ ID NO: 3216265 - RNA, 17 nt, Mycobacterium bovis subsp bovis AF2122/97
ccugccgcuguggccgc

SEQ ID NO: 3216266 - RNA, 21 nt, Mycobacterium bovis subsp bovis AF2122/97
ccugccggcagcggcgaguug

SEQ ID NO: 3216267 - RNA, 16 nt, Mycobacterium bovis subsp bovis AF2122/97
ccugccucaccgccgc

SEQ ID NO: 3216268 - RNA, 14 nt, Mycobacterium bovis subsp bovis AF2122/97
ccugcgaaacgcug

SEQ ID NO: 3216269 - RNA, 21 nt, Mycobacterium bovis subsp bovis AF2122/97
ccugcgacgagcccaccgucg

SEQ ID NO: 3216270 - RNA, 20 nt, Mycobacterium bovis subsp bovis AF2122/97
ccugcgacuaagggcacucc

SEQ ID NO: 3216271 - RNA, 17 nt, Mycobacterium bovis subsp bovis AF2122/97
ccugcgagugcggcacg

SEQ ID NO: 3216272 - RNA, 22 nt, Mycobacterium bovis subsp bovis AF2122/97
ccugcgcaaauugcaacagagc

SEQ ID NO: 3216273 - RNA, 13 nt, Mycobacterium bovis subsp bovis AF2122/97
ccugcgcacucga

SEQ ID NO: 3216274 - RNA, 14 nt, Mycobacterium bovis subsp bovis AF2122/97
ccugcgcagccgcc

SEQ ID NO: 3216275 - RNA, 15 nt, Mycobacterium bovis subsp bovis AF2122/97
ccugcgcagccgccu

SEQ ID NO: 3216276 - RNA, 16 nt, Mycobacterium bovis subsp bovis AF2122/97
ccugcgcagccgccuc

SEQ ID NO: 3216277 - RNA, 13 nt, Mycobacterium bovis subsp bovis AF2122/97
ccugcgcaucacc

SEQ ID NO: 3216278 - RNA, 19 nt, Mycobacterium bovis subsp bovis AF2122/97
ccugcgcaucaccacuggc

SEQ ID NO: 3216279 - RNA, 17 nt, Mycobacterium bovis subsp bovis AF2122/97
ccugcgccacacccggc

SEQ ID NO: 3216280 - RNA, 16 nt, Mycobacterium bovis subsp bovis AF2122/97
ccugcgccacccgcgg

SEQ ID NO: 3216281 - RNA, 15 nt, Mycobacterium bovis subsp bovis AF2122/97
ccugcgccgacccgc

SEQ ID NO: 3216282 - RNA, 23 nt, Mycobacterium bovis subsp bovis AF2122/97
ccugcgccgaguuguucgcccac

SEQ ID NO: 3216283 - RNA, 13 nt, Mycobacterium bovis subsp bovis AF2122/97
ccugcgccgcagu

SEQ ID NO: 3216284 - RNA, 21 nt, Mycobacterium bovis subsp bovis AF2122/97
ccugcgccgccagcgccgccg

SEQ ID NO: 3216285 - RNA, 13 nt, Mycobacterium bovis subsp bovis AF2122/97
ccugcgccgcccg

SEQ ID NO: 3216286 - RNA, 14 nt, Mycobacterium bovis subsp bovis AF2122/97
ccugcgccgcccgc

SEQ ID NO: 3216287 - RNA, 18 nt, Mycobacterium bovis subsp bovis AF2122/97
ccugcgccgcccgcgcca

SEQ ID NO: 3216288 - RNA, 19 nt, Mycobacterium bovis subsp bovis AF2122/97
ccugcgccgcccgcgccac

SEQ ID NO: 3216289 - RNA, 18 nt, Mycobacterium bovis subsp bovis AF2122/97
ccugcgccgguaacuguc

SEQ ID NO: 3216290 - RNA, 19 nt, Mycobacterium bovis subsp bovis AF2122/97
ccugcgccgguaacugucc

SEQ ID NO: 3216291 - RNA, 18 nt, Mycobacterium bovis subsp bovis AF2122/97
ccugcgccucggcggcca

SEQ ID NO: 3216292 - RNA, 20 nt, Mycobacterium bovis subsp bovis AF2122/97
ccugcgccucggcggccagc

SEQ ID NO: 3216293 - RNA, 16 nt, Mycobacterium bovis subsp bovis AF2122/97
ccuggcaacgacacgc

SEQ ID NO: 3216294 - RNA, 19 nt, Mycobacterium bovis subsp bovis AF2122/97
ccuggcaacgacacgccgc

SEQ ID NO: 3216295 - RNA, 15 nt, Mycobacterium bovis subsp bovis AF2122/97
ccuggcaccucgccc

SEQ ID NO: 3216296 - RNA, 18 nt, Mycobacterium bovis subsp bovis AF2122/97
ccuggcaccucgcccucc

SEQ ID NO: 3216297 - RNA, 22 nt, Mycobacterium bovis subsp bovis AF2122/97
ccuggcagacgcccuugccuug

SEQ ID NO: 3216298 - RNA, 17 nt, Mycobacterium bovis subsp bovis AF2122/97
ccuggccacacucagca

SEQ ID NO: 3216299 - RNA, 14 nt, Mycobacterium bovis subsp bovis AF2122/97
ccuggccacccaga

SEQ ID NO: 3216300 - RNA, 14 nt, Mycobacterium bovis subsp bovis AF2122/97
ccuggccaccuggu

SEQ ID NO: 3216301 - RNA, 21 nt, Mycobacterium bovis subsp bovis AF2122/97
ccuggccacucccagccaacc

SEQ ID NO: 3216302 - RNA, 22 nt, Mycobacterium bovis subsp bovis AF2122/97
ccuggccagcagagcggcacgc

SEQ ID NO: 3216303 - RNA, 18 nt, Mycobacterium bovis subsp bovis AF2122/97
ccuggccagcccgagcuc

SEQ ID NO: 3216304 - RNA, 21 nt, Mycobacterium bovis subsp bovis AF2122/97
ccuggccagcccgagcucggg

SEQ ID NO: 3216305 - RNA, 22 nt, Mycobacterium bovis subsp bovis AF2122/97
ccuggccaucgagggcaucggg

SEQ ID NO: 3216306 - RNA, 14 nt, Mycobacterium bovis subsp bovis AF2122/97
ccuggcccgccacg

SEQ ID NO: 3216307 - RNA, 22 nt, Mycobacterium bovis subsp bovis AF2122/97
ccuggcccgccacgaugucguc

SEQ ID NO: 3216308 - RNA, 16 nt, Mycobacterium bovis subsp bovis AF2122/97
ccuggcccuuguuggc

SEQ ID NO: 3216309 - RNA, 23 nt, Mycobacterium bovis subsp bovis AF2122/97
ccuggccgcccagaccgccgacg

SEQ ID NO: 3216310 - RNA, 14 nt, Mycobacterium bovis subsp bovis AF2122/97
ccuggccgcccgcu

SEQ ID NO: 3216311 - RNA, 15 nt, Mycobacterium bovis subsp bovis AF2122/97
ccuggccgccgcccc

SEQ ID NO: 3216312 - RNA, 16 nt, Mycobacterium bovis subsp bovis AF2122/97
ccuggccgccgccccg

SEQ ID NO: 3216313 - RNA, 14 nt, Mycobacterium bovis subsp bovis AF2122/97
ccuggccgccgccg

SEQ ID NO: 3216314 - RNA, 12 nt, Mycobacterium bovis subsp bovis AF2122/97
ccuggccgccgg

SEQ ID NO: 3216315 - RNA, 13 nt, Mycobacterium bovis subsp bovis AF2122/97
ccuggccgccggc

SEQ ID NO: 3216316 - RNA, 14 nt, Mycobacterium bovis subsp bovis AF2122/97
ccuggccgccggcc

SEQ ID NO: 3216317 - RNA, 17 nt, Mycobacterium bovis subsp bovis AF2122/97
ccuggccgccggcgccg

SEQ ID NO: 3216318 - RNA, 19 nt, Mycobacterium bovis subsp bovis AF2122/97
ccuggccgccggcgccgcc

SEQ ID NO: 3216319 - RNA, 12 nt, Mycobacterium bovis subsp bovis AF2122/97
ccuggccgcgcc

SEQ ID NO: 3216320 - RNA, 14 nt, Mycobacterium bovis subsp bovis AF2122/97
ccuggccggugcgc

SEQ ID NO: 3216321 - RNA, 18 nt, Mycobacterium bovis subsp bovis AF2122/97
ccuggccgucccaccagc

SEQ ID NO: 3216322 - RNA, 17 nt, Mycobacterium bovis subsp bovis AF2122/97
ccuggccgucgcuggug

SEQ ID NO: 3216323 - RNA, 16 nt, Mycobacterium bovis subsp bovis AF2122/97
ccuggccugcccagca

SEQ ID NO: 3216324 - RNA, 18 nt, Mycobacterium bovis subsp bovis AF2122/97
ccuggcgaacucgcgcag

SEQ ID NO: 3216325 - RNA, 15 nt, Mycobacterium bovis subsp bovis AF2122/97
ccuggcgaaugucgc

SEQ ID NO: 3216326 - RNA, 16 nt, Mycobacterium bovis subsp bovis AF2122/97
ccuggcgacgcgacac

SEQ ID NO: 3216327 - RNA, 23 nt, Mycobacterium bovis subsp bovis AF2122/97
ccuggcgacgcgacacacgccgc

SEQ ID NO: 3216328 - RNA, 11 nt, Mycobacterium bovis subsp bovis AF2122/97
ccuggcgagcc

SEQ ID NO: 3216329 - RNA, 23 nt, Mycobacterium bovis subsp bovis AF2122/97
ccuggcggaacagcuucgcgcag

SEQ ID NO: 3216330 - RNA, 19 nt, Mycobacterium bovis subsp bovis AF2122/97
ccuggcggcccggguuggc

SEQ ID NO: 3216331 - RNA, 22 nt, Mycobacterium bovis subsp bovis AF2122/97
ccuggcggguaagcgaccgacg

SEQ ID NO: 3216332 - RNA, 19 nt, Mycobacterium bovis subsp bovis AF2122/97
ccuggcggguguggcagug

SEQ ID NO: 3216333 - RNA, 16 nt, Mycobacterium bovis subsp bovis AF2122/97
ccuggcggugccggcg

SEQ ID NO: 3216334 - RNA, 21 nt, Mycobacterium bovis subsp bovis AF2122/97
ccuggcggugccggcggcgca

SEQ ID NO: 3216335 - RNA, 21 nt, Mycobacterium bovis subsp bovis AF2122/97
ccuggcuaucgcagaacggac

SEQ ID NO: 3216336 - RNA, 19 nt, Mycobacterium bovis subsp bovis AF2122/97
ccuggcuguccgcgggccg

SEQ ID NO: 3216337 - RNA, 14 nt, Mycobacterium bovis subsp bovis AF2122/97
ccugggaaacuggg

SEQ ID NO: 3216338 - RNA, 19 nt, Mycobacterium bovis subsp bovis AF2122/97
ccugggacaguucgcgccg

SEQ ID NO: 3216339 - RNA, 17 nt, Mycobacterium bovis subsp bovis AF2122/97
ccugggauccggcggca

SEQ ID NO: 3216340 - RNA, 15 nt, Mycobacterium bovis subsp bovis AF2122/97
ccugggcaaacuggg

SEQ ID NO: 3216341 - RNA, 22 nt, Mycobacterium bovis subsp bovis AF2122/97
ccugggcaaacugggcaccggc

SEQ ID NO: 3216342 - RNA, 14 nt, Mycobacterium bovis subsp bovis AF2122/97
ccugggcacggccg

SEQ ID NO: 3216343 - RNA, 13 nt, Mycobacterium bovis subsp bovis AF2122/97
ccugggccagccg

SEQ ID NO: 3216344 - RNA, 14 nt, Mycobacterium bovis subsp bovis AF2122/97
ccugggccagccgc

SEQ ID NO: 3216345 - RNA, 15 nt, Mycobacterium bovis subsp bovis AF2122/97
ccugggccgccgccc

SEQ ID NO: 3216346 - RNA, 19 nt, Mycobacterium bovis subsp bovis AF2122/97
ccugggcgacuaccggcuc

SEQ ID NO: 3216347 - RNA, 15 nt, Mycobacterium bovis subsp bovis AF2122/97
ccugggcgccccagg

SEQ ID NO: 3216348 - RNA, 14 nt, Mycobacterium bovis subsp bovis AF2122/97
ccugggcgccggcg

SEQ ID NO: 3216349 - RNA, 16 nt, Mycobacterium bovis subsp bovis AF2122/97
ccugggcgcgcuggcg

SEQ ID NO: 3216350 - RNA, 17 nt, Mycobacterium bovis subsp bovis AF2122/97
ccugggcggccagcacg

SEQ ID NO: 3216351 - RNA, 12 nt, Mycobacterium bovis subsp bovis AF2122/97
ccugggcgggcu

SEQ ID NO: 3216352 - RNA, 12 nt, Mycobacterium bovis subsp bovis AF2122/97
ccuggggcagcc

SEQ ID NO: 3216353 - RNA, 22 nt, Mycobacterium bovis subsp bovis AF2122/97
ccuggggccguccggcuuggcg

SEQ ID NO: 3216354 - RNA, 19 nt, Mycobacterium bovis subsp bovis AF2122/97
ccugggguagccaucggcu

SEQ ID NO: 3216355 - RNA, 19 nt, Mycobacterium bovis subsp bovis AF2122/97
ccugggugauggccgcgcc

SEQ ID NO: 3216356 - RNA, 23 nt, Mycobacterium bovis subsp bovis AF2122/97
ccugggugauggccgcgcccgcc

SEQ ID NO: 3216357 - RNA, 18 nt, Mycobacterium bovis subsp bovis AF2122/97
ccuggguggcgucgcggu

SEQ ID NO: 3216358 - RNA, 19 nt, Mycobacterium bovis subsp bovis AF2122/97
ccuggguuggcauccaaaa

SEQ ID NO: 3216359 - RNA, 16 nt, Mycobacterium bovis subsp bovis AF2122/97
ccuggguugugccgcc

SEQ ID NO: 3216360 - RNA, 18 nt, Mycobacterium bovis subsp bovis AF2122/97
ccuggguugugccgcccu

SEQ ID NO: 3216361 - RNA, 21 nt, Mycobacterium bovis subsp bovis AF2122/97
ccuggguuugcacggcgcgcc

SEQ ID NO: 3216362 - RNA, 15 nt, Mycobacterium bovis subsp bovis AF2122/97
ccugguaaggccggc

SEQ ID NO: 3216363 - RNA, 17 nt, Mycobacterium bovis subsp bovis AF2122/97
ccugguaaggccggccg

SEQ ID NO: 3216364 - RNA, 18 nt, Mycobacterium bovis subsp bovis AF2122/97
ccugguaaggccggccgg

SEQ ID NO: 3216365 - RNA, 20 nt, Mycobacterium bovis subsp bovis AF2122/97
ccugguaaggccggccggug

SEQ ID NO: 3216366 - RNA, 22 nt, Mycobacterium bovis subsp bovis AF2122/97
ccugguaaggccggccgguggc

SEQ ID NO: 3216367 - RNA, 16 nt, Mycobacterium bovis subsp bovis AF2122/97
ccugguaccccagcac

SEQ ID NO: 3216368 - RNA, 18 nt, Mycobacterium bovis subsp bovis AF2122/97
ccugguagcacccacggc

SEQ ID NO: 3216369 - RNA, 14 nt, Mycobacterium bovis subsp bovis AF2122/97
ccuggucaaccgcg

SEQ ID NO: 3216370 - RNA, 12 nt, Mycobacterium bovis subsp bovis AF2122/97
ccugguccaccc

SEQ ID NO: 3216371 - RNA, 19 nt, Mycobacterium bovis subsp bovis AF2122/97
ccugguccaggcccuggcc

SEQ ID NO: 3216372 - RNA, 14 nt, Mycobacterium bovis subsp bovis AF2122/97
ccuggucccaccgc

SEQ ID NO: 3216373 - RNA, 19 nt, Mycobacterium bovis subsp bovis AF2122/97
ccuggucgaaacgguacgc

SEQ ID NO: 3216374 - RNA, 14 nt, Mycobacterium bovis subsp bovis AF2122/97
ccuggucgagcacg

SEQ ID NO: 3216375 - RNA, 13 nt, Mycobacterium bovis subsp bovis AF2122/97
ccuggucgccgug

SEQ ID NO: 3216376 - RNA, 13 nt, Mycobacterium bovis subsp bovis AF2122/97
ccuggucggccag

SEQ ID NO: 3216377 - RNA, 15 nt, Mycobacterium bovis subsp bovis AF2122/97
ccuggucggccaggu

SEQ ID NO: 3216378 - RNA, 19 nt, Mycobacterium bovis subsp bovis AF2122/97
ccuggucggugacugugcg

SEQ ID NO: 3216379 - RNA, 20 nt, Mycobacterium bovis subsp bovis AF2122/97
ccuggugagauugguggccc

SEQ ID NO: 3216380 - RNA, 14 nt, Mycobacterium bovis subsp bovis AF2122/97
ccuugaccgaccag

SEQ ID NO: 3216381 - RNA, 21 nt, Mycobacterium bovis subsp bovis AF2122/97
ccuugaccgcggucuucuuca

SEQ ID NO: 3216382 - RNA, 22 nt, Mycobacterium bovis subsp bovis AF2122/97
ccuugaccucggguaacguguu

SEQ ID NO: 3216383 - RNA, 19 nt, Mycobacterium bovis subsp bovis AF2122/97
ccuugacggugagaucggg

SEQ ID NO: 3216384 - RNA, 19 nt, Mycobacterium bovis subsp bovis AF2122/97
ccuugagcaaaccgcgcag

SEQ ID NO: 3216385 - RNA, 20 nt, Mycobacterium bovis subsp bovis AF2122/97
ccuugagcaaugacccgcgg

SEQ ID NO: 3216386 - RNA, 15 nt, Mycobacterium bovis subsp bovis AF2122/97
ccuugagccgccgug

SEQ ID NO: 3216387 - RNA, 19 nt, Mycobacterium bovis subsp bovis AF2122/97
ccuugaggauccgcaccac

SEQ ID NO: 3216388 - RNA, 20 nt, Mycobacterium bovis subsp bovis AF2122/97
ccuugaggcccugcggccac

SEQ ID NO: 3216389 - RNA, 17 nt, Mycobacterium bovis subsp bovis AF2122/97
ccuugaucaccgugcgg

SEQ ID NO: 3216390 - RNA, 22 nt, Mycobacterium bovis subsp bovis AF2122/97
ccuugaucgacaacgcggcacc

SEQ ID NO: 3216391 - RNA, 17 nt, Mycobacterium bovis subsp bovis AF2122/97
ccuugaucgagcagggu

SEQ ID NO: 3216392 - RNA, 17 nt, Mycobacterium bovis subsp bovis AF2122/97
ccuugaucgugcuggcg

SEQ ID NO: 3216393 - RNA, 23 nt, Mycobacterium bovis subsp bovis AF2122/97
ccuugaugccuuccgacgaccag

SEQ ID NO: 3216394 - RNA, 16 nt, Mycobacterium bovis subsp bovis AF2122/97
ccuugauggucuccac

SEQ ID NO: 3216395 - RNA, 15 nt, Mycobacterium bovis subsp bovis AF2122/97
ccuugauguccgcga

SEQ ID NO: 3216396 - RNA, 14 nt, Mycobacterium bovis subsp bovis AF2122/97
ccuugauugccgcg

SEQ ID NO: 3216397 - RNA, 13 nt, Mycobacterium bovis subsp bovis AF2122/97
ccuugcaccggcc

SEQ ID NO: 3216398 - RNA, 12 nt, Mycobacterium bovis subsp bovis AF2122/97
ccuugcagcgcc

SEQ ID NO: 3216399 - RNA, 15 nt, Mycobacterium bovis subsp bovis AF2122/97
ccuugcagcgccccc

SEQ ID NO: 3216400 - RNA, 23 nt, Mycobacterium bovis subsp bovis AF2122/97
ccuugcagcgcccccgcugccau

SEQ ID NO: 3216401 - RNA, 22 nt, Mycobacterium bovis subsp bovis AF2122/97
ccuugcccacggcgaccacgcc

SEQ ID NO: 3216402 - RNA, 22 nt, Mycobacterium bovis subsp bovis AF2122/97
ccuugcccucaacggcggcaac

SEQ ID NO: 3216403 - RNA, 21 nt, Mycobacterium bovis subsp bovis AF2122/97
ccuugccgccagccccagcgu

SEQ ID NO: 3216404 - RNA, 16 nt, Mycobacterium bovis subsp bovis AF2122/97
ccuugccgccauucca

SEQ ID NO: 3216405 - RNA, 16 nt, Mycobacterium bovis subsp bovis AF2122/97
ccuugccgcccgcucc

SEQ ID NO: 3216406 - RNA, 22 nt, Mycobacterium bovis subsp bovis AF2122/97
ccuugccgcccgcuccgccguc

SEQ ID NO: 3216407 - RNA, 12 nt, Mycobacterium bovis subsp bovis AF2122/97
ccuugccgccga

SEQ ID NO: 3216408 - RNA, 13 nt, Mycobacterium bovis subsp bovis AF2122/97
ccuugccgccgag

SEQ ID NO: 3216409 - RNA, 16 nt, Mycobacterium bovis subsp bovis AF2122/97
ccuugccgccggcccc

SEQ ID NO: 3216410 - RNA, 19 nt, Mycobacterium bovis subsp bovis AF2122/97
ccuugccgccggccccgcc

SEQ ID NO: 3216411 - RNA, 23 nt, Mycobacterium bovis subsp bovis AF2122/97
ccuugccgccggccccgccggcg

SEQ ID NO: 3216412 - RNA, 23 nt, Mycobacterium bovis subsp bovis AF2122/97
ccuugccgccggccccgccgucg

SEQ ID NO: 3216413 - RNA, 14 nt, Mycobacterium bovis subsp bovis AF2122/97
ccuugccgccggcg

SEQ ID NO: 3216414 - RNA, 23 nt, Mycobacterium bovis subsp bovis AF2122/97
ccuugccgccuuggcccccgggu

SEQ ID NO: 3216415 - RNA, 17 nt, Mycobacterium bovis subsp bovis AF2122/97
ccuugccgggccgcgcg

SEQ ID NO: 3216416 - RNA, 13 nt, Mycobacterium bovis subsp bovis AF2122/97
ccuugccgguggg

SEQ ID NO: 3216417 - RNA, 17 nt, Mycobacterium bovis subsp bovis AF2122/97
ccuugccuuccgaccca

SEQ ID NO: 3216418 - RNA, 16 nt, Mycobacterium bovis subsp bovis AF2122/97
ccuugcgacguucuug

SEQ ID NO: 3216419 - RNA, 14 nt, Mycobacterium bovis subsp bovis AF2122/97
ccuugcgcagcacc

SEQ ID NO: 3216420 - RNA, 16 nt, Mycobacterium bovis subsp bovis AF2122/97
ccuugcgccagcgggc

SEQ ID NO: 3216421 - RNA, 22 nt, Mycobacterium bovis subsp bovis AF2122/97
ccuugcgcgcgcagaucgucca

SEQ ID NO: 3216422 - RNA, 16 nt, Mycobacterium bovis subsp bovis AF2122/97
ccuugcggaagaagug

SEQ ID NO: 3216423 - RNA, 18 nt, Mycobacterium bovis subsp bovis AF2122/97
ccuugcggcagaccaagc

SEQ ID NO: 3216424 - RNA, 15 nt, Mycobacterium bovis subsp bovis AF2122/97
ccuugcgggccuggu

SEQ ID NO: 3216425 - RNA, 12 nt, Mycobacterium bovis subsp bovis AF2122/97
ccuugcgguagg

SEQ ID NO: 3216426 - RNA, 19 nt, Mycobacterium bovis subsp bovis AF2122/97
ccuugcgguccaggccggc

SEQ ID NO: 3216427 - RNA, 20 nt, Mycobacterium bovis subsp bovis AF2122/97
ccuugcgguccaggccggca

SEQ ID NO: 3216428 - RNA, 16 nt, Mycobacterium bovis subsp bovis AF2122/97
ccuugcucagcacgcc

SEQ ID NO: 3216429 - RNA, 17 nt, Mycobacterium bovis subsp bovis AF2122/97
ccuugcucagccggccc

SEQ ID NO: 3216430 - RNA, 18 nt, Mycobacterium bovis subsp bovis AF2122/97
ccuugcucagccggcccu

SEQ ID NO: 3216431 - RNA, 14 nt, Mycobacterium bovis subsp bovis AF2122/97
ccuugcuccacauc

SEQ ID NO: 3216432 - RNA, 15 nt, Mycobacterium bovis subsp bovis AF2122/97
ccuugcucguccagg

SEQ ID NO: 3216433 - RNA, 19 nt, Mycobacterium bovis subsp bovis AF2122/97
ccuugcugcgcgauggccg

SEQ ID NO: 3216434 - RNA, 17 nt, Mycobacterium bovis subsp bovis AF2122/97
ccuuggaugcccugccc

SEQ ID NO: 3216435 - RNA, 19 nt, Mycobacterium bovis subsp bovis AF2122/97
ccuuggcacccuccgccgg

SEQ ID NO: 3216436 - RNA, 14 nt, Mycobacterium bovis subsp bovis AF2122/97
ccuuggcaguccag

SEQ ID NO: 3216437 - RNA, 12 nt, Mycobacterium bovis subsp bovis AF2122/97
ccuuggccagca

SEQ ID NO: 3216438 - RNA, 22 nt, Mycobacterium bovis subsp bovis AF2122/97
ccuuggccagcagggccaccac

SEQ ID NO: 3216439 - RNA, 22 nt, Mycobacterium bovis subsp bovis AF2122/97
ccuuggccgccacucgcccgcu

SEQ ID NO: 3216440 - RNA, 20 nt, Mycobacterium bovis subsp bovis AF2122/97
ccuuggcgacgucgcgggug

SEQ ID NO: 3216441 - RNA, 20 nt, Mycobacterium bovis subsp bovis AF2122/97
ccuuggcgacugucuggucg

SEQ ID NO: 3216442 - RNA, 22 nt, Mycobacterium bovis subsp bovis AF2122/97
ccuuggcgacugucuggucggc

SEQ ID NO: 3216443 - RNA, 14 nt, Mycobacterium bovis subsp bovis AF2122/97
ccuuggcgcggcac

SEQ ID NO: 3216444 - RNA, 15 nt, Mycobacterium bovis subsp bovis AF2122/97
ccuuggcgcggcacc

SEQ ID NO: 3216445 - RNA, 15 nt, Mycobacterium bovis subsp bovis AF2122/97
ccuugggaccgcgcc

SEQ ID NO: 3216446 - RNA, 14 nt, Mycobacterium bovis subsp bovis AF2122/97
ccuugggcaccacc

SEQ ID NO: 3216447 - RNA, 20 nt, Mycobacterium bovis subsp bovis AF2122/97
ccuugggcgacgcggcgccg

SEQ ID NO: 3216448 - RNA, 21 nt, Mycobacterium bovis subsp bovis AF2122/97
ccuugggcguacucggcgcgc

SEQ ID NO: 3216449 - RNA, 16 nt, Mycobacterium bovis subsp bovis AF2122/97
ccuugguagccggccg

SEQ ID NO: 3216450 - RNA, 17 nt, Mycobacterium bovis subsp bovis AF2122/97
ccuugguagccggccgc

SEQ ID NO: 3216451 - RNA, 16 nt, Mycobacterium bovis subsp bovis AF2122/97
ccuuggucaccuucuu

SEQ ID NO: 3216452 - RNA, 17 nt, Mycobacterium bovis subsp bovis AF2122/97
ccuuggucgccgccuuc

SEQ ID NO: 3216453 - RNA, 15 nt, Mycobacterium bovis subsp bovis AF2122/97
ccuuggucgccggcg

SEQ ID NO: 3216454 - RNA, 20 nt, Mycobacterium bovis subsp bovis AF2122/97
ccuuggucuucgccgucggc

SEQ ID NO: 3216455 - RNA, 13 nt, Mycobacterium bovis subsp bovis AF2122/97
ccuugguggccag

SEQ ID NO: 3216456 - RNA, 16 nt, Mycobacterium bovis subsp bovis AF2122/97
ccuugguggccagcca

SEQ ID NO: 3216457 - RNA, 17 nt, Mycobacterium bovis subsp bovis AF2122/97
ccuugguggccagccag

SEQ ID NO: 3216458 - RNA, 12 nt, Mycobacterium bovis subsp bovis AF2122/97
ccuuggugggca

SEQ ID NO: 3216459 - RNA, 22 nt, Mycobacterium bovis subsp bovis AF2122/97
ccuuggugggcagauacgagcu

SEQ ID NO: 3216460 - RNA, 18 nt, Mycobacterium bovis subsp bovis AF2122/97
ccuugguguggggcggcu

SEQ ID NO: 3216461 - RNA, 15 nt, Mycobacterium bovis subsp bovis AF2122/97
ccuugguuagccgcg

SEQ ID NO: 3216462 - RNA, 22 nt, Mycobacterium bovis subsp bovis AF2122/97
ccuugguuagccgcggcccgcg

SEQ ID NO: 3216463 - RNA, 19 nt, Mycobacterium bovis subsp bovis AF2122/97
ccuuguagcacaccgacau

SEQ ID NO: 3216464 - RNA, 21 nt, Mycobacterium bovis subsp bovis AF2122/97
ccuugucggccccggccgcgu

SEQ ID NO: 3216465 - RNA, 21 nt, Mycobacterium bovis subsp bovis AF2122/97
ccuugucuaguugacgcagcc

SEQ ID NO: 3216466 - RNA, 20 nt, Mycobacterium bovis subsp bovis AF2122/97
cgaacaaguggccagcgcca

SEQ ID NO: 3216467 - RNA, 16 nt, Mycobacterium bovis subsp bovis AF2122/97
cgaacacaccgggcgg

SEQ ID NO: 3216468 - RNA, 15 nt, Mycobacterium bovis subsp bovis AF2122/97
cgaacaccagcgcgc

SEQ ID NO: 3216469 - RNA, 16 nt, Mycobacterium bovis subsp bovis AF2122/97
cgaacaccagcgcgcc

SEQ ID NO: 3216470 - RNA, 18 nt, Mycobacterium bovis subsp bovis AF2122/97
cgaacaccagcgcgccgu

SEQ ID NO: 3216471 - RNA, 14 nt, Mycobacterium bovis subsp bovis AF2122/97
cgaacaccccgggc

SEQ ID NO: 3216472 - RNA, 16 nt, Mycobacterium bovis subsp bovis AF2122/97
cgaacaccccgggcgc

SEQ ID NO: 3216473 - RNA, 20 nt, Mycobacterium bovis subsp bovis AF2122/97
cgaacacccgaagccggcgc

SEQ ID NO: 3216474 - RNA, 14 nt, Mycobacterium bovis subsp bovis AF2122/97
cgaacaccgccgcg

SEQ ID NO: 3216475 - RNA, 15 nt, Mycobacterium bovis subsp bovis AF2122/97
cgaacaccgccgcgu

SEQ ID NO: 3216476 - RNA, 20 nt, Mycobacterium bovis subsp bovis AF2122/97
cgaacaccgccgcgucgagc

SEQ ID NO: 3216477 - RNA, 16 nt, Mycobacterium bovis subsp bovis AF2122/97
cgaacaccgguaacgc

SEQ ID NO: 3216478 - RNA, 20 nt, Mycobacterium bovis subsp bovis AF2122/97
cgaacaccgguaacgcgaca

SEQ ID NO: 3216479 - RNA, 23 nt, Mycobacterium bovis subsp bovis AF2122/97
cgaacaccguccaauuggcgucg

SEQ ID NO: 3216480 - RNA, 22 nt, Mycobacterium bovis subsp bovis AF2122/97
cgaacaccucggcacggaccgc

SEQ ID NO: 3216481 - RNA, 13 nt, Mycobacterium bovis subsp bovis AF2122/97
cgaacacgcgaug

SEQ ID NO: 3216482 - RNA, 18 nt, Mycobacterium bovis subsp bovis AF2122/97
cgaacacgucggccagug

SEQ ID NO: 3216483 - RNA, 17 nt, Mycobacterium bovis subsp bovis AF2122/97
cgaacagacaugcgcac

SEQ ID NO: 3216484 - RNA, 19 nt, Mycobacterium bovis subsp bovis AF2122/97
cgaacagacaugcgcacca

SEQ ID NO: 3216485 - RNA, 23 nt, Mycobacterium bovis subsp bovis AF2122/97
cgaacagcacauaugugcccggc

SEQ ID NO: 3216486 - RNA, 17 nt, Mycobacterium bovis subsp bovis AF2122/97
cgaacagcaccgaaccc

SEQ ID NO: 3216487 - RNA, 21 nt, Mycobacterium bovis subsp bovis AF2122/97
cgaacagcaccgaacccgcca

SEQ ID NO: 3216488 - RNA, 18 nt, Mycobacterium bovis subsp bovis AF2122/97
cgaacagcgaaccgccgg

SEQ ID NO: 3216489 - RNA, 18 nt, Mycobacterium bovis subsp bovis AF2122/97
cgaacagcgaaccggcug

SEQ ID NO: 3216490 - RNA, 14 nt, Mycobacterium bovis subsp bovis AF2122/97
cgaacagcggucca

SEQ ID NO: 3216491 - RNA, 22 nt, Mycobacterium bovis subsp bovis AF2122/97
cgaacagcgguccagccaccgc

SEQ ID NO: 3216492 - RNA, 17 nt, Mycobacterium bovis subsp bovis AF2122/97
cgaacagcucgaucagc

SEQ ID NO: 3216493 - RNA, 16 nt, Mycobacterium bovis subsp bovis AF2122/97
cgaacagcugcccgcc

SEQ ID NO: 3216494 - RNA, 15 nt, Mycobacterium bovis subsp bovis AF2122/97
cgaacaggccggccg

SEQ ID NO: 3216495 - RNA, 20 nt, Mycobacterium bovis subsp bovis AF2122/97
cgaacagggaggucgccgca

SEQ ID NO: 3216496 - RNA, 15 nt, Mycobacterium bovis subsp bovis AF2122/97
cgaacagggcugcga

SEQ ID NO: 3216497 - RNA, 16 nt, Mycobacterium bovis subsp bovis AF2122/97
cgaacagggcugcgau

SEQ ID NO: 3216498 - RNA, 17 nt, Mycobacterium bovis subsp bovis AF2122/97
cgaacagggcugcgaug

SEQ ID NO: 3216499 - RNA, 20 nt, Mycobacterium bovis subsp bovis AF2122/97
cgaacagguuggccccggcc

SEQ ID NO: 3216500 - RNA, 18 nt, Mycobacterium bovis subsp bovis AF2122/97
cgaacaguaggccuccgc

SEQ ID NO: 3216501 - RNA, 19 nt, Mycobacterium bovis subsp bovis AF2122/97
cgaacaguaggccuccgcu

SEQ ID NO: 3216502 - RNA, 11 nt, Mycobacterium bovis subsp bovis AF2122/97
cgaacagucga

SEQ ID NO: 3216503 - RNA, 17 nt, Mycobacterium bovis subsp bovis AF2122/97
cgaacagucgagugaag

SEQ ID NO: 3216504 - RNA, 14 nt, Mycobacterium bovis subsp bovis AF2122/97
cgaacagugacgcc

SEQ ID NO: 3216505 - RNA, 21 nt, Mycobacterium bovis subsp bovis AF2122/97
cgaacaguggggguccggcgg

SEQ ID NO: 3216506 - RNA, 18 nt, Mycobacterium bovis subsp bovis AF2122/97
cgaacaguucggcgagca

SEQ ID NO: 3216507 - RNA, 20 nt, Mycobacterium bovis subsp bovis AF2122/97
cgaacaguugcggcuggcgc

SEQ ID NO: 3216508 - RNA, 14 nt, Mycobacterium bovis subsp bovis AF2122/97
cgaacaucaccguc

SEQ ID NO: 3216509 - RNA, 22 nt, Mycobacterium bovis subsp bovis AF2122/97
cgaacaucaccgucgcccgggu

SEQ ID NO: 3216510 - RNA, 15 nt, Mycobacterium bovis subsp bovis AF2122/97
cgaacauccgccgcc

SEQ ID NO: 3216511 - RNA, 16 nt, Mycobacterium bovis subsp bovis AF2122/97
cgaacaucgccagcgc

SEQ ID NO: 3216512 - RNA, 21 nt, Mycobacterium bovis subsp bovis AF2122/97
cgaacaugauccgccggcaac

SEQ ID NO: 3216513 - RNA, 20 nt, Mycobacterium bovis subsp bovis AF2122/97
cgaacauggcacgcgggaag

SEQ ID NO: 3216514 - RNA, 21 nt, Mycobacterium bovis subsp bovis AF2122/97
cgaacauggccagcaucagcg

SEQ ID NO: 3216515 - RNA, 13 nt, Mycobacterium bovis subsp bovis AF2122/97
cgaacauugcgcc

SEQ ID NO: 3216516 - RNA, 15 nt, Mycobacterium bovis subsp bovis AF2122/97
cgaacauugcgccca

SEQ ID NO: 3216517 - RNA, 18 nt, Mycobacterium bovis subsp bovis AF2122/97
cgaacauugcgcccagcg

SEQ ID NO: 3216518 - RNA, 20 nt, Mycobacterium bovis subsp bovis AF2122/97
cgaacauugcgcccagcgac

SEQ ID NO: 3216519 - RNA, 13 nt, Mycobacterium bovis subsp bovis AF2122/97
cgaaccaccaccg

SEQ ID NO: 3216520 - RNA, 20 nt, Mycobacterium bovis subsp bovis AF2122/97
cgaaccaccggcgccgccgg

SEQ ID NO: 3216521 - RNA, 20 nt, Mycobacterium bovis subsp bovis AF2122/97
cgaaccacgcgcccgcacca

SEQ ID NO: 3216522 - RNA, 23 nt, Mycobacterium bovis subsp bovis AF2122/97
cgaaccacgcgcccgcaccaccg

SEQ ID NO: 3216523 - RNA, 13 nt, Mycobacterium bovis subsp bovis AF2122/97
cgaaccacggcag

SEQ ID NO: 3216524 - RNA, 20 nt, Mycobacterium bovis subsp bovis AF2122/97
cgaaccagaguucggccagc

SEQ ID NO: 3216525 - RNA, 22 nt, Mycobacterium bovis subsp bovis AF2122/97
cgaaccagaguucggccagcgu

SEQ ID NO: 3216526 - RNA, 22 nt, Mycobacterium bovis subsp bovis AF2122/97
cgaaccagcuugcgccgcagcg

SEQ ID NO: 3216527 - RNA, 20 nt, Mycobacterium bovis subsp bovis AF2122/97
cgaaccaguccucgggcagg

SEQ ID NO: 3216528 - RNA, 20 nt, Mycobacterium bovis subsp bovis AF2122/97
cgaaccagucgaagaagacc

SEQ ID NO: 3216529 - RNA, 22 nt, Mycobacterium bovis subsp bovis AF2122/97
cgaaccaugguugaugacggcg

SEQ ID NO: 3216530 - RNA, 21 nt, Mycobacterium bovis subsp bovis AF2122/97
cgaacccaccgugccgggcga

SEQ ID NO: 3216531 - RNA, 13 nt, Mycobacterium bovis subsp bovis AF2122/97
cgaacccacugcc

SEQ ID NO: 3216532 - RNA, 18 nt, Mycobacterium bovis subsp bovis AF2122/97
cgaacccacugcccgccg

SEQ ID NO: 3216533 - RNA, 22 nt, Mycobacterium bovis subsp bovis AF2122/97
cgaacccacugcccgccgacgc

SEQ ID NO: 3216534 - RNA, 17 nt, Mycobacterium bovis subsp bovis AF2122/97
cgaaccccacgcagaag

SEQ ID NO: 3216535 - RNA, 13 nt, Mycobacterium bovis subsp bovis AF2122/97
cgaacccccgccg

SEQ ID NO: 3216536 - RNA, 18 nt, Mycobacterium bovis subsp bovis AF2122/97
cgaacccgaucgucgagc

SEQ ID NO: 3216537 - RNA, 15 nt, Mycobacterium bovis subsp bovis AF2122/97
cgaacccgccaccgc

SEQ ID NO: 3216538 - RNA, 18 nt, Mycobacterium bovis subsp bovis AF2122/97
cgaacccgccgaugcugc

SEQ ID NO: 3216539 - RNA, 22 nt, Mycobacterium bovis subsp bovis AF2122/97
cgaacccggcggacgacgucgg

SEQ ID NO: 3216540 - RNA, 13 nt, Mycobacterium bovis subsp bovis AF2122/97
cgaacccucagcc

SEQ ID NO: 3216541 - RNA, 16 nt, Mycobacterium bovis subsp bovis AF2122/97
cgaacccucagccgcg

SEQ ID NO: 3216542 - RNA, 22 nt, Mycobacterium bovis subsp bovis AF2122/97
cgaacccucagccgcgccgggu

SEQ ID NO: 3216543 - RNA, 15 nt, Mycobacterium bovis subsp bovis AF2122/97
cgaacccuccgcagc

SEQ ID NO: 3216544 - RNA, 22 nt, Mycobacterium bovis subsp bovis AF2122/97
cgaacccuucgcggugugcggc

SEQ ID NO: 3216545 - RNA, 23 nt, Mycobacterium bovis subsp bovis AF2122/97
cgaaccgacaccugucguccucg

SEQ ID NO: 3216546 - RNA, 12 nt, Mycobacterium bovis subsp bovis AF2122/97
cgaaccgacccg

SEQ ID NO: 3216547 - RNA, 19 nt, Mycobacterium bovis subsp bovis AF2122/97
cgaaccgaggugccgugga

SEQ ID NO: 3216548 - RNA, 14 nt, Mycobacterium bovis subsp bovis AF2122/97
cgaaccgcaaggcc

SEQ ID NO: 3216549 - RNA, 22 nt, Mycobacterium bovis subsp bovis AF2122/97
cgaaccgcacggugaccacgcc

SEQ ID NO: 3216550 - RNA, 14 nt, Mycobacterium bovis subsp bovis AF2122/97
cgaaccgccgacgg

SEQ ID NO: 3216551 - RNA, 14 nt, Mycobacterium bovis subsp bovis AF2122/97
cgaaccgccgccgc

SEQ ID NO: 3216552 - RNA, 15 nt, Mycobacterium bovis subsp bovis AF2122/97
cgaacuccaucacca

SEQ ID NO: 3216553 - RNA, 15 nt, Mycobacterium bovis subsp bovis AF2122/97
cgaacuccaugccgc

SEQ ID NO: 3216554 - RNA, 14 nt, Mycobacterium bovis subsp bovis AF2122/97
cgaacuccgcggaa

SEQ ID NO: 3216555 - RNA, 15 nt, Mycobacterium bovis subsp bovis AF2122/97
cgaacucgcgccgag

SEQ ID NO: 3216556 - RNA, 15 nt, Mycobacterium bovis subsp bovis AF2122/97
cgaacucgcgggcga

SEQ ID NO: 3216557 - RNA, 14 nt, Mycobacterium bovis subsp bovis AF2122/97
cgaacucggccggg

SEQ ID NO: 3216558 - RNA, 15 nt, Mycobacterium bovis subsp bovis AF2122/97
cgaacucggccgggc

SEQ ID NO: 3216559 - RNA, 17 nt, Mycobacterium bovis subsp bovis AF2122/97
cgaacucggccgggcgg

SEQ ID NO: 3216560 - RNA, 13 nt, Mycobacterium bovis subsp bovis AF2122/97
cgaacucgggcaa

SEQ ID NO: 3216561 - RNA, 20 nt, Mycobacterium bovis subsp bovis AF2122/97
cgaacucuacgguggugcgg

SEQ ID NO: 3216562 - RNA, 14 nt, Mycobacterium bovis subsp bovis AF2122/97
cgaacugaucgacc

SEQ ID NO: 3216563 - RNA, 16 nt, Mycobacterium bovis subsp bovis AF2122/97
cgaacugggcgaucga

SEQ ID NO: 3216564 - RNA, 17 nt, Mycobacterium bovis subsp bovis AF2122/97
cgaacugggggccggca

SEQ ID NO: 3216565 - RNA, 18 nt, Mycobacterium bovis subsp bovis AF2122/97
cgaacugggggccggcac

SEQ ID NO: 3216566 - RNA, 23 nt, Mycobacterium bovis subsp bovis AF2122/97
cgaacugggggccggcacugccg

SEQ ID NO: 3216567 - RNA, 21 nt, Mycobacterium bovis subsp bovis AF2122/97
cgaacugguuucgcaccgugu

SEQ ID NO: 3216568 - RNA, 23 nt, Mycobacterium bovis subsp bovis AF2122/97
cgaacuuccauucauggccgcga

SEQ ID NO: 3216569 - RNA, 21 nt, Mycobacterium bovis subsp bovis AF2122/97
cgaacuucgauucuggccgga

SEQ ID NO: 3216570 - RNA, 13 nt, Mycobacterium bovis subsp bovis AF2122/97
cgaacuucuggua

SEQ ID NO: 3216571 - RNA, 21 nt, Mycobacterium bovis subsp bovis AF2122/97
cgaagaacaguugcccgacgc

SEQ ID NO: 3216572 - RNA, 18 nt, Mycobacterium bovis subsp bovis AF2122/97
cgaagaaccggccgacga

SEQ ID NO: 3216573 - RNA, 19 nt, Mycobacterium bovis subsp bovis AF2122/97
cgaagaaccggccgacgaa

SEQ ID NO: 3216574 - RNA, 16 nt, Mycobacterium bovis subsp bovis AF2122/97
cgaagaaccggucgca

SEQ ID NO: 3216575 - RNA, 20 nt, Mycobacterium bovis subsp bovis AF2122/97
cgaagaaccggucgcagugc

SEQ ID NO: 3216576 - RNA, 19 nt, Mycobacterium bovis subsp bovis AF2122/97
cgaagaacgacgccaccgc

SEQ ID NO: 3216577 - RNA, 21 nt, Mycobacterium bovis subsp bovis AF2122/97
cgaagaacgacgccaccgcga

SEQ ID NO: 3216578 - RNA, 17 nt, Mycobacterium bovis subsp bovis AF2122/97
cgaagaagaacucggcg

SEQ ID NO: 3216579 - RNA, 22 nt, Mycobacterium bovis subsp bovis AF2122/97
cgaagaagaacucggcgucgug

SEQ ID NO: 3216580 - RNA, 17 nt, Mycobacterium bovis subsp bovis AF2122/97
cgaagaauaugccgaug

SEQ ID NO: 3216581 - RNA, 18 nt, Mycobacterium bovis subsp bovis AF2122/97
cgaagaauaugccgauga

SEQ ID NO: 3216582 - RNA, 20 nt, Mycobacterium bovis subsp bovis AF2122/97
cgaagaauaugccgaugacc

SEQ ID NO: 3216583 - RNA, 22 nt, Mycobacterium bovis subsp bovis AF2122/97
cgaagaaugggauggcaccacc

SEQ ID NO: 3216584 - RNA, 23 nt, Mycobacterium bovis subsp bovis AF2122/97
cgaagaaugggauggcaccaccc

SEQ ID NO: 3216585 - RNA, 15 nt, Mycobacterium bovis subsp bovis AF2122/97
cgaagaccagcaacg

SEQ ID NO: 3216586 - RNA, 20 nt, Mycobacterium bovis subsp bovis AF2122/97
cgaagaccgccuccaccgcc

SEQ ID NO: 3216587 - RNA, 14 nt, Mycobacterium bovis subsp bovis AF2122/97
cgaagaccucgucg

SEQ ID NO: 3216588 - RNA, 20 nt, Mycobacterium bovis subsp bovis AF2122/97
cgaagaccucgucgcgucgc

SEQ ID NO: 3216589 - RNA, 20 nt, Mycobacterium bovis subsp bovis AF2122/97
cgaagaccuggccugcggca

SEQ ID NO: 3216590 - RNA, 23 nt, Mycobacterium bovis subsp bovis AF2122/97
cgaagaccuggccugcggcaggu

SEQ ID NO: 3216591 - RNA, 21 nt, Mycobacterium bovis subsp bovis AF2122/97
cgaagacgugccggcucaggu

SEQ ID NO: 3216592 - RNA, 14 nt, Mycobacterium bovis subsp bovis AF2122/97
cgaagagcaccgcg

SEQ ID NO: 3216593 - RNA, 15 nt, Mycobacterium bovis subsp bovis AF2122/97
cgaagagcaccgcgc

SEQ ID NO: 3216594 - RNA, 16 nt, Mycobacterium bovis subsp bovis AF2122/97
cgaagagccagcaacg

SEQ ID NO: 3216595 - RNA, 17 nt, Mycobacterium bovis subsp bovis AF2122/97
cgaagagccagcaacgg

SEQ ID NO: 3216596 - RNA, 15 nt, Mycobacterium bovis subsp bovis AF2122/97
cgaagaggagaacga

SEQ ID NO: 3216597 - RNA, 13 nt, Mycobacterium bovis subsp bovis AF2122/97
cgaagagggcgcc

SEQ ID NO: 3216598 - RNA, 15 nt, Mycobacterium bovis subsp bovis AF2122/97
cgaagagggcgccgc

SEQ ID NO: 3216599 - RNA, 18 nt, Mycobacterium bovis subsp bovis AF2122/97
cgaagagggcgccgcgcg

SEQ ID NO: 3216600 - RNA, 14 nt, Mycobacterium bovis subsp bovis AF2122/97
cgaagauaucggca

SEQ ID NO: 3216601 - RNA, 17 nt, Mycobacterium bovis subsp bovis AF2122/97
cgaagauaucggcacgg

SEQ ID NO: 3216602 - RNA, 14 nt, Mycobacterium bovis subsp bovis AF2122/97
cgaagaucagcgga

SEQ ID NO: 3216603 - RNA, 21 nt, Mycobacterium bovis subsp bovis AF2122/97
cgaagauccagcgcaccggcg

SEQ ID NO: 3216604 - RNA, 17 nt, Mycobacterium bovis subsp bovis AF2122/97
cgaagaucgagccgacc

SEQ ID NO: 3216605 - RNA, 15 nt, Mycobacterium bovis subsp bovis AF2122/97
cgaagaucgccuggg

SEQ ID NO: 3216606 - RNA, 21 nt, Mycobacterium bovis subsp bovis AF2122/97
cgaagaucgcgugccacagca

SEQ ID NO: 3216607 - RNA, 20 nt, Mycobacterium bovis subsp bovis AF2122/97
cgaagaugaccucggcgacg

SEQ ID NO: 3216608 - RNA, 19 nt, Mycobacterium bovis subsp bovis AF2122/97
cgaagaugccuggaaucgc

SEQ ID NO: 3216609 - RNA, 13 nt, Mycobacterium bovis subsp bovis AF2122/97
cgaagauggccag

SEQ ID NO: 3216610 - RNA, 14 nt, Mycobacterium bovis subsp bovis AF2122/97
cgaagauggccagc

SEQ ID NO: 3216611 - RNA, 18 nt, Mycobacterium bovis subsp bovis AF2122/97
cgaagauggccagcgcgg

SEQ ID NO: 3216612 - RNA, 20 nt, Mycobacterium bovis subsp bovis AF2122/97
cgaagcacaccguccgucgg

SEQ ID NO: 3216613 - RNA, 15 nt, Mycobacterium bovis subsp bovis AF2122/97
cgaagcaccucccga

SEQ ID NO: 3216614 - RNA, 13 nt, Mycobacterium bovis subsp bovis AF2122/97
cgaagcagacgaa

SEQ ID NO: 3216615 - RNA, 14 nt, Mycobacterium bovis subsp bovis AF2122/97
cgaagccaccaggu

SEQ ID NO: 3216616 - RNA, 17 nt, Mycobacterium bovis subsp bovis AF2122/97
cgaagccaccaggucga

SEQ ID NO: 3216617 - RNA, 20 nt, Mycobacterium bovis subsp bovis AF2122/97
cgaagccagaucagccgccg

SEQ ID NO: 3216618 - RNA, 14 nt, Mycobacterium bovis subsp bovis AF2122/97
cgaagccagaucgc

SEQ ID NO: 3216619 - RNA, 11 nt, Mycobacterium bovis subsp bovis AF2122/97
cgaagcccacg

SEQ ID NO: 3216620 - RNA, 21 nt, Mycobacterium bovis subsp bovis AF2122/97
cgaagcccagcaccaccaccc

SEQ ID NO: 3216621 - RNA, 19 nt, Mycobacterium bovis subsp bovis AF2122/97
cgaagccccgguggcaggg

SEQ ID NO: 3216622 - RNA, 18 nt, Mycobacterium bovis subsp bovis AF2122/97
cgaagccccucaccucgg

SEQ ID NO: 3216623 - RNA, 12 nt, Mycobacterium bovis subsp bovis AF2122/97
cgaagcccgaca

SEQ ID NO: 3216624 - RNA, 15 nt, Mycobacterium bovis subsp bovis AF2122/97
cgaagcccgacauga

SEQ ID NO: 3216625 - RNA, 23 nt, Mycobacterium bovis subsp bovis AF2122/97
cgaagcccgacuguagaaaaccc

SEQ ID NO: 3216626 - RNA, 17 nt, Mycobacterium bovis subsp bovis AF2122/97
cgaagcccgaguugaag

SEQ ID NO: 3216627 - RNA, 22 nt, Mycobacterium bovis subsp bovis AF2122/97
cgaagcccggacaacuucuuua

SEQ ID NO: 3216628 - RNA, 11 nt, Mycobacterium bovis subsp bovis AF2122/97
cgaagccgacc

SEQ ID NO: 3216629 - RNA, 19 nt, Mycobacterium bovis subsp bovis AF2122/97
cgaagccgccgggugcgcc

SEQ ID NO: 3216630 - RNA, 20 nt, Mycobacterium bovis subsp bovis AF2122/97
cgaagccgccgggugcgccg

SEQ ID NO: 3216631 - RNA, 18 nt, Mycobacterium bovis subsp bovis AF2122/97
cgaagccggaccgcacuu

SEQ ID NO: 3216632 - RNA, 13 nt, Mycobacterium bovis subsp bovis AF2122/97
cgaagccggcgcc

SEQ ID NO: 3216633 - RNA, 16 nt, Mycobacterium bovis subsp bovis AF2122/97
cgaagccggcgccggc

SEQ ID NO: 3216634 - RNA, 18 nt, Mycobacterium bovis subsp bovis AF2122/97
cgaagccggcgccggcuu

SEQ ID NO: 3216635 - RNA, 13 nt, Mycobacterium bovis subsp bovis AF2122/97
cgaagccggcgcu

SEQ ID NO: 3216636 - RNA, 15 nt, Mycobacterium bovis subsp bovis AF2122/97
cgaagccggcgcucg

SEQ ID NO: 3216637 - RNA, 12 nt, Mycobacterium bovis subsp bovis AF2122/97
cgaagccggguc

SEQ ID NO: 3216638 - RNA, 21 nt, Mycobacterium bovis subsp bovis AF2122/97
cgaagccgggucucggugcgg

SEQ ID NO: 3216639 - RNA, 14 nt, Mycobacterium bovis subsp bovis AF2122/97
cgaaguuccagccg

SEQ ID NO: 3216640 - RNA, 20 nt, Mycobacterium bovis subsp bovis AF2122/97
cgaaguucucggugcgcagc

SEQ ID NO: 3216641 - RNA, 23 nt, Mycobacterium bovis subsp bovis AF2122/97
cgaaguucucggugcgcagcugc

SEQ ID NO: 3216642 - RNA, 20 nt, Mycobacterium bovis subsp bovis AF2122/97
cgaaguuugcgacgacgcca

SEQ ID NO: 3216643 - RNA, 18 nt, Mycobacterium bovis subsp bovis AF2122/97
cgaaguuuuggaagcccg

SEQ ID NO: 3216644 - RNA, 22 nt, Mycobacterium bovis subsp bovis AF2122/97
cgaauaacagcaggcauucccg

SEQ ID NO: 3216645 - RNA, 15 nt, Mycobacterium bovis subsp bovis AF2122/97
cgaauaccacaccgu

SEQ ID NO: 3216646 - RNA, 19 nt, Mycobacterium bovis subsp bovis AF2122/97
cgaauaccacaccgugacc

SEQ ID NO: 3216647 - RNA, 14 nt, Mycobacterium bovis subsp bovis AF2122/97
cgaauaccagaccg

SEQ ID NO: 3216648 - RNA, 22 nt, Mycobacterium bovis subsp bovis AF2122/97
cgaauaccagaccggccgacgu

SEQ ID NO: 3216649 - RNA, 13 nt, Mycobacterium bovis subsp bovis AF2122/97
cgaauacccgcgg

SEQ ID NO: 3216650 - RNA, 13 nt, Mycobacterium bovis subsp bovis AF2122/97
cgaauaccggugg

SEQ ID NO: 3216651 - RNA, 21 nt, Mycobacterium bovis subsp bovis AF2122/97
cgaauacgaccgucgcgcugc

SEQ ID NO: 3216652 - RNA, 14 nt, Mycobacterium bovis subsp bovis AF2122/97
cgaauacggugcca

SEQ ID NO: 3216653 - RNA, 23 nt, Mycobacterium bovis subsp bovis AF2122/97
cgaaucaccuugcuccacaucgg

SEQ ID NO: 3216654 - RNA, 12 nt, Mycobacterium bovis subsp bovis AF2122/97
cgaaucagcucg

SEQ ID NO: 3216655 - RNA, 14 nt, Mycobacterium bovis subsp bovis AF2122/97
cgaauccaggccgu

SEQ ID NO: 3216656 - RNA, 14 nt, Mycobacterium bovis subsp bovis AF2122/97
cgaauccaucgaga

SEQ ID NO: 3216657 - RNA, 20 nt, Mycobacterium bovis subsp bovis AF2122/97
cgaaucccgcgaugcgcacc

SEQ ID NO: 3216658 - RNA, 16 nt, Mycobacterium bovis subsp bovis AF2122/97
cgaaucccgcgcccgg

SEQ ID NO: 3216659 - RNA, 17 nt, Mycobacterium bovis subsp bovis AF2122/97
cgaaucccgcgcccggc

SEQ ID NO: 3216660 - RNA, 19 nt, Mycobacterium bovis subsp bovis AF2122/97
cgaaucccgcgcccggccg

SEQ ID NO: 3216661 - RNA, 21 nt, Mycobacterium bovis subsp bovis AF2122/97
cgaauccgaucaccucggcga

SEQ ID NO: 3216662 - RNA, 23 nt, Mycobacterium bovis subsp bovis AF2122/97
cgaauccgcucgagguggucucg

SEQ ID NO: 3216663 - RNA, 14 nt, Mycobacterium bovis subsp bovis AF2122/97
cgaauccggccacu

SEQ ID NO: 3216664 - RNA, 21 nt, Mycobacterium bovis subsp bovis AF2122/97
cgaauccucgcgaaaccgccg

SEQ ID NO: 3216665 - RNA, 14 nt, Mycobacterium bovis subsp bovis AF2122/97
cgaaucgcccaucg

SEQ ID NO: 3216666 - RNA, 20 nt, Mycobacterium bovis subsp bovis AF2122/97
cgaaucgcgacgcgacgguu

SEQ ID NO: 3216667 - RNA, 15 nt, Mycobacterium bovis subsp bovis AF2122/97
cgaaucgcgucgagc

SEQ ID NO: 3216668 - RNA, 16 nt, Mycobacterium bovis subsp bovis AF2122/97
cgaaucgcugaccgcg

SEQ ID NO: 3216669 - RNA, 21 nt, Mycobacterium bovis subsp bovis AF2122/97
cgaaucgcugaccgcguagac

SEQ ID NO: 3216670 - RNA, 15 nt, Mycobacterium bovis subsp bovis AF2122/97
cgaaucgcugccgcc

SEQ ID NO: 3216671 - RNA, 17 nt, Mycobacterium bovis subsp bovis AF2122/97
cgaaucgcugccgccga

SEQ ID NO: 3216672 - RNA, 18 nt, Mycobacterium bovis subsp bovis AF2122/97
cgaaucgcugccgccgau

SEQ ID NO: 3216673 - RNA, 17 nt, Mycobacterium bovis subsp bovis AF2122/97
cgaaucgcuggugaagu

SEQ ID NO: 3216674 - RNA, 20 nt, Mycobacterium bovis subsp bovis AF2122/97
cgaaucgggucggccgcugg

SEQ ID NO: 3216675 - RNA, 14 nt, Mycobacterium bovis subsp bovis AF2122/97
cgaaucgucacgga

SEQ ID NO: 3216676 - RNA, 16 nt, Mycobacterium bovis subsp bovis AF2122/97
cgaaucgucaucccga

SEQ ID NO: 3216677 - RNA, 23 nt, Mycobacterium bovis subsp bovis AF2122/97
cgaaucgugucgccucgaugcca

SEQ ID NO: 3216678 - RNA, 13 nt, Mycobacterium bovis subsp bovis AF2122/97
cgaaucucaccgu

SEQ ID NO: 3216679 - RNA, 15 nt, Mycobacterium bovis subsp bovis AF2122/97
cgaaucugccggccg

SEQ ID NO: 3216680 - RNA, 19 nt, Mycobacterium bovis subsp bovis AF2122/97
cgaaucugccggccggcgg

SEQ ID NO: 3216681 - RNA, 13 nt, Mycobacterium bovis subsp bovis AF2122/97
cgaaugacggcca

SEQ ID NO: 3216682 - RNA, 15 nt, Mycobacterium bovis subsp bovis AF2122/97
cgaaugacggccagu

SEQ ID NO: 3216683 - RNA, 18 nt, Mycobacterium bovis subsp bovis AF2122/97
cgaaugaucgucccgcgg

SEQ ID NO: 3216684 - RNA, 16 nt, Mycobacterium bovis subsp bovis AF2122/97
cgaaugccaccucgac

SEQ ID NO: 3216685 - RNA, 18 nt, Mycobacterium bovis subsp bovis AF2122/97
cgaaugccaccucgacgc

SEQ ID NO: 3216686 - RNA, 19 nt, Mycobacterium bovis subsp bovis AF2122/97
cgaaugccauaaccggugg

SEQ ID NO: 3216687 - RNA, 16 nt, Mycobacterium bovis subsp bovis AF2122/97
cgaaugcggccccgac

SEQ ID NO: 3216688 - RNA, 18 nt, Mycobacterium bovis subsp bovis AF2122/97
cgaaugcgggccuccugc

SEQ ID NO: 3216689 - RNA, 12 nt, Mycobacterium bovis subsp bovis AF2122/97
cgaaugcgggug

SEQ ID NO: 3216690 - RNA, 14 nt, Mycobacterium bovis subsp bovis AF2122/97
cgaaugcgggugga

SEQ ID NO: 3216691 - RNA, 18 nt, Mycobacterium bovis subsp bovis AF2122/97
cgaaugcggguggaguug

SEQ ID NO: 3216692 - RNA, 16 nt, Mycobacterium bovis subsp bovis AF2122/97
cgaaugcgguccucga

SEQ ID NO: 3216693 - RNA, 21 nt, Mycobacterium bovis subsp bovis AF2122/97
cgaaugcggugaguccgcuga

SEQ ID NO: 3216694 - RNA, 14 nt, Mycobacterium bovis subsp bovis AF2122/97
cgaaugcugacaug

SEQ ID NO: 3216695 - RNA, 18 nt, Mycobacterium bovis subsp bovis AF2122/97
cgaaugcugggcccgcca

SEQ ID NO: 3216696 - RNA, 22 nt, Mycobacterium bovis subsp bovis AF2122/97
cgaaugcugggcccgccagccc

SEQ ID NO: 3216697 - RNA, 23 nt, Mycobacterium bovis subsp bovis AF2122/97
cgaaugcugggcccgccagccca

SEQ ID NO: 3216698 - RNA, 20 nt, Mycobacterium bovis subsp bovis AF2122/97
cgaauggccgaucccaccgg

SEQ ID NO: 3216699 - RNA, 23 nt, Mycobacterium bovis subsp bovis AF2122/97
cgaauggcggugggcuuggcgcc

SEQ ID NO: 3216700 - RNA, 18 nt, Mycobacterium bovis subsp bovis AF2122/97
cgaaugggggcuggucgc

SEQ ID NO: 3216701 - RNA, 22 nt, Mycobacterium bovis subsp bovis AF2122/97
cgaaugggggcuggucgccgua

SEQ ID NO: 3216702 - RNA, 17 nt, Mycobacterium bovis subsp bovis AF2122/97
cgaaugguaucgagugg

SEQ ID NO: 3216703 - RNA, 15 nt, Mycobacterium bovis subsp bovis AF2122/97
cgaaugucgccgccu

SEQ ID NO: 3216704 - RNA, 15 nt, Mycobacterium bovis subsp bovis AF2122/97
cgaaugugaucaccc

SEQ ID NO: 3216705 - RNA, 23 nt, Mycobacterium bovis subsp bovis AF2122/97
cgaauguugcgaucugcggcgcc

SEQ ID NO: 3216706 - RNA, 16 nt, Mycobacterium bovis subsp bovis AF2122/97
cgaauguuucggcgau

SEQ ID NO: 3216707 - RNA, 15 nt, Mycobacterium bovis subsp bovis AF2122/97
cgaauucagcugcac

SEQ ID NO: 3216708 - RNA, 17 nt, Mycobacterium bovis subsp bovis AF2122/97
cgaauuccagccagccg

SEQ ID NO: 3216709 - RNA, 14 nt, Mycobacterium bovis subsp bovis AF2122/97
cgaauugcguucgc

SEQ ID NO: 3216710 - RNA, 19 nt, Mycobacterium bovis subsp bovis AF2122/97
cgaauugcguucgccgccc

SEQ ID NO: 3216711 - RNA, 18 nt, Mycobacterium bovis subsp bovis AF2122/97
cgaauuggcggaacugua

SEQ ID NO: 3216712 - RNA, 23 nt, Mycobacterium bovis subsp bovis AF2122/97
cgaauugguaaugcaccagggcg

SEQ ID NO: 3216713 - RNA, 12 nt, Mycobacterium bovis subsp bovis AF2122/97
cgacaaaagcca

SEQ ID NO: 3216714 - RNA, 17 nt, Mycobacterium bovis subsp bovis AF2122/97
cgacaaaagccagggcc

SEQ ID NO: 3216715 - RNA, 14 nt, Mycobacterium bovis subsp bovis AF2122/97
cgacaaacagcgcc

SEQ ID NO: 3216716 - RNA, 18 nt, Mycobacterium bovis subsp bovis AF2122/97
cgacaaaccgggcgugcc

SEQ ID NO: 3216717 - RNA, 19 nt, Mycobacterium bovis subsp bovis AF2122/97
cgacaaacggcgacccagc

SEQ ID NO: 3216718 - RNA, 17 nt, Mycobacterium bovis subsp bovis AF2122/97
cgacaaacguguugacc

SEQ ID NO: 3216719 - RNA, 21 nt, Mycobacterium bovis subsp bovis AF2122/97
cgacaaacguguugaccgggu

SEQ ID NO: 3216720 - RNA, 15 nt, Mycobacterium bovis subsp bovis AF2122/97
cgacaaagcggcugc

SEQ ID NO: 3216721 - RNA, 19 nt, Mycobacterium bovis subsp bovis AF2122/97
cgacaaagcggcugcccga

SEQ ID NO: 3216722 - RNA, 19 nt, Mycobacterium bovis subsp bovis AF2122/97
cgacaaaucggucgacgau

SEQ ID NO: 3216723 - RNA, 20 nt, Mycobacterium bovis subsp bovis AF2122/97
cgacaacaacucuucggcgg

SEQ ID NO: 3216724 - RNA, 13 nt, Mycobacterium bovis subsp bovis AF2122/97
cgacaacaccacg

SEQ ID NO: 3216725 - RNA, 14 nt, Mycobacterium bovis subsp bovis AF2122/97
cgacacgccagccg

SEQ ID NO: 3216726 - RNA, 14 nt, Mycobacterium bovis subsp bovis AF2122/97
cgacacgccaggug

SEQ ID NO: 3216727 - RNA, 13 nt, Mycobacterium bovis subsp bovis AF2122/97
cgacacgccgaac

SEQ ID NO: 3216728 - RNA, 22 nt, Mycobacterium bovis subsp bovis AF2122/97
cgacacgccgaacgugcggugg

SEQ ID NO: 3216729 - RNA, 14 nt, Mycobacterium bovis subsp bovis AF2122/97
cgacacgccgaugc

SEQ ID NO: 3216730 - RNA, 15 nt, Mycobacterium bovis subsp bovis AF2122/97
cgacacgccgaugcc

SEQ ID NO: 3216731 - RNA, 16 nt, Mycobacterium bovis subsp bovis AF2122/97
cgacacgccgcaucgg

SEQ ID NO: 3216732 - RNA, 15 nt, Mycobacterium bovis subsp bovis AF2122/97
cgacacgccggcggg

SEQ ID NO: 3216733 - RNA, 20 nt, Mycobacterium bovis subsp bovis AF2122/97
cgacacgccgugcgugcggg

SEQ ID NO: 3216734 - RNA, 16 nt, Mycobacterium bovis subsp bovis AF2122/97
cgacacgccugggcga

SEQ ID NO: 3216735 - RNA, 15 nt, Mycobacterium bovis subsp bovis AF2122/97
cgacacgcggcccga

SEQ ID NO: 3216736 - RNA, 22 nt, Mycobacterium bovis subsp bovis AF2122/97
cgacacggcggcugcggcgucg

SEQ ID NO: 3216737 - RNA, 14 nt, Mycobacterium bovis subsp bovis AF2122/97
cgacacggugcugc

SEQ ID NO: 3216738 - RNA, 20 nt, Mycobacterium bovis subsp bovis AF2122/97
cgacacggugcugccguugg

SEQ ID NO: 3216739 - RNA, 16 nt, Mycobacterium bovis subsp bovis AF2122/97
cgacacguugacgaug

SEQ ID NO: 3216740 - RNA, 19 nt, Mycobacterium bovis subsp bovis AF2122/97
cgacacguuucacgugguc

SEQ ID NO: 3216741 - RNA, 19 nt, Mycobacterium bovis subsp bovis AF2122/97
cgacacucacgggugcugg

SEQ ID NO: 3216742 - RNA, 22 nt, Mycobacterium bovis subsp bovis AF2122/97
cgacacugggaucccgacgaag

SEQ ID NO: 3216743 - RNA, 19 nt, Mycobacterium bovis subsp bovis AF2122/97
cgacagauugcucgguggu

SEQ ID NO: 3216744 - RNA, 13 nt, Mycobacterium bovis subsp bovis AF2122/97
cgacagcacccgg

SEQ ID NO: 3216745 - RNA, 19 nt, Mycobacterium bovis subsp bovis AF2122/97
cgacagcacccggccaccg

SEQ ID NO: 3216746 - RNA, 20 nt, Mycobacterium bovis subsp bovis AF2122/97
cgacagcacccggccaccgg

SEQ ID NO: 3216747 - RNA, 21 nt, Mycobacterium bovis subsp bovis AF2122/97
cgacagcacccggccaccgga

SEQ ID NO: 3216748 - RNA, 14 nt, Mycobacterium bovis subsp bovis AF2122/97
cgacagcaccgaau

SEQ ID NO: 3216749 - RNA, 20 nt, Mycobacterium bovis subsp bovis AF2122/97
cgacagcagaaucucggguc

SEQ ID NO: 3216750 - RNA, 12 nt, Mycobacterium bovis subsp bovis AF2122/97
cgacagcagccg

SEQ ID NO: 3216751 - RNA, 16 nt, Mycobacterium bovis subsp bovis AF2122/97
cgacagcagccggugc

SEQ ID NO: 3216752 - RNA, 12 nt, Mycobacterium bovis subsp bovis AF2122/97
cgacagcagcgc

SEQ ID NO: 3216753 - RNA, 16 nt, Mycobacterium bovis subsp bovis AF2122/97
cgacagcagcgccacc

SEQ ID NO: 3216754 - RNA, 14 nt, Mycobacterium bovis subsp bovis AF2122/97
cgacagcagcgcga

SEQ ID NO: 3216755 - RNA, 19 nt, Mycobacterium bovis subsp bovis AF2122/97
cgacagcagguugccgaag

SEQ ID NO: 3216756 - RNA, 16 nt, Mycobacterium bovis subsp bovis AF2122/97
cgacagcaucacgccc

SEQ ID NO: 3216757 - RNA, 20 nt, Mycobacterium bovis subsp bovis AF2122/97
cgacagcaucacgcccacga

SEQ ID NO: 3216758 - RNA, 13 nt, Mycobacterium bovis subsp bovis AF2122/97
cgacagccaccgc

SEQ ID NO: 3216759 - RNA, 14 nt, Mycobacterium bovis subsp bovis AF2122/97
cgacagccaccgcg

SEQ ID NO: 3216760 - RNA, 17 nt, Mycobacterium bovis subsp bovis AF2122/97
cgacagccaccucgacg

SEQ ID NO: 3216761 - RNA, 21 nt, Mycobacterium bovis subsp bovis AF2122/97
cgacagccaccucgacgguga

SEQ ID NO: 3216762 - RNA, 15 nt, Mycobacterium bovis subsp bovis AF2122/97
cgacagccccaucac

SEQ ID NO: 3216763 - RNA, 18 nt, Mycobacterium bovis subsp bovis AF2122/97
cgacagccccaucaccac

SEQ ID NO: 3216764 - RNA, 20 nt, Mycobacterium bovis subsp bovis AF2122/97
cgacagccccaucaccaccg

SEQ ID NO: 3216765 - RNA, 23 nt, Mycobacterium bovis subsp bovis AF2122/97
cgacagccccaucaccaccggca

SEQ ID NO: 3216766 - RNA, 16 nt, Mycobacterium bovis subsp bovis AF2122/97
cgacagccccgcggcc

SEQ ID NO: 3216767 - RNA, 17 nt, Mycobacterium bovis subsp bovis AF2122/97
cgacagccccgcggcca

SEQ ID NO: 3216768 - RNA, 21 nt, Mycobacterium bovis subsp bovis AF2122/97
cgacagccccgcggccagcag

SEQ ID NO: 3216769 - RNA, 23 nt, Mycobacterium bovis subsp bovis AF2122/97
cgacagccccgcggccagcagca

SEQ ID NO: 3216770 - RNA, 17 nt, Mycobacterium bovis subsp bovis AF2122/97
cgacagccgauccgauc

SEQ ID NO: 3216771 - RNA, 22 nt, Mycobacterium bovis subsp bovis AF2122/97
cgacagccgauccgaucgcaga

SEQ ID NO: 3216772 - RNA, 18 nt, Mycobacterium bovis subsp bovis AF2122/97
cgacagcgaaggcgccga

SEQ ID NO: 3216773 - RNA, 17 nt, Mycobacterium bovis subsp bovis AF2122/97
cgacagcgcaguaacgu

SEQ ID NO: 3216774 - RNA, 18 nt, Mycobacterium bovis subsp bovis AF2122/97
cgacagcgccuuguuggc

SEQ ID NO: 3216775 - RNA, 20 nt, Mycobacterium bovis subsp bovis AF2122/97
cgacagcgccuuguuggcga

SEQ ID NO: 3216776 - RNA, 13 nt, Mycobacterium bovis subsp bovis AF2122/97
cgacagcgcggcg

SEQ ID NO: 3216777 - RNA, 14 nt, Mycobacterium bovis subsp bovis AF2122/97
cgacagcgcggcgg

SEQ ID NO: 3216778 - RNA, 16 nt, Mycobacterium bovis subsp bovis AF2122/97
cgacagcgcugggccc

SEQ ID NO: 3216779 - RNA, 14 nt, Mycobacterium bovis subsp bovis AF2122/97
cgacagcggacccc

SEQ ID NO: 3216780 - RNA, 15 nt, Mycobacterium bovis subsp bovis AF2122/97
cgacagcggcaaucg

SEQ ID NO: 3216781 - RNA, 14 nt, Mycobacterium bovis subsp bovis AF2122/97
cgacagcggcaccg

SEQ ID NO: 3216782 - RNA, 16 nt, Mycobacterium bovis subsp bovis AF2122/97
cgacagcggcaccggg

SEQ ID NO: 3216783 - RNA, 19 nt, Mycobacterium bovis subsp bovis AF2122/97
cgacagcggcgacaugauc

SEQ ID NO: 3216784 - RNA, 12 nt, Mycobacterium bovis subsp bovis AF2122/97
cgacagcgggcu

SEQ ID NO: 3216785 - RNA, 16 nt, Mycobacterium bovis subsp bovis AF2122/97
cgacagcgugccgaac

SEQ ID NO: 3216786 - RNA, 22 nt, Mycobacterium bovis subsp bovis AF2122/97
cgacagcucaucgauccucgcc

SEQ ID NO: 3216787 - RNA, 18 nt, Mycobacterium bovis subsp bovis AF2122/97
cgacagcuuggccgguuc

SEQ ID NO: 3216788 - RNA, 12 nt, Mycobacterium bovis subsp bovis AF2122/97
cgacaggcgccc

SEQ ID NO: 3216789 - RNA, 18 nt, Mycobacterium bovis subsp bovis AF2122/97
cgacaggcgcccacaaau

SEQ ID NO: 3216790 - RNA, 18 nt, Mycobacterium bovis subsp bovis AF2122/97
cgacagggacccgagauc

SEQ ID NO: 3216791 - RNA, 23 nt, Mycobacterium bovis subsp bovis AF2122/97
cgacagggacccgagaucaccgg

SEQ ID NO: 3216792 - RNA, 20 nt, Mycobacterium bovis subsp bovis AF2122/97
cgacagggccuugaucggca

SEQ ID NO: 3216793 - RNA, 14 nt, Mycobacterium bovis subsp bovis AF2122/97
cgacaggucacuac

SEQ ID NO: 3216794 - RNA, 13 nt, Mycobacterium bovis subsp bovis AF2122/97
cgacaggucgccc

SEQ ID NO: 3216795 - RNA, 12 nt, Mycobacterium bovis subsp bovis AF2122/97
cgacaggugcca

SEQ ID NO: 3216796 - RNA, 17 nt, Mycobacterium bovis subsp bovis AF2122/97
cgacaggugcucgucau

SEQ ID NO: 3216797 - RNA, 14 nt, Mycobacterium bovis subsp bovis AF2122/97
cgacaguccgcgcc

SEQ ID NO: 3216798 - RNA, 17 nt, Mycobacterium bovis subsp bovis AF2122/97
cgacaguccgcgccggc

SEQ ID NO: 3216799 - RNA, 15 nt, Mycobacterium bovis subsp bovis AF2122/97
cgacaguggcucacc

SEQ ID NO: 3216800 - RNA, 18 nt, Mycobacterium bovis subsp bovis AF2122/97
cgacagugugaagaccac

SEQ ID NO: 3216801 - RNA, 19 nt, Mycobacterium bovis subsp bovis AF2122/97
cgacagugugaagaccacc

SEQ ID NO: 3216802 - RNA, 22 nt, Mycobacterium bovis subsp bovis AF2122/97
cgacagugugaagaccaccgcc

SEQ ID NO: 3216803 - RNA, 23 nt, Mycobacterium bovis subsp bovis AF2122/97
cgacaguugugcguacugguccg

SEQ ID NO: 3216804 - RNA, 22 nt, Mycobacterium bovis subsp bovis AF2122/97
cgacaguuuaccgugccgcccg

SEQ ID NO: 3216805 - RNA, 12 nt, Mycobacterium bovis subsp bovis AF2122/97
cgacaucaccac

SEQ ID NO: 3216806 - RNA, 14 nt, Mycobacterium bovis subsp bovis AF2122/97
cgacaucaccaccg

SEQ ID NO: 3216807 - RNA, 15 nt, Mycobacterium bovis subsp bovis AF2122/97
cgacaucaccaccga

SEQ ID NO: 3216808 - RNA, 20 nt, Mycobacterium bovis subsp bovis AF2122/97
cgacaucaccaccgaccugg

SEQ ID NO: 3216809 - RNA, 21 nt, Mycobacterium bovis subsp bovis AF2122/97
cgacaucaccaccgaccugga

SEQ ID NO: 3216810 - RNA, 15 nt, Mycobacterium bovis subsp bovis AF2122/97
cgacaucaccaccgc

SEQ ID NO: 3216811 - RNA, 16 nt, Mycobacterium bovis subsp bovis AF2122/97
cgacaucaccaccgca

SEQ ID NO: 3216812 - RNA, 16 nt, Mycobacterium bovis subsp bovis AF2122/97
cgaccacuucccgcuu

SEQ ID NO: 3216813 - RNA, 17 nt, Mycobacterium bovis subsp bovis AF2122/97
cgaccagaacgacgccg

SEQ ID NO: 3216814 - RNA, 17 nt, Mycobacterium bovis subsp bovis AF2122/97
cgaccagaaucgggccg

SEQ ID NO: 3216815 - RNA, 19 nt, Mycobacterium bovis subsp bovis AF2122/97
cgaccagagcuucgccgcg

SEQ ID NO: 3216816 - RNA, 19 nt, Mycobacterium bovis subsp bovis AF2122/97
cgaccagauagaacaacgu

SEQ ID NO: 3216817 - RNA, 12 nt, Mycobacterium bovis subsp bovis AF2122/97
cgaccagcacca

SEQ ID NO: 3216818 - RNA, 20 nt, Mycobacterium bovis subsp bovis AF2122/97
cgaccagcacccgcucggcc

SEQ ID NO: 3216819 - RNA, 14 nt, Mycobacterium bovis subsp bovis AF2122/97
cgaccagcagacca

SEQ ID NO: 3216820 - RNA, 15 nt, Mycobacterium bovis subsp bovis AF2122/97
cgaccagcagaucca

SEQ ID NO: 3216821 - RNA, 23 nt, Mycobacterium bovis subsp bovis AF2122/97
cgaccagcagauccaggcgucgg

SEQ ID NO: 3216822 - RNA, 13 nt, Mycobacterium bovis subsp bovis AF2122/97
cgaccagccccgc

SEQ ID NO: 3216823 - RNA, 18 nt, Mycobacterium bovis subsp bovis AF2122/97
cgaccagccccgcugguc

SEQ ID NO: 3216824 - RNA, 22 nt, Mycobacterium bovis subsp bovis AF2122/97
cgaccagccccgcuggucgacc

SEQ ID NO: 3216825 - RNA, 15 nt, Mycobacterium bovis subsp bovis AF2122/97
cgaccagccgagcga

SEQ ID NO: 3216826 - RNA, 23 nt, Mycobacterium bovis subsp bovis AF2122/97
cgaccagccgaucaucaccggca

SEQ ID NO: 3216827 - RNA, 15 nt, Mycobacterium bovis subsp bovis AF2122/97
cgaccagcgccgcac

SEQ ID NO: 3216828 - RNA, 19 nt, Mycobacterium bovis subsp bovis AF2122/97
cgaccagcgccgcacccgc

SEQ ID NO: 3216829 - RNA, 12 nt, Mycobacterium bovis subsp bovis AF2122/97
cgaccagcgcgc

SEQ ID NO: 3216830 - RNA, 15 nt, Mycobacterium bovis subsp bovis AF2122/97
cgaccagcggccgac

SEQ ID NO: 3216831 - RNA, 18 nt, Mycobacterium bovis subsp bovis AF2122/97
cgaccagcggccgaccgc

SEQ ID NO: 3216832 - RNA, 19 nt, Mycobacterium bovis subsp bovis AF2122/97
cgaccagcggccgaccgcg

SEQ ID NO: 3216833 - RNA, 16 nt, Mycobacterium bovis subsp bovis AF2122/97
cgaccagcucagcugc

SEQ ID NO: 3216834 - RNA, 20 nt, Mycobacterium bovis subsp bovis AF2122/97
cgaccagcucagcugcggau

SEQ ID NO: 3216835 - RNA, 16 nt, Mycobacterium bovis subsp bovis AF2122/97
cgaccagcugagcugg

SEQ ID NO: 3216836 - RNA, 14 nt, Mycobacterium bovis subsp bovis AF2122/97
cgaccagcuggccg

SEQ ID NO: 3216837 - RNA, 18 nt, Mycobacterium bovis subsp bovis AF2122/97
cgaccagcuggccguacu

SEQ ID NO: 3216838 - RNA, 22 nt, Mycobacterium bovis subsp bovis AF2122/97
cgaccagcugugaacaggccga

SEQ ID NO: 3216839 - RNA, 17 nt, Mycobacterium bovis subsp bovis AF2122/97
cgaccaggaccaccgca

SEQ ID NO: 3216840 - RNA, 20 nt, Mycobacterium bovis subsp bovis AF2122/97
cgaccaggagccuccagcgc

SEQ ID NO: 3216841 - RNA, 13 nt, Mycobacterium bovis subsp bovis AF2122/97
cgaccaggccacu

SEQ ID NO: 3216842 - RNA, 17 nt, Mycobacterium bovis subsp bovis AF2122/97
cgaccaggccacugccg

SEQ ID NO: 3216843 - RNA, 12 nt, Mycobacterium bovis subsp bovis AF2122/97
cgaccagggccg

SEQ ID NO: 3216844 - RNA, 16 nt, Mycobacterium bovis subsp bovis AF2122/97
cgaccagggccgccgc

SEQ ID NO: 3216845 - RNA, 18 nt, Mycobacterium bovis subsp bovis AF2122/97
cgaccagggccgccgcug

SEQ ID NO: 3216846 - RNA, 15 nt, Mycobacterium bovis subsp bovis AF2122/97
cgaccagggcggugc

SEQ ID NO: 3216847 - RNA, 16 nt, Mycobacterium bovis subsp bovis AF2122/97
cgaccagggcggugcu

SEQ ID NO: 3216848 - RNA, 19 nt, Mycobacterium bovis subsp bovis AF2122/97
cgaccagguagaccaggug

SEQ ID NO: 3216849 - RNA, 15 nt, Mycobacterium bovis subsp bovis AF2122/97
cgaccaggucgccag

SEQ ID NO: 3216850 - RNA, 19 nt, Mycobacterium bovis subsp bovis AF2122/97
cgaccaggucgccagcucg

SEQ ID NO: 3216851 - RNA, 20 nt, Mycobacterium bovis subsp bovis AF2122/97
cgaccaggucgccagcucgg

SEQ ID NO: 3216852 - RNA, 14 nt, Mycobacterium bovis subsp bovis AF2122/97
cgaccagugguggc

SEQ ID NO: 3216853 - RNA, 24 nt, Mycobacterium bovis subsp bovis AF2122/97
cgaccaguucggaaucggagccgu

SEQ ID NO: 3216854 - RNA, 13 nt, Mycobacterium bovis subsp bovis AF2122/97
cgaccauacccgc

SEQ ID NO: 3216855 - RNA, 18 nt, Mycobacterium bovis subsp bovis AF2122/97
cgaccauacccgcgcgca

SEQ ID NO: 3216856 - RNA, 17 nt, Mycobacterium bovis subsp bovis AF2122/97
cgaccauauucagcucg

SEQ ID NO: 3216857 - RNA, 19 nt, Mycobacterium bovis subsp bovis AF2122/97
cgaccaucaccacggccgc

SEQ ID NO: 3216858 - RNA, 21 nt, Mycobacterium bovis subsp bovis AF2122/97
cgaccaucaccacggccgccg

SEQ ID NO: 3216859 - RNA, 17 nt, Mycobacterium bovis subsp bovis AF2122/97
cgaccauccgaguuguc

SEQ ID NO: 3216860 - RNA, 21 nt, Mycobacterium bovis subsp bovis AF2122/97
cgaccauccgaguugucgccg

SEQ ID NO: 3216861 - RNA, 14 nt, Mycobacterium bovis subsp bovis AF2122/97
cgaccaucgcgacg

SEQ ID NO: 3216862 - RNA, 16 nt, Mycobacterium bovis subsp bovis AF2122/97
cgaccaucgggacgcc

SEQ ID NO: 3216863 - RNA, 17 nt, Mycobacterium bovis subsp bovis AF2122/97
cgaccaucucaccgggc

SEQ ID NO: 3216864 - RNA, 20 nt, Mycobacterium bovis subsp bovis AF2122/97
cgaccaucucaccgggcccg

SEQ ID NO: 3216865 - RNA, 17 nt, Mycobacterium bovis subsp bovis AF2122/97
cgaccaucugaucgggc

SEQ ID NO: 3216866 - RNA, 21 nt, Mycobacterium bovis subsp bovis AF2122/97
cgaccaucugaucgggcccgu

SEQ ID NO: 3216867 - RNA, 13 nt, Mycobacterium bovis subsp bovis AF2122/97
cgaccaugagccg

SEQ ID NO: 3216868 - RNA, 15 nt, Mycobacterium bovis subsp bovis AF2122/97
cgaccaugagccggc

SEQ ID NO: 3216869 - RNA, 18 nt, Mycobacterium bovis subsp bovis AF2122/97
cgaccaugagccggcgcc

SEQ ID NO: 3216870 - RNA, 22 nt, Mycobacterium bovis subsp bovis AF2122/97
cgaccaugagccggcgccgccg

SEQ ID NO: 3216871 - RNA, 22 nt, Mycobacterium bovis subsp bovis AF2122/97
cgaccaugaugccuaccgggcc

SEQ ID NO: 3216872 - RNA, 16 nt, Mycobacterium bovis subsp bovis AF2122/97
cgaccaugccgaucgg

SEQ ID NO: 3216873 - RNA, 18 nt, Mycobacterium bovis subsp bovis AF2122/97
cgaccaugccgaucggcc

SEQ ID NO: 3216874 - RNA, 15 nt, Mycobacterium bovis subsp bovis AF2122/97
cgaccaugcuccuau

SEQ ID NO: 3216875 - RNA, 21 nt, Mycobacterium bovis subsp bovis AF2122/97
cgaccaugguagcgccccgau

SEQ ID NO: 3216876 - RNA, 20 nt, Mycobacterium bovis subsp bovis AF2122/97
cgaccauucgagagccucua

SEQ ID NO: 3216877 - RNA, 16 nt, Mycobacterium bovis subsp bovis AF2122/97
cgacccaacgaccacc

SEQ ID NO: 3216878 - RNA, 13 nt, Mycobacterium bovis subsp bovis AF2122/97
cgacccagcugac

SEQ ID NO: 3216879 - RNA, 17 nt, Mycobacterium bovis subsp bovis AF2122/97
cgacccagcugaccuga

SEQ ID NO: 3216880 - RNA, 13 nt, Mycobacterium bovis subsp bovis AF2122/97
cgacccaucacca

SEQ ID NO: 3216881 - RNA, 14 nt, Mycobacterium bovis subsp bovis AF2122/97
cgacccaucaccag

SEQ ID NO: 3216882 - RNA, 17 nt, Mycobacterium bovis subsp bovis AF2122/97
cgacccaucaccagcgg

SEQ ID NO: 3216883 - RNA, 15 nt, Mycobacterium bovis subsp bovis AF2122/97
cgaccccacacgccg

SEQ ID NO: 3216884 - RNA, 17 nt, Mycobacterium bovis subsp bovis AF2122/97
cgaccccaggcgcucau

SEQ ID NO: 3216885 - RNA, 21 nt, Mycobacterium bovis subsp bovis AF2122/97
cgacccccagcgcccgccggc

SEQ ID NO: 3216886 - RNA, 18 nt, Mycobacterium bovis subsp bovis AF2122/97
cgacccccgaucaggccg

SEQ ID NO: 3216887 - RNA, 21 nt, Mycobacterium bovis subsp bovis AF2122/97
cgacccccgaucaggccgacg

SEQ ID NO: 3216888 - RNA, 19 nt, Mycobacterium bovis subsp bovis AF2122/97
cgaccccgaacauccgccg

SEQ ID NO: 3216889 - RNA, 20 nt, Mycobacterium bovis subsp bovis AF2122/97
cgaccccgaacauccgccgc

SEQ ID NO: 3216890 - RNA, 19 nt, Mycobacterium bovis subsp bovis AF2122/97
cgaccccgaagaugaccuc

SEQ ID NO: 3216891 - RNA, 14 nt, Mycobacterium bovis subsp bovis AF2122/97
cgaccccgccgagc

SEQ ID NO: 3216892 - RNA, 17 nt, Mycobacterium bovis subsp bovis AF2122/97
cgaccccgccgagcggu

SEQ ID NO: 3216893 - RNA, 12 nt, Mycobacterium bovis subsp bovis AF2122/97
cgaccccgcgcu

SEQ ID NO: 3216894 - RNA, 14 nt, Mycobacterium bovis subsp bovis AF2122/97
cgaccccggaguug

SEQ ID NO: 3216895 - RNA, 13 nt, Mycobacterium bovis subsp bovis AF2122/97
cgaccccggcccc

SEQ ID NO: 3216896 - RNA, 23 nt, Mycobacterium bovis subsp bovis AF2122/97
cgaccccggccccgacggucaac

SEQ ID NO: 3216897 - RNA, 21 nt, Mycobacterium bovis subsp bovis AF2122/97
cgaccccggcgguaccgccgc

SEQ ID NO: 3216898 - RNA, 13 nt, Mycobacterium bovis subsp bovis AF2122/97
cgaccccggcugc

SEQ ID NO: 3216899 - RNA, 12 nt, Mycobacterium bovis subsp bovis AF2122/97
cgaccgccagcg

SEQ ID NO: 3216900 - RNA, 17 nt, Mycobacterium bovis subsp bovis AF2122/97
cgaccgccagcguggag

SEQ ID NO: 3216901 - RNA, 20 nt, Mycobacterium bovis subsp bovis AF2122/97
cgaccgccaucacgaccagg

SEQ ID NO: 3216902 - RNA, 11 nt, Mycobacterium bovis subsp bovis AF2122/97
cgaccgcccgc

SEQ ID NO: 3216903 - RNA, 13 nt, Mycobacterium bovis subsp bovis AF2122/97
cgaccgcccgcca

SEQ ID NO: 3216904 - RNA, 15 nt, Mycobacterium bovis subsp bovis AF2122/97
cgaccgcccgccaac

SEQ ID NO: 3216905 - RNA, 16 nt, Mycobacterium bovis subsp bovis AF2122/97
cgaccgcccgccagcg

SEQ ID NO: 3216906 - RNA, 17 nt, Mycobacterium bovis subsp bovis AF2122/97
cgaccgcccgccagcga

SEQ ID NO: 3216907 - RNA, 15 nt, Mycobacterium bovis subsp bovis AF2122/97
cgaccgccgcgagca

SEQ ID NO: 3216908 - RNA, 18 nt, Mycobacterium bovis subsp bovis AF2122/97
cgaccgccgcgagcagaa

SEQ ID NO: 3216909 - RNA, 21 nt, Mycobacterium bovis subsp bovis AF2122/97
cgaccgccgcuaccccagccg

SEQ ID NO: 3216910 - RNA, 16 nt, Mycobacterium bovis subsp bovis AF2122/97
cgaccgccggaccgcc

SEQ ID NO: 3216911 - RNA, 19 nt, Mycobacterium bovis subsp bovis AF2122/97
cgaccgccggaccgccgca

SEQ ID NO: 3216912 - RNA, 13 nt, Mycobacterium bovis subsp bovis AF2122/97
cgaccgccguggc

SEQ ID NO: 3216913 - RNA, 15 nt, Mycobacterium bovis subsp bovis AF2122/97
cgaccgccguggccc

SEQ ID NO: 3216914 - RNA, 20 nt, Mycobacterium bovis subsp bovis AF2122/97
cgaccgccguggcccgcucg

SEQ ID NO: 3216915 - RNA, 17 nt, Mycobacterium bovis subsp bovis AF2122/97
cgaccgccguggccgca

SEQ ID NO: 3216916 - RNA, 16 nt, Mycobacterium bovis subsp bovis AF2122/97
cgaccgccugcgcggc

SEQ ID NO: 3216917 - RNA, 14 nt, Mycobacterium bovis subsp bovis AF2122/97
cgaccgcgacccgg

SEQ ID NO: 3216918 - RNA, 15 nt, Mycobacterium bovis subsp bovis AF2122/97
cgaccgcgacggcaa

SEQ ID NO: 3216919 - RNA, 16 nt, Mycobacterium bovis subsp bovis AF2122/97
cgaccgcgagcaucug

SEQ ID NO: 3216920 - RNA, 14 nt, Mycobacterium bovis subsp bovis AF2122/97
cgaccgcgauggug

SEQ ID NO: 3216921 - RNA, 22 nt, Mycobacterium bovis subsp bovis AF2122/97
cgaccgcgcaacaccucgucgg

SEQ ID NO: 3216922 - RNA, 12 nt, Mycobacterium bovis subsp bovis AF2122/97
cgaccgcgccaa

SEQ ID NO: 3216923 - RNA, 13 nt, Mycobacterium bovis subsp bovis AF2122/97
cgaccgcgccaac

SEQ ID NO: 3216924 - RNA, 14 nt, Mycobacterium bovis subsp bovis AF2122/97
cgaccgcgccaaca

SEQ ID NO: 3216925 - RNA, 17 nt, Mycobacterium bovis subsp bovis AF2122/97
cgaccgcgcccgcgggc

SEQ ID NO: 3216926 - RNA, 14 nt, Mycobacterium bovis subsp bovis AF2122/97
cgaccgcgccgcau

SEQ ID NO: 3216927 - RNA, 22 nt, Mycobacterium bovis subsp bovis AF2122/97
cgaccgcgcucaccggggccgu

SEQ ID NO: 3216928 - RNA, 13 nt, Mycobacterium bovis subsp bovis AF2122/97
cgaccgcggcccc

SEQ ID NO: 3216929 - RNA, 20 nt, Mycobacterium bovis subsp bovis AF2122/97
cgaccgcggccccgccguug

SEQ ID NO: 3216930 - RNA, 14 nt, Mycobacterium bovis subsp bovis AF2122/97
cgaccgcggccggg

SEQ ID NO: 3216931 - RNA, 15 nt, Mycobacterium bovis subsp bovis AF2122/97
cgaccgcggccuugg

SEQ ID NO: 3216932 - RNA, 19 nt, Mycobacterium bovis subsp bovis AF2122/97
cgaccgcgggccgacgcag

SEQ ID NO: 3216933 - RNA, 21 nt, Mycobacterium bovis subsp bovis AF2122/97
cgaccgcguacaggccggcca

SEQ ID NO: 3216934 - RNA, 19 nt, Mycobacterium bovis subsp bovis AF2122/97
cgaccgcguuguccgcggc

SEQ ID NO: 3216935 - RNA, 23 nt, Mycobacterium bovis subsp bovis AF2122/97
cgaccgcuaacagauuguccggc

SEQ ID NO: 3216936 - RNA, 17 nt, Mycobacterium bovis subsp bovis AF2122/97
cgaccgcuaugaugccg

SEQ ID NO: 3216937 - RNA, 14 nt, Mycobacterium bovis subsp bovis AF2122/97
cgaccgcucccggu

SEQ ID NO: 3216938 - RNA, 20 nt, Mycobacterium bovis subsp bovis AF2122/97
cgaccggaacguuccugcac

SEQ ID NO: 3216939 - RNA, 19 nt, Mycobacterium bovis subsp bovis AF2122/97
cgaccggacacuccugcac

SEQ ID NO: 3216940 - RNA, 21 nt, Mycobacterium bovis subsp bovis AF2122/97
cgaccggacacuccugcacac

SEQ ID NO: 3216941 - RNA, 15 nt, Mycobacterium bovis subsp bovis AF2122/97
cgaccggaccggggg

SEQ ID NO: 3216942 - RNA, 19 nt, Mycobacterium bovis subsp bovis AF2122/97
cgaccggacgagcgucaga

SEQ ID NO: 3216943 - RNA, 16 nt, Mycobacterium bovis subsp bovis AF2122/97
cgaccggcacccgcgg

SEQ ID NO: 3216944 - RNA, 17 nt, Mycobacterium bovis subsp bovis AF2122/97
cgaccggcacccgcggc

SEQ ID NO: 3216945 - RNA, 18 nt, Mycobacterium bovis subsp bovis AF2122/97
cgaccggcacccgcggcg

SEQ ID NO: 3216946 - RNA, 21 nt, Mycobacterium bovis subsp bovis AF2122/97
cgaccggcacccgcggcgaac

SEQ ID NO: 3216947 - RNA, 20 nt, Mycobacterium bovis subsp bovis AF2122/97
cgaccggcagcgaugcggug

SEQ ID NO: 3216948 - RNA, 22 nt, Mycobacterium bovis subsp bovis AF2122/97
cgaccggcagcgaugcgguguc

SEQ ID NO: 3216949 - RNA, 19 nt, Mycobacterium bovis subsp bovis AF2122/97
cgaccggccacgaccucgg

SEQ ID NO: 3216950 - RNA, 18 nt, Mycobacterium bovis subsp bovis AF2122/97
cgaccggcccccggucga

SEQ ID NO: 3216951 - RNA, 16 nt, Mycobacterium bovis subsp bovis AF2122/97
cgaccggccggccgcg

SEQ ID NO: 3216952 - RNA, 17 nt, Mycobacterium bovis subsp bovis AF2122/97
cgaccggcgagcccgca

SEQ ID NO: 3216953 - RNA, 20 nt, Mycobacterium bovis subsp bovis AF2122/97
cgaccggcgggaugcgcgcc

SEQ ID NO: 3216954 - RNA, 17 nt, Mycobacterium bovis subsp bovis AF2122/97
cgaccggcguaaccggc

SEQ ID NO: 3216955 - RNA, 18 nt, Mycobacterium bovis subsp bovis AF2122/97
cgaccggcguaaccggca

SEQ ID NO: 3216956 - RNA, 15 nt, Mycobacterium bovis subsp bovis AF2122/97
cgaccggcuaccggc

SEQ ID NO: 3216957 - RNA, 16 nt, Mycobacterium bovis subsp bovis AF2122/97
cgaccggcuaccggcg

SEQ ID NO: 3216958 - RNA, 18 nt, Mycobacterium bovis subsp bovis AF2122/97
cgaccggcuugcccuccg

SEQ ID NO: 3216959 - RNA, 20 nt, Mycobacterium bovis subsp bovis AF2122/97
cgaccggcuugcccuccggg

SEQ ID NO: 3216960 - RNA, 21 nt, Mycobacterium bovis subsp bovis AF2122/97
cgaccgggaaccacggucagc

SEQ ID NO: 3216961 - RNA, 22 nt, Mycobacterium bovis subsp bovis AF2122/97
cgaccgggaucggcuccgccgc

SEQ ID NO: 3216962 - RNA, 24 nt, Mycobacterium bovis subsp bovis AF2122/97
cgaccgggaucggcuccgccgcgg

SEQ ID NO: 3216963 - RNA, 17 nt, Mycobacterium bovis subsp bovis AF2122/97
cgaccgggcccccaggu

SEQ ID NO: 3216964 - RNA, 18 nt, Mycobacterium bovis subsp bovis AF2122/97
cgaccgggcucuggccag

SEQ ID NO: 3216965 - RNA, 19 nt, Mycobacterium bovis subsp bovis AF2122/97
cgaccgggcucuggccagu

SEQ ID NO: 3216966 - RNA, 22 nt, Mycobacterium bovis subsp bovis AF2122/97
cgaccgggcucuggccaguccg

SEQ ID NO: 3216967 - RNA, 22 nt, Mycobacterium bovis subsp bovis AF2122/97
cgaccggguccggcguacgccg

SEQ ID NO: 3216968 - RNA, 20 nt, Mycobacterium bovis subsp bovis AF2122/97
cgaccgggucgcaaccgccg

SEQ ID NO: 3216969 - RNA, 21 nt, Mycobacterium bovis subsp bovis AF2122/97
cgaccgggucgcaaccgccgc

SEQ ID NO: 3216970 - RNA, 20 nt, Mycobacterium bovis subsp bovis AF2122/97
cgaccgguaauccguugccg

SEQ ID NO: 3216971 - RNA, 17 nt, Mycobacterium bovis subsp bovis AF2122/97
cgaccgguacccguagc

SEQ ID NO: 3216972 - RNA, 15 nt, Mycobacterium bovis subsp bovis AF2122/97
cgaccgguccagcca

SEQ ID NO: 3216973 - RNA, 18 nt, Mycobacterium bovis subsp bovis AF2122/97
cgaccgguccagccaacg

SEQ ID NO: 3216974 - RNA, 14 nt, Mycobacterium bovis subsp bovis AF2122/97
cgaccggucgguga

SEQ ID NO: 3216975 - RNA, 23 nt, Mycobacterium bovis subsp bovis AF2122/97
cgaccggugauguagagcucacc

SEQ ID NO: 3216976 - RNA, 19 nt, Mycobacterium bovis subsp bovis AF2122/97
cgaccgguggcaccggcgg

SEQ ID NO: 3216977 - RNA, 21 nt, Mycobacterium bovis subsp bovis AF2122/97
cgaccgguggcaccggcggcg

SEQ ID NO: 3216978 - RNA, 22 nt, Mycobacterium bovis subsp bovis AF2122/97
cgaccgguggcaccggcggcga

SEQ ID NO: 3216979 - RNA, 19 nt, Mycobacterium bovis subsp bovis AF2122/97
cgaccgguucggcguacaa

SEQ ID NO: 3216980 - RNA, 16 nt, Mycobacterium bovis subsp bovis AF2122/97
cgaccguauugaccag

SEQ ID NO: 3216981 - RNA, 19 nt, Mycobacterium bovis subsp bovis AF2122/97
cgaccguauugaccagcgg

SEQ ID NO: 3216982 - RNA, 13 nt, Mycobacterium bovis subsp bovis AF2122/97
cgaccgucaaccu

SEQ ID NO: 3216983 - RNA, 21 nt, Mycobacterium bovis subsp bovis AF2122/97
cgaccgucacgcguacgucgg

SEQ ID NO: 3216984 - RNA, 21 nt, Mycobacterium bovis subsp bovis AF2122/97
cgaccgucagggucaccugcg

SEQ ID NO: 3216985 - RNA, 16 nt, Mycobacterium bovis subsp bovis AF2122/97
cgacgaacagcggugg

SEQ ID NO: 3216986 - RNA, 15 nt, Mycobacterium bovis subsp bovis AF2122/97
cgacgaaccccauca

SEQ ID NO: 3216987 - RNA, 14 nt, Mycobacterium bovis subsp bovis AF2122/97
cgacgaacccgaca

SEQ ID NO: 3216988 - RNA, 15 nt, Mycobacterium bovis subsp bovis AF2122/97
cgacgaaccggauca

SEQ ID NO: 3216989 - RNA, 19 nt, Mycobacterium bovis subsp bovis AF2122/97
cgacgaacgaaccgccgcc

SEQ ID NO: 3216990 - RNA, 20 nt, Mycobacterium bovis subsp bovis AF2122/97
cgacgaacgaaccgccgccg

SEQ ID NO: 3216991 - RNA, 14 nt, Mycobacterium bovis subsp bovis AF2122/97
cgacgaacgccguc

SEQ ID NO: 3216992 - RNA, 18 nt, Mycobacterium bovis subsp bovis AF2122/97
cgacgaacgccucaccga

SEQ ID NO: 3216993 - RNA, 16 nt, Mycobacterium bovis subsp bovis AF2122/97
cgacgaacuccgcguu

SEQ ID NO: 3216994 - RNA, 23 nt, Mycobacterium bovis subsp bovis AF2122/97
cgacgaagaagaacucggcgucg

SEQ ID NO: 3216995 - RNA, 19 nt, Mycobacterium bovis subsp bovis AF2122/97
cgacgaagaucgcgugcca

SEQ ID NO: 3216996 - RNA, 23 nt, Mycobacterium bovis subsp bovis AF2122/97
cgacgaagaucgcgugccacagc

SEQ ID NO: 3216997 - RNA, 23 nt, Mycobacterium bovis subsp bovis AF2122/97
cgacgaagaucgcugcgaagccg

SEQ ID NO: 3216998 - RNA, 21 nt, Mycobacterium bovis subsp bovis AF2122/97
cgacgaagaucuucaccggcc

SEQ ID NO: 3216999 - RNA, 23 nt, Mycobacterium bovis subsp bovis AF2122/97
cgacgaagaucuucaccggccgg

SEQ ID NO: 3217000 - RNA, 22 nt, Mycobacterium bovis subsp bovis AF2122/97
cgacgaaguucuccagcucgaa

SEQ ID NO: 3217001 - RNA, 17 nt, Mycobacterium bovis subsp bovis AF2122/97
cgacgaauaacgcgguc

SEQ ID NO: 3217002 - RNA, 16 nt, Mycobacterium bovis subsp bovis AF2122/97
cgacgaauaccgggau

SEQ ID NO: 3217003 - RNA, 14 nt, Mycobacterium bovis subsp bovis AF2122/97
cgacgaauccccga

SEQ ID NO: 3217004 - RNA, 20 nt, Mycobacterium bovis subsp bovis AF2122/97
cgacgaauguccgcagacga

SEQ ID NO: 3217005 - RNA, 16 nt, Mycobacterium bovis subsp bovis AF2122/97
cgacgacaacagccag

SEQ ID NO: 3217006 - RNA, 18 nt, Mycobacterium bovis subsp bovis AF2122/97
cgacgacaacagccagcu

SEQ ID NO: 3217007 - RNA, 13 nt, Mycobacterium bovis subsp bovis AF2122/97
cgacgacaaccgg

SEQ ID NO: 3217008 - RNA, 18 nt, Mycobacterium bovis subsp bovis AF2122/97
cgacgacaaccggccaga

SEQ ID NO: 3217009 - RNA, 18 nt, Mycobacterium bovis subsp bovis AF2122/97
cgacgacaagugcccggc

SEQ ID NO: 3217010 - RNA, 16 nt, Mycobacterium bovis subsp bovis AF2122/97
cgacgacaccagagcg

SEQ ID NO: 3217011 - RNA, 18 nt, Mycobacterium bovis subsp bovis AF2122/97
cgacgacacguugacgau

SEQ ID NO: 3217012 - RNA, 23 nt, Mycobacterium bovis subsp bovis AF2122/97
cgacgacauacgagcagugaccg

SEQ ID NO: 3217013 - RNA, 15 nt, Mycobacterium bovis subsp bovis AF2122/97
cgacgacaucgagcc

SEQ ID NO: 3217014 - RNA, 16 nt, Mycobacterium bovis subsp bovis AF2122/97
cgacgacaucgguggc

SEQ ID NO: 3217015 - RNA, 17 nt, Mycobacterium bovis subsp bovis AF2122/97
cgacgacaucgguggcc

SEQ ID NO: 3217016 - RNA, 23 nt, Mycobacterium bovis subsp bovis AF2122/97
cgacgacaucgguggcccggugc

SEQ ID NO: 3217017 - RNA, 13 nt, Mycobacterium bovis subsp bovis AF2122/97
cgacgacaucugc

SEQ ID NO: 3217018 - RNA, 18 nt, Mycobacterium bovis subsp bovis AF2122/97
cgacgacaucugcccagc

SEQ ID NO: 3217019 - RNA, 13 nt, Mycobacterium bovis subsp bovis AF2122/97
cgacgacauuggu

SEQ ID NO: 3217020 - RNA, 20 nt, Mycobacterium bovis subsp bovis AF2122/97
cgacgacauuggugcugaca

SEQ ID NO: 3217021 - RNA, 14 nt, Mycobacterium bovis subsp bovis AF2122/97
cgacgaccacacca

SEQ ID NO: 3217022 - RNA, 12 nt, Mycobacterium bovis subsp bovis AF2122/97
cgacgaccaccu

SEQ ID NO: 3217023 - RNA, 23 nt, Mycobacterium bovis subsp bovis AF2122/97
cgacgaccaccuucugacgcggc

SEQ ID NO: 3217024 - RNA, 14 nt, Mycobacterium bovis subsp bovis AF2122/97
cgacgaccagcaga

SEQ ID NO: 3217025 - RNA, 16 nt, Mycobacterium bovis subsp bovis AF2122/97
cgacgacccgacguag

SEQ ID NO: 3217026 - RNA, 16 nt, Mycobacterium bovis subsp bovis AF2122/97
cgacgacccgggucgg

SEQ ID NO: 3217027 - RNA, 21 nt, Mycobacterium bovis subsp bovis AF2122/97
cgacgacccgggucggcacga

SEQ ID NO: 3217028 - RNA, 23 nt, Mycobacterium bovis subsp bovis AF2122/97
cgacgacccgggucggcacgacc

SEQ ID NO: 3217029 - RNA, 22 nt, Mycobacterium bovis subsp bovis AF2122/97
cgacgacgccaaugccgcggag

SEQ ID NO: 3217030 - RNA, 12 nt, Mycobacterium bovis subsp bovis AF2122/97
cgacgacgcccu

SEQ ID NO: 3217031 - RNA, 13 nt, Mycobacterium bovis subsp bovis AF2122/97
cgacgacggcacc

SEQ ID NO: 3217032 - RNA, 12 nt, Mycobacterium bovis subsp bovis AF2122/97
cgacgacggcga

SEQ ID NO: 3217033 - RNA, 19 nt, Mycobacterium bovis subsp bovis AF2122/97
cgacgacggcgacggcgcc

SEQ ID NO: 3217034 - RNA, 23 nt, Mycobacterium bovis subsp bovis AF2122/97
cgacgacguccucgacgaucagc

SEQ ID NO: 3217035 - RNA, 16 nt, Mycobacterium bovis subsp bovis AF2122/97
cgacgacuccuauugc

SEQ ID NO: 3217036 - RNA, 11 nt, Mycobacterium bovis subsp bovis AF2122/97
cgacgacugga

SEQ ID NO: 3217037 - RNA, 17 nt, Mycobacterium bovis subsp bovis AF2122/97
cgacgagacgaaccgcc

SEQ ID NO: 3217038 - RNA, 18 nt, Mycobacterium bovis subsp bovis AF2122/97
cgacgagauacggccacc

SEQ ID NO: 3217039 - RNA, 20 nt, Mycobacterium bovis subsp bovis AF2122/97
cgacgagauagcauccgccc

SEQ ID NO: 3217040 - RNA, 14 nt, Mycobacterium bovis subsp bovis AF2122/97
cgacgagauccagc

SEQ ID NO: 3217041 - RNA, 16 nt, Mycobacterium bovis subsp bovis AF2122/97
cgacgagauccagcgc

SEQ ID NO: 3217042 - RNA, 17 nt, Mycobacterium bovis subsp bovis AF2122/97
cgacgagauugccgggc

SEQ ID NO: 3217043 - RNA, 19 nt, Mycobacterium bovis subsp bovis AF2122/97
cgacgagauugccgggccg

SEQ ID NO: 3217044 - RNA, 22 nt, Mycobacterium bovis subsp bovis AF2122/97
cgacgagauugccgggccgccg

SEQ ID NO: 3217045 - RNA, 22 nt, Mycobacterium bovis subsp bovis AF2122/97
cgacgagcaacgccacccgaau

SEQ ID NO: 3217046 - RNA, 13 nt, Mycobacterium bovis subsp bovis AF2122/97
cgacgagcaccau

SEQ ID NO: 3217047 - RNA, 15 nt, Mycobacterium bovis subsp bovis AF2122/97
cgacgagcaccgcgc

SEQ ID NO: 3217048 - RNA, 16 nt, Mycobacterium bovis subsp bovis AF2122/97
cgacgagcaccgcgcc

SEQ ID NO: 3217049 - RNA, 17 nt, Mycobacterium bovis subsp bovis AF2122/97
cgacgagcaccgcgccg

SEQ ID NO: 3217050 - RNA, 18 nt, Mycobacterium bovis subsp bovis AF2122/97
cgacgagcaccgcgccgc

SEQ ID NO: 3217051 - RNA, 13 nt, Mycobacterium bovis subsp bovis AF2122/97
cgacgagcagcaa

SEQ ID NO: 3217052 - RNA, 20 nt, Mycobacterium bovis subsp bovis AF2122/97
cgacgagcaucuucgcgcag

SEQ ID NO: 3217053 - RNA, 14 nt, Mycobacterium bovis subsp bovis AF2122/97
cgacgagcccaccg

SEQ ID NO: 3217054 - RNA, 17 nt, Mycobacterium bovis subsp bovis AF2122/97
cgacgagcccaccgucg

SEQ ID NO: 3217055 - RNA, 24 nt, Mycobacterium bovis subsp bovis AF2122/97
cgacgagccgcaaaaucgaugacg

SEQ ID NO: 3217056 - RNA, 15 nt, Mycobacterium bovis subsp bovis AF2122/97
cgacgagccgcgguc

SEQ ID NO: 3217057 - RNA, 18 nt, Mycobacterium bovis subsp bovis AF2122/97
cgacgagccgcggucggc

SEQ ID NO: 3217058 - RNA, 12 nt, Mycobacterium bovis subsp bovis AF2122/97
cgacgagcgcag

SEQ ID NO: 3217059 - RNA, 15 nt, Mycobacterium bovis subsp bovis AF2122/97
cgacgagcgccucaa

SEQ ID NO: 3217060 - RNA, 17 nt, Mycobacterium bovis subsp bovis AF2122/97
cgacgagcggccguggc

SEQ ID NO: 3217061 - RNA, 17 nt, Mycobacterium bovis subsp bovis AF2122/97
cgacgaggacgucaccg

SEQ ID NO: 3217062 - RNA, 15 nt, Mycobacterium bovis subsp bovis AF2122/97
cgacgagggccagca

SEQ ID NO: 3217063 - RNA, 20 nt, Mycobacterium bovis subsp bovis AF2122/97
cgacgagggccagcagccgc

SEQ ID NO: 3217064 - RNA, 21 nt, Mycobacterium bovis subsp bovis AF2122/97
cgacgagggcgggacccguga

SEQ ID NO: 3217065 - RNA, 17 nt, Mycobacterium bovis subsp bovis AF2122/97
cgacgaggggcgcgggu

SEQ ID NO: 3217066 - RNA, 18 nt, Mycobacterium bovis subsp bovis AF2122/97
cgacgaggggcgcgggug

SEQ ID NO: 3217067 - RNA, 14 nt, Mycobacterium bovis subsp bovis AF2122/97
cgacgagucgccgc

SEQ ID NO: 3217068 - RNA, 14 nt, Mycobacterium bovis subsp bovis AF2122/97
cgacgagucggcgg

SEQ ID NO: 3217069 - RNA, 17 nt, Mycobacterium bovis subsp bovis AF2122/97
cgacgagucggcgggcg

SEQ ID NO: 3217070 - RNA, 16 nt, Mycobacterium bovis subsp bovis AF2122/97
cgacgagugguccggc

SEQ ID NO: 3217071 - RNA, 22 nt, Mycobacterium bovis subsp bovis AF2122/97
cgacgagugguccggcggccgg

SEQ ID NO: 3217072 - RNA, 21 nt, Mycobacterium bovis subsp bovis AF2122/97
cgacgccgacgaugacgcgcg

SEQ ID NO: 3217073 - RNA, 18 nt, Mycobacterium bovis subsp bovis AF2122/97
cgacgccgagaccgccgc

SEQ ID NO: 3217074 - RNA, 20 nt, Mycobacterium bovis subsp bovis AF2122/97
cgacgccgagaccgccgcug

SEQ ID NO: 3217075 - RNA, 13 nt, Mycobacterium bovis subsp bovis AF2122/97
cgacgccgaucgc

SEQ ID NO: 3217076 - RNA, 16 nt, Mycobacterium bovis subsp bovis AF2122/97
cgacgccgaucgcggc

SEQ ID NO: 3217077 - RNA, 18 nt, Mycobacterium bovis subsp bovis AF2122/97
cgacgccgaucgcggcgg

SEQ ID NO: 3217078 - RNA, 19 nt, Mycobacterium bovis subsp bovis AF2122/97
cgacgccgaucgcggcggc

SEQ ID NO: 3217079 - RNA, 16 nt, Mycobacterium bovis subsp bovis AF2122/97
cgacgccgcagcgucc

SEQ ID NO: 3217080 - RNA, 14 nt, Mycobacterium bovis subsp bovis AF2122/97
cgacgccgccaccc

SEQ ID NO: 3217081 - RNA, 15 nt, Mycobacterium bovis subsp bovis AF2122/97
cgacgccgccacccg

SEQ ID NO: 3217082 - RNA, 16 nt, Mycobacterium bovis subsp bovis AF2122/97
cgacgccgccacccgg

SEQ ID NO: 3217083 - RNA, 17 nt, Mycobacterium bovis subsp bovis AF2122/97
cgacgccgccacccggc

SEQ ID NO: 3217084 - RNA, 19 nt, Mycobacterium bovis subsp bovis AF2122/97
cgacgccgccacccggcgg

SEQ ID NO: 3217085 - RNA, 20 nt, Mycobacterium bovis subsp bovis AF2122/97
cgacgccgccagguccgccg

SEQ ID NO: 3217086 - RNA, 12 nt, Mycobacterium bovis subsp bovis AF2122/97
cgacgccgccgg

SEQ ID NO: 3217087 - RNA, 13 nt, Mycobacterium bovis subsp bovis AF2122/97
cgacgccgccggc

SEQ ID NO: 3217088 - RNA, 19 nt, Mycobacterium bovis subsp bovis AF2122/97
cgacgccgccggcaccgua

SEQ ID NO: 3217089 - RNA, 22 nt, Mycobacterium bovis subsp bovis AF2122/97
cgacgccgccggccccgccgau

SEQ ID NO: 3217090 - RNA, 16 nt, Mycobacterium bovis subsp bovis AF2122/97
cgacgccgccggcgcc

SEQ ID NO: 3217091 - RNA, 16 nt, Mycobacterium bovis subsp bovis AF2122/97
cgacgccgcgcagccg

SEQ ID NO: 3217092 - RNA, 17 nt, Mycobacterium bovis subsp bovis AF2122/97
cgacgccgcgcagccgg

SEQ ID NO: 3217093 - RNA, 12 nt, Mycobacterium bovis subsp bovis AF2122/97
cgacgccgcggu

SEQ ID NO: 3217094 - RNA, 13 nt, Mycobacterium bovis subsp bovis AF2122/97
cgacgccgcgguu

SEQ ID NO: 3217095 - RNA, 17 nt, Mycobacterium bovis subsp bovis AF2122/97
cgacgccgcgguuuucg

SEQ ID NO: 3217096 - RNA, 15 nt, Mycobacterium bovis subsp bovis AF2122/97
cgacgccgcuggaga

SEQ ID NO: 3217097 - RNA, 17 nt, Mycobacterium bovis subsp bovis AF2122/97
cgacgccggccagcggc

SEQ ID NO: 3217098 - RNA, 15 nt, Mycobacterium bovis subsp bovis AF2122/97
cgacgccggccuggc

SEQ ID NO: 3217099 - RNA, 18 nt, Mycobacterium bovis subsp bovis AF2122/97
cgacgccggccuggccgc

SEQ ID NO: 3217100 - RNA, 14 nt, Mycobacterium bovis subsp bovis AF2122/97
cgacgccggccuug

SEQ ID NO: 3217101 - RNA, 14 nt, Mycobacterium bovis subsp bovis AF2122/97
cgacgccggugccg

SEQ ID NO: 3217102 - RNA, 12 nt, Mycobacterium bovis subsp bovis AF2122/97
cgacgccgucgg

SEQ ID NO: 3217103 - RNA, 16 nt, Mycobacterium bovis subsp bovis AF2122/97
cgacgccuuccagccc

SEQ ID NO: 3217104 - RNA, 15 nt, Mycobacterium bovis subsp bovis AF2122/97
cgacgcgaacgcggc

SEQ ID NO: 3217105 - RNA, 18 nt, Mycobacterium bovis subsp bovis AF2122/97
cgacgcgacacacgccgc

SEQ ID NO: 3217106 - RNA, 22 nt, Mycobacterium bovis subsp bovis AF2122/97
cgacgcgacacacgccgccggu

SEQ ID NO: 3217107 - RNA, 15 nt, Mycobacterium bovis subsp bovis AF2122/97
cgacgcgacacgccg

SEQ ID NO: 3217108 - RNA, 17 nt, Mycobacterium bovis subsp bovis AF2122/97
cgacgcgacacgccggc

SEQ ID NO: 3217109 - RNA, 14 nt, Mycobacterium bovis subsp bovis AF2122/97
cgacgcgaccgcga

SEQ ID NO: 3217110 - RNA, 16 nt, Mycobacterium bovis subsp bovis AF2122/97
cgacgcgaccgcgaug

SEQ ID NO: 3217111 - RNA, 13 nt, Mycobacterium bovis subsp bovis AF2122/97
cgacgcgaucugu

SEQ ID NO: 3217112 - RNA, 16 nt, Mycobacterium bovis subsp bovis AF2122/97
cgacgcgcaucgcacg

SEQ ID NO: 3217113 - RNA, 20 nt, Mycobacterium bovis subsp bovis AF2122/97
cgacgcgcauucgccgggcg

SEQ ID NO: 3217114 - RNA, 21 nt, Mycobacterium bovis subsp bovis AF2122/97
cgacgcgcauucgccgggcgg

SEQ ID NO: 3217115 - RNA, 18 nt, Mycobacterium bovis subsp bovis AF2122/97
cgacgcgcccgcgcgcuc

SEQ ID NO: 3217116 - RNA, 19 nt, Mycobacterium bovis subsp bovis AF2122/97
cgacgcgcccgcgcgcucc

SEQ ID NO: 3217117 - RNA, 21 nt, Mycobacterium bovis subsp bovis AF2122/97
cgacgcgcgagaacacccgug

SEQ ID NO: 3217118 - RNA, 22 nt, Mycobacterium bovis subsp bovis AF2122/97
cgacgcgcgcuugggguugggc

SEQ ID NO: 3217119 - RNA, 16 nt, Mycobacterium bovis subsp bovis AF2122/97
cgacgcgcucggcgau

SEQ ID NO: 3217120 - RNA, 20 nt, Mycobacterium bovis subsp bovis AF2122/97
cgacgcgcucggcgaucugc

SEQ ID NO: 3217121 - RNA, 16 nt, Mycobacterium bovis subsp bovis AF2122/97
cgacgcggcaggccgg

SEQ ID NO: 3217122 - RNA, 12 nt, Mycobacterium bovis subsp bovis AF2122/97
cgacgcggcgcc

SEQ ID NO: 3217123 - RNA, 14 nt, Mycobacterium bovis subsp bovis AF2122/97
cgacgcggcgucgg

SEQ ID NO: 3217124 - RNA, 20 nt, Mycobacterium bovis subsp bovis AF2122/97
cgacgcggcgucggucgggu

SEQ ID NO: 3217125 - RNA, 15 nt, Mycobacterium bovis subsp bovis AF2122/97
cgacgcgggccgcga

SEQ ID NO: 3217126 - RNA, 14 nt, Mycobacterium bovis subsp bovis AF2122/97
cgacgcgggcguug

SEQ ID NO: 3217127 - RNA, 23 nt, Mycobacterium bovis subsp bovis AF2122/97
cgacgcgggcguugacgaacacc

SEQ ID NO: 3217128 - RNA, 22 nt, Mycobacterium bovis subsp bovis AF2122/97
cgacgcggggcucaaccccguc

SEQ ID NO: 3217129 - RNA, 22 nt, Mycobacterium bovis subsp bovis AF2122/97
cgacgcggucaucgagcugacc

SEQ ID NO: 3217130 - RNA, 23 nt, Mycobacterium bovis subsp bovis AF2122/97
cgacgcggucggcggccgccagg

SEQ ID NO: 3217131 - RNA, 17 nt, Mycobacterium bovis subsp bovis AF2122/97
cgacgcgucgccggccg

SEQ ID NO: 3217132 - RNA, 15 nt, Mycobacterium bovis subsp bovis AF2122/97
cgacgcgucggcgac

SEQ ID NO: 3217133 - RNA, 17 nt, Mycobacterium bovis subsp bovis AF2122/97
cgacgcgucggcgacgc

SEQ ID NO: 3217134 - RNA, 16 nt, Mycobacterium bovis subsp bovis AF2122/97
cgacgcgucguggucg

SEQ ID NO: 3217135 - RNA, 15 nt, Mycobacterium bovis subsp bovis AF2122/97
cgacgcguggcaucc

SEQ ID NO: 3217136 - RNA, 21 nt, Mycobacterium bovis subsp bovis AF2122/97
cgacgcguucgagugcggucg

SEQ ID NO: 3217137 - RNA, 16 nt, Mycobacterium bovis subsp bovis AF2122/97
cgacgcuaaguccccg

SEQ ID NO: 3217138 - RNA, 17 nt, Mycobacterium bovis subsp bovis AF2122/97
cgacgcuaaguccccgc

SEQ ID NO: 3217139 - RNA, 17 nt, Mycobacterium bovis subsp bovis AF2122/97
cgacgcuaccgccggag

SEQ ID NO: 3217140 - RNA, 14 nt, Mycobacterium bovis subsp bovis AF2122/97
cgacgcucaucucg

SEQ ID NO: 3217141 - RNA, 15 nt, Mycobacterium bovis subsp bovis AF2122/97
cgacgcucgcugcag

SEQ ID NO: 3217142 - RNA, 17 nt, Mycobacterium bovis subsp bovis AF2122/97
cgacgcucgcugcagca

SEQ ID NO: 3217143 - RNA, 19 nt, Mycobacterium bovis subsp bovis AF2122/97
cgacgcugccgccaggcuc

SEQ ID NO: 3217144 - RNA, 14 nt, Mycobacterium bovis subsp bovis AF2122/97
cgacgcuggcggug

SEQ ID NO: 3217145 - RNA, 14 nt, Mycobacterium bovis subsp bovis AF2122/97
cgacgcuggucggc

SEQ ID NO: 3217146 - RNA, 16 nt, Mycobacterium bovis subsp bovis AF2122/97
cgacgcuggucggcgg

SEQ ID NO: 3217147 - RNA, 16 nt, Mycobacterium bovis subsp bovis AF2122/97
cgacgcuguggcucga

SEQ ID NO: 3217148 - RNA, 19 nt, Mycobacterium bovis subsp bovis AF2122/97
cgacgcuguggcucgacga

SEQ ID NO: 3217149 - RNA, 14 nt, Mycobacterium bovis subsp bovis AF2122/97
cgacgcuuucccga

SEQ ID NO: 3217150 - RNA, 15 nt, Mycobacterium bovis subsp bovis AF2122/97
cgacgcuuucccgau

SEQ ID NO: 3217151 - RNA, 17 nt, Mycobacterium bovis subsp bovis AF2122/97
cgacgcuuucccgauga

SEQ ID NO: 3217152 - RNA, 18 nt, Mycobacterium bovis subsp bovis AF2122/97
cgacggaaucgucggcgc

SEQ ID NO: 3217153 - RNA, 19 nt, Mycobacterium bovis subsp bovis AF2122/97
cgacggaaucgucggcgcg

SEQ ID NO: 3217154 - RNA, 19 nt, Mycobacterium bovis subsp bovis AF2122/97
cgacggacucccucgauca

SEQ ID NO: 3217155 - RNA, 21 nt, Mycobacterium bovis subsp bovis AF2122/97
cgacggacucccucgaucacg

SEQ ID NO: 3217156 - RNA, 22 nt, Mycobacterium bovis subsp bovis AF2122/97
cgacggacucccucgaucacgg

SEQ ID NO: 3217157 - RNA, 23 nt, Mycobacterium bovis subsp bovis AF2122/97
cgacggacuucccgcgcgagccg

SEQ ID NO: 3217158 - RNA, 16 nt, Mycobacterium bovis subsp bovis AF2122/97
cgacggaguucgacgu

SEQ ID NO: 3217159 - RNA, 15 nt, Mycobacterium bovis subsp bovis AF2122/97
cgacgggucggcgcc

SEQ ID NO: 3217160 - RNA, 17 nt, Mycobacterium bovis subsp bovis AF2122/97
cgacgggucggcgccga

SEQ ID NO: 3217161 - RNA, 18 nt, Mycobacterium bovis subsp bovis AF2122/97
cgacgggucggcgccgag

SEQ ID NO: 3217162 - RNA, 19 nt, Mycobacterium bovis subsp bovis AF2122/97
cgacgggucggcgccgagc

SEQ ID NO: 3217163 - RNA, 14 nt, Mycobacterium bovis subsp bovis AF2122/97
cgacggucaccggc

SEQ ID NO: 3217164 - RNA, 15 nt, Mycobacterium bovis subsp bovis AF2122/97
cgacggucaccggcg

SEQ ID NO: 3217165 - RNA, 16 nt, Mycobacterium bovis subsp bovis AF2122/97
cgacggucaccggcgc

SEQ ID NO: 3217166 - RNA, 19 nt, Mycobacterium bovis subsp bovis AF2122/97
cgacggucaccggcgcacc

SEQ ID NO: 3217167 - RNA, 17 nt, Mycobacterium bovis subsp bovis AF2122/97
cgacggucagguccugg

SEQ ID NO: 3217168 - RNA, 16 nt, Mycobacterium bovis subsp bovis AF2122/97
cgacggucccggcacg

SEQ ID NO: 3217169 - RNA, 17 nt, Mycobacterium bovis subsp bovis AF2122/97
cgacggucccggcacgu

SEQ ID NO: 3217170 - RNA, 20 nt, Mycobacterium bovis subsp bovis AF2122/97
cgacggucccggcacgucga

SEQ ID NO: 3217171 - RNA, 13 nt, Mycobacterium bovis subsp bovis AF2122/97
cgacggucggcgg

SEQ ID NO: 3217172 - RNA, 16 nt, Mycobacterium bovis subsp bovis AF2122/97
cgacggucuggcccgc

SEQ ID NO: 3217173 - RNA, 17 nt, Mycobacterium bovis subsp bovis AF2122/97
cgacggucuggcccgcg

SEQ ID NO: 3217174 - RNA, 16 nt, Mycobacterium bovis subsp bovis AF2122/97
cgacggugaaccacca

SEQ ID NO: 3217175 - RNA, 17 nt, Mycobacterium bovis subsp bovis AF2122/97
cgacggugaaccaccac

SEQ ID NO: 3217176 - RNA, 13 nt, Mycobacterium bovis subsp bovis AF2122/97
cgacggugaucag

SEQ ID NO: 3217177 - RNA, 18 nt, Mycobacterium bovis subsp bovis AF2122/97
cgacggugccaccgcgac

SEQ ID NO: 3217178 - RNA, 15 nt, Mycobacterium bovis subsp bovis AF2122/97
cgacggugcgcugga

SEQ ID NO: 3217179 - RNA, 22 nt, Mycobacterium bovis subsp bovis AF2122/97
cgacgguggcgccgucggccga

SEQ ID NO: 3217180 - RNA, 13 nt, Mycobacterium bovis subsp bovis AF2122/97
cgacggugggcga

SEQ ID NO: 3217181 - RNA, 17 nt, Mycobacterium bovis subsp bovis AF2122/97
cgacgguguagccgccg

SEQ ID NO: 3217182 - RNA, 20 nt, Mycobacterium bovis subsp bovis AF2122/97
cgacgguguagccgccggca

SEQ ID NO: 3217183 - RNA, 13 nt, Mycobacterium bovis subsp bovis AF2122/97
cgacgguguccgg

SEQ ID NO: 3217184 - RNA, 22 nt, Mycobacterium bovis subsp bovis AF2122/97
cgacgguuacccagccgugcuu

SEQ ID NO: 3217185 - RNA, 15 nt, Mycobacterium bovis subsp bovis AF2122/97
cgacgguuugcaccg

SEQ ID NO: 3217186 - RNA, 17 nt, Mycobacterium bovis subsp bovis AF2122/97
cgacguaaugcgcugcc

SEQ ID NO: 3217187 - RNA, 15 nt, Mycobacterium bovis subsp bovis AF2122/97
cgacguagauggugg

SEQ ID NO: 3217188 - RNA, 20 nt, Mycobacterium bovis subsp bovis AF2122/97
cgacguagcgaagugcgcgc

SEQ ID NO: 3217189 - RNA, 20 nt, Mycobacterium bovis subsp bovis AF2122/97
cgacguaguggaagccgacc

SEQ ID NO: 3217190 - RNA, 17 nt, Mycobacterium bovis subsp bovis AF2122/97
cgacguauuggcgcagc

SEQ ID NO: 3217191 - RNA, 18 nt, Mycobacterium bovis subsp bovis AF2122/97
cgacguauuggcgcagca

SEQ ID NO: 3217192 - RNA, 19 nt, Mycobacterium bovis subsp bovis AF2122/97
cgacguauuggcgcagcau

SEQ ID NO: 3217193 - RNA, 23 nt, Mycobacterium bovis subsp bovis AF2122/97
cgacguauuucgcccccuggaug

SEQ ID NO: 3217194 - RNA, 15 nt, Mycobacterium bovis subsp bovis AF2122/97
cgacgucagcaccau

SEQ ID NO: 3217195 - RNA, 16 nt, Mycobacterium bovis subsp bovis AF2122/97
cgacgucagcaccauc

SEQ ID NO: 3217196 - RNA, 17 nt, Mycobacterium leprae
aaaaaaaugaauguguu

SEQ ID NO: 3217197 - RNA, 20 nt, Mycobacterium leprae
aaaaacagcgugaauuacuc

SEQ ID NO: 3217198 - RNA, 15 nt, Mycobacterium leprae
aaaaacucauguucu

SEQ ID NO: 3217199 - RNA, 19 nt, Mycobacterium leprae
aaaaauccgcgcaacaccc

SEQ ID NO: 3217200 - RNA, 13 nt, Mycobacterium leprae
aaaaauugcgaua

SEQ ID NO: 3217201 - RNA, 18 nt, Mycobacterium leprae
aaaacacgggcaccagau

SEQ ID NO: 3217202 - RNA, 20 nt, Mycobacterium leprae
aaaacaugaacacgcuuaau

SEQ ID NO: 3217203 - RNA, 16 nt, Mycobacterium leprae
aaaaccacaaacucca

SEQ ID NO: 3217204 - RNA, 19 nt, Mycobacterium leprae
aaaacccacuucggcacag

SEQ ID NO: 3217205 - RNA, 15 nt, Mycobacterium leprae
aaaacucaugcaaga

SEQ ID NO: 3217206 - RNA, 11 nt, Mycobacterium leprae
aaaacugccgg

SEQ ID NO: 3217207 - RNA, 12 nt, Mycobacterium leprae
aaaacuuaauau

SEQ ID NO: 3217208 - RNA, 13 nt, Mycobacterium leprae
aaaagauauuaag

SEQ ID NO: 3217209 - RNA, 22 nt, Mycobacterium leprae
aaaagggaccgggcucuuucuu

SEQ ID NO: 3217210 - RNA, 19 nt, Mycobacterium leprae
aaaauagcugccaagcuga

SEQ ID NO: 3217211 - RNA, 18 nt, Mycobacterium leprae
aaaaucagacugcccaga

SEQ ID NO: 3217212 - RNA, 21 nt, Mycobacterium leprae
aaaaucagguauuuccuaaaa

SEQ ID NO: 3217213 - RNA, 16 nt, Mycobacterium leprae
aaaauccaagucuuuc

SEQ ID NO: 3217214 - RNA, 12 nt, Mycobacterium leprae
aaaauccuccca

SEQ ID NO: 3217215 - RNA, 23 nt, Mycobacterium leprae
aaaaucguccgcguaaccaacua

SEQ ID NO: 3217216 - RNA, 23 nt, Mycobacterium leprae
aaaaucucugugcgaaaacacuu

SEQ ID NO: 3217217 - RNA, 19 nt, Mycobacterium leprae
aaaaucugguuagcaacug

SEQ ID NO: 3217218 - RNA, 14 nt, Mycobacterium leprae
aaaaugcugcacug

SEQ ID NO: 3217219 - RNA, 15 nt, Mycobacterium leprae
aaaauguuuuguuua

SEQ ID NO: 3217220 - RNA, 21 nt, Mycobacterium leprae
aaaauguuuuguuuauguucg

SEQ ID NO: 3217221 - RNA, 21 nt, Mycobacterium leprae
aaaauuagucgaggccagaug

SEQ ID NO: 3217222 - RNA, 12 nt, Mycobacterium leprae
aaaauucaugcc

SEQ ID NO: 3217223 - RNA, 19 nt, Mycobacterium leprae
aaaauuuaaaaauuuguuc

SEQ ID NO: 3217224 - RNA, 13 nt, Mycobacterium leprae
aaaauuuguucug

SEQ ID NO: 3217225 - RNA, 21 nt, Mycobacterium leprae
aaaauuuucuugugaguuguc

SEQ ID NO: 3217226 - RNA, 13 nt, Mycobacterium leprae
aaacacagcaagc

SEQ ID NO: 3217227 - RNA, 14 nt, Mycobacterium leprae
aaacaccuaguugg

SEQ ID NO: 3217228 - RNA, 17 nt, Mycobacterium leprae
aaacagugccacaguca

SEQ ID NO: 3217229 - RNA, 14 nt, Mycobacterium leprae
aaaccaaacaacaa

SEQ ID NO: 3217230 - RNA, 15 nt, Mycobacterium leprae
aaaccaaacaacaac

SEQ ID NO: 3217231 - RNA, 11 nt, Mycobacterium leprae
aaaccaagcca

SEQ ID NO: 3217232 - RNA, 22 nt, Mycobacterium leprae
aaaccaucgucgacgaguucca

SEQ ID NO: 3217233 - RNA, 22 nt, Mycobacterium leprae
aaaccgaagaucaccgccacca

SEQ ID NO: 3217234 - RNA, 13 nt, Mycobacterium leprae
aaaccggccgcgg

SEQ ID NO: 3217235 - RNA, 19 nt, Mycobacterium leprae
aaaccucgagcuugcccuc

SEQ ID NO: 3217236 - RNA, 19 nt, Mycobacterium leprae
aaaccuguguaucagugcu

SEQ ID NO: 3217237 - RNA, 20 nt, Mycobacterium leprae
aaaccuguguaucagugcuc

SEQ ID NO: 3217238 - RNA, 13 nt, Mycobacterium leprae
aaaccuuccggcg

SEQ ID NO: 3217239 - RNA, 20 nt, Mycobacterium leprae
aaacgaccuggugacgucgu

SEQ ID NO: 3217240 - RNA, 22 nt, Mycobacterium leprae
aaacggccgggcaaaccacuua

SEQ ID NO: 3217241 - RNA, 23 nt, Mycobacterium leprae
aaacggccuugccgcuccgcgca

SEQ ID NO: 3217242 - RNA, 15 nt, Mycobacterium leprae
aaacgucgaucucga

SEQ ID NO: 3217243 - RNA, 19 nt, Mycobacterium leprae
aaacguugacugggaacau

SEQ ID NO: 3217244 - RNA, 16 nt, Mycobacterium leprae
aaacugguuagcgagg

SEQ ID NO: 3217245 - RNA, 14 nt, Mycobacterium leprae
aaacuuaauaucuu

SEQ ID NO: 3217246 - RNA, 16 nt, Mycobacterium leprae
aaacuucgacgagaca

SEQ ID NO: 3217247 - RNA, 17 nt, Mycobacterium leprae
aaagaaagcucacugug

SEQ ID NO: 3217248 - RNA, 20 nt, Mycobacterium leprae
aaagaacgcgaccuguuggu

SEQ ID NO: 3217249 - RNA, 23 nt, Mycobacterium leprae
aaagaaguuugucguacccaaua

SEQ ID NO: 3217250 - RNA, 19 nt, Mycobacterium leprae
aaagaauuuaccggcguuc

SEQ ID NO: 3217251 - RNA, 14 nt, Mycobacterium leprae
aaagacacgacagc

SEQ ID NO: 3217252 - RNA, 17 nt, Mycobacterium leprae
aaagacggcaugucaau

SEQ ID NO: 3217253 - RNA, 17 nt, Mycobacterium leprae
aaagacuucgaauauga

SEQ ID NO: 3217254 - RNA, 13 nt, Mycobacterium leprae
aaagauauuaagu

SEQ ID NO: 3217255 - RNA, 22 nt, Mycobacterium leprae
aaagauauuaaguuuucucuaa

SEQ ID NO: 3217256 - RNA, 19 nt, Mycobacterium leprae
aaagaucgggccauuugga

SEQ ID NO: 3217257 - RNA, 17 nt, Mycobacterium leprae
aaagcacacgaagccuc

SEQ ID NO: 3217258 - RNA, 23 nt, Mycobacterium leprae
aaagcagaauauugcgacaucca

SEQ ID NO: 3217259 - RNA, 13 nt, Mycobacterium leprae
aaagcccacgccu

SEQ ID NO: 3217260 - RNA, 15 nt, Mycobacterium leprae
aaagcgguuccuccc

SEQ ID NO: 3217261 - RNA, 20 nt, Mycobacterium leprae
aaagcucaggccguggacga

SEQ ID NO: 3217262 - RNA, 19 nt, Mycobacterium leprae
aaagcuggcgaacaacaaa

SEQ ID NO: 3217263 - RNA, 21 nt, Mycobacterium leprae
aaaggaguucaacaaaaccau

SEQ ID NO: 3217264 - RNA, 20 nt, Mycobacterium leprae
aaaggccaauccagccgagg

SEQ ID NO: 3217265 - RNA, 19 nt, Mycobacterium leprae
aaaggcuguccuugccggc

SEQ ID NO: 3217266 - RNA, 20 nt, Mycobacterium leprae
aaaggcuguccuugccggcg

SEQ ID NO: 3217267 - RNA, 20 nt, Mycobacterium leprae
aaagggaccgggcucuuucu

SEQ ID NO: 3217268 - RNA, 16 nt, Mycobacterium leprae
aaaggggccaacacgu

SEQ ID NO: 3217269 - RNA, 15 nt, Mycobacterium leprae
aaaggguagccgugg

SEQ ID NO: 3217270 - RNA, 14 nt, Mycobacterium leprae
aaaggguggcggug

SEQ ID NO: 3217271 - RNA, 17 nt, Mycobacterium leprae
aaagucgcgggcuugcu

SEQ ID NO: 3217272 - RNA, 18 nt, Mycobacterium leprae
aaauacgcgcgcucacag

SEQ ID NO: 3217273 - RNA, 16 nt, Mycobacterium leprae
aaauagcugccaagcu

SEQ ID NO: 3217274 - RNA, 21 nt, Mycobacterium leprae
aaaucacggagaucggcgugc

SEQ ID NO: 3217275 - RNA, 12 nt, Mycobacterium leprae
aaaucagacugc

SEQ ID NO: 3217276 - RNA, 17 nt, Mycobacterium leprae
aaaucaucgcugccauc

SEQ ID NO: 3217277 - RNA, 19 nt, Mycobacterium leprae
aaaucgacguuugcaggug

SEQ ID NO: 3217278 - RNA, 23 nt, Mycobacterium leprae
aaaucgagaauuuaccggcguuc

SEQ ID NO: 3217279 - RNA, 11 nt, Mycobacterium leprae
aaaucgccugu

SEQ ID NO: 3217280 - RNA, 21 nt, Mycobacterium leprae
aaaucggcaugaugugcucgg

SEQ ID NO: 3217281 - RNA, 16 nt, Mycobacterium leprae
aaaucguucgaccaga

SEQ ID NO: 3217282 - RNA, 19 nt, Mycobacterium leprae
aaaucguucgaccagauga

SEQ ID NO: 3217283 - RNA, 17 nt, Mycobacterium leprae
aaaucuucaauuuucca

SEQ ID NO: 3217284 - RNA, 22 nt, Mycobacterium leprae
aaauggcacugauacugaugug

SEQ ID NO: 3217285 - RNA, 13 nt, Mycobacterium leprae
aaauggcuguuuu

SEQ ID NO: 3217286 - RNA, 18 nt, Mycobacterium leprae
aaauggcuguuuuugcgu

SEQ ID NO: 3217287 - RNA, 13 nt, Mycobacterium leprae
aaauguucaacau

SEQ ID NO: 3217288 - RNA, 19 nt, Mycobacterium leprae
aaauguuuuguuuauguuc

SEQ ID NO: 3217289 - RNA, 15 nt, Mycobacterium leprae
aaauuagggauugac

SEQ ID NO: 3217290 - RNA, 18 nt, Mycobacterium leprae
aaauuccuacccucucag

SEQ ID NO: 3217291 - RNA, 20 nt, Mycobacterium leprae
aaauucucgcgccaccgccg

SEQ ID NO: 3217292 - RNA, 20 nt, Mycobacterium leprae
aaauuuguuuaucagccugu

SEQ ID NO: 3217293 - RNA, 20 nt, Mycobacterium leprae
aacaacagacacauuguuuu

SEQ ID NO: 3217294 - RNA, 16 nt, Mycobacterium leprae
aacaacgaccagcgcu

SEQ ID NO: 3217295 - RNA, 14 nt, Mycobacterium leprae
aacaagagaagagc

SEQ ID NO: 3217296 - RNA, 17 nt, Mycobacterium leprae
aacaauaaucccgcucu

SEQ ID NO: 3217297 - RNA, 21 nt, Mycobacterium leprae
aacaauccuguagcuguucgg

SEQ ID NO: 3217298 - RNA, 14 nt, Mycobacterium leprae
aacaccagaucagc

SEQ ID NO: 3217299 - RNA, 14 nt, Mycobacterium leprae
aacacgaucgcagc

SEQ ID NO: 3217300 - RNA, 17 nt, Mycobacterium leprae
aacacgaucgcagccca

SEQ ID NO: 3217301 - RNA, 23 nt, Mycobacterium leprae
aacacgugcugaggguggcgccg

SEQ ID NO: 3217302 - RNA, 18 nt, Mycobacterium leprae
aacugucgguaaugcaag

SEQ ID NO: 3217303 - RNA, 18 nt, Mycobacterium leprae
aacuguucggcuaugaga

SEQ ID NO: 3217304 - RNA, 22 nt, Mycobacterium leprae
aacuguucggcuaugagacgaa

SEQ ID NO: 3217305 - RNA, 15 nt, Mycobacterium leprae
aacuucaaccaagcc

SEQ ID NO: 3217306 - RNA, 21 nt, Mycobacterium leprae
aacuucagaagcacgacacua

SEQ ID NO: 3217307 - RNA, 22 nt, Mycobacterium leprae
aacuuccuaugucgugcugacc

SEQ ID NO: 3217308 - RNA, 22 nt, Mycobacterium leprae
aacuucuucagcuacagcggca

SEQ ID NO: 3217309 - RNA, 18 nt, Mycobacterium leprae
aacuugauuucaaggaau

SEQ ID NO: 3217310 - RNA, 12 nt, Mycobacterium leprae
aacuugcacuga

SEQ ID NO: 3217311 - RNA, 22 nt, Mycobacterium leprae
aacuuggcacaacaagagaaga

SEQ ID NO: 3217312 - RNA, 22 nt, Mycobacterium leprae
aacuugguccgacggcuggcug

SEQ ID NO: 3217313 - RNA, 15 nt, Mycobacterium leprae
aagaaacgacgcaua

SEQ ID NO: 3217314 - RNA, 16 nt, Mycobacterium leprae
aagaaguaaagcccug

SEQ ID NO: 3217315 - RNA, 19 nt, Mycobacterium leprae
aagaaucuugaaauucaau

SEQ ID NO: 3217316 - RNA, 17 nt, Mycobacterium leprae
aagacauaucaacaacu

SEQ ID NO: 3217317 - RNA, 20 nt, Mycobacterium leprae
aagacaucgguaucggcaua

SEQ ID NO: 3217318 - RNA, 21 nt, Mycobacterium leprae
aagacucagugaagaccaucu

SEQ ID NO: 3217319 - RNA, 21 nt, Mycobacterium leprae
aagagagagcacaugaaaacc

SEQ ID NO: 3217320 - RNA, 23 nt, Mycobacterium leprae
aagagcggcacgauaggcagugc

SEQ ID NO: 3217321 - RNA, 16 nt, Mycobacterium leprae
aagaggccgacagaac

SEQ ID NO: 3217322 - RNA, 15 nt, Mycobacterium leprae
aagauaaucgcccug

SEQ ID NO: 3217323 - RNA, 19 nt, Mycobacterium leprae
aagauacuggauucauugu

SEQ ID NO: 3217324 - RNA, 20 nt, Mycobacterium leprae
aagaugacaccgaacagcuc

SEQ ID NO: 3217325 - RNA, 17 nt, Mycobacterium leprae
aagaugacucggcgugc

SEQ ID NO: 3217326 - RNA, 18 nt, Mycobacterium leprae
aagaugacucggcgugcc

SEQ ID NO: 3217327 - RNA, 15 nt, Mycobacterium leprae
aagaugaucgucaua

SEQ ID NO: 3217328 - RNA, 12 nt, Mycobacterium leprae
aagauuccaaug

SEQ ID NO: 3217329 - RNA, 22 nt, Mycobacterium leprae
aagauugacaaaagugcaguga

SEQ ID NO: 3217330 - RNA, 14 nt, Mycobacterium leprae
aagauugcggacaa

SEQ ID NO: 3217331 - RNA, 18 nt, Mycobacterium leprae
aagcaaaaaauagcugcc

SEQ ID NO: 3217332 - RNA, 13 nt, Mycobacterium leprae
aagcaacugcagc

SEQ ID NO: 3217333 - RNA, 23 nt, Mycobacterium leprae
aagcacacgaagccucaucgaaa

SEQ ID NO: 3217334 - RNA, 18 nt, Mycobacterium leprae
aagcacgaugacauaccg

SEQ ID NO: 3217335 - RNA, 19 nt, Mycobacterium leprae
aagcagaauuggagugaag

SEQ ID NO: 3217336 - RNA, 21 nt, Mycobacterium leprae
aagcagcaccacagcgccaac

SEQ ID NO: 3217337 - RNA, 20 nt, Mycobacterium leprae
aagcagcauccaccaccgac

SEQ ID NO: 3217338 - RNA, 13 nt, Mycobacterium leprae
aagcagccggggu

SEQ ID NO: 3217339 - RNA, 22 nt, Mycobacterium leprae
aagcagugucugggccgggcug

SEQ ID NO: 3217340 - RNA, 19 nt, Mycobacterium leprae
aagcaucuuaacgccaguu

SEQ ID NO: 3217341 - RNA, 22 nt, Mycobacterium leprae
aagcaucuuaacgccaguugca

SEQ ID NO: 3217342 - RNA, 23 nt, Mycobacterium leprae
aagccauugcucgguauuugcgg

SEQ ID NO: 3217343 - RNA, 20 nt, Mycobacterium leprae
aagcccacgccuagcuagcc

SEQ ID NO: 3217344 - RNA, 12 nt, Mycobacterium leprae
aagccgccgaca

SEQ ID NO: 3217345 - RNA, 17 nt, Mycobacterium leprae
aagccgccgacaccgau

SEQ ID NO: 3217346 - RNA, 18 nt, Mycobacterium leprae
aagccgcgcccggccagu

SEQ ID NO: 3217347 - RNA, 20 nt, Mycobacterium leprae
aagccgcuggaagucggucu

SEQ ID NO: 3217348 - RNA, 12 nt, Mycobacterium leprae
aagccgugacuc

SEQ ID NO: 3217349 - RNA, 19 nt, Mycobacterium leprae
aagcgaccggaugaacacg

SEQ ID NO: 3217350 - RNA, 12 nt, Mycobacterium leprae
aagcgcuugccc

SEQ ID NO: 3217351 - RNA, 18 nt, Mycobacterium leprae
aagcggauaguaugccuc

SEQ ID NO: 3217352 - RNA, 23 nt, Mycobacterium leprae
aagcgggugccgcguccguugua

SEQ ID NO: 3217353 - RNA, 17 nt, Mycobacterium leprae
aagcggguucccgcgau

SEQ ID NO: 3217354 - RNA, 16 nt, Mycobacterium leprae
aagcgguuguccggcg

SEQ ID NO: 3217355 - RNA, 14 nt, Mycobacterium leprae
aagcgugagggcgg

SEQ ID NO: 3217356 - RNA, 16 nt, Mycobacterium leprae
aagcguuacagccgag

SEQ ID NO: 3217357 - RNA, 19 nt, Mycobacterium leprae
aagcuagaucaacagcgca

SEQ ID NO: 3217358 - RNA, 21 nt, Mycobacterium leprae
aagcucgcccuaguaggaaaa

SEQ ID NO: 3217359 - RNA, 17 nt, Mycobacterium leprae
aagcugaugacaguaag

SEQ ID NO: 3217360 - RNA, 20 nt, Mycobacterium leprae
aagcugaugacaguaaguag

SEQ ID NO: 3217361 - RNA, 13 nt, Mycobacterium leprae
aagcugcccggcg

SEQ ID NO: 3217362 - RNA, 22 nt, Mycobacterium leprae
aagcugcgcaccugccacggcc

SEQ ID NO: 3217363 - RNA, 16 nt, Mycobacterium leprae
aagcuggcgaacaaca

SEQ ID NO: 3217364 - RNA, 17 nt, Mycobacterium leprae
aagcugguccgccucga

SEQ ID NO: 3217365 - RNA, 12 nt, Mycobacterium leprae
aagcugugagug

SEQ ID NO: 3217366 - RNA, 15 nt, Mycobacterium leprae
aagcugugagugugc

SEQ ID NO: 3217367 - RNA, 22 nt, Mycobacterium leprae
aagcuguuacgaggacucccuu

SEQ ID NO: 3217368 - RNA, 23 nt, Mycobacterium leprae
aagcuuacuuggucaaggugaaa

SEQ ID NO: 3217369 - RNA, 18 nt, Mycobacterium leprae
aaggaacaaaaucucacg

SEQ ID NO: 3217370 - RNA, 22 nt, Mycobacterium leprae
aaggaagcaaaguccucgaauc

SEQ ID NO: 3217371 - RNA, 17 nt, Mycobacterium leprae
aaggaccggugcugcag

SEQ ID NO: 3217372 - RNA, 20 nt, Mycobacterium leprae
aaggacgcauccaucgcauc

SEQ ID NO: 3217373 - RNA, 12 nt, Mycobacterium leprae
aaggagccgagg

SEQ ID NO: 3217374 - RNA, 18 nt, Mycobacterium leprae
aaggaucgagcggagcug

SEQ ID NO: 3217375 - RNA, 20 nt, Mycobacterium leprae
aaggccaugacaugcacacu

SEQ ID NO: 3217376 - RNA, 21 nt, Mycobacterium leprae
aaggcgccaaacuugcacuga

SEQ ID NO: 3217377 - RNA, 16 nt, Mycobacterium leprae
aaggcgucaagcagca

SEQ ID NO: 3217378 - RNA, 19 nt, Mycobacterium leprae
aagggcuuucgcuggcucu

SEQ ID NO: 3217379 - RNA, 20 nt, Mycobacterium leprae
aaggguggugggucagugua

SEQ ID NO: 3217380 - RNA, 14 nt, Mycobacterium leprae
aagguaagcuugca

SEQ ID NO: 3217381 - RNA, 14 nt, Mycobacterium leprae
aaggugaaacuccc

SEQ ID NO: 3217382 - RNA, 13 nt, Mycobacterium leprae
aaggugacaagua

SEQ ID NO: 3217383 - RNA, 14 nt, Mycobacterium leprae
aagguguugcggug

SEQ ID NO: 3217384 - RNA, 15 nt, Mycobacterium leprae
aagguguugcgguga

SEQ ID NO: 3217385 - RNA, 14 nt, Mycobacterium leprae
aaguacugaccggc

SEQ ID NO: 3217386 - RNA, 16 nt, Mycobacterium leprae
aaguacugaccggcua

SEQ ID NO: 3217387 - RNA, 15 nt, Mycobacterium leprae
aaguagagaaaaaug

SEQ ID NO: 3217388 - RNA, 16 nt, Mycobacterium leprae
aaguauucgaucucgu

SEQ ID NO: 3217389 - RNA, 13 nt, Mycobacterium leprae
aagucaaaaccag

SEQ ID NO: 3217390 - RNA, 16 nt, Mycobacterium leprae
aagucagcaucagaca

SEQ ID NO: 3217391 - RNA, 14 nt, Mycobacterium leprae
aagucaucggcgca

SEQ ID NO: 3217392 - RNA, 15 nt, Mycobacterium leprae
aagucaugcagaugc

SEQ ID NO: 3217393 - RNA, 23 nt, Mycobacterium leprae
aagucaugcagaugcaagauuau

SEQ ID NO: 3217394 - RNA, 24 nt, Mycobacterium leprae
aagucaugcagaugcaagauuauu

SEQ ID NO: 3217395 - RNA, 14 nt, Mycobacterium leprae
aaguccggccugcc

SEQ ID NO: 3217396 - RNA, 16 nt, Mycobacterium leprae
aaguccuugcugguga

SEQ ID NO: 3217397 - RNA, 18 nt, Mycobacterium leprae
aagugaccaccagggaug

SEQ ID NO: 3217398 - RNA, 18 nt, Mycobacterium leprae
aagugcaccaucugcucu

SEQ ID NO: 3217399 - RNA, 15 nt, Mycobacterium leprae
aagugcgaaguaaag

SEQ ID NO: 3217400 - RNA, 15 nt, Mycobacterium leprae
aagugcugcggcgcc

SEQ ID NO: 3217401 - RNA, 24 nt, Mycobacterium leprae
aaguggaauaacagagugcaccac

SEQ ID NO: 3217402 - RNA, 24 nt, Mycobacterium leprae
aagugggguacuucaucaacugag

SEQ ID NO: 3217403 - RNA, 15 nt, Mycobacterium leprae
aaguguaaccaacgc

SEQ ID NO: 3217404 - RNA, 17 nt, Mycobacterium leprae
aagugugguuucgauca

SEQ ID NO: 3217405 - RNA, 17 nt, Mycobacterium leprae
aaguuggugucaacagu

SEQ ID NO: 3217406 - RNA, 20 nt, Mycobacterium leprae
aaguuguaagugcaguuccu

SEQ ID NO: 3217407 - RNA, 15 nt, Mycobacterium leprae
aaguuuucucuaaaa

SEQ ID NO: 3217408 - RNA, 21 nt, Mycobacterium leprae
aaguuuucucuaaaagaauaa

SEQ ID NO: 3217409 - RNA, 19 nt, Mycobacterium leprae
aauaaaccggcagacgugc

SEQ ID NO: 3217410 - RNA, 20 nt, Mycobacterium leprae
aauaaaccggcagacgugcu

SEQ ID NO: 3217411 - RNA, 19 nt, Mycobacterium leprae
aauaaauauccgaauguga

SEQ ID NO: 3217412 - RNA, 17 nt, Mycobacterium leprae
aauaacagagugcacca

SEQ ID NO: 3217413 - RNA, 22 nt, Mycobacterium leprae
aauaaccuucugcgaacacuga

SEQ ID NO: 3217414 - RNA, 17 nt, Mycobacterium leprae
acaaccucggccgaggc

SEQ ID NO: 3217415 - RNA, 17 nt, Mycobacterium leprae
acaaccucuagccaagc

SEQ ID NO: 3217416 - RNA, 14 nt, Mycobacterium leprae
acaacggaccacua

SEQ ID NO: 3217417 - RNA, 20 nt, Mycobacterium leprae
acaacgggaucgacaaaauu

SEQ ID NO: 3217418 - RNA, 20 nt, Mycobacterium leprae
acaacggugccgggucagag

SEQ ID NO: 3217419 - RNA, 18 nt, Mycobacterium leprae
acaacuugacgaugcugu

SEQ ID NO: 3217420 - RNA, 13 nt, Mycobacterium leprae
acaagcaacugca

SEQ ID NO: 3217421 - RNA, 15 nt, Mycobacterium leprae
acaagcagaauugga

SEQ ID NO: 3217422 - RNA, 22 nt, Mycobacterium leprae
acaagcagugucugggccgggc

SEQ ID NO: 3217423 - RNA, 13 nt, Mycobacterium leprae
acaagccaauuag

SEQ ID NO: 3217424 - RNA, 12 nt, Mycobacterium leprae
acaagcgaucgg

SEQ ID NO: 3217425 - RNA, 21 nt, Mycobacterium leprae
acaaggagccaacgauacuga

SEQ ID NO: 3217426 - RNA, 13 nt, Mycobacterium leprae
acaagucaaaacc

SEQ ID NO: 3217427 - RNA, 15 nt, Mycobacterium leprae
acaagucaaaaccag

SEQ ID NO: 3217428 - RNA, 13 nt, Mycobacterium leprae
acaaguccgcggg

SEQ ID NO: 3217429 - RNA, 20 nt, Mycobacterium leprae
acaauacgcgccuguuuuug

SEQ ID NO: 3217430 - RNA, 15 nt, Mycobacterium leprae
acaauauaaugccgg

SEQ ID NO: 3217431 - RNA, 15 nt, Mycobacterium leprae
acaaugucggccacc

SEQ ID NO: 3217432 - RNA, 10 nt, Mycobacterium leprae
acaauguuuc

SEQ ID NO: 3217433 - RNA, 16 nt, Mycobacterium leprae
acaauucggugcgagu

SEQ ID NO: 3217434 - RNA, 22 nt, Mycobacterium leprae
acacaaagcuggcgaacaacaa

SEQ ID NO: 3217435 - RNA, 22 nt, Mycobacterium leprae
acacaaguugucguuccagcuu

SEQ ID NO: 3217436 - RNA, 18 nt, Mycobacterium leprae
acacacccuccugcaggu

SEQ ID NO: 3217437 - RNA, 20 nt, Mycobacterium leprae
acacaggaauuuagaggcug

SEQ ID NO: 3217438 - RNA, 14 nt, Mycobacterium leprae
acacaguuguuggc

SEQ ID NO: 3217439 - RNA, 19 nt, Mycobacterium leprae
acaccacuucuugugcacc

SEQ ID NO: 3217440 - RNA, 20 nt, Mycobacterium leprae
acaccacuucuugugcaccg

SEQ ID NO: 3217441 - RNA, 14 nt, Mycobacterium leprae
acaccagagacacc

SEQ ID NO: 3217442 - RNA, 20 nt, Mycobacterium leprae
acacccaauugccuggcgag

SEQ ID NO: 3217443 - RNA, 23 nt, Mycobacterium leprae
acacccgcacaguuaccacgacg

SEQ ID NO: 3217444 - RNA, 23 nt, Mycobacterium leprae
acacccgguuggccaacugucgg

SEQ ID NO: 3217445 - RNA, 16 nt, Mycobacterium leprae
acacccuggcugggcu

SEQ ID NO: 3217446 - RNA, 23 nt, Mycobacterium leprae
acaccgaacagcucgacagcagg

SEQ ID NO: 3217447 - RNA, 23 nt, Mycobacterium leprae
acaccgcagggcuguuuggccuc

SEQ ID NO: 3217448 - RNA, 19 nt, Mycobacterium leprae
acaccgcccgguaucccaa

SEQ ID NO: 3217449 - RNA, 10 nt, Mycobacterium leprae
acaccgccgg

SEQ ID NO: 3217450 - RNA, 20 nt, Mycobacterium leprae
acaccgccggcgucaggcca

SEQ ID NO: 3217451 - RNA, 23 nt, Mycobacterium leprae
acaccgccggcgucaggccaggc

SEQ ID NO: 3217452 - RNA, 21 nt, Mycobacterium leprae
acaccucaaggccaugacaug

SEQ ID NO: 3217453 - RNA, 17 nt, Mycobacterium leprae
acaccuguugcaauccg

SEQ ID NO: 3217454 - RNA, 22 nt, Mycobacterium leprae
acacgagcguuuagucaccgcc

SEQ ID NO: 3217455 - RNA, 22 nt, Mycobacterium leprae
acacgaggguacgagugguuga

SEQ ID NO: 3217456 - RNA, 19 nt, Mycobacterium leprae
acacgccgcggcugggcag

SEQ ID NO: 3217457 - RNA, 23 nt, Mycobacterium leprae
acacgccguuaguuucgggccuc

SEQ ID NO: 3217458 - RNA, 16 nt, Mycobacterium leprae
acacgguugugcacag

SEQ ID NO: 3217459 - RNA, 19 nt, Mycobacterium leprae
acacgguugugcacaggau

SEQ ID NO: 3217460 - RNA, 21 nt, Mycobacterium leprae
acacguugaugcaucaagcug

SEQ ID NO: 3217461 - RNA, 20 nt, Mycobacterium leprae
acacuaacaccgugccgaug

SEQ ID NO: 3217462 - RNA, 13 nt, Mycobacterium leprae
acacuaagccccg

SEQ ID NO: 3217463 - RNA, 18 nt, Mycobacterium leprae
acacuacuguugucagug

SEQ ID NO: 3217464 - RNA, 15 nt, Mycobacterium leprae
acacuagggagguca

SEQ ID NO: 3217465 - RNA, 19 nt, Mycobacterium leprae
acacugaaccgggcagucu

SEQ ID NO: 3217466 - RNA, 17 nt, Mycobacterium leprae
acacugcggcugcggaa

SEQ ID NO: 3217467 - RNA, 12 nt, Mycobacterium leprae
acacugugccug

SEQ ID NO: 3217468 - RNA, 15 nt, Mycobacterium leprae
acacuuacaccaaca

SEQ ID NO: 3217469 - RNA, 16 nt, Mycobacterium leprae
acacuucuacgaaaaa

SEQ ID NO: 3217470 - RNA, 22 nt, Mycobacterium leprae
acacuugccgcguucgucggaa

SEQ ID NO: 3217471 - RNA, 16 nt, Mycobacterium leprae
acagaacccauccgaa

SEQ ID NO: 3217472 - RNA, 23 nt, Mycobacterium leprae
acagaacccauccgaaucaccgc

SEQ ID NO: 3217473 - RNA, 14 nt, Mycobacterium leprae
acagaagcaagucc

SEQ ID NO: 3217474 - RNA, 15 nt, Mycobacterium leprae
acagagcaagccgca

SEQ ID NO: 3217475 - RNA, 18 nt, Mycobacterium leprae
acagagcgcucggcgugc

SEQ ID NO: 3217476 - RNA, 23 nt, Mycobacterium leprae
acagagcugugucaaugacaagc

SEQ ID NO: 3217477 - RNA, 15 nt, Mycobacterium leprae
acagaugagcucagu

SEQ ID NO: 3217478 - RNA, 18 nt, Mycobacterium leprae
acagauucguaccgcgca

SEQ ID NO: 3217479 - RNA, 17 nt, Mycobacterium leprae
acagcacccagcucaca

SEQ ID NO: 3217480 - RNA, 21 nt, Mycobacterium leprae
acagcacccccggccaggugg

SEQ ID NO: 3217481 - RNA, 23 nt, Mycobacterium leprae
acagcagagggcaauacgcugcc

SEQ ID NO: 3217482 - RNA, 15 nt, Mycobacterium leprae
acagcaggucgccga

SEQ ID NO: 3217483 - RNA, 19 nt, Mycobacterium leprae
acagcaucggcaacgcugu

SEQ ID NO: 3217484 - RNA, 20 nt, Mycobacterium leprae
acagccagugcguaccccua

SEQ ID NO: 3217485 - RNA, 13 nt, Mycobacterium leprae
acagcccaggugc

SEQ ID NO: 3217486 - RNA, 15 nt, Mycobacterium leprae
acagccgucagggca

SEQ ID NO: 3217487 - RNA, 18 nt, Mycobacterium leprae
acagccgugccucgcugu

SEQ ID NO: 3217488 - RNA, 20 nt, Mycobacterium leprae
acagccuccgaaaagcugag

SEQ ID NO: 3217489 - RNA, 19 nt, Mycobacterium leprae
acagccucucgacaaagaa

SEQ ID NO: 3217490 - RNA, 19 nt, Mycobacterium leprae
acagcggggucgacuuaau

SEQ ID NO: 3217491 - RNA, 17 nt, Mycobacterium leprae
acagcgugaaccaaagc

SEQ ID NO: 3217492 - RNA, 15 nt, Mycobacterium leprae
acagcguucgaccca

SEQ ID NO: 3217493 - RNA, 14 nt, Mycobacterium leprae
acagcucagcggcu

SEQ ID NO: 3217494 - RNA, 13 nt, Mycobacterium leprae
acagcugguucau

SEQ ID NO: 3217495 - RNA, 16 nt, Mycobacterium leprae
acagcuucggucuggc

SEQ ID NO: 3217496 - RNA, 24 nt, Mycobacterium leprae
acaggacccagcgauaucaagcug

SEQ ID NO: 3217497 - RNA, 19 nt, Mycobacterium leprae
acagggguccugaccgccu

SEQ ID NO: 3217498 - RNA, 19 nt, Mycobacterium leprae
acagguaaacgagaccagg

SEQ ID NO: 3217499 - RNA, 17 nt, Mycobacterium leprae
acagguaguagccgcuu

SEQ ID NO: 3217500 - RNA, 19 nt, Mycobacterium leprae
acagguugaaaaagaaagc

SEQ ID NO: 3217501 - RNA, 13 nt, Mycobacterium leprae
acaguaauggcau

SEQ ID NO: 3217502 - RNA, 14 nt, Mycobacterium leprae
acaguaggccagcc

SEQ ID NO: 3217503 - RNA, 15 nt, Mycobacterium leprae
acaguaucgaccagc

SEQ ID NO: 3217504 - RNA, 17 nt, Mycobacterium leprae
acaguaucgaccagcca

SEQ ID NO: 3217505 - RNA, 21 nt, Mycobacterium leprae
acaguaucgaccagccacgca

SEQ ID NO: 3217506 - RNA, 21 nt, Mycobacterium leprae
acagucagccgcggguaaccu

SEQ ID NO: 3217507 - RNA, 15 nt, Mycobacterium leprae
acagucccuucgccg

SEQ ID NO: 3217508 - RNA, 22 nt, Mycobacterium leprae
acagucggcgcaguuaguuuaa

SEQ ID NO: 3217509 - RNA, 16 nt, Mycobacterium leprae
acagugcaucgaugau

SEQ ID NO: 3217510 - RNA, 20 nt, Mycobacterium leprae
acagugcgguuguacagcuc

SEQ ID NO: 3217511 - RNA, 23 nt, Mycobacterium leprae
acagugggggugcggcagcugcc

SEQ ID NO: 3217512 - RNA, 17 nt, Mycobacterium leprae
acaguggugauugcugg

SEQ ID NO: 3217513 - RNA, 18 nt, Mycobacterium leprae
acaguguguuuuucugca

SEQ ID NO: 3217514 - RNA, 23 nt, Mycobacterium leprae
acaguuaccacgacguagcccac

SEQ ID NO: 3217515 - RNA, 13 nt, Mycobacterium leprae
acaguuguuggcc

SEQ ID NO: 3217516 - RNA, 16 nt, Mycobacterium leprae
acaguuuaaguagacc

SEQ ID NO: 3217517 - RNA, 15 nt, Mycobacterium leprae
acauagguagauaaa

SEQ ID NO: 3217518 - RNA, 20 nt, Mycobacterium leprae
acauagucagaucaaccaaa

SEQ ID NO: 3217519 - RNA, 21 nt, Mycobacterium leprae
acauagucagaucaaccaaau

SEQ ID NO: 3217520 - RNA, 16 nt, Mycobacterium leprae
acauagucauugccua

SEQ ID NO: 3217521 - RNA, 18 nt, Mycobacterium leprae
acauagucauugccuagu

SEQ ID NO: 3217522 - RNA, 20 nt, Mycobacterium leprae
acauauccaguguaguguca

SEQ ID NO: 3217523 - RNA, 16 nt, Mycobacterium leprae
acauaucuaauuggga

SEQ ID NO: 3217524 - RNA, 13 nt, Mycobacterium leprae
acaucacugggug

SEQ ID NO: 3217525 - RNA, 12 nt, Mycobacterium leprae
acaucagccuau

SEQ ID NO: 3217526 - RNA, 14 nt, Mycobacterium leprae
acaucccugggccg

SEQ ID NO: 3217527 - RNA, 21 nt, Mycobacterium leprae
acauccgagcaggucauaaac

SEQ ID NO: 3217528 - RNA, 19 nt, Mycobacterium leprae
acaucgaguccaagcucaa

SEQ ID NO: 3217529 - RNA, 23 nt, Mycobacterium leprae
acaucgcaggugucgacggugaa

SEQ ID NO: 3217530 - RNA, 13 nt, Mycobacterium leprae
acaucgucggccc

SEQ ID NO: 3217531 - RNA, 18 nt, Mycobacterium leprae
acaucgucggcccaggga

SEQ ID NO: 3217532 - RNA, 17 nt, Mycobacterium leprae
acaucguggaccaagca

SEQ ID NO: 3217533 - RNA, 14 nt, Mycobacterium leprae
acaucguguggugu

SEQ ID NO: 3217534 - RNA, 14 nt, Mycobacterium leprae
acaugcacacuaaa

SEQ ID NO: 3217535 - RNA, 15 nt, Mycobacterium leprae
acauggcgaucugca

SEQ ID NO: 3217536 - RNA, 21 nt, Mycobacterium leprae
acauguagaccaagcagcauc

SEQ ID NO: 3217537 - RNA, 18 nt, Mycobacterium leprae
acaugucccggugcugcc

SEQ ID NO: 3217538 - RNA, 20 nt, Mycobacterium leprae
acaugucccggugcugccug

SEQ ID NO: 3217539 - RNA, 12 nt, Mycobacterium leprae
acaugugugcug

SEQ ID NO: 3217540 - RNA, 21 nt, Mycobacterium leprae
acauugcccgcguucauggca

SEQ ID NO: 3217541 - RNA, 15 nt, Mycobacterium leprae
acauuguucugccau

SEQ ID NO: 3217542 - RNA, 22 nt, Mycobacterium leprae
accaaaauuuaugguagucagu

SEQ ID NO: 3217543 - RNA, 23 nt, Mycobacterium leprae
accaaaccgaagaucaccgccac

SEQ ID NO: 3217544 - RNA, 14 nt, Mycobacterium leprae
accaaaccucugca

SEQ ID NO: 3217545 - RNA, 24 nt, Mycobacterium leprae
accaaacuggacuucuaccgcgaa

SEQ ID NO: 3217546 - RNA, 13 nt, Mycobacterium leprae
accaaaugcuaug

SEQ ID NO: 3217547 - RNA, 16 nt, Mycobacterium leprae
accaaaugugcugugg

SEQ ID NO: 3217548 - RNA, 18 nt, Mycobacterium leprae
accaacaccccgauucca

SEQ ID NO: 3217549 - RNA, 21 nt, Mycobacterium leprae
accaagccaauuauuccaauc

SEQ ID NO: 3217550 - RNA, 15 nt, Mycobacterium leprae
accaagccggugcca

SEQ ID NO: 3217551 - RNA, 15 nt, Mycobacterium leprae
accaauagccgacca

SEQ ID NO: 3217552 - RNA, 16 nt, Mycobacterium leprae
accaauccagccaaca

SEQ ID NO: 3217553 - RNA, 14 nt, Mycobacterium leprae
accacaagcaacug

SEQ ID NO: 3217554 - RNA, 16 nt, Mycobacterium leprae
accacauaugccgcca

SEQ ID NO: 3217555 - RNA, 14 nt, Mycobacterium leprae
accaccaccccuac

SEQ ID NO: 3217556 - RNA, 13 nt, Mycobacterium leprae
accaccaccgcca

SEQ ID NO: 3217557 - RNA, 14 nt, Mycobacterium leprae
accaccaccgccac

SEQ ID NO: 3217558 - RNA, 13 nt, Mycobacterium leprae
accacccacaacg

SEQ ID NO: 3217559 - RNA, 14 nt, Mycobacterium leprae
accacccacaacgc

SEQ ID NO: 3217560 - RNA, 16 nt, Mycobacterium leprae
accaccgacaugcuua

SEQ ID NO: 3217561 - RNA, 20 nt, Mycobacterium leprae
accaccguggagacgaucgc

SEQ ID NO: 3217562 - RNA, 14 nt, Mycobacterium leprae
accacgaagcgaug

SEQ ID NO: 3217563 - RNA, 17 nt, Mycobacterium leprae
accacgcaaugucgccg

SEQ ID NO: 3217564 - RNA, 16 nt, Mycobacterium leprae
accacgccgacaccuc

SEQ ID NO: 3217565 - RNA, 18 nt, Mycobacterium leprae
accacgcgacaucgugga

SEQ ID NO: 3217566 - RNA, 12 nt, Mycobacterium leprae
accacggcgggu

SEQ ID NO: 3217567 - RNA, 19 nt, Mycobacterium leprae
accacgucgggcagcaacc

SEQ ID NO: 3217568 - RNA, 23 nt, Mycobacterium leprae
accacucucaucgcggcugccac

SEQ ID NO: 3217569 - RNA, 17 nt, Mycobacterium leprae
accacugaaccugccau

SEQ ID NO: 3217570 - RNA, 21 nt, Mycobacterium leprae
accacugccgaucgacauagu

SEQ ID NO: 3217571 - RNA, 15 nt, Mycobacterium leprae
accacugcgcccuga

SEQ ID NO: 3217572 - RNA, 18 nt, Mycobacterium leprae
accacuucuugugcaccg

SEQ ID NO: 3217573 - RNA, 19 nt, Mycobacterium leprae
accacuugcaguacaaugu

SEQ ID NO: 3217574 - RNA, 19 nt, Mycobacterium leprae
accagaucagcagaaauuu

SEQ ID NO: 3217575 - RNA, 17 nt, Mycobacterium leprae
accagauggcuccccga

SEQ ID NO: 3217576 - RNA, 20 nt, Mycobacterium leprae
accagauuggaaaucgcucg

SEQ ID NO: 3217577 - RNA, 13 nt, Mycobacterium leprae
accagcagaucaa

SEQ ID NO: 3217578 - RNA, 16 nt, Mycobacterium leprae
accagccaagccgcca

SEQ ID NO: 3217579 - RNA, 19 nt, Mycobacterium leprae
accagccagaccaacauga

SEQ ID NO: 3217580 - RNA, 12 nt, Mycobacterium leprae
accagcgucgcu

SEQ ID NO: 3217581 - RNA, 20 nt, Mycobacterium leprae
accagcucacccgcagcacc

SEQ ID NO: 3217582 - RNA, 23 nt, Mycobacterium leprae
accaggucgacuaacgcuucugc

SEQ ID NO: 3217583 - RNA, 14 nt, Mycobacterium leprae
accagguuguggca

SEQ ID NO: 3217584 - RNA, 17 nt, Mycobacterium leprae
accagguuguggcacca

SEQ ID NO: 3217585 - RNA, 18 nt, Mycobacterium leprae
accaguugcuugucuucu

SEQ ID NO: 3217586 - RNA, 17 nt, Mycobacterium leprae
accauaaacacgugcau

SEQ ID NO: 3217587 - RNA, 21 nt, Mycobacterium leprae
accauaacacuacuugcgcuc

SEQ ID NO: 3217588 - RNA, 21 nt, Mycobacterium leprae
accauacagcuaaccuccacg

SEQ ID NO: 3217589 - RNA, 16 nt, Mycobacterium leprae
accauaguuacgacgu

SEQ ID NO: 3217590 - RNA, 19 nt, Mycobacterium leprae
accaucagaaaaccgucgc

SEQ ID NO: 3217591 - RNA, 16 nt, Mycobacterium leprae
accaucccaaaaccac

SEQ ID NO: 3217592 - RNA, 17 nt, Mycobacterium leprae
accaucgaaacugccaa

SEQ ID NO: 3217593 - RNA, 24 nt, Mycobacterium leprae
accaucugcucucagcacaucagu

SEQ ID NO: 3217594 - RNA, 20 nt, Mycobacterium leprae
accaugagcacacgcugcgu

SEQ ID NO: 3217595 - RNA, 13 nt, Mycobacterium leprae
accaugccaccug

SEQ ID NO: 3217596 - RNA, 15 nt, Mycobacterium leprae
accauugggucaucg

SEQ ID NO: 3217597 - RNA, 20 nt, Mycobacterium leprae
accauuuccgcuaaugccaa

SEQ ID NO: 3217598 - RNA, 23 nt, Mycobacterium leprae
accauuuccgcuaaugccaagca

SEQ ID NO: 3217599 - RNA, 21 nt, Mycobacterium leprae
acccaagugacugcguuucau

SEQ ID NO: 3217600 - RNA, 18 nt, Mycobacterium leprae
acccaauagagcagugcu

SEQ ID NO: 3217601 - RNA, 21 nt, Mycobacterium leprae
acccaauagagcagugcugac

SEQ ID NO: 3217602 - RNA, 22 nt, Mycobacterium leprae
acccacggcugucagagugcag

SEQ ID NO: 3217603 - RNA, 18 nt, Mycobacterium leprae
acccagacgcgaccgcca

SEQ ID NO: 3217604 - RNA, 14 nt, Mycobacterium leprae
acccagccguggug

SEQ ID NO: 3217605 - RNA, 21 nt, Mycobacterium leprae
acccagcgauaucaagcugcg

SEQ ID NO: 3217606 - RNA, 17 nt, Mycobacterium leprae
acccaggccuguugcgg

SEQ ID NO: 3217607 - RNA, 18 nt, Mycobacterium leprae
acccaggccuguugcggc

SEQ ID NO: 3217608 - RNA, 15 nt, Mycobacterium leprae
accccacgucgccgg

SEQ ID NO: 3217609 - RNA, 23 nt, Mycobacterium leprae
accccaggcuacugugaucgcau

SEQ ID NO: 3217610 - RNA, 15 nt, Mycobacterium leprae
accccagucgagcca

SEQ ID NO: 3217611 - RNA, 21 nt, Mycobacterium leprae
accccagucgagccaccucug

SEQ ID NO: 3217612 - RNA, 16 nt, Mycobacterium leprae
accccgauuccaccug

SEQ ID NO: 3217613 - RNA, 13 nt, Mycobacterium leprae
accccgcggcgcu

SEQ ID NO: 3217614 - RNA, 12 nt, Mycobacterium leprae
accccggcauuu

SEQ ID NO: 3217615 - RNA, 16 nt, Mycobacterium leprae
accccguagaacacgu

SEQ ID NO: 3217616 - RNA, 21 nt, Mycobacterium leprae
acccgcaaaccaaacaacaac

SEQ ID NO: 3217617 - RNA, 22 nt, Mycobacterium leprae
acccgcacaguuaccacgacgu

SEQ ID NO: 3217618 - RNA, 18 nt, Mycobacterium leprae
acccgcaucguugucggc

SEQ ID NO: 3217619 - RNA, 16 nt, Mycobacterium leprae
acccgcaugcccuggg

SEQ ID NO: 3217620 - RNA, 15 nt, Mycobacterium leprae
acccgcccaagcgaa

SEQ ID NO: 3217621 - RNA, 13 nt, Mycobacterium leprae
acccgccucgauc

SEQ ID NO: 3217622 - RNA, 16 nt, Mycobacterium leprae
acccggaaggugucug

SEQ ID NO: 3217623 - RNA, 20 nt, Mycobacterium leprae
acccggaaggugucugcgaa

SEQ ID NO: 3217624 - RNA, 14 nt, Mycobacterium leprae
acccggcagaggca

SEQ ID NO: 3217625 - RNA, 12 nt, Mycobacterium leprae
acccggcggcau

SEQ ID NO: 3217626 - RNA, 17 nt, Mycobacterium leprae
acccggcggcaugccug

SEQ ID NO: 3217627 - RNA, 22 nt, Mycobacterium leprae
acccgggacuugacuccucugc

SEQ ID NO: 3217628 - RNA, 22 nt, Mycobacterium leprae
acccgggggcgguggaaggauc

SEQ ID NO: 3217629 - RNA, 12 nt, Mycobacterium leprae
acccggucgucu

SEQ ID NO: 3217630 - RNA, 17 nt, Mycobacterium leprae
acccggucgucuccguc

SEQ ID NO: 3217631 - RNA, 21 nt, Mycobacterium leprae
acccggucgucuccguccagc

SEQ ID NO: 3217632 - RNA, 15 nt, Mycobacterium leprae
acccgguugucgacg

SEQ ID NO: 3217633 - RNA, 14 nt, Mycobacterium leprae
acccgugucgaccg

SEQ ID NO: 3217634 - RNA, 16 nt, Mycobacterium leprae
acccgugucgaccgac

SEQ ID NO: 3217635 - RNA, 14 nt, Mycobacterium leprae
acccguugagcugc

SEQ ID NO: 3217636 - RNA, 15 nt, Mycobacterium leprae
acccucacccgaccg

SEQ ID NO: 3217637 - RNA, 15 nt, Mycobacterium leprae
acccucucagcaauc

SEQ ID NO: 3217638 - RNA, 19 nt, Mycobacterium leprae
acccucuucuaggcaugaa

SEQ ID NO: 3217639 - RNA, 23 nt, Mycobacterium leprae
accuguuucagcguggcuaggcc

SEQ ID NO: 3217640 - RNA, 22 nt, Mycobacterium leprae
accuuaaguccgguagucgcua

SEQ ID NO: 3217641 - RNA, 15 nt, Mycobacterium leprae
accuuaccguccacc

SEQ ID NO: 3217642 - RNA, 20 nt, Mycobacterium leprae
accuuccgcaaaguuaugca

SEQ ID NO: 3217643 - RNA, 16 nt, Mycobacterium leprae
accuucuagcgcagau

SEQ ID NO: 3217644 - RNA, 21 nt, Mycobacterium leprae
accuugaaagcgcgagauuag

SEQ ID NO: 3217645 - RNA, 23 nt, Mycobacterium leprae
accuugacugcuaagucgccgaa

SEQ ID NO: 3217646 - RNA, 15 nt, Mycobacterium leprae
accuuguugcagccu

SEQ ID NO: 3217647 - RNA, 11 nt, Mycobacterium leprae
accuuuggccg

SEQ ID NO: 3217648 - RNA, 16 nt, Mycobacterium leprae
acgaaaauguuuuguu

SEQ ID NO: 3217649 - RNA, 23 nt, Mycobacterium leprae
acgaaaccaugccgccgaagccg

SEQ ID NO: 3217650 - RNA, 17 nt, Mycobacterium leprae
acgaaauucggcggcca

SEQ ID NO: 3217651 - RNA, 12 nt, Mycobacterium leprae
acgaacaacaga

SEQ ID NO: 3217652 - RNA, 18 nt, Mycobacterium leprae
acgaacccgucgaugauc

SEQ ID NO: 3217653 - RNA, 22 nt, Mycobacterium leprae
acgaacccgucgaugaucuaac

SEQ ID NO: 3217654 - RNA, 21 nt, Mycobacterium leprae
acgaacugggugaccacccac

SEQ ID NO: 3217655 - RNA, 22 nt, Mycobacterium leprae
acgaacugggugaccacccaca

SEQ ID NO: 3217656 - RNA, 13 nt, Mycobacterium leprae
acgaacuucagaa

SEQ ID NO: 3217657 - RNA, 22 nt, Mycobacterium leprae
acgaagccgccacgaccaaacc

SEQ ID NO: 3217658 - RNA, 18 nt, Mycobacterium leprae
acgaauaacugccaauca

SEQ ID NO: 3217659 - RNA, 20 nt, Mycobacterium leprae
acgaauaugcccagcagaug

SEQ ID NO: 3217660 - RNA, 15 nt, Mycobacterium leprae
acgacagccugccga

SEQ ID NO: 3217661 - RNA, 18 nt, Mycobacterium leprae
acgacaggagcuucaaca

SEQ ID NO: 3217662 - RNA, 18 nt, Mycobacterium leprae
acgacauugugggccgcu

SEQ ID NO: 3217663 - RNA, 23 nt, Mycobacterium leprae
acgaccggcugcaccuguugcuc

SEQ ID NO: 3217664 - RNA, 16 nt, Mycobacterium leprae
acgaccuccgcagcau

SEQ ID NO: 3217665 - RNA, 18 nt, Mycobacterium leprae
acgaccuccucgggggug

SEQ ID NO: 3217666 - RNA, 21 nt, Mycobacterium leprae
acgacgacucaguggcgggcu

SEQ ID NO: 3217667 - RNA, 13 nt, Mycobacterium leprae
acgacgccacagc

SEQ ID NO: 3217668 - RNA, 18 nt, Mycobacterium leprae
acgacggcuuugcugucg

SEQ ID NO: 3217669 - RNA, 19 nt, Mycobacterium leprae
acgacgugaaacaagccga

SEQ ID NO: 3217670 - RNA, 21 nt, Mycobacterium leprae
acgacuugcccguaguugugu

SEQ ID NO: 3217671 - RNA, 16 nt, Mycobacterium leprae
acgagaccaguugcac

SEQ ID NO: 3217672 - RNA, 16 nt, Mycobacterium leprae
acgagaucagugcaau

SEQ ID NO: 3217673 - RNA, 21 nt, Mycobacterium leprae
acgagcguuuagucaccgccg

SEQ ID NO: 3217674 - RNA, 13 nt, Mycobacterium leprae
acgaggcggugac

SEQ ID NO: 3217675 - RNA, 22 nt, Mycobacterium leprae
acgagggugacgguggcgcaca

SEQ ID NO: 3217676 - RNA, 19 nt, Mycobacterium leprae
acgauaucgcuaaggcugc

SEQ ID NO: 3217677 - RNA, 17 nt, Mycobacterium leprae
acgaucgggaugccgaa

SEQ ID NO: 3217678 - RNA, 18 nt, Mycobacterium leprae
acgaugcgugccccggcc

SEQ ID NO: 3217679 - RNA, 14 nt, Mycobacterium leprae
acgauuagcaugac

SEQ ID NO: 3217680 - RNA, 15 nt, Mycobacterium leprae
acgauuccuggaaag

SEQ ID NO: 3217681 - RNA, 16 nt, Mycobacterium leprae
acgauuucggcucagc

SEQ ID NO: 3217682 - RNA, 15 nt, Mycobacterium leprae
acgcaaaguugaacg

SEQ ID NO: 3217683 - RNA, 22 nt, Mycobacterium leprae
acgcaacgagguaagacaaggu

SEQ ID NO: 3217684 - RNA, 16 nt, Mycobacterium leprae
acgcaacugcuggagg

SEQ ID NO: 3217685 - RNA, 21 nt, Mycobacterium leprae
acgcaaguucgacguggucga

SEQ ID NO: 3217686 - RNA, 22 nt, Mycobacterium leprae
acgcaccgcguaacagauuauu

SEQ ID NO: 3217687 - RNA, 16 nt, Mycobacterium leprae
acgcacgccuugcagc

SEQ ID NO: 3217688 - RNA, 13 nt, Mycobacterium leprae
acgcagcucugga

SEQ ID NO: 3217689 - RNA, 16 nt, Mycobacterium leprae
acgcaugacacccccg

SEQ ID NO: 3217690 - RNA, 18 nt, Mycobacterium leprae
acgccccuaccccgcggc

SEQ ID NO: 3217691 - RNA, 13 nt, Mycobacterium leprae
acgcccgaccagu

SEQ ID NO: 3217692 - RNA, 13 nt, Mycobacterium leprae
acgcccuccuggc

SEQ ID NO: 3217693 - RNA, 19 nt, Mycobacterium leprae
acgccgagaacaucgcggu

SEQ ID NO: 3217694 - RNA, 12 nt, Mycobacterium leprae
acgccgaggguc

SEQ ID NO: 3217695 - RNA, 17 nt, Mycobacterium leprae
acgccgaucgugccccu

SEQ ID NO: 3217696 - RNA, 17 nt, Mycobacterium leprae
acgccgccguugccaua

SEQ ID NO: 3217697 - RNA, 19 nt, Mycobacterium leprae
acgccgcucgauucucgag

SEQ ID NO: 3217698 - RNA, 18 nt, Mycobacterium leprae
acgccggcggccaccgcg

SEQ ID NO: 3217699 - RNA, 17 nt, Mycobacterium leprae
acgccggcgucgcaccg

SEQ ID NO: 3217700 - RNA, 21 nt, Mycobacterium leprae
acgccggggaaccuggaccga

SEQ ID NO: 3217701 - RNA, 16 nt, Mycobacterium leprae
acgccgguauguggga

SEQ ID NO: 3217702 - RNA, 19 nt, Mycobacterium leprae
acgccggucgaagugaccu

SEQ ID NO: 3217703 - RNA, 22 nt, Mycobacterium leprae
acgccggucgaagugaccucca

SEQ ID NO: 3217704 - RNA, 23 nt, Mycobacterium leprae
acgccgugccgagcuaacagaac

SEQ ID NO: 3217705 - RNA, 17 nt, Mycobacterium leprae
acgccuagcuagccgac

SEQ ID NO: 3217706 - RNA, 14 nt, Mycobacterium leprae
acgcgacgccgcca

SEQ ID NO: 3217707 - RNA, 24 nt, Mycobacterium leprae
acgcgaucgccgaaaucgguggca

SEQ ID NO: 3217708 - RNA, 20 nt, Mycobacterium leprae
acgcgaucuaccccggcauu

SEQ ID NO: 3217709 - RNA, 16 nt, Mycobacterium leprae
acgcgcaccugguggu

SEQ ID NO: 3217710 - RNA, 19 nt, Mycobacterium leprae
acgcgcaccugguggugcg

SEQ ID NO: 3217711 - RNA, 18 nt, Mycobacterium leprae
acgcgccggcuacuggac

SEQ ID NO: 3217712 - RNA, 20 nt, Mycobacterium leprae
acgcgcgacaguaucgacca

SEQ ID NO: 3217713 - RNA, 24 nt, Mycobacterium leprae
acgcgcgacaguaucgaccagcca

SEQ ID NO: 3217714 - RNA, 16 nt, Mycobacterium leprae
acgcgguccuguccag

SEQ ID NO: 3217715 - RNA, 18 nt, Mycobacterium leprae
acgcgguugccggcggaa

SEQ ID NO: 3217716 - RNA, 17 nt, Mycobacterium leprae
acgcguacuccagcagc

SEQ ID NO: 3217717 - RNA, 13 nt, Mycobacterium leprae
acgcgugcggcgc

SEQ ID NO: 3217718 - RNA, 14 nt, Mycobacterium leprae
acgcgugcggcgcc

SEQ ID NO: 3217719 - RNA, 19 nt, Mycobacterium leprae
acgcgugcggcgcccaccu

SEQ ID NO: 3217720 - RNA, 19 nt, Mycobacterium leprae
acgcguugauggccgagga

SEQ ID NO: 3217721 - RNA, 13 nt, Mycobacterium leprae
acgcuaaaacgaa

SEQ ID NO: 3217722 - RNA, 20 nt, Mycobacterium leprae
acgcuauguuggccagcagc

SEQ ID NO: 3217723 - RNA, 21 nt, Mycobacterium leprae
acgcucccaggggggcgcggu

SEQ ID NO: 3217724 - RNA, 16 nt, Mycobacterium leprae
acgcucggccaaggau

SEQ ID NO: 3217725 - RNA, 14 nt, Mycobacterium leprae
acgcugaaccgcgu

SEQ ID NO: 3217726 - RNA, 16 nt, Mycobacterium leprae
acgcugauaaggucug

SEQ ID NO: 3217727 - RNA, 21 nt, Mycobacterium leprae
acgcugauggcacuacccgac

SEQ ID NO: 3217728 - RNA, 18 nt, Mycobacterium leprae
acgcugauugccaacuca

SEQ ID NO: 3217729 - RNA, 18 nt, Mycobacterium leprae
acgcugcgugaagcaggu

SEQ ID NO: 3217730 - RNA, 21 nt, Mycobacterium leprae
acgcugcuugcucuggguggu

SEQ ID NO: 3217731 - RNA, 14 nt, Mycobacterium leprae
acgcuggccgccgg

SEQ ID NO: 3217732 - RNA, 22 nt, Mycobacterium leprae
acggaauaaucacagccuccga

SEQ ID NO: 3217733 - RNA, 14 nt, Mycobacterium leprae
acggagcaagcgcu

SEQ ID NO: 3217734 - RNA, 15 nt, Mycobacterium leprae
acggagcgcaggaac

SEQ ID NO: 3217735 - RNA, 20 nt, Mycobacterium leprae
acggaucggcuacaucgaca

SEQ ID NO: 3217736 - RNA, 19 nt, Mycobacterium leprae
acggauguggucaacaucg

SEQ ID NO: 3217737 - RNA, 22 nt, Mycobacterium leprae
acggauuucucgugguggcugg

SEQ ID NO: 3217738 - RNA, 22 nt, Mycobacterium leprae
acggcaacgguuacugccacaa

SEQ ID NO: 3217739 - RNA, 18 nt, Mycobacterium leprae
acggcagcgucaccaagc

SEQ ID NO: 3217740 - RNA, 21 nt, Mycobacterium leprae
acggcagugagcucaccggcg

SEQ ID NO: 3217741 - RNA, 24 nt, Mycobacterium leprae
acggccagcgcggcaucgucggca

SEQ ID NO: 3217742 - RNA, 16 nt, Mycobacterium leprae
acggcccagcaccacu

SEQ ID NO: 3217743 - RNA, 21 nt, Mycobacterium leprae
acggccggaucaucgaugcac

SEQ ID NO: 3217744 - RNA, 11 nt, Mycobacterium leprae
acggccgggca

SEQ ID NO: 3217745 - RNA, 13 nt, Mycobacterium leprae
acggcgcggcugc

SEQ ID NO: 3217746 - RNA, 16 nt, Mycobacterium leprae
acggcgcucaccgacg

SEQ ID NO: 3217747 - RNA, 13 nt, Mycobacterium leprae
acggcggccgcca

SEQ ID NO: 3217748 - RNA, 22 nt, Mycobacterium leprae
acggcuacggggugggcagccu

SEQ ID NO: 3217749 - RNA, 22 nt, Mycobacterium leprae
acggcugacuccguacucacgu

SEQ ID NO: 3217750 - RNA, 14 nt, Mycobacterium leprae
acggcuggcagcaa

SEQ ID NO: 3217751 - RNA, 15 nt, Mycobacterium leprae
acucccuucgccggu

SEQ ID NO: 3217752 - RNA, 23 nt, Mycobacterium leprae
acuccgggcccggacggcccagc

SEQ ID NO: 3217753 - RNA, 15 nt, Mycobacterium leprae
acuccguacucacgu

SEQ ID NO: 3217754 - RNA, 21 nt, Mycobacterium leprae
acuccgugacgcauuaccugg

SEQ ID NO: 3217755 - RNA, 22 nt, Mycobacterium leprae
acuccuaggaucagaaccgcgg

SEQ ID NO: 3217756 - RNA, 23 nt, Mycobacterium leprae
acucgaccuugccgaagcucugg

SEQ ID NO: 3217757 - RNA, 16 nt, Mycobacterium leprae
acucgaguggcgaacg

SEQ ID NO: 3217758 - RNA, 13 nt, Mycobacterium leprae
acucgaugacacg

SEQ ID NO: 3217759 - RNA, 15 nt, Mycobacterium leprae
acucgcgacgauacu

SEQ ID NO: 3217760 - RNA, 22 nt, Mycobacterium leprae
acucggaauggcggcagcgcca

SEQ ID NO: 3217761 - RNA, 19 nt, Mycobacterium leprae
acucggagcaaggugguga

SEQ ID NO: 3217762 - RNA, 18 nt, Mycobacterium leprae
acucggcagagcguucga

SEQ ID NO: 3217763 - RNA, 17 nt, Mycobacterium leprae
acucgugcgucgucuca

SEQ ID NO: 3217764 - RNA, 23 nt, Mycobacterium leprae
acucguuucucauucucugccuu

SEQ ID NO: 3217765 - RNA, 12 nt, Mycobacterium leprae
acucuagauaac

SEQ ID NO: 3217766 - RNA, 12 nt, Mycobacterium leprae
acucucaucgcg

SEQ ID NO: 3217767 - RNA, 12 nt, Mycobacterium leprae
acucugaaaaua

SEQ ID NO: 3217768 - RNA, 13 nt, Mycobacterium leprae
acucuggcuagcc

SEQ ID NO: 3217769 - RNA, 14 nt, Mycobacterium leprae
acucuucugcugga

SEQ ID NO: 3217770 - RNA, 15 nt, Mycobacterium leprae
acucuucugcuggaa

SEQ ID NO: 3217771 - RNA, 17 nt, Mycobacterium leprae
acugaaugcgaugcugg

SEQ ID NO: 3217772 - RNA, 21 nt, Mycobacterium leprae
acugaauuaaggggacggugu

SEQ ID NO: 3217773 - RNA, 22 nt, Mycobacterium leprae
acugaccaagaaguuaccgagc

SEQ ID NO: 3217774 - RNA, 15 nt, Mycobacterium leprae
acugagaccaugguc

SEQ ID NO: 3217775 - RNA, 15 nt, Mycobacterium leprae
acugaugggcagcac

SEQ ID NO: 3217776 - RNA, 22 nt, Mycobacterium leprae
acugaugugcugagagcagaug

SEQ ID NO: 3217777 - RNA, 20 nt, Mycobacterium leprae
acugcaauccguggagagca

SEQ ID NO: 3217778 - RNA, 22 nt, Mycobacterium leprae
acugcaauccguggagagcaug

SEQ ID NO: 3217779 - RNA, 16 nt, Mycobacterium leprae
acugcacccggccguc

SEQ ID NO: 3217780 - RNA, 22 nt, Mycobacterium leprae
acugcacggcgugcaggcaguc

SEQ ID NO: 3217781 - RNA, 16 nt, Mycobacterium leprae
acugcaggagguagca

SEQ ID NO: 3217782 - RNA, 18 nt, Mycobacterium leprae
acugcagggcgagcugcg

SEQ ID NO: 3217783 - RNA, 19 nt, Mycobacterium leprae
acugcccgggugaacgcca

SEQ ID NO: 3217784 - RNA, 23 nt, Mycobacterium leprae
acugcccgggugaacgccaggcg

SEQ ID NO: 3217785 - RNA, 14 nt, Mycobacterium leprae
acugccgaccgccu

SEQ ID NO: 3217786 - RNA, 15 nt, Mycobacterium leprae
acugcgaacaucgaa

SEQ ID NO: 3217787 - RNA, 17 nt, Mycobacterium leprae
acugcgaagcgcagcga

SEQ ID NO: 3217788 - RNA, 18 nt, Mycobacterium leprae
acugcgacagcagccacu

SEQ ID NO: 3217789 - RNA, 14 nt, Mycobacterium leprae
acugcguuucauga

SEQ ID NO: 3217790 - RNA, 13 nt, Mycobacterium leprae
acugcuagccggc

SEQ ID NO: 3217791 - RNA, 14 nt, Mycobacterium leprae
acugcuagccggcu

SEQ ID NO: 3217792 - RNA, 22 nt, Mycobacterium leprae
acugcugcgcaagguuguuugu

SEQ ID NO: 3217793 - RNA, 11 nt, Mycobacterium leprae
acugcuggagg

SEQ ID NO: 3217794 - RNA, 16 nt, Mycobacterium leprae
acugcuucggccagcg

SEQ ID NO: 3217795 - RNA, 18 nt, Mycobacterium leprae
acugcuucggccagcgca

SEQ ID NO: 3217796 - RNA, 15 nt, Mycobacterium leprae
acuggacguggcggu

SEQ ID NO: 3217797 - RNA, 19 nt, Mycobacterium leprae
acuggaguacuggcggccg

SEQ ID NO: 3217798 - RNA, 13 nt, Mycobacterium leprae
acuggauaugccg

SEQ ID NO: 3217799 - RNA, 16 nt, Mycobacterium leprae
acuggaucacacucug

SEQ ID NO: 3217800 - RNA, 18 nt, Mycobacterium leprae
acuggcauuaggcgacaa

SEQ ID NO: 3217801 - RNA, 16 nt, Mycobacterium leprae
acuggcgaguggagug

SEQ ID NO: 3217802 - RNA, 21 nt, Mycobacterium leprae
acuggcggccggugaugacga

SEQ ID NO: 3217803 - RNA, 14 nt, Mycobacterium leprae
acuggcuaaaucgu

SEQ ID NO: 3217804 - RNA, 22 nt, Mycobacterium leprae
acuggcuacgacaggagcuuca

SEQ ID NO: 3217805 - RNA, 15 nt, Mycobacterium leprae
acuggcuguagugau

SEQ ID NO: 3217806 - RNA, 16 nt, Mycobacterium leprae
acugggaccaccugag

SEQ ID NO: 3217807 - RNA, 22 nt, Mycobacterium leprae
acuggggcguccagugaugacc

SEQ ID NO: 3217808 - RNA, 22 nt, Mycobacterium leprae
acugggucguuggcaacguggc

SEQ ID NO: 3217809 - RNA, 17 nt, Mycobacterium leprae
acugggugaccacccac

SEQ ID NO: 3217810 - RNA, 13 nt, Mycobacterium leprae
acuggguggaugu

SEQ ID NO: 3217811 - RNA, 22 nt, Mycobacterium leprae
acugguggcagccacagcgacg

SEQ ID NO: 3217812 - RNA, 19 nt, Mycobacterium leprae
acuguagagacguaccacu

SEQ ID NO: 3217813 - RNA, 14 nt, Mycobacterium leprae
acuguauaaaccgg

SEQ ID NO: 3217814 - RNA, 19 nt, Mycobacterium leprae
acugucaaugcaggugguc

SEQ ID NO: 3217815 - RNA, 20 nt, Mycobacterium leprae
acugucgcccgacggcgucg

SEQ ID NO: 3217816 - RNA, 21 nt, Mycobacterium leprae
acugucuaccguugacguggu

SEQ ID NO: 3217817 - RNA, 20 nt, Mycobacterium leprae
acugugaaucugaugacgcg

SEQ ID NO: 3217818 - RNA, 16 nt, Mycobacterium leprae
acugugucaccugaaa

SEQ ID NO: 3217819 - RNA, 14 nt, Mycobacterium leprae
acuguugcuugccc

SEQ ID NO: 3217820 - RNA, 19 nt, Mycobacterium leprae
acuguugucaguggcgacg

SEQ ID NO: 3217821 - RNA, 12 nt, Mycobacterium leprae
acuuacaccaac

SEQ ID NO: 3217822 - RNA, 15 nt, Mycobacterium leprae
acuuacuaucacgaa

SEQ ID NO: 3217823 - RNA, 12 nt, Mycobacterium leprae
acuuacuucugu

SEQ ID NO: 3217824 - RNA, 18 nt, Mycobacterium leprae
acuuagauuggaaggcau

SEQ ID NO: 3217825 - RNA, 18 nt, Mycobacterium leprae
acuuauagucauguuguu

SEQ ID NO: 3217826 - RNA, 21 nt, Mycobacterium leprae
acuuaugcacccgcguacagg

SEQ ID NO: 3217827 - RNA, 15 nt, Mycobacterium leprae
acuucaaccaagccg

SEQ ID NO: 3217828 - RNA, 22 nt, Mycobacterium leprae
acuucagcgacaggcagcugca

SEQ ID NO: 3217829 - RNA, 21 nt, Mycobacterium leprae
acuucagcgagcgugucaugg

SEQ ID NO: 3217830 - RNA, 17 nt, Mycobacterium leprae
acuucaucaacugagua

SEQ ID NO: 3217831 - RNA, 15 nt, Mycobacterium leprae
acuucccaccguggu

SEQ ID NO: 3217832 - RNA, 17 nt, Mycobacterium leprae
acuucgcagccaccgac

SEQ ID NO: 3217833 - RNA, 23 nt, Mycobacterium leprae
acuucgcccucuuugaucagcaa

SEQ ID NO: 3217834 - RNA, 20 nt, Mycobacterium leprae
acuucgcugagcgaagucga

SEQ ID NO: 3217835 - RNA, 18 nt, Mycobacterium leprae
acuucggcaacggcgucu

SEQ ID NO: 3217836 - RNA, 19 nt, Mycobacterium leprae
acuucgguaacgcugacca

SEQ ID NO: 3217837 - RNA, 19 nt, Mycobacterium leprae
acuucuggaucuagccggg

SEQ ID NO: 3217838 - RNA, 21 nt, Mycobacterium leprae
acuugaaaccggccgcggugg

SEQ ID NO: 3217839 - RNA, 20 nt, Mycobacterium leprae
acuugaccagccgcagcacc

SEQ ID NO: 3217840 - RNA, 18 nt, Mycobacterium leprae
acuugaccuauacuggau

SEQ ID NO: 3217841 - RNA, 15 nt, Mycobacterium leprae
acuugacgaugcugu

SEQ ID NO: 3217842 - RNA, 15 nt, Mycobacterium leprae
acuugacggucgagc

SEQ ID NO: 3217843 - RNA, 14 nt, Mycobacterium leprae
acuugacuccucug

SEQ ID NO: 3217844 - RNA, 22 nt, Mycobacterium leprae
acuugacuccucugcuggaucu

SEQ ID NO: 3217845 - RNA, 18 nt, Mycobacterium leprae
acuugcgcucacccaagg

SEQ ID NO: 3217846 - RNA, 14 nt, Mycobacterium leprae
acuuggcacaacaa

SEQ ID NO: 3217847 - RNA, 19 nt, Mycobacterium leprae
acuuggcacaacaagagaa

SEQ ID NO: 3217848 - RNA, 14 nt, Mycobacterium leprae
acuuggcugguuaa

SEQ ID NO: 3217849 - RNA, 16 nt, Mycobacterium leprae
acuuggucaaggugaa

SEQ ID NO: 3217850 - RNA, 18 nt, Mycobacterium leprae
acuuguaucgugccuccg

SEQ ID NO: 3217851 - RNA, 18 nt, Mycobacterium leprae
acuugugauucagcgcug

SEQ ID NO: 3217852 - RNA, 17 nt, Mycobacterium leprae
acuuuacgugcguaagg

SEQ ID NO: 3217853 - RNA, 20 nt, Mycobacterium leprae
acuuuagcaacgacgccaca

SEQ ID NO: 3217854 - RNA, 17 nt, Mycobacterium leprae
acuuuguacgacgaccu

SEQ ID NO: 3217855 - RNA, 13 nt, Mycobacterium leprae
agaaaaaugcugc

SEQ ID NO: 3217856 - RNA, 15 nt, Mycobacterium leprae
agaaacaaaggugcc

SEQ ID NO: 3217857 - RNA, 16 nt, Mycobacterium leprae
agaaacaggcauauaa

SEQ ID NO: 3217858 - RNA, 17 nt, Mycobacterium leprae
agaaacaggcauauaau

SEQ ID NO: 3217859 - RNA, 21 nt, Mycobacterium leprae
agaaacagggccgaagcagcc

SEQ ID NO: 3217860 - RNA, 19 nt, Mycobacterium leprae
agaaagaauuuaccggcgu

SEQ ID NO: 3217861 - RNA, 13 nt, Mycobacterium leprae
agaaaguugaagu

SEQ ID NO: 3217862 - RNA, 16 nt, Mycobacterium leprae
agaaauacccacccag

SEQ ID NO: 3217863 - RNA, 22 nt, Mycobacterium leprae
agaacaccccgcggaguuggcc

SEQ ID NO: 3217864 - RNA, 17 nt, Mycobacterium leprae
agcacaaaauucucgcg

SEQ ID NO: 3217865 - RNA, 16 nt, Mycobacterium leprae
agcacacugcggcugc

SEQ ID NO: 3217866 - RNA, 17 nt, Mycobacterium leprae
agcacaugaaaaccguc

SEQ ID NO: 3217867 - RNA, 20 nt, Mycobacterium leprae
agcaccaaccuguagacgag

SEQ ID NO: 3217868 - RNA, 20 nt, Mycobacterium leprae
agcaccaagucuucgaugcu

SEQ ID NO: 3217869 - RNA, 23 nt, Mycobacterium leprae
agcaccauggaacagcguucgac

SEQ ID NO: 3217870 - RNA, 13 nt, Mycobacterium leprae
agcacccggccac

SEQ ID NO: 3217871 - RNA, 14 nt, Mycobacterium leprae
agcacccggccaca

SEQ ID NO: 3217872 - RNA, 21 nt, Mycobacterium leprae
agcaccgagaauaaaugccgg

SEQ ID NO: 3217873 - RNA, 17 nt, Mycobacterium leprae
agcaccggcauggccgc

SEQ ID NO: 3217874 - RNA, 12 nt, Mycobacterium leprae
agcaccugccgc

SEQ ID NO: 3217875 - RNA, 15 nt, Mycobacterium leprae
agcacggcacaaucg

SEQ ID NO: 3217876 - RNA, 18 nt, Mycobacterium leprae
agcacggcgcucaccgac

SEQ ID NO: 3217877 - RNA, 19 nt, Mycobacterium leprae
agcacggcgcucaccgacg

SEQ ID NO: 3217878 - RNA, 16 nt, Mycobacterium leprae
agcacgggguguuggc

SEQ ID NO: 3217879 - RNA, 19 nt, Mycobacterium leprae
agcacgggguguuggcgcu

SEQ ID NO: 3217880 - RNA, 13 nt, Mycobacterium leprae
agcacuaguaauc

SEQ ID NO: 3217881 - RNA, 15 nt, Mycobacterium leprae
agcacugcaguaacc

SEQ ID NO: 3217882 - RNA, 14 nt, Mycobacterium leprae
agcacuucgcccug

SEQ ID NO: 3217883 - RNA, 23 nt, Mycobacterium leprae
agcacuucgcgagugcuggucaa

SEQ ID NO: 3217884 - RNA, 19 nt, Mycobacterium leprae
agcacuucgguaacgcuga

SEQ ID NO: 3217885 - RNA, 15 nt, Mycobacterium leprae
agcagaauauugcga

SEQ ID NO: 3217886 - RNA, 19 nt, Mycobacterium leprae
agcagaauuggagugaagu

SEQ ID NO: 3217887 - RNA, 21 nt, Mycobacterium leprae
agcagaauuggagugaaguga

SEQ ID NO: 3217888 - RNA, 18 nt, Mycobacterium leprae
agcagacugagucugcgg

SEQ ID NO: 3217889 - RNA, 14 nt, Mycobacterium leprae
agcagcacggggug

SEQ ID NO: 3217890 - RNA, 13 nt, Mycobacterium leprae
agcagcaggcuga

SEQ ID NO: 3217891 - RNA, 17 nt, Mycobacterium leprae
agcagcaguuuccaaca

SEQ ID NO: 3217892 - RNA, 21 nt, Mycobacterium leprae
agcagcaguuuccaacaaacu

SEQ ID NO: 3217893 - RNA, 16 nt, Mycobacterium leprae
agcagccgaccgcccg

SEQ ID NO: 3217894 - RNA, 16 nt, Mycobacterium leprae
agcagcgcgcagaaca

SEQ ID NO: 3217895 - RNA, 21 nt, Mycobacterium leprae
agcagcuauagggcacgcugu

SEQ ID NO: 3217896 - RNA, 18 nt, Mycobacterium leprae
agcagcucucuacucguc

SEQ ID NO: 3217897 - RNA, 21 nt, Mycobacterium leprae
agcagcugcacgaauccgcua

SEQ ID NO: 3217898 - RNA, 14 nt, Mycobacterium leprae
agcaggucgccgac

SEQ ID NO: 3217899 - RNA, 12 nt, Mycobacterium leprae
agcagguugagg

SEQ ID NO: 3217900 - RNA, 19 nt, Mycobacterium leprae
agcagucccaaggggagca

SEQ ID NO: 3217901 - RNA, 15 nt, Mycobacterium leprae
agcaguguggcaucc

SEQ ID NO: 3217902 - RNA, 19 nt, Mycobacterium leprae
agcaguguggcauccgcca

SEQ ID NO: 3217903 - RNA, 15 nt, Mycobacterium leprae
agcaguucggcugaa

SEQ ID NO: 3217904 - RNA, 17 nt, Mycobacterium leprae
agcauagcccaugccga

SEQ ID NO: 3217905 - RNA, 16 nt, Mycobacterium leprae
agcauagcggccgcca

SEQ ID NO: 3217906 - RNA, 17 nt, Mycobacterium leprae
agcaucggcaacgcugu

SEQ ID NO: 3217907 - RNA, 11 nt, Mycobacterium leprae
agcaucggcag

SEQ ID NO: 3217908 - RNA, 18 nt, Mycobacterium leprae
agcaucggguaaaucucu

SEQ ID NO: 3217909 - RNA, 15 nt, Mycobacterium leprae
agcaucguauagcac

SEQ ID NO: 3217910 - RNA, 19 nt, Mycobacterium leprae
agcaucuggccgugcggcg

SEQ ID NO: 3217911 - RNA, 11 nt, Mycobacterium leprae
agcaugacagg

SEQ ID NO: 3217912 - RNA, 14 nt, Mycobacterium leprae
agcaugagcugcug

SEQ ID NO: 3217913 - RNA, 15 nt, Mycobacterium leprae
agcaugagcugcugg

SEQ ID NO: 3217914 - RNA, 22 nt, Mycobacterium leprae
agcaugcccagaccgaaaacca

SEQ ID NO: 3217915 - RNA, 12 nt, Mycobacterium leprae
agcaugcgccuc

SEQ ID NO: 3217916 - RNA, 17 nt, Mycobacterium leprae
agcaugcgccuccagcu

SEQ ID NO: 3217917 - RNA, 13 nt, Mycobacterium leprae
agcaugguggcca

SEQ ID NO: 3217918 - RNA, 20 nt, Mycobacterium leprae
agcauguacuuaccugcgcg

SEQ ID NO: 3217919 - RNA, 16 nt, Mycobacterium leprae
agcaugucggccacug

SEQ ID NO: 3217920 - RNA, 17 nt, Mycobacterium leprae
agcaugucggugguggg

SEQ ID NO: 3217921 - RNA, 20 nt, Mycobacterium leprae
agcaugucgguggugggugc

SEQ ID NO: 3217922 - RNA, 17 nt, Mycobacterium leprae
agcaugugaggucauua

SEQ ID NO: 3217923 - RNA, 15 nt, Mycobacterium leprae
agccaagcucagcgc

SEQ ID NO: 3217924 - RNA, 20 nt, Mycobacterium leprae
agccaagcucagcgcagugc

SEQ ID NO: 3217925 - RNA, 20 nt, Mycobacterium leprae
agccaaucguguaucgucgc

SEQ ID NO: 3217926 - RNA, 17 nt, Mycobacterium leprae
agccaaugcugcagcug

SEQ ID NO: 3217927 - RNA, 15 nt, Mycobacterium leprae
agccaauucguccgg

SEQ ID NO: 3217928 - RNA, 14 nt, Mycobacterium leprae
agccacaaguaggu

SEQ ID NO: 3217929 - RNA, 20 nt, Mycobacterium leprae
agccacacgcgacgccgcca

SEQ ID NO: 3217930 - RNA, 23 nt, Mycobacterium leprae
agccaccaaguacggcggguugg

SEQ ID NO: 3217931 - RNA, 18 nt, Mycobacterium leprae
agccaccacaaauacuuc

SEQ ID NO: 3217932 - RNA, 15 nt, Mycobacterium leprae
agccacccgcaucgu

SEQ ID NO: 3217933 - RNA, 23 nt, Mycobacterium leprae
agccacuccgguugcggcgagcu

SEQ ID NO: 3217934 - RNA, 12 nt, Mycobacterium leprae
agccacuucaga

SEQ ID NO: 3217935 - RNA, 20 nt, Mycobacterium leprae
agccagaauggaguuggugu

SEQ ID NO: 3217936 - RNA, 16 nt, Mycobacterium leprae
agccaggagaagcgcu

SEQ ID NO: 3217937 - RNA, 22 nt, Mycobacterium leprae
agccaggaugcggcccagugca

SEQ ID NO: 3217938 - RNA, 23 nt, Mycobacterium leprae
agccaucgaauauccaucuagcg

SEQ ID NO: 3217939 - RNA, 13 nt, Mycobacterium leprae
agccaucucuauu

SEQ ID NO: 3217940 - RNA, 21 nt, Mycobacterium leprae
agccaugcaaccacacccugg

SEQ ID NO: 3217941 - RNA, 14 nt, Mycobacterium leprae
agccauucuagguu

SEQ ID NO: 3217942 - RNA, 13 nt, Mycobacterium leprae
agccauugcucgg

SEQ ID NO: 3217943 - RNA, 22 nt, Mycobacterium leprae
agccauuugcggcuuguggcua

SEQ ID NO: 3217944 - RNA, 16 nt, Mycobacterium leprae
agcccacgccuagcua

SEQ ID NO: 3217945 - RNA, 23 nt, Mycobacterium leprae
agcccacguccugaauucagccg

SEQ ID NO: 3217946 - RNA, 15 nt, Mycobacterium leprae
agcccagauugcagu

SEQ ID NO: 3217947 - RNA, 15 nt, Mycobacterium leprae
agcccaggugcccag

SEQ ID NO: 3217948 - RNA, 14 nt, Mycobacterium leprae
agcccauccgucca

SEQ ID NO: 3217949 - RNA, 22 nt, Mycobacterium leprae
agcccauccguccaccccgggc

SEQ ID NO: 3217950 - RNA, 18 nt, Mycobacterium leprae
agccccauggcacggcga

SEQ ID NO: 3217951 - RNA, 15 nt, Mycobacterium leprae
agccccuggcaucau

SEQ ID NO: 3217952 - RNA, 22 nt, Mycobacterium leprae
agccccuggcaucaucaacaug

SEQ ID NO: 3217953 - RNA, 22 nt, Mycobacterium leprae
agcccgauuuggauggucggca

SEQ ID NO: 3217954 - RNA, 23 nt, Mycobacterium leprae
agcccgauuuggauggucggcag

SEQ ID NO: 3217955 - RNA, 21 nt, Mycobacterium leprae
agcccgcaucggcccgcaacc

SEQ ID NO: 3217956 - RNA, 19 nt, Mycobacterium leprae
agcccgcugcugcgaccga

SEQ ID NO: 3217957 - RNA, 17 nt, Mycobacterium leprae
agcccggauacagcacg

SEQ ID NO: 3217958 - RNA, 13 nt, Mycobacterium leprae
agcccggcgugca

SEQ ID NO: 3217959 - RNA, 14 nt, Mycobacterium leprae
agcccucccagcca

SEQ ID NO: 3217960 - RNA, 20 nt, Mycobacterium leprae
agcccucccagccaucgaau

SEQ ID NO: 3217961 - RNA, 17 nt, Mycobacterium leprae
agcccuucacuuccgcu

SEQ ID NO: 3217962 - RNA, 18 nt, Mycobacterium leprae
agcccuucuccaccaccg

SEQ ID NO: 3217963 - RNA, 20 nt, Mycobacterium leprae
agccgaacaaacccccaacc

SEQ ID NO: 3217964 - RNA, 15 nt, Mycobacterium leprae
agccgaagccgccag

SEQ ID NO: 3217965 - RNA, 17 nt, Mycobacterium leprae
agccgacaaucucacgu

SEQ ID NO: 3217966 - RNA, 14 nt, Mycobacterium leprae
agccgaccgcccgg

SEQ ID NO: 3217967 - RNA, 21 nt, Mycobacterium leprae
agccgaccgcccgguagcacc

SEQ ID NO: 3217968 - RNA, 17 nt, Mycobacterium leprae
agccgacugacaacacu

SEQ ID NO: 3217969 - RNA, 22 nt, Mycobacterium leprae
agccgaggggccgucggcaacu

SEQ ID NO: 3217970 - RNA, 18 nt, Mycobacterium leprae
agccgagguucccggcgg

SEQ ID NO: 3217971 - RNA, 20 nt, Mycobacterium leprae
agccgaucggcugccgcgau

SEQ ID NO: 3217972 - RNA, 15 nt, Mycobacterium leprae
agccgauuagacaca

SEQ ID NO: 3217973 - RNA, 22 nt, Mycobacterium leprae
agccgccacgaccaaaccucug

SEQ ID NO: 3217974 - RNA, 18 nt, Mycobacterium leprae
agccgccagacuggccgg

SEQ ID NO: 3217975 - RNA, 23 nt, Mycobacterium leprae
agccgccagucgcagggcgcgca

SEQ ID NO: 3217976 - RNA, 14 nt, Mycobacterium leprae
agccgccgggucga

SEQ ID NO: 3217977 - RNA, 13 nt, Mycobacterium leprae
agcuggaaucccc

SEQ ID NO: 3217978 - RNA, 15 nt, Mycobacterium leprae
agcuggaauccccca

SEQ ID NO: 3217979 - RNA, 14 nt, Mycobacterium leprae
agcuggagguuguu

SEQ ID NO: 3217980 - RNA, 14 nt, Mycobacterium leprae
agcuggccggggcc

SEQ ID NO: 3217981 - RNA, 18 nt, Mycobacterium leprae
agcuggcggaugcgggcu

SEQ ID NO: 3217982 - RNA, 16 nt, Mycobacterium leprae
agcuggggcggccgcc

SEQ ID NO: 3217983 - RNA, 22 nt, Mycobacterium leprae
agcuggguaccgaugugcugga

SEQ ID NO: 3217984 - RNA, 20 nt, Mycobacterium leprae
agcuggucuucuuggcgcug

SEQ ID NO: 3217985 - RNA, 14 nt, Mycobacterium leprae
agcuguauaacaaa

SEQ ID NO: 3217986 - RNA, 16 nt, Mycobacterium leprae
agcugugccgacacca

SEQ ID NO: 3217987 - RNA, 18 nt, Mycobacterium leprae
agcugugccggaggcgaa

SEQ ID NO: 3217988 - RNA, 22 nt, Mycobacterium leprae
agcugugggguauugugcggac

SEQ ID NO: 3217989 - RNA, 18 nt, Mycobacterium leprae
agcugugucaaugacaag

SEQ ID NO: 3217990 - RNA, 19 nt, Mycobacterium leprae
agcugugucaaugacaagc

SEQ ID NO: 3217991 - RNA, 13 nt, Mycobacterium leprae
agcugugucgguc

SEQ ID NO: 3217992 - RNA, 23 nt, Mycobacterium leprae
agcuguucggguuggucguggca

SEQ ID NO: 3217993 - RNA, 13 nt, Mycobacterium leprae
agcuguugacugc

SEQ ID NO: 3217994 - RNA, 15 nt, Mycobacterium leprae
agcuguuucuguauu

SEQ ID NO: 3217995 - RNA, 14 nt, Mycobacterium leprae
agcuuagaaagcug

SEQ ID NO: 3217996 - RNA, 13 nt, Mycobacterium leprae
agcuuauacugcu

SEQ ID NO: 3217997 - RNA, 16 nt, Mycobacterium leprae
agcuuauacugcugcg

SEQ ID NO: 3217998 - RNA, 18 nt, Mycobacterium leprae
agcuucaaaccggccacc

SEQ ID NO: 3217999 - RNA, 21 nt, Mycobacterium leprae
agcuuccaaguggcugcgccg

SEQ ID NO: 3218000 - RNA, 23 nt, Mycobacterium leprae
agcuuccaaguggcugcgccgga

SEQ ID NO: 3218001 - RNA, 20 nt, Mycobacterium leprae
agcuuccauuucaaagcugc

SEQ ID NO: 3218002 - RNA, 16 nt, Mycobacterium leprae
agcuuccucgugugcu

SEQ ID NO: 3218003 - RNA, 16 nt, Mycobacterium leprae
agcuuccugcgguggu

SEQ ID NO: 3218004 - RNA, 19 nt, Mycobacterium leprae
agcuuccugcggugguggc

SEQ ID NO: 3218005 - RNA, 23 nt, Mycobacterium leprae
agcuucgcagacacagccgucag

SEQ ID NO: 3218006 - RNA, 20 nt, Mycobacterium leprae
agcuugggaaacugggucua

SEQ ID NO: 3218007 - RNA, 23 nt, Mycobacterium leprae
agcuugggaaacugggucuaaua

SEQ ID NO: 3218008 - RNA, 23 nt, Mycobacterium leprae
aggaaaauuagucgaggccagau

SEQ ID NO: 3218009 - RNA, 16 nt, Mycobacterium leprae
aggaacgacuugacca

SEQ ID NO: 3218010 - RNA, 13 nt, Mycobacterium leprae
aggaagauauccg

SEQ ID NO: 3218011 - RNA, 20 nt, Mycobacterium leprae
aggaagcucgguucggugac

SEQ ID NO: 3218012 - RNA, 12 nt, Mycobacterium leprae
aggaaugccugg

SEQ ID NO: 3218013 - RNA, 21 nt, Mycobacterium leprae
aggaaugguuguagcgccuga

SEQ ID NO: 3218014 - RNA, 17 nt, Mycobacterium leprae
aggaaugucucgguguc

SEQ ID NO: 3218015 - RNA, 14 nt, Mycobacterium leprae
aggacaacagagca

SEQ ID NO: 3218016 - RNA, 15 nt, Mycobacterium leprae
aggaccaaccgcgca

SEQ ID NO: 3218017 - RNA, 12 nt, Mycobacterium leprae
aggacgcacccu

SEQ ID NO: 3218018 - RNA, 20 nt, Mycobacterium leprae
aggacucggauccaucagac

SEQ ID NO: 3218019 - RNA, 14 nt, Mycobacterium leprae
aggagcgugggucg

SEQ ID NO: 3218020 - RNA, 14 nt, Mycobacterium leprae
aggaggugcuggau

SEQ ID NO: 3218021 - RNA, 20 nt, Mycobacterium leprae
aggaguaauaacugugcaua

SEQ ID NO: 3218022 - RNA, 18 nt, Mycobacterium leprae
aggaguucaacaaaacca

SEQ ID NO: 3218023 - RNA, 14 nt, Mycobacterium leprae
aggaucagcgcugc

SEQ ID NO: 3218024 - RNA, 19 nt, Mycobacterium leprae
aggaucgagcggagcuggg

SEQ ID NO: 3218025 - RNA, 17 nt, Mycobacterium leprae
aggaugcgugcccauau

SEQ ID NO: 3218026 - RNA, 20 nt, Mycobacterium leprae
aggauuugcuggcugccgcc

SEQ ID NO: 3218027 - RNA, 18 nt, Mycobacterium leprae
aggcacaacaucaccacg

SEQ ID NO: 3218028 - RNA, 15 nt, Mycobacterium leprae
aggcacagcccagua

SEQ ID NO: 3218029 - RNA, 16 nt, Mycobacterium leprae
aggcagagccaaacau

SEQ ID NO: 3218030 - RNA, 13 nt, Mycobacterium leprae
aggcagcagcucg

SEQ ID NO: 3218031 - RNA, 17 nt, Mycobacterium leprae
aggcagcccgcgccgcc

SEQ ID NO: 3218032 - RNA, 20 nt, Mycobacterium leprae
aggcaggacugauggccguc

SEQ ID NO: 3218033 - RNA, 15 nt, Mycobacterium leprae
aggcagggcugggga

SEQ ID NO: 3218034 - RNA, 14 nt, Mycobacterium leprae
aggcauaugagcau

SEQ ID NO: 3218035 - RNA, 17 nt, Mycobacterium leprae
aggcauaugagcaucga

SEQ ID NO: 3218036 - RNA, 22 nt, Mycobacterium leprae
aggcaugccgccgggugcagca

SEQ ID NO: 3218037 - RNA, 21 nt, Mycobacterium leprae
aggcaugggcauuggcgacaa

SEQ ID NO: 3218038 - RNA, 20 nt, Mycobacterium leprae
aggccaauccgcagucgguu

SEQ ID NO: 3218039 - RNA, 19 nt, Mycobacterium leprae
aggccaccguuggacacca

SEQ ID NO: 3218040 - RNA, 18 nt, Mycobacterium leprae
aggccaggauggugccau

SEQ ID NO: 3218041 - RNA, 19 nt, Mycobacterium leprae
aggccaugacaugcacacu

SEQ ID NO: 3218042 - RNA, 14 nt, Mycobacterium leprae
aggccgagugcagg

SEQ ID NO: 3218043 - RNA, 22 nt, Mycobacterium leprae
aggccgauuccggagacggcag

SEQ ID NO: 3218044 - RNA, 18 nt, Mycobacterium leprae
aggccgcccacguucaga

SEQ ID NO: 3218045 - RNA, 13 nt, Mycobacterium leprae
aggccggcaaggu

SEQ ID NO: 3218046 - RNA, 11 nt, Mycobacterium leprae
aggccuagcug

SEQ ID NO: 3218047 - RNA, 16 nt, Mycobacterium leprae
aggccuggucguucau

SEQ ID NO: 3218048 - RNA, 15 nt, Mycobacterium leprae
aggccuuaagcugca

SEQ ID NO: 3218049 - RNA, 16 nt, Mycobacterium leprae
aggccuuaagcugcau

SEQ ID NO: 3218050 - RNA, 16 nt, Mycobacterium leprae
aggcgaagagcggcac

SEQ ID NO: 3218051 - RNA, 19 nt, Mycobacterium leprae
aggcgaauugcuaccuggu

SEQ ID NO: 3218052 - RNA, 17 nt, Mycobacterium leprae
aggcgacgucacgcugc

SEQ ID NO: 3218053 - RNA, 23 nt, Mycobacterium leprae
aggcgcguuauugcugugucgcg

SEQ ID NO: 3218054 - RNA, 17 nt, Mycobacterium leprae
aggcggccggcacugag

SEQ ID NO: 3218055 - RNA, 21 nt, Mycobacterium leprae
aggcgguaggaaucaccggac

SEQ ID NO: 3218056 - RNA, 17 nt, Mycobacterium leprae
aggcggucauguagcua

SEQ ID NO: 3218057 - RNA, 13 nt, Mycobacterium leprae
aggcggugaucaa

SEQ ID NO: 3218058 - RNA, 22 nt, Mycobacterium leprae
aggcgguugcguaauggccggc

SEQ ID NO: 3218059 - RNA, 18 nt, Mycobacterium leprae
aggcgucaagcagcacca

SEQ ID NO: 3218060 - RNA, 15 nt, Mycobacterium leprae
aggcguccucauccc

SEQ ID NO: 3218061 - RNA, 18 nt, Mycobacterium leprae
aggcguuaucggaagcgu

SEQ ID NO: 3218062 - RNA, 17 nt, Mycobacterium leprae
aggcugcauccugcagc

SEQ ID NO: 3218063 - RNA, 22 nt, Mycobacterium leprae
aggcugccaacguccagugugu

SEQ ID NO: 3218064 - RNA, 22 nt, Mycobacterium leprae
aggcuguuguuaccggcgaaga

SEQ ID NO: 3218065 - RNA, 17 nt, Mycobacterium leprae
aggcuuagcuuccgggu

SEQ ID NO: 3218066 - RNA, 17 nt, Mycobacterium leprae
agggacgcaaaggccaa

SEQ ID NO: 3218067 - RNA, 16 nt, Mycobacterium leprae
agggagaaugccacag

SEQ ID NO: 3218068 - RNA, 19 nt, Mycobacterium leprae
agggagaaugccacaggcg

SEQ ID NO: 3218069 - RNA, 21 nt, Mycobacterium leprae
agggauccaagacaggcgcgg

SEQ ID NO: 3218070 - RNA, 15 nt, Mycobacterium leprae
agggauuccuguucu

SEQ ID NO: 3218071 - RNA, 15 nt, Mycobacterium leprae
agggcaauacgcugc

SEQ ID NO: 3218072 - RNA, 15 nt, Mycobacterium leprae
agggcacgugcggcg

SEQ ID NO: 3218073 - RNA, 19 nt, Mycobacterium leprae
agggcacgugcggcggccu

SEQ ID NO: 3218074 - RNA, 19 nt, Mycobacterium leprae
agggcaucgccgugguggc

SEQ ID NO: 3218075 - RNA, 14 nt, Mycobacterium leprae
agggcgagcugcgc

SEQ ID NO: 3218076 - RNA, 20 nt, Mycobacterium leprae
agggcgaguacguccgcgcc

SEQ ID NO: 3218077 - RNA, 19 nt, Mycobacterium leprae
agggcggcauucccaaccg

SEQ ID NO: 3218078 - RNA, 23 nt, Mycobacterium leprae
agggcggcauucccaaccgcgac

SEQ ID NO: 3218079 - RNA, 16 nt, Mycobacterium leprae
agggcguugucuugug

SEQ ID NO: 3218080 - RNA, 21 nt, Mycobacterium leprae
agggcugguggccgaggucga

SEQ ID NO: 3218081 - RNA, 13 nt, Mycobacterium leprae
aggggacuggaua

SEQ ID NO: 3218082 - RNA, 18 nt, Mycobacterium leprae
aggggagucgggcuuggc

SEQ ID NO: 3218083 - RNA, 22 nt, Mycobacterium leprae
aggggagucgggcuuggccucg

SEQ ID NO: 3218084 - RNA, 21 nt, Mycobacterium leprae
aggggaugcagguacuagcac

SEQ ID NO: 3218085 - RNA, 17 nt, Mycobacterium leprae
aggggccaacacgucac

SEQ ID NO: 3218086 - RNA, 22 nt, Mycobacterium leprae
aggggccaacacgucacgacuc

SEQ ID NO: 3218087 - RNA, 17 nt, Mycobacterium leprae
aggggcugggcaccugg

SEQ ID NO: 3218088 - RNA, 17 nt, Mycobacterium leprae
aggggucgaugaggcuc

SEQ ID NO: 3218089 - RNA, 18 nt, Mycobacterium leprae
agggguucgccgccggcg

SEQ ID NO: 3218090 - RNA, 18 nt, Mycobacterium leprae
agucuugaacucaucguc

SEQ ID NO: 3218091 - RNA, 19 nt, Mycobacterium leprae
agucuugaugccaaccugc

SEQ ID NO: 3218092 - RNA, 21 nt, Mycobacterium leprae
agucuugugcguagucgaccg

SEQ ID NO: 3218093 - RNA, 15 nt, Mycobacterium leprae
agugaaaguaggcac

SEQ ID NO: 3218094 - RNA, 19 nt, Mycobacterium leprae
agugaaccuauugucaggu

SEQ ID NO: 3218095 - RNA, 12 nt, Mycobacterium leprae
agugacgucgga

SEQ ID NO: 3218096 - RNA, 18 nt, Mycobacterium leprae
agugacuacgguuaauau

SEQ ID NO: 3218097 - RNA, 19 nt, Mycobacterium leprae
agugaguacaccacccaag

SEQ ID NO: 3218098 - RNA, 18 nt, Mycobacterium leprae
agugaucggcgacacaga

SEQ ID NO: 3218099 - RNA, 15 nt, Mycobacterium leprae
agugaucugcucggc

SEQ ID NO: 3218100 - RNA, 23 nt, Mycobacterium leprae
agugaugcggacgacgcugagag

SEQ ID NO: 3218101 - RNA, 18 nt, Mycobacterium leprae
agugcacagaauuugcca

SEQ ID NO: 3218102 - RNA, 15 nt, Mycobacterium leprae
agugcacugagcagu

SEQ ID NO: 3218103 - RNA, 12 nt, Mycobacterium leprae
agugcagagagu

SEQ ID NO: 3218104 - RNA, 21 nt, Mycobacterium leprae
agugcaguuccuucagacgcc

SEQ ID NO: 3218105 - RNA, 15 nt, Mycobacterium leprae
agugcaucgaugauc

SEQ ID NO: 3218106 - RNA, 23 nt, Mycobacterium leprae
agugccgaccuagcuucgaucca

SEQ ID NO: 3218107 - RNA, 14 nt, Mycobacterium leprae
agugccgcggucua

SEQ ID NO: 3218108 - RNA, 19 nt, Mycobacterium leprae
agugccguuggcccaccgc

SEQ ID NO: 3218109 - RNA, 13 nt, Mycobacterium leprae
agugcgaccugaa

SEQ ID NO: 3218110 - RNA, 15 nt, Mycobacterium leprae
agugcgccagcgaca

SEQ ID NO: 3218111 - RNA, 15 nt, Mycobacterium leprae
agugcuagcagcgcg

SEQ ID NO: 3218112 - RNA, 20 nt, Mycobacterium leprae
agugcuagcggcgccaggcg

SEQ ID NO: 3218113 - RNA, 14 nt, Mycobacterium leprae
agugcucggguggu

SEQ ID NO: 3218114 - RNA, 18 nt, Mycobacterium leprae
agugcuggucaacagugg

SEQ ID NO: 3218115 - RNA, 19 nt, Mycobacterium leprae
aguggacacuacagcguga

SEQ ID NO: 3218116 - RNA, 18 nt, Mycobacterium leprae
aguggaucuccuaagagg

SEQ ID NO: 3218117 - RNA, 19 nt, Mycobacterium leprae
aguggcaacugaagauuug

SEQ ID NO: 3218118 - RNA, 21 nt, Mycobacterium leprae
aguggccaauucggcgagcac

SEQ ID NO: 3218119 - RNA, 19 nt, Mycobacterium leprae
aguggcgacacuacuguug

SEQ ID NO: 3218120 - RNA, 14 nt, Mycobacterium leprae
aguggcgaguggcu

SEQ ID NO: 3218121 - RNA, 20 nt, Mycobacterium leprae
aguggcgggcuugaccugga

SEQ ID NO: 3218122 - RNA, 17 nt, Mycobacterium leprae
aguggcugcaccggcuc

SEQ ID NO: 3218123 - RNA, 21 nt, Mycobacterium leprae
aguggcuugucacgccggucg

SEQ ID NO: 3218124 - RNA, 17 nt, Mycobacterium leprae
agugguaauauccuccg

SEQ ID NO: 3218125 - RNA, 15 nt, Mycobacterium leprae
agugucaaucuacac

SEQ ID NO: 3218126 - RNA, 22 nt, Mycobacterium leprae
aguguccgcaaaaugcuccccc

SEQ ID NO: 3218127 - RNA, 17 nt, Mycobacterium leprae
agugucugggccgggcu

SEQ ID NO: 3218128 - RNA, 19 nt, Mycobacterium leprae
agugugagcccaaucuguu

SEQ ID NO: 3218129 - RNA, 23 nt, Mycobacterium leprae
aguguguuugguuuuguuguugu

SEQ ID NO: 3218130 - RNA, 17 nt, Mycobacterium leprae
aguguucaggccaucag

SEQ ID NO: 3218131 - RNA, 12 nt, Mycobacterium leprae
aguguucggaac

SEQ ID NO: 3218132 - RNA, 20 nt, Mycobacterium leprae
aguguucggcacccauccaa

SEQ ID NO: 3218133 - RNA, 23 nt, Mycobacterium leprae
aguuaagagaaguagagaaaaau

SEQ ID NO: 3218134 - RNA, 17 nt, Mycobacterium leprae
aguucaauggugccgag

SEQ ID NO: 3218135 - RNA, 12 nt, Mycobacterium leprae
aguucacgcugg

SEQ ID NO: 3218136 - RNA, 17 nt, Mycobacterium leprae
aguucacgcuggccgcc

SEQ ID NO: 3218137 - RNA, 16 nt, Mycobacterium leprae
aguucacggucaccgg

SEQ ID NO: 3218138 - RNA, 20 nt, Mycobacterium leprae
aguucauuccccuagaacag

SEQ ID NO: 3218139 - RNA, 15 nt, Mycobacterium leprae
aguuccgcgcugaau

SEQ ID NO: 3218140 - RNA, 17 nt, Mycobacterium leprae
aguuccuguguugccau

SEQ ID NO: 3218141 - RNA, 12 nt, Mycobacterium leprae
aguuccuucaga

SEQ ID NO: 3218142 - RNA, 16 nt, Mycobacterium leprae
aguucgacaccggcca

SEQ ID NO: 3218143 - RNA, 21 nt, Mycobacterium leprae
aguucggguaccggcaaacca

SEQ ID NO: 3218144 - RNA, 23 nt, Mycobacterium leprae
aguucgggugcguaaucgccggu

SEQ ID NO: 3218145 - RNA, 21 nt, Mycobacterium leprae
aguucgugcgcgcauuggcca

SEQ ID NO: 3218146 - RNA, 18 nt, Mycobacterium leprae
aguucguuccuggcuggc

SEQ ID NO: 3218147 - RNA, 22 nt, Mycobacterium leprae
aguucuugguuagguugguggu

SEQ ID NO: 3218148 - RNA, 19 nt, Mycobacterium leprae
aguugaccaggcaaugugu

SEQ ID NO: 3218149 - RNA, 20 nt, Mycobacterium leprae
aguugaguagcgccggggug

SEQ ID NO: 3218150 - RNA, 18 nt, Mycobacterium leprae
aguugcacaucagcaaag

SEQ ID NO: 3218151 - RNA, 15 nt, Mycobacterium leprae
aguugcauugucuac

SEQ ID NO: 3218152 - RNA, 18 nt, Mycobacterium leprae
aguuguacuggcgugcau

SEQ ID NO: 3218153 - RNA, 19 nt, Mycobacterium leprae
aguuguuaucgaggugagc

SEQ ID NO: 3218154 - RNA, 21 nt, Mycobacterium leprae
aguuguugacaaagcccacgc

SEQ ID NO: 3218155 - RNA, 16 nt, Mycobacterium leprae
aguuuaccgugguugc

SEQ ID NO: 3218156 - RNA, 15 nt, Mycobacterium leprae
aguuuagagugcagc

SEQ ID NO: 3218157 - RNA, 14 nt, Mycobacterium leprae
aguuuccgccucag

SEQ ID NO: 3218158 - RNA, 14 nt, Mycobacterium leprae
aguuuggcgcugcu

SEQ ID NO: 3218159 - RNA, 17 nt, Mycobacterium leprae
aguuugguuauugcucu

SEQ ID NO: 3218160 - RNA, 13 nt, Mycobacterium leprae
aguuuucgcggga

SEQ ID NO: 3218161 - RNA, 16 nt, Mycobacterium leprae
aguuuuucucacaccu

SEQ ID NO: 3218162 - RNA, 13 nt, Mycobacterium leprae
auaaaccggcaga

SEQ ID NO: 3218163 - RNA, 14 nt, Mycobacterium leprae
auaaagcuuagaaa

SEQ ID NO: 3218164 - RNA, 17 nt, Mycobacterium leprae
auaaagcuuagaaagcu

SEQ ID NO: 3218165 - RNA, 13 nt, Mycobacterium leprae
auaaaguguuaug

SEQ ID NO: 3218166 - RNA, 23 nt, Mycobacterium leprae
auaacccccaacugguugaagcg

SEQ ID NO: 3218167 - RNA, 16 nt, Mycobacterium leprae
auaacccgauaggggu

SEQ ID NO: 3218168 - RNA, 16 nt, Mycobacterium leprae
auaagaaguuguagcu

SEQ ID NO: 3218169 - RNA, 19 nt, Mycobacterium leprae
auaagcaaaaaauagcugc

SEQ ID NO: 3218170 - RNA, 13 nt, Mycobacterium leprae
auaagcagcagcg

SEQ ID NO: 3218171 - RNA, 13 nt, Mycobacterium leprae
auaagcgaagucc

SEQ ID NO: 3218172 - RNA, 22 nt, Mycobacterium leprae
auaagcuugggaaacugggucu

SEQ ID NO: 3218173 - RNA, 23 nt, Mycobacterium leprae
auaaggauuugcacgaauaucga

SEQ ID NO: 3218174 - RNA, 23 nt, Mycobacterium leprae
auaaggugcccgggaaacuagcg

SEQ ID NO: 3218175 - RNA, 17 nt, Mycobacterium leprae
auaaucccgcucugcgu

SEQ ID NO: 3218176 - RNA, 21 nt, Mycobacterium leprae
auaaugcacugcgaguaacua

SEQ ID NO: 3218177 - RNA, 18 nt, Mycobacterium leprae
auaaugccgguggccagc

SEQ ID NO: 3218178 - RNA, 19 nt, Mycobacterium leprae
auaaugucgaagggcuggu

SEQ ID NO: 3218179 - RNA, 21 nt, Mycobacterium leprae
auaauuuggcugauaauaucg

SEQ ID NO: 3218180 - RNA, 18 nt, Mycobacterium leprae
auacaacaauaaucccgc

SEQ ID NO: 3218181 - RNA, 16 nt, Mycobacterium leprae
auacaaguagguuguu

SEQ ID NO: 3218182 - RNA, 19 nt, Mycobacterium leprae
auacaaucgcggcacaugc

SEQ ID NO: 3218183 - RNA, 15 nt, Mycobacterium leprae
auacacggugcgugc

SEQ ID NO: 3218184 - RNA, 19 nt, Mycobacterium leprae
auacagagccacauuugac

SEQ ID NO: 3218185 - RNA, 18 nt, Mycobacterium leprae
auacagguggcaucagau

SEQ ID NO: 3218186 - RNA, 14 nt, Mycobacterium leprae
auaccgaacagugg

SEQ ID NO: 3218187 - RNA, 22 nt, Mycobacterium leprae
auaccgcccaguaaugugcuau

SEQ ID NO: 3218188 - RNA, 23 nt, Mycobacterium leprae
auaccuucuaaccggucaaucag

SEQ ID NO: 3218189 - RNA, 17 nt, Mycobacterium leprae
auacgccagucagucac

SEQ ID NO: 3218190 - RNA, 22 nt, Mycobacterium leprae
auacgcugauaaggucuggcac

SEQ ID NO: 3218191 - RNA, 22 nt, Mycobacterium leprae
auacguguuuguuauaguccgc

SEQ ID NO: 3218192 - RNA, 17 nt, Mycobacterium leprae
auacugaugugcugaga

SEQ ID NO: 3218193 - RNA, 19 nt, Mycobacterium leprae
auagaacaccgaagcugau

SEQ ID NO: 3218194 - RNA, 19 nt, Mycobacterium leprae
auagaacauccgcagcaug

SEQ ID NO: 3218195 - RNA, 15 nt, Mycobacterium leprae
auagauggagccacc

SEQ ID NO: 3218196 - RNA, 17 nt, Mycobacterium leprae
auagccgcgacaguccg

SEQ ID NO: 3218197 - RNA, 17 nt, Mycobacterium leprae
auagccgguggccaccg

SEQ ID NO: 3218198 - RNA, 17 nt, Mycobacterium leprae
auagccgugaccgacag

SEQ ID NO: 3218199 - RNA, 14 nt, Mycobacterium leprae
auagcgaaaauaac

SEQ ID NO: 3218200 - RNA, 16 nt, Mycobacterium leprae
auagcgcagacgucgu

SEQ ID NO: 3218201 - RNA, 18 nt, Mycobacterium leprae
auagcguuuaaguaacau

SEQ ID NO: 3218202 - RNA, 16 nt, Mycobacterium leprae
auagcuaaagugcugc

SEQ ID NO: 3218203 - RNA, 19 nt, Mycobacterium leprae
auccggaggcggccacgug

SEQ ID NO: 3218204 - RNA, 19 nt, Mycobacterium leprae
auccggcguuaaacgcgau

SEQ ID NO: 3218205 - RNA, 13 nt, Mycobacterium leprae
auccgggccaguc

SEQ ID NO: 3218206 - RNA, 15 nt, Mycobacterium leprae
auccgggcgcucagc

SEQ ID NO: 3218207 - RNA, 20 nt, Mycobacterium leprae
auccgguggcgacaguguug

SEQ ID NO: 3218208 - RNA, 14 nt, Mycobacterium leprae
auccgguguggagu

SEQ ID NO: 3218209 - RNA, 18 nt, Mycobacterium leprae
auccguacaccaaucagg

SEQ ID NO: 3218210 - RNA, 15 nt, Mycobacterium leprae
auccguggagagcau

SEQ ID NO: 3218211 - RNA, 21 nt, Mycobacterium leprae
auccguuccucuuaacaacuu

SEQ ID NO: 3218212 - RNA, 23 nt, Mycobacterium leprae
auccucacacucacgccugcauc

SEQ ID NO: 3218213 - RNA, 16 nt, Mycobacterium leprae
auccucgacccaccac

SEQ ID NO: 3218214 - RNA, 19 nt, Mycobacterium leprae
auccucgauggcgccgagu

SEQ ID NO: 3218215 - RNA, 13 nt, Mycobacterium leprae
auccucggacugc

SEQ ID NO: 3218216 - RNA, 18 nt, Mycobacterium leprae
auccucggcacagugacg

SEQ ID NO: 3218217 - RNA, 18 nt, Mycobacterium leprae
auccugagaugccagcca

SEQ ID NO: 3218218 - RNA, 21 nt, Mycobacterium leprae
auccugcagcaucaggguacu

SEQ ID NO: 3218219 - RNA, 18 nt, Mycobacterium leprae
aucgaaaggcguuaucgg

SEQ ID NO: 3218220 - RNA, 19 nt, Mycobacterium leprae
aucgaaccgacgaugcugu

SEQ ID NO: 3218221 - RNA, 22 nt, Mycobacterium leprae
aucgaacuuuuccaugcugccg

SEQ ID NO: 3218222 - RNA, 23 nt, Mycobacterium leprae
aucgaauugaccgacggcgccgc

SEQ ID NO: 3218223 - RNA, 20 nt, Mycobacterium leprae
aucgacacggcgaccgacug

SEQ ID NO: 3218224 - RNA, 21 nt, Mycobacterium leprae
aucgacaggcaaccgcccgca

SEQ ID NO: 3218225 - RNA, 17 nt, Mycobacterium leprae
aucgacaucccagcaac

SEQ ID NO: 3218226 - RNA, 13 nt, Mycobacterium leprae
aucgacauccuga

SEQ ID NO: 3218227 - RNA, 20 nt, Mycobacterium leprae
aucgaccagccaagccgcca

SEQ ID NO: 3218228 - RNA, 16 nt, Mycobacterium leprae
aucgaccagccacgca

SEQ ID NO: 3218229 - RNA, 19 nt, Mycobacterium leprae
aucgacccguuguucggca

SEQ ID NO: 3218230 - RNA, 13 nt, Mycobacterium leprae
aucgaccucgaau

SEQ ID NO: 3218231 - RNA, 17 nt, Mycobacterium leprae
aucgacgcagcaacugu

SEQ ID NO: 3218232 - RNA, 19 nt, Mycobacterium leprae
aucgacgccgucuccgccg

SEQ ID NO: 3218233 - RNA, 14 nt, Mycobacterium leprae
aucgacggcuggca

SEQ ID NO: 3218234 - RNA, 17 nt, Mycobacterium leprae
aucgacggcuggcagca

SEQ ID NO: 3218235 - RNA, 15 nt, Mycobacterium leprae
aucgacguccacaua

SEQ ID NO: 3218236 - RNA, 19 nt, Mycobacterium leprae
aucgacguuugcaggugcu

SEQ ID NO: 3218237 - RNA, 22 nt, Mycobacterium leprae
aucgacuacuagaaggcggcuu

SEQ ID NO: 3218238 - RNA, 21 nt, Mycobacterium leprae
aucgacuccgcaagaugcccg

SEQ ID NO: 3218239 - RNA, 18 nt, Mycobacterium leprae
aucgagaagggagugcag

SEQ ID NO: 3218240 - RNA, 21 nt, Mycobacterium leprae
aucgagaagggagugcagugc

SEQ ID NO: 3218241 - RNA, 17 nt, Mycobacterium leprae
aucgaggccagccugcg

SEQ ID NO: 3218242 - RNA, 18 nt, Mycobacterium leprae
aucgaucucgacggcagu

SEQ ID NO: 3218243 - RNA, 21 nt, Mycobacterium leprae
aucgaugccguggugaugcgg

SEQ ID NO: 3218244 - RNA, 17 nt, Mycobacterium leprae
aucgauguggccgcacg

SEQ ID NO: 3218245 - RNA, 23 nt, Mycobacterium leprae
aucgcaaaacaacguaccuaagc

SEQ ID NO: 3218246 - RNA, 21 nt, Mycobacterium leprae
aucgcaacccuuuugcccaau

SEQ ID NO: 3218247 - RNA, 17 nt, Mycobacterium leprae
aucgcacacagcggcca

SEQ ID NO: 3218248 - RNA, 16 nt, Mycobacterium leprae
aucgcaccgauccggc

SEQ ID NO: 3218249 - RNA, 17 nt, Mycobacterium leprae
aucgcaccggcugcacc

SEQ ID NO: 3218250 - RNA, 19 nt, Mycobacterium leprae
aucgcagccgcaaggucac

SEQ ID NO: 3218251 - RNA, 15 nt, Mycobacterium leprae
aucgcagugcguauu

SEQ ID NO: 3218252 - RNA, 19 nt, Mycobacterium leprae
aucgcagugcguauucggc

SEQ ID NO: 3218253 - RNA, 14 nt, Mycobacterium leprae
aucgcauucgugag

SEQ ID NO: 3218254 - RNA, 17 nt, Mycobacterium leprae
aucgcauucgugagccu

SEQ ID NO: 3218255 - RNA, 21 nt, Mycobacterium leprae
aucgccaacccgggagucgac

SEQ ID NO: 3218256 - RNA, 13 nt, Mycobacterium leprae
aucgcccaccgca

SEQ ID NO: 3218257 - RNA, 18 nt, Mycobacterium leprae
aucgccugugucgagcug

SEQ ID NO: 3218258 - RNA, 14 nt, Mycobacterium leprae
aucgccuucagcac

SEQ ID NO: 3218259 - RNA, 20 nt, Mycobacterium leprae
aucgccuucagcacagccca

SEQ ID NO: 3218260 - RNA, 19 nt, Mycobacterium leprae
aucgcguugacagccgucc

SEQ ID NO: 3218261 - RNA, 18 nt, Mycobacterium leprae
aucgcuaagacucaccaa

SEQ ID NO: 3218262 - RNA, 18 nt, Mycobacterium leprae
aucgcuacccuugagcac

SEQ ID NO: 3218263 - RNA, 19 nt, Mycobacterium leprae
aucgcuacccuugagcacc

SEQ ID NO: 3218264 - RNA, 15 nt, Mycobacterium leprae
aucgcugauguccaa

SEQ ID NO: 3218265 - RNA, 21 nt, Mycobacterium leprae
aucgcuucgguuagcaucgac

SEQ ID NO: 3218266 - RNA, 20 nt, Mycobacterium leprae
aucgcuugagacaucgucgc

SEQ ID NO: 3218267 - RNA, 22 nt, Mycobacterium leprae
aucggaagcguuguaaggucac

SEQ ID NO: 3218268 - RNA, 17 nt, Mycobacterium leprae
aucggaaucgccgcgac

SEQ ID NO: 3218269 - RNA, 17 nt, Mycobacterium leprae
aucggcacuucgcugag

SEQ ID NO: 3218270 - RNA, 11 nt, Mycobacterium leprae
aucggccucac

SEQ ID NO: 3218271 - RNA, 13 nt, Mycobacterium leprae
aucggcggccagc

SEQ ID NO: 3218272 - RNA, 16 nt, Mycobacterium leprae
aucggcgugcacggcg

SEQ ID NO: 3218273 - RNA, 23 nt, Mycobacterium leprae
aucggcucccaucggcggccagc

SEQ ID NO: 3218274 - RNA, 23 nt, Mycobacterium leprae
aucggggcgauguuauguagcug

SEQ ID NO: 3218275 - RNA, 12 nt, Mycobacterium leprae
aucgggguccgc

SEQ ID NO: 3218276 - RNA, 17 nt, Mycobacterium leprae
aucggguaaagccgcgc

SEQ ID NO: 3218277 - RNA, 19 nt, Mycobacterium leprae
aucgguaccagcggcagcg

SEQ ID NO: 3218278 - RNA, 14 nt, Mycobacterium leprae
aucgguccuugacc

SEQ ID NO: 3218279 - RNA, 18 nt, Mycobacterium leprae
aucgguggauuaggcgug

SEQ ID NO: 3218280 - RNA, 23 nt, Mycobacterium leprae
aucggugucggcggcuuguugac

SEQ ID NO: 3218281 - RNA, 15 nt, Mycobacterium leprae
aucguaggucgcccg

SEQ ID NO: 3218282 - RNA, 20 nt, Mycobacterium leprae
aucguauagcacacgaccgu

SEQ ID NO: 3218283 - RNA, 12 nt, Mycobacterium leprae
aucgucagauuc

SEQ ID NO: 3218284 - RNA, 14 nt, Mycobacterium leprae
aucgucagauucau

SEQ ID NO: 3218285 - RNA, 15 nt, Mycobacterium leprae
aucgucagucggccu

SEQ ID NO: 3218286 - RNA, 13 nt, Mycobacterium leprae
aucguccgcaacc

SEQ ID NO: 3218287 - RNA, 23 nt, Mycobacterium leprae
aucgucggccggagagucgggcu

SEQ ID NO: 3218288 - RNA, 15 nt, Mycobacterium leprae
aucgucuucgcagcc

SEQ ID NO: 3218289 - RNA, 20 nt, Mycobacterium leprae
aucgugaagauaggucgccg

SEQ ID NO: 3218290 - RNA, 18 nt, Mycobacterium leprae
aucgugaaucagaugacc

SEQ ID NO: 3218291 - RNA, 16 nt, Mycobacterium leprae
aucgugaggugugacc

SEQ ID NO: 3218292 - RNA, 20 nt, Mycobacterium leprae
aucgugcgugagaucaccag

SEQ ID NO: 3218293 - RNA, 22 nt, Mycobacterium leprae
aucguggcagcuguauaacaaa

SEQ ID NO: 3218294 - RNA, 19 nt, Mycobacterium leprae
aucguguccacugcggcaa

SEQ ID NO: 3218295 - RNA, 23 nt, Mycobacterium leprae
aucguguccacugcggcaaagca

SEQ ID NO: 3218296 - RNA, 18 nt, Mycobacterium leprae
aucguguuagugaacagu

SEQ ID NO: 3218297 - RNA, 15 nt, Mycobacterium leprae
aucguguuccacugu

SEQ ID NO: 3218298 - RNA, 20 nt, Mycobacterium leprae
aucguuaaaaugcuggagcg

SEQ ID NO: 3218299 - RNA, 15 nt, Mycobacterium leprae
aucguuucaggugag

SEQ ID NO: 3218300 - RNA, 17 nt, Mycobacterium leprae
aucuaacccgcaaacca

SEQ ID NO: 3218301 - RNA, 21 nt, Mycobacterium leprae
aucuacacuagggaggucacc

SEQ ID NO: 3218302 - RNA, 22 nt, Mycobacterium leprae
aucuacacuagggaggucacca

SEQ ID NO: 3218303 - RNA, 21 nt, Mycobacterium leprae
aucuacccuuuuugucacuga

SEQ ID NO: 3218304 - RNA, 13 nt, Mycobacterium leprae
aucuacuggaugc

SEQ ID NO: 3218305 - RNA, 16 nt, Mycobacterium leprae
aucuagcguaaggacc

SEQ ID NO: 3218306 - RNA, 16 nt, Mycobacterium leprae
aucuauaguugaucau

SEQ ID NO: 3218307 - RNA, 13 nt, Mycobacterium leprae
aucuaugguuuug

SEQ ID NO: 3218308 - RNA, 18 nt, Mycobacterium leprae
aucucacgcccgacgaac

SEQ ID NO: 3218309 - RNA, 14 nt, Mycobacterium leprae
aucuccgacuggcu

SEQ ID NO: 3218310 - RNA, 19 nt, Mycobacterium leprae
aucucgaccgcgcgcuccg

SEQ ID NO: 3218311 - RNA, 21 nt, Mycobacterium leprae
aucucgaugucggacaaugag

SEQ ID NO: 3218312 - RNA, 13 nt, Mycobacterium leprae
aucucggcgcgcu

SEQ ID NO: 3218313 - RNA, 19 nt, Mycobacterium leprae
aucucgggcagcugcaaca

SEQ ID NO: 3218314 - RNA, 21 nt, Mycobacterium leprae
aucugaugacgcgacgccggc

SEQ ID NO: 3218315 - RNA, 15 nt, Mycobacterium leprae
auggaguuggugucu

SEQ ID NO: 3218316 - RNA, 20 nt, Mycobacterium leprae
auggauauucgauggcuggg

SEQ ID NO: 3218317 - RNA, 22 nt, Mycobacterium leprae
auggaucaguuugccgucggga

SEQ ID NO: 3218318 - RNA, 16 nt, Mycobacterium leprae
auggcacggcgacaag

SEQ ID NO: 3218319 - RNA, 15 nt, Mycobacterium leprae
auggcacugccgauc

SEQ ID NO: 3218320 - RNA, 21 nt, Mycobacterium leprae
auggcauccaacacgccgauc

SEQ ID NO: 3218321 - RNA, 15 nt, Mycobacterium leprae
auggcauugaucgcu

SEQ ID NO: 3218322 - RNA, 21 nt, Mycobacterium leprae
auggccagccgucccacgcca

SEQ ID NO: 3218323 - RNA, 14 nt, Mycobacterium leprae
auggccgaccaaau

SEQ ID NO: 3218324 - RNA, 17 nt, Mycobacterium leprae
auggccgccaggucagc

SEQ ID NO: 3218325 - RNA, 18 nt, Mycobacterium leprae
auggcgcgguacaaucag

SEQ ID NO: 3218326 - RNA, 16 nt, Mycobacterium leprae
auggcggaggcugggc

SEQ ID NO: 3218327 - RNA, 15 nt, Mycobacterium leprae
auggcggcagcgcca

SEQ ID NO: 3218328 - RNA, 15 nt, Mycobacterium leprae
auggcgggcuggagg

SEQ ID NO: 3218329 - RNA, 16 nt, Mycobacterium leprae
auggcguuuguuauug

SEQ ID NO: 3218330 - RNA, 16 nt, Mycobacterium leprae
auggcuaagcuaggcg

SEQ ID NO: 3218331 - RNA, 20 nt, Mycobacterium leprae
auggcuccauagaacaccga

SEQ ID NO: 3218332 - RNA, 23 nt, Mycobacterium leprae
auggcugcaacgacuggaugacc

SEQ ID NO: 3218333 - RNA, 14 nt, Mycobacterium leprae
auggcugccgggcg

SEQ ID NO: 3218334 - RNA, 20 nt, Mycobacterium leprae
augggcauuggcgacaaaga

SEQ ID NO: 3218335 - RNA, 12 nt, Mycobacterium leprae
auggggguggga

SEQ ID NO: 3218336 - RNA, 20 nt, Mycobacterium leprae
augguagugcacacggccgu

SEQ ID NO: 3218337 - RNA, 20 nt, Mycobacterium leprae
auggucauuggaaaggggcc

SEQ ID NO: 3218338 - RNA, 15 nt, Mycobacterium leprae
auggucauuggaagc

SEQ ID NO: 3218339 - RNA, 18 nt, Mycobacterium leprae
augguccaacgugguugg

SEQ ID NO: 3218340 - RNA, 16 nt, Mycobacterium leprae
augguccacccgcgcg

SEQ ID NO: 3218341 - RNA, 15 nt, Mycobacterium leprae
augguccuggcugcg

SEQ ID NO: 3218342 - RNA, 19 nt, Mycobacterium leprae
auggugcaagggauaacau

SEQ ID NO: 3218343 - RNA, 17 nt, Mycobacterium leprae
auggugccauugguggg

SEQ ID NO: 3218344 - RNA, 18 nt, Mycobacterium leprae
auggugccauugguggga

SEQ ID NO: 3218345 - RNA, 19 nt, Mycobacterium leprae
auggugccauuggugggau

SEQ ID NO: 3218346 - RNA, 21 nt, Mycobacterium leprae
auggugccauuggugggauga

SEQ ID NO: 3218347 - RNA, 16 nt, Mycobacterium leprae
auggugcggcgaucau

SEQ ID NO: 3218348 - RNA, 11 nt, Mycobacterium leprae
augguggugcc

SEQ ID NO: 3218349 - RNA, 22 nt, Mycobacterium leprae
auggugugcaguaacaucacgc

SEQ ID NO: 3218350 - RNA, 19 nt, Mycobacterium leprae
auguaaccggggaccucau

SEQ ID NO: 3218351 - RNA, 13 nt, Mycobacterium leprae
auguaacuguuga

SEQ ID NO: 3218352 - RNA, 17 nt, Mycobacterium leprae
auguaaucguaccaaca

SEQ ID NO: 3218353 - RNA, 22 nt, Mycobacterium leprae
auguacaacaccagaucagcag

SEQ ID NO: 3218354 - RNA, 12 nt, Mycobacterium leprae
auguagcccuuc

SEQ ID NO: 3218355 - RNA, 16 nt, Mycobacterium leprae
augucacuucccaccg

SEQ ID NO: 3218356 - RNA, 14 nt, Mycobacterium leprae
augucaugaacgua

SEQ ID NO: 3218357 - RNA, 14 nt, Mycobacterium leprae
augucgaucggcag

SEQ ID NO: 3218358 - RNA, 20 nt, Mycobacterium leprae
augucgcagagguaaaucug

SEQ ID NO: 3218359 - RNA, 20 nt, Mycobacterium leprae
augucgccgggugcgcugcu

SEQ ID NO: 3218360 - RNA, 21 nt, Mycobacterium leprae
augucgcgauggggggcagca

SEQ ID NO: 3218361 - RNA, 16 nt, Mycobacterium leprae
augucggacaaugagu

SEQ ID NO: 3218362 - RNA, 15 nt, Mycobacterium leprae
augugcagcagcucg

SEQ ID NO: 3218363 - RNA, 16 nt, Mycobacterium leprae
augugcagugcgguga

SEQ ID NO: 3218364 - RNA, 22 nt, Mycobacterium leprae
augugccacgucgaucagcggc

SEQ ID NO: 3218365 - RNA, 19 nt, Mycobacterium leprae
augugcgcacuggguggau

SEQ ID NO: 3218366 - RNA, 17 nt, Mycobacterium leprae
augugcuguggaucagg

SEQ ID NO: 3218367 - RNA, 14 nt, Mycobacterium leprae
auguggcuuuggga

SEQ ID NO: 3218368 - RNA, 15 nt, Mycobacterium leprae
augugggcuuuccuu

SEQ ID NO: 3218369 - RNA, 20 nt, Mycobacterium leprae
augugguugucggaccacuc

SEQ ID NO: 3218370 - RNA, 19 nt, Mycobacterium leprae
augugugcaggaccgugcu

SEQ ID NO: 3218371 - RNA, 21 nt, Mycobacterium leprae
auguuaauuuauuugguguuu

SEQ ID NO: 3218372 - RNA, 17 nt, Mycobacterium leprae
auguuacaucacaggau

SEQ ID NO: 3218373 - RNA, 17 nt, Mycobacterium leprae
auguuauuuauagaugc

SEQ ID NO: 3218374 - RNA, 21 nt, Mycobacterium leprae
auguuccuauguuggucugcu

SEQ ID NO: 3218375 - RNA, 22 nt, Mycobacterium leprae
auguucuguuguggggguggag

SEQ ID NO: 3218376 - RNA, 14 nt, Mycobacterium leprae
auguuggccagcag

SEQ ID NO: 3218377 - RNA, 17 nt, Mycobacterium leprae
auguuguuagugcugcu

SEQ ID NO: 3218378 - RNA, 18 nt, Mycobacterium leprae
auguuguuagugcugcug

SEQ ID NO: 3218379 - RNA, 15 nt, Mycobacterium leprae
auguuguucaacaac

SEQ ID NO: 3218380 - RNA, 20 nt, Mycobacterium leprae
auguuguugguaugagcauu

SEQ ID NO: 3218381 - RNA, 17 nt, Mycobacterium leprae
auguuuggcuguuggga

SEQ ID NO: 3218382 - RNA, 20 nt, Mycobacterium leprae
auuaaguagcaagccgccag

SEQ ID NO: 3218383 - RNA, 16 nt, Mycobacterium leprae
auuaaguuuucucuaa

SEQ ID NO: 3218384 - RNA, 13 nt, Mycobacterium leprae
auuaauauauaua

SEQ ID NO: 3218385 - RNA, 16 nt, Mycobacterium leprae
auuaauucuucucuaa

SEQ ID NO: 3218386 - RNA, 18 nt, Mycobacterium leprae
auuacccgcugaugcugc

SEQ ID NO: 3218387 - RNA, 18 nt, Mycobacterium leprae
auuacgacgacucagugg

SEQ ID NO: 3218388 - RNA, 22 nt, Mycobacterium leprae
auuacuacgcuagcaagucgcu

SEQ ID NO: 3218389 - RNA, 17 nt, Mycobacterium leprae
auuacugacuuggccuu

SEQ ID NO: 3218390 - RNA, 14 nt, Mycobacterium leprae
auuagcucuucucg

SEQ ID NO: 3218391 - RNA, 23 nt, Mycobacterium leprae
auuagggauugacuaauauguuc

SEQ ID NO: 3218392 - RNA, 16 nt, Mycobacterium leprae
auuagucuagauaaga

SEQ ID NO: 3218393 - RNA, 13 nt, Mycobacterium leprae
auuaguguggagu

SEQ ID NO: 3218394 - RNA, 23 nt, Mycobacterium leprae
auuaucgccggcuugaaauuacu

SEQ ID NO: 3218395 - RNA, 12 nt, Mycobacterium leprae
auuauugacaua

SEQ ID NO: 3218396 - RNA, 14 nt, Mycobacterium leprae
auucaaccagccaa

SEQ ID NO: 3218397 - RNA, 16 nt, Mycobacterium leprae
auucacccuuucggga

SEQ ID NO: 3218398 - RNA, 14 nt, Mycobacterium leprae
auucaccgaucgac

SEQ ID NO: 3218399 - RNA, 16 nt, Mycobacterium leprae
auucaccgaucgacaa

SEQ ID NO: 3218400 - RNA, 15 nt, Mycobacterium leprae
auucacgaacaacag

SEQ ID NO: 3218401 - RNA, 16 nt, Mycobacterium leprae
auucacgaacaacaga

SEQ ID NO: 3218402 - RNA, 20 nt, Mycobacterium leprae
auucagaauucuauaucuau

SEQ ID NO: 3218403 - RNA, 18 nt, Mycobacterium leprae
auucagagcugcagguca

SEQ ID NO: 3218404 - RNA, 22 nt, Mycobacterium leprae
auucagagcugcaggucaggau

SEQ ID NO: 3218405 - RNA, 17 nt, Mycobacterium leprae
auucagccgugcccaag

SEQ ID NO: 3218406 - RNA, 15 nt, Mycobacterium leprae
auucaggaaaauacu

SEQ ID NO: 3218407 - RNA, 14 nt, Mycobacterium leprae
auucaggaugcugu

SEQ ID NO: 3218408 - RNA, 19 nt, Mycobacterium leprae
auucaugaaaaucgccgac

SEQ ID NO: 3218409 - RNA, 20 nt, Mycobacterium leprae
auucauuuucguaucaaaac

SEQ ID NO: 3218410 - RNA, 22 nt, Mycobacterium leprae
auucauuuucguaucaaaacua

SEQ ID NO: 3218411 - RNA, 22 nt, Mycobacterium leprae
auuccgguaacacgucuagcga

SEQ ID NO: 3218412 - RNA, 13 nt, Mycobacterium leprae
auuccgugugacg

SEQ ID NO: 3218413 - RNA, 17 nt, Mycobacterium leprae
auuccugcagccgaucg

SEQ ID NO: 3218414 - RNA, 12 nt, Mycobacterium leprae
auucgacaccaa

SEQ ID NO: 3218415 - RNA, 12 nt, Mycobacterium leprae
auucgcaaagcg

SEQ ID NO: 3218416 - RNA, 13 nt, Mycobacterium leprae
auucgcaccugau

SEQ ID NO: 3218417 - RNA, 18 nt, Mycobacterium leprae
auucgcaccugauguuau

SEQ ID NO: 3218418 - RNA, 21 nt, Mycobacterium leprae
auucgccgacucgcgauccca

SEQ ID NO: 3218419 - RNA, 22 nt, Mycobacterium leprae
auucgccggacacaaccagcuu

SEQ ID NO: 3218420 - RNA, 16 nt, Mycobacterium leprae
auucgcgauccaucag

SEQ ID NO: 3218421 - RNA, 21 nt, Mycobacterium leprae
auucgcucgccgggguauagu

SEQ ID NO: 3218422 - RNA, 17 nt, Mycobacterium leprae
auucgguggcgaucggc

SEQ ID NO: 3218423 - RNA, 15 nt, Mycobacterium leprae
auucgguuuccucau

SEQ ID NO: 3218424 - RNA, 22 nt, Mycobacterium leprae
auucgucgaguaaugcagguga

SEQ ID NO: 3218425 - RNA, 13 nt, Mycobacterium leprae
auucgugguggug

SEQ ID NO: 3218426 - RNA, 15 nt, Mycobacterium leprae
auucguggugguggc

SEQ ID NO: 3218427 - RNA, 22 nt, Mycobacterium leprae
auucguugggagccgcgcgcau

SEQ ID NO: 3218428 - RNA, 20 nt, Mycobacterium leprae
caaacuacuguugucagugg

SEQ ID NO: 3218429 - RNA, 14 nt, Mycobacterium leprae
caaacugcugcgca

SEQ ID NO: 3218430 - RNA, 16 nt, Mycobacterium leprae
caaacugcugcgcaag

SEQ ID NO: 3218431 - RNA, 15 nt, Mycobacterium leprae
caaacuuccucugcc

SEQ ID NO: 3218432 - RNA, 16 nt, Mycobacterium leprae
caaacuuccucugcca

SEQ ID NO: 3218433 - RNA, 19 nt, Mycobacterium leprae
caaacuugguuaauaucaa

SEQ ID NO: 3218434 - RNA, 16 nt, Mycobacterium leprae
caaagacgacaacaga

SEQ ID NO: 3218435 - RNA, 19 nt, Mycobacterium leprae
caaagacgacaacagagca

SEQ ID NO: 3218436 - RNA, 13 nt, Mycobacterium leprae
caaagcagcauau

SEQ ID NO: 3218437 - RNA, 16 nt, Mycobacterium leprae
caaagcuagccaccaa

SEQ ID NO: 3218438 - RNA, 19 nt, Mycobacterium leprae
caaagcuagccaccaagua

SEQ ID NO: 3218439 - RNA, 15 nt, Mycobacterium leprae
caaagcucaggccgu

SEQ ID NO: 3218440 - RNA, 19 nt, Mycobacterium leprae
caaagcuggcgaacaacaa

SEQ ID NO: 3218441 - RNA, 20 nt, Mycobacterium leprae
caaaggccaauccagccgag

SEQ ID NO: 3218442 - RNA, 13 nt, Mycobacterium leprae
caaaggucgacac

SEQ ID NO: 3218443 - RNA, 18 nt, Mycobacterium leprae
caaaggugcccaccaugu

SEQ ID NO: 3218444 - RNA, 20 nt, Mycobacterium leprae
caaaguuagcggagaccccc

SEQ ID NO: 3218445 - RNA, 15 nt, Mycobacterium leprae
caaauacuucaccaa

SEQ ID NO: 3218446 - RNA, 15 nt, Mycobacterium leprae
caaaucaccagcgac

SEQ ID NO: 3218447 - RNA, 16 nt, Mycobacterium leprae
caaaucagcaccaucc

SEQ ID NO: 3218448 - RNA, 19 nt, Mycobacterium leprae
caaaucauagugaccaaaa

SEQ ID NO: 3218449 - RNA, 14 nt, Mycobacterium leprae
caaaugcuaugaua

SEQ ID NO: 3218450 - RNA, 17 nt, Mycobacterium leprae
caaauugccgagcuggu

SEQ ID NO: 3218451 - RNA, 23 nt, Mycobacterium leprae
caaauuuuccggcuguuacucag

SEQ ID NO: 3218452 - RNA, 16 nt, Mycobacterium leprae
caacaagagaagagcu

SEQ ID NO: 3218453 - RNA, 13 nt, Mycobacterium leprae
caacaagccgccg

SEQ ID NO: 3218454 - RNA, 14 nt, Mycobacterium leprae
caacaccgcggcga

SEQ ID NO: 3218455 - RNA, 14 nt, Mycobacterium leprae
caacaccucaagca

SEQ ID NO: 3218456 - RNA, 13 nt, Mycobacterium leprae
caacacgaucgca

SEQ ID NO: 3218457 - RNA, 20 nt, Mycobacterium leprae
caacacgaucgcagcccaga

SEQ ID NO: 3218458 - RNA, 22 nt, Mycobacterium leprae
caacacgaucgcagcccagauu

SEQ ID NO: 3218459 - RNA, 14 nt, Mycobacterium leprae
caacacguuucugc

SEQ ID NO: 3218460 - RNA, 14 nt, Mycobacterium leprae
caacagccacaccc

SEQ ID NO: 3218461 - RNA, 11 nt, Mycobacterium leprae
caacagcggac

SEQ ID NO: 3218462 - RNA, 20 nt, Mycobacterium leprae
caacagcggacguacagugg

SEQ ID NO: 3218463 - RNA, 21 nt, Mycobacterium leprae
caacagcuugacaucagucag

SEQ ID NO: 3218464 - RNA, 20 nt, Mycobacterium leprae
caacaggaugcgugcccaua

SEQ ID NO: 3218465 - RNA, 20 nt, Mycobacterium leprae
caacauuguaaucagcccaa

SEQ ID NO: 3218466 - RNA, 16 nt, Mycobacterium leprae
caaccagacccacagc

SEQ ID NO: 3218467 - RNA, 12 nt, Mycobacterium leprae
caaccagccaau

SEQ ID NO: 3218468 - RNA, 18 nt, Mycobacterium leprae
caaccagccaaucuuuac

SEQ ID NO: 3218469 - RNA, 13 nt, Mycobacterium leprae
caaccagccccuc

SEQ ID NO: 3218470 - RNA, 18 nt, Mycobacterium leprae
caaccaugccgcgcgccu

SEQ ID NO: 3218471 - RNA, 16 nt, Mycobacterium leprae
caaccccacgucgccg

SEQ ID NO: 3218472 - RNA, 19 nt, Mycobacterium leprae
caaccccgugccgucccua

SEQ ID NO: 3218473 - RNA, 20 nt, Mycobacterium leprae
caacccggccgaucgugugc

SEQ ID NO: 3218474 - RNA, 21 nt, Mycobacterium leprae
caacccguugucaagcacugc

SEQ ID NO: 3218475 - RNA, 22 nt, Mycobacterium leprae
caacccguugucaagcacugca

SEQ ID NO: 3218476 - RNA, 20 nt, Mycobacterium leprae
caaccgaugcagggccagcc

SEQ ID NO: 3218477 - RNA, 21 nt, Mycobacterium leprae
caaccgaugcagggccagccc

SEQ ID NO: 3218478 - RNA, 14 nt, Mycobacterium leprae
caaccgccggcaag

SEQ ID NO: 3218479 - RNA, 14 nt, Mycobacterium leprae
caaccggccggccc

SEQ ID NO: 3218480 - RNA, 15 nt, Mycobacterium leprae
caaccguccccgugg

SEQ ID NO: 3218481 - RNA, 23 nt, Mycobacterium leprae
caaccguucgagccccggaacgg

SEQ ID NO: 3218482 - RNA, 22 nt, Mycobacterium leprae
caaccugcgcggcugccgcacc

SEQ ID NO: 3218483 - RNA, 14 nt, Mycobacterium leprae
caaccuggaggcca

SEQ ID NO: 3218484 - RNA, 14 nt, Mycobacterium leprae
caacgaacagcggg

SEQ ID NO: 3218485 - RNA, 13 nt, Mycobacterium leprae
caacgaccagcgc

SEQ ID NO: 3218486 - RNA, 13 nt, Mycobacterium leprae
caacgacuggaug

SEQ ID NO: 3218487 - RNA, 14 nt, Mycobacterium leprae
caacgacuggauga

SEQ ID NO: 3218488 - RNA, 21 nt, Mycobacterium leprae
caacgcaccgcguaacagauu

SEQ ID NO: 3218489 - RNA, 14 nt, Mycobacterium leprae
caacgccuccacug

SEQ ID NO: 3218490 - RNA, 13 nt, Mycobacterium leprae
caacgcggcggcg

SEQ ID NO: 3218491 - RNA, 22 nt, Mycobacterium leprae
caacgcucaacuguucggcuau

SEQ ID NO: 3218492 - RNA, 19 nt, Mycobacterium leprae
caacgcugcaaggugggcg

SEQ ID NO: 3218493 - RNA, 21 nt, Mycobacterium leprae
caacgcugcaaggugggcgau

SEQ ID NO: 3218494 - RNA, 15 nt, Mycobacterium leprae
caacggcgccgacaa

SEQ ID NO: 3218495 - RNA, 17 nt, Mycobacterium leprae
caacggcgccgacaacg

SEQ ID NO: 3218496 - RNA, 15 nt, Mycobacterium leprae
caacggcggcaaggu

SEQ ID NO: 3218497 - RNA, 17 nt, Mycobacterium leprae
caacggcguggucggcg

SEQ ID NO: 3218498 - RNA, 20 nt, Mycobacterium leprae
caacggcuacggggugggca

SEQ ID NO: 3218499 - RNA, 16 nt, Mycobacterium leprae
caacgggaacagcggc

SEQ ID NO: 3218500 - RNA, 16 nt, Mycobacterium leprae
caacgggacugacgga

SEQ ID NO: 3218501 - RNA, 14 nt, Mycobacterium leprae
caacgggaucgaca

SEQ ID NO: 3218502 - RNA, 15 nt, Mycobacterium leprae
caacgggugucugaa

SEQ ID NO: 3218503 - RNA, 21 nt, Mycobacterium leprae
caacgggugucugaacuggug

SEQ ID NO: 3218504 - RNA, 20 nt, Mycobacterium leprae
caacggucgcucggacuggg

SEQ ID NO: 3218505 - RNA, 20 nt, Mycobacterium leprae
caacgguuacugccacaacg

SEQ ID NO: 3218506 - RNA, 21 nt, Mycobacterium leprae
caacguagggaugaucgaucc

SEQ ID NO: 3218507 - RNA, 16 nt, Mycobacterium leprae
caacgucacgucgacg

SEQ ID NO: 3218508 - RNA, 17 nt, Mycobacterium leprae
caacgucacgucgacgg

SEQ ID NO: 3218509 - RNA, 18 nt, Mycobacterium leprae
caacgugauggacgaccu

SEQ ID NO: 3218510 - RNA, 14 nt, Mycobacterium leprae
caacgugcaguccu

SEQ ID NO: 3218511 - RNA, 21 nt, Mycobacterium leprae
caacgugggcgauucgggccg

SEQ ID NO: 3218512 - RNA, 17 nt, Mycobacterium leprae
caacguugaagcggggg

SEQ ID NO: 3218513 - RNA, 13 nt, Mycobacterium leprae
caacguugcugcu

SEQ ID NO: 3218514 - RNA, 14 nt, Mycobacterium leprae
caacuaggagcgca

SEQ ID NO: 3218515 - RNA, 15 nt, Mycobacterium leprae
caacuauccucacac

SEQ ID NO: 3218516 - RNA, 14 nt, Mycobacterium leprae
caacucggccgcca

SEQ ID NO: 3218517 - RNA, 16 nt, Mycobacterium leprae
caacugaguagcggcg

SEQ ID NO: 3218518 - RNA, 14 nt, Mycobacterium leprae
caacugcuggaggg

SEQ ID NO: 3218519 - RNA, 16 nt, Mycobacterium leprae
caacuguuagaucuug

SEQ ID NO: 3218520 - RNA, 13 nt, Mycobacterium leprae
caacuguugcuug

SEQ ID NO: 3218521 - RNA, 17 nt, Mycobacterium leprae
caacuugacgaugcugu

SEQ ID NO: 3218522 - RNA, 17 nt, Mycobacterium leprae
caagacaggcgcggucg

SEQ ID NO: 3218523 - RNA, 17 nt, Mycobacterium leprae
caagacgcuuucgagca

SEQ ID NO: 3218524 - RNA, 17 nt, Mycobacterium leprae
caagacguugugacagu

SEQ ID NO: 3218525 - RNA, 13 nt, Mycobacterium leprae
caagacugcaccc

SEQ ID NO: 3218526 - RNA, 22 nt, Mycobacterium leprae
caagacugcguguucaucaucu

SEQ ID NO: 3218527 - RNA, 18 nt, Mycobacterium leprae
caagagccacggcaaugu

SEQ ID NO: 3218528 - RNA, 21 nt, Mycobacterium leprae
caagagugaaaguaggcacag

SEQ ID NO: 3218529 - RNA, 18 nt, Mycobacterium leprae
caagauacuccgcgaaau

SEQ ID NO: 3218530 - RNA, 14 nt, Mycobacterium leprae
caagaucgaggcca

SEQ ID NO: 3218531 - RNA, 21 nt, Mycobacterium leprae
caagaucggccagccguggcu

SEQ ID NO: 3218532 - RNA, 17 nt, Mycobacterium leprae
caagauggcgucaccgu

SEQ ID NO: 3218533 - RNA, 21 nt, Mycobacterium leprae
caagauugcagcccugagcac

SEQ ID NO: 3218534 - RNA, 23 nt, Mycobacterium leprae
caagauugcagcccugagcacca

SEQ ID NO: 3218535 - RNA, 14 nt, Mycobacterium leprae
caagcaacugcagc

SEQ ID NO: 3218536 - RNA, 17 nt, Mycobacterium leprae
caagcacacugcggcug

SEQ ID NO: 3218537 - RNA, 13 nt, Mycobacterium leprae
caagcacugcagu

SEQ ID NO: 3218538 - RNA, 14 nt, Mycobacterium leprae
caagcacuucgcga

SEQ ID NO: 3218539 - RNA, 20 nt, Mycobacterium leprae
caagcagaucgacagcggcc

SEQ ID NO: 3218540 - RNA, 14 nt, Mycobacterium leprae
caagcagcaccaca

SEQ ID NO: 3218541 - RNA, 15 nt, Mycobacterium leprae
caagcagcaccacag

SEQ ID NO: 3218542 - RNA, 18 nt, Mycobacterium leprae
cacaggaauuuagaggcu

SEQ ID NO: 3218543 - RNA, 22 nt, Mycobacterium leprae
cacaggaauuuagaggcugcac

SEQ ID NO: 3218544 - RNA, 20 nt, Mycobacterium leprae
cacaggacuucaaauaccaa

SEQ ID NO: 3218545 - RNA, 24 nt, Mycobacterium leprae
cacaguuaccacgacguagcccac

SEQ ID NO: 3218546 - RNA, 15 nt, Mycobacterium leprae
cacaguuguuggccu

SEQ ID NO: 3218547 - RNA, 15 nt, Mycobacterium leprae
cacauacgcucugau

SEQ ID NO: 3218548 - RNA, 15 nt, Mycobacterium leprae
cacauaugccgccau

SEQ ID NO: 3218549 - RNA, 23 nt, Mycobacterium leprae
cacauaugccgccauguuaaaca

SEQ ID NO: 3218550 - RNA, 18 nt, Mycobacterium leprae
cacaucaguaucagugcc

SEQ ID NO: 3218551 - RNA, 13 nt, Mycobacterium leprae
cacauccgauuug

SEQ ID NO: 3218552 - RNA, 22 nt, Mycobacterium leprae
cacaucucaacauggaccaccg

SEQ ID NO: 3218553 - RNA, 21 nt, Mycobacterium leprae
cacaugcaacuaugcggcggg

SEQ ID NO: 3218554 - RNA, 19 nt, Mycobacterium leprae
cacaugucccggugcugcc

SEQ ID NO: 3218555 - RNA, 16 nt, Mycobacterium leprae
cacauucaaccagcca

SEQ ID NO: 3218556 - RNA, 17 nt, Mycobacterium leprae
cacauugaccacgccga

SEQ ID NO: 3218557 - RNA, 21 nt, Mycobacterium leprae
cacauugaccacgccgacacc

SEQ ID NO: 3218558 - RNA, 12 nt, Mycobacterium leprae
caccaaaggcgc

SEQ ID NO: 3218559 - RNA, 22 nt, Mycobacterium leprae
caccaagauugcggacaauuca

SEQ ID NO: 3218560 - RNA, 20 nt, Mycobacterium leprae
caccaaucagaucacguugg

SEQ ID NO: 3218561 - RNA, 13 nt, Mycobacterium leprae
caccaaucaggcc

SEQ ID NO: 3218562 - RNA, 14 nt, Mycobacterium leprae
caccaauccagcca

SEQ ID NO: 3218563 - RNA, 13 nt, Mycobacterium leprae
caccaccaccccu

SEQ ID NO: 3218564 - RNA, 20 nt, Mycobacterium leprae
caccaccaugcggcgccuga

SEQ ID NO: 3218565 - RNA, 21 nt, Mycobacterium leprae
caccacccaagauagcgcaga

SEQ ID NO: 3218566 - RNA, 18 nt, Mycobacterium leprae
caccaccgacaugcuuac

SEQ ID NO: 3218567 - RNA, 12 nt, Mycobacterium leprae
caccaccgccac

SEQ ID NO: 3218568 - RNA, 18 nt, Mycobacterium leprae
caccacucucaucgcggc

SEQ ID NO: 3218569 - RNA, 16 nt, Mycobacterium leprae
caccagaaguggucga

SEQ ID NO: 3218570 - RNA, 16 nt, Mycobacterium leprae
caccagagacaccugu

SEQ ID NO: 3218571 - RNA, 20 nt, Mycobacterium leprae
caccagauggcuccccgagc

SEQ ID NO: 3218572 - RNA, 16 nt, Mycobacterium leprae
caccagcgacuggcug

SEQ ID NO: 3218573 - RNA, 11 nt, Mycobacterium leprae
caccagcucac

SEQ ID NO: 3218574 - RNA, 19 nt, Mycobacterium leprae
caccagggauuccuguucu

SEQ ID NO: 3218575 - RNA, 13 nt, Mycobacterium leprae
caccagucgcgca

SEQ ID NO: 3218576 - RNA, 17 nt, Mycobacterium leprae
caccaguggcucgccgc

SEQ ID NO: 3218577 - RNA, 13 nt, Mycobacterium leprae
caccauaccgacg

SEQ ID NO: 3218578 - RNA, 14 nt, Mycobacterium leprae
caccauaccgacga

SEQ ID NO: 3218579 - RNA, 16 nt, Mycobacterium leprae
caccauagcacccuca

SEQ ID NO: 3218580 - RNA, 14 nt, Mycobacterium leprae
caccauccacaacg

SEQ ID NO: 3218581 - RNA, 17 nt, Mycobacterium leprae
caccauccacaacguca

SEQ ID NO: 3218582 - RNA, 13 nt, Mycobacterium leprae
caccaucugcucu

SEQ ID NO: 3218583 - RNA, 22 nt, Mycobacterium leprae
caccaucuuugacauccggugu

SEQ ID NO: 3218584 - RNA, 15 nt, Mycobacterium leprae
caccauggugaacaa

SEQ ID NO: 3218585 - RNA, 20 nt, Mycobacterium leprae
caccauggugcggcgccgcc

SEQ ID NO: 3218586 - RNA, 23 nt, Mycobacterium leprae
caccauggugcggcgccgcccgg

SEQ ID NO: 3218587 - RNA, 15 nt, Mycobacterium leprae
caccaugugcacagu

SEQ ID NO: 3218588 - RNA, 17 nt, Mycobacterium leprae
caccauuuccggaacaa

SEQ ID NO: 3218589 - RNA, 19 nt, Mycobacterium leprae
caccauuuccggaacaaca

SEQ ID NO: 3218590 - RNA, 17 nt, Mycobacterium leprae
caccauuucugccgcug

SEQ ID NO: 3218591 - RNA, 18 nt, Mycobacterium leprae
caccauuucugccgcugg

SEQ ID NO: 3218592 - RNA, 20 nt, Mycobacterium leprae
cacccaaggauucagccaag

SEQ ID NO: 3218593 - RNA, 17 nt, Mycobacterium leprae
cacccaagggcuuccaa

SEQ ID NO: 3218594 - RNA, 15 nt, Mycobacterium leprae
cacccacaacgccaa

SEQ ID NO: 3218595 - RNA, 18 nt, Mycobacterium leprae
cacccacgcugcgcggcu

SEQ ID NO: 3218596 - RNA, 15 nt, Mycobacterium leprae
cacccaggacuacgc

SEQ ID NO: 3218597 - RNA, 13 nt, Mycobacterium leprae
cacccccgggauc

SEQ ID NO: 3218598 - RNA, 22 nt, Mycobacterium leprae
caccccgcggaguuggccgcgg

SEQ ID NO: 3218599 - RNA, 18 nt, Mycobacterium leprae
caccccgggcacagcggu

SEQ ID NO: 3218600 - RNA, 23 nt, Mycobacterium leprae
caccccuacccaaaucagcacca

SEQ ID NO: 3218601 - RNA, 14 nt, Mycobacterium leprae
cacccgcagcaccu

SEQ ID NO: 3218602 - RNA, 21 nt, Mycobacterium leprae
cacccgcaugcccugggccag

SEQ ID NO: 3218603 - RNA, 14 nt, Mycobacterium leprae
cacccgcgaggccu

SEQ ID NO: 3218604 - RNA, 21 nt, Mycobacterium leprae
cacccgcgauagcuugcaguu

SEQ ID NO: 3218605 - RNA, 23 nt, Mycobacterium leprae
cacccggcggcaugccugcuugc

SEQ ID NO: 3218606 - RNA, 15 nt, Mycobacterium leprae
cacccucacccgacc

SEQ ID NO: 3218607 - RNA, 13 nt, Mycobacterium leprae
cacccuccucgcg

SEQ ID NO: 3218608 - RNA, 15 nt, Mycobacterium leprae
caccgaacagcucga

SEQ ID NO: 3218609 - RNA, 21 nt, Mycobacterium leprae
caccgaacagcucgacagcag

SEQ ID NO: 3218610 - RNA, 13 nt, Mycobacterium leprae
caccgaacccaga

SEQ ID NO: 3218611 - RNA, 12 nt, Mycobacterium leprae
caccgaacuguc

SEQ ID NO: 3218612 - RNA, 23 nt, Mycobacterium leprae
caccgaagcugaugacaguaagu

SEQ ID NO: 3218613 - RNA, 20 nt, Mycobacterium leprae
caccgacaaagcucaggccg

SEQ ID NO: 3218614 - RNA, 22 nt, Mycobacterium leprae
caccgacggaugcccagccagg

SEQ ID NO: 3218615 - RNA, 16 nt, Mycobacterium leprae
caccgagacgggugcu

SEQ ID NO: 3218616 - RNA, 22 nt, Mycobacterium leprae
caccgagcgaccugacccgacg

SEQ ID NO: 3218617 - RNA, 13 nt, Mycobacterium leprae
caccgaucacggu

SEQ ID NO: 3218618 - RNA, 22 nt, Mycobacterium leprae
caccgaucgcccgcccaacuag

SEQ ID NO: 3218619 - RNA, 18 nt, Mycobacterium leprae
caccgaugugcucgguca

SEQ ID NO: 3218620 - RNA, 15 nt, Mycobacterium leprae
caccgauuccggugg

SEQ ID NO: 3218621 - RNA, 16 nt, Mycobacterium leprae
caccgcaacgccucca

SEQ ID NO: 3218622 - RNA, 17 nt, Mycobacterium leprae
caccgcaacgccuccac

SEQ ID NO: 3218623 - RNA, 13 nt, Mycobacterium leprae
caccgcaaucgaa

SEQ ID NO: 3218624 - RNA, 13 nt, Mycobacterium leprae
caccgccaccacg

SEQ ID NO: 3218625 - RNA, 14 nt, Mycobacterium leprae
caccgccaccuagg

SEQ ID NO: 3218626 - RNA, 19 nt, Mycobacterium leprae
caccgccgagcgcaccaac

SEQ ID NO: 3218627 - RNA, 20 nt, Mycobacterium leprae
caccgccgagcgcaccaacu

SEQ ID NO: 3218628 - RNA, 17 nt, Mycobacterium leprae
caccgccggcgucaggc

SEQ ID NO: 3218629 - RNA, 15 nt, Mycobacterium leprae
caccgcgaagccguu

SEQ ID NO: 3218630 - RNA, 20 nt, Mycobacterium leprae
caccgcgaagcugaccacuc

SEQ ID NO: 3218631 - RNA, 21 nt, Mycobacterium leprae
caccgcggcggguagucggcg

SEQ ID NO: 3218632 - RNA, 17 nt, Mycobacterium leprae
caccgcuucagagugca

SEQ ID NO: 3218633 - RNA, 15 nt, Mycobacterium leprae
caccggaaagcugaa

SEQ ID NO: 3218634 - RNA, 14 nt, Mycobacterium leprae
caccggacagcggc

SEQ ID NO: 3218635 - RNA, 17 nt, Mycobacterium leprae
caccggccaaaagccuu

SEQ ID NO: 3218636 - RNA, 13 nt, Mycobacterium leprae
caccggccaccgg

SEQ ID NO: 3218637 - RNA, 22 nt, Mycobacterium leprae
caccggcgcuuguaaggccagc

SEQ ID NO: 3218638 - RNA, 23 nt, Mycobacterium leprae
caccggcgcuuguaaggccagca

SEQ ID NO: 3218639 - RNA, 18 nt, Mycobacterium leprae
caccggcggcgagcaagc

SEQ ID NO: 3218640 - RNA, 21 nt, Mycobacterium leprae
caccggcggugucggcuacca

SEQ ID NO: 3218641 - RNA, 20 nt, Mycobacterium leprae
caccgguugccgaaccucgc

SEQ ID NO: 3218642 - RNA, 21 nt, Mycobacterium leprae
caccgguugccgaaccucgcc

SEQ ID NO: 3218643 - RNA, 18 nt, Mycobacterium leprae
caccguaagucagaugga

SEQ ID NO: 3218644 - RNA, 22 nt, Mycobacterium leprae
caccguaagucagauggaacaa

SEQ ID NO: 3218645 - RNA, 16 nt, Mycobacterium leprae
caccguccucggcggc

SEQ ID NO: 3218646 - RNA, 17 nt, Mycobacterium leprae
caccguccucggcggca

SEQ ID NO: 3218647 - RNA, 19 nt, Mycobacterium leprae
caccguggcaacgaccacc

SEQ ID NO: 3218648 - RNA, 14 nt, Mycobacterium leprae
caccguggucacgg

SEQ ID NO: 3218649 - RNA, 13 nt, Mycobacterium leprae
caccgugucgucu

SEQ ID NO: 3218650 - RNA, 16 nt, Mycobacterium leprae
caccguuguggaucga

SEQ ID NO: 3218651 - RNA, 18 nt, Mycobacterium leprae
caccguuguggaucgacc

SEQ ID NO: 3218652 - RNA, 23 nt, Mycobacterium leprae
caccuaguugguugccaagauac

SEQ ID NO: 3218653 - RNA, 16 nt, Mycobacterium leprae
caccucagcaacuucu

SEQ ID NO: 3218654 - RNA, 22 nt, Mycobacterium leprae
caccuccccgcccaaggcucca

SEQ ID NO: 3218655 - RNA, 13 nt, Mycobacterium leprae
cagaacaccccgc

SEQ ID NO: 3218656 - RNA, 18 nt, Mycobacterium leprae
cagaacaccccgcggagu

SEQ ID NO: 3218657 - RNA, 14 nt, Mycobacterium leprae
cagaagaccgugcu

SEQ ID NO: 3218658 - RNA, 22 nt, Mycobacterium leprae
cagaagcuguugugaagcugag

SEQ ID NO: 3218659 - RNA, 17 nt, Mycobacterium leprae
cagaaggggcugcggcu

SEQ ID NO: 3218660 - RNA, 22 nt, Mycobacterium leprae
cagaauauugcgacauccaaag

SEQ ID NO: 3218661 - RNA, 23 nt, Mycobacterium leprae
cagaauauugcgacauccaaagg

SEQ ID NO: 3218662 - RNA, 21 nt, Mycobacterium leprae
cagaaucgucggcuaacucga

SEQ ID NO: 3218663 - RNA, 15 nt, Mycobacterium leprae
cagaauuuucggcgg

SEQ ID NO: 3218664 - RNA, 15 nt, Mycobacterium leprae
cagacaccacugcca

SEQ ID NO: 3218665 - RNA, 17 nt, Mycobacterium leprae
cagacagcaagacgggg

SEQ ID NO: 3218666 - RNA, 17 nt, Mycobacterium leprae
cagacauggcuguaucu

SEQ ID NO: 3218667 - RNA, 15 nt, Mycobacterium leprae
cagacccacagcugc

SEQ ID NO: 3218668 - RNA, 14 nt, Mycobacterium leprae
cagacccagcuaga

SEQ ID NO: 3218669 - RNA, 17 nt, Mycobacterium leprae
cagacccgggacuuuag

SEQ ID NO: 3218670 - RNA, 22 nt, Mycobacterium leprae
cagaccgcuaugcggacggaca

SEQ ID NO: 3218671 - RNA, 14 nt, Mycobacterium leprae
cagaccggcgaucu

SEQ ID NO: 3218672 - RNA, 20 nt, Mycobacterium leprae
cagaccucuuccgccgcuac

SEQ ID NO: 3218673 - RNA, 20 nt, Mycobacterium leprae
cagacgagcucucagucgaa

SEQ ID NO: 3218674 - RNA, 14 nt, Mycobacterium leprae
cagacgauccacug

SEQ ID NO: 3218675 - RNA, 15 nt, Mycobacterium leprae
cagacgucgucguca

SEQ ID NO: 3218676 - RNA, 18 nt, Mycobacterium leprae
cagacgucgucgucaucg

SEQ ID NO: 3218677 - RNA, 21 nt, Mycobacterium leprae
cagacgucgucgucaucguug

SEQ ID NO: 3218678 - RNA, 15 nt, Mycobacterium leprae
cagacucagaaaucg

SEQ ID NO: 3218679 - RNA, 15 nt, Mycobacterium leprae
cagacucgagucccg

SEQ ID NO: 3218680 - RNA, 16 nt, Mycobacterium leprae
cagagacgguguugcu

SEQ ID NO: 3218681 - RNA, 18 nt, Mycobacterium leprae
cagagacgguguugcuga

SEQ ID NO: 3218682 - RNA, 14 nt, Mycobacterium leprae
cagagcccagcacg

SEQ ID NO: 3218683 - RNA, 17 nt, Mycobacterium leprae
cagagcccagcacgcgc

SEQ ID NO: 3218684 - RNA, 21 nt, Mycobacterium leprae
cagagccggcauagaauccgu

SEQ ID NO: 3218685 - RNA, 14 nt, Mycobacterium leprae
cagagccggcgggu

SEQ ID NO: 3218686 - RNA, 22 nt, Mycobacterium leprae
cagagcgcucggcgugcggaua

SEQ ID NO: 3218687 - RNA, 19 nt, Mycobacterium leprae
cagagcgcugugauuggcu

SEQ ID NO: 3218688 - RNA, 19 nt, Mycobacterium leprae
cagagcugauggccgccag

SEQ ID NO: 3218689 - RNA, 17 nt, Mycobacterium leprae
cagagguaaaucuggca

SEQ ID NO: 3218690 - RNA, 19 nt, Mycobacterium leprae
cagagguaaaucuggcaag

SEQ ID NO: 3218691 - RNA, 20 nt, Mycobacterium leprae
cagagucaaauucaaccgga

SEQ ID NO: 3218692 - RNA, 14 nt, Mycobacterium leprae
cagagugcaccacu

SEQ ID NO: 3218693 - RNA, 22 nt, Mycobacterium leprae
cagagugcaccacuguaucuug

SEQ ID NO: 3218694 - RNA, 16 nt, Mycobacterium leprae
cagaguguguguggca

SEQ ID NO: 3218695 - RNA, 23 nt, Mycobacterium leprae
cagauaccgggcucggugaaaau

SEQ ID NO: 3218696 - RNA, 12 nt, Mycobacterium leprae
cagaucaaccaa

SEQ ID NO: 3218697 - RNA, 13 nt, Mycobacterium leprae
cagauccagcauc

SEQ ID NO: 3218698 - RNA, 14 nt, Mycobacterium leprae
cagauccgguggcg

SEQ ID NO: 3218699 - RNA, 19 nt, Mycobacterium leprae
cagauccugggcggcuagu

SEQ ID NO: 3218700 - RNA, 18 nt, Mycobacterium leprae
cagaucgacuccgcaaga

SEQ ID NO: 3218701 - RNA, 19 nt, Mycobacterium leprae
cagaucgacuccgcaagau

SEQ ID NO: 3218702 - RNA, 15 nt, Mycobacterium leprae
cagaucgcgucgcau

SEQ ID NO: 3218703 - RNA, 12 nt, Mycobacterium leprae
cagauggaacaa

SEQ ID NO: 3218704 - RNA, 21 nt, Mycobacterium leprae
cagauggcuccccgagccgcu

SEQ ID NO: 3218705 - RNA, 14 nt, Mycobacterium leprae
cagauguccuucaa

SEQ ID NO: 3218706 - RNA, 16 nt, Mycobacterium leprae
cagauguugcagcagu

SEQ ID NO: 3218707 - RNA, 23 nt, Mycobacterium leprae
cagauucccgcugagcaauuucu

SEQ ID NO: 3218708 - RNA, 17 nt, Mycobacterium leprae
cagauugcaguccacca

SEQ ID NO: 3218709 - RNA, 18 nt, Mycobacterium leprae
cagauugcaguccaccag

SEQ ID NO: 3218710 - RNA, 21 nt, Mycobacterium leprae
cagauugcgugaccgcgccga

SEQ ID NO: 3218711 - RNA, 12 nt, Mycobacterium leprae
cagauuggaaau

SEQ ID NO: 3218712 - RNA, 14 nt, Mycobacterium leprae
cagcaacagccaca

SEQ ID NO: 3218713 - RNA, 22 nt, Mycobacterium leprae
cagcaacuguuuggugccgauc

SEQ ID NO: 3218714 - RNA, 22 nt, Mycobacterium leprae
cagcaaggcuuggccagcaagu

SEQ ID NO: 3218715 - RNA, 18 nt, Mycobacterium leprae
cagcaaucugcgucaucg

SEQ ID NO: 3218716 - RNA, 21 nt, Mycobacterium leprae
cagcaaucugcgucaucgacu

SEQ ID NO: 3218717 - RNA, 11 nt, Mycobacterium leprae
cagcaccacug

SEQ ID NO: 3218718 - RNA, 11 nt, Mycobacterium leprae
cagcaccaucc

SEQ ID NO: 3218719 - RNA, 19 nt, Mycobacterium leprae
cagcaccauccggcgggcg

SEQ ID NO: 3218720 - RNA, 15 nt, Mycobacterium leprae
cagcaccauggaaca

SEQ ID NO: 3218721 - RNA, 18 nt, Mycobacterium leprae
cagcaccauucuggucga

SEQ ID NO: 3218722 - RNA, 13 nt, Mycobacterium leprae
cagcacccagcuc

SEQ ID NO: 3218723 - RNA, 17 nt, Mycobacterium leprae
cagcacccccggccagg

SEQ ID NO: 3218724 - RNA, 10 nt, Mycobacterium leprae
cagcacccgc

SEQ ID NO: 3218725 - RNA, 18 nt, Mycobacterium leprae
cagcacccgcuugucuuu

SEQ ID NO: 3218726 - RNA, 19 nt, Mycobacterium leprae
cagcacccgcuugucuuug

SEQ ID NO: 3218727 - RNA, 12 nt, Mycobacterium leprae
cagcaccggcau

SEQ ID NO: 3218728 - RNA, 20 nt, Mycobacterium leprae
cagcaccucgaaucagcauc

SEQ ID NO: 3218729 - RNA, 16 nt, Mycobacterium leprae
cagcaccugccgcagc

SEQ ID NO: 3218730 - RNA, 17 nt, Mycobacterium leprae
cagcaccuugggcgccu

SEQ ID NO: 3218731 - RNA, 13 nt, Mycobacterium leprae
cagcacgauggcc

SEQ ID NO: 3218732 - RNA, 16 nt, Mycobacterium leprae
cagcacgauggccggu

SEQ ID NO: 3218733 - RNA, 14 nt, Mycobacterium leprae
cagcacgcgcgaca

SEQ ID NO: 3218734 - RNA, 14 nt, Mycobacterium leprae
cagcacguaaccca

SEQ ID NO: 3218735 - RNA, 17 nt, Mycobacterium leprae
cagcacuugcaguuugg

SEQ ID NO: 3218736 - RNA, 21 nt, Mycobacterium leprae
cagcagaaauuuuucggacgg

SEQ ID NO: 3218737 - RNA, 15 nt, Mycobacterium leprae
cagcagccacugaga

SEQ ID NO: 3218738 - RNA, 17 nt, Mycobacterium leprae
cagcagcgggaccaaga

SEQ ID NO: 3218739 - RNA, 22 nt, Mycobacterium leprae
cagcaggaaucccagcagcugg

SEQ ID NO: 3218740 - RNA, 18 nt, Mycobacterium leprae
cagcaggcgaguggcgag

SEQ ID NO: 3218741 - RNA, 19 nt, Mycobacterium leprae
cagcaguggucggcgaagg

SEQ ID NO: 3218742 - RNA, 19 nt, Mycobacterium leprae
cagcauaacccgaucaccu

SEQ ID NO: 3218743 - RNA, 17 nt, Mycobacterium leprae
cagcauagucgguggug

SEQ ID NO: 3218744 - RNA, 13 nt, Mycobacterium leprae
cagcaucaacgcg

SEQ ID NO: 3218745 - RNA, 18 nt, Mycobacterium leprae
cagcaucagacagagccg

SEQ ID NO: 3218746 - RNA, 17 nt, Mycobacterium leprae
cagcauccaccaccgac

SEQ ID NO: 3218747 - RNA, 12 nt, Mycobacterium leprae
cagcauccgccg

SEQ ID NO: 3218748 - RNA, 18 nt, Mycobacterium leprae
cagcauccgccgacgaug

SEQ ID NO: 3218749 - RNA, 20 nt, Mycobacterium leprae
cagcauccgccgacgaugcg

SEQ ID NO: 3218750 - RNA, 18 nt, Mycobacterium leprae
cagcauccucggcacagu

SEQ ID NO: 3218751 - RNA, 15 nt, Mycobacterium leprae
cagcaucgacagcac

SEQ ID NO: 3218752 - RNA, 17 nt, Mycobacterium leprae
cagcaucgacagcaccc

SEQ ID NO: 3218753 - RNA, 18 nt, Mycobacterium leprae
cagcaucgacagcaccca

SEQ ID NO: 3218754 - RNA, 21 nt, Mycobacterium leprae
cagcaucgcgucuuccaaacu

SEQ ID NO: 3218755 - RNA, 21 nt, Mycobacterium leprae
cagcaucggcaucccagugug

SEQ ID NO: 3218756 - RNA, 22 nt, Mycobacterium leprae
cagcaucguauagcacacgacc

SEQ ID NO: 3218757 - RNA, 13 nt, Mycobacterium leprae
cagcaugcccaga

SEQ ID NO: 3218758 - RNA, 21 nt, Mycobacterium leprae
cagcauggacgaauccugaga

SEQ ID NO: 3218759 - RNA, 20 nt, Mycobacterium leprae
cagcauggcgaugcgcagcc

SEQ ID NO: 3218760 - RNA, 17 nt, Mycobacterium leprae
cagcaugguggccacga

SEQ ID NO: 3218761 - RNA, 14 nt, Mycobacterium leprae
cagcaugucggcca

SEQ ID NO: 3218762 - RNA, 19 nt, Mycobacterium leprae
cagccaacaccaccagugg

SEQ ID NO: 3218763 - RNA, 22 nt, Mycobacterium leprae
cagccaacaccaccaguggcuc

SEQ ID NO: 3218764 - RNA, 12 nt, Mycobacterium leprae
cagccaagccgc

SEQ ID NO: 3218765 - RNA, 15 nt, Mycobacterium leprae
cagccaagccgccag

SEQ ID NO: 3218766 - RNA, 23 nt, Mycobacterium leprae
cagccaaucguguaucgucgcaa

SEQ ID NO: 3218767 - RNA, 22 nt, Mycobacterium leprae
cagccaaucuuuacgcgcgccu

SEQ ID NO: 3218768 - RNA, 16 nt, Mycobacterium leprae
caggcacguugaugaa

SEQ ID NO: 3218769 - RNA, 17 nt, Mycobacterium leprae
caggcagcgccugcccc

SEQ ID NO: 3218770 - RNA, 16 nt, Mycobacterium leprae
caggcagcugugcacg

SEQ ID NO: 3218771 - RNA, 19 nt, Mycobacterium leprae
caggccaccggugaugugg

SEQ ID NO: 3218772 - RNA, 15 nt, Mycobacterium leprae
caggccgagugcagg

SEQ ID NO: 3218773 - RNA, 16 nt, Mycobacterium leprae
caggccgagugcagga

SEQ ID NO: 3218774 - RNA, 23 nt, Mycobacterium leprae
caggccugcuauccgcggugugu

SEQ ID NO: 3218775 - RNA, 18 nt, Mycobacterium leprae
caggcgacacgcgcgaca

SEQ ID NO: 3218776 - RNA, 13 nt, Mycobacterium leprae
caggcgugggugu

SEQ ID NO: 3218777 - RNA, 21 nt, Mycobacterium leprae
caggcuguacacuacuccugc

SEQ ID NO: 3218778 - RNA, 13 nt, Mycobacterium leprae
caggcuguugugg

SEQ ID NO: 3218779 - RNA, 13 nt, Mycobacterium leprae
caggcuucgucac

SEQ ID NO: 3218780 - RNA, 16 nt, Mycobacterium leprae
cagggaagugacgcca

SEQ ID NO: 3218781 - RNA, 16 nt, Mycobacterium leprae
cagggcacacagcaau

SEQ ID NO: 3218782 - RNA, 14 nt, Mycobacterium leprae
cagggccagcccgc

SEQ ID NO: 3218783 - RNA, 15 nt, Mycobacterium leprae
cagggccagcccgcu

SEQ ID NO: 3218784 - RNA, 16 nt, Mycobacterium leprae
cagggccgaagcagcc

SEQ ID NO: 3218785 - RNA, 11 nt, Mycobacterium leprae
cagggcgcccc

SEQ ID NO: 3218786 - RNA, 20 nt, Mycobacterium leprae
cagggcguugccguccccuc

SEQ ID NO: 3218787 - RNA, 21 nt, Mycobacterium leprae
cagggcuguuaaaguaaagca

SEQ ID NO: 3218788 - RNA, 15 nt, Mycobacterium leprae
caggggaaccaucgc

SEQ ID NO: 3218789 - RNA, 22 nt, Mycobacterium leprae
caggggcugggcaccugggcug

SEQ ID NO: 3218790 - RNA, 15 nt, Mycobacterium leprae
cagggguuccaagau

SEQ ID NO: 3218791 - RNA, 16 nt, Mycobacterium leprae
caggguacucagcugg

SEQ ID NO: 3218792 - RNA, 20 nt, Mycobacterium leprae
caggguacucagcuggugcu

SEQ ID NO: 3218793 - RNA, 21 nt, Mycobacterium leprae
caggguacucagcuggugcug

SEQ ID NO: 3218794 - RNA, 19 nt, Mycobacterium leprae
cagguagacgcgcuaaacc

SEQ ID NO: 3218795 - RNA, 17 nt, Mycobacterium leprae
cagguagcuacgugguc

SEQ ID NO: 3218796 - RNA, 21 nt, Mycobacterium leprae
cagguauaaguucggaccgca

SEQ ID NO: 3218797 - RNA, 23 nt, Mycobacterium leprae
cagguauuuccuaaaauucaugc

SEQ ID NO: 3218798 - RNA, 13 nt, Mycobacterium leprae
caggucaacagca

SEQ ID NO: 3218799 - RNA, 19 nt, Mycobacterium leprae
caggucagcggucacauug

SEQ ID NO: 3218800 - RNA, 18 nt, Mycobacterium leprae
caggucaguuucaucgac

SEQ ID NO: 3218801 - RNA, 12 nt, Mycobacterium leprae
caggucauccuu

SEQ ID NO: 3218802 - RNA, 17 nt, Mycobacterium leprae
cagguccacccgcaugc

SEQ ID NO: 3218803 - RNA, 20 nt, Mycobacterium leprae
cagguccaucgagcucugag

SEQ ID NO: 3218804 - RNA, 21 nt, Mycobacterium leprae
cagguccaucgagcucugaga

SEQ ID NO: 3218805 - RNA, 23 nt, Mycobacterium leprae
cagguccaucgagcucugagagu

SEQ ID NO: 3218806 - RNA, 22 nt, Mycobacterium leprae
caggucgacuaacgcuucugcc

SEQ ID NO: 3218807 - RNA, 14 nt, Mycobacterium leprae
caggucgaggacca

SEQ ID NO: 3218808 - RNA, 17 nt, Mycobacterium leprae
caggucucacacccgca

SEQ ID NO: 3218809 - RNA, 15 nt, Mycobacterium leprae
caggugaagccggcg

SEQ ID NO: 3218810 - RNA, 18 nt, Mycobacterium leprae
caggugaauuuuuuucug

SEQ ID NO: 3218811 - RNA, 21 nt, Mycobacterium leprae
caggugagucgcccagcaggu

SEQ ID NO: 3218812 - RNA, 22 nt, Mycobacterium leprae
caggugcggccacauugaccac

SEQ ID NO: 3218813 - RNA, 20 nt, Mycobacterium leprae
caggugcgguaaucccagcg

SEQ ID NO: 3218814 - RNA, 17 nt, Mycobacterium leprae
caggugcuggcugcgcc

SEQ ID NO: 3218815 - RNA, 20 nt, Mycobacterium leprae
caggugucuuccaguggcug

SEQ ID NO: 3218816 - RNA, 20 nt, Mycobacterium leprae
caggugugccuggaugggca

SEQ ID NO: 3218817 - RNA, 22 nt, Mycobacterium leprae
caggugugccuggaugggcagc

SEQ ID NO: 3218818 - RNA, 13 nt, Mycobacterium leprae
cagguuccccggu

SEQ ID NO: 3218819 - RNA, 21 nt, Mycobacterium leprae
cagguuccccggugucacccg

SEQ ID NO: 3218820 - RNA, 20 nt, Mycobacterium leprae
cagguucgugcaggcgcuca

SEQ ID NO: 3218821 - RNA, 19 nt, Mycobacterium leprae
cagguucugcaccccaggc

SEQ ID NO: 3218822 - RNA, 20 nt, Mycobacterium leprae
cagguucugcaccccaggcu

SEQ ID NO: 3218823 - RNA, 14 nt, Mycobacterium leprae
cagguugaaaaaga

SEQ ID NO: 3218824 - RNA, 16 nt, Mycobacterium leprae
cagguugaaaaagaaa

SEQ ID NO: 3218825 - RNA, 20 nt, Mycobacterium leprae
cagguuguggcaccagucgc

SEQ ID NO: 3218826 - RNA, 23 nt, Mycobacterium leprae
cagguuguggcaccagucgcgca

SEQ ID NO: 3218827 - RNA, 21 nt, Mycobacterium leprae
caguaauccaguccggugcug

SEQ ID NO: 3218828 - RNA, 14 nt, Mycobacterium leprae
caguaccgagggcc

SEQ ID NO: 3218829 - RNA, 18 nt, Mycobacterium leprae
caguacuggugcuguguu

SEQ ID NO: 3218830 - RNA, 22 nt, Mycobacterium leprae
caguacuggugcuguguugugg

SEQ ID NO: 3218831 - RNA, 22 nt, Mycobacterium leprae
caguagaauuuauuucggagaa

SEQ ID NO: 3218832 - RNA, 16 nt, Mycobacterium leprae
caguaucagugccauu

SEQ ID NO: 3218833 - RNA, 14 nt, Mycobacterium leprae
caguaugucgucaa

SEQ ID NO: 3218834 - RNA, 18 nt, Mycobacterium leprae
cagucaacauggcgaucu

SEQ ID NO: 3218835 - RNA, 21 nt, Mycobacterium leprae
cagucaacauggcgaucugca

SEQ ID NO: 3218836 - RNA, 21 nt, Mycobacterium leprae
cagucagccgucgagccgauu

SEQ ID NO: 3218837 - RNA, 17 nt, Mycobacterium leprae
cagucagcgugccugag

SEQ ID NO: 3218838 - RNA, 18 nt, Mycobacterium leprae
cagucagcgugccugagg

SEQ ID NO: 3218839 - RNA, 13 nt, Mycobacterium leprae
cagucagucacca

SEQ ID NO: 3218840 - RNA, 16 nt, Mycobacterium leprae
cagucagucaccacug

SEQ ID NO: 3218841 - RNA, 12 nt, Mycobacterium leprae
cagucaucaccc

SEQ ID NO: 3218842 - RNA, 15 nt, Mycobacterium leprae
cagucaucaccccgg

SEQ ID NO: 3218843 - RNA, 15 nt, Mycobacterium leprae
cagucauccacugcg

SEQ ID NO: 3218844 - RNA, 15 nt, Mycobacterium leprae
caguccaccagaagu

SEQ ID NO: 3218845 - RNA, 13 nt, Mycobacterium leprae
caguccaccgcca

SEQ ID NO: 3218846 - RNA, 16 nt, Mycobacterium leprae
caguccaccgccaggc

SEQ ID NO: 3218847 - RNA, 14 nt, Mycobacterium leprae
caguccugcccgga

SEQ ID NO: 3218848 - RNA, 12 nt, Mycobacterium leprae
cagucgaagaga

SEQ ID NO: 3218849 - RNA, 20 nt, Mycobacterium leprae
cagucgagauaguccgacca

SEQ ID NO: 3218850 - RNA, 14 nt, Mycobacterium leprae
cagucgagccaccu

SEQ ID NO: 3218851 - RNA, 13 nt, Mycobacterium leprae
cagucgcagggcg

SEQ ID NO: 3218852 - RNA, 18 nt, Mycobacterium leprae
cagucgcagggcgcgcag

SEQ ID NO: 3218853 - RNA, 15 nt, Mycobacterium leprae
cagucgcgcaccgcg

SEQ ID NO: 3218854 - RNA, 20 nt, Mycobacterium leprae
cagucguucgcugacagcaa

SEQ ID NO: 3218855 - RNA, 16 nt, Mycobacterium leprae
cagucucgcuggcgcu

SEQ ID NO: 3218856 - RNA, 23 nt, Mycobacterium leprae
cagucuggcggcccacaagucca

SEQ ID NO: 3218857 - RNA, 14 nt, Mycobacterium leprae
cagugaacacgcug

SEQ ID NO: 3218858 - RNA, 15 nt, Mycobacterium leprae
cagugaacacgcuga

SEQ ID NO: 3218859 - RNA, 16 nt, Mycobacterium leprae
cagugacggcgucgaa

SEQ ID NO: 3218860 - RNA, 23 nt, Mycobacterium leprae
cagugagcagugggccaguggcu

SEQ ID NO: 3218861 - RNA, 19 nt, Mycobacterium leprae
cagugaucacaucagugcu

SEQ ID NO: 3218862 - RNA, 23 nt, Mycobacterium leprae
cagugaucacaucagugcugugg

SEQ ID NO: 3218863 - RNA, 17 nt, Mycobacterium leprae
cagugaugaucggcaaa

SEQ ID NO: 3218864 - RNA, 15 nt, Mycobacterium leprae
cagugaugcggacga

SEQ ID NO: 3218865 - RNA, 22 nt, Mycobacterium leprae
cagugauuaaguagcaagccgc

SEQ ID NO: 3218866 - RNA, 13 nt, Mycobacterium leprae
cagugcacugagc

SEQ ID NO: 3218867 - RNA, 14 nt, Mycobacterium leprae
cagugcaucgauga

SEQ ID NO: 3218868 - RNA, 23 nt, Mycobacterium leprae
cagugccuucgucaauucggcga

SEQ ID NO: 3218869 - RNA, 19 nt, Mycobacterium leprae
caguggccaagcuaucggu

SEQ ID NO: 3218870 - RNA, 21 nt, Mycobacterium leprae
caguggcgggcuugaccugga

SEQ ID NO: 3218871 - RNA, 18 nt, Mycobacterium leprae
caguggggcuggugccga

SEQ ID NO: 3218872 - RNA, 24 nt, Mycobacterium leprae
caguggggggcauggcacugccga

SEQ ID NO: 3218873 - RNA, 22 nt, Mycobacterium leprae
cagugggggugcggcagcugcc

SEQ ID NO: 3218874 - RNA, 15 nt, Mycobacterium leprae
caguguagagggcca

SEQ ID NO: 3218875 - RNA, 21 nt, Mycobacterium leprae
caguguagugucaaucuacac

SEQ ID NO: 3218876 - RNA, 17 nt, Mycobacterium leprae
caguguauuggcggguc

SEQ ID NO: 3218877 - RNA, 15 nt, Mycobacterium leprae
caguguccgucgacg

SEQ ID NO: 3218878 - RNA, 15 nt, Mycobacterium leprae
cagugucggugccgu

SEQ ID NO: 3218879 - RNA, 21 nt, Mycobacterium leprae
cagugucuuagggcgauucga

SEQ ID NO: 3218880 - RNA, 13 nt, Mycobacterium leprae
caguuaaagguaa

SEQ ID NO: 3218881 - RNA, 16 nt, Mycobacterium leprae
caucuaaacugacgcu

SEQ ID NO: 3218882 - RNA, 19 nt, Mycobacterium leprae
caucuaaauccuagaaaau

SEQ ID NO: 3218883 - RNA, 16 nt, Mycobacterium leprae
caucuagagaaacacc

SEQ ID NO: 3218884 - RNA, 20 nt, Mycobacterium leprae
caucucaacauggaccaccg

SEQ ID NO: 3218885 - RNA, 16 nt, Mycobacterium leprae
caucugauugaucggu

SEQ ID NO: 3218886 - RNA, 16 nt, Mycobacterium leprae
caucugcucucagcac

SEQ ID NO: 3218887 - RNA, 16 nt, Mycobacterium leprae
caucugcuuguggcgg

SEQ ID NO: 3218888 - RNA, 16 nt, Mycobacterium leprae
caucuuaacgccaguu

SEQ ID NO: 3218889 - RNA, 17 nt, Mycobacterium leprae
caucuugaccugccguc

SEQ ID NO: 3218890 - RNA, 15 nt, Mycobacterium leprae
caugaacugacuuca

SEQ ID NO: 3218891 - RNA, 21 nt, Mycobacterium leprae
caugacacccccgggaucucg

SEQ ID NO: 3218892 - RNA, 14 nt, Mycobacterium leprae
caugacaugcacac

SEQ ID NO: 3218893 - RNA, 13 nt, Mycobacterium leprae
caugacggcguug

SEQ ID NO: 3218894 - RNA, 21 nt, Mycobacterium leprae
caugacgucuucuauacuuua

SEQ ID NO: 3218895 - RNA, 13 nt, Mycobacterium leprae
caugagcaacacg

SEQ ID NO: 3218896 - RNA, 16 nt, Mycobacterium leprae
caugagcacacgcugc

SEQ ID NO: 3218897 - RNA, 18 nt, Mycobacterium leprae
caugagccgaaucgguac

SEQ ID NO: 3218898 - RNA, 16 nt, Mycobacterium leprae
caugagccggucggag

SEQ ID NO: 3218899 - RNA, 12 nt, Mycobacterium leprae
caugagcugcug

SEQ ID NO: 3218900 - RNA, 17 nt, Mycobacterium leprae
caugagucuucacucac

SEQ ID NO: 3218901 - RNA, 19 nt, Mycobacterium leprae
caugauccagcugucagug

SEQ ID NO: 3218902 - RNA, 16 nt, Mycobacterium leprae
caugauccguacacca

SEQ ID NO: 3218903 - RNA, 19 nt, Mycobacterium leprae
caugcaaccacacccuggc

SEQ ID NO: 3218904 - RNA, 22 nt, Mycobacterium leprae
caugcaacuaugcggcgggauc

SEQ ID NO: 3218905 - RNA, 17 nt, Mycobacterium leprae
caugcaagucgaacgga

SEQ ID NO: 3218906 - RNA, 19 nt, Mycobacterium leprae
caugcaccgacggugcuga

SEQ ID NO: 3218907 - RNA, 14 nt, Mycobacterium leprae
caugcacgccggcg

SEQ ID NO: 3218908 - RNA, 17 nt, Mycobacterium leprae
caugccagguccaaccg

SEQ ID NO: 3218909 - RNA, 16 nt, Mycobacterium leprae
caugcccgcgccgcag

SEQ ID NO: 3218910 - RNA, 20 nt, Mycobacterium leprae
caugcccugggccagcgauc

SEQ ID NO: 3218911 - RNA, 14 nt, Mycobacterium leprae
caugccgaucagcc

SEQ ID NO: 3218912 - RNA, 16 nt, Mycobacterium leprae
caugccgcuugauuug

SEQ ID NO: 3218913 - RNA, 19 nt, Mycobacterium leprae
caugccugcuugcuggcug

SEQ ID NO: 3218914 - RNA, 22 nt, Mycobacterium leprae
caugccuugaccuucucgacca

SEQ ID NO: 3218915 - RNA, 14 nt, Mycobacterium leprae
caugcgaccgccgg

SEQ ID NO: 3218916 - RNA, 18 nt, Mycobacterium leprae
caugcgcugaggcagcag

SEQ ID NO: 3218917 - RNA, 21 nt, Mycobacterium leprae
caugcgugaaguauggcucca

SEQ ID NO: 3218918 - RNA, 16 nt, Mycobacterium leprae
caugcuccgacacugg

SEQ ID NO: 3218919 - RNA, 16 nt, Mycobacterium leprae
caugcugccgucgauc

SEQ ID NO: 3218920 - RNA, 13 nt, Mycobacterium leprae
caugcugcucccu

SEQ ID NO: 3218921 - RNA, 16 nt, Mycobacterium leprae
caugcuggcaguggca

SEQ ID NO: 3218922 - RNA, 13 nt, Mycobacterium leprae
cauggaagccgcc

SEQ ID NO: 3218923 - RNA, 16 nt, Mycobacterium leprae
cauggaagccgccgug

SEQ ID NO: 3218924 - RNA, 16 nt, Mycobacterium leprae
cauggagguucugggu

SEQ ID NO: 3218925 - RNA, 22 nt, Mycobacterium leprae
cauggagguucuggguagcagg

SEQ ID NO: 3218926 - RNA, 13 nt, Mycobacterium leprae
cauggcacugccg

SEQ ID NO: 3218927 - RNA, 15 nt, Mycobacterium leprae
cauggcacugccgau

SEQ ID NO: 3218928 - RNA, 22 nt, Mycobacterium leprae
cauggcaguccacaggacuuca

SEQ ID NO: 3218929 - RNA, 14 nt, Mycobacterium leprae
cauggcagucuugg

SEQ ID NO: 3218930 - RNA, 23 nt, Mycobacterium leprae
cauggcauaagauagcguuaggc

SEQ ID NO: 3218931 - RNA, 18 nt, Mycobacterium leprae
cauggcgagcaucuggcc

SEQ ID NO: 3218932 - RNA, 21 nt, Mycobacterium leprae
cauggcuguaucucgggguag

SEQ ID NO: 3218933 - RNA, 14 nt, Mycobacterium leprae
cauggcuucgucac

SEQ ID NO: 3218934 - RNA, 17 nt, Mycobacterium leprae
cauggcuucgucacccg

SEQ ID NO: 3218935 - RNA, 21 nt, Mycobacterium leprae
cauggcuuuacauaucgcgaa

SEQ ID NO: 3218936 - RNA, 14 nt, Mycobacterium leprae
caugguagugcaca

SEQ ID NO: 3218937 - RNA, 22 nt, Mycobacterium leprae
caugguggccacgauuccggcu

SEQ ID NO: 3218938 - RNA, 17 nt, Mycobacterium leprae
caugguuaacgaagagu

SEQ ID NO: 3218939 - RNA, 15 nt, Mycobacterium leprae
cauguaacacucauu

SEQ ID NO: 3218940 - RNA, 18 nt, Mycobacterium leprae
cauguagaccaagcagca

SEQ ID NO: 3218941 - RNA, 16 nt, Mycobacterium leprae
caugucauauguagcg

SEQ ID NO: 3218942 - RNA, 17 nt, Mycobacterium leprae
caugucauauguagcga

SEQ ID NO: 3218943 - RNA, 14 nt, Mycobacterium leprae
caugucauggccuu

SEQ ID NO: 3218944 - RNA, 20 nt, Mycobacterium leprae
caugucccggugcugccugc

SEQ ID NO: 3218945 - RNA, 16 nt, Mycobacterium leprae
caugucgaacaaccga

SEQ ID NO: 3218946 - RNA, 23 nt, Mycobacterium leprae
caugucggugguggaugcugcuu

SEQ ID NO: 3218947 - RNA, 24 nt, Mycobacterium leprae
caugucggugguggaugcugcuug

SEQ ID NO: 3218948 - RNA, 23 nt, Mycobacterium leprae
caugucgguggugggugcugcuu

SEQ ID NO: 3218949 - RNA, 24 nt, Mycobacterium leprae
caugucgguggugggugcugcuug

SEQ ID NO: 3218950 - RNA, 19 nt, Mycobacterium leprae
caugugaccgcggugcagu

SEQ ID NO: 3218951 - RNA, 22 nt, Mycobacterium leprae
caugugaccgcggugcagugcc

SEQ ID NO: 3218952 - RNA, 12 nt, Mycobacterium leprae
caugugagguca

SEQ ID NO: 3218953 - RNA, 16 nt, Mycobacterium leprae
caugugcgcacugggu

SEQ ID NO: 3218954 - RNA, 19 nt, Mycobacterium leprae
caugugcgcacugggugga

SEQ ID NO: 3218955 - RNA, 14 nt, Mycobacterium leprae
caugugugcuggcc

SEQ ID NO: 3218956 - RNA, 23 nt, Mycobacterium leprae
cauguuaaaauaaaccggcagac

SEQ ID NO: 3218957 - RNA, 17 nt, Mycobacterium leprae
cauguucuguugugggg

SEQ ID NO: 3218958 - RNA, 15 nt, Mycobacterium leprae
cauuaacgcuggucg

SEQ ID NO: 3218959 - RNA, 16 nt, Mycobacterium leprae
cauuacaccuaauccg

SEQ ID NO: 3218960 - RNA, 19 nt, Mycobacterium leprae
cauuacgcgaucuaccccg

SEQ ID NO: 3218961 - RNA, 17 nt, Mycobacterium leprae
cauuacuacgcuagcaa

SEQ ID NO: 3218962 - RNA, 21 nt, Mycobacterium leprae
cauuaguucgagcgcccaagu

SEQ ID NO: 3218963 - RNA, 14 nt, Mycobacterium leprae
cauucaaccagcca

SEQ ID NO: 3218964 - RNA, 13 nt, Mycobacterium leprae
cauucagccgcga

SEQ ID NO: 3218965 - RNA, 15 nt, Mycobacterium leprae
cauucaggaugcugu

SEQ ID NO: 3218966 - RNA, 22 nt, Mycobacterium leprae
cauucaggugcuauuuguggau

SEQ ID NO: 3218967 - RNA, 12 nt, Mycobacterium leprae
cauucccaaccg

SEQ ID NO: 3218968 - RNA, 20 nt, Mycobacterium leprae
cauuccccuagaacaggggg

SEQ ID NO: 3218969 - RNA, 14 nt, Mycobacterium leprae
cauuccgugugacg

SEQ ID NO: 3218970 - RNA, 17 nt, Mycobacterium leprae
cauucgccguccacugg

SEQ ID NO: 3218971 - RNA, 14 nt, Mycobacterium leprae
cauucggaaucgcg

SEQ ID NO: 3218972 - RNA, 21 nt, Mycobacterium leprae
cauucgugagccuaugcggcc

SEQ ID NO: 3218973 - RNA, 20 nt, Mycobacterium leprae
cauucugaaugcuccucaac

SEQ ID NO: 3218974 - RNA, 18 nt, Mycobacterium leprae
cauucuggucgagcgccc

SEQ ID NO: 3218975 - RNA, 23 nt, Mycobacterium leprae
cauugaccacgccgacaccucaa

SEQ ID NO: 3218976 - RNA, 20 nt, Mycobacterium leprae
cauugaccgcaucaccgauc

SEQ ID NO: 3218977 - RNA, 17 nt, Mycobacterium leprae
cauugaugaaugucaau

SEQ ID NO: 3218978 - RNA, 18 nt, Mycobacterium leprae
cauugccaacguguguga

SEQ ID NO: 3218979 - RNA, 20 nt, Mycobacterium leprae
cauugccaucgaacggcggg

SEQ ID NO: 3218980 - RNA, 20 nt, Mycobacterium leprae
cauugcccgcguucauggca

SEQ ID NO: 3218981 - RNA, 21 nt, Mycobacterium leprae
cauugccggugauuucggcgg

SEQ ID NO: 3218982 - RNA, 19 nt, Mycobacterium leprae
cauugccuaguuucuccac

SEQ ID NO: 3218983 - RNA, 17 nt, Mycobacterium leprae
cauugcguuugaugucg

SEQ ID NO: 3218984 - RNA, 17 nt, Mycobacterium leprae
cauugcucgagucgauu

SEQ ID NO: 3218985 - RNA, 17 nt, Mycobacterium leprae
cauuggcucgacauugu

SEQ ID NO: 3218986 - RNA, 18 nt, Mycobacterium leprae
cauugggucaucggcguc

SEQ ID NO: 3218987 - RNA, 15 nt, Mycobacterium leprae
cauuguacugacugg

SEQ ID NO: 3218988 - RNA, 15 nt, Mycobacterium leprae
cauuguagaaacggc

SEQ ID NO: 3218989 - RNA, 22 nt, Mycobacterium leprae
cauuguccagcgguaacuggcu

SEQ ID NO: 3218990 - RNA, 15 nt, Mycobacterium leprae
cauugucgguguuga

SEQ ID NO: 3218991 - RNA, 16 nt, Mycobacterium leprae
cauugucuaccacaua

SEQ ID NO: 3218992 - RNA, 20 nt, Mycobacterium leprae
cauugugcugcccaucaccg

SEQ ID NO: 3218993 - RNA, 22 nt, Mycobacterium leprae
cauuuacgugccgagguguucu

SEQ ID NO: 3218994 - RNA, 21 nt, Mycobacterium leprae
ccagaagcuguugugaagcug

SEQ ID NO: 3218995 - RNA, 15 nt, Mycobacterium leprae
ccagacaccacugcc

SEQ ID NO: 3218996 - RNA, 16 nt, Mycobacterium leprae
ccagacaccacugcca

SEQ ID NO: 3218997 - RNA, 19 nt, Mycobacterium leprae
ccagacaucggaaucgccg

SEQ ID NO: 3218998 - RNA, 21 nt, Mycobacterium leprae
ccagacccuuguagcccuccg

SEQ ID NO: 3218999 - RNA, 21 nt, Mycobacterium leprae
ccagaccgaaaaccacaagca

SEQ ID NO: 3219000 - RNA, 17 nt, Mycobacterium leprae
ccagacgcgaccgccac

SEQ ID NO: 3219001 - RNA, 18 nt, Mycobacterium leprae
ccagacgcgaccgccacc

SEQ ID NO: 3219002 - RNA, 19 nt, Mycobacterium leprae
ccagagauuucgcaggcug

SEQ ID NO: 3219003 - RNA, 20 nt, Mycobacterium leprae
ccagagcugcgacggacagg

SEQ ID NO: 3219004 - RNA, 16 nt, Mycobacterium leprae
ccagagcuguugucgc

SEQ ID NO: 3219005 - RNA, 20 nt, Mycobacterium leprae
ccagauagucgagggcucag

SEQ ID NO: 3219006 - RNA, 23 nt, Mycobacterium leprae
ccagauccaucggacaagccguu

SEQ ID NO: 3219007 - RNA, 12 nt, Mycobacterium leprae
ccagaugccguu

SEQ ID NO: 3219008 - RNA, 17 nt, Mycobacterium leprae
ccagcaacgcuacgcac

SEQ ID NO: 3219009 - RNA, 15 nt, Mycobacterium leprae
ccagcaccaaccugu

SEQ ID NO: 3219010 - RNA, 16 nt, Mycobacterium leprae
ccagcaccacugcggu

SEQ ID NO: 3219011 - RNA, 12 nt, Mycobacterium leprae
ccagcacccgca

SEQ ID NO: 3219012 - RNA, 18 nt, Mycobacterium leprae
ccagcacgcaaccgccgg

SEQ ID NO: 3219013 - RNA, 17 nt, Mycobacterium leprae
ccagcagaucaaacaug

SEQ ID NO: 3219014 - RNA, 12 nt, Mycobacterium leprae
ccagcagauggc

SEQ ID NO: 3219015 - RNA, 14 nt, Mycobacterium leprae
ccagcaucaacgcc

SEQ ID NO: 3219016 - RNA, 19 nt, Mycobacterium leprae
ccagcaucaacgccagcaa

SEQ ID NO: 3219017 - RNA, 22 nt, Mycobacterium leprae
ccagcaucaacgccagcaagca

SEQ ID NO: 3219018 - RNA, 20 nt, Mycobacterium leprae
ccagcauuauccgggcugga

SEQ ID NO: 3219019 - RNA, 21 nt, Mycobacterium leprae
ccagccaacauagucauugcc

SEQ ID NO: 3219020 - RNA, 14 nt, Mycobacterium leprae
ccagccaacggcua

SEQ ID NO: 3219021 - RNA, 22 nt, Mycobacterium leprae
ccagccaccagggaagaucuca

SEQ ID NO: 3219022 - RNA, 16 nt, Mycobacterium leprae
ccagccacgcaaacga

SEQ ID NO: 3219023 - RNA, 15 nt, Mycobacterium leprae
ccagccacggcgucg

SEQ ID NO: 3219024 - RNA, 21 nt, Mycobacterium leprae
ccagccaggaugcggcccagu

SEQ ID NO: 3219025 - RNA, 21 nt, Mycobacterium leprae
ccagcccgcuagcaucgacca

SEQ ID NO: 3219026 - RNA, 15 nt, Mycobacterium leprae
ccagcccggcgugca

SEQ ID NO: 3219027 - RNA, 15 nt, Mycobacterium leprae
ccagccgcagcaccc

SEQ ID NO: 3219028 - RNA, 19 nt, Mycobacterium leprae
ccagcgaagguagcccguu

SEQ ID NO: 3219029 - RNA, 13 nt, Mycobacterium leprae
ccagcgacacagc

SEQ ID NO: 3219030 - RNA, 16 nt, Mycobacterium leprae
ccagcgacacagccgg

SEQ ID NO: 3219031 - RNA, 14 nt, Mycobacterium leprae
ccagcgacuggcug

SEQ ID NO: 3219032 - RNA, 20 nt, Mycobacterium leprae
ccagcgauaucaagcugcgc

SEQ ID NO: 3219033 - RNA, 16 nt, Mycobacterium leprae
ccagcgcacccauccg

SEQ ID NO: 3219034 - RNA, 17 nt, Mycobacterium leprae
ccagcgcacccauccga

SEQ ID NO: 3219035 - RNA, 17 nt, Mycobacterium leprae
ccagcgcaucagccaac

SEQ ID NO: 3219036 - RNA, 20 nt, Mycobacterium leprae
ccagcgcaucagccaacacc

SEQ ID NO: 3219037 - RNA, 14 nt, Mycobacterium leprae
ccagcgccagaccu

SEQ ID NO: 3219038 - RNA, 18 nt, Mycobacterium leprae
ccagcguaaacgugaugc

SEQ ID NO: 3219039 - RNA, 19 nt, Mycobacterium leprae
ccagcguaaacgugaugcu

SEQ ID NO: 3219040 - RNA, 22 nt, Mycobacterium leprae
ccagcgucgcucacggccacca

SEQ ID NO: 3219041 - RNA, 22 nt, Mycobacterium leprae
ccagcguuggaccgaacagguc

SEQ ID NO: 3219042 - RNA, 20 nt, Mycobacterium leprae
ccagcucacaauugacaaca

SEQ ID NO: 3219043 - RNA, 14 nt, Mycobacterium leprae
ccagcucggcaucg

SEQ ID NO: 3219044 - RNA, 23 nt, Mycobacterium leprae
ccagcucggcaucggccucaccu

SEQ ID NO: 3219045 - RNA, 14 nt, Mycobacterium leprae
ccaggacuacgcca

SEQ ID NO: 3219046 - RNA, 21 nt, Mycobacterium leprae
ccaggagaagcgcugcagcga

SEQ ID NO: 3219047 - RNA, 16 nt, Mycobacterium leprae
ccaggaguaccgugcc

SEQ ID NO: 3219048 - RNA, 15 nt, Mycobacterium leprae
ccaggaucccugauc

SEQ ID NO: 3219049 - RNA, 18 nt, Mycobacterium leprae
ccaggauggugccauccg

SEQ ID NO: 3219050 - RNA, 21 nt, Mycobacterium leprae
ccaggauggugccauccggug

SEQ ID NO: 3219051 - RNA, 23 nt, Mycobacterium leprae
ccaggcagcgccugccccgcugg

SEQ ID NO: 3219052 - RNA, 19 nt, Mycobacterium leprae
ccaggcagcugugcacgug

SEQ ID NO: 3219053 - RNA, 21 nt, Mycobacterium leprae
ccaggcgguaggaaucaccgg

SEQ ID NO: 3219054 - RNA, 19 nt, Mycobacterium leprae
ccaggcuacugugaucgca

SEQ ID NO: 3219055 - RNA, 20 nt, Mycobacterium leprae
ccagggaugaguaucugugg

SEQ ID NO: 3219056 - RNA, 21 nt, Mycobacterium leprae
ccagggaugcugggucagcau

SEQ ID NO: 3219057 - RNA, 24 nt, Mycobacterium leprae
ccagggauuccuguucuacaucca

SEQ ID NO: 3219058 - RNA, 19 nt, Mycobacterium leprae
ccagggcggcauucccaac

SEQ ID NO: 3219059 - RNA, 12 nt, Mycobacterium leprae
ccaggguagcug

SEQ ID NO: 3219060 - RNA, 23 nt, Mycobacterium leprae
ccaggucaucuaaacugacgcug

SEQ ID NO: 3219061 - RNA, 23 nt, Mycobacterium leprae
ccaggucgacuaacgcuucugcc

SEQ ID NO: 3219062 - RNA, 15 nt, Mycobacterium leprae
ccaggucggcuagcc

SEQ ID NO: 3219063 - RNA, 20 nt, Mycobacterium leprae
ccaggucuugggaguuuccg

SEQ ID NO: 3219064 - RNA, 12 nt, Mycobacterium leprae
ccaggugcugca

SEQ ID NO: 3219065 - RNA, 17 nt, Mycobacterium leprae
ccaggugcugcaguugg

SEQ ID NO: 3219066 - RNA, 18 nt, Mycobacterium leprae
ccaggugcuggcugcgcc

SEQ ID NO: 3219067 - RNA, 17 nt, Mycobacterium leprae
ccaggugucuuccagug

SEQ ID NO: 3219068 - RNA, 19 nt, Mycobacterium leprae
ccaguaaguggaggugauc

SEQ ID NO: 3219069 - RNA, 18 nt, Mycobacterium leprae
ccaguacaauauugacca

SEQ ID NO: 3219070 - RNA, 21 nt, Mycobacterium leprae
ccaguacccgugcccaagacu

SEQ ID NO: 3219071 - RNA, 14 nt, Mycobacterium leprae
ccagucagucacca

SEQ ID NO: 3219072 - RNA, 16 nt, Mycobacterium leprae
ccaguccggugcuguc

SEQ ID NO: 3219073 - RNA, 13 nt, Mycobacterium leprae
ccagucgagccac

SEQ ID NO: 3219074 - RNA, 20 nt, Mycobacterium leprae
ccagucggucugcucggcga

SEQ ID NO: 3219075 - RNA, 19 nt, Mycobacterium leprae
ccagugccuugggcacgga

SEQ ID NO: 3219076 - RNA, 20 nt, Mycobacterium leprae
ccagugcgcaacuucaacuu

SEQ ID NO: 3219077 - RNA, 17 nt, Mycobacterium leprae
ccaguggcucgccgcgc

SEQ ID NO: 3219078 - RNA, 20 nt, Mycobacterium leprae
ccaguggcucgccgcgcauc

SEQ ID NO: 3219079 - RNA, 13 nt, Mycobacterium leprae
ccaguggcugcac

SEQ ID NO: 3219080 - RNA, 22 nt, Mycobacterium leprae
ccagugugccagcgcucgcugg

SEQ ID NO: 3219081 - RNA, 20 nt, Mycobacterium leprae
ccagugugcugcauccgaca

SEQ ID NO: 3219082 - RNA, 20 nt, Mycobacterium leprae
ccauaaacacgugcaucgag

SEQ ID NO: 3219083 - RNA, 23 nt, Mycobacterium leprae
ccauacccaggguagcugacggu

SEQ ID NO: 3219084 - RNA, 19 nt, Mycobacterium leprae
ccauauagcgucccagcuc

SEQ ID NO: 3219085 - RNA, 20 nt, Mycobacterium leprae
ccaucaacggcuacaacaaa

SEQ ID NO: 3219086 - RNA, 12 nt, Mycobacterium leprae
ccauccaccgcc

SEQ ID NO: 3219087 - RNA, 14 nt, Mycobacterium leprae
ccauccaccgccga

SEQ ID NO: 3219088 - RNA, 21 nt, Mycobacterium leprae
ccauccgaucaauggcagcca

SEQ ID NO: 3219089 - RNA, 13 nt, Mycobacterium leprae
ccaucgacgccgc

SEQ ID NO: 3219090 - RNA, 15 nt, Mycobacterium leprae
ccaucgacgccgccg

SEQ ID NO: 3219091 - RNA, 13 nt, Mycobacterium leprae
ccaucgacgccgu

SEQ ID NO: 3219092 - RNA, 19 nt, Mycobacterium leprae
ccaucgucgacgaguucca

SEQ ID NO: 3219093 - RNA, 22 nt, Mycobacterium leprae
ccaucgugaggugugaccgugc

SEQ ID NO: 3219094 - RNA, 23 nt, Mycobacterium leprae
ccaucgugaggugugaccgugca

SEQ ID NO: 3219095 - RNA, 15 nt, Mycobacterium leprae
ccaugcaugcaccgu

SEQ ID NO: 3219096 - RNA, 19 nt, Mycobacterium leprae
ccaugccgccgaagccgcg

SEQ ID NO: 3219097 - RNA, 15 nt, Mycobacterium leprae
ccaugccgcgcgccu

SEQ ID NO: 3219098 - RNA, 22 nt, Mycobacterium leprae
ccaugggaguuuaucgguggau

SEQ ID NO: 3219099 - RNA, 18 nt, Mycobacterium leprae
ccauggucgucgcugcuu

SEQ ID NO: 3219100 - RNA, 23 nt, Mycobacterium leprae
ccauggucgucgcugcuuccuga

SEQ ID NO: 3219101 - RNA, 21 nt, Mycobacterium leprae
ccaugugcugacagacauggc

SEQ ID NO: 3219102 - RNA, 18 nt, Mycobacterium leprae
ccauuaguucgagcgccc

SEQ ID NO: 3219103 - RNA, 18 nt, Mycobacterium leprae
ccauucgcgauccaucag

SEQ ID NO: 3219104 - RNA, 21 nt, Mycobacterium leprae
ccauucggaaucgcgugcuau

SEQ ID NO: 3219105 - RNA, 15 nt, Mycobacterium leprae
ccauugaccucuuca

SEQ ID NO: 3219106 - RNA, 18 nt, Mycobacterium leprae
cccuggcaucaucaacau

SEQ ID NO: 3219107 - RNA, 21 nt, Mycobacterium leprae
cccugucuguugguccuugca

SEQ ID NO: 3219108 - RNA, 17 nt, Mycobacterium leprae
cccuguuccucgcgggc

SEQ ID NO: 3219109 - RNA, 22 nt, Mycobacterium leprae
cccuguuccucgcgggcggcgu

SEQ ID NO: 3219110 - RNA, 22 nt, Mycobacterium leprae
cccuugcagcaacauucacccc

SEQ ID NO: 3219111 - RNA, 14 nt, Mycobacterium leprae
ccgaaaccagggua

SEQ ID NO: 3219112 - RNA, 17 nt, Mycobacterium leprae
ccgaaacccgaaaccaa

SEQ ID NO: 3219113 - RNA, 22 nt, Mycobacterium leprae
ccgaaacgcuauggauacucaa

SEQ ID NO: 3219114 - RNA, 16 nt, Mycobacterium leprae
ccgaacaacgaacagc

SEQ ID NO: 3219115 - RNA, 21 nt, Mycobacterium leprae
ccgaacagccgcgccaacagc

SEQ ID NO: 3219116 - RNA, 16 nt, Mycobacterium leprae
ccgaaccucgccaccu

SEQ ID NO: 3219117 - RNA, 17 nt, Mycobacterium leprae
ccgaaccugugcguaag

SEQ ID NO: 3219118 - RNA, 11 nt, Mycobacterium leprae
ccgaacuuggg

SEQ ID NO: 3219119 - RNA, 20 nt, Mycobacterium leprae
ccgaagaucaccgccaccac

SEQ ID NO: 3219120 - RNA, 22 nt, Mycobacterium leprae
ccgaagaucaccgccaccacga

SEQ ID NO: 3219121 - RNA, 13 nt, Mycobacterium leprae
ccgaagccgccag

SEQ ID NO: 3219122 - RNA, 17 nt, Mycobacterium leprae
ccgaagccgggcgagcu

SEQ ID NO: 3219123 - RNA, 12 nt, Mycobacterium leprae
ccgaagcgaaga

SEQ ID NO: 3219124 - RNA, 21 nt, Mycobacterium leprae
ccgaagcgggggaaguaagcu

SEQ ID NO: 3219125 - RNA, 15 nt, Mycobacterium leprae
ccgaaguccaccgga

SEQ ID NO: 3219126 - RNA, 23 nt, Mycobacterium leprae
ccgaaugauuguguguaggugau

SEQ ID NO: 3219127 - RNA, 23 nt, Mycobacterium leprae
ccgaaugcaaugcgccauuucga

SEQ ID NO: 3219128 - RNA, 18 nt, Mycobacterium leprae
ccgacaaucucacguccg

SEQ ID NO: 3219129 - RNA, 15 nt, Mycobacterium leprae
ccgaccagagcuguu

SEQ ID NO: 3219130 - RNA, 14 nt, Mycobacterium leprae
ccgaccgaaagccg

SEQ ID NO: 3219131 - RNA, 16 nt, Mycobacterium leprae
ccgaccgaaagccgca

SEQ ID NO: 3219132 - RNA, 14 nt, Mycobacterium leprae
ccgaccgcccggua

SEQ ID NO: 3219133 - RNA, 20 nt, Mycobacterium leprae
ccgaccgcccgguagcacca

SEQ ID NO: 3219134 - RNA, 14 nt, Mycobacterium leprae
ccgaccgguugggu

SEQ ID NO: 3219135 - RNA, 12 nt, Mycobacterium leprae
ccgacgaaugca

SEQ ID NO: 3219136 - RNA, 21 nt, Mycobacterium leprae
ccgacgaugcgugccccggcc

SEQ ID NO: 3219137 - RNA, 17 nt, Mycobacterium leprae
ccgacgcgcacuagcau

SEQ ID NO: 3219138 - RNA, 23 nt, Mycobacterium leprae
ccgacgcgguugccggcggaagu

SEQ ID NO: 3219139 - RNA, 21 nt, Mycobacterium leprae
ccgacggaugcccagccagga

SEQ ID NO: 3219140 - RNA, 17 nt, Mycobacterium leprae
ccgacggcacaccgugu

SEQ ID NO: 3219141 - RNA, 15 nt, Mycobacterium leprae
ccgacggcgccgcac

SEQ ID NO: 3219142 - RNA, 19 nt, Mycobacterium leprae
ccgacggcgcggcugcuug

SEQ ID NO: 3219143 - RNA, 15 nt, Mycobacterium leprae
ccgacgucucgcggu

SEQ ID NO: 3219144 - RNA, 20 nt, Mycobacterium leprae
ccgacgucucgcggugauug

SEQ ID NO: 3219145 - RNA, 14 nt, Mycobacterium leprae
ccgacgucuucaau

SEQ ID NO: 3219146 - RNA, 21 nt, Mycobacterium leprae
ccgacuaauuguggcuucccc

SEQ ID NO: 3219147 - RNA, 19 nt, Mycobacterium leprae
ccgacuggugggcgcagac

SEQ ID NO: 3219148 - RNA, 21 nt, Mycobacterium leprae
ccgagaauaaaugccggugca

SEQ ID NO: 3219149 - RNA, 18 nt, Mycobacterium leprae
ccgagaaucaggccgccc

SEQ ID NO: 3219150 - RNA, 18 nt, Mycobacterium leprae
ccgagaucgacgcugcgc

SEQ ID NO: 3219151 - RNA, 14 nt, Mycobacterium leprae
ccgagauggcgucu

SEQ ID NO: 3219152 - RNA, 19 nt, Mycobacterium leprae
ccgagcaugaccgagcugg

SEQ ID NO: 3219153 - RNA, 16 nt, Mycobacterium leprae
ccgagccgacaaucga

SEQ ID NO: 3219154 - RNA, 21 nt, Mycobacterium leprae
ccgagccgacaaucgagcacg

SEQ ID NO: 3219155 - RNA, 23 nt, Mycobacterium leprae
ccgagccgcaggucucacacccg

SEQ ID NO: 3219156 - RNA, 14 nt, Mycobacterium leprae
ccgagcgcaccaac

SEQ ID NO: 3219157 - RNA, 22 nt, Mycobacterium leprae
ccgagcgcagcaagcggccgcc

SEQ ID NO: 3219158 - RNA, 21 nt, Mycobacterium leprae
ccgagcgcccgcacagcacca

SEQ ID NO: 3219159 - RNA, 16 nt, Mycobacterium leprae
ccgagcguacugguga

SEQ ID NO: 3219160 - RNA, 21 nt, Mycobacterium leprae
ccgagcuggccggggccaagc

SEQ ID NO: 3219161 - RNA, 14 nt, Mycobacterium leprae
ccgagcuuuuccag

SEQ ID NO: 3219162 - RNA, 18 nt, Mycobacterium leprae
ccgagcuuuuccagcggg

SEQ ID NO: 3219163 - RNA, 14 nt, Mycobacterium leprae
ccgaggagaggcag

SEQ ID NO: 3219164 - RNA, 18 nt, Mycobacterium leprae
ccgaggagaggcagggcu

SEQ ID NO: 3219165 - RNA, 21 nt, Mycobacterium leprae
ccgaggagaggcagggcuggg

SEQ ID NO: 3219166 - RNA, 21 nt, Mycobacterium leprae
ccgaggaugccguagaucucg

SEQ ID NO: 3219167 - RNA, 11 nt, Mycobacterium leprae
ccgaggucgag

SEQ ID NO: 3219168 - RNA, 16 nt, Mycobacterium leprae
ccgagguuaccagcgc

SEQ ID NO: 3219169 - RNA, 21 nt, Mycobacterium leprae
ccgaguugggccaugcagucg

SEQ ID NO: 3219170 - RNA, 20 nt, Mycobacterium leprae
ccgauaaacaaggagccgag

SEQ ID NO: 3219171 - RNA, 15 nt, Mycobacterium leprae
ccgauacccaucacg

SEQ ID NO: 3219172 - RNA, 15 nt, Mycobacterium leprae
ccgauagaccgcuac

SEQ ID NO: 3219173 - RNA, 15 nt, Mycobacterium leprae
ccgauaucgaccagc

SEQ ID NO: 3219174 - RNA, 15 nt, Mycobacterium leprae
ccgauauggcgauca

SEQ ID NO: 3219175 - RNA, 14 nt, Mycobacterium leprae
ccgauauguucggu

SEQ ID NO: 3219176 - RNA, 17 nt, Mycobacterium leprae
ccgauauguucgguagu

SEQ ID NO: 3219177 - RNA, 17 nt, Mycobacterium leprae
ccgaucaauggcagcca

SEQ ID NO: 3219178 - RNA, 22 nt, Mycobacterium leprae
ccgaucaccuagaacagcaucg

SEQ ID NO: 3219179 - RNA, 22 nt, Mycobacterium leprae
ccgaucaucgagguggcggcga

SEQ ID NO: 3219180 - RNA, 15 nt, Mycobacterium leprae
ccgaucauggcugga

SEQ ID NO: 3219181 - RNA, 20 nt, Mycobacterium leprae
ccgaucauggcuggacagaa

SEQ ID NO: 3219182 - RNA, 18 nt, Mycobacterium leprae
ccgauccagacagcaaga

SEQ ID NO: 3219183 - RNA, 11 nt, Mycobacterium leprae
ccgaucccauc

SEQ ID NO: 3219184 - RNA, 16 nt, Mycobacterium leprae
ccgaucccaucggcug

SEQ ID NO: 3219185 - RNA, 19 nt, Mycobacterium leprae
ccgaucccaucggcugcac

SEQ ID NO: 3219186 - RNA, 19 nt, Mycobacterium leprae
ccgaucgcaccggcugcac

SEQ ID NO: 3219187 - RNA, 12 nt, Mycobacterium leprae
ccgaucgcccgc

SEQ ID NO: 3219188 - RNA, 22 nt, Mycobacterium leprae
ccgaucgcuugcuaccaguguc

SEQ ID NO: 3219189 - RNA, 14 nt, Mycobacterium leprae
ccgaucggcugccg

SEQ ID NO: 3219190 - RNA, 19 nt, Mycobacterium leprae
ccgaucugggggugcaccu

SEQ ID NO: 3219191 - RNA, 21 nt, Mycobacterium leprae
ccgaugauccacucgccgcgg

SEQ ID NO: 3219192 - RNA, 16 nt, Mycobacterium leprae
ccgaugauggccgacc

SEQ ID NO: 3219193 - RNA, 15 nt, Mycobacterium leprae
ccgaugaugguuggu

SEQ ID NO: 3219194 - RNA, 19 nt, Mycobacterium leprae
ccgaugcagggccagcccg

SEQ ID NO: 3219195 - RNA, 14 nt, Mycobacterium leprae
ccgaugcucgcccu

SEQ ID NO: 3219196 - RNA, 17 nt, Mycobacterium leprae
ccgaugcucgcccucgg

SEQ ID NO: 3219197 - RNA, 22 nt, Mycobacterium leprae
ccgauguuguagaccaucacga

SEQ ID NO: 3219198 - RNA, 17 nt, Mycobacterium leprae
ccgauucgguggcgauc

SEQ ID NO: 3219199 - RNA, 18 nt, Mycobacterium leprae
ccgauuguuacugaauca

SEQ ID NO: 3219200 - RNA, 13 nt, Mycobacterium leprae
ccgauuugggggu

SEQ ID NO: 3219201 - RNA, 18 nt, Mycobacterium leprae
ccgcaaccgauacgccag

SEQ ID NO: 3219202 - RNA, 22 nt, Mycobacterium leprae
ccgcaacugguugaccccgccc

SEQ ID NO: 3219203 - RNA, 17 nt, Mycobacterium leprae
ccgcaagcgcgccgagu

SEQ ID NO: 3219204 - RNA, 15 nt, Mycobacterium leprae
ccgcaaggucacgag

SEQ ID NO: 3219205 - RNA, 19 nt, Mycobacterium leprae
ccgcacaaacuucgacgau

SEQ ID NO: 3219206 - RNA, 20 nt, Mycobacterium leprae
ccgcacagagcccagcacgc

SEQ ID NO: 3219207 - RNA, 15 nt, Mycobacterium leprae
ccgcacaguuccagu

SEQ ID NO: 3219208 - RNA, 12 nt, Mycobacterium leprae
ccgcaccggcga

SEQ ID NO: 3219209 - RNA, 17 nt, Mycobacterium leprae
ccgcaccugaacaggca

SEQ ID NO: 3219210 - RNA, 23 nt, Mycobacterium leprae
ccgcacguugccucuguucaggc

SEQ ID NO: 3219211 - RNA, 22 nt, Mycobacterium leprae
ccgcagaggacgggcggccagg

SEQ ID NO: 3219212 - RNA, 21 nt, Mycobacterium leprae
ccgcagcacuaaagucuucaa

SEQ ID NO: 3219213 - RNA, 22 nt, Mycobacterium leprae
ccgcagcaugguaagaauaccg

SEQ ID NO: 3219214 - RNA, 18 nt, Mycobacterium leprae
ccgcaggucucacacccg

SEQ ID NO: 3219215 - RNA, 22 nt, Mycobacterium leprae
ccgcaguacuggugcuguguug

SEQ ID NO: 3219216 - RNA, 21 nt, Mycobacterium leprae
ccgcagucguucgcugacagc

SEQ ID NO: 3219217 - RNA, 15 nt, Mycobacterium leprae
ccgcauccggcgcca

SEQ ID NO: 3219218 - RNA, 15 nt, Mycobacterium leprae
ccgggcaaaccacuu

SEQ ID NO: 3219219 - RNA, 14 nt, Mycobacterium leprae
ccgggcacuugggu

SEQ ID NO: 3219220 - RNA, 15 nt, Mycobacterium leprae
ccgggcagucucguu

SEQ ID NO: 3219221 - RNA, 22 nt, Mycobacterium leprae
ccgggcccggacggcccagcac

SEQ ID NO: 3219222 - RNA, 15 nt, Mycobacterium leprae
ccgggccgcaacaca

SEQ ID NO: 3219223 - RNA, 16 nt, Mycobacterium leprae
ccgggccggccgcgga

SEQ ID NO: 3219224 - RNA, 22 nt, Mycobacterium leprae
ccgggcgagcuggggcggccgc

SEQ ID NO: 3219225 - RNA, 15 nt, Mycobacterium leprae
ccgggcgcucagcgg

SEQ ID NO: 3219226 - RNA, 14 nt, Mycobacterium leprae
ccgggcucggugaa

SEQ ID NO: 3219227 - RNA, 21 nt, Mycobacterium leprae
ccgggcugcuguguuugcugg

SEQ ID NO: 3219228 - RNA, 14 nt, Mycobacterium leprae
ccgggcuucgccac

SEQ ID NO: 3219229 - RNA, 23 nt, Mycobacterium leprae
ccggggcaggccugaucuccaac

SEQ ID NO: 3219230 - RNA, 16 nt, Mycobacterium leprae
ccggggcaucugucua

SEQ ID NO: 3219231 - RNA, 23 nt, Mycobacterium leprae
ccggggguaguaguucacgguca

SEQ ID NO: 3219232 - RNA, 15 nt, Mycobacterium leprae
ccggguacggacauc

SEQ ID NO: 3219233 - RNA, 15 nt, Mycobacterium leprae
ccgguagcgccgagc

SEQ ID NO: 3219234 - RNA, 18 nt, Mycobacterium leprae
ccgguagcggucuggcgc

SEQ ID NO: 3219235 - RNA, 14 nt, Mycobacterium leprae
ccgguagcguggac

SEQ ID NO: 3219236 - RNA, 20 nt, Mycobacterium leprae
ccggucaacaagccgccgac

SEQ ID NO: 3219237 - RNA, 20 nt, Mycobacterium leprae
ccggucggcggcgccgaucc

SEQ ID NO: 3219238 - RNA, 19 nt, Mycobacterium leprae
ccggucugcgucgacugac

SEQ ID NO: 3219239 - RNA, 20 nt, Mycobacterium leprae
ccggucuuuucgcgcgcacc

SEQ ID NO: 3219240 - RNA, 22 nt, Mycobacterium leprae
ccggugcagcucguccaucgcg

SEQ ID NO: 3219241 - RNA, 14 nt, Mycobacterium leprae
ccggugccggccaa

SEQ ID NO: 3219242 - RNA, 17 nt, Mycobacterium leprae
ccggugccuauuucacu

SEQ ID NO: 3219243 - RNA, 17 nt, Mycobacterium leprae
ccggugcugcagccacg

SEQ ID NO: 3219244 - RNA, 15 nt, Mycobacterium leprae
ccgguggccagcgca

SEQ ID NO: 3219245 - RNA, 20 nt, Mycobacterium leprae
ccgguggcgguaaccugcug

SEQ ID NO: 3219246 - RNA, 19 nt, Mycobacterium leprae
ccgguggucgcgauccaau

SEQ ID NO: 3219247 - RNA, 20 nt, Mycobacterium leprae
ccgguguacacgugcugccc

SEQ ID NO: 3219248 - RNA, 12 nt, Mycobacterium leprae
ccggugucaccc

SEQ ID NO: 3219249 - RNA, 14 nt, Mycobacterium leprae
ccgguuacccgcuu

SEQ ID NO: 3219250 - RNA, 24 nt, Mycobacterium leprae
ccgguuacguccgcggcagcugcu

SEQ ID NO: 3219251 - RNA, 17 nt, Mycobacterium leprae
ccgguuggcugccgucg

SEQ ID NO: 3219252 - RNA, 18 nt, Mycobacterium leprae
ccguaaaucguaaaugcc

SEQ ID NO: 3219253 - RNA, 13 nt, Mycobacterium leprae
ccguaagacacuu

SEQ ID NO: 3219254 - RNA, 19 nt, Mycobacterium leprae
ccguaaucaagaucggcca

SEQ ID NO: 3219255 - RNA, 19 nt, Mycobacterium leprae
ccguacaccaaucaggcca

SEQ ID NO: 3219256 - RNA, 16 nt, Mycobacterium leprae
ccguagcgcaccaauc

SEQ ID NO: 3219257 - RNA, 19 nt, Mycobacterium leprae
ccguaguguuuuaccagcc

SEQ ID NO: 3219258 - RNA, 20 nt, Mycobacterium leprae
ccguaguguuuuaccagcca

SEQ ID NO: 3219259 - RNA, 21 nt, Mycobacterium leprae
ccguaugaucuaauagccgaa

SEQ ID NO: 3219260 - RNA, 19 nt, Mycobacterium leprae
ccguaugugccgccgacgg

SEQ ID NO: 3219261 - RNA, 15 nt, Mycobacterium leprae
ccguauugaccugac

SEQ ID NO: 3219262 - RNA, 21 nt, Mycobacterium leprae
ccgucacuacguuggccagca

SEQ ID NO: 3219263 - RNA, 18 nt, Mycobacterium leprae
ccgucacugugugcagcu

SEQ ID NO: 3219264 - RNA, 11 nt, Mycobacterium leprae
ccgucagccgu

SEQ ID NO: 3219265 - RNA, 14 nt, Mycobacterium leprae
ccgucccucggcca

SEQ ID NO: 3219266 - RNA, 15 nt, Mycobacterium leprae
ccgucgaagcccugc

SEQ ID NO: 3219267 - RNA, 16 nt, Mycobacterium leprae
ccgucgcgagcugaac

SEQ ID NO: 3219268 - RNA, 19 nt, Mycobacterium leprae
ccgucgcguugaggacgau

SEQ ID NO: 3219269 - RNA, 15 nt, Mycobacterium leprae
ccgucucucaggccg

SEQ ID NO: 3219270 - RNA, 12 nt, Mycobacterium leprae
ccgucuggaaca

SEQ ID NO: 3219271 - RNA, 14 nt, Mycobacterium leprae
ccgugacucaacau

SEQ ID NO: 3219272 - RNA, 17 nt, Mycobacterium leprae
ccgugauuuucauuggc

SEQ ID NO: 3219273 - RNA, 20 nt, Mycobacterium leprae
ccgugcccaagacucaguga

SEQ ID NO: 3219274 - RNA, 17 nt, Mycobacterium leprae
ccgugccuugcggcagg

SEQ ID NO: 3219275 - RNA, 17 nt, Mycobacterium leprae
ccgugcuuccauucgcg

SEQ ID NO: 3219276 - RNA, 13 nt, Mycobacterium leprae
ccguggagagcau

SEQ ID NO: 3219277 - RNA, 16 nt, Mycobacterium leprae
ccgugguagucagcac

SEQ ID NO: 3219278 - RNA, 14 nt, Mycobacterium leprae
ccguggucggcgau

SEQ ID NO: 3219279 - RNA, 16 nt, Mycobacterium leprae
ccgugguggucgaccg

SEQ ID NO: 3219280 - RNA, 12 nt, Mycobacterium leprae
ccguguagugca

SEQ ID NO: 3219281 - RNA, 13 nt, Mycobacterium leprae
ccgugucaagucg

SEQ ID NO: 3219282 - RNA, 21 nt, Mycobacterium leprae
ccgugucggccccccggggcu

SEQ ID NO: 3219283 - RNA, 12 nt, Mycobacterium leprae
ccgugucgguag

SEQ ID NO: 3219284 - RNA, 18 nt, Mycobacterium leprae
ccguuaacuguagucggu

SEQ ID NO: 3219285 - RNA, 17 nt, Mycobacterium leprae
ccguuacggccaugucu

SEQ ID NO: 3219286 - RNA, 13 nt, Mycobacterium leprae
ccguuagguuguc

SEQ ID NO: 3219287 - RNA, 13 nt, Mycobacterium leprae
ccguuaucgaucu

SEQ ID NO: 3219288 - RNA, 17 nt, Mycobacterium leprae
ccguucaguggccaagc

SEQ ID NO: 3219289 - RNA, 19 nt, Mycobacterium leprae
ccguuccauuccagaugcc

SEQ ID NO: 3219290 - RNA, 14 nt, Mycobacterium leprae
ccguuccugagugu

SEQ ID NO: 3219291 - RNA, 23 nt, Mycobacterium leprae
ccguucuaggguguugugggugu

SEQ ID NO: 3219292 - RNA, 18 nt, Mycobacterium leprae
ccguuggcgaucagcagg

SEQ ID NO: 3219293 - RNA, 13 nt, Mycobacterium leprae
ccguugggcugcc

SEQ ID NO: 3219294 - RNA, 15 nt, Mycobacterium leprae
ccguuuacuguguug

SEQ ID NO: 3219295 - RNA, 17 nt, Mycobacterium leprae
ccguuuccgcuaccauc

SEQ ID NO: 3219296 - RNA, 16 nt, Mycobacterium leprae
ccuaauuagucuagau

SEQ ID NO: 3219297 - RNA, 17 nt, Mycobacterium leprae
ccuaauuugucgguagu

SEQ ID NO: 3219298 - RNA, 17 nt, Mycobacterium leprae
ccuaccggccaaccaca

SEQ ID NO: 3219299 - RNA, 20 nt, Mycobacterium leprae
ccuaccggccaaccacagca

SEQ ID NO: 3219300 - RNA, 21 nt, Mycobacterium leprae
ccuaccggccaaccacagcaa

SEQ ID NO: 3219301 - RNA, 15 nt, Mycobacterium leprae
ccuacuuuuccaccc

SEQ ID NO: 3219302 - RNA, 15 nt, Mycobacterium leprae
ccuagaaagaccccc

SEQ ID NO: 3219303 - RNA, 19 nt, Mycobacterium leprae
ccuagauuaggugugcuag

SEQ ID NO: 3219304 - RNA, 20 nt, Mycobacterium leprae
ccuaggaucagaaccgcggu

SEQ ID NO: 3219305 - RNA, 17 nt, Mycobacterium leprae
ccuaggccacccgccag

SEQ ID NO: 3219306 - RNA, 23 nt, Mycobacterium leprae
ccuauccgaguggguaaaaccgg

SEQ ID NO: 3219307 - RNA, 19 nt, Mycobacterium leprae
ccuauugucagguggcuug

SEQ ID NO: 3219308 - RNA, 20 nt, Mycobacterium leprae
ccuauuuuuccgcagcgacg

SEQ ID NO: 3219309 - RNA, 20 nt, Mycobacterium leprae
ccucaaggccaugacaugca

SEQ ID NO: 3219310 - RNA, 22 nt, Mycobacterium leprae
ccucaaucaucgcagagcucac

SEQ ID NO: 3219311 - RNA, 16 nt, Mycobacterium leprae
ccucacacucacgccu

SEQ ID NO: 3219312 - RNA, 19 nt, Mycobacterium leprae
ccucacaguaggccagccc

SEQ ID NO: 3219313 - RNA, 15 nt, Mycobacterium leprae
ccucacccaguccug

SEQ ID NO: 3219314 - RNA, 20 nt, Mycobacterium leprae
ccucaccugcgacagccgug

SEQ ID NO: 3219315 - RNA, 20 nt, Mycobacterium leprae
ccucacgaauccuacaucca

SEQ ID NO: 3219316 - RNA, 22 nt, Mycobacterium leprae
ccucacucaugaucgcaggcac

SEQ ID NO: 3219317 - RNA, 20 nt, Mycobacterium leprae
ccucagccagcaagcaggca

SEQ ID NO: 3219318 - RNA, 15 nt, Mycobacterium leprae
ccucagugucagcag

SEQ ID NO: 3219319 - RNA, 12 nt, Mycobacterium leprae
ccuccacugcuc

SEQ ID NO: 3219320 - RNA, 13 nt, Mycobacterium leprae
ccuccagaaucac

SEQ ID NO: 3219321 - RNA, 16 nt, Mycobacterium leprae
ccuccagccgcgggcg

SEQ ID NO: 3219322 - RNA, 20 nt, Mycobacterium leprae
ccuccaggugaagccggcgc

SEQ ID NO: 3219323 - RNA, 21 nt, Mycobacterium leprae
ccucccagugagugcauucug

SEQ ID NO: 3219324 - RNA, 16 nt, Mycobacterium leprae
ccuccgagcgcccgca

SEQ ID NO: 3219325 - RNA, 22 nt, Mycobacterium leprae
ccuccgagcgcccgcacagcac

SEQ ID NO: 3219326 - RNA, 19 nt, Mycobacterium leprae
ccuccguugucccgcccgg

SEQ ID NO: 3219327 - RNA, 17 nt, Mycobacterium leprae
ccuccuaggccacccgc

SEQ ID NO: 3219328 - RNA, 23 nt, Mycobacterium leprae
ccucgaaccgauccagcauucag

SEQ ID NO: 3219329 - RNA, 20 nt, Mycobacterium leprae
ccucgaaucagcaucgacag

SEQ ID NO: 3219330 - RNA, 12 nt, Mycobacterium leprae
ccucgacccacc

SEQ ID NO: 3219331 - RNA, 15 nt, Mycobacterium leprae
cgaacugggugacca

SEQ ID NO: 3219332 - RNA, 18 nt, Mycobacterium leprae
cgaacugggugaccaccc

SEQ ID NO: 3219333 - RNA, 21 nt, Mycobacterium leprae
cgaagaaucuugaaauucaau

SEQ ID NO: 3219334 - RNA, 20 nt, Mycobacterium leprae
cgaagacuucuucgauuacg

SEQ ID NO: 3219335 - RNA, 17 nt, Mycobacterium leprae
cgaagagaggaaccgau

SEQ ID NO: 3219336 - RNA, 16 nt, Mycobacterium leprae
cgaagcaccagcagug

SEQ ID NO: 3219337 - RNA, 18 nt, Mycobacterium leprae
cgaagccuggucgcguag

SEQ ID NO: 3219338 - RNA, 18 nt, Mycobacterium leprae
cgaagcgauugggugggc

SEQ ID NO: 3219339 - RNA, 17 nt, Mycobacterium leprae
cgaagggaaugcgucag

SEQ ID NO: 3219340 - RNA, 18 nt, Mycobacterium leprae
cgaagugcuugggcacgc

SEQ ID NO: 3219341 - RNA, 18 nt, Mycobacterium leprae
cgaauagccgguggccac

SEQ ID NO: 3219342 - RNA, 21 nt, Mycobacterium leprae
cgaauagccgguggccaccgc

SEQ ID NO: 3219343 - RNA, 19 nt, Mycobacterium leprae
cgaauaguuauaccgugca

SEQ ID NO: 3219344 - RNA, 23 nt, Mycobacterium leprae
cgaauaucgcuacccuugagcac

SEQ ID NO: 3219345 - RNA, 18 nt, Mycobacterium leprae
cgaauaugcccagcagau

SEQ ID NO: 3219346 - RNA, 21 nt, Mycobacterium leprae
cgaauaugcccagcagauggc

SEQ ID NO: 3219347 - RNA, 21 nt, Mycobacterium leprae
cgaauauggcuaugacaagac

SEQ ID NO: 3219348 - RNA, 14 nt, Mycobacterium leprae
cgaaucagcaucga

SEQ ID NO: 3219349 - RNA, 14 nt, Mycobacterium leprae
cgaauccucgaugg

SEQ ID NO: 3219350 - RNA, 23 nt, Mycobacterium leprae
cgaauccugagaugccagccaac

SEQ ID NO: 3219351 - RNA, 12 nt, Mycobacterium leprae
cgaauucaucga

SEQ ID NO: 3219352 - RNA, 18 nt, Mycobacterium leprae
cgacaaagagaacuucuu

SEQ ID NO: 3219353 - RNA, 16 nt, Mycobacterium leprae
cgacaagcaucuuaac

SEQ ID NO: 3219354 - RNA, 21 nt, Mycobacterium leprae
cgacaccggccaaaagccuug

SEQ ID NO: 3219355 - RNA, 14 nt, Mycobacterium leprae
cgacacuggacugu

SEQ ID NO: 3219356 - RNA, 18 nt, Mycobacterium leprae
cgacacuugccgcguucg

SEQ ID NO: 3219357 - RNA, 18 nt, Mycobacterium leprae
cgacagaacccauccgaa

SEQ ID NO: 3219358 - RNA, 17 nt, Mycobacterium leprae
cgacagcacccagcuca

SEQ ID NO: 3219359 - RNA, 15 nt, Mycobacterium leprae
cgacagcagccacug

SEQ ID NO: 3219360 - RNA, 17 nt, Mycobacterium leprae
cgacagcucguggucca

SEQ ID NO: 3219361 - RNA, 17 nt, Mycobacterium leprae
cgacaguaucgaccagc

SEQ ID NO: 3219362 - RNA, 20 nt, Mycobacterium leprae
cgacauacaaucgcggcaca

SEQ ID NO: 3219363 - RNA, 22 nt, Mycobacterium leprae
cgacauagugcaagugcaccau

SEQ ID NO: 3219364 - RNA, 16 nt, Mycobacterium leprae
cgacaucaccggcggu

SEQ ID NO: 3219365 - RNA, 11 nt, Mycobacterium leprae
cgacaucgcag

SEQ ID NO: 3219366 - RNA, 14 nt, Mycobacterium leprae
cgacaucgcaggug

SEQ ID NO: 3219367 - RNA, 18 nt, Mycobacterium leprae
cgacaucguugcacggca

SEQ ID NO: 3219368 - RNA, 19 nt, Mycobacterium leprae
cgacaucuugaccugccgu

SEQ ID NO: 3219369 - RNA, 23 nt, Mycobacterium leprae
cgacaugacagcucggacaagau

SEQ ID NO: 3219370 - RNA, 16 nt, Mycobacterium leprae
cgacauucaccaguaa

SEQ ID NO: 3219371 - RNA, 22 nt, Mycobacterium leprae
cgaccaacccggcgauugccac

SEQ ID NO: 3219372 - RNA, 14 nt, Mycobacterium leprae
cgaccagccacgca

SEQ ID NO: 3219373 - RNA, 17 nt, Mycobacterium leprae
cgaccagcgagcaaccu

SEQ ID NO: 3219374 - RNA, 14 nt, Mycobacterium leprae
cgaccagcgcuaaa

SEQ ID NO: 3219375 - RNA, 23 nt, Mycobacterium leprae
cgaccaggauguuauucgggagc

SEQ ID NO: 3219376 - RNA, 17 nt, Mycobacterium leprae
cgacccggugguguucc

SEQ ID NO: 3219377 - RNA, 18 nt, Mycobacterium leprae
cgacccuugcuugagccu

SEQ ID NO: 3219378 - RNA, 15 nt, Mycobacterium leprae
cgaccgaaagccgca

SEQ ID NO: 3219379 - RNA, 15 nt, Mycobacterium leprae
cgaccgaccaaccgu

SEQ ID NO: 3219380 - RNA, 15 nt, Mycobacterium leprae
cgaccgacugcagaa

SEQ ID NO: 3219381 - RNA, 12 nt, Mycobacterium leprae
cgaccgacuggc

SEQ ID NO: 3219382 - RNA, 14 nt, Mycobacterium leprae
cgaccgcaccggcg

SEQ ID NO: 3219383 - RNA, 15 nt, Mycobacterium leprae
cgaccgcaccggcga

SEQ ID NO: 3219384 - RNA, 21 nt, Mycobacterium leprae
cgaccgcccgguagcaccaag

SEQ ID NO: 3219385 - RNA, 19 nt, Mycobacterium leprae
cgaccgcuggggucgcgga

SEQ ID NO: 3219386 - RNA, 17 nt, Mycobacterium leprae
cgaccgcuuuuccuucu

SEQ ID NO: 3219387 - RNA, 21 nt, Mycobacterium leprae
cgaccggacucaaacgucgaa

SEQ ID NO: 3219388 - RNA, 18 nt, Mycobacterium leprae
cgaccggccagugcaacc

SEQ ID NO: 3219389 - RNA, 23 nt, Mycobacterium leprae
cgaccgucuggaacacgaucggc

SEQ ID NO: 3219390 - RNA, 19 nt, Mycobacterium leprae
cgaccuccuugaccaccac

SEQ ID NO: 3219391 - RNA, 21 nt, Mycobacterium leprae
cgaccuccuugaccaccaccg

SEQ ID NO: 3219392 - RNA, 22 nt, Mycobacterium leprae
cgaccuccuugaccaccaccgc

SEQ ID NO: 3219393 - RNA, 16 nt, Mycobacterium leprae
cgaccuggugacgucg

SEQ ID NO: 3219394 - RNA, 19 nt, Mycobacterium leprae
cgaccuugccgaagcucug

SEQ ID NO: 3219395 - RNA, 20 nt, Mycobacterium leprae
cgaccuugccgaagcucugg

SEQ ID NO: 3219396 - RNA, 17 nt, Mycobacterium leprae
cgaccuugucgagguaa

SEQ ID NO: 3219397 - RNA, 21 nt, Mycobacterium leprae
cgacgaacccgucgaugaucu

SEQ ID NO: 3219398 - RNA, 20 nt, Mycobacterium leprae
cgacgaccuccgcagcaucg

SEQ ID NO: 3219399 - RNA, 15 nt, Mycobacterium leprae
cgacgacgugaaaca

SEQ ID NO: 3219400 - RNA, 23 nt, Mycobacterium leprae
cgacgaguuccaggacaacggcg

SEQ ID NO: 3219401 - RNA, 16 nt, Mycobacterium leprae
cgacgaugugcagcag

SEQ ID NO: 3219402 - RNA, 18 nt, Mycobacterium leprae
cgacgcaacugcuggagg

SEQ ID NO: 3219403 - RNA, 13 nt, Mycobacterium leprae
cgacgccgcggcu

SEQ ID NO: 3219404 - RNA, 22 nt, Mycobacterium leprae
cgacgccuagagagugcggugc

SEQ ID NO: 3219405 - RNA, 23 nt, Mycobacterium leprae
cgacgccuagagagugcggugcu

SEQ ID NO: 3219406 - RNA, 20 nt, Mycobacterium leprae
cgacgcggaaagcuucuggu

SEQ ID NO: 3219407 - RNA, 23 nt, Mycobacterium leprae
cgacgcuauguuggccagcagcg

SEQ ID NO: 3219408 - RNA, 18 nt, Mycobacterium leprae
cgacggauuucucguggu

SEQ ID NO: 3219409 - RNA, 16 nt, Mycobacterium leprae
cgacggcaacggcacc

SEQ ID NO: 3219410 - RNA, 17 nt, Mycobacterium leprae
cgacggcaacggcacca

SEQ ID NO: 3219411 - RNA, 17 nt, Mycobacterium leprae
cgacggcgcggcugcuu

SEQ ID NO: 3219412 - RNA, 14 nt, Mycobacterium leprae
cgacggcggccgcc

SEQ ID NO: 3219413 - RNA, 14 nt, Mycobacterium leprae
cgacggcuggcagc

SEQ ID NO: 3219414 - RNA, 23 nt, Mycobacterium leprae
cgacgguaaguuuucagccacau

SEQ ID NO: 3219415 - RNA, 18 nt, Mycobacterium leprae
cgacgguccugguggcaa

SEQ ID NO: 3219416 - RNA, 16 nt, Mycobacterium leprae
cgacggugcggcuggc

SEQ ID NO: 3219417 - RNA, 19 nt, Mycobacterium leprae
cgacggugcugauggccgg

SEQ ID NO: 3219418 - RNA, 20 nt, Mycobacterium leprae
cgacggugcugauggccggc

SEQ ID NO: 3219419 - RNA, 20 nt, Mycobacterium leprae
cgacguagcccacguccuga

SEQ ID NO: 3219420 - RNA, 14 nt, Mycobacterium leprae
cgacguauccaagg

SEQ ID NO: 3219421 - RNA, 16 nt, Mycobacterium leprae
cgacguuuugucuucu

SEQ ID NO: 3219422 - RNA, 18 nt, Mycobacterium leprae
cgacuaacgcuucugccu

SEQ ID NO: 3219423 - RNA, 13 nt, Mycobacterium leprae
cgacuaagccgcc

SEQ ID NO: 3219424 - RNA, 15 nt, Mycobacterium leprae
cgacuaagccgccga

SEQ ID NO: 3219425 - RNA, 17 nt, Mycobacterium leprae
cgacuaagccgccgaac

SEQ ID NO: 3219426 - RNA, 15 nt, Mycobacterium leprae
cgacuaauuguggcu

SEQ ID NO: 3219427 - RNA, 20 nt, Mycobacterium leprae
cgacucaccgguacacaccg

SEQ ID NO: 3219428 - RNA, 18 nt, Mycobacterium leprae
cgacucgcgaucccacgc

SEQ ID NO: 3219429 - RNA, 15 nt, Mycobacterium leprae
cgacucggcgccauc

SEQ ID NO: 3219430 - RNA, 16 nt, Mycobacterium leprae
cgacucggcgccaucg

SEQ ID NO: 3219431 - RNA, 20 nt, Mycobacterium leprae
cgacugaccagcgaucgacc

SEQ ID NO: 3219432 - RNA, 20 nt, Mycobacterium leprae
cgacuggcuugucaccagau

SEQ ID NO: 3219433 - RNA, 21 nt, Mycobacterium leprae
cgacuguggcacccacucggc

SEQ ID NO: 3219434 - RNA, 23 nt, Mycobacterium leprae
cgacuguggcacccacucggcgg

SEQ ID NO: 3219435 - RNA, 21 nt, Mycobacterium leprae
cgacuucgguccgcucaccgc

SEQ ID NO: 3219436 - RNA, 23 nt, Mycobacterium leprae
cgacuugaccagccgcagcaccc

SEQ ID NO: 3219437 - RNA, 18 nt, Mycobacterium leprae
cgacuuguugucgcgucg

SEQ ID NO: 3219438 - RNA, 18 nt, Mycobacterium leprae
cgagaagggagugcagug

SEQ ID NO: 3219439 - RNA, 20 nt, Mycobacterium leprae
cgagaagggagugcagugcc

SEQ ID NO: 3219440 - RNA, 18 nt, Mycobacterium leprae
cgagaaugucgcacccug

SEQ ID NO: 3219441 - RNA, 14 nt, Mycobacterium leprae
cgagacacccggcu

SEQ ID NO: 3219442 - RNA, 20 nt, Mycobacterium leprae
cgagacccagccgugguggu

SEQ ID NO: 3219443 - RNA, 22 nt, Mycobacterium leprae
cgaugcgcaccucgcugcagca

SEQ ID NO: 3219444 - RNA, 17 nt, Mycobacterium leprae
cgaugcgugccccggcc

SEQ ID NO: 3219445 - RNA, 23 nt, Mycobacterium leprae
cgaugcuaccgaacuugccacuu

SEQ ID NO: 3219446 - RNA, 12 nt, Mycobacterium leprae
cgauggcaacac

SEQ ID NO: 3219447 - RNA, 17 nt, Mycobacterium leprae
cgauggccagccguccc

SEQ ID NO: 3219448 - RNA, 14 nt, Mycobacterium leprae
cgauggcgguguua

SEQ ID NO: 3219449 - RNA, 14 nt, Mycobacterium leprae
cgauguacuccgaa

SEQ ID NO: 3219450 - RNA, 21 nt, Mycobacterium leprae
cgaugucgaccugaccgugcu

SEQ ID NO: 3219451 - RNA, 23 nt, Mycobacterium leprae
cgaugucggggaugguuuccagg

SEQ ID NO: 3219452 - RNA, 14 nt, Mycobacterium leprae
cgaugugcagcagc

SEQ ID NO: 3219453 - RNA, 15 nt, Mycobacterium leprae
cgaugugcagcagcu

SEQ ID NO: 3219454 - RNA, 14 nt, Mycobacterium leprae
cgaugugcucgguc

SEQ ID NO: 3219455 - RNA, 11 nt, Mycobacterium leprae
cgaugugcuua

SEQ ID NO: 3219456 - RNA, 19 nt, Mycobacterium leprae
cgauguggcuuugggaucu

SEQ ID NO: 3219457 - RNA, 17 nt, Mycobacterium leprae
cgauuaccacugccgau

SEQ ID NO: 3219458 - RNA, 13 nt, Mycobacterium leprae
cgauuagccgguc

SEQ ID NO: 3219459 - RNA, 13 nt, Mycobacterium leprae
cgauucaccgauc

SEQ ID NO: 3219460 - RNA, 15 nt, Mycobacterium leprae
cgauuccgccgucga

SEQ ID NO: 3219461 - RNA, 19 nt, Mycobacterium leprae
cgauuccuggaaagaguua

SEQ ID NO: 3219462 - RNA, 23 nt, Mycobacterium leprae
cgauucucgagcggcgcaugcca

SEQ ID NO: 3219463 - RNA, 22 nt, Mycobacterium leprae
cgauugggucagucagcgugcc

SEQ ID NO: 3219464 - RNA, 22 nt, Mycobacterium leprae
cgauuuggauggucggcagcug

SEQ ID NO: 3219465 - RNA, 19 nt, Mycobacterium leprae
cgcaaaacgauucugcgga

SEQ ID NO: 3219466 - RNA, 14 nt, Mycobacterium leprae
cgcaaaccaaacaa

SEQ ID NO: 3219467 - RNA, 12 nt, Mycobacterium leprae
cgcaacagucag

SEQ ID NO: 3219468 - RNA, 15 nt, Mycobacterium leprae
cgcaacagucagccg

SEQ ID NO: 3219469 - RNA, 17 nt, Mycobacterium leprae
cgcaaccgauacgccag

SEQ ID NO: 3219470 - RNA, 14 nt, Mycobacterium leprae
cgcaaccgccggca

SEQ ID NO: 3219471 - RNA, 20 nt, Mycobacterium leprae
cgcaaccgccggcaagcccg

SEQ ID NO: 3219472 - RNA, 17 nt, Mycobacterium leprae
cgcaacgccuccacugc

SEQ ID NO: 3219473 - RNA, 18 nt, Mycobacterium leprae
cgcaacugcuggagggca

SEQ ID NO: 3219474 - RNA, 20 nt, Mycobacterium leprae
cgcaacuuuguacgacgacc

SEQ ID NO: 3219475 - RNA, 23 nt, Mycobacterium leprae
cgcaagguuguuuguucagugcc

SEQ ID NO: 3219476 - RNA, 17 nt, Mycobacterium leprae
cgcaagugcggcgccca

SEQ ID NO: 3219477 - RNA, 18 nt, Mycobacterium leprae
cgcaaguucgacgugguc

SEQ ID NO: 3219478 - RNA, 22 nt, Mycobacterium leprae
cgcaauacggugcaccagcuca

SEQ ID NO: 3219479 - RNA, 19 nt, Mycobacterium leprae
cgcaaucgaaaaaugccgg

SEQ ID NO: 3219480 - RNA, 17 nt, Mycobacterium leprae
cgcaaucuacuggaugc

SEQ ID NO: 3219481 - RNA, 14 nt, Mycobacterium leprae
cgcaauuuggugau

SEQ ID NO: 3219482 - RNA, 21 nt, Mycobacterium leprae
cgcaauuuggugaucacgguu

SEQ ID NO: 3219483 - RNA, 18 nt, Mycobacterium leprae
cgcacaaaaauccuccca

SEQ ID NO: 3219484 - RNA, 16 nt, Mycobacterium leprae
cgcacacgacagccgc

SEQ ID NO: 3219485 - RNA, 15 nt, Mycobacterium leprae
cgcacagagcccagc

SEQ ID NO: 3219486 - RNA, 18 nt, Mycobacterium leprae
cgcacaguuccagugccu

SEQ ID NO: 3219487 - RNA, 19 nt, Mycobacterium leprae
cgcacaucgguaggccuga

SEQ ID NO: 3219488 - RNA, 22 nt, Mycobacterium leprae
cgcacauggggcuaaucguucc

SEQ ID NO: 3219489 - RNA, 15 nt, Mycobacterium leprae
cgcaccaacucgaug

SEQ ID NO: 3219490 - RNA, 17 nt, Mycobacterium leprae
cgcaccaauccaccgug

SEQ ID NO: 3219491 - RNA, 20 nt, Mycobacterium leprae
cgcacccggcagcauccgcc

SEQ ID NO: 3219492 - RNA, 17 nt, Mycobacterium leprae
cgcacccugcacacuga

SEQ ID NO: 3219493 - RNA, 17 nt, Mycobacterium leprae
cgcacccugccgccaca

SEQ ID NO: 3219494 - RNA, 14 nt, Mycobacterium leprae
cgcaccgauccggc

SEQ ID NO: 3219495 - RNA, 15 nt, Mycobacterium leprae
cgcaccgaucugccc

SEQ ID NO: 3219496 - RNA, 17 nt, Mycobacterium leprae
cgcaccggcguuccggc

SEQ ID NO: 3219497 - RNA, 12 nt, Mycobacterium leprae
cgcaccggcugc

SEQ ID NO: 3219498 - RNA, 13 nt, Mycobacterium leprae
cgcaccggcugca

SEQ ID NO: 3219499 - RNA, 20 nt, Mycobacterium leprae
cgcaccucgcugcagcauaa

SEQ ID NO: 3219500 - RNA, 16 nt, Mycobacterium leprae
cgcacguaagcauguc

SEQ ID NO: 3219501 - RNA, 18 nt, Mycobacterium leprae
cgcacguuagacgacggc

SEQ ID NO: 3219502 - RNA, 18 nt, Mycobacterium leprae
cgcagaagccggcucgcg

SEQ ID NO: 3219503 - RNA, 16 nt, Mycobacterium leprae
cgcagaccucuuccgc

SEQ ID NO: 3219504 - RNA, 18 nt, Mycobacterium leprae
cgcagaccucuuccgccg

SEQ ID NO: 3219505 - RNA, 16 nt, Mycobacterium leprae
cgcagagcucacuggg

SEQ ID NO: 3219506 - RNA, 14 nt, Mycobacterium leprae
cgcagagguaaauc

SEQ ID NO: 3219507 - RNA, 14 nt, Mycobacterium leprae
cgcagcaagcggcc

SEQ ID NO: 3219508 - RNA, 17 nt, Mycobacterium leprae
cgcagcaagcggccgcc

SEQ ID NO: 3219509 - RNA, 16 nt, Mycobacterium leprae
cgcagcaccugccgca

SEQ ID NO: 3219510 - RNA, 16 nt, Mycobacterium leprae
cgcagcaucagggcug

SEQ ID NO: 3219511 - RNA, 15 nt, Mycobacterium leprae
cgcagcaucggcauc

SEQ ID NO: 3219512 - RNA, 20 nt, Mycobacterium leprae
cgcagcaugguggccacgau

SEQ ID NO: 3219513 - RNA, 13 nt, Mycobacterium leprae
cgcagccaccacu

SEQ ID NO: 3219514 - RNA, 14 nt, Mycobacterium leprae
cgcagccaccacuc

SEQ ID NO: 3219515 - RNA, 23 nt, Mycobacterium leprae
cgcagccggaggguugccgacgg

SEQ ID NO: 3219516 - RNA, 17 nt, Mycobacterium leprae
cgcagcgacggcaagcu

SEQ ID NO: 3219517 - RNA, 16 nt, Mycobacterium leprae
cgcagcgcgaacaaga

SEQ ID NO: 3219518 - RNA, 15 nt, Mycobacterium leprae
cgcagcgcggccauc

SEQ ID NO: 3219519 - RNA, 17 nt, Mycobacterium leprae
cgcagcgguacccgcca

SEQ ID NO: 3219520 - RNA, 19 nt, Mycobacterium leprae
cgcagcucgccaaggucga

SEQ ID NO: 3219521 - RNA, 15 nt, Mycobacterium leprae
cgcagcugcucggcc

SEQ ID NO: 3219522 - RNA, 15 nt, Mycobacterium leprae
cgcagcuggccaagc

SEQ ID NO: 3219523 - RNA, 16 nt, Mycobacterium leprae
cgcaggaucggguagc

SEQ ID NO: 3219524 - RNA, 24 nt, Mycobacterium leprae
cgcaggcacccguugaagccguug

SEQ ID NO: 3219525 - RNA, 15 nt, Mycobacterium leprae
cgcagggacgauagu

SEQ ID NO: 3219526 - RNA, 18 nt, Mycobacterium leprae
cgcagggcgcgcagcugg

SEQ ID NO: 3219527 - RNA, 14 nt, Mycobacterium leprae
cgcaggucacccuc

SEQ ID NO: 3219528 - RNA, 21 nt, Mycobacterium leprae
cgcaguggguggacgacggcu

SEQ ID NO: 3219529 - RNA, 14 nt, Mycobacterium leprae
cgcagugugcuuuc

SEQ ID NO: 3219530 - RNA, 23 nt, Mycobacterium leprae
cgcaguuaguuuaacgccugcuu

SEQ ID NO: 3219531 - RNA, 15 nt, Mycobacterium leprae
cgcaguuggccacug

SEQ ID NO: 3219532 - RNA, 18 nt, Mycobacterium leprae
cgcauacuggcacgccag

SEQ ID NO: 3219533 - RNA, 23 nt, Mycobacterium leprae
cgcauagcagcuucucggggcga

SEQ ID NO: 3219534 - RNA, 16 nt, Mycobacterium leprae
cgcauauggccgaacc

SEQ ID NO: 3219535 - RNA, 15 nt, Mycobacterium leprae
cgcaucaacaccaaa

SEQ ID NO: 3219536 - RNA, 21 nt, Mycobacterium leprae
cgcaucaacaccaaaugugcu

SEQ ID NO: 3219537 - RNA, 15 nt, Mycobacterium leprae
cgcaucagccaacac

SEQ ID NO: 3219538 - RNA, 17 nt, Mycobacterium leprae
cgcaucagccaacacca

SEQ ID NO: 3219539 - RNA, 22 nt, Mycobacterium leprae
cgcaucagccaacaccaccagu

SEQ ID NO: 3219540 - RNA, 17 nt, Mycobacterium leprae
cgcauccucggacugcc

SEQ ID NO: 3219541 - RNA, 17 nt, Mycobacterium leprae
cgcaucugccauaucaa

SEQ ID NO: 3219542 - RNA, 20 nt, Mycobacterium leprae
cgcaucuucgcccagcacgc

SEQ ID NO: 3219543 - RNA, 15 nt, Mycobacterium leprae
cgcaugagccggucg

SEQ ID NO: 3219544 - RNA, 23 nt, Mycobacterium leprae
cgcauguaacacucauuggaccc

SEQ ID NO: 3219545 - RNA, 14 nt, Mycobacterium leprae
cgcauugccaacgu

SEQ ID NO: 3219546 - RNA, 15 nt, Mycobacterium leprae
cgcauuggucggggu

SEQ ID NO: 3219547 - RNA, 20 nt, Mycobacterium leprae
cgcauuuaccgagaucgacg

SEQ ID NO: 3219548 - RNA, 18 nt, Mycobacterium leprae
cgccaaacuggucaacgc

SEQ ID NO: 3219549 - RNA, 20 nt, Mycobacterium leprae
cgccaaacuggucaacgcag

SEQ ID NO: 3219550 - RNA, 15 nt, Mycobacterium leprae
cgccaacacuagcgg

SEQ ID NO: 3219551 - RNA, 12 nt, Mycobacterium leprae
cgccaagaccua

SEQ ID NO: 3219552 - RNA, 16 nt, Mycobacterium leprae
cgccacaugugcgcca

SEQ ID NO: 3219553 - RNA, 16 nt, Mycobacterium leprae
cgccaccgaccgccuu

SEQ ID NO: 3219554 - RNA, 12 nt, Mycobacterium leprae
cgccaccgccgg

SEQ ID NO: 3219555 - RNA, 16 nt, Mycobacterium leprae
cgccacgaccaaaccu

SEQ ID NO: 3219556 - RNA, 12 nt, Mycobacterium leprae
cgcggaccgucg

SEQ ID NO: 3219557 - RNA, 18 nt, Mycobacterium leprae
cgcggacucuccccacug

SEQ ID NO: 3219558 - RNA, 19 nt, Mycobacterium leprae
cgcggaguuggccgcggca

SEQ ID NO: 3219559 - RNA, 13 nt, Mycobacterium leprae
cgcggaucugggc

SEQ ID NO: 3219560 - RNA, 21 nt, Mycobacterium leprae
cgcggcacguucgaucggcag

SEQ ID NO: 3219561 - RNA, 13 nt, Mycobacterium leprae
cgcggcagcugcu

SEQ ID NO: 3219562 - RNA, 15 nt, Mycobacterium leprae
cgcggcaucgucggc

SEQ ID NO: 3219563 - RNA, 16 nt, Mycobacterium leprae
cgcggcaucgucggca

SEQ ID NO: 3219564 - RNA, 19 nt, Mycobacterium leprae
cgcggcgaccuggucgagc

SEQ ID NO: 3219565 - RNA, 21 nt, Mycobacterium leprae
cgcggcgaccuggucgagcag

SEQ ID NO: 3219566 - RNA, 23 nt, Mycobacterium leprae
cgcggcgaggggaugcagguacu

SEQ ID NO: 3219567 - RNA, 19 nt, Mycobacterium leprae
cgcggcgaugaccggacga

SEQ ID NO: 3219568 - RNA, 9 nt, Mycobacterium leprae
cgcggcgcc

SEQ ID NO: 3219569 - RNA, 20 nt, Mycobacterium leprae
cgcggcguuauccacgccga

SEQ ID NO: 3219570 - RNA, 14 nt, Mycobacterium leprae
cgcggcugccacug

SEQ ID NO: 3219571 - RNA, 12 nt, Mycobacterium leprae
cgcgggcaagcc

SEQ ID NO: 3219572 - RNA, 21 nt, Mycobacterium leprae
cgcgggcccgucguggugugc

SEQ ID NO: 3219573 - RNA, 21 nt, Mycobacterium leprae
cgcgggcgaugccaucgggcc

SEQ ID NO: 3219574 - RNA, 13 nt, Mycobacterium leprae
cgcgggcgccgca

SEQ ID NO: 3219575 - RNA, 19 nt, Mycobacterium leprae
cgcgggcgccgcaguguuu

SEQ ID NO: 3219576 - RNA, 17 nt, Mycobacterium leprae
cgcgggcuugcuccgag

SEQ ID NO: 3219577 - RNA, 19 nt, Mycobacterium leprae
cgcggggcgaugucgaccu

SEQ ID NO: 3219578 - RNA, 21 nt, Mycobacterium leprae
cgcggguaccccauucagcgg

SEQ ID NO: 3219579 - RNA, 20 nt, Mycobacterium leprae
cgcgguagauaucuacuggg

SEQ ID NO: 3219580 - RNA, 22 nt, Mycobacterium leprae
cgcgguaggaguuuuucagcgg

SEQ ID NO: 3219581 - RNA, 13 nt, Mycobacterium leprae
cgcgguaggccag

SEQ ID NO: 3219582 - RNA, 14 nt, Mycobacterium leprae
cgcggucgccgaug

SEQ ID NO: 3219583 - RNA, 17 nt, Mycobacterium leprae
cgcggucgucaagugcg

SEQ ID NO: 3219584 - RNA, 19 nt, Mycobacterium leprae
cgcggucgugcugcugguu

SEQ ID NO: 3219585 - RNA, 14 nt, Mycobacterium leprae
cgcggucugggcgu

SEQ ID NO: 3219586 - RNA, 16 nt, Mycobacterium leprae
cgcggugauuggcuga

SEQ ID NO: 3219587 - RNA, 19 nt, Mycobacterium leprae
cgcgguguucgucgcggag

SEQ ID NO: 3219588 - RNA, 23 nt, Mycobacterium leprae
cgcguauuucgagcgugacgaca

SEQ ID NO: 3219589 - RNA, 14 nt, Mycobacterium leprae
cgcgucgacaagca

SEQ ID NO: 3219590 - RNA, 21 nt, Mycobacterium leprae
cgcgucgagaaguuaccgacg

SEQ ID NO: 3219591 - RNA, 20 nt, Mycobacterium leprae
cgcgucgcaucgguggcacg

SEQ ID NO: 3219592 - RNA, 14 nt, Mycobacterium leprae
cgcgugaucuccgc

SEQ ID NO: 3219593 - RNA, 13 nt, Mycobacterium leprae
cgcgugccaccag

SEQ ID NO: 3219594 - RNA, 16 nt, Mycobacterium leprae
cgcgugcggcgcccac

SEQ ID NO: 3219595 - RNA, 23 nt, Mycobacterium leprae
cgcguggguccguucgugucgga

SEQ ID NO: 3219596 - RNA, 17 nt, Mycobacterium leprae
cgcguucugucgcgucg

SEQ ID NO: 3219597 - RNA, 14 nt, Mycobacterium leprae
cgcguugaccaaac

SEQ ID NO: 3219598 - RNA, 15 nt, Mycobacterium leprae
cgcguuggcucgacg

SEQ ID NO: 3219599 - RNA, 15 nt, Mycobacterium leprae
cgcguuugucggcgu

SEQ ID NO: 3219600 - RNA, 18 nt, Mycobacterium leprae
cgcuaacaacuauccuca

SEQ ID NO: 3219601 - RNA, 19 nt, Mycobacterium leprae
cgcuaaggcagcccgcgcc

SEQ ID NO: 3219602 - RNA, 16 nt, Mycobacterium leprae
cgcuaaggcugcugac

SEQ ID NO: 3219603 - RNA, 15 nt, Mycobacterium leprae
cgcuaaucgcgggca

SEQ ID NO: 3219604 - RNA, 19 nt, Mycobacterium leprae
cgcuaaucgcgggcaagcc

SEQ ID NO: 3219605 - RNA, 19 nt, Mycobacterium leprae
cgcuacauugcuccgcagc

SEQ ID NO: 3219606 - RNA, 12 nt, Mycobacterium leprae
cgcuacgcccga

SEQ ID NO: 3219607 - RNA, 20 nt, Mycobacterium leprae
cgcuacggcgguguuucucg

SEQ ID NO: 3219608 - RNA, 23 nt, Mycobacterium leprae
cgcuagcgauguagccaacagcc

SEQ ID NO: 3219609 - RNA, 15 nt, Mycobacterium leprae
cgcuaggacaacaga

SEQ ID NO: 3219610 - RNA, 20 nt, Mycobacterium leprae
cgcuaugaguuucggcgccu

SEQ ID NO: 3219611 - RNA, 16 nt, Mycobacterium leprae
cgcuauggauacucaa

SEQ ID NO: 3219612 - RNA, 21 nt, Mycobacterium leprae
cgcuaugugcaaucgauccgg

SEQ ID NO: 3219613 - RNA, 19 nt, Mycobacterium leprae
cgcuauguuggccagcagc

SEQ ID NO: 3219614 - RNA, 22 nt, Mycobacterium leprae
cgcucacagcaggcgaguggcg

SEQ ID NO: 3219615 - RNA, 20 nt, Mycobacterium leprae
cgcucacccgcgccgccugc

SEQ ID NO: 3219616 - RNA, 15 nt, Mycobacterium leprae
cgcucaccgacggau

SEQ ID NO: 3219617 - RNA, 15 nt, Mycobacterium leprae
cgcucaccgcggccg

SEQ ID NO: 3219618 - RNA, 21 nt, Mycobacterium leprae
cgcucacgauugcucugaggu

SEQ ID NO: 3219619 - RNA, 18 nt, Mycobacterium leprae
cgcucaggcuaccgagcu

SEQ ID NO: 3219620 - RNA, 12 nt, Mycobacterium leprae
cgcuccgcccac

SEQ ID NO: 3219621 - RNA, 17 nt, Mycobacterium leprae
cgcucgucgcgggcggu

SEQ ID NO: 3219622 - RNA, 21 nt, Mycobacterium leprae
cgcucugcguaaccgccaucg

SEQ ID NO: 3219623 - RNA, 19 nt, Mycobacterium leprae
cgcugaaccgcgucggcgu

SEQ ID NO: 3219624 - RNA, 19 nt, Mycobacterium leprae
cgcugaccgccggucgggg

SEQ ID NO: 3219625 - RNA, 18 nt, Mycobacterium leprae
cgcugagagugccaccgc

SEQ ID NO: 3219626 - RNA, 15 nt, Mycobacterium leprae
cgcugaggauagcca

SEQ ID NO: 3219627 - RNA, 22 nt, Mycobacterium leprae
cgcugauaaggucuggcaccgc

SEQ ID NO: 3219628 - RNA, 12 nt, Mycobacterium leprae
cgcugaucaacg

SEQ ID NO: 3219629 - RNA, 20 nt, Mycobacterium leprae
cgcugaucgcgauaccggcg

SEQ ID NO: 3219630 - RNA, 21 nt, Mycobacterium leprae
cgcugaucgggcugcggugac

SEQ ID NO: 3219631 - RNA, 16 nt, Mycobacterium leprae
cgcugauggcacuacc

SEQ ID NO: 3219632 - RNA, 14 nt, Mycobacterium leprae
cgcugauuggcaau

SEQ ID NO: 3219633 - RNA, 16 nt, Mycobacterium leprae
cgcugcaaggugggcg

SEQ ID NO: 3219634 - RNA, 23 nt, Mycobacterium leprae
cgcugcaauucgcuaacuucccg

SEQ ID NO: 3219635 - RNA, 22 nt, Mycobacterium leprae
cgcugcacauucaaccagccaa

SEQ ID NO: 3219636 - RNA, 12 nt, Mycobacterium leprae
cgcugcacgaaa

SEQ ID NO: 3219637 - RNA, 21 nt, Mycobacterium leprae
cgcugcagcaacagccacacc

SEQ ID NO: 3219638 - RNA, 13 nt, Mycobacterium leprae
cgcugcauccgca

SEQ ID NO: 3219639 - RNA, 15 nt, Mycobacterium leprae
cgcugcauccgcagc

SEQ ID NO: 3219640 - RNA, 12 nt, Mycobacterium leprae
cgcugccaaagu

SEQ ID NO: 3219641 - RNA, 18 nt, Mycobacterium leprae
cgcugccaucgacgccgu

SEQ ID NO: 3219642 - RNA, 13 nt, Mycobacterium leprae
cgcugcgcgcagu

SEQ ID NO: 3219643 - RNA, 15 nt, Mycobacterium leprae
cgcugcgcggcugcg

SEQ ID NO: 3219644 - RNA, 17 nt, Mycobacterium leprae
cgcugcuuccugaacaa

SEQ ID NO: 3219645 - RNA, 16 nt, Mycobacterium leprae
cgcugcuugcucuggg

SEQ ID NO: 3219646 - RNA, 18 nt, Mycobacterium leprae
cgcuggcacuccgaccga

SEQ ID NO: 3219647 - RNA, 15 nt, Mycobacterium leprae
cgcuggcggugugug

SEQ ID NO: 3219648 - RNA, 13 nt, Mycobacterium leprae
cgcuggcucaacg

SEQ ID NO: 3219649 - RNA, 21 nt, Mycobacterium leprae
cgcugggacaugaagccguug

SEQ ID NO: 3219650 - RNA, 15 nt, Mycobacterium leprae
cgcugggugagcugu

SEQ ID NO: 3219651 - RNA, 17 nt, Mycobacterium leprae
cgcugggugagcugugc

SEQ ID NO: 3219652 - RNA, 22 nt, Mycobacterium leprae
cgcugggugugucaucaucacc

SEQ ID NO: 3219653 - RNA, 21 nt, Mycobacterium leprae
cgcugguaucggugucggcgg

SEQ ID NO: 3219654 - RNA, 23 nt, Mycobacterium leprae
cgcugguaucggugucggcggcu

SEQ ID NO: 3219655 - RNA, 14 nt, Mycobacterium leprae
cgcugucgauggac

SEQ ID NO: 3219656 - RNA, 17 nt, Mycobacterium leprae
cgcugugcgcaugcacg

SEQ ID NO: 3219657 - RNA, 20 nt, Mycobacterium leprae
cgcuguguguuuggggguua

SEQ ID NO: 3219658 - RNA, 20 nt, Mycobacterium leprae
cgcuguuccauaacguugca

SEQ ID NO: 3219659 - RNA, 20 nt, Mycobacterium leprae
cgcuucgguuagcaucgacc

SEQ ID NO: 3219660 - RNA, 14 nt, Mycobacterium leprae
cgcuugcccgcugg

SEQ ID NO: 3219661 - RNA, 14 nt, Mycobacterium leprae
cgcuuguaaggcca

SEQ ID NO: 3219662 - RNA, 13 nt, Mycobacterium leprae
cgcuuuccgcgcc

SEQ ID NO: 3219663 - RNA, 15 nt, Mycobacterium leprae
cgcuuugccgcugug

SEQ ID NO: 3219664 - RNA, 18 nt, Mycobacterium leprae
cggaaaagucguggagca

SEQ ID NO: 3219665 - RNA, 15 nt, Mycobacterium leprae
cggaaacacagcaag

SEQ ID NO: 3219666 - RNA, 21 nt, Mycobacterium leprae
cggaaauggguuuggugggca

SEQ ID NO: 3219667 - RNA, 17 nt, Mycobacterium leprae
cggaacaacagacacau

SEQ ID NO: 3219668 - RNA, 16 nt, Mycobacterium leprae
cggaaccauccggcaa

SEQ ID NO: 3219669 - RNA, 22 nt, Mycobacterium leprae
cggccggugaugacgaaauucg

SEQ ID NO: 3219670 - RNA, 22 nt, Mycobacterium leprae
cggccguaaucaagaucggcca

SEQ ID NO: 3219671 - RNA, 15 nt, Mycobacterium leprae
cggccuccggugccc

SEQ ID NO: 3219672 - RNA, 22 nt, Mycobacterium leprae
cggccucgugcugcgugccugg

SEQ ID NO: 3219673 - RNA, 23 nt, Mycobacterium leprae
cggccucgugcugcgugccuggu

SEQ ID NO: 3219674 - RNA, 19 nt, Mycobacterium leprae
cggccuggaaacgggugga

SEQ ID NO: 3219675 - RNA, 17 nt, Mycobacterium leprae
cggccuugccgcuccgc

SEQ ID NO: 3219676 - RNA, 15 nt, Mycobacterium leprae
cggccuuggcagccg

SEQ ID NO: 3219677 - RNA, 14 nt, Mycobacterium leprae
cggcgaaacguuca

SEQ ID NO: 3219678 - RNA, 15 nt, Mycobacterium leprae
cggcgaaggagcggu

SEQ ID NO: 3219679 - RNA, 15 nt, Mycobacterium leprae
cggcgaagucaagau

SEQ ID NO: 3219680 - RNA, 21 nt, Mycobacterium leprae
cggcgaccaguuuacaucgga

SEQ ID NO: 3219681 - RNA, 20 nt, Mycobacterium leprae
cggcgaccuggucgagcagc

SEQ ID NO: 3219682 - RNA, 22 nt, Mycobacterium leprae
cggcgaccuggucgagcagcuc

SEQ ID NO: 3219683 - RNA, 18 nt, Mycobacterium leprae
cggcgagcaagcggugug

SEQ ID NO: 3219684 - RNA, 22 nt, Mycobacterium leprae
cggcgauauccgccggccgcac

SEQ ID NO: 3219685 - RNA, 23 nt, Mycobacterium leprae
cggcgauccucaaccagcgugca

SEQ ID NO: 3219686 - RNA, 15 nt, Mycobacterium leprae
cggcgaugaccggac

SEQ ID NO: 3219687 - RNA, 17 nt, Mycobacterium leprae
cggcgaugaccggacga

SEQ ID NO: 3219688 - RNA, 22 nt, Mycobacterium leprae
cggcgaugugacguucgaugcc

SEQ ID NO: 3219689 - RNA, 21 nt, Mycobacterium leprae
cggcgcacagguguugggcca

SEQ ID NO: 3219690 - RNA, 17 nt, Mycobacterium leprae
cggcgcaguugaccgga

SEQ ID NO: 3219691 - RNA, 20 nt, Mycobacterium leprae
cggcgccucacccaugccuc

SEQ ID NO: 3219692 - RNA, 18 nt, Mycobacterium leprae
cggcgcgaucuuccacca

SEQ ID NO: 3219693 - RNA, 15 nt, Mycobacterium leprae
cggcgcgcaggcugc

SEQ ID NO: 3219694 - RNA, 13 nt, Mycobacterium leprae
cggcgcgguggcu

SEQ ID NO: 3219695 - RNA, 17 nt, Mycobacterium leprae
cggcgcucaccgacgga

SEQ ID NO: 3219696 - RNA, 21 nt, Mycobacterium leprae
cggcgcucaccgacggaugcc

SEQ ID NO: 3219697 - RNA, 15 nt, Mycobacterium leprae
cggcgcucuguucug

SEQ ID NO: 3219698 - RNA, 19 nt, Mycobacterium leprae
cggcgcuggggcgcuggcg

SEQ ID NO: 3219699 - RNA, 18 nt, Mycobacterium leprae
cggcggcagcuggaaagu

SEQ ID NO: 3219700 - RNA, 13 nt, Mycobacterium leprae
cggcggccaccgc

SEQ ID NO: 3219701 - RNA, 16 nt, Mycobacterium leprae
cggcggcgccgauccc

SEQ ID NO: 3219702 - RNA, 16 nt, Mycobacterium leprae
cggcggcggccauggu

SEQ ID NO: 3219703 - RNA, 15 nt, Mycobacterium leprae
cggcggggcgucgcu

SEQ ID NO: 3219704 - RNA, 16 nt, Mycobacterium leprae
cggcggggugucuggg

SEQ ID NO: 3219705 - RNA, 20 nt, Mycobacterium leprae
cggcgucaaagucgcgggcu

SEQ ID NO: 3219706 - RNA, 13 nt, Mycobacterium leprae
cggcgucacccag

SEQ ID NO: 3219707 - RNA, 18 nt, Mycobacterium leprae
cggcgucauucacccgcg

SEQ ID NO: 3219708 - RNA, 16 nt, Mycobacterium leprae
cggcgucgacaucacc

SEQ ID NO: 3219709 - RNA, 18 nt, Mycobacterium leprae
cggcgucgacaucaccgg

SEQ ID NO: 3219710 - RNA, 20 nt, Mycobacterium leprae
cggcgucgacaucaccggcg

SEQ ID NO: 3219711 - RNA, 17 nt, Mycobacterium leprae
cggcgucgcgucaucag

SEQ ID NO: 3219712 - RNA, 21 nt, Mycobacterium leprae
cggcgucgcuguuugccgagu

SEQ ID NO: 3219713 - RNA, 17 nt, Mycobacterium leprae
cggcgucgguggcagca

SEQ ID NO: 3219714 - RNA, 15 nt, Mycobacterium leprae
cggcgucgugacggg

SEQ ID NO: 3219715 - RNA, 23 nt, Mycobacterium leprae
cggcgucuucccaaugcucgacc

SEQ ID NO: 3219716 - RNA, 13 nt, Mycobacterium leprae
cggcgugccuggc

SEQ ID NO: 3219717 - RNA, 14 nt, Mycobacterium leprae
cggcguggucggcg

SEQ ID NO: 3219718 - RNA, 15 nt, Mycobacterium leprae
cggcguggucggcga

SEQ ID NO: 3219719 - RNA, 22 nt, Mycobacterium leprae
cggcguguggggguccgcgcac

SEQ ID NO: 3219720 - RNA, 21 nt, Mycobacterium leprae
cggcguguuuacgcucgguaa

SEQ ID NO: 3219721 - RNA, 15 nt, Mycobacterium leprae
cggcguuauugacca

SEQ ID NO: 3219722 - RNA, 15 nt, Mycobacterium leprae
cggcguucgauaaga

SEQ ID NO: 3219723 - RNA, 21 nt, Mycobacterium leprae
cggcguugagcgcagccacca

SEQ ID NO: 3219724 - RNA, 23 nt, Mycobacterium leprae
cggcuacacaacaagcgacuucg

SEQ ID NO: 3219725 - RNA, 22 nt, Mycobacterium leprae
cggcuacacgguauaaaggcgc

SEQ ID NO: 3219726 - RNA, 16 nt, Mycobacterium leprae
cggcuaccaauugcga

SEQ ID NO: 3219727 - RNA, 17 nt, Mycobacterium leprae
cggcuacugcgacagca

SEQ ID NO: 3219728 - RNA, 20 nt, Mycobacterium leprae
cggcuacugcgacagcagcc

SEQ ID NO: 3219729 - RNA, 20 nt, Mycobacterium leprae
cggcuagccgugcagccuca

SEQ ID NO: 3219730 - RNA, 15 nt, Mycobacterium leprae
cggcuagucggccgg

SEQ ID NO: 3219731 - RNA, 13 nt, Mycobacterium leprae
cggcuaucgccgc

SEQ ID NO: 3219732 - RNA, 21 nt, Mycobacterium leprae
cggcuaugcucaaccgugcug

SEQ ID NO: 3219733 - RNA, 21 nt, Mycobacterium leprae
cggcucccaucggcggccagc

SEQ ID NO: 3219734 - RNA, 16 nt, Mycobacterium leprae
cggcuccuccagcauc

SEQ ID NO: 3219735 - RNA, 17 nt, Mycobacterium leprae
cggcugccacuguguca

SEQ ID NO: 3219736 - RNA, 22 nt, Mycobacterium leprae
cggcugccacugugucacgcga

SEQ ID NO: 3219737 - RNA, 13 nt, Mycobacterium leprae
cggcugccgcgca

SEQ ID NO: 3219738 - RNA, 17 nt, Mycobacterium leprae
cggcugcguuaccggcg

SEQ ID NO: 3219739 - RNA, 19 nt, Mycobacterium leprae
cggcuggcuaauggcgggc

SEQ ID NO: 3219740 - RNA, 21 nt, Mycobacterium leprae
cggcuggcuaauggcgggcug

SEQ ID NO: 3219741 - RNA, 15 nt, Mycobacterium leprae
cggcugggcagccga

SEQ ID NO: 3219742 - RNA, 17 nt, Mycobacterium leprae
cggcugggcagccgagg

SEQ ID NO: 3219743 - RNA, 16 nt, Mycobacterium leprae
cggcuggugcggcggu

SEQ ID NO: 3219744 - RNA, 22 nt, Mycobacterium leprae
cggcugucagagugcagaucac

SEQ ID NO: 3219745 - RNA, 19 nt, Mycobacterium leprae
cggcuugauguccaagggg

SEQ ID NO: 3219746 - RNA, 17 nt, Mycobacterium leprae
cggcuuugcugucgaau

SEQ ID NO: 3219747 - RNA, 16 nt, Mycobacterium leprae
cggcuuuggcggacug

SEQ ID NO: 3219748 - RNA, 15 nt, Mycobacterium leprae
cggcuuuucgacauu

SEQ ID NO: 3219749 - RNA, 14 nt, Mycobacterium leprae
cgggaacacgucga

SEQ ID NO: 3219750 - RNA, 17 nt, Mycobacterium leprae
cgggacagugucuuagg

SEQ ID NO: 3219751 - RNA, 17 nt, Mycobacterium leprae
cgggaccgggcgcgcgc

SEQ ID NO: 3219752 - RNA, 21 nt, Mycobacterium leprae
cgggacgugcacugguggugg

SEQ ID NO: 3219753 - RNA, 20 nt, Mycobacterium leprae
cgggagaggaucagcgcugc

SEQ ID NO: 3219754 - RNA, 16 nt, Mycobacterium leprae
cgggaggauggcgacg

SEQ ID NO: 3219755 - RNA, 20 nt, Mycobacterium leprae
cgggaugaugauugccgccg

SEQ ID NO: 3219756 - RNA, 18 nt, Mycobacterium leprae
cgggauggcugggcaagc

SEQ ID NO: 3219757 - RNA, 18 nt, Mycobacterium leprae
cgggaugugugcgcgccg

SEQ ID NO: 3219758 - RNA, 23 nt, Mycobacterium leprae
cgggcaaaccacuuagcgugagc

SEQ ID NO: 3219759 - RNA, 14 nt, Mycobacterium leprae
cgggcaagcccugc

SEQ ID NO: 3219760 - RNA, 21 nt, Mycobacterium leprae
cgggcacacagauccugggcg

SEQ ID NO: 3219761 - RNA, 18 nt, Mycobacterium leprae
cgggcaccagauggcucc

SEQ ID NO: 3219762 - RNA, 20 nt, Mycobacterium leprae
cgggccagagcugcgacgga

SEQ ID NO: 3219763 - RNA, 23 nt, Mycobacterium leprae
cgggccgcuaugaguuucggcgc

SEQ ID NO: 3219764 - RNA, 13 nt, Mycobacterium leprae
cgggccggccgcg

SEQ ID NO: 3219765 - RNA, 21 nt, Mycobacterium leprae
cgggccguuauccacagcauc

SEQ ID NO: 3219766 - RNA, 15 nt, Mycobacterium leprae
cgggccugaguggug

SEQ ID NO: 3219767 - RNA, 17 nt, Mycobacterium leprae
cgggcgcucagcggcca

SEQ ID NO: 3219768 - RNA, 19 nt, Mycobacterium leprae
cgggcgcucagcggccaga

SEQ ID NO: 3219769 - RNA, 18 nt, Mycobacterium leprae
cgggcgcucagugaucag

SEQ ID NO: 3219770 - RNA, 13 nt, Mycobacterium leprae
cgggcggcaccug

SEQ ID NO: 3219771 - RNA, 15 nt, Mycobacterium leprae
cgggcggcaccugca

SEQ ID NO: 3219772 - RNA, 12 nt, Mycobacterium leprae
cgggcggcagcc

SEQ ID NO: 3219773 - RNA, 14 nt, Mycobacterium leprae
cgggcgucacgaag

SEQ ID NO: 3219774 - RNA, 22 nt, Mycobacterium leprae
cgggcuaaggugcguugugcgg

SEQ ID NO: 3219775 - RNA, 21 nt, Mycobacterium leprae
cgggcuaaguccggccugccc

SEQ ID NO: 3219776 - RNA, 22 nt, Mycobacterium leprae
cgggcuagaaucuucacgcgga

SEQ ID NO: 3219777 - RNA, 15 nt, Mycobacterium leprae
cgggcucacggggcu

SEQ ID NO: 3219778 - RNA, 22 nt, Mycobacterium leprae
cgggcucacggggcuggguccc

SEQ ID NO: 3219779 - RNA, 14 nt, Mycobacterium leprae
cgggcuuccugcug

SEQ ID NO: 3219780 - RNA, 15 nt, Mycobacterium leprae
cgggcuugaccugga

SEQ ID NO: 3219781 - RNA, 16 nt, Mycobacterium leprae
cgguguuccgcccagu

SEQ ID NO: 3219782 - RNA, 23 nt, Mycobacterium leprae
cgguguuccgcccagugacgucg

SEQ ID NO: 3219783 - RNA, 15 nt, Mycobacterium leprae
cgguguucgcuccgc

SEQ ID NO: 3219784 - RNA, 20 nt, Mycobacterium leprae
cgguuacguccgcggcagcu

SEQ ID NO: 3219785 - RNA, 19 nt, Mycobacterium leprae
cgguuaguccgaccgcauc

SEQ ID NO: 3219786 - RNA, 20 nt, Mycobacterium leprae
cgguuccgcaauuucggcgu

SEQ ID NO: 3219787 - RNA, 21 nt, Mycobacterium leprae
cgguucuauuuguguuggccg

SEQ ID NO: 3219788 - RNA, 20 nt, Mycobacterium leprae
cgguugccugucgauuacca

SEQ ID NO: 3219789 - RNA, 15 nt, Mycobacterium leprae
cgguugcguggcugc

SEQ ID NO: 3219790 - RNA, 16 nt, Mycobacterium leprae
cgguugcguggcugcu

SEQ ID NO: 3219791 - RNA, 22 nt, Mycobacterium leprae
cgguugucgacgcgugcgucau

SEQ ID NO: 3219792 - RNA, 17 nt, Mycobacterium leprae
cgguuuauggcuaagcu

SEQ ID NO: 3219793 - RNA, 11 nt, Mycobacterium leprae
cgguuucacag

SEQ ID NO: 3219794 - RNA, 17 nt, Mycobacterium leprae
cgguuuccaugaugguu

SEQ ID NO: 3219795 - RNA, 20 nt, Mycobacterium leprae
cgguuucgggaaagcugaga

SEQ ID NO: 3219796 - RNA, 15 nt, Mycobacterium leprae
cgguuugggccaggu

SEQ ID NO: 3219797 - RNA, 13 nt, Mycobacterium leprae
cgguuuuggcggu

SEQ ID NO: 3219798 - RNA, 16 nt, Mycobacterium leprae
cguaacaccgucgaaa

SEQ ID NO: 3219799 - RNA, 15 nt, Mycobacterium leprae
cguaacggucgguaa

SEQ ID NO: 3219800 - RNA, 18 nt, Mycobacterium leprae
cguaacucuauaaaauuu

SEQ ID NO: 3219801 - RNA, 18 nt, Mycobacterium leprae
cguaagacacuuccuggc

SEQ ID NO: 3219802 - RNA, 16 nt, Mycobacterium leprae
cguaagcgucucgacg

SEQ ID NO: 3219803 - RNA, 20 nt, Mycobacterium leprae
cguaaggaagaugacaccga

SEQ ID NO: 3219804 - RNA, 19 nt, Mycobacterium leprae
cguaaggaccaaccgcgca

SEQ ID NO: 3219805 - RNA, 15 nt, Mycobacterium leprae
cguaagucagaugga

SEQ ID NO: 3219806 - RNA, 17 nt, Mycobacterium leprae
cguaauaauauccaaag

SEQ ID NO: 3219807 - RNA, 20 nt, Mycobacterium leprae
cguaaucaagaucggccagc

SEQ ID NO: 3219808 - RNA, 13 nt, Mycobacterium leprae
cguacagugguga

SEQ ID NO: 3219809 - RNA, 21 nt, Mycobacterium leprae
cguaccggaauguccaccagc

SEQ ID NO: 3219810 - RNA, 18 nt, Mycobacterium leprae
cguaccggaucgacggca

SEQ ID NO: 3219811 - RNA, 23 nt, Mycobacterium leprae
cguaccgggaugugugcgcgccg

SEQ ID NO: 3219812 - RNA, 23 nt, Mycobacterium leprae
cguaccuaagccaagcucagcgc

SEQ ID NO: 3219813 - RNA, 23 nt, Mycobacterium leprae
cguacucacgugucuucgaccga

SEQ ID NO: 3219814 - RNA, 13 nt, Mycobacterium leprae
cguacuccagcag

SEQ ID NO: 3219815 - RNA, 18 nt, Mycobacterium leprae
cguacugaacgagaagca

SEQ ID NO: 3219816 - RNA, 17 nt, Mycobacterium leprae
cguacugugcgagagua

SEQ ID NO: 3219817 - RNA, 15 nt, Mycobacterium leprae
cguagcgcaccaauc

SEQ ID NO: 3219818 - RNA, 19 nt, Mycobacterium leprae
cguagcgcaccaauccacc

SEQ ID NO: 3219819 - RNA, 14 nt, Mycobacterium leprae
cguagcgucggcgg

SEQ ID NO: 3219820 - RNA, 18 nt, Mycobacterium leprae
cguagcgucggcggucag

SEQ ID NO: 3219821 - RNA, 17 nt, Mycobacterium leprae
cguaguacccggccaga

SEQ ID NO: 3219822 - RNA, 23 nt, Mycobacterium leprae
cguaguguagcugcagcgacugg

SEQ ID NO: 3219823 - RNA, 23 nt, Mycobacterium leprae
cguauagcgaaaauaacuauaau

SEQ ID NO: 3219824 - RNA, 22 nt, Mycobacterium leprae
cguaucucagcuccgaagcagc

SEQ ID NO: 3219825 - RNA, 17 nt, Mycobacterium leprae
cguaugaccgcggucgg

SEQ ID NO: 3219826 - RNA, 14 nt, Mycobacterium leprae
cgucaaaaaacuca

SEQ ID NO: 3219827 - RNA, 18 nt, Mycobacterium leprae
cgucaacggcgccgacaa

SEQ ID NO: 3219828 - RNA, 18 nt, Mycobacterium leprae
cgucaaguccagcacgau

SEQ ID NO: 3219829 - RNA, 20 nt, Mycobacterium leprae
cgucaagugcgcaccggcug

SEQ ID NO: 3219830 - RNA, 21 nt, Mycobacterium leprae
cgucacucuaccucggucggc

SEQ ID NO: 3219831 - RNA, 11 nt, Mycobacterium leprae
cgucagcugcu

SEQ ID NO: 3219832 - RNA, 15 nt, Mycobacterium leprae
cgucagcuggaaucc

SEQ ID NO: 3219833 - RNA, 16 nt, Mycobacterium leprae
cgucaggccaggcagc

SEQ ID NO: 3219834 - RNA, 17 nt, Mycobacterium leprae
cgucaggccaggcagcg

SEQ ID NO: 3219835 - RNA, 18 nt, Mycobacterium leprae
cgucaguaucgcgacggc

SEQ ID NO: 3219836 - RNA, 17 nt, Mycobacterium leprae
cgucaucgacagaugcg

SEQ ID NO: 3219837 - RNA, 16 nt, Mycobacterium leprae
cgucaucgacauccca

SEQ ID NO: 3219838 - RNA, 14 nt, Mycobacterium leprae
cgucaucgacgaug

SEQ ID NO: 3219839 - RNA, 22 nt, Mycobacterium leprae
cgucaucguugccgcugucgau

SEQ ID NO: 3219840 - RNA, 18 nt, Mycobacterium leprae
cgucauggcacugggcug

SEQ ID NO: 3219841 - RNA, 16 nt, Mycobacterium leprae
cguccagacaccacug

SEQ ID NO: 3219842 - RNA, 18 nt, Mycobacterium leprae
cguccaguaugucgucaa

SEQ ID NO: 3219843 - RNA, 18 nt, Mycobacterium leprae
cguccauuuucguggcga

SEQ ID NO: 3219844 - RNA, 16 nt, Mycobacterium leprae
cgucccucggccaucu

SEQ ID NO: 3219845 - RNA, 15 nt, Mycobacterium leprae
cguccgcgccggcgu

SEQ ID NO: 3219846 - RNA, 13 nt, Mycobacterium leprae
cguccgcggcagc

SEQ ID NO: 3219847 - RNA, 14 nt, Mycobacterium leprae
cguccgcggcagcu

SEQ ID NO: 3219848 - RNA, 15 nt, Mycobacterium leprae
cguccgcggcagcug

SEQ ID NO: 3219849 - RNA, 12 nt, Mycobacterium leprae
cguccgcggcgg

SEQ ID NO: 3219850 - RNA, 14 nt, Mycobacterium leprae
cguccgcggcggcc

SEQ ID NO: 3219851 - RNA, 18 nt, Mycobacterium leprae
cguccucggcccaugggg

SEQ ID NO: 3219852 - RNA, 15 nt, Mycobacterium leprae
cguccugccggugcg

SEQ ID NO: 3219853 - RNA, 15 nt, Mycobacterium leprae
cgucgaaaccauggu

SEQ ID NO: 3219854 - RNA, 15 nt, Mycobacterium leprae
cgucgaauucccagg

SEQ ID NO: 3219855 - RNA, 18 nt, Mycobacterium leprae
cgucgacaucaugaaauc

SEQ ID NO: 3219856 - RNA, 23 nt, Mycobacterium leprae
cgucgacgaguuccaggacaacg

SEQ ID NO: 3219857 - RNA, 14 nt, Mycobacterium leprae
cgucgaggaccgcc

SEQ ID NO: 3219858 - RNA, 16 nt, Mycobacterium leprae
cgucgaggaccgccau

SEQ ID NO: 3219859 - RNA, 16 nt, Mycobacterium leprae
cgucgauggccgccuu

SEQ ID NO: 3219860 - RNA, 14 nt, Mycobacterium leprae
cgucgaugucgggg

SEQ ID NO: 3219861 - RNA, 16 nt, Mycobacterium leprae
cgucgaugucggggau

SEQ ID NO: 3219862 - RNA, 24 nt, Mycobacterium leprae
cgucgauucgcucgccgcccgcug

SEQ ID NO: 3219863 - RNA, 19 nt, Mycobacterium leprae
cgucgcaccgauauccggc

SEQ ID NO: 3219864 - RNA, 13 nt, Mycobacterium leprae
cgucgcagcagcg

SEQ ID NO: 3219865 - RNA, 22 nt, Mycobacterium leprae
cgucgcagguucugcaccccag

SEQ ID NO: 3219866 - RNA, 15 nt, Mycobacterium leprae
cgucgcaucggugau

SEQ ID NO: 3219867 - RNA, 22 nt, Mycobacterium leprae
cgucgcccaacguaucggcgau

SEQ ID NO: 3219868 - RNA, 16 nt, Mycobacterium leprae
cgucgcccucgccggc

SEQ ID NO: 3219869 - RNA, 20 nt, Mycobacterium leprae
cgucgccgauccucgugaca

SEQ ID NO: 3219870 - RNA, 22 nt, Mycobacterium leprae
cgucgccgauccucgugacauc

SEQ ID NO: 3219871 - RNA, 18 nt, Mycobacterium leprae
cgucgccuuagccgaacu

SEQ ID NO: 3219872 - RNA, 22 nt, Mycobacterium leprae
cgucgcggauuuacccccagaa

SEQ ID NO: 3219873 - RNA, 19 nt, Mycobacterium leprae
cgucgcugauacaacugga

SEQ ID NO: 3219874 - RNA, 15 nt, Mycobacterium leprae
cgucgcugugccaag

SEQ ID NO: 3219875 - RNA, 21 nt, Mycobacterium leprae
cgucggagucaucgacuugcu

SEQ ID NO: 3219876 - RNA, 23 nt, Mycobacterium leprae
cgucggccaguaccuccagccgc

SEQ ID NO: 3219877 - RNA, 23 nt, Mycobacterium leprae
cgucggcguugagcgcagccacc

SEQ ID NO: 3219878 - RNA, 19 nt, Mycobacterium leprae
cgucggcugaaccgcugug

SEQ ID NO: 3219879 - RNA, 21 nt, Mycobacterium leprae
cgucgggaccgggcgcgcgcu

SEQ ID NO: 3219880 - RNA, 13 nt, Mycobacterium leprae
cgucgggugccga

SEQ ID NO: 3219881 - RNA, 18 nt, Mycobacterium leprae
cgucgggugcuacacggc

SEQ ID NO: 3219882 - RNA, 20 nt, Mycobacterium leprae
cgucgguagacguggcaguc

SEQ ID NO: 3219883 - RNA, 19 nt, Mycobacterium leprae
cgucguaggcugucugcgg

SEQ ID NO: 3219884 - RNA, 15 nt, Mycobacterium leprae
cgucguccggcaauc

SEQ ID NO: 3219885 - RNA, 18 nt, Mycobacterium leprae
cgucgucgcaucggugau

SEQ ID NO: 3219886 - RNA, 12 nt, Mycobacterium leprae
cgucgucucagc

SEQ ID NO: 3219887 - RNA, 20 nt, Mycobacterium leprae
cgucgugaaucaugccgcag

SEQ ID NO: 3219888 - RNA, 13 nt, Mycobacterium leprae
cgucgugaucggc

SEQ ID NO: 3219889 - RNA, 19 nt, Mycobacterium leprae
cgucgugcugaucaccggc

SEQ ID NO: 3219890 - RNA, 18 nt, Mycobacterium leprae
cgucguggcugugaugua

SEQ ID NO: 3219891 - RNA, 17 nt, Mycobacterium leprae
cgucguuguguaggcgg

SEQ ID NO: 3219892 - RNA, 22 nt, Mycobacterium leprae
cgucucgacggauuucucgugg

SEQ ID NO: 3219893 - RNA, 19 nt, Mycobacterium leprae
cgucuggaacacgaucggc

SEQ ID NO: 3219894 - RNA, 15 nt, Mycobacterium leprae
cuaauccagacaucg

SEQ ID NO: 3219895 - RNA, 19 nt, Mycobacterium leprae
cuaaucgcgggcaagcccu

SEQ ID NO: 3219896 - RNA, 19 nt, Mycobacterium leprae
cuaauggcgggcuggagga

SEQ ID NO: 3219897 - RNA, 18 nt, Mycobacterium leprae
cuaauugcgaugcacuga

SEQ ID NO: 3219898 - RNA, 17 nt, Mycobacterium leprae
cuaauugggaucgacac

SEQ ID NO: 3219899 - RNA, 19 nt, Mycobacterium leprae
cuacagaugacagcgcgaa

SEQ ID NO: 3219900 - RNA, 18 nt, Mycobacterium leprae
cuacagcaguguucaggc

SEQ ID NO: 3219901 - RNA, 14 nt, Mycobacterium leprae
cuacaucgacaaaa

SEQ ID NO: 3219902 - RNA, 17 nt, Mycobacterium leprae
cuacaucgacaaaaaca

SEQ ID NO: 3219903 - RNA, 23 nt, Mycobacterium leprae
cuacauuguuuucgguagacugg

SEQ ID NO: 3219904 - RNA, 22 nt, Mycobacterium leprae
cuaccacuuccuacuucugggu

SEQ ID NO: 3219905 - RNA, 16 nt, Mycobacterium leprae
cuaccauuauuucguc

SEQ ID NO: 3219906 - RNA, 20 nt, Mycobacterium leprae
cuacccagaaaccaccggca

SEQ ID NO: 3219907 - RNA, 18 nt, Mycobacterium leprae
cuacccuagagucgaccg

SEQ ID NO: 3219908 - RNA, 15 nt, Mycobacterium leprae
cuacccuugagcacc

SEQ ID NO: 3219909 - RNA, 20 nt, Mycobacterium leprae
cuaccgagauggcgucuuga

SEQ ID NO: 3219910 - RNA, 14 nt, Mycobacterium leprae
cuaccgaguugucc

SEQ ID NO: 3219911 - RNA, 22 nt, Mycobacterium leprae
cuaccgaguuguccagauucga

SEQ ID NO: 3219912 - RNA, 18 nt, Mycobacterium leprae
cuaccggccaaccacagc

SEQ ID NO: 3219913 - RNA, 21 nt, Mycobacterium leprae
cuaccgggcgcucagugauca

SEQ ID NO: 3219914 - RNA, 18 nt, Mycobacterium leprae
cuaccguugacgugguga

SEQ ID NO: 3219915 - RNA, 20 nt, Mycobacterium leprae
cuaccuauccgaguggguaa

SEQ ID NO: 3219916 - RNA, 13 nt, Mycobacterium leprae
cuaccucggccgu

SEQ ID NO: 3219917 - RNA, 15 nt, Mycobacterium leprae
cuaccucggucggca

SEQ ID NO: 3219918 - RNA, 18 nt, Mycobacterium leprae
cuaccucggucggcaugu

SEQ ID NO: 3219919 - RNA, 21 nt, Mycobacterium leprae
cuaccucggucggcaugugca

SEQ ID NO: 3219920 - RNA, 22 nt, Mycobacterium leprae
cuacgaaaaaugaguugcaaca

SEQ ID NO: 3219921 - RNA, 17 nt, Mycobacterium leprae
cuacgcagcucuggauc

SEQ ID NO: 3219922 - RNA, 16 nt, Mycobacterium leprae
cuacggcguugcgggc

SEQ ID NO: 3219923 - RNA, 20 nt, Mycobacterium leprae
cuacugcgacagcagccacu

SEQ ID NO: 3219924 - RNA, 12 nt, Mycobacterium leprae
cuacuugcgcuc

SEQ ID NO: 3219925 - RNA, 14 nt, Mycobacterium leprae
cuacuuuucgugcu

SEQ ID NO: 3219926 - RNA, 14 nt, Mycobacterium leprae
cuagaaagaccccc

SEQ ID NO: 3219927 - RNA, 21 nt, Mycobacterium leprae
cuagacgggaggaagauaucc

SEQ ID NO: 3219928 - RNA, 16 nt, Mycobacterium leprae
cuagacugacccaagc

SEQ ID NO: 3219929 - RNA, 21 nt, Mycobacterium leprae
cuagagucgaccgccgaagca

SEQ ID NO: 3219930 - RNA, 14 nt, Mycobacterium leprae
cuagauaagauaaa

SEQ ID NO: 3219931 - RNA, 14 nt, Mycobacterium leprae
cuagaucaacagcg

SEQ ID NO: 3219932 - RNA, 18 nt, Mycobacterium leprae
cuagaucaacagcgcagu

SEQ ID NO: 3219933 - RNA, 14 nt, Mycobacterium leprae
cuagauugguccaa

SEQ ID NO: 3219934 - RNA, 23 nt, Mycobacterium leprae
cuagcaaggcgcgguaucucaau

SEQ ID NO: 3219935 - RNA, 22 nt, Mycobacterium leprae
cuagcaaggguugguagcuggc

SEQ ID NO: 3219936 - RNA, 16 nt, Mycobacterium leprae
cuagcagcgcgcagaa

SEQ ID NO: 3219937 - RNA, 22 nt, Mycobacterium leprae
cuagcaucgaccacgucgggca

SEQ ID NO: 3219938 - RNA, 20 nt, Mycobacterium leprae
cuagcauuccucgugugugu

SEQ ID NO: 3219939 - RNA, 22 nt, Mycobacterium leprae
cuagcgaucucgaugucggaca

SEQ ID NO: 3219940 - RNA, 23 nt, Mycobacterium leprae
cuagcgauucgggagaggaucag

SEQ ID NO: 3219941 - RNA, 18 nt, Mycobacterium leprae
cuagcggccuaggacgcc

SEQ ID NO: 3219942 - RNA, 18 nt, Mycobacterium leprae
cuagcugauuuggccgcc

SEQ ID NO: 3219943 - RNA, 15 nt, Mycobacterium leprae
cuagcuggcagucgg

SEQ ID NO: 3219944 - RNA, 16 nt, Mycobacterium leprae
cuagcuguccaauguc

SEQ ID NO: 3219945 - RNA, 16 nt, Mycobacterium leprae
cuaggacaacagagca

SEQ ID NO: 3219946 - RNA, 14 nt, Mycobacterium leprae
cuaggauagaucca

SEQ ID NO: 3219947 - RNA, 16 nt, Mycobacterium leprae
cuaggccagugucggu

SEQ ID NO: 3219948 - RNA, 23 nt, Mycobacterium leprae
cuaggcugaugcggucaugcguc

SEQ ID NO: 3219949 - RNA, 17 nt, Mycobacterium leprae
cuagggaugugaccauu

SEQ ID NO: 3219950 - RNA, 15 nt, Mycobacterium leprae
cuaggguuggauggu

SEQ ID NO: 3219951 - RNA, 17 nt, Mycobacterium leprae
cuagguaccccagucga

SEQ ID NO: 3219952 - RNA, 20 nt, Mycobacterium leprae
cuaguggucgauuacucacg

SEQ ID NO: 3219953 - RNA, 19 nt, Mycobacterium leprae
cuaguucgacaccggccaa

SEQ ID NO: 3219954 - RNA, 13 nt, Mycobacterium leprae
cuauaauuuaaau

SEQ ID NO: 3219955 - RNA, 17 nt, Mycobacterium leprae
cuauaauuuaaauuuca

SEQ ID NO: 3219956 - RNA, 19 nt, Mycobacterium leprae
cuauacuggauaacuuugc

SEQ ID NO: 3219957 - RNA, 23 nt, Mycobacterium leprae
cuauagcgucgaagaaucuugaa

SEQ ID NO: 3219958 - RNA, 16 nt, Mycobacterium leprae
cuauaguacggcggcg

SEQ ID NO: 3219959 - RNA, 15 nt, Mycobacterium leprae
cuauauauauauuaa

SEQ ID NO: 3219960 - RNA, 16 nt, Mycobacterium leprae
cuauauauauauuaau

SEQ ID NO: 3219961 - RNA, 13 nt, Mycobacterium leprae
cuauaucgcggcg

SEQ ID NO: 3219962 - RNA, 14 nt, Mycobacterium leprae
cuauaucuauaguu

SEQ ID NO: 3219963 - RNA, 15 nt, Mycobacterium leprae
cuaucacgaauucca

SEQ ID NO: 3219964 - RNA, 13 nt, Mycobacterium leprae
cuaucauagccac

SEQ ID NO: 3219965 - RNA, 20 nt, Mycobacterium leprae
cuauccucgggugcgcacgg

SEQ ID NO: 3219966 - RNA, 19 nt, Mycobacterium leprae
cuaucgacauccugaugcu

SEQ ID NO: 3219967 - RNA, 18 nt, Mycobacterium leprae
cuaugaguuucggcgccu

SEQ ID NO: 3219968 - RNA, 19 nt, Mycobacterium leprae
cuaugauagcgaccaucga

SEQ ID NO: 3219969 - RNA, 16 nt, Mycobacterium leprae
cuaugcagugagcagu

SEQ ID NO: 3219970 - RNA, 12 nt, Mycobacterium leprae
cuaugccgcgcg

SEQ ID NO: 3219971 - RNA, 22 nt, Mycobacterium leprae
cuauggaauccacuugagcggc

SEQ ID NO: 3219972 - RNA, 23 nt, Mycobacterium leprae
cuaugucacuucccaccguggug

SEQ ID NO: 3219973 - RNA, 17 nt, Mycobacterium leprae
cuaugucgugcugacca

SEQ ID NO: 3219974 - RNA, 16 nt, Mycobacterium leprae
cuaugugcaaucgauc

SEQ ID NO: 3219975 - RNA, 17 nt, Mycobacterium leprae
cuauguuggccagcagc

SEQ ID NO: 3219976 - RNA, 15 nt, Mycobacterium leprae
cuauucgcaccugau

SEQ ID NO: 3219977 - RNA, 17 nt, Mycobacterium leprae
cucaacauggaccaccg

SEQ ID NO: 3219978 - RNA, 20 nt, Mycobacterium leprae
cucaacauggaccaccguug

SEQ ID NO: 3219979 - RNA, 16 nt, Mycobacterium leprae
cucaaccaugccgcgc

SEQ ID NO: 3219980 - RNA, 15 nt, Mycobacterium leprae
cucaagucgacgaug

SEQ ID NO: 3219981 - RNA, 21 nt, Mycobacterium leprae
cucaauccguuguccgcggcu

SEQ ID NO: 3219982 - RNA, 15 nt, Mycobacterium leprae
cucaaucgcccgcaa

SEQ ID NO: 3219983 - RNA, 23 nt, Mycobacterium leprae
cucaaugaccgcaccgaucugcc

SEQ ID NO: 3219984 - RNA, 11 nt, Mycobacterium leprae
cucaaugcugu

SEQ ID NO: 3219985 - RNA, 16 nt, Mycobacterium leprae
cucaauuggcagagca

SEQ ID NO: 3219986 - RNA, 22 nt, Mycobacterium leprae
cucacaauugacaacacgaucg

SEQ ID NO: 3219987 - RNA, 14 nt, Mycobacterium leprae
cucacacucacgcc

SEQ ID NO: 3219988 - RNA, 17 nt, Mycobacterium leprae
cucacacucacgccugc

SEQ ID NO: 3219989 - RNA, 19 nt, Mycobacterium leprae
cucacagguaaacgagacc

SEQ ID NO: 3219990 - RNA, 22 nt, Mycobacterium leprae
cucacagguaaacgagaccagg

SEQ ID NO: 3219991 - RNA, 20 nt, Mycobacterium leprae
cucaccaaaucgacuacauc

SEQ ID NO: 3219992 - RNA, 18 nt, Mycobacterium leprae
cucaccaauagccgacca

SEQ ID NO: 3219993 - RNA, 22 nt, Mycobacterium leprae
cucacccaugccucuagcaagg

SEQ ID NO: 3219994 - RNA, 16 nt, Mycobacterium leprae
cucacccgcagcaccu

SEQ ID NO: 3219995 - RNA, 19 nt, Mycobacterium leprae
cucacccgcgccgccugcu

SEQ ID NO: 3219996 - RNA, 20 nt, Mycobacterium leprae
cucaccgaaucguuccaccc

SEQ ID NO: 3219997 - RNA, 16 nt, Mycobacterium leprae
cucaccgcggccgacu

SEQ ID NO: 3219998 - RNA, 21 nt, Mycobacterium leprae
cucaccgcggccgacuauuag

SEQ ID NO: 3219999 - RNA, 21 nt, Mycobacterium leprae
cucaccgguacacaccgcaca

SEQ ID NO: 3220000 - RNA, 15 nt, Mycobacterium leprae
cucaccugcgacagc

SEQ ID NO: 3220001 - RNA, 15 nt, Mycobacterium leprae
cucacggccaccaua

SEQ ID NO: 3220002 - RNA, 16 nt, Mycobacterium leprae
cucacggccaccauag

SEQ ID NO: 3220003 - RNA, 15 nt, Mycobacterium leprae
cucacgugucuucga

SEQ ID NO: 3220004 - RNA, 20 nt, Mycobacterium leprae
cucacuaacguucggugacg

SEQ ID NO: 3220005 - RNA, 16 nt, Mycobacterium leprae
cucagaucugauucag

SEQ ID NO: 3220006 - RNA, 19 nt, Mycobacterium leprae
cucuguugcuguccaccga

SEQ ID NO: 3220007 - RNA, 19 nt, Mycobacterium leprae
cucuuaacaacuugacgau

SEQ ID NO: 3220008 - RNA, 14 nt, Mycobacterium leprae
cucuuccgagccga

SEQ ID NO: 3220009 - RNA, 18 nt, Mycobacterium leprae
cucuuccgccgcuacacu

SEQ ID NO: 3220010 - RNA, 14 nt, Mycobacterium leprae
cucuucgugcagca

SEQ ID NO: 3220011 - RNA, 15 nt, Mycobacterium leprae
cugaaaacagcgccu

SEQ ID NO: 3220012 - RNA, 16 nt, Mycobacterium leprae
cugaacaggcgccuga

SEQ ID NO: 3220013 - RNA, 19 nt, Mycobacterium leprae
cugaacauuaguuccuggg

SEQ ID NO: 3220014 - RNA, 16 nt, Mycobacterium leprae
cugaaccaggggucgg

SEQ ID NO: 3220015 - RNA, 16 nt, Mycobacterium leprae
cugaaccugccaucca

SEQ ID NO: 3220016 - RNA, 17 nt, Mycobacterium leprae
cugaacgagaagcagcu

SEQ ID NO: 3220017 - RNA, 18 nt, Mycobacterium leprae
cugacagacauggcugua

SEQ ID NO: 3220018 - RNA, 12 nt, Mycobacterium leprae
cugacagauacu

SEQ ID NO: 3220019 - RNA, 17 nt, Mycobacterium leprae
cugacauauuugggagc

SEQ ID NO: 3220020 - RNA, 13 nt, Mycobacterium leprae
cugacaucaagcc

SEQ ID NO: 3220021 - RNA, 22 nt, Mycobacterium leprae
cugacaucaagccuccagaauc

SEQ ID NO: 3220022 - RNA, 15 nt, Mycobacterium leprae
cugacaucaucgcua

SEQ ID NO: 3220023 - RNA, 22 nt, Mycobacterium leprae
cugacaucggcuacggcaaccg

SEQ ID NO: 3220024 - RNA, 20 nt, Mycobacterium leprae
cugaccaagaaguuaccgag

SEQ ID NO: 3220025 - RNA, 16 nt, Mycobacterium leprae
cugaccacucgcgacg

SEQ ID NO: 3220026 - RNA, 23 nt, Mycobacterium leprae
cugaccacucgcgacgauacuuc

SEQ ID NO: 3220027 - RNA, 21 nt, Mycobacterium leprae
cugacccaagcgccagcucag

SEQ ID NO: 3220028 - RNA, 16 nt, Mycobacterium leprae
cugacggagcaagcgc

SEQ ID NO: 3220029 - RNA, 23 nt, Mycobacterium leprae
cugacucgacauagaacauccgc

SEQ ID NO: 3220030 - RNA, 14 nt, Mycobacterium leprae
cugagacaucgcca

SEQ ID NO: 3220031 - RNA, 17 nt, Mycobacterium leprae
cugagacaucgccaccg

SEQ ID NO: 3220032 - RNA, 18 nt, Mycobacterium leprae
cugagagcagauggugca

SEQ ID NO: 3220033 - RNA, 15 nt, Mycobacterium leprae
cugagagugccaccg

SEQ ID NO: 3220034 - RNA, 15 nt, Mycobacterium leprae
cugagcaauuucuuc

SEQ ID NO: 3220035 - RNA, 17 nt, Mycobacterium leprae
cugagccgacaaucuca

SEQ ID NO: 3220036 - RNA, 13 nt, Mycobacterium leprae
cugagccgccgug

SEQ ID NO: 3220037 - RNA, 15 nt, Mycobacterium leprae
cugagcgcgaacaga

SEQ ID NO: 3220038 - RNA, 12 nt, Mycobacterium leprae
cugagcgggcca

SEQ ID NO: 3220039 - RNA, 18 nt, Mycobacterium leprae
cugagcgggccagcacca

SEQ ID NO: 3220040 - RNA, 15 nt, Mycobacterium leprae
cugagcguggcugcu

SEQ ID NO: 3220041 - RNA, 18 nt, Mycobacterium leprae
cugagcguggcugcucaa

SEQ ID NO: 3220042 - RNA, 13 nt, Mycobacterium leprae
cugaggcagcagc

SEQ ID NO: 3220043 - RNA, 16 nt, Mycobacterium leprae
cugaggcagcagcucg

SEQ ID NO: 3220044 - RNA, 19 nt, Mycobacterium leprae
cugaggucaccggccaccg

SEQ ID NO: 3220045 - RNA, 20 nt, Mycobacterium leprae
cugagguguugggagcgaag

SEQ ID NO: 3220046 - RNA, 19 nt, Mycobacterium leprae
cugagugugaugccgaagc

SEQ ID NO: 3220047 - RNA, 17 nt, Mycobacterium leprae
cugauacaacuggaagu

SEQ ID NO: 3220048 - RNA, 21 nt, Mycobacterium leprae
cugauacugaugugcugagag

SEQ ID NO: 3220049 - RNA, 14 nt, Mycobacterium leprae
cugaucgggcugcg

SEQ ID NO: 3220050 - RNA, 17 nt, Mycobacterium leprae
cugaucggucagcucga

SEQ ID NO: 3220051 - RNA, 15 nt, Mycobacterium leprae
cugaucuauuuauaa

SEQ ID NO: 3220052 - RNA, 18 nt, Mycobacterium leprae
cugaugacgcgacgccgg

SEQ ID NO: 3220053 - RNA, 22 nt, Mycobacterium leprae
cugauggcacuacccgacacaa

SEQ ID NO: 3220054 - RNA, 12 nt, Mycobacterium leprae
cugauggccgcc

SEQ ID NO: 3220055 - RNA, 14 nt, Mycobacterium leprae
cugauggccgccag

SEQ ID NO: 3220056 - RNA, 18 nt, Mycobacterium leprae
cugauggccgucgaugau

SEQ ID NO: 3220057 - RNA, 17 nt, Mycobacterium leprae
cugauggggggugugau

SEQ ID NO: 3220058 - RNA, 23 nt, Mycobacterium leprae
cugaugugcugagagcagauggu

SEQ ID NO: 3220059 - RNA, 21 nt, Mycobacterium leprae
cugauguuaucccuugcacca

SEQ ID NO: 3220060 - RNA, 20 nt, Mycobacterium leprae
cugauugaucggugacuugg

SEQ ID NO: 3220061 - RNA, 18 nt, Mycobacterium leprae
cugauugucaacaaccga

SEQ ID NO: 3220062 - RNA, 12 nt, Mycobacterium leprae
cugcaacgcugc

SEQ ID NO: 3220063 - RNA, 16 nt, Mycobacterium leprae
cugcaacucaucggcu

SEQ ID NO: 3220064 - RNA, 22 nt, Mycobacterium leprae
cugcaacucaucggcucccauc

SEQ ID NO: 3220065 - RNA, 13 nt, Mycobacterium leprae
cugcaagcccccu

SEQ ID NO: 3220066 - RNA, 17 nt, Mycobacterium leprae
cugcaauccguggagag

SEQ ID NO: 3220067 - RNA, 17 nt, Mycobacterium leprae
cugcacaacgauacguu

SEQ ID NO: 3220068 - RNA, 17 nt, Mycobacterium leprae
cugcacacugacuugca

SEQ ID NO: 3220069 - RNA, 19 nt, Mycobacterium leprae
cugcacauucaaccagcca

SEQ ID NO: 3220070 - RNA, 22 nt, Mycobacterium leprae
cugcacauucaaccagccaauc

SEQ ID NO: 3220071 - RNA, 18 nt, Mycobacterium leprae
cugcacccggcggcaugc

SEQ ID NO: 3220072 - RNA, 16 nt, Mycobacterium leprae
cugcacccgucgcuga

SEQ ID NO: 3220073 - RNA, 16 nt, Mycobacterium leprae
cugcaccgagcgaccu

SEQ ID NO: 3220074 - RNA, 21 nt, Mycobacterium leprae
cugcacgaccacacugugccu

SEQ ID NO: 3220075 - RNA, 19 nt, Mycobacterium leprae
cugcacgucuacgucuuca

SEQ ID NO: 3220076 - RNA, 21 nt, Mycobacterium leprae
cugcagcaacagccacacccg

SEQ ID NO: 3220077 - RNA, 22 nt, Mycobacterium leprae
cugcagccgaucggcugccgcg

SEQ ID NO: 3220078 - RNA, 13 nt, Mycobacterium leprae
cugcagcggucag

SEQ ID NO: 3220079 - RNA, 17 nt, Mycobacterium leprae
cugcagcuaaucccaug

SEQ ID NO: 3220080 - RNA, 11 nt, Mycobacterium leprae
cugcagcuacu

SEQ ID NO: 3220081 - RNA, 16 nt, Mycobacterium leprae
cugcaggagguagcaa

SEQ ID NO: 3220082 - RNA, 11 nt, Mycobacterium leprae
cugcaggucag

SEQ ID NO: 3220083 - RNA, 14 nt, Mycobacterium leprae
cugcauccgcagca

SEQ ID NO: 3220084 - RNA, 21 nt, Mycobacterium leprae
cugcauggacgauaucgcuaa

SEQ ID NO: 3220085 - RNA, 15 nt, Mycobacterium leprae
cugccaaucagcacu

SEQ ID NO: 3220086 - RNA, 16 nt, Mycobacterium leprae
cugccaaucagcacuc

SEQ ID NO: 3220087 - RNA, 21 nt, Mycobacterium leprae
cugccacggccccggaugcgu

SEQ ID NO: 3220088 - RNA, 16 nt, Mycobacterium leprae
cugccagacacugcca

SEQ ID NO: 3220089 - RNA, 15 nt, Mycobacterium leprae
cugccagagaugcgu

SEQ ID NO: 3220090 - RNA, 20 nt, Mycobacterium leprae
cugccagagaugcguagcca

SEQ ID NO: 3220091 - RNA, 21 nt, Mycobacterium leprae
cugccagcuauccccgaucgc

SEQ ID NO: 3220092 - RNA, 13 nt, Mycobacterium leprae
cugccaggcgcga

SEQ ID NO: 3220093 - RNA, 22 nt, Mycobacterium leprae
cugccauccaacgugaccagcu

SEQ ID NO: 3220094 - RNA, 13 nt, Mycobacterium leprae
cugccaugccagu

SEQ ID NO: 3220095 - RNA, 15 nt, Mycobacterium leprae
cugccauuggccgcu

SEQ ID NO: 3220096 - RNA, 19 nt, Mycobacterium leprae
cugcccagagaucgccgcu

SEQ ID NO: 3220097 - RNA, 14 nt, Mycobacterium leprae
cugccccgaucugg

SEQ ID NO: 3220098 - RNA, 14 nt, Mycobacterium leprae
cugccccgcuggug

SEQ ID NO: 3220099 - RNA, 16 nt, Mycobacterium leprae
cugcccgacgaggcgg

SEQ ID NO: 3220100 - RNA, 23 nt, Mycobacterium leprae
cugcccgacgaggcggugaccga

SEQ ID NO: 3220101 - RNA, 14 nt, Mycobacterium leprae
cugcccguaugcac

SEQ ID NO: 3220102 - RNA, 13 nt, Mycobacterium leprae
cugcccugccccg

SEQ ID NO: 3220103 - RNA, 16 nt, Mycobacterium leprae
cugccgauauaccugc

SEQ ID NO: 3220104 - RNA, 22 nt, Mycobacterium leprae
cugccgccacagcaagucgccu

SEQ ID NO: 3220105 - RNA, 23 nt, Mycobacterium leprae
cugccgcugguaucggugucggc

SEQ ID NO: 3220106 - RNA, 18 nt, Mycobacterium leprae
cugccggcggcagauguu

SEQ ID NO: 3220107 - RNA, 13 nt, Mycobacterium leprae
cugccgguagccu

SEQ ID NO: 3220108 - RNA, 15 nt, Mycobacterium leprae
cugccgguagccugg

SEQ ID NO: 3220109 - RNA, 18 nt, Mycobacterium leprae
cugccggugaccgggccg

SEQ ID NO: 3220110 - RNA, 19 nt, Mycobacterium leprae
cugccggugaccgggccgg

SEQ ID NO: 3220111 - RNA, 14 nt, Mycobacterium leprae
cugccgucccucgg

SEQ ID NO: 3220112 - RNA, 14 nt, Mycobacterium leprae
cugccgugugcuuc

SEQ ID NO: 3220113 - RNA, 14 nt, Mycobacterium leprae
cugccucgucgaug

SEQ ID NO: 3220114 - RNA, 22 nt, Mycobacterium leprae
cugcgaacacugaguagaugca

SEQ ID NO: 3220115 - RNA, 13 nt, Mycobacterium leprae
cugcgacaacacc

SEQ ID NO: 3220116 - RNA, 17 nt, Mycobacterium leprae
cugcgacacuugccgcg

SEQ ID NO: 3220117 - RNA, 14 nt, Mycobacterium leprae
cugcgacaucucgg

SEQ ID NO: 3220118 - RNA, 21 nt, Mycobacterium leprae
cugcgacaucucggucaggug

SEQ ID NO: 3220119 - RNA, 16 nt, Mycobacterium leprae
cugcgaccuggugucg

SEQ ID NO: 3220120 - RNA, 22 nt, Mycobacterium leprae
cugggcggcuagucggccggcu

SEQ ID NO: 3220121 - RNA, 15 nt, Mycobacterium leprae
cugggcucauagcua

SEQ ID NO: 3220122 - RNA, 12 nt, Mycobacterium leprae
cugggcugugcu

SEQ ID NO: 3220123 - RNA, 23 nt, Mycobacterium leprae
cuggguaagguuguugacgauga

SEQ ID NO: 3220124 - RNA, 16 nt, Mycobacterium leprae
cugggugaccacccac

SEQ ID NO: 3220125 - RNA, 13 nt, Mycobacterium leprae
cugggugggugca

SEQ ID NO: 3220126 - RNA, 16 nt, Mycobacterium leprae
cugguaacggaccugg

SEQ ID NO: 3220127 - RNA, 17 nt, Mycobacterium leprae
cugguagccguucggcu

SEQ ID NO: 3220128 - RNA, 16 nt, Mycobacterium leprae
cugguauguccgcccu

SEQ ID NO: 3220129 - RNA, 16 nt, Mycobacterium leprae
cuggucaucuguagcu

SEQ ID NO: 3220130 - RNA, 15 nt, Mycobacterium leprae
cugguccgccagcga

SEQ ID NO: 3220131 - RNA, 15 nt, Mycobacterium leprae
cuggucuggcgggug

SEQ ID NO: 3220132 - RNA, 19 nt, Mycobacterium leprae
cuggugcguggcgaccgca

SEQ ID NO: 3220133 - RNA, 13 nt, Mycobacterium leprae
cuggugcuguguu

SEQ ID NO: 3220134 - RNA, 16 nt, Mycobacterium leprae
cugguggcaagugugu

SEQ ID NO: 3220135 - RNA, 15 nt, Mycobacterium leprae
cugguggccgagguc

SEQ ID NO: 3220136 - RNA, 17 nt, Mycobacterium leprae
cuggugggcgcagacgu

SEQ ID NO: 3220137 - RNA, 16 nt, Mycobacterium leprae
cuggugguggccucgu

SEQ ID NO: 3220138 - RNA, 15 nt, Mycobacterium leprae
cuggugucgcagcgu

SEQ ID NO: 3220139 - RNA, 18 nt, Mycobacterium leprae
cuggugugcgcgccgccc

SEQ ID NO: 3220140 - RNA, 20 nt, Mycobacterium leprae
cuggugugcgcgccgcccag

SEQ ID NO: 3220141 - RNA, 15 nt, Mycobacterium leprae
cugguguggacagcg

SEQ ID NO: 3220142 - RNA, 22 nt, Mycobacterium leprae
cugguguuuugacgccucagcc

SEQ ID NO: 3220143 - RNA, 20 nt, Mycobacterium leprae
cugguucagccauucuaggu

SEQ ID NO: 3220144 - RNA, 17 nt, Mycobacterium leprae
cugguugggcaucgccg

SEQ ID NO: 3220145 - RNA, 18 nt, Mycobacterium leprae
cuguacacuacuccugcu

SEQ ID NO: 3220146 - RNA, 17 nt, Mycobacterium leprae
cuguagaugacggcaaa

SEQ ID NO: 3220147 - RNA, 22 nt, Mycobacterium leprae
cuguagugggacacucgauccu

SEQ ID NO: 3220148 - RNA, 17 nt, Mycobacterium leprae
cuguaucuugguagacg

SEQ ID NO: 3220149 - RNA, 15 nt, Mycobacterium leprae
cugucaaccaugguc

SEQ ID NO: 3220150 - RNA, 23 nt, Mycobacterium leprae
cugucaaggcgguuccgacuggu

SEQ ID NO: 3220151 - RNA, 18 nt, Mycobacterium leprae
cugucauccucacgaccg

SEQ ID NO: 3220152 - RNA, 21 nt, Mycobacterium leprae
cuguccgucagcgugcuccag

SEQ ID NO: 3220153 - RNA, 21 nt, Mycobacterium leprae
cuguccuugccggcgccgcug

SEQ ID NO: 3220154 - RNA, 22 nt, Mycobacterium leprae
cugucgaaaaccucacgaaucc

SEQ ID NO: 3220155 - RNA, 18 nt, Mycobacterium leprae
cugucgauuaccacugcc

SEQ ID NO: 3220156 - RNA, 17 nt, Mycobacterium leprae
cugucgcgaccaacccg

SEQ ID NO: 3220157 - RNA, 13 nt, Mycobacterium leprae
cugucggugccgc

SEQ ID NO: 3220158 - RNA, 16 nt, Mycobacterium leprae
cugucggugccgccau

SEQ ID NO: 3220159 - RNA, 16 nt, Mycobacterium leprae
cugucgugagaaucgg

SEQ ID NO: 3220160 - RNA, 14 nt, Mycobacterium leprae
cugucgugcccaga

SEQ ID NO: 3220161 - RNA, 15 nt, Mycobacterium leprae
cugucgugcccagau

SEQ ID NO: 3220162 - RNA, 21 nt, Mycobacterium leprae
cugucuaccguugacguggug

SEQ ID NO: 3220163 - RNA, 15 nt, Mycobacterium leprae
cugucuauuugagau

SEQ ID NO: 3220164 - RNA, 19 nt, Mycobacterium leprae
cugucugcggauuuugccc

SEQ ID NO: 3220165 - RNA, 16 nt, Mycobacterium leprae
cugucuggaucgggga

SEQ ID NO: 3220166 - RNA, 23 nt, Mycobacterium leprae
cugucuugcggcgugcugauaug

SEQ ID NO: 3220167 - RNA, 22 nt, Mycobacterium leprae
cugugacagcgugccgaagugu

SEQ ID NO: 3220168 - RNA, 14 nt, Mycobacterium leprae
cugugauuggcugc

SEQ ID NO: 3220169 - RNA, 19 nt, Mycobacterium leprae
cugugcaaauacgcgcgcu

SEQ ID NO: 3220170 - RNA, 19 nt, Mycobacterium leprae
cugugccugcauucuccug

SEQ ID NO: 3220171 - RNA, 21 nt, Mycobacterium leprae
cugugccugcauucuccuguc

SEQ ID NO: 3220172 - RNA, 24 nt, Mycobacterium leprae
cugugcgaaaacacuuacaccaac

SEQ ID NO: 3220173 - RNA, 21 nt, Mycobacterium leprae
cugugcgagaguacggagcca

SEQ ID NO: 3220174 - RNA, 17 nt, Mycobacterium leprae
cugugcuaaccgggcca

SEQ ID NO: 3220175 - RNA, 19 nt, Mycobacterium leprae
cugugggguauugugcgga

SEQ ID NO: 3220176 - RNA, 22 nt, Mycobacterium leprae
cugugggucgacccgguggugu

SEQ ID NO: 3220177 - RNA, 17 nt, Mycobacterium leprae
cuguguacgaagccuga

SEQ ID NO: 3220178 - RNA, 21 nt, Mycobacterium leprae
cuguguacgaagccugagacc

SEQ ID NO: 3220179 - RNA, 17 nt, Mycobacterium leprae
cuguguugccgugagga

SEQ ID NO: 3220180 - RNA, 12 nt, Mycobacterium leprae
cuguguugcggg

SEQ ID NO: 3220181 - RNA, 14 nt, Mycobacterium leprae
cuguguuguuggga

SEQ ID NO: 3220182 - RNA, 12 nt, Mycobacterium leprae
cuguuacaggaa

SEQ ID NO: 3220183 - RNA, 15 nt, Mycobacterium leprae
cuguuacgaggacuc

SEQ ID NO: 3220184 - RNA, 14 nt, Mycobacterium leprae
cuguuauauagugc

SEQ ID NO: 3220185 - RNA, 19 nt, Mycobacterium leprae
cuguuccgguuggcugccg

SEQ ID NO: 3220186 - RNA, 19 nt, Mycobacterium leprae
cuguucgaucuaguuuugu

SEQ ID NO: 3220187 - RNA, 21 nt, Mycobacterium leprae
cuguugaauauacgaaucccg

SEQ ID NO: 3220188 - RNA, 18 nt, Mycobacterium leprae
cuguugacguguuuugcu

SEQ ID NO: 3220189 - RNA, 16 nt, Mycobacterium leprae
cuguugaucgacgcaa

SEQ ID NO: 3220190 - RNA, 14 nt, Mycobacterium leprae
cuguugcaggcuuc

SEQ ID NO: 3220191 - RNA, 16 nt, Mycobacterium leprae
cuguugcggccaagcu

SEQ ID NO: 3220192 - RNA, 18 nt, Mycobacterium leprae
cuguugguaaccagccac

SEQ ID NO: 3220193 - RNA, 22 nt, Mycobacterium leprae
cuguuggugagauuucagccgg

SEQ ID NO: 3220194 - RNA, 17 nt, Mycobacterium leprae
cuguuggugugugagga

SEQ ID NO: 3220195 - RNA, 16 nt, Mycobacterium leprae
cuguugucagcagacc

SEQ ID NO: 3220196 - RNA, 19 nt, Mycobacterium leprae
cuguuguggggguggagua

SEQ ID NO: 3220197 - RNA, 17 nt, Mycobacterium leprae
cuguuguuaccggcgaa

SEQ ID NO: 3220198 - RNA, 22 nt, Mycobacterium leprae
cuguuguuggucggcgcuggcg

SEQ ID NO: 3220199 - RNA, 13 nt, Mycobacterium leprae
cuguuucugcuau

SEQ ID NO: 3220200 - RNA, 19 nt, Mycobacterium leprae
cuuaacaacuugacgaugc

SEQ ID NO: 3220201 - RNA, 17 nt, Mycobacterium leprae
cuuaaguaggcggucau

SEQ ID NO: 3220202 - RNA, 17 nt, Mycobacterium leprae
cuuaaucgagccacuua

SEQ ID NO: 3220203 - RNA, 22 nt, Mycobacterium leprae
cuuaaucgagccacuuaaguua

SEQ ID NO: 3220204 - RNA, 22 nt, Mycobacterium leprae
cuuaaucgccggcguugauuga

SEQ ID NO: 3220205 - RNA, 23 nt, Mycobacterium leprae
cuuaaugcaggaggugcagacuu

SEQ ID NO: 3220206 - RNA, 17 nt, Mycobacterium leprae
cuuacagucacuauaau

SEQ ID NO: 3220207 - RNA, 18 nt, Mycobacterium leprae
cuuacagucacuauaauu

SEQ ID NO: 3220208 - RNA, 19 nt, Mycobacterium leprae
cuuacagucacuauaauuu

SEQ ID NO: 3220209 - RNA, 21 nt, Mycobacterium leprae
cuuaccucagugucagcagca

SEQ ID NO: 3220210 - RNA, 13 nt, Mycobacterium leprae
cuuacgaucucag

SEQ ID NO: 3220211 - RNA, 16 nt, Mycobacterium leprae
cuuagauuggaaggca

SEQ ID NO: 3220212 - RNA, 22 nt, Mycobacterium leprae
cuuagcaacguguaaggccagc

SEQ ID NO: 3220213 - RNA, 20 nt, Mycobacterium leprae
cuuagcacguccucggccca

SEQ ID NO: 3220214 - RNA, 18 nt, Mycobacterium leprae
cuuagccaugucuaccug

SEQ ID NO: 3220215 - RNA, 16 nt, Mycobacterium leprae
cuuagcuaugcaguga

SEQ ID NO: 3220216 - RNA, 23 nt, Mycobacterium leprae
cuuagcugagaaguagcgacauc

SEQ ID NO: 3220217 - RNA, 15 nt, Mycobacterium leprae
cuuagggcgauucga

SEQ ID NO: 3220218 - RNA, 23 nt, Mycobacterium leprae
cuuaguuuagagugcagcacaag

SEQ ID NO: 3220219 - RNA, 22 nt, Mycobacterium leprae
cuuaucucaucgucucgcucca

SEQ ID NO: 3220220 - RNA, 16 nt, Mycobacterium leprae
cuuaugcgugcugagu

SEQ ID NO: 3220221 - RNA, 20 nt, Mycobacterium leprae
cuucaacguugaagcggggg

SEQ ID NO: 3220222 - RNA, 22 nt, Mycobacterium leprae
cuucaagggcaucgccguggug

SEQ ID NO: 3220223 - RNA, 16 nt, Mycobacterium leprae
cuucaauuuuccaguu

SEQ ID NO: 3220224 - RNA, 18 nt, Mycobacterium leprae
cuucagcgacaggcagcu

SEQ ID NO: 3220225 - RNA, 21 nt, Mycobacterium leprae
cuucaggucuacucgccugau

SEQ ID NO: 3220226 - RNA, 14 nt, Mycobacterium leprae
cuucaucaacugag

SEQ ID NO: 3220227 - RNA, 14 nt, Mycobacterium leprae
cuucaucagcucug

SEQ ID NO: 3220228 - RNA, 13 nt, Mycobacterium leprae
cuucaucagugug

SEQ ID NO: 3220229 - RNA, 16 nt, Mycobacterium leprae
cuucauguccuacaca

SEQ ID NO: 3220230 - RNA, 13 nt, Mycobacterium leprae
cuuccacaucgau

SEQ ID NO: 3220231 - RNA, 15 nt, Mycobacterium leprae
cuuccagucuggcgg

SEQ ID NO: 3220232 - RNA, 13 nt, Mycobacterium leprae
gaaacgccucugc

SEQ ID NO: 3220233 - RNA, 16 nt, Mycobacterium leprae
gaaacggcgucgaauu

SEQ ID NO: 3220234 - RNA, 20 nt, Mycobacterium leprae
gaaacggguggacgaaccgg

SEQ ID NO: 3220235 - RNA, 24 nt, Mycobacterium leprae
gaaacgucaucgacagaugcgauc

SEQ ID NO: 3220236 - RNA, 21 nt, Mycobacterium leprae
gaaacugcauacagcgcugga

SEQ ID NO: 3220237 - RNA, 13 nt, Mycobacterium leprae
gaaagaauuuacc

SEQ ID NO: 3220238 - RNA, 18 nt, Mycobacterium leprae
gaaagaauuuaccggcgu

SEQ ID NO: 3220239 - RNA, 15 nt, Mycobacterium leprae
gaaagcgcgagauua

SEQ ID NO: 3220240 - RNA, 15 nt, Mycobacterium leprae
gaaagcucaagcuug

SEQ ID NO: 3220241 - RNA, 17 nt, Mycobacterium leprae
gaaagcucaagcuugag

SEQ ID NO: 3220242 - RNA, 17 nt, Mycobacterium leprae
gaaaguaggcacagccc

SEQ ID NO: 3220243 - RNA, 14 nt, Mycobacterium leprae
gaaagucagcauca

SEQ ID NO: 3220244 - RNA, 14 nt, Mycobacterium leprae
gaaauaguggcuga

SEQ ID NO: 3220245 - RNA, 17 nt, Mycobacterium leprae
gaaaucgagaauuuacc

SEQ ID NO: 3220246 - RNA, 22 nt, Mycobacterium leprae
gaaaucgagaauuuaccggcgu

SEQ ID NO: 3220247 - RNA, 14 nt, Mycobacterium leprae
gaaaucgguggcag

SEQ ID NO: 3220248 - RNA, 17 nt, Mycobacterium leprae
gaaaucguucgaccaga

SEQ ID NO: 3220249 - RNA, 16 nt, Mycobacterium leprae
gaaaugcauuggauga

SEQ ID NO: 3220250 - RNA, 22 nt, Mycobacterium leprae
gaacaaccgguaaacagugcca

SEQ ID NO: 3220251 - RNA, 19 nt, Mycobacterium leprae
gaacaagaaaaggacccac

SEQ ID NO: 3220252 - RNA, 20 nt, Mycobacterium leprae
gaacaaggguacgccaggua

SEQ ID NO: 3220253 - RNA, 21 nt, Mycobacterium leprae
gaacacccuggaauccgcgca

SEQ ID NO: 3220254 - RNA, 17 nt, Mycobacterium leprae
gaacacgcugaucgcug

SEQ ID NO: 3220255 - RNA, 17 nt, Mycobacterium leprae
gaacacguucuugccau

SEQ ID NO: 3220256 - RNA, 18 nt, Mycobacterium leprae
gaacagccuugcaaaacg

SEQ ID NO: 3220257 - RNA, 22 nt, Mycobacterium leprae
gaacagccuugcaaaacgucga

SEQ ID NO: 3220258 - RNA, 17 nt, Mycobacterium leprae
gaacagcucgacagcag

SEQ ID NO: 3220259 - RNA, 19 nt, Mycobacterium leprae
gaacagugggggugcggca

SEQ ID NO: 3220260 - RNA, 20 nt, Mycobacterium leprae
gaacaucccugggccggcac

SEQ ID NO: 3220261 - RNA, 22 nt, Mycobacterium leprae
gaacaucgaagaacauggaugu

SEQ ID NO: 3220262 - RNA, 24 nt, Mycobacterium leprae
gaacaucgcgaaugacguucagug

SEQ ID NO: 3220263 - RNA, 18 nt, Mycobacterium leprae
gaacaugaucaauaccac

SEQ ID NO: 3220264 - RNA, 13 nt, Mycobacterium leprae
gaaccaucaacgg

SEQ ID NO: 3220265 - RNA, 20 nt, Mycobacterium leprae
gaaccaucacuaucgucgug

SEQ ID NO: 3220266 - RNA, 17 nt, Mycobacterium leprae
gaaccgacgaugcuguu

SEQ ID NO: 3220267 - RNA, 22 nt, Mycobacterium leprae
gaaccgauuuucucggcagcag

SEQ ID NO: 3220268 - RNA, 15 nt, Mycobacterium leprae
gaaccgcagcugcuc

SEQ ID NO: 3220269 - RNA, 16 nt, Mycobacterium leprae
gaaccucgccaccugg

SEQ ID NO: 3220270 - RNA, 22 nt, Mycobacterium leprae
gaaccugugcguaaggaagaug

SEQ ID NO: 3220271 - RNA, 21 nt, Mycobacterium leprae
gaacgacuugaccagccgcag

SEQ ID NO: 3220272 - RNA, 13 nt, Mycobacterium leprae
gaacgagaagcag

SEQ ID NO: 3220273 - RNA, 14 nt, Mycobacterium leprae
gaacgagaagcagc

SEQ ID NO: 3220274 - RNA, 22 nt, Mycobacterium leprae
gaacgagagguuuuugccgagc

SEQ ID NO: 3220275 - RNA, 22 nt, Mycobacterium leprae
gaacgcagucugaucgcucacc

SEQ ID NO: 3220276 - RNA, 15 nt, Mycobacterium leprae
gaacgccucggcaag

SEQ ID NO: 3220277 - RNA, 16 nt, Mycobacterium leprae
gaacgccucggcaagc

SEQ ID NO: 3220278 - RNA, 13 nt, Mycobacterium leprae
gaacgugcugcug

SEQ ID NO: 3220279 - RNA, 23 nt, Mycobacterium leprae
gaacucagcgguaagcggauccu

SEQ ID NO: 3220280 - RNA, 15 nt, Mycobacterium leprae
gaacucgauacaguc

SEQ ID NO: 3220281 - RNA, 16 nt, Mycobacterium leprae
gaacucgucguccggc

SEQ ID NO: 3220282 - RNA, 16 nt, Mycobacterium leprae
gaacugacuucaguca

SEQ ID NO: 3220283 - RNA, 11 nt, Mycobacterium leprae
gaacugcaggu

SEQ ID NO: 3220284 - RNA, 20 nt, Mycobacterium leprae
gaacuggaucggucagccac

SEQ ID NO: 3220285 - RNA, 15 nt, Mycobacterium leprae
gaacuucaagcucau

SEQ ID NO: 3220286 - RNA, 12 nt, Mycobacterium leprae
gaacuucuucag

SEQ ID NO: 3220287 - RNA, 15 nt, Mycobacterium leprae
gaacuuguucuuugc

SEQ ID NO: 3220288 - RNA, 17 nt, Mycobacterium leprae
gaacuuuuccaugcugc

SEQ ID NO: 3220289 - RNA, 23 nt, Mycobacterium leprae
gaacuuuuccaugcugccgucga

SEQ ID NO: 3220290 - RNA, 20 nt, Mycobacterium leprae
gaagaaucuugaaauucaau

SEQ ID NO: 3220291 - RNA, 16 nt, Mycobacterium leprae
gaagacauaucaacaa

SEQ ID NO: 3220292 - RNA, 21 nt, Mycobacterium leprae
gaagacauaucaacaacugcg

SEQ ID NO: 3220293 - RNA, 22 nt, Mycobacterium leprae
gaagagcggcacgauaggcagu

SEQ ID NO: 3220294 - RNA, 15 nt, Mycobacterium leprae
gaagaguccugaucu

SEQ ID NO: 3220295 - RNA, 18 nt, Mycobacterium leprae
gaagaguuucugcugccg

SEQ ID NO: 3220296 - RNA, 14 nt, Mycobacterium leprae
gaagaucaccgcca

SEQ ID NO: 3220297 - RNA, 15 nt, Mycobacterium leprae
gaagaucaccgccac

SEQ ID NO: 3220298 - RNA, 22 nt, Mycobacterium leprae
gaagauccuauccggaaaucga

SEQ ID NO: 3220299 - RNA, 21 nt, Mycobacterium leprae
gaagaugacaccgaacagcuc

SEQ ID NO: 3220300 - RNA, 16 nt, Mycobacterium leprae
gaagauguuccggcga

SEQ ID NO: 3220301 - RNA, 23 nt, Mycobacterium leprae
gaagauguuccggcgaccagcga

SEQ ID NO: 3220302 - RNA, 16 nt, Mycobacterium leprae
gaagcccucccagcca

SEQ ID NO: 3220303 - RNA, 13 nt, Mycobacterium leprae
gaagccgccacga

SEQ ID NO: 3220304 - RNA, 24 nt, Mycobacterium leprae
gaagccggcucgcggggaugcuga

SEQ ID NO: 3220305 - RNA, 16 nt, Mycobacterium leprae
gaagccuggucgcgua

SEQ ID NO: 3220306 - RNA, 23 nt, Mycobacterium leprae
gaagcgcagcucgccaaggucga

SEQ ID NO: 3220307 - RNA, 18 nt, Mycobacterium leprae
gaagcgcugauccucucc

SEQ ID NO: 3220308 - RNA, 23 nt, Mycobacterium leprae
gaagcguccgcuaccugguccgu

SEQ ID NO: 3220309 - RNA, 14 nt, Mycobacterium leprae
gaagcucaacuagg

SEQ ID NO: 3220310 - RNA, 12 nt, Mycobacterium leprae
gaagcucuggcu

SEQ ID NO: 3220311 - RNA, 17 nt, Mycobacterium leprae
gaagcugaauggucauu

SEQ ID NO: 3220312 - RNA, 17 nt, Mycobacterium leprae
gaaggagccgaggcaca

SEQ ID NO: 3220313 - RNA, 22 nt, Mycobacterium leprae
gaaggagcggugguacaauccc

SEQ ID NO: 3220314 - RNA, 17 nt, Mycobacterium leprae
gaaggcgauaucgaugc

SEQ ID NO: 3220315 - RNA, 18 nt, Mycobacterium leprae
gaaggcgauaucgaugca

SEQ ID NO: 3220316 - RNA, 21 nt, Mycobacterium leprae
gaaggcgauaucgaugcaggc

SEQ ID NO: 3220317 - RNA, 14 nt, Mycobacterium leprae
gaagggagugcagu

SEQ ID NO: 3220318 - RNA, 15 nt, Mycobacterium leprae
gaagggagugcagug

SEQ ID NO: 3220319 - RNA, 16 nt, Mycobacterium leprae
gaaggggucgaugagg

SEQ ID NO: 3220320 - RNA, 20 nt, Mycobacterium leprae
gaaggggucgaugaggcucg

SEQ ID NO: 3220321 - RNA, 15 nt, Mycobacterium leprae
gaagguagugugaca

SEQ ID NO: 3220322 - RNA, 18 nt, Mycobacterium leprae
gaaggugagucgacagcg

SEQ ID NO: 3220323 - RNA, 17 nt, Mycobacterium leprae
gaaguagcgacaucggg

SEQ ID NO: 3220324 - RNA, 22 nt, Mycobacterium leprae
gaaguauggcuccauagaacac

SEQ ID NO: 3220325 - RNA, 22 nt, Mycobacterium leprae
gaagucgacgccgcggcugccg

SEQ ID NO: 3220326 - RNA, 14 nt, Mycobacterium leprae
gaagugaucggcga

SEQ ID NO: 3220327 - RNA, 23 nt, Mycobacterium leprae
gaagugauucgaaggcggugauc

SEQ ID NO: 3220328 - RNA, 15 nt, Mycobacterium leprae
gaagugcuugggcac

SEQ ID NO: 3220329 - RNA, 23 nt, Mycobacterium leprae
gaagugcuugggcacgcuggccg

SEQ ID NO: 3220330 - RNA, 17 nt, Mycobacterium leprae
gaagugguuuuggcagu

SEQ ID NO: 3220331 - RNA, 22 nt, Mycobacterium leprae
gaaguuguucgucgggugccga

SEQ ID NO: 3220332 - RNA, 19 nt, Mycobacterium leprae
gaauagcugugggguauug

SEQ ID NO: 3220333 - RNA, 22 nt, Mycobacterium leprae
gaauaguuauaccgugcacggg

SEQ ID NO: 3220334 - RNA, 18 nt, Mycobacterium leprae
gaauaugcccagcagaug

SEQ ID NO: 3220335 - RNA, 13 nt, Mycobacterium leprae
gaauauugcgaca

SEQ ID NO: 3220336 - RNA, 15 nt, Mycobacterium leprae
gaaucaugaagaucg

SEQ ID NO: 3220337 - RNA, 21 nt, Mycobacterium leprae
gaaucaugccgcagcaucagg

SEQ ID NO: 3220338 - RNA, 16 nt, Mycobacterium leprae
gaauccgccucggugu

SEQ ID NO: 3220339 - RNA, 17 nt, Mycobacterium leprae
gaauccucgacccacca

SEQ ID NO: 3220340 - RNA, 15 nt, Mycobacterium leprae
gaauccucgauggcg

SEQ ID NO: 3220341 - RNA, 14 nt, Mycobacterium leprae
gaauccuguugacg

SEQ ID NO: 3220342 - RNA, 22 nt, Mycobacterium leprae
gaaucgaucccacugacgccga

SEQ ID NO: 3220343 - RNA, 23 nt, Mycobacterium leprae
gaaucggcgcacagcuggcuugu

SEQ ID NO: 3220344 - RNA, 23 nt, Mycobacterium leprae
gacccgugcuuaccucaguguca

SEQ ID NO: 3220345 - RNA, 20 nt, Mycobacterium leprae
gacccguuguucggcaggcc

SEQ ID NO: 3220346 - RNA, 21 nt, Mycobacterium leprae
gacccguuguucggcaggccg

SEQ ID NO: 3220347 - RNA, 12 nt, Mycobacterium leprae
gaccgaaagccg

SEQ ID NO: 3220348 - RNA, 13 nt, Mycobacterium leprae
gaccgaaccccga

SEQ ID NO: 3220349 - RNA, 13 nt, Mycobacterium leprae
gaccgaccaaccg

SEQ ID NO: 3220350 - RNA, 17 nt, Mycobacterium leprae
gaccgaugcucgcccuc

SEQ ID NO: 3220351 - RNA, 12 nt, Mycobacterium leprae
gaccgcccugga

SEQ ID NO: 3220352 - RNA, 15 nt, Mycobacterium leprae
gaccgcgugaucgcu

SEQ ID NO: 3220353 - RNA, 17 nt, Mycobacterium leprae
gaccgcuggggucgcgg

SEQ ID NO: 3220354 - RNA, 16 nt, Mycobacterium leprae
gaccgggccggccgcg

SEQ ID NO: 3220355 - RNA, 16 nt, Mycobacterium leprae
gaccgucaugcugcuc

SEQ ID NO: 3220356 - RNA, 19 nt, Mycobacterium leprae
gaccgucgaagugcgccag

SEQ ID NO: 3220357 - RNA, 20 nt, Mycobacterium leprae
gaccgucgaagugcgccagc

SEQ ID NO: 3220358 - RNA, 22 nt, Mycobacterium leprae
gaccgugcagcugccaaccggu

SEQ ID NO: 3220359 - RNA, 17 nt, Mycobacterium leprae
gaccuagucgaggcuca

SEQ ID NO: 3220360 - RNA, 15 nt, Mycobacterium leprae
gaccuauuuuuccgc

SEQ ID NO: 3220361 - RNA, 15 nt, Mycobacterium leprae
gaccucaucccacag

SEQ ID NO: 3220362 - RNA, 19 nt, Mycobacterium leprae
gaccucccugacgcacacc

SEQ ID NO: 3220363 - RNA, 21 nt, Mycobacterium leprae
gaccuccgcagcaucggcauc

SEQ ID NO: 3220364 - RNA, 18 nt, Mycobacterium leprae
gaccuccgcuauaagugu

SEQ ID NO: 3220365 - RNA, 17 nt, Mycobacterium leprae
gaccuccuugaccacca

SEQ ID NO: 3220366 - RNA, 17 nt, Mycobacterium leprae
gaccucggcgcuggggc

SEQ ID NO: 3220367 - RNA, 20 nt, Mycobacterium leprae
gaccucuuccgccgcuacac

SEQ ID NO: 3220368 - RNA, 16 nt, Mycobacterium leprae
gaccuggugacgucgu

SEQ ID NO: 3220369 - RNA, 18 nt, Mycobacterium leprae
gacgaacaugcaguacuu

SEQ ID NO: 3220370 - RNA, 15 nt, Mycobacterium leprae
gacgaaccggacagc

SEQ ID NO: 3220371 - RNA, 23 nt, Mycobacterium leprae
gacgaagacauaucaacaacugc

SEQ ID NO: 3220372 - RNA, 19 nt, Mycobacterium leprae
gacgaccuccucgggggug

SEQ ID NO: 3220373 - RNA, 14 nt, Mycobacterium leprae
gacgacggcgggcc

SEQ ID NO: 3220374 - RNA, 18 nt, Mycobacterium leprae
gacgacgugaaacaagcc

SEQ ID NO: 3220375 - RNA, 12 nt, Mycobacterium leprae
gacgacugccga

SEQ ID NO: 3220376 - RNA, 15 nt, Mycobacterium leprae
gacgagacacugacg

SEQ ID NO: 3220377 - RNA, 13 nt, Mycobacterium leprae
gacgaggcgguga

SEQ ID NO: 3220378 - RNA, 20 nt, Mycobacterium leprae
gacgaggugacucgccggcg

SEQ ID NO: 3220379 - RNA, 17 nt, Mycobacterium leprae
gacgaggugucggcgau

SEQ ID NO: 3220380 - RNA, 19 nt, Mycobacterium leprae
gacgaucgcaaucgacggc

SEQ ID NO: 3220381 - RNA, 16 nt, Mycobacterium leprae
gacgaugaucggcuug

SEQ ID NO: 3220382 - RNA, 19 nt, Mycobacterium leprae
gacgaugaucggcuugccg

SEQ ID NO: 3220383 - RNA, 17 nt, Mycobacterium leprae
gacgaugcaguggguga

SEQ ID NO: 3220384 - RNA, 22 nt, Mycobacterium leprae
gacgaugcgugccccggccgcc

SEQ ID NO: 3220385 - RNA, 18 nt, Mycobacterium leprae
gacgauuccuggaaagag

SEQ ID NO: 3220386 - RNA, 18 nt, Mycobacterium leprae
gacgauuugcgaucaacu

SEQ ID NO: 3220387 - RNA, 15 nt, Mycobacterium leprae
gacgcaacugagaag

SEQ ID NO: 3220388 - RNA, 16 nt, Mycobacterium leprae
gacgcaacugagaagg

SEQ ID NO: 3220389 - RNA, 21 nt, Mycobacterium leprae
gacgcauccaucgcaucugcc

SEQ ID NO: 3220390 - RNA, 11 nt, Mycobacterium leprae
gacgccaggcg

SEQ ID NO: 3220391 - RNA, 20 nt, Mycobacterium leprae
gacgccgccggagcgaagca

SEQ ID NO: 3220392 - RNA, 16 nt, Mycobacterium leprae
gacgccgcggcugccg

SEQ ID NO: 3220393 - RNA, 13 nt, Mycobacterium leprae
gacgccggcggcc

SEQ ID NO: 3220394 - RNA, 16 nt, Mycobacterium leprae
gacgcgaacgugcugc

SEQ ID NO: 3220395 - RNA, 17 nt, Mycobacterium leprae
gacgcgaccgccaccag

SEQ ID NO: 3220396 - RNA, 14 nt, Mycobacterium leprae
gacgcgcuaaaccu

SEQ ID NO: 3220397 - RNA, 14 nt, Mycobacterium leprae
gacgcuaccgagga

SEQ ID NO: 3220398 - RNA, 22 nt, Mycobacterium leprae
gacgcuauguuggccagcagcg

SEQ ID NO: 3220399 - RNA, 20 nt, Mycobacterium leprae
gacgcucgaggaagcgcagc

SEQ ID NO: 3220400 - RNA, 18 nt, Mycobacterium leprae
gacggacaggccguagcg

SEQ ID NO: 3220401 - RNA, 12 nt, Mycobacterium leprae
gacggagcgcag

SEQ ID NO: 3220402 - RNA, 18 nt, Mycobacterium leprae
gacggaugcccagccagg

SEQ ID NO: 3220403 - RNA, 20 nt, Mycobacterium leprae
gacggauuucucgugguggc

SEQ ID NO: 3220404 - RNA, 12 nt, Mycobacterium leprae
gacggcacagug

SEQ ID NO: 3220405 - RNA, 15 nt, Mycobacterium leprae
gacggcacagugcuu

SEQ ID NO: 3220406 - RNA, 15 nt, Mycobacterium leprae
gacggcagaaauaac

SEQ ID NO: 3220407 - RNA, 20 nt, Mycobacterium leprae
gacggcagcgauugggaucg

SEQ ID NO: 3220408 - RNA, 13 nt, Mycobacterium leprae
gacggcagugauu

SEQ ID NO: 3220409 - RNA, 15 nt, Mycobacterium leprae
gacggcagugauuuu

SEQ ID NO: 3220410 - RNA, 13 nt, Mycobacterium leprae
gacggcccagcac

SEQ ID NO: 3220411 - RNA, 19 nt, Mycobacterium leprae
gacggccggcgucgcguca

SEQ ID NO: 3220412 - RNA, 22 nt, Mycobacterium leprae
gacggccggcgucgcgucauca

SEQ ID NO: 3220413 - RNA, 12 nt, Mycobacterium leprae
gacggcuggcag

SEQ ID NO: 3220414 - RNA, 17 nt, Mycobacterium leprae
gacgggaagugguggca

SEQ ID NO: 3220415 - RNA, 15 nt, Mycobacterium leprae
gacgggaggaacucc

SEQ ID NO: 3220416 - RNA, 15 nt, Mycobacterium leprae
gacgggcggccaggc

SEQ ID NO: 3220417 - RNA, 22 nt, Mycobacterium leprae
gacgggcggccaggcaggaucu

SEQ ID NO: 3220418 - RNA, 17 nt, Mycobacterium leprae
gacgguccugguggcaa

SEQ ID NO: 3220419 - RNA, 19 nt, Mycobacterium leprae
gacgguccugguggcaacg

SEQ ID NO: 3220420 - RNA, 18 nt, Mycobacterium leprae
gacggucgagcuggacag

SEQ ID NO: 3220421 - RNA, 15 nt, Mycobacterium leprae
gacggucgcacgacc

SEQ ID NO: 3220422 - RNA, 22 nt, Mycobacterium leprae
gacgguguugcugaguguuggu

SEQ ID NO: 3220423 - RNA, 22 nt, Mycobacterium leprae
gacgguuucacaacccggcaga

SEQ ID NO: 3220424 - RNA, 15 nt, Mycobacterium leprae
gacguaacggucggu

SEQ ID NO: 3220425 - RNA, 23 nt, Mycobacterium leprae
gacgucgguguggugcucuaucg

SEQ ID NO: 3220426 - RNA, 17 nt, Mycobacterium leprae
gacgugaucgcagaagc

SEQ ID NO: 3220427 - RNA, 18 nt, Mycobacterium leprae
gacgugcacugguggugg

SEQ ID NO: 3220428 - RNA, 15 nt, Mycobacterium leprae
gacgugccgcaggca

SEQ ID NO: 3220429 - RNA, 16 nt, Mycobacterium leprae
gacgugccgcaggcac

SEQ ID NO: 3220430 - RNA, 20 nt, Mycobacterium leprae
gacguggugguagccaacgc

SEQ ID NO: 3220431 - RNA, 18 nt, Mycobacterium leprae
gacguguucacgcaguca

SEQ ID NO: 3220432 - RNA, 13 nt, Mycobacterium leprae
gacguguuuugcu

SEQ ID NO: 3220433 - RNA, 15 nt, Mycobacterium leprae
gacguuaucuugaug

SEQ ID NO: 3220434 - RNA, 21 nt, Mycobacterium leprae
gacuaagccgccgaacaagcc

SEQ ID NO: 3220435 - RNA, 22 nt, Mycobacterium leprae
gacuaagccgccgaacaagcca

SEQ ID NO: 3220436 - RNA, 13 nt, Mycobacterium leprae
gacuaauauguuc

SEQ ID NO: 3220437 - RNA, 21 nt, Mycobacterium leprae
gacuagucgucgugcugauca

SEQ ID NO: 3220438 - RNA, 17 nt, Mycobacterium leprae
gacucaacauaacaccc

SEQ ID NO: 3220439 - RNA, 19 nt, Mycobacterium leprae
gacucagggcccagaucca

SEQ ID NO: 3220440 - RNA, 22 nt, Mycobacterium leprae
gacucaucgccaaccgucggga

SEQ ID NO: 3220441 - RNA, 15 nt, Mycobacterium leprae
gacucccuucgccgg

SEQ ID NO: 3220442 - RNA, 15 nt, Mycobacterium leprae
gacucgagucccgaa

SEQ ID NO: 3220443 - RNA, 21 nt, Mycobacterium leprae
gacucgccgguggggauuuga

SEQ ID NO: 3220444 - RNA, 14 nt, Mycobacterium leprae
gacucggucugcug

SEQ ID NO: 3220445 - RNA, 16 nt, Mycobacterium leprae
gacucuccccacugca

SEQ ID NO: 3220446 - RNA, 19 nt, Mycobacterium leprae
gacugacccaagcgccagc

SEQ ID NO: 3220447 - RNA, 23 nt, Mycobacterium leprae
gacugcacccggccgucgcucgg

SEQ ID NO: 3220448 - RNA, 16 nt, Mycobacterium leprae
gacugcagugucuaca

SEQ ID NO: 3220449 - RNA, 15 nt, Mycobacterium leprae
gacugccugcuuucg

SEQ ID NO: 3220450 - RNA, 13 nt, Mycobacterium leprae
gacuggcugccca

SEQ ID NO: 3220451 - RNA, 20 nt, Mycobacterium leprae
gacuguagagacguaccacu

SEQ ID NO: 3220452 - RNA, 17 nt, Mycobacterium leprae
gacuguguacgaagccu

SEQ ID NO: 3220453 - RNA, 22 nt, Mycobacterium leprae
gacuucacucacuaacguucgg

SEQ ID NO: 3220454 - RNA, 14 nt, Mycobacterium leprae
gacuucuucgauua

SEQ ID NO: 3220455 - RNA, 23 nt, Mycobacterium leprae
gacuugacugggucguuggcaac

SEQ ID NO: 3220456 - RNA, 19 nt, Mycobacterium leprae
gacuugccgaagccgggac

SEQ ID NO: 3220457 - RNA, 24 nt, Mycobacterium leprae
gagucggauuuauuugucgcugga

SEQ ID NO: 3220458 - RNA, 16 nt, Mycobacterium leprae
gagucucacccaccuu

SEQ ID NO: 3220459 - RNA, 21 nt, Mycobacterium leprae
gagucucuggugcgccaacac

SEQ ID NO: 3220460 - RNA, 23 nt, Mycobacterium leprae
gagugaaaguaggcacagcccag

SEQ ID NO: 3220461 - RNA, 15 nt, Mycobacterium leprae
gagugcagugcccgc

SEQ ID NO: 3220462 - RNA, 15 nt, Mycobacterium leprae
gagugcauucugacu

SEQ ID NO: 3220463 - RNA, 18 nt, Mycobacterium leprae
gagugcgcugcagcaaca

SEQ ID NO: 3220464 - RNA, 11 nt, Mycobacterium leprae
gagugcugacg

SEQ ID NO: 3220465 - RNA, 14 nt, Mycobacterium leprae
gagugcuggucaac

SEQ ID NO: 3220466 - RNA, 15 nt, Mycobacterium leprae
gagugguaaggcuca

SEQ ID NO: 3220467 - RNA, 19 nt, Mycobacterium leprae
gagugguacaacaguuguu

SEQ ID NO: 3220468 - RNA, 20 nt, Mycobacterium leprae
gaguguagcaaggugcuguu

SEQ ID NO: 3220469 - RNA, 19 nt, Mycobacterium leprae
gaguguccgcaaaaugcuc

SEQ ID NO: 3220470 - RNA, 16 nt, Mycobacterium leprae
gagugugauaccgacu

SEQ ID NO: 3220471 - RNA, 21 nt, Mycobacterium leprae
gaguguggguauuggacccga

SEQ ID NO: 3220472 - RNA, 22 nt, Mycobacterium leprae
gaguguggguauuggacccgau

SEQ ID NO: 3220473 - RNA, 23 nt, Mycobacterium leprae
gaguuccucguggguacgugcca

SEQ ID NO: 3220474 - RNA, 20 nt, Mycobacterium leprae
gaguucuaucaacauuuguu

SEQ ID NO: 3220475 - RNA, 13 nt, Mycobacterium leprae
gaguugacccaca

SEQ ID NO: 3220476 - RNA, 14 nt, Mycobacterium leprae
gaguugacccacaa

SEQ ID NO: 3220477 - RNA, 19 nt, Mycobacterium leprae
gaguugagcgguucaucga

SEQ ID NO: 3220478 - RNA, 14 nt, Mycobacterium leprae
gaguugaugugauc

SEQ ID NO: 3220479 - RNA, 20 nt, Mycobacterium leprae
gaguugggccaugcagucgc

SEQ ID NO: 3220480 - RNA, 14 nt, Mycobacterium leprae
gauaaagcuuagaa

SEQ ID NO: 3220481 - RNA, 14 nt, Mycobacterium leprae
gauaaauaguauua

SEQ ID NO: 3220482 - RNA, 13 nt, Mycobacterium leprae
gauaacccguguc

SEQ ID NO: 3220483 - RNA, 14 nt, Mycobacterium leprae
gauaacccgugucg

SEQ ID NO: 3220484 - RNA, 19 nt, Mycobacterium leprae
gauaacgcugaaccgcguc

SEQ ID NO: 3220485 - RNA, 19 nt, Mycobacterium leprae
gauaacgggugucuaauca

SEQ ID NO: 3220486 - RNA, 14 nt, Mycobacterium leprae
gauaagcacuagaa

SEQ ID NO: 3220487 - RNA, 22 nt, Mycobacterium leprae
gauaaugccgguggccagcgca

SEQ ID NO: 3220488 - RNA, 14 nt, Mycobacterium leprae
gauaauuuggcuga

SEQ ID NO: 3220489 - RNA, 21 nt, Mycobacterium leprae
gauaauuuggcugauaauauc

SEQ ID NO: 3220490 - RNA, 17 nt, Mycobacterium leprae
gauaccagcgucgcuca

SEQ ID NO: 3220491 - RNA, 17 nt, Mycobacterium leprae
gauaccgggcucgguga

SEQ ID NO: 3220492 - RNA, 20 nt, Mycobacterium leprae
gauacguuagucuggcuggc

SEQ ID NO: 3220493 - RNA, 14 nt, Mycobacterium leprae
gauacugcaauccg

SEQ ID NO: 3220494 - RNA, 21 nt, Mycobacterium leprae
gauacugcugcacccggcggc

SEQ ID NO: 3220495 - RNA, 20 nt, Mycobacterium leprae
gauagaggaucugcacaaca

SEQ ID NO: 3220496 - RNA, 18 nt, Mycobacterium leprae
gauagauggagccaccac

SEQ ID NO: 3220497 - RNA, 23 nt, Mycobacterium leprae
gauagcgaccaucgaaacugcca

SEQ ID NO: 3220498 - RNA, 13 nt, Mycobacterium leprae
gauagcgacuguu

SEQ ID NO: 3220499 - RNA, 20 nt, Mycobacterium leprae
gauagcggcgguaaacagag

SEQ ID NO: 3220500 - RNA, 14 nt, Mycobacterium leprae
gauagcugugcagg

SEQ ID NO: 3220501 - RNA, 19 nt, Mycobacterium leprae
gauagugguucgauucugc

SEQ ID NO: 3220502 - RNA, 13 nt, Mycobacterium leprae
gauauguucggua

SEQ ID NO: 3220503 - RNA, 19 nt, Mycobacterium leprae
gauauugcggcauugcggc

SEQ ID NO: 3220504 - RNA, 21 nt, Mycobacterium leprae
gaucaacagcgcagugugcuu

SEQ ID NO: 3220505 - RNA, 11 nt, Mycobacterium leprae
gaucaaccaaa

SEQ ID NO: 3220506 - RNA, 14 nt, Mycobacterium leprae
gaucaacgccgcga

SEQ ID NO: 3220507 - RNA, 17 nt, Mycobacterium leprae
gaucaacguuuugccga

SEQ ID NO: 3220508 - RNA, 21 nt, Mycobacterium leprae
gaucacaaauugucagcuaaa

SEQ ID NO: 3220509 - RNA, 17 nt, Mycobacterium leprae
gaucacaucagugcugu

SEQ ID NO: 3220510 - RNA, 16 nt, Mycobacterium leprae
gaucaccgccaccacg

SEQ ID NO: 3220511 - RNA, 18 nt, Mycobacterium leprae
gaucaccuagaacagcau

SEQ ID NO: 3220512 - RNA, 20 nt, Mycobacterium leprae
gaucaccuagaacagcaucg

SEQ ID NO: 3220513 - RNA, 13 nt, Mycobacterium leprae
gaucacgguguau

SEQ ID NO: 3220514 - RNA, 14 nt, Mycobacterium leprae
gaucacguuggccg

SEQ ID NO: 3220515 - RNA, 13 nt, Mycobacterium leprae
gaucagccgcgca

SEQ ID NO: 3220516 - RNA, 16 nt, Mycobacterium leprae
gaucagugcaauaccu

SEQ ID NO: 3220517 - RNA, 12 nt, Mycobacterium leprae
gaucagugcggu

SEQ ID NO: 3220518 - RNA, 21 nt, Mycobacterium leprae
gaucauccgcaagcgcgccga

SEQ ID NO: 3220519 - RNA, 15 nt, Mycobacterium leprae
gaucaucgaugcacu

SEQ ID NO: 3220520 - RNA, 19 nt, Mycobacterium leprae
gaucaugccuggugcgcau

SEQ ID NO: 3220521 - RNA, 20 nt, Mycobacterium leprae
gaucauggcuggacagaagc

SEQ ID NO: 3220522 - RNA, 21 nt, Mycobacterium leprae
gaucauguuccgcugauacgu

SEQ ID NO: 3220523 - RNA, 15 nt, Mycobacterium leprae
gaucauugacuuggc

SEQ ID NO: 3220524 - RNA, 20 nt, Mycobacterium leprae
gauccacaauucuucgcuca

SEQ ID NO: 3220525 - RNA, 15 nt, Mycobacterium leprae
gauccagucaugaag

SEQ ID NO: 3220526 - RNA, 19 nt, Mycobacterium leprae
gaucccaucggcugcaccg

SEQ ID NO: 3220527 - RNA, 16 nt, Mycobacterium leprae
gaucccggcgcugucc

SEQ ID NO: 3220528 - RNA, 20 nt, Mycobacterium leprae
gaucccgguuacguccgcgg

SEQ ID NO: 3220529 - RNA, 23 nt, Mycobacterium leprae
gauccggcggcucuuucggcgag

SEQ ID NO: 3220530 - RNA, 14 nt, Mycobacterium leprae
gauccgguggcgac

SEQ ID NO: 3220531 - RNA, 18 nt, Mycobacterium leprae
gauccugcucauucaggc

SEQ ID NO: 3220532 - RNA, 14 nt, Mycobacterium leprae
gauccugggcggcu

SEQ ID NO: 3220533 - RNA, 15 nt, Mycobacterium leprae
gauccugggcggcua

SEQ ID NO: 3220534 - RNA, 15 nt, Mycobacterium leprae
gauccugguuuacug

SEQ ID NO: 3220535 - RNA, 16 nt, Mycobacterium leprae
gaucgacaccucacca

SEQ ID NO: 3220536 - RNA, 23 nt, Mycobacterium leprae
gaucgaccucgaauccgccucgg

SEQ ID NO: 3220537 - RNA, 14 nt, Mycobacterium leprae
gaucgacggcuacu

SEQ ID NO: 3220538 - RNA, 21 nt, Mycobacterium leprae
gaucgagaagggagugcagug

SEQ ID NO: 3220539 - RNA, 14 nt, Mycobacterium leprae
gaucgaucucgacg

SEQ ID NO: 3220540 - RNA, 21 nt, Mycobacterium leprae
gaucgcaaucgacggccgcac

SEQ ID NO: 3220541 - RNA, 20 nt, Mycobacterium leprae
gaucgcaccggcugcacccg

SEQ ID NO: 3220542 - RNA, 14 nt, Mycobacterium leprae
gaucgcagcccaga

SEQ ID NO: 3220543 - RNA, 19 nt, Mycobacterium leprae
gaucgcagucaucaccccg

SEQ ID NO: 3220544 - RNA, 20 nt, Mycobacterium leprae
gaucgcuaguuuacuaggcc

SEQ ID NO: 3220545 - RNA, 23 nt, Mycobacterium leprae
gaucgcuaguuuacuaggcccca

SEQ ID NO: 3220546 - RNA, 20 nt, Mycobacterium leprae
gaucgcugccggcggcagau

SEQ ID NO: 3220547 - RNA, 23 nt, Mycobacterium leprae
gaucggcauggcguucggggugu

SEQ ID NO: 3220548 - RNA, 15 nt, Mycobacterium leprae
gaucgggcccagcac

SEQ ID NO: 3220549 - RNA, 19 nt, Mycobacterium leprae
gaucggggcgauguuaugu

SEQ ID NO: 3220550 - RNA, 20 nt, Mycobacterium leprae
gaucggugcaugcacaucgc

SEQ ID NO: 3220551 - RNA, 19 nt, Mycobacterium leprae
gaucgguuaugucggcugu

SEQ ID NO: 3220552 - RNA, 20 nt, Mycobacterium leprae
gaucguacgaaagaugcugc

SEQ ID NO: 3220553 - RNA, 22 nt, Mycobacterium leprae
gaucgugaagauaggucgccga

SEQ ID NO: 3220554 - RNA, 14 nt, Mycobacterium leprae
gaucgugugcacug

SEQ ID NO: 3220555 - RNA, 23 nt, Mycobacterium leprae
gaucguguuccacugucgcccga

SEQ ID NO: 3220556 - RNA, 22 nt, Mycobacterium leprae
gaucguuaccgacaccgccgac

SEQ ID NO: 3220557 - RNA, 18 nt, Mycobacterium leprae
gaucguugucggucgaca

SEQ ID NO: 3220558 - RNA, 15 nt, Mycobacterium leprae
gaucucgacggcagu

SEQ ID NO: 3220559 - RNA, 18 nt, Mycobacterium leprae
gaucucgacggcagugau

SEQ ID NO: 3220560 - RNA, 19 nt, Mycobacterium leprae
gaucugcgucgcccucgcc

SEQ ID NO: 3220561 - RNA, 22 nt, Mycobacterium leprae
gaucugcucguagcggcggcgg

SEQ ID NO: 3220562 - RNA, 14 nt, Mycobacterium leprae
gaucuggauggccg

SEQ ID NO: 3220563 - RNA, 18 nt, Mycobacterium leprae
gaucuuaaucgagccacu

SEQ ID NO: 3220564 - RNA, 20 nt, Mycobacterium leprae
gaucuucccuaaaguucccu

SEQ ID NO: 3220565 - RNA, 16 nt, Mycobacterium leprae
gaucuugcagcuggcg

SEQ ID NO: 3220566 - RNA, 19 nt, Mycobacterium leprae
gaucuugccccguuguggu

SEQ ID NO: 3220567 - RNA, 21 nt, Mycobacterium leprae
gaucuuuucggcugcacugug

SEQ ID NO: 3220568 - RNA, 17 nt, Mycobacterium leprae
gaucuuuugaccagcac

SEQ ID NO: 3220569 - RNA, 20 nt, Mycobacterium leprae
gcaagcaggcaugccgccgg

SEQ ID NO: 3220570 - RNA, 12 nt, Mycobacterium leprae
gcaagcagugcc

SEQ ID NO: 3220571 - RNA, 11 nt, Mycobacterium leprae
gcaagccgcca

SEQ ID NO: 3220572 - RNA, 16 nt, Mycobacterium leprae
gcaagccuuuguuuua

SEQ ID NO: 3220573 - RNA, 19 nt, Mycobacterium leprae
gcaagcgagccaucgcaau

SEQ ID NO: 3220574 - RNA, 14 nt, Mycobacterium leprae
gcaagcgcuuuucc

SEQ ID NO: 3220575 - RNA, 16 nt, Mycobacterium leprae
gcaagcggccgcccag

SEQ ID NO: 3220576 - RNA, 14 nt, Mycobacterium leprae
gcaagcucgggugu

SEQ ID NO: 3220577 - RNA, 15 nt, Mycobacterium leprae
gcaagcugcccggcg

SEQ ID NO: 3220578 - RNA, 15 nt, Mycobacterium leprae
gcaaggcuuggccag

SEQ ID NO: 3220579 - RNA, 12 nt, Mycobacterium leprae
gcaagggugggg

SEQ ID NO: 3220580 - RNA, 13 nt, Mycobacterium leprae
gcaaggguggggc

SEQ ID NO: 3220581 - RNA, 19 nt, Mycobacterium leprae
gcaaggguugguagcuggc

SEQ ID NO: 3220582 - RNA, 23 nt, Mycobacterium leprae
gcaaggguugguagcuggcucug

SEQ ID NO: 3220583 - RNA, 14 nt, Mycobacterium leprae
gcaaggucccccgc

SEQ ID NO: 3220584 - RNA, 20 nt, Mycobacterium leprae
gcaaggucguguugccaccg

SEQ ID NO: 3220585 - RNA, 23 nt, Mycobacterium leprae
gcaaggucguguugccaccgaca

SEQ ID NO: 3220586 - RNA, 21 nt, Mycobacterium leprae
gcaaggugagcguugugggca

SEQ ID NO: 3220587 - RNA, 16 nt, Mycobacterium leprae
gcaagguguugcggug

SEQ ID NO: 3220588 - RNA, 17 nt, Mycobacterium leprae
gcaagguguugcgguga

SEQ ID NO: 3220589 - RNA, 21 nt, Mycobacterium leprae
gcaagguuguuuguucagugc

SEQ ID NO: 3220590 - RNA, 16 nt, Mycobacterium leprae
gcaaguaaaacugaca

SEQ ID NO: 3220591 - RNA, 22 nt, Mycobacterium leprae
gcaagucauaucgucaaggcca

SEQ ID NO: 3220592 - RNA, 14 nt, Mycobacterium leprae
gcaagucgaacgga

SEQ ID NO: 3220593 - RNA, 18 nt, Mycobacterium leprae
gcaagugcaccaucugcu

SEQ ID NO: 3220594 - RNA, 19 nt, Mycobacterium leprae
gcaaucaaugugcgggccg

SEQ ID NO: 3220595 - RNA, 21 nt, Mycobacterium leprae
gcaauccguggagagcaugga

SEQ ID NO: 3220596 - RNA, 16 nt, Mycobacterium leprae
gcacaacaagagaaga

SEQ ID NO: 3220597 - RNA, 18 nt, Mycobacterium leprae
gcacaaguaccggcucac

SEQ ID NO: 3220598 - RNA, 16 nt, Mycobacterium leprae
gcacacaacgccgagg

SEQ ID NO: 3220599 - RNA, 19 nt, Mycobacterium leprae
gcacaccguguccgaacgg

SEQ ID NO: 3220600 - RNA, 17 nt, Mycobacterium leprae
gcacagagcccagcacg

SEQ ID NO: 3220601 - RNA, 19 nt, Mycobacterium leprae
gcacagccagcaaggcaac

SEQ ID NO: 3220602 - RNA, 17 nt, Mycobacterium leprae
gcacagguguugggcca

SEQ ID NO: 3220603 - RNA, 19 nt, Mycobacterium leprae
gcacaucaguaucagugcc

SEQ ID NO: 3220604 - RNA, 20 nt, Mycobacterium leprae
gcacaucgaaccgacgaugc

SEQ ID NO: 3220605 - RNA, 16 nt, Mycobacterium leprae
gcacauucaaccagcc

SEQ ID NO: 3220606 - RNA, 20 nt, Mycobacterium leprae
gcacauugggaucccaccgg

SEQ ID NO: 3220607 - RNA, 20 nt, Mycobacterium leprae
gcaccaagucuucgaugcuc

SEQ ID NO: 3220608 - RNA, 18 nt, Mycobacterium leprae
gcaccacgcacacgacag

SEQ ID NO: 3220609 - RNA, 19 nt, Mycobacterium leprae
gcaccagcucacccgcagc

SEQ ID NO: 3220610 - RNA, 23 nt, Mycobacterium leprae
gcaccagcucacccgcagcaccu

SEQ ID NO: 3220611 - RNA, 14 nt, Mycobacterium leprae
gcaccaggucgucg

SEQ ID NO: 3220612 - RNA, 17 nt, Mycobacterium leprae
gcaccagugugccagcg

SEQ ID NO: 3220613 - RNA, 19 nt, Mycobacterium leprae
gcaccagugugccagcgcu

SEQ ID NO: 3220614 - RNA, 22 nt, Mycobacterium leprae
gcaccaucucgaccgcgcgcuc

SEQ ID NO: 3220615 - RNA, 16 nt, Mycobacterium leprae
gcaccauucuggucga

SEQ ID NO: 3220616 - RNA, 17 nt, Mycobacterium leprae
gcaccauuucugccgcu

SEQ ID NO: 3220617 - RNA, 16 nt, Mycobacterium leprae
gcacccacucggcggu

SEQ ID NO: 3220618 - RNA, 17 nt, Mycobacterium leprae
gcacccauccgaucaau

SEQ ID NO: 3220619 - RNA, 14 nt, Mycobacterium leprae
gcacccgagcggca

SEQ ID NO: 3220620 - RNA, 21 nt, Mycobacterium leprae
gcacccggccacaacgcggcc

SEQ ID NO: 3220621 - RNA, 23 nt, Mycobacterium leprae
gcacccggccacaacgcggccuu

SEQ ID NO: 3220622 - RNA, 18 nt, Mycobacterium leprae
gcacccugcacacugacu

SEQ ID NO: 3220623 - RNA, 22 nt, Mycobacterium leprae
gcaccgaauauuuucaagacug

SEQ ID NO: 3220624 - RNA, 15 nt, Mycobacterium leprae
gcaccgaucgcccgc

SEQ ID NO: 3220625 - RNA, 18 nt, Mycobacterium leprae
gcaccgcgccggucgugc

SEQ ID NO: 3220626 - RNA, 21 nt, Mycobacterium leprae
gcaccgcguaacagauuauug

SEQ ID NO: 3220627 - RNA, 18 nt, Mycobacterium leprae
gcaccggcauggccgcug

SEQ ID NO: 3220628 - RNA, 21 nt, Mycobacterium leprae
gcaccggcguuccggccucgg

SEQ ID NO: 3220629 - RNA, 15 nt, Mycobacterium leprae
gcaccggcugcaccc

SEQ ID NO: 3220630 - RNA, 22 nt, Mycobacterium leprae
gcaccggcugcacccgucgcug

SEQ ID NO: 3220631 - RNA, 14 nt, Mycobacterium leprae
gcaccggcuugaua

SEQ ID NO: 3220632 - RNA, 15 nt, Mycobacterium leprae
gcaccgugucgucuu

SEQ ID NO: 3220633 - RNA, 22 nt, Mycobacterium leprae
gcaccuaaggccgucgcgggcc

SEQ ID NO: 3220634 - RNA, 16 nt, Mycobacterium leprae
gcaccuacaugucggu

SEQ ID NO: 3220635 - RNA, 21 nt, Mycobacterium leprae
gcaccugaucggucagcucga

SEQ ID NO: 3220636 - RNA, 14 nt, Mycobacterium leprae
gcaccugccacggc

SEQ ID NO: 3220637 - RNA, 14 nt, Mycobacterium leprae
gcaccugccgcagc

SEQ ID NO: 3220638 - RNA, 16 nt, Mycobacterium leprae
gcaccugggcugugcu

SEQ ID NO: 3220639 - RNA, 19 nt, Mycobacterium leprae
gcaccuguugcucaacggg

SEQ ID NO: 3220640 - RNA, 22 nt, Mycobacterium leprae
gcaccuuacgauuacgcacgcc

SEQ ID NO: 3220641 - RNA, 24 nt, Mycobacterium leprae
gcaccuuacgauuacgcacgccuu

SEQ ID NO: 3220642 - RNA, 23 nt, Mycobacterium leprae
gcacgaaauggcgccaccguggu

SEQ ID NO: 3220643 - RNA, 23 nt, Mycobacterium leprae
gcacgaguuggauugaucguccg

SEQ ID NO: 3220644 - RNA, 17 nt, Mycobacterium leprae
gcacgcaaucggcuggu

SEQ ID NO: 3220645 - RNA, 14 nt, Mycobacterium leprae
gcacggagcggccg

SEQ ID NO: 3220646 - RNA, 17 nt, Mycobacterium leprae
gcacggagcggccgcga

SEQ ID NO: 3220647 - RNA, 13 nt, Mycobacterium leprae
gcacggaucgacc

SEQ ID NO: 3220648 - RNA, 13 nt, Mycobacterium leprae
gcacggauucggu

SEQ ID NO: 3220649 - RNA, 23 nt, Mycobacterium leprae
gcacggcgcucaccgacggaugc

SEQ ID NO: 3220650 - RNA, 14 nt, Mycobacterium leprae
gcacggcgugcagg

SEQ ID NO: 3220651 - RNA, 14 nt, Mycobacterium leprae
gcacggggucagcg

SEQ ID NO: 3220652 - RNA, 19 nt, Mycobacterium leprae
gcacguaagcaugucggug

SEQ ID NO: 3220653 - RNA, 23 nt, Mycobacterium leprae
gcacguaagcaugucgguggugg

SEQ ID NO: 3220654 - RNA, 15 nt, Mycobacterium leprae
gcacguccccgugca

SEQ ID NO: 3220655 - RNA, 16 nt, Mycobacterium leprae
gcacguccccgugcac

SEQ ID NO: 3220656 - RNA, 14 nt, Mycobacterium leprae
gcacgugcggcggc

SEQ ID NO: 3220657 - RNA, 20 nt, Mycobacterium leprae
gcacgugggucauugccgau

SEQ ID NO: 3220658 - RNA, 19 nt, Mycobacterium leprae
gcacguguguguaucacga

SEQ ID NO: 3220659 - RNA, 19 nt, Mycobacterium leprae
gcacuaaagucuucaaucc

SEQ ID NO: 3220660 - RNA, 17 nt, Mycobacterium leprae
gcacuacccgacacaaa

SEQ ID NO: 3220661 - RNA, 20 nt, Mycobacterium leprae
gcacuauggcccgucgcugc

SEQ ID NO: 3220662 - RNA, 17 nt, Mycobacterium leprae
gcacucacccgcgaggc

SEQ ID NO: 3220663 - RNA, 17 nt, Mycobacterium leprae
gcacuccuacgguguau

SEQ ID NO: 3220664 - RNA, 20 nt, Mycobacterium leprae
gcacuccuucaugcuggccu

SEQ ID NO: 3220665 - RNA, 17 nt, Mycobacterium leprae
gcacugagaguacugac

SEQ ID NO: 3220666 - RNA, 21 nt, Mycobacterium leprae
gcacugagaguacugaccgac

SEQ ID NO: 3220667 - RNA, 22 nt, Mycobacterium leprae
gcacugccgaucucguguuaca

SEQ ID NO: 3220668 - RNA, 17 nt, Mycobacterium leprae
gcacugcuucggccagc

SEQ ID NO: 3220669 - RNA, 20 nt, Mycobacterium leprae
gcacugcuucggccagcgca

SEQ ID NO: 3220670 - RNA, 14 nt, Mycobacterium leprae
gcacuggaacguuu

SEQ ID NO: 3220671 - RNA, 17 nt, Mycobacterium leprae
gcacuguucacuaacac

SEQ ID NO: 3220672 - RNA, 20 nt, Mycobacterium leprae
gcacuguucacuaacacgau

SEQ ID NO: 3220673 - RNA, 15 nt, Mycobacterium leprae
gcacuguucauugau

SEQ ID NO: 3220674 - RNA, 19 nt, Mycobacterium leprae
gcacuguucauugaugaau

SEQ ID NO: 3220675 - RNA, 18 nt, Mycobacterium leprae
gcacuuacgcgauucaug

SEQ ID NO: 3220676 - RNA, 19 nt, Mycobacterium leprae
gcacuuacgcgauucauga

SEQ ID NO: 3220677 - RNA, 17 nt, Mycobacterium leprae
gcacuucgguaacgcug

SEQ ID NO: 3220678 - RNA, 20 nt, Mycobacterium leprae
gcagaaauucagcgccagga

SEQ ID NO: 3220679 - RNA, 13 nt, Mycobacterium leprae
gcagaagccggcu

SEQ ID NO: 3220680 - RNA, 23 nt, Mycobacterium leprae
gcagaauauugcgacauccaaag

SEQ ID NO: 3220681 - RNA, 14 nt, Mycobacterium leprae
gcauccgacaaagc

SEQ ID NO: 3220682 - RNA, 15 nt, Mycobacterium leprae
gcauccgccacaugu

SEQ ID NO: 3220683 - RNA, 18 nt, Mycobacterium leprae
gcaucgaagcaaccagcc

SEQ ID NO: 3220684 - RNA, 13 nt, Mycobacterium leprae
gcaucgacgaggu

SEQ ID NO: 3220685 - RNA, 16 nt, Mycobacterium leprae
gcaucgaugauccggc

SEQ ID NO: 3220686 - RNA, 17 nt, Mycobacterium leprae
gcaucgaugauccggcc

SEQ ID NO: 3220687 - RNA, 18 nt, Mycobacterium leprae
gcaucgcgcaggccuggu

SEQ ID NO: 3220688 - RNA, 15 nt, Mycobacterium leprae
gcaucggcaggcugu

SEQ ID NO: 3220689 - RNA, 15 nt, Mycobacterium leprae
gcaucggccucaccu

SEQ ID NO: 3220690 - RNA, 13 nt, Mycobacterium leprae
gcaucgguggcac

SEQ ID NO: 3220691 - RNA, 19 nt, Mycobacterium leprae
gcaucgucuggacucgguc

SEQ ID NO: 3220692 - RNA, 16 nt, Mycobacterium leprae
gcaucugccauaucaa

SEQ ID NO: 3220693 - RNA, 17 nt, Mycobacterium leprae
gcaucugcuacgcuggc

SEQ ID NO: 3220694 - RNA, 16 nt, Mycobacterium leprae
gcaucuucgcccagca

SEQ ID NO: 3220695 - RNA, 14 nt, Mycobacterium leprae
gcaugagcugcugg

SEQ ID NO: 3220696 - RNA, 15 nt, Mycobacterium leprae
gcaugagcugcuggg

SEQ ID NO: 3220697 - RNA, 17 nt, Mycobacterium leprae
gcaugccaaccugugca

SEQ ID NO: 3220698 - RNA, 13 nt, Mycobacterium leprae
gcaugccgccggg

SEQ ID NO: 3220699 - RNA, 16 nt, Mycobacterium leprae
gcaugccgccgggugc

SEQ ID NO: 3220700 - RNA, 17 nt, Mycobacterium leprae
gcaugccgccgggugca

SEQ ID NO: 3220701 - RNA, 17 nt, Mycobacterium leprae
gcaugcgcugaggcagc

SEQ ID NO: 3220702 - RNA, 15 nt, Mycobacterium leprae
gcaugcuaacaucau

SEQ ID NO: 3220703 - RNA, 18 nt, Mycobacterium leprae
gcauggacccacugggca

SEQ ID NO: 3220704 - RNA, 22 nt, Mycobacterium leprae
gcauggacccacugggcaagca

SEQ ID NO: 3220705 - RNA, 17 nt, Mycobacterium leprae
gcauggccgcuggggca

SEQ ID NO: 3220706 - RNA, 18 nt, Mycobacterium leprae
gcauggcgaugcgcagcc

SEQ ID NO: 3220707 - RNA, 24 nt, Mycobacterium leprae
gcaugggccgguguacacgugcug

SEQ ID NO: 3220708 - RNA, 15 nt, Mycobacterium leprae
gcaugguggccacga

SEQ ID NO: 3220709 - RNA, 13 nt, Mycobacterium leprae
gcaugucgguggu

SEQ ID NO: 3220710 - RNA, 19 nt, Mycobacterium leprae
gcaugucgguggugggugc

SEQ ID NO: 3220711 - RNA, 16 nt, Mycobacterium leprae
gcaugugugaacgaca

SEQ ID NO: 3220712 - RNA, 16 nt, Mycobacterium leprae
gcauguuaaaauaaac

SEQ ID NO: 3220713 - RNA, 15 nt, Mycobacterium leprae
gcauuauccgggcug

SEQ ID NO: 3220714 - RNA, 12 nt, Mycobacterium leprae
gcauucccaacc

SEQ ID NO: 3220715 - RNA, 17 nt, Mycobacterium leprae
gcauucgcaaagcggca

SEQ ID NO: 3220716 - RNA, 18 nt, Mycobacterium leprae
gcauugaucuuggugaug

SEQ ID NO: 3220717 - RNA, 19 nt, Mycobacterium leprae
gcauugccggggcugcgcu

SEQ ID NO: 3220718 - RNA, 20 nt, Mycobacterium leprae
gcauugccggggcugcgcug

SEQ ID NO: 3220719 - RNA, 24 nt, Mycobacterium leprae
gcauugcuggugccccagucgcca

SEQ ID NO: 3220720 - RNA, 13 nt, Mycobacterium leprae
gcauuguccagcg

SEQ ID NO: 3220721 - RNA, 22 nt, Mycobacterium leprae
gcauuuaccgagaucgacgcug

SEQ ID NO: 3220722 - RNA, 21 nt, Mycobacterium leprae
gccaaacacggccagcgcggc

SEQ ID NO: 3220723 - RNA, 18 nt, Mycobacterium leprae
gccaaacagauccugcuc

SEQ ID NO: 3220724 - RNA, 18 nt, Mycobacterium leprae
gccaaaguccaugugcug

SEQ ID NO: 3220725 - RNA, 23 nt, Mycobacterium leprae
gccaacccuacgggaacacgucg

SEQ ID NO: 3220726 - RNA, 15 nt, Mycobacterium leprae
gccaaccugugcaug

SEQ ID NO: 3220727 - RNA, 21 nt, Mycobacterium leprae
gccaacgauacugaugggcag

SEQ ID NO: 3220728 - RNA, 17 nt, Mycobacterium leprae
gccaacgcgcaccuggu

SEQ ID NO: 3220729 - RNA, 22 nt, Mycobacterium leprae
gccaacgcgcaccugguggugc

SEQ ID NO: 3220730 - RNA, 18 nt, Mycobacterium leprae
gccaacgggaacagcggc

SEQ ID NO: 3220731 - RNA, 14 nt, Mycobacterium leprae
gccaacucggccgc

SEQ ID NO: 3220732 - RNA, 15 nt, Mycobacterium leprae
gccaagaccuaccug

SEQ ID NO: 3220733 - RNA, 20 nt, Mycobacterium leprae
gccaaggucguuagcgccga

SEQ ID NO: 3220734 - RNA, 18 nt, Mycobacterium leprae
gccaaguaccggaaucga

SEQ ID NO: 3220735 - RNA, 16 nt, Mycobacterium leprae
gccaauccagccgagg

SEQ ID NO: 3220736 - RNA, 23 nt, Mycobacterium leprae
gccaaucguguaucgucgcaacg

SEQ ID NO: 3220737 - RNA, 17 nt, Mycobacterium leprae
gccaaugcugcagcugg

SEQ ID NO: 3220738 - RNA, 16 nt, Mycobacterium leprae
gccaauucgccgacca

SEQ ID NO: 3220739 - RNA, 15 nt, Mycobacterium leprae
gccacaacgcggccu

SEQ ID NO: 3220740 - RNA, 20 nt, Mycobacterium leprae
gccacaacguagggaugauc

SEQ ID NO: 3220741 - RNA, 19 nt, Mycobacterium leprae
gccacacgcgacgccgcca

SEQ ID NO: 3220742 - RNA, 20 nt, Mycobacterium leprae
gccacaggcgauucauggcu

SEQ ID NO: 3220743 - RNA, 23 nt, Mycobacterium leprae
gccacaggcgauucauggcuugc

SEQ ID NO: 3220744 - RNA, 14 nt, Mycobacterium leprae
gccacauccucggu

SEQ ID NO: 3220745 - RNA, 20 nt, Mycobacterium leprae
gccacauccucgguaucguc

SEQ ID NO: 3220746 - RNA, 21 nt, Mycobacterium leprae
gccaccacaaauacuucacca

SEQ ID NO: 3220747 - RNA, 15 nt, Mycobacterium leprae
gccaccaccaccccu

SEQ ID NO: 3220748 - RNA, 23 nt, Mycobacterium leprae
gccaccacucucaucgcggcugc

SEQ ID NO: 3220749 - RNA, 23 nt, Mycobacterium leprae
gccaccagggaagaucucagcca

SEQ ID NO: 3220750 - RNA, 22 nt, Mycobacterium leprae
gccacccgccagaucacauugg

SEQ ID NO: 3220751 - RNA, 16 nt, Mycobacterium leprae
gccaccgacaaagcuc

SEQ ID NO: 3220752 - RNA, 21 nt, Mycobacterium leprae
gccaccgacaaagcucaggcc

SEQ ID NO: 3220753 - RNA, 21 nt, Mycobacterium leprae
gccaccgccggucaucgcuuc

SEQ ID NO: 3220754 - RNA, 20 nt, Mycobacterium leprae
gccaccgcgaacgccucggc

SEQ ID NO: 3220755 - RNA, 13 nt, Mycobacterium leprae
gccaccggcgcuu

SEQ ID NO: 3220756 - RNA, 23 nt, Mycobacterium leprae
gccaccgguagcggucuggcgcu

SEQ ID NO: 3220757 - RNA, 23 nt, Mycobacterium leprae
gccaccggugauguggccgugga

SEQ ID NO: 3220758 - RNA, 14 nt, Mycobacterium leprae
gccaccugcaugga

SEQ ID NO: 3220759 - RNA, 15 nt, Mycobacterium leprae
gccacgaccaaaccu

SEQ ID NO: 3220760 - RNA, 16 nt, Mycobacterium leprae
gccacgagacccagcc

SEQ ID NO: 3220761 - RNA, 22 nt, Mycobacterium leprae
gccacgcuggcacuccgaccga

SEQ ID NO: 3220762 - RNA, 15 nt, Mycobacterium leprae
gccacggaugugguc

SEQ ID NO: 3220763 - RNA, 14 nt, Mycobacterium leprae
gccacggccccgga

SEQ ID NO: 3220764 - RNA, 17 nt, Mycobacterium leprae
gccacggccccggaugc

SEQ ID NO: 3220765 - RNA, 19 nt, Mycobacterium leprae
gccacgucgccguuuccgc

SEQ ID NO: 3220766 - RNA, 13 nt, Mycobacterium leprae
gccacgugcacau

SEQ ID NO: 3220767 - RNA, 13 nt, Mycobacterium leprae
gccacuaaacauu

SEQ ID NO: 3220768 - RNA, 19 nt, Mycobacterium leprae
gccacuccgguugcggcga

SEQ ID NO: 3220769 - RNA, 19 nt, Mycobacterium leprae
gccacucguagggaccgcu

SEQ ID NO: 3220770 - RNA, 23 nt, Mycobacterium leprae
gccacugagauuaucccgauagc

SEQ ID NO: 3220771 - RNA, 14 nt, Mycobacterium leprae
gccacugcacgacc

SEQ ID NO: 3220772 - RNA, 22 nt, Mycobacterium leprae
gccacugucgcgaccaacccgg

SEQ ID NO: 3220773 - RNA, 20 nt, Mycobacterium leprae
gccacugugucacgcgacca

SEQ ID NO: 3220774 - RNA, 14 nt, Mycobacterium leprae
gccacuucgcccga

SEQ ID NO: 3220775 - RNA, 21 nt, Mycobacterium leprae
gccagaccaacaugaacguca

SEQ ID NO: 3220776 - RNA, 17 nt, Mycobacterium leprae
gccagagcugcgacgga

SEQ ID NO: 3220777 - RNA, 17 nt, Mycobacterium leprae
gccagauccagcaucau

SEQ ID NO: 3220778 - RNA, 14 nt, Mycobacterium leprae
gccagcaaggcaac

SEQ ID NO: 3220779 - RNA, 19 nt, Mycobacterium leprae
gccagcaccaaccuguaga

SEQ ID NO: 3220780 - RNA, 19 nt, Mycobacterium leprae
gccagcagcgggaccaaga

SEQ ID NO: 3220781 - RNA, 20 nt, Mycobacterium leprae
gccagcaucaacgccagcaa

SEQ ID NO: 3220782 - RNA, 21 nt, Mycobacterium leprae
gccagcgacacagccggccgg

SEQ ID NO: 3220783 - RNA, 22 nt, Mycobacterium leprae
gccagcgacgguaagcucgccc

SEQ ID NO: 3220784 - RNA, 17 nt, Mycobacterium leprae
gccagcgaucuaccucg

SEQ ID NO: 3220785 - RNA, 20 nt, Mycobacterium leprae
gccagcgaucuaccucgcca

SEQ ID NO: 3220786 - RNA, 16 nt, Mycobacterium leprae
gccagcgcaucagcca

SEQ ID NO: 3220787 - RNA, 12 nt, Mycobacterium leprae
gccagcgcggca

SEQ ID NO: 3220788 - RNA, 14 nt, Mycobacterium leprae
gccagcgcucgcug

SEQ ID NO: 3220789 - RNA, 12 nt, Mycobacterium leprae
gccagcucagca

SEQ ID NO: 3220790 - RNA, 23 nt, Mycobacterium leprae
gccagcuucgcagacacagccgu

SEQ ID NO: 3220791 - RNA, 19 nt, Mycobacterium leprae
gccagcuuucgcacccagc

SEQ ID NO: 3220792 - RNA, 22 nt, Mycobacterium leprae
gccaggauagauaaugccaccg

SEQ ID NO: 3220793 - RNA, 13 nt, Mycobacterium leprae
gccgaccgcccgg

SEQ ID NO: 3220794 - RNA, 16 nt, Mycobacterium leprae
gccgaccucggcgcug

SEQ ID NO: 3220795 - RNA, 18 nt, Mycobacterium leprae
gccgaccucggcgcuggg

SEQ ID NO: 3220796 - RNA, 21 nt, Mycobacterium leprae
gccgacgcgguugccggcgga

SEQ ID NO: 3220797 - RNA, 14 nt, Mycobacterium leprae
gccgacgucuucaa

SEQ ID NO: 3220798 - RNA, 19 nt, Mycobacterium leprae
gccgagacuaccggagguu

SEQ ID NO: 3220799 - RNA, 16 nt, Mycobacterium leprae
gccgagacugaaugcg

SEQ ID NO: 3220800 - RNA, 12 nt, Mycobacterium leprae
gccgagcaugac

SEQ ID NO: 3220801 - RNA, 14 nt, Mycobacterium leprae
gccgagcgcaucgg

SEQ ID NO: 3220802 - RNA, 20 nt, Mycobacterium leprae
gccgagcgucgaauaaacuu

SEQ ID NO: 3220803 - RNA, 14 nt, Mycobacterium leprae
gccgaggaagcucg

SEQ ID NO: 3220804 - RNA, 17 nt, Mycobacterium leprae
gccgaggaugccguaga

SEQ ID NO: 3220805 - RNA, 15 nt, Mycobacterium leprae
gccgaggcacaacau

SEQ ID NO: 3220806 - RNA, 18 nt, Mycobacterium leprae
gccgagguggcagcuggg

SEQ ID NO: 3220807 - RNA, 15 nt, Mycobacterium leprae
gccgaguccgcuaag

SEQ ID NO: 3220808 - RNA, 21 nt, Mycobacterium leprae
gccgaucauggagguucuggg

SEQ ID NO: 3220809 - RNA, 15 nt, Mycobacterium leprae
gccgaucccaucggc

SEQ ID NO: 3220810 - RNA, 19 nt, Mycobacterium leprae
gccgaucccaucggcugca

SEQ ID NO: 3220811 - RNA, 20 nt, Mycobacterium leprae
gccgaucccaucggcugcac

SEQ ID NO: 3220812 - RNA, 18 nt, Mycobacterium leprae
gccgaucccggcgcuguc

SEQ ID NO: 3220813 - RNA, 12 nt, Mycobacterium leprae
gccgaucgguau

SEQ ID NO: 3220814 - RNA, 17 nt, Mycobacterium leprae
gccgaucgugugcacug

SEQ ID NO: 3220815 - RNA, 21 nt, Mycobacterium leprae
gccgaucuccgacuggcugcc

SEQ ID NO: 3220816 - RNA, 17 nt, Mycobacterium leprae
gccgaucucggcgcgcu

SEQ ID NO: 3220817 - RNA, 17 nt, Mycobacterium leprae
gccgauuagacacacuu

SEQ ID NO: 3220818 - RNA, 21 nt, Mycobacterium leprae
gccgauuccggagacggcagc

SEQ ID NO: 3220819 - RNA, 21 nt, Mycobacterium leprae
gccgcacgggauggccaagcc

SEQ ID NO: 3220820 - RNA, 15 nt, Mycobacterium leprae
gccgcagcaucuguc

SEQ ID NO: 3220821 - RNA, 16 nt, Mycobacterium leprae
gccgcagcaucugucg

SEQ ID NO: 3220822 - RNA, 14 nt, Mycobacterium leprae
gccgccaaguaccg

SEQ ID NO: 3220823 - RNA, 17 nt, Mycobacterium leprae
gccgccagguuccccgg

SEQ ID NO: 3220824 - RNA, 16 nt, Mycobacterium leprae
gccgccgaacaagcca

SEQ ID NO: 3220825 - RNA, 16 nt, Mycobacterium leprae
gccgccgaagccgcgc

SEQ ID NO: 3220826 - RNA, 17 nt, Mycobacterium leprae
gccgccgaagccgcgca

SEQ ID NO: 3220827 - RNA, 22 nt, Mycobacterium leprae
gccgccgacaccgauaccagcg

SEQ ID NO: 3220828 - RNA, 20 nt, Mycobacterium leprae
gccgccggcggcacagaccg

SEQ ID NO: 3220829 - RNA, 13 nt, Mycobacterium leprae
gccgccguccacu

SEQ ID NO: 3220830 - RNA, 19 nt, Mycobacterium leprae
gccgccuuuacgaagccgc

SEQ ID NO: 3220831 - RNA, 17 nt, Mycobacterium leprae
gccgcgagcacugacau

SEQ ID NO: 3220832 - RNA, 23 nt, Mycobacterium leprae
gccgcgaguuggccgagcgucga

SEQ ID NO: 3220833 - RNA, 15 nt, Mycobacterium leprae
gccgcgcgccugcgc

SEQ ID NO: 3220834 - RNA, 16 nt, Mycobacterium leprae
gccgcgcuacggcggu

SEQ ID NO: 3220835 - RNA, 13 nt, Mycobacterium leprae
gccgcggcugccg

SEQ ID NO: 3220836 - RNA, 15 nt, Mycobacterium leprae
gccgcggcugggcag

SEQ ID NO: 3220837 - RNA, 15 nt, Mycobacterium leprae
gccgcgggugcaguu

SEQ ID NO: 3220838 - RNA, 16 nt, Mycobacterium leprae
gccgcgguuuccgcgg

SEQ ID NO: 3220839 - RNA, 20 nt, Mycobacterium leprae
gccgcuaaacggaauacagc

SEQ ID NO: 3220840 - RNA, 17 nt, Mycobacterium leprae
gccgcuacucgucaaga

SEQ ID NO: 3220841 - RNA, 22 nt, Mycobacterium leprae
gccgcucgaccaugugaccgcg

SEQ ID NO: 3220842 - RNA, 17 nt, Mycobacterium leprae
gccgcucuagaaauuag

SEQ ID NO: 3220843 - RNA, 15 nt, Mycobacterium leprae
gccgcugcauccgca

SEQ ID NO: 3220844 - RNA, 18 nt, Mycobacterium leprae
gccgcugcauccgcagca

SEQ ID NO: 3220845 - RNA, 15 nt, Mycobacterium leprae
gccgcuggucaagcu

SEQ ID NO: 3220846 - RNA, 13 nt, Mycobacterium leprae
gccggaacagcau

SEQ ID NO: 3220847 - RNA, 16 nt, Mycobacterium leprae
gccggaacagcauccu

SEQ ID NO: 3220848 - RNA, 15 nt, Mycobacterium leprae
gccggacggcaccua

SEQ ID NO: 3220849 - RNA, 13 nt, Mycobacterium leprae
gccggauguguug

SEQ ID NO: 3220850 - RNA, 16 nt, Mycobacterium leprae
gccggcaaccagcccc

SEQ ID NO: 3220851 - RNA, 17 nt, Mycobacterium leprae
gccggcacaucgucggc

SEQ ID NO: 3220852 - RNA, 16 nt, Mycobacterium leprae
gccggcauagaauccg

SEQ ID NO: 3220853 - RNA, 21 nt, Mycobacterium leprae
gccggccaauugaauccgcug

SEQ ID NO: 3220854 - RNA, 16 nt, Mycobacterium leprae
gccggccccugagcaa

SEQ ID NO: 3220855 - RNA, 14 nt, Mycobacterium leprae
gccggccgcggaca

SEQ ID NO: 3220856 - RNA, 15 nt, Mycobacterium leprae
gccggccggcaagcu

SEQ ID NO: 3220857 - RNA, 21 nt, Mycobacterium leprae
gccggccgguccauucgccgu

SEQ ID NO: 3220858 - RNA, 16 nt, Mycobacterium leprae
gccggccuggcuggug

SEQ ID NO: 3220859 - RNA, 16 nt, Mycobacterium leprae
gccggcgcgcaggcug

SEQ ID NO: 3220860 - RNA, 18 nt, Mycobacterium leprae
gccggcgcgcaggcugcg

SEQ ID NO: 3220861 - RNA, 18 nt, Mycobacterium leprae
gccggcggccaccgcgaa

SEQ ID NO: 3220862 - RNA, 22 nt, Mycobacterium leprae
gccggcgucaaagucgcgggcu

SEQ ID NO: 3220863 - RNA, 17 nt, Mycobacterium leprae
gccggcgucaggccagg

SEQ ID NO: 3220864 - RNA, 18 nt, Mycobacterium leprae
gccggcgucaggccaggc

SEQ ID NO: 3220865 - RNA, 20 nt, Mycobacterium leprae
gccggcgucaggccaggcag

SEQ ID NO: 3220866 - RNA, 15 nt, Mycobacterium leprae
gccggcgucgcguca

SEQ ID NO: 3220867 - RNA, 16 nt, Mycobacterium leprae
gccggcuacuggacgu

SEQ ID NO: 3220868 - RNA, 18 nt, Mycobacterium leprae
gccggcuguuucuugggu

SEQ ID NO: 3220869 - RNA, 13 nt, Mycobacterium leprae
gccggcuuggggu

SEQ ID NO: 3220870 - RNA, 20 nt, Mycobacterium leprae
gccgggaccuuucccgcaga

SEQ ID NO: 3220871 - RNA, 20 nt, Mycobacterium leprae
gccgggcaaaccacuuagcg

SEQ ID NO: 3220872 - RNA, 17 nt, Mycobacterium leprae
gccgggcacuuggguca

SEQ ID NO: 3220873 - RNA, 16 nt, Mycobacterium leprae
gccggggccaagcugu

SEQ ID NO: 3220874 - RNA, 14 nt, Mycobacterium leprae
gccggggcucgcgu

SEQ ID NO: 3220875 - RNA, 20 nt, Mycobacterium leprae
gccgggguauaguacagacc

SEQ ID NO: 3220876 - RNA, 22 nt, Mycobacterium leprae
gccgggguauaguacagaccga

SEQ ID NO: 3220877 - RNA, 16 nt, Mycobacterium leprae
gccgggucuuccuacg

SEQ ID NO: 3220878 - RNA, 20 nt, Mycobacterium leprae
gccgggugcgcugcugacgu

SEQ ID NO: 3220879 - RNA, 16 nt, Mycobacterium leprae
gccgguagccuggaag

SEQ ID NO: 3220880 - RNA, 20 nt, Mycobacterium leprae
gccggucaacaagccgccga

SEQ ID NO: 3220881 - RNA, 13 nt, Mycobacterium leprae
gccggucgaucgc

SEQ ID NO: 3220882 - RNA, 14 nt, Mycobacterium leprae
gccggugaugacga

SEQ ID NO: 3220883 - RNA, 15 nt, Mycobacterium leprae
gccgguggcaaccga

SEQ ID NO: 3220884 - RNA, 20 nt, Mycobacterium leprae
gccgguggcaaccgacacac

SEQ ID NO: 3220885 - RNA, 13 nt, Mycobacterium leprae
gccgguggccagc

SEQ ID NO: 3220886 - RNA, 14 nt, Mycobacterium leprae
gccgguggccagcg

SEQ ID NO: 3220887 - RNA, 16 nt, Mycobacterium leprae
gccguagcgcaccaau

SEQ ID NO: 3220888 - RNA, 15 nt, Mycobacterium leprae
gccguaguacccggc

SEQ ID NO: 3220889 - RNA, 17 nt, Mycobacterium leprae
gccguaugugccgccga

SEQ ID NO: 3220890 - RNA, 18 nt, Mycobacterium leprae
gccguaugugccgccgac

SEQ ID NO: 3220891 - RNA, 19 nt, Mycobacterium leprae
gccguaugugccgccgacg

SEQ ID NO: 3220892 - RNA, 14 nt, Mycobacterium leprae
gccgucagggcagc

SEQ ID NO: 3220893 - RNA, 14 nt, Mycobacterium leprae
gccguccacuggcu

SEQ ID NO: 3220894 - RNA, 22 nt, Mycobacterium leprae
gccgucgauuuugcaggccagu

SEQ ID NO: 3220895 - RNA, 13 nt, Mycobacterium leprae
gccgucgcgggug

SEQ ID NO: 3220896 - RNA, 20 nt, Mycobacterium leprae
gccgucgggaccgggcgcgc

SEQ ID NO: 3220897 - RNA, 17 nt, Mycobacterium leprae
gccgugaauccgcugca

SEQ ID NO: 3220898 - RNA, 11 nt, Mycobacterium leprae
gccgugcccaa

SEQ ID NO: 3220899 - RNA, 17 nt, Mycobacterium leprae
gccgugcccgcagagga

SEQ ID NO: 3220900 - RNA, 20 nt, Mycobacterium leprae
gccgugcuuccauucgcgau

SEQ ID NO: 3220901 - RNA, 23 nt, Mycobacterium leprae
gccgugggucuggaagcgcugau

SEQ ID NO: 3220902 - RNA, 19 nt, Mycobacterium leprae
gccguuauggcgcugaggu

SEQ ID NO: 3220903 - RNA, 18 nt, Mycobacterium leprae
gccguucaucgucgggug

SEQ ID NO: 3220904 - RNA, 14 nt, Mycobacterium leprae
gccguugaccuggg

SEQ ID NO: 3220905 - RNA, 15 nt, Mycobacterium leprae
gccguugggcugccc

SEQ ID NO: 3220906 - RNA, 18 nt, Mycobacterium leprae
gccguugggcugcccucc

SEQ ID NO: 3220907 - RNA, 22 nt, Mycobacterium leprae
gcgauaccggcgaaucggucug

SEQ ID NO: 3220908 - RNA, 16 nt, Mycobacterium leprae
gcgauagcuugcaguu

SEQ ID NO: 3220909 - RNA, 14 nt, Mycobacterium leprae
gcgauauccgccgg

SEQ ID NO: 3220910 - RNA, 17 nt, Mycobacterium leprae
gcgauauccgccggccg

SEQ ID NO: 3220911 - RNA, 21 nt, Mycobacterium leprae
gcgauauccgccggccgcacc

SEQ ID NO: 3220912 - RNA, 15 nt, Mycobacterium leprae
gcgaucaaacucgcu

SEQ ID NO: 3220913 - RNA, 15 nt, Mycobacterium leprae
gcgaucagaucgcgu

SEQ ID NO: 3220914 - RNA, 12 nt, Mycobacterium leprae
gcgaucagcagg

SEQ ID NO: 3220915 - RNA, 19 nt, Mycobacterium leprae
gcgaucaggagguggucaa

SEQ ID NO: 3220916 - RNA, 20 nt, Mycobacterium leprae
gcgaucaugagcaacacgua

SEQ ID NO: 3220917 - RNA, 11 nt, Mycobacterium leprae
gcgauccauca

SEQ ID NO: 3220918 - RNA, 12 nt, Mycobacterium leprae
gcgauccggcac

SEQ ID NO: 3220919 - RNA, 18 nt, Mycobacterium leprae
gcgaucggcucgauggga

SEQ ID NO: 3220920 - RNA, 16 nt, Mycobacterium leprae
gcgauggcauugcugg

SEQ ID NO: 3220921 - RNA, 21 nt, Mycobacterium leprae
gcgauggggggcagcaguggg

SEQ ID NO: 3220922 - RNA, 16 nt, Mycobacterium leprae
gcgauucgggagagga

SEQ ID NO: 3220923 - RNA, 18 nt, Mycobacterium leprae
gcgauucuaggcggugac

SEQ ID NO: 3220924 - RNA, 13 nt, Mycobacterium leprae
gcgauugccacca

SEQ ID NO: 3220925 - RNA, 18 nt, Mycobacterium leprae
gcgauugggaucguacga

SEQ ID NO: 3220926 - RNA, 20 nt, Mycobacterium leprae
gcgcaagcgugcaggcugca

SEQ ID NO: 3220927 - RNA, 14 nt, Mycobacterium leprae
gcgcaagucuggag

SEQ ID NO: 3220928 - RNA, 17 nt, Mycobacterium leprae
gcgcaauuuggugauca

SEQ ID NO: 3220929 - RNA, 15 nt, Mycobacterium leprae
gcgcacagcucuccg

SEQ ID NO: 3220930 - RNA, 16 nt, Mycobacterium leprae
gcgcacagcuggcuug

SEQ ID NO: 3220931 - RNA, 15 nt, Mycobacterium leprae
gcgcacccauccgau

SEQ ID NO: 3220932 - RNA, 13 nt, Mycobacterium leprae
gcgcaccucgcug

SEQ ID NO: 3220933 - RNA, 17 nt, Mycobacterium leprae
gcgcacgcugauggcac

SEQ ID NO: 3220934 - RNA, 17 nt, Mycobacterium leprae
gcgcacggaacccucug

SEQ ID NO: 3220935 - RNA, 20 nt, Mycobacterium leprae
gcgcagaccucuuccgccgc

SEQ ID NO: 3220936 - RNA, 14 nt, Mycobacterium leprae
gcgcagacgucguc

SEQ ID NO: 3220937 - RNA, 15 nt, Mycobacterium leprae
gcgcagacuagucga

SEQ ID NO: 3220938 - RNA, 19 nt, Mycobacterium leprae
gcgcagcaagcggccgccc

SEQ ID NO: 3220939 - RNA, 22 nt, Mycobacterium leprae
gcgcagcaauugacgccgaccg

SEQ ID NO: 3220940 - RNA, 14 nt, Mycobacterium leprae
gcgcagcacaaaau

SEQ ID NO: 3220941 - RNA, 14 nt, Mycobacterium leprae
gcgcagccaccacu

SEQ ID NO: 3220942 - RNA, 19 nt, Mycobacterium leprae
gcgcagcucgccaaggucg

SEQ ID NO: 3220943 - RNA, 23 nt, Mycobacterium leprae
gcgcagugugcuuucggcucaag

SEQ ID NO: 3220944 - RNA, 15 nt, Mycobacterium leprae
gcgcaguugaccgga

SEQ ID NO: 3220945 - RNA, 20 nt, Mycobacterium leprae
gcgcauuggucggggugcug

SEQ ID NO: 3220946 - RNA, 18 nt, Mycobacterium leprae
gcgccaacuggaucggua

SEQ ID NO: 3220947 - RNA, 17 nt, Mycobacterium leprae
gcgccacuguagagcuu

SEQ ID NO: 3220948 - RNA, 19 nt, Mycobacterium leprae
gcgccacuguagagcuuca

SEQ ID NO: 3220949 - RNA, 22 nt, Mycobacterium leprae
gcgccagccuuucacgccaggc

SEQ ID NO: 3220950 - RNA, 17 nt, Mycobacterium leprae
gcgccaggggaaccauc

SEQ ID NO: 3220951 - RNA, 13 nt, Mycobacterium leprae
gcgccaguucggc

SEQ ID NO: 3220952 - RNA, 20 nt, Mycobacterium leprae
gcgcccaagugaugucuuug

SEQ ID NO: 3220953 - RNA, 23 nt, Mycobacterium leprae
gcgcccugacgguuucgggaaag

SEQ ID NO: 3220954 - RNA, 22 nt, Mycobacterium leprae
gcgccgaaaaccuacgcggucc

SEQ ID NO: 3220955 - RNA, 19 nt, Mycobacterium leprae
gcgccgaagccgggcgagc

SEQ ID NO: 3220956 - RNA, 15 nt, Mycobacterium leprae
gcgccgcccagcagu

SEQ ID NO: 3220957 - RNA, 15 nt, Mycobacterium leprae
gcgccgccugcugca

SEQ ID NO: 3220958 - RNA, 18 nt, Mycobacterium leprae
gcgccggcgucggccagu

SEQ ID NO: 3220959 - RNA, 23 nt, Mycobacterium leprae
gcgccggcuaucuugcggauuug

SEQ ID NO: 3220960 - RNA, 23 nt, Mycobacterium leprae
gcgccguggaggugcggcuggcu

SEQ ID NO: 3220961 - RNA, 13 nt, Mycobacterium leprae
gcgccucaccaaa

SEQ ID NO: 3220962 - RNA, 19 nt, Mycobacterium leprae
gcgccucgucggccagcac

SEQ ID NO: 3220963 - RNA, 20 nt, Mycobacterium leprae
gcgccucgucggccagcacu

SEQ ID NO: 3220964 - RNA, 19 nt, Mycobacterium leprae
gcgccugagcgggccagca

SEQ ID NO: 3220965 - RNA, 14 nt, Mycobacterium leprae
gcgccuguuuuugg

SEQ ID NO: 3220966 - RNA, 19 nt, Mycobacterium leprae
gcgccuugcaagccacauc

SEQ ID NO: 3220967 - RNA, 21 nt, Mycobacterium leprae
gcgcgacaguaucgaccagcc

SEQ ID NO: 3220968 - RNA, 23 nt, Mycobacterium leprae
gcgcgacaguaucgaccagccac

SEQ ID NO: 3220969 - RNA, 15 nt, Mycobacterium leprae
gcgcgacugcagugu

SEQ ID NO: 3220970 - RNA, 12 nt, Mycobacterium leprae
gcgcgagaugug

SEQ ID NO: 3220971 - RNA, 10 nt, Mycobacterium leprae
gcgcgcaccc

SEQ ID NO: 3220972 - RNA, 15 nt, Mycobacterium leprae
gcgcgccucgaugca

SEQ ID NO: 3220973 - RNA, 14 nt, Mycobacterium leprae
gcgcgccuggguga

SEQ ID NO: 3220974 - RNA, 24 nt, Mycobacterium leprae
gcgcgcucacagcaggcgaguggc

SEQ ID NO: 3220975 - RNA, 16 nt, Mycobacterium leprae
gcgcgcuccgccggcg

SEQ ID NO: 3220976 - RNA, 19 nt, Mycobacterium leprae
gcgcggcguaaacguugac

SEQ ID NO: 3220977 - RNA, 22 nt, Mycobacterium leprae
gcgcggggcgaugucgaccuga

SEQ ID NO: 3220978 - RNA, 17 nt, Mycobacterium leprae
gcgcgguacaaucaguc

SEQ ID NO: 3220979 - RNA, 16 nt, Mycobacterium leprae
gcgcgguaugcggccg

SEQ ID NO: 3220980 - RNA, 17 nt, Mycobacterium leprae
gcgcgguaugcggccgc

SEQ ID NO: 3220981 - RNA, 21 nt, Mycobacterium leprae
gcgcgguucuugccaaggucg

SEQ ID NO: 3220982 - RNA, 14 nt, Mycobacterium leprae
gcgcgugaucuccg

SEQ ID NO: 3220983 - RNA, 17 nt, Mycobacterium leprae
gcgcguuaggugccccg

SEQ ID NO: 3220984 - RNA, 17 nt, Mycobacterium leprae
gcgcuaaaucuggccaa

SEQ ID NO: 3220985 - RNA, 18 nt, Mycobacterium leprae
gcgcuaaaucuggccaac

SEQ ID NO: 3220986 - RNA, 12 nt, Mycobacterium leprae
gcgcuaggacaa

SEQ ID NO: 3220987 - RNA, 16 nt, Mycobacterium leprae
gcgcuauacuugcugc

SEQ ID NO: 3220988 - RNA, 15 nt, Mycobacterium leprae
gcgcuaugccaucca

SEQ ID NO: 3220989 - RNA, 21 nt, Mycobacterium leprae
gcgcuauucgggccaguuuca

SEQ ID NO: 3220990 - RNA, 21 nt, Mycobacterium leprae
gcgcugacaggcuuagcuucc

SEQ ID NO: 3220991 - RNA, 23 nt, Mycobacterium leprae
gcgcugaggaacgaauccucagc

SEQ ID NO: 3220992 - RNA, 17 nt, Mycobacterium leprae
gcgcugauaucggcgau

SEQ ID NO: 3220993 - RNA, 16 nt, Mycobacterium leprae
gcgcugaucgggcugc

SEQ ID NO: 3220994 - RNA, 17 nt, Mycobacterium leprae
gcgcugcugcggaucgg

SEQ ID NO: 3220995 - RNA, 20 nt, Mycobacterium leprae
gcgcugggacaugaagccgu

SEQ ID NO: 3220996 - RNA, 21 nt, Mycobacterium leprae
gcgcuggugcuuggcagcccu

SEQ ID NO: 3220997 - RNA, 17 nt, Mycobacterium leprae
gcgcugugauuggcugc

SEQ ID NO: 3220998 - RNA, 18 nt, Mycobacterium leprae
gcgcugugauuggcugcu

SEQ ID NO: 3220999 - RNA, 19 nt, Mycobacterium leprae
gcgcuguuguuggucggcg

SEQ ID NO: 3221000 - RNA, 20 nt, Mycobacterium leprae
gcggaaacguuuguggugcu

SEQ ID NO: 3221001 - RNA, 20 nt, Mycobacterium leprae
gcggaagcgcuaccguacuc

SEQ ID NO: 3221002 - RNA, 16 nt, Mycobacterium leprae
gcggaaguaacgucga

SEQ ID NO: 3221003 - RNA, 15 nt, Mycobacterium leprae
gcggaccauggcgcu

SEQ ID NO: 3221004 - RNA, 23 nt, Mycobacterium leprae
gcggaccgucgcgcgugccacca

SEQ ID NO: 3221005 - RNA, 13 nt, Mycobacterium leprae
gcggaccguggug

SEQ ID NO: 3221006 - RNA, 20 nt, Mycobacterium leprae
gcggaccuagucgaggcuca

SEQ ID NO: 3221007 - RNA, 19 nt, Mycobacterium leprae
gcggacucuccccacugca

SEQ ID NO: 3221008 - RNA, 19 nt, Mycobacterium leprae
gcggacugaaaacagcgcc

SEQ ID NO: 3221009 - RNA, 16 nt, Mycobacterium leprae
gcggacugauccccag

SEQ ID NO: 3221010 - RNA, 22 nt, Mycobacterium leprae
gcggagaaauuaucguugaccg

SEQ ID NO: 3221011 - RNA, 19 nt, Mycobacterium leprae
gcggagcgcggagcuggug

SEQ ID NO: 3221012 - RNA, 18 nt, Mycobacterium leprae
gcggagcuugagcagcac

SEQ ID NO: 3221013 - RNA, 16 nt, Mycobacterium leprae
gcggauccuguugacu

SEQ ID NO: 3221014 - RNA, 22 nt, Mycobacterium leprae
gcggaugaauaucaucgccaac

SEQ ID NO: 3221015 - RNA, 19 nt, Mycobacterium leprae
gcggaugguguaaggccag

SEQ ID NO: 3221016 - RNA, 15 nt, Mycobacterium leprae
gcggauuuaccccca

SEQ ID NO: 3221017 - RNA, 19 nt, Mycobacterium leprae
gcggauuuacccccagaac

SEQ ID NO: 3221018 - RNA, 19 nt, Mycobacterium leprae
gcggcaaguaggguggguu

SEQ ID NO: 3221019 - RNA, 20 nt, Mycobacterium leprae
gcggcacgauaggcagugcu

SEQ ID NO: 3221020 - RNA, 12 nt, Mycobacterium leprae
gcguccuccacc

SEQ ID NO: 3221021 - RNA, 19 nt, Mycobacterium leprae
gcgucggguuaugcaguga

SEQ ID NO: 3221022 - RNA, 23 nt, Mycobacterium leprae
gcgucggugacucugaccgacag

SEQ ID NO: 3221023 - RNA, 19 nt, Mycobacterium leprae
gcgucgucuuuuucgcgga

SEQ ID NO: 3221024 - RNA, 16 nt, Mycobacterium leprae
gcgucgugacggguca

SEQ ID NO: 3221025 - RNA, 17 nt, Mycobacterium leprae
gcgucucgcgcauacac

SEQ ID NO: 3221026 - RNA, 13 nt, Mycobacterium leprae
gcgugaagcaggu

SEQ ID NO: 3221027 - RNA, 15 nt, Mycobacterium leprae
gcgugagccuggcac

SEQ ID NO: 3221028 - RNA, 16 nt, Mycobacterium leprae
gcgugauagaagacag

SEQ ID NO: 3221029 - RNA, 23 nt, Mycobacterium leprae
gcgugauccacaauucuucgcuc

SEQ ID NO: 3221030 - RNA, 21 nt, Mycobacterium leprae
gcgugaucgacaucguguggu

SEQ ID NO: 3221031 - RNA, 22 nt, Mycobacterium leprae
gcgugaucgacaucguguggug

SEQ ID NO: 3221032 - RNA, 16 nt, Mycobacterium leprae
gcgugaucuccgcaug

SEQ ID NO: 3221033 - RNA, 15 nt, Mycobacterium leprae
gcgugcaaauggcac

SEQ ID NO: 3221034 - RNA, 16 nt, Mycobacterium leprae
gcgugccccggccgcc

SEQ ID NO: 3221035 - RNA, 20 nt, Mycobacterium leprae
gcgugccugguugggcaucg

SEQ ID NO: 3221036 - RNA, 22 nt, Mycobacterium leprae
gcgugcgauauauaccuacgau

SEQ ID NO: 3221037 - RNA, 23 nt, Mycobacterium leprae
gcgugcggauauugaucguugcu

SEQ ID NO: 3221038 - RNA, 17 nt, Mycobacterium leprae
gcgugcucuuccaccgu

SEQ ID NO: 3221039 - RNA, 19 nt, Mycobacterium leprae
gcgugcugucgugcccaga

SEQ ID NO: 3221040 - RNA, 23 nt, Mycobacterium leprae
gcguggauggcuuccacaucgau

SEQ ID NO: 3221041 - RNA, 18 nt, Mycobacterium leprae
gcguggccuccgagcgcc

SEQ ID NO: 3221042 - RNA, 19 nt, Mycobacterium leprae
gcguggccuccgagcgccc

SEQ ID NO: 3221043 - RNA, 16 nt, Mycobacterium leprae
gcguggcuaggccagu

SEQ ID NO: 3221044 - RNA, 15 nt, Mycobacterium leprae
gcguggucaaugugg

SEQ ID NO: 3221045 - RNA, 13 nt, Mycobacterium leprae
gcguggucgagga

SEQ ID NO: 3221046 - RNA, 13 nt, Mycobacterium leprae
gcgugugcaaccg

SEQ ID NO: 3221047 - RNA, 15 nt, Mycobacterium leprae
gcgugugcaaccgcg

SEQ ID NO: 3221048 - RNA, 13 nt, Mycobacterium leprae
gcgugugcacucc

SEQ ID NO: 3221049 - RNA, 22 nt, Mycobacterium leprae
gcguguggggguccgcgcacgg

SEQ ID NO: 3221050 - RNA, 22 nt, Mycobacterium leprae
gcguuaauaacccccaacuggu

SEQ ID NO: 3221051 - RNA, 16 nt, Mycobacterium leprae
gcguuaccggcgucug

SEQ ID NO: 3221052 - RNA, 24 nt, Mycobacterium leprae
gcguuaccggcgucuggcuggccu

SEQ ID NO: 3221053 - RNA, 17 nt, Mycobacterium leprae
gcguucagcgaagaguu

SEQ ID NO: 3221054 - RNA, 16 nt, Mycobacterium leprae
gcguucgauaagaagu

SEQ ID NO: 3221055 - RNA, 20 nt, Mycobacterium leprae
gcguugagcgcagccaccac

SEQ ID NO: 3221056 - RNA, 20 nt, Mycobacterium leprae
gcguugauggccgaggaguc

SEQ ID NO: 3221057 - RNA, 14 nt, Mycobacterium leprae
gcguugggaaagcu

SEQ ID NO: 3221058 - RNA, 20 nt, Mycobacterium leprae
gcguugucuugugguugauc

SEQ ID NO: 3221059 - RNA, 16 nt, Mycobacterium leprae
gcguuguugauggugu

SEQ ID NO: 3221060 - RNA, 15 nt, Mycobacterium leprae
gcguuuagucaccgc

SEQ ID NO: 3221061 - RNA, 19 nt, Mycobacterium leprae
gcguuuagucaccgccgaa

SEQ ID NO: 3221062 - RNA, 19 nt, Mycobacterium leprae
gcguuugaugucguggugc

SEQ ID NO: 3221063 - RNA, 12 nt, Mycobacterium leprae
gcuaaagugcug

SEQ ID NO: 3221064 - RNA, 13 nt, Mycobacterium leprae
gcuaaagugcugc

SEQ ID NO: 3221065 - RNA, 17 nt, Mycobacterium leprae
gcuaaauggacaaaugg

SEQ ID NO: 3221066 - RNA, 19 nt, Mycobacterium leprae
gcuaacaaggugaugccca

SEQ ID NO: 3221067 - RNA, 20 nt, Mycobacterium leprae
gcuaacaaggugaugcccau

SEQ ID NO: 3221068 - RNA, 12 nt, Mycobacterium leprae
gcuaaccgggcc

SEQ ID NO: 3221069 - RNA, 15 nt, Mycobacterium leprae
gcuaacuucccgacg

SEQ ID NO: 3221070 - RNA, 16 nt, Mycobacterium leprae
gcuaagacgcucaauc

SEQ ID NO: 3221071 - RNA, 13 nt, Mycobacterium leprae
gcuaaggcugcug

SEQ ID NO: 3221072 - RNA, 22 nt, Mycobacterium leprae
gcuaaggugcguugugcgguga

SEQ ID NO: 3221073 - RNA, 14 nt, Mycobacterium leprae
gcuaaguccggccu

SEQ ID NO: 3221074 - RNA, 18 nt, Mycobacterium leprae
gcuaaguccuccaguugu

SEQ ID NO: 3221075 - RNA, 14 nt, Mycobacterium leprae
gcuaaucccauggg

SEQ ID NO: 3221076 - RNA, 15 nt, Mycobacterium leprae
gcuaaucgcgggcaa

SEQ ID NO: 3221077 - RNA, 13 nt, Mycobacterium leprae
gcuacaucgacaa

SEQ ID NO: 3221078 - RNA, 23 nt, Mycobacterium leprae
gcuacauugcuccgcagcaccug

SEQ ID NO: 3221079 - RNA, 18 nt, Mycobacterium leprae
gcuaccaguguccgucga

SEQ ID NO: 3221080 - RNA, 14 nt, Mycobacterium leprae
gcuaccaugccacc

SEQ ID NO: 3221081 - RNA, 22 nt, Mycobacterium leprae
gcuaccguacucauagcggcga

SEQ ID NO: 3221082 - RNA, 18 nt, Mycobacterium leprae
gcuacgauuuugcaacgg

SEQ ID NO: 3221083 - RNA, 17 nt, Mycobacterium leprae
gcuacgccaggguaccc

SEQ ID NO: 3221084 - RNA, 20 nt, Mycobacterium leprae
gcuacucguuucucauucuc

SEQ ID NO: 3221085 - RNA, 17 nt, Mycobacterium leprae
gcuacugcgacagcagc

SEQ ID NO: 3221086 - RNA, 22 nt, Mycobacterium leprae
gcuacugcgaucgcaaauauaa

SEQ ID NO: 3221087 - RNA, 14 nt, Mycobacterium leprae
gcuagcgauucggg

SEQ ID NO: 3221088 - RNA, 12 nt, Mycobacterium leprae
gcuagcugucca

SEQ ID NO: 3221089 - RNA, 21 nt, Mycobacterium leprae
gcuaguucgacaccggccaaa

SEQ ID NO: 3221090 - RNA, 13 nt, Mycobacterium leprae
gcuaguugccugg

SEQ ID NO: 3221091 - RNA, 18 nt, Mycobacterium leprae
gcuaucaccgcggugcug

SEQ ID NO: 3221092 - RNA, 17 nt, Mycobacterium leprae
gcuauccaauucgccga

SEQ ID NO: 3221093 - RNA, 16 nt, Mycobacterium leprae
gcuaugacaagaccac

SEQ ID NO: 3221094 - RNA, 20 nt, Mycobacterium leprae
gcuaugaguuucggcgccuc

SEQ ID NO: 3221095 - RNA, 23 nt, Mycobacterium leprae
gcuaugguucuguuaugcgucgu

SEQ ID NO: 3221096 - RNA, 21 nt, Mycobacterium leprae
gcuauugcagacuuuggagca

SEQ ID NO: 3221097 - RNA, 18 nt, Mycobacterium leprae
gcuauugcauuggcugau

SEQ ID NO: 3221098 - RNA, 18 nt, Mycobacterium leprae
gcucaaugucacugcgac

SEQ ID NO: 3221099 - RNA, 19 nt, Mycobacterium leprae
gcucacaauugacaacacg

SEQ ID NO: 3221100 - RNA, 19 nt, Mycobacterium leprae
gcucacacugagaccaugg

SEQ ID NO: 3221101 - RNA, 16 nt, Mycobacterium leprae
gcucacagcaggcgag

SEQ ID NO: 3221102 - RNA, 17 nt, Mycobacterium leprae
gcucacagcaggcgagu

SEQ ID NO: 3221103 - RNA, 14 nt, Mycobacterium leprae
gcucacagcagucc

SEQ ID NO: 3221104 - RNA, 14 nt, Mycobacterium leprae
gcucacccgcagca

SEQ ID NO: 3221105 - RNA, 18 nt, Mycobacterium leprae
gcucacccgcagcaccuu

SEQ ID NO: 3221106 - RNA, 20 nt, Mycobacterium leprae
gcucacccgcgccgccugcu

SEQ ID NO: 3221107 - RNA, 23 nt, Mycobacterium leprae
gcucaccgacggaugcccagcca

SEQ ID NO: 3221108 - RNA, 15 nt, Mycobacterium leprae
gcucaccgacugaga

SEQ ID NO: 3221109 - RNA, 17 nt, Mycobacterium leprae
gcucaccggcggcgagc

SEQ ID NO: 3221110 - RNA, 20 nt, Mycobacterium leprae
gcucacgauugcucugaggu

SEQ ID NO: 3221111 - RNA, 16 nt, Mycobacterium leprae
gcucacggggcugggu

SEQ ID NO: 3221112 - RNA, 14 nt, Mycobacterium leprae
gcucacugugucuu

SEQ ID NO: 3221113 - RNA, 18 nt, Mycobacterium leprae
gcucagaucugauucaga

SEQ ID NO: 3221114 - RNA, 11 nt, Mycobacterium leprae
gcucagcagau

SEQ ID NO: 3221115 - RNA, 16 nt, Mycobacterium leprae
gcucagcggccagaca

SEQ ID NO: 3221116 - RNA, 16 nt, Mycobacterium leprae
gcucagugaagugcuc

SEQ ID NO: 3221117 - RNA, 18 nt, Mycobacterium leprae
gcucagugaagugcucgg

SEQ ID NO: 3221118 - RNA, 22 nt, Mycobacterium leprae
gcucaucucguugaaaacgguu

SEQ ID NO: 3221119 - RNA, 15 nt, Mycobacterium leprae
gcuccaaguggcugc

SEQ ID NO: 3221120 - RNA, 18 nt, Mycobacterium leprae
gcuccauugcguuugaug

SEQ ID NO: 3221121 - RNA, 23 nt, Mycobacterium leprae
gcuccauuugucaucggcgugcc

SEQ ID NO: 3221122 - RNA, 19 nt, Mycobacterium leprae
gcucccaucggcggccagc

SEQ ID NO: 3221123 - RNA, 22 nt, Mycobacterium leprae
gcucccaucggcggccagcuca

SEQ ID NO: 3221124 - RNA, 16 nt, Mycobacterium leprae
gcuccccgucggggaa

SEQ ID NO: 3221125 - RNA, 17 nt, Mycobacterium leprae
gcucccgggucgagcag

SEQ ID NO: 3221126 - RNA, 21 nt, Mycobacterium leprae
gcuccgaucucaucuaugcug

SEQ ID NO: 3221127 - RNA, 19 nt, Mycobacterium leprae
gcuccgcagcaccugccgc

SEQ ID NO: 3221128 - RNA, 22 nt, Mycobacterium leprae
gcuccgcagcaccugccgcagc

SEQ ID NO: 3221129 - RNA, 19 nt, Mycobacterium leprae
gcuccguggcccaaaccgu

SEQ ID NO: 3221130 - RNA, 12 nt, Mycobacterium leprae
gcuccuccagca

SEQ ID NO: 3221131 - RNA, 21 nt, Mycobacterium leprae
gcuccuucuuaucucaucguc

SEQ ID NO: 3221132 - RNA, 23 nt, Mycobacterium leprae
gcuccuucuuaucucaucgucuc

SEQ ID NO: 3221133 - RNA, 14 nt, Mycobacterium leprae
gcuggaauccccca

SEQ ID NO: 3221134 - RNA, 20 nt, Mycobacterium leprae
gcuggacaucggcugugguu

SEQ ID NO: 3221135 - RNA, 14 nt, Mycobacterium leprae
gcuggagaucgacg

SEQ ID NO: 3221136 - RNA, 20 nt, Mycobacterium leprae
gcuggcaagcucgggugugu

SEQ ID NO: 3221137 - RNA, 13 nt, Mycobacterium leprae
gcuggcaguggca

SEQ ID NO: 3221138 - RNA, 14 nt, Mycobacterium leprae
gcuggcccuguucc

SEQ ID NO: 3221139 - RNA, 17 nt, Mycobacterium leprae
gcuggccggcagggaug

SEQ ID NO: 3221140 - RNA, 15 nt, Mycobacterium leprae
gcuggccuguucaug

SEQ ID NO: 3221141 - RNA, 12 nt, Mycobacterium leprae
gcuggccuugcg

SEQ ID NO: 3221142 - RNA, 14 nt, Mycobacterium leprae
gcuggcggugggug

SEQ ID NO: 3221143 - RNA, 15 nt, Mycobacterium leprae
gcuggcggugggugc

SEQ ID NO: 3221144 - RNA, 22 nt, Mycobacterium leprae
gcuggcuaauggcgggcuggag

SEQ ID NO: 3221145 - RNA, 19 nt, Mycobacterium leprae
gcuggcucggucacuccac

SEQ ID NO: 3221146 - RNA, 17 nt, Mycobacterium leprae
gcuggcucugucgucga

SEQ ID NO: 3221147 - RNA, 17 nt, Mycobacterium leprae
gcuggcuuccucuccua

SEQ ID NO: 3221148 - RNA, 12 nt, Mycobacterium leprae
gcugggaaugcc

SEQ ID NO: 3221149 - RNA, 17 nt, Mycobacterium leprae
gcugggcaagcccggau

SEQ ID NO: 3221150 - RNA, 13 nt, Mycobacterium leprae
gcugggcaccacc

SEQ ID NO: 3221151 - RNA, 16 nt, Mycobacterium leprae
gcugggcaccugggcu

SEQ ID NO: 3221152 - RNA, 22 nt, Mycobacterium leprae
gcugggcaccugggcugugcug

SEQ ID NO: 3221153 - RNA, 19 nt, Mycobacterium leprae
gcugggccacagcaucucg

SEQ ID NO: 3221154 - RNA, 17 nt, Mycobacterium leprae
gcugggcuugaaacccg

SEQ ID NO: 3221155 - RNA, 13 nt, Mycobacterium leprae
gcuggggcggccg

SEQ ID NO: 3221156 - RNA, 17 nt, Mycobacterium leprae
gcugggugagcugugcc

SEQ ID NO: 3221157 - RNA, 17 nt, Mycobacterium leprae
gcugguaggugacgcca

SEQ ID NO: 3221158 - RNA, 17 nt, Mycobacterium leprae
gcuggucaagcugggcu

SEQ ID NO: 3221159 - RNA, 17 nt, Mycobacterium leprae
gcuggucggauggccau

SEQ ID NO: 3221160 - RNA, 23 nt, Mycobacterium leprae
gcuggucguguugcuugcuguga

SEQ ID NO: 3221161 - RNA, 22 nt, Mycobacterium leprae
gcuggugccccagucgccagag

SEQ ID NO: 3221162 - RNA, 17 nt, Mycobacterium leprae
gcugguggaguacuggg

SEQ ID NO: 3221163 - RNA, 19 nt, Mycobacterium leprae
gcugguggaguacugggca

SEQ ID NO: 3221164 - RNA, 23 nt, Mycobacterium leprae
gcugguucuuggcuugcugucgu

SEQ ID NO: 3221165 - RNA, 20 nt, Mycobacterium leprae
gcugguuugguuuggguggu

SEQ ID NO: 3221166 - RNA, 15 nt, Mycobacterium leprae
gcuguauaacaaauc

SEQ ID NO: 3221167 - RNA, 13 nt, Mycobacterium leprae
gcugucagagugc

SEQ ID NO: 3221168 - RNA, 19 nt, Mycobacterium leprae
gcuguccuugccggcgccg

SEQ ID NO: 3221169 - RNA, 22 nt, Mycobacterium leprae
gcugucguugccguaguacccg

SEQ ID NO: 3221170 - RNA, 22 nt, Mycobacterium leprae
gcugugauaacgcugaaccgcg

SEQ ID NO: 3221171 - RNA, 15 nt, Mycobacterium leprae
gcugugaugcugugg

SEQ ID NO: 3221172 - RNA, 19 nt, Mycobacterium leprae
gcugugcaaauacgcgcgc

SEQ ID NO: 3221173 - RNA, 18 nt, Mycobacterium leprae
gcugugccgacaccaucc

SEQ ID NO: 3221174 - RNA, 14 nt, Mycobacterium leprae
gcuguggcggucgg

SEQ ID NO: 3221175 - RNA, 14 nt, Mycobacterium leprae
gcuguguugcgggg

SEQ ID NO: 3221176 - RNA, 14 nt, Mycobacterium leprae
gcuguugaccuggg

SEQ ID NO: 3221177 - RNA, 18 nt, Mycobacterium leprae
gcuguugucagcagacca

SEQ ID NO: 3221178 - RNA, 20 nt, Mycobacterium leprae
gcuguugucagcagaccaca

SEQ ID NO: 3221179 - RNA, 15 nt, Mycobacterium leprae
gcuguugugaagcug

SEQ ID NO: 3221180 - RNA, 16 nt, Mycobacterium leprae
gcuguugugaagcuga

SEQ ID NO: 3221181 - RNA, 19 nt, Mycobacterium leprae
gcuguuuuccgcggcaagu

SEQ ID NO: 3221182 - RNA, 19 nt, Mycobacterium leprae
gcuguuuuggucauggcga

SEQ ID NO: 3221183 - RNA, 19 nt, Mycobacterium leprae
gcuuagccaucucuauuug

SEQ ID NO: 3221184 - RNA, 14 nt, Mycobacterium leprae
gcuuagcccgcugc

SEQ ID NO: 3221185 - RNA, 17 nt, Mycobacterium leprae
gcuuagcuaugcaguga

SEQ ID NO: 3221186 - RNA, 17 nt, Mycobacterium leprae
gcuuagcuuccggguuc

SEQ ID NO: 3221187 - RNA, 17 nt, Mycobacterium leprae
gcuuaguuguacuggcg

SEQ ID NO: 3221188 - RNA, 14 nt, Mycobacterium leprae
gcuuauacugcugc

SEQ ID NO: 3221189 - RNA, 14 nt, Mycobacterium leprae
gcuucaucagugug

SEQ ID NO: 3221190 - RNA, 21 nt, Mycobacterium leprae
gcuuccaaaacuuacuucugu

SEQ ID NO: 3221191 - RNA, 17 nt, Mycobacterium leprae
gcuuccucgacagucaa

SEQ ID NO: 3221192 - RNA, 18 nt, Mycobacterium leprae
gcuucgccacugaccuau

SEQ ID NO: 3221193 - RNA, 22 nt, Mycobacterium leprae
gcuucggccagcgcaucagcca

SEQ ID NO: 3221194 - RNA, 20 nt, Mycobacterium leprae
gcuucgugugcuuugccgca

SEQ ID NO: 3221195 - RNA, 17 nt, Mycobacterium leprae
gcuugaacgccgcgagc

SEQ ID NO: 3221196 - RNA, 21 nt, Mycobacterium leprae
gcuugagccuguugcaagcgg

SEQ ID NO: 3221197 - RNA, 18 nt, Mycobacterium leprae
gcuugauuugcacaacau

SEQ ID NO: 3221198 - RNA, 17 nt, Mycobacterium leprae
gcuugcccugcgggaag

SEQ ID NO: 3221199 - RNA, 14 nt, Mycobacterium leprae
gcuugccgaagucc

SEQ ID NO: 3221200 - RNA, 18 nt, Mycobacterium leprae
gcuugccgauauucgcga

SEQ ID NO: 3221201 - RNA, 16 nt, Mycobacterium leprae
gcuugcucuagccggg

SEQ ID NO: 3221202 - RNA, 18 nt, Mycobacterium leprae
gcuugcugugaccaucau

SEQ ID NO: 3221203 - RNA, 18 nt, Mycobacterium leprae
gcuuggcgcauuggucgg

SEQ ID NO: 3221204 - RNA, 15 nt, Mycobacterium leprae
gcuugggcacgcugg

SEQ ID NO: 3221205 - RNA, 14 nt, Mycobacterium leprae
gcuuguaaggccag

SEQ ID NO: 3221206 - RNA, 13 nt, Mycobacterium leprae
gcuuguugccgcc

SEQ ID NO: 3221207 - RNA, 15 nt, Mycobacterium leprae
gcuuguugccgccgg

SEQ ID NO: 3221208 - RNA, 18 nt, Mycobacterium leprae
gcuuguugccgccgggac

SEQ ID NO: 3221209 - RNA, 19 nt, Mycobacterium leprae
gcuuguugccgccgggacg

SEQ ID NO: 3221210 - RNA, 22 nt, Mycobacterium leprae
gcuuucaguuggaucuagcaag

SEQ ID NO: 3221211 - RNA, 13 nt, Mycobacterium leprae
gcuuucgcuggcu

SEQ ID NO: 3221212 - RNA, 17 nt, Mycobacterium leprae
gcuuucgcuggcucugu

SEQ ID NO: 3221213 - RNA, 14 nt, Mycobacterium leprae
gcuuugcuggcaag

SEQ ID NO: 3221214 - RNA, 14 nt, Mycobacterium leprae
gcuuuggcggacug

SEQ ID NO: 3221215 - RNA, 23 nt, Mycobacterium leprae
gcuuugggaucuuuugaccagca

SEQ ID NO: 3221216 - RNA, 17 nt, Mycobacterium leprae
gcuuuucgacauugccc

SEQ ID NO: 3221217 - RNA, 12 nt, Mycobacterium leprae
gcuuuuugugaa

SEQ ID NO: 3221218 - RNA, 15 nt, Mycobacterium leprae
gcuuuuugugaacau

SEQ ID NO: 3221219 - RNA, 15 nt, Mycobacterium leprae
ggaaacacagcaagc

SEQ ID NO: 3221220 - RNA, 18 nt, Mycobacterium leprae
ggaaaccuuccggcgguc

SEQ ID NO: 3221221 - RNA, 19 nt, Mycobacterium leprae
ggaaagucgggaucggcac

SEQ ID NO: 3221222 - RNA, 18 nt, Mycobacterium leprae
ggaacagcguucgaccca

SEQ ID NO: 3221223 - RNA, 18 nt, Mycobacterium leprae
ggaaccuggaccgaccag

SEQ ID NO: 3221224 - RNA, 20 nt, Mycobacterium leprae
ggaacgacggauaaguccac

SEQ ID NO: 3221225 - RNA, 15 nt, Mycobacterium leprae
ggaacgacuugacca

SEQ ID NO: 3221226 - RNA, 19 nt, Mycobacterium leprae
ggaacgauaugagcuccac

SEQ ID NO: 3221227 - RNA, 13 nt, Mycobacterium leprae
ggaacucgugcgu

SEQ ID NO: 3221228 - RNA, 14 nt, Mycobacterium leprae
ggaagcccgcccaa

SEQ ID NO: 3221229 - RNA, 19 nt, Mycobacterium leprae
ggaagcccucccagccauc

SEQ ID NO: 3221230 - RNA, 15 nt, Mycobacterium leprae
ggaaggagccgaggc

SEQ ID NO: 3221231 - RNA, 18 nt, Mycobacterium leprae
ggaaggaucgagcggagc

SEQ ID NO: 3221232 - RNA, 21 nt, Mycobacterium leprae
ggaagugacgccacaguuagc

SEQ ID NO: 3221233 - RNA, 19 nt, Mycobacterium leprae
ggaauaacagagugcacca

SEQ ID NO: 3221234 - RNA, 23 nt, Mycobacterium leprae
ggaauauuuuuaaggucaucuac

SEQ ID NO: 3221235 - RNA, 19 nt, Mycobacterium leprae
ggaauccacuugagcggcc

SEQ ID NO: 3221236 - RNA, 19 nt, Mycobacterium leprae
ggaaucgaguucugcaccg

SEQ ID NO: 3221237 - RNA, 23 nt, Mycobacterium leprae
ggaaucuuugaucugcugcaggu

SEQ ID NO: 3221238 - RNA, 22 nt, Mycobacterium leprae
ggaauucagagcugcaggucag

SEQ ID NO: 3221239 - RNA, 15 nt, Mycobacterium leprae
ggaauuuagaggcug

SEQ ID NO: 3221240 - RNA, 22 nt, Mycobacterium leprae
ggaauuuauuguccacgucggu

SEQ ID NO: 3221241 - RNA, 18 nt, Mycobacterium leprae
ggacaaccugggcggcau

SEQ ID NO: 3221242 - RNA, 18 nt, Mycobacterium leprae
ggacaagaucgaggccag

SEQ ID NO: 3221243 - RNA, 23 nt, Mycobacterium leprae
ggacaagcagugucugggccggg

SEQ ID NO: 3221244 - RNA, 19 nt, Mycobacterium leprae
ggacacaaccagcuuggga

SEQ ID NO: 3221245 - RNA, 16 nt, Mycobacterium leprae
ggacacgagcggccuc

SEQ ID NO: 3221246 - RNA, 12 nt, Mycobacterium leprae
ggcacggcgaca

SEQ ID NO: 3221247 - RNA, 20 nt, Mycobacterium leprae
ggcacguucgaucggcagcc

SEQ ID NO: 3221248 - RNA, 15 nt, Mycobacterium leprae
ggcacuccgaccgag

SEQ ID NO: 3221249 - RNA, 14 nt, Mycobacterium leprae
ggcacuucgcugag

SEQ ID NO: 3221250 - RNA, 18 nt, Mycobacterium leprae
ggcacuugaaauuugcuc

SEQ ID NO: 3221251 - RNA, 15 nt, Mycobacterium leprae
ggcagacgugcuacu

SEQ ID NO: 3221252 - RNA, 15 nt, Mycobacterium leprae
ggcagaggcugcagu

SEQ ID NO: 3221253 - RNA, 12 nt, Mycobacterium leprae
ggcagcaaccgc

SEQ ID NO: 3221254 - RNA, 13 nt, Mycobacterium leprae
ggcagcaaccgca

SEQ ID NO: 3221255 - RNA, 15 nt, Mycobacterium leprae
ggcagcagcucgacg

SEQ ID NO: 3221256 - RNA, 21 nt, Mycobacterium leprae
ggcagccgagguucccggcgg

SEQ ID NO: 3221257 - RNA, 17 nt, Mycobacterium leprae
ggcagcgccaauuccuc

SEQ ID NO: 3221258 - RNA, 21 nt, Mycobacterium leprae
ggcagcgccaauuccuccgcu

SEQ ID NO: 3221259 - RNA, 20 nt, Mycobacterium leprae
ggcagcuaagaagcugcccu

SEQ ID NO: 3221260 - RNA, 15 nt, Mycobacterium leprae
ggcagcuacagcggg

SEQ ID NO: 3221261 - RNA, 22 nt, Mycobacterium leprae
ggcagcucgcccggacgugcac

SEQ ID NO: 3221262 - RNA, 23 nt, Mycobacterium leprae
ggcagcuguauaacaaaucauag

SEQ ID NO: 3221263 - RNA, 18 nt, Mycobacterium leprae
ggcaguagcaucgaacaa

SEQ ID NO: 3221264 - RNA, 17 nt, Mycobacterium leprae
ggcagucggcucaacca

SEQ ID NO: 3221265 - RNA, 23 nt, Mycobacterium leprae
ggcagucucguugccggggcucg

SEQ ID NO: 3221266 - RNA, 22 nt, Mycobacterium leprae
ggcagucuuucagugccgaccu

SEQ ID NO: 3221267 - RNA, 21 nt, Mycobacterium leprae
ggcagugauuuuuggugucuu

SEQ ID NO: 3221268 - RNA, 13 nt, Mycobacterium leprae
ggcagugccuggc

SEQ ID NO: 3221269 - RNA, 19 nt, Mycobacterium leprae
ggcauccugcuguaauaua

SEQ ID NO: 3221270 - RNA, 15 nt, Mycobacterium leprae
ggcaucucaacuuuc

SEQ ID NO: 3221271 - RNA, 14 nt, Mycobacterium leprae
ggcaugaaccucac

SEQ ID NO: 3221272 - RNA, 15 nt, Mycobacterium leprae
ggcaugagccgacug

SEQ ID NO: 3221273 - RNA, 19 nt, Mycobacterium leprae
ggcaugagccgacugacaa

SEQ ID NO: 3221274 - RNA, 24 nt, Mycobacterium leprae
ggcaugccgccgggugcagcagua

SEQ ID NO: 3221275 - RNA, 13 nt, Mycobacterium leprae
ggcaugggccggu

SEQ ID NO: 3221276 - RNA, 19 nt, Mycobacterium leprae
ggcaugucaauacccacga

SEQ ID NO: 3221277 - RNA, 14 nt, Mycobacterium leprae
ggcauucgucgagu

SEQ ID NO: 3221278 - RNA, 20 nt, Mycobacterium leprae
ggccaacacgucacgacuca

SEQ ID NO: 3221279 - RNA, 12 nt, Mycobacterium leprae
ggccaaccacag

SEQ ID NO: 3221280 - RNA, 19 nt, Mycobacterium leprae
ggccaaccacagcaauaga

SEQ ID NO: 3221281 - RNA, 23 nt, Mycobacterium leprae
ggccaacuaggauagauccacca

SEQ ID NO: 3221282 - RNA, 15 nt, Mycobacterium leprae
ggccacaacgcggcc

SEQ ID NO: 3221283 - RNA, 20 nt, Mycobacterium leprae
ggccacauugaccacgccga

SEQ ID NO: 3221284 - RNA, 13 nt, Mycobacterium leprae
ggccaccgccacc

SEQ ID NO: 3221285 - RNA, 14 nt, Mycobacterium leprae
ggccacgacaucgu

SEQ ID NO: 3221286 - RNA, 13 nt, Mycobacterium leprae
ggccacgucgccg

SEQ ID NO: 3221287 - RNA, 14 nt, Mycobacterium leprae
ggccacgucgccgu

SEQ ID NO: 3221288 - RNA, 22 nt, Mycobacterium leprae
ggccacgugcacaucagcgcga

SEQ ID NO: 3221289 - RNA, 16 nt, Mycobacterium leprae
ggccacuacgacguug

SEQ ID NO: 3221290 - RNA, 15 nt, Mycobacterium leprae
ggccagagcugcgac

SEQ ID NO: 3221291 - RNA, 17 nt, Mycobacterium leprae
ggccagcccggcgugca

SEQ ID NO: 3221292 - RNA, 17 nt, Mycobacterium leprae
ggccagccgucccacgc

SEQ ID NO: 3221293 - RNA, 20 nt, Mycobacterium leprae
ggccagccuagccacaagua

SEQ ID NO: 3221294 - RNA, 12 nt, Mycobacterium leprae
ggccagcgcggc

SEQ ID NO: 3221295 - RNA, 13 nt, Mycobacterium leprae
ggccagcguugga

SEQ ID NO: 3221296 - RNA, 19 nt, Mycobacterium leprae
ggccaggccgagugcagga

SEQ ID NO: 3221297 - RNA, 22 nt, Mycobacterium leprae
ggccagggcgccgauuuggggg

SEQ ID NO: 3221298 - RNA, 22 nt, Mycobacterium leprae
ggccagggggcgucaaguccag

SEQ ID NO: 3221299 - RNA, 16 nt, Mycobacterium leprae
ggccaggucggcuagc

SEQ ID NO: 3221300 - RNA, 22 nt, Mycobacterium leprae
ggccaguaccuccagccgcggg

SEQ ID NO: 3221301 - RNA, 20 nt, Mycobacterium leprae
ggccauauaugaacuucagc

SEQ ID NO: 3221302 - RNA, 23 nt, Mycobacterium leprae
ggccaucagauccgguggcgaca

SEQ ID NO: 3221303 - RNA, 18 nt, Mycobacterium leprae
ggccaugacaugcacacu

SEQ ID NO: 3221304 - RNA, 15 nt, Mycobacterium leprae
ggccauggcagccga

SEQ ID NO: 3221305 - RNA, 17 nt, Mycobacterium leprae
ggccauuggcaccguug

SEQ ID NO: 3221306 - RNA, 21 nt, Mycobacterium leprae
ggccauuggcaccguuggcga

SEQ ID NO: 3221307 - RNA, 18 nt, Mycobacterium leprae
ggccauuguugugcuggg

SEQ ID NO: 3221308 - RNA, 19 nt, Mycobacterium leprae
ggcccagauccaucggaca

SEQ ID NO: 3221309 - RNA, 20 nt, Mycobacterium leprae
ggccccggacccgagccgca

SEQ ID NO: 3221310 - RNA, 19 nt, Mycobacterium leprae
ggcccgcgucgccuuagcc

SEQ ID NO: 3221311 - RNA, 15 nt, Mycobacterium leprae
ggcccgucgcugcug

SEQ ID NO: 3221312 - RNA, 16 nt, Mycobacterium leprae
ggcccucgcgcggggc

SEQ ID NO: 3221313 - RNA, 20 nt, Mycobacterium leprae
ggcccuguuccucgcgggcg

SEQ ID NO: 3221314 - RNA, 22 nt, Mycobacterium leprae
ggcccuguuccucgcgggcggc

SEQ ID NO: 3221315 - RNA, 23 nt, Mycobacterium leprae
ggcccuguuccucgcgggcggcg

SEQ ID NO: 3221316 - RNA, 21 nt, Mycobacterium leprae
ggccgaaacuaaauccgggcg

SEQ ID NO: 3221317 - RNA, 14 nt, Mycobacterium leprae
ggccgaacuuggga

SEQ ID NO: 3221318 - RNA, 13 nt, Mycobacterium leprae
ggccgaggucgag

SEQ ID NO: 3221319 - RNA, 22 nt, Mycobacterium leprae
ggccgcaacacacccuccugca

SEQ ID NO: 3221320 - RNA, 12 nt, Mycobacterium leprae
ggccgccagcac

SEQ ID NO: 3221321 - RNA, 14 nt, Mycobacterium leprae
ggccgccaggucag

SEQ ID NO: 3221322 - RNA, 19 nt, Mycobacterium leprae
ggccgccagguccacccgc

SEQ ID NO: 3221323 - RNA, 17 nt, Mycobacterium leprae
ggccgccguccacugca

SEQ ID NO: 3221324 - RNA, 16 nt, Mycobacterium leprae
ggccgcgcuggccucc

SEQ ID NO: 3221325 - RNA, 13 nt, Mycobacterium leprae
ggccgcggcgacc

SEQ ID NO: 3221326 - RNA, 20 nt, Mycobacterium leprae
ggccggaucaucgaugcacu

SEQ ID NO: 3221327 - RNA, 12 nt, Mycobacterium leprae
ggccggccuggc

SEQ ID NO: 3221328 - RNA, 19 nt, Mycobacterium leprae
ggccggcucgcauccgcaa

SEQ ID NO: 3221329 - RNA, 16 nt, Mycobacterium leprae
ggccgggaucggcggc

SEQ ID NO: 3221330 - RNA, 21 nt, Mycobacterium leprae
ggccgggaucggcggcaccug

SEQ ID NO: 3221331 - RNA, 23 nt, Mycobacterium leprae
ggccgggucuuccuacggcuucc

SEQ ID NO: 3221332 - RNA, 22 nt, Mycobacterium leprae
ggccggucaacaagccgccgac

SEQ ID NO: 3221333 - RNA, 23 nt, Mycobacterium leprae
ggccgucgcucgguaagcuggcu

SEQ ID NO: 3221334 - RNA, 14 nt, Mycobacterium leprae
ggccgucggcggca

SEQ ID NO: 3221335 - RNA, 20 nt, Mycobacterium leprae
ggccgugauuuucauuggca

SEQ ID NO: 3221336 - RNA, 22 nt, Mycobacterium leprae
ggccgugcauuaacggcuuccg

SEQ ID NO: 3221337 - RNA, 15 nt, Mycobacterium leprae
ggccgugcuagucgu

SEQ ID NO: 3221338 - RNA, 14 nt, Mycobacterium leprae
ggccguggccgacg

SEQ ID NO: 3221339 - RNA, 16 nt, Mycobacterium leprae
ggccguuauccacagc

SEQ ID NO: 3221340 - RNA, 12 nt, Mycobacterium leprae
ggccuaggacgc

SEQ ID NO: 3221341 - RNA, 20 nt, Mycobacterium leprae
ggccucacaguaggccagcc

SEQ ID NO: 3221342 - RNA, 21 nt, Mycobacterium leprae
ggccuccaggugaagccggcg

SEQ ID NO: 3221343 - RNA, 13 nt, Mycobacterium leprae
ggccuccuaggcc

SEQ ID NO: 3221344 - RNA, 16 nt, Mycobacterium leprae
ggccugcucauggcac

SEQ ID NO: 3221345 - RNA, 20 nt, Mycobacterium leprae
ggcgaaaacccgcgcgugca

SEQ ID NO: 3221346 - RNA, 20 nt, Mycobacterium leprae
ggcgaccagcgagcaaccua

SEQ ID NO: 3221347 - RNA, 19 nt, Mycobacterium leprae
ggcgaccgcacggcaagcc

SEQ ID NO: 3221348 - RNA, 20 nt, Mycobacterium leprae
ggcgacgaccuccgcagcau

SEQ ID NO: 3221349 - RNA, 15 nt, Mycobacterium leprae
ggcgacgucacgcug

SEQ ID NO: 3221350 - RNA, 16 nt, Mycobacterium leprae
ggcgacgugaucgacg

SEQ ID NO: 3221351 - RNA, 16 nt, Mycobacterium leprae
ggcgagcaucuggccg

SEQ ID NO: 3221352 - RNA, 23 nt, Mycobacterium leprae
ggcgagcaucuggccgugcggcg

SEQ ID NO: 3221353 - RNA, 17 nt, Mycobacterium leprae
ggcgagcuggggcggcc

SEQ ID NO: 3221354 - RNA, 21 nt, Mycobacterium leprae
ggcgaguacguccgcgccggc

SEQ ID NO: 3221355 - RNA, 16 nt, Mycobacterium leprae
ggcgauauccgccggc

SEQ ID NO: 3221356 - RNA, 16 nt, Mycobacterium leprae
ggcgaugcgcagccgc

SEQ ID NO: 3221357 - RNA, 15 nt, Mycobacterium leprae
ggcgauugccaccac

SEQ ID NO: 3221358 - RNA, 16 nt, Mycobacterium leprae
ggcgauuuucuugccg

SEQ ID NO: 3221359 - RNA, 15 nt, Mycobacterium leprae
ggcuuggccagcaag

SEQ ID NO: 3221360 - RNA, 22 nt, Mycobacterium leprae
ggcuuugcaaagcagaauauug

SEQ ID NO: 3221361 - RNA, 18 nt, Mycobacterium leprae
gggacacggcguggaugg

SEQ ID NO: 3221362 - RNA, 21 nt, Mycobacterium leprae
gggaccgggcguuucccuauc

SEQ ID NO: 3221363 - RNA, 14 nt, Mycobacterium leprae
gggacuugacuccu

SEQ ID NO: 3221364 - RNA, 20 nt, Mycobacterium leprae
gggacuuuagcaacgacgcc

SEQ ID NO: 3221365 - RNA, 16 nt, Mycobacterium leprae
gggagaaugccacagg

SEQ ID NO: 3221366 - RNA, 21 nt, Mycobacterium leprae
gggagagacgucgaugucagc

SEQ ID NO: 3221367 - RNA, 13 nt, Mycobacterium leprae
gggaggucaccaa

SEQ ID NO: 3221368 - RNA, 22 nt, Mycobacterium leprae
gggagugcuagcggcgccaggc

SEQ ID NO: 3221369 - RNA, 19 nt, Mycobacterium leprae
gggaguuuccgccucaggg

SEQ ID NO: 3221370 - RNA, 18 nt, Mycobacterium leprae
gggauaacaucaggugcg

SEQ ID NO: 3221371 - RNA, 20 nt, Mycobacterium leprae
gggauagcugugcaggagag

SEQ ID NO: 3221372 - RNA, 13 nt, Mycobacterium leprae
gggaucggcggca

SEQ ID NO: 3221373 - RNA, 22 nt, Mycobacterium leprae
gggaucguacgaaagaugcugc

SEQ ID NO: 3221374 - RNA, 18 nt, Mycobacterium leprae
gggaugaugauugccgcc

SEQ ID NO: 3221375 - RNA, 14 nt, Mycobacterium leprae
gggaugcagguacu

SEQ ID NO: 3221376 - RNA, 22 nt, Mycobacterium leprae
gggauggccaagccgcccggcc

SEQ ID NO: 3221377 - RNA, 13 nt, Mycobacterium leprae
gggcaacaggcgg

SEQ ID NO: 3221378 - RNA, 15 nt, Mycobacterium leprae
gggcaagccauugcu

SEQ ID NO: 3221379 - RNA, 16 nt, Mycobacterium leprae
gggcaagcccggauac

SEQ ID NO: 3221380 - RNA, 14 nt, Mycobacterium leprae
gggcaagcccugcc

SEQ ID NO: 3221381 - RNA, 17 nt, Mycobacterium leprae
gggcaagcccugcccgg

SEQ ID NO: 3221382 - RNA, 18 nt, Mycobacterium leprae
gggcaagcccugcccggc

SEQ ID NO: 3221383 - RNA, 16 nt, Mycobacterium leprae
gggccacuaauggcgu

SEQ ID NO: 3221384 - RNA, 12 nt, Mycobacterium leprae
gggccacuucgc

SEQ ID NO: 3221385 - RNA, 23 nt, Mycobacterium leprae
gggccagagcugcgacggacagg

SEQ ID NO: 3221386 - RNA, 21 nt, Mycobacterium leprae
gggccagcgaucuaccucgcc

SEQ ID NO: 3221387 - RNA, 14 nt, Mycobacterium leprae
gggccaggccgagu

SEQ ID NO: 3221388 - RNA, 22 nt, Mycobacterium leprae
gggccagggggcgucaagucca

SEQ ID NO: 3221389 - RNA, 12 nt, Mycobacterium leprae
gggccaugcagu

SEQ ID NO: 3221390 - RNA, 22 nt, Mycobacterium leprae
gggcccagauccaucggacaag

SEQ ID NO: 3221391 - RNA, 15 nt, Mycobacterium leprae
gggccgaagcagccg

SEQ ID NO: 3221392 - RNA, 19 nt, Mycobacterium leprae
gggccgcuauaggcgagcu

SEQ ID NO: 3221393 - RNA, 13 nt, Mycobacterium leprae
gggccggccgcgg

SEQ ID NO: 3221394 - RNA, 21 nt, Mycobacterium leprae
gggccguuauccacagcauca

SEQ ID NO: 3221395 - RNA, 21 nt, Mycobacterium leprae
gggcgaaaacauucaggaugc

SEQ ID NO: 3221396 - RNA, 21 nt, Mycobacterium leprae
gggcgacgaucugugacacuu

SEQ ID NO: 3221397 - RNA, 17 nt, Mycobacterium leprae
gggcgaugaaauccgca

SEQ ID NO: 3221398 - RNA, 15 nt, Mycobacterium leprae
gggcgaugucgaccu

SEQ ID NO: 3221399 - RNA, 18 nt, Mycobacterium leprae
gggcgauucgggccgcua

SEQ ID NO: 3221400 - RNA, 23 nt, Mycobacterium leprae
gggcgccaccaugaaacgcgcga

SEQ ID NO: 3221401 - RNA, 16 nt, Mycobacterium leprae
gggcgcucagcggcca

SEQ ID NO: 3221402 - RNA, 17 nt, Mycobacterium leprae
gggcggcaccugcaaug

SEQ ID NO: 3221403 - RNA, 19 nt, Mycobacterium leprae
gggcggcauucccaaccgc

SEQ ID NO: 3221404 - RNA, 15 nt, Mycobacterium leprae
gggcggccaggcagg

SEQ ID NO: 3221405 - RNA, 13 nt, Mycobacterium leprae
gggcguugaccuc

SEQ ID NO: 3221406 - RNA, 19 nt, Mycobacterium leprae
gggcguuuuagugugcaug

SEQ ID NO: 3221407 - RNA, 24 nt, Mycobacterium leprae
gggcuauccucgggugcgcacgga

SEQ ID NO: 3221408 - RNA, 19 nt, Mycobacterium leprae
gggcucggccaggugugcc

SEQ ID NO: 3221409 - RNA, 24 nt, Mycobacterium leprae
gggcugcuguguuugcuggucagg

SEQ ID NO: 3221410 - RNA, 13 nt, Mycobacterium leprae
gggcuugaccugg

SEQ ID NO: 3221411 - RNA, 14 nt, Mycobacterium leprae
gggcuugaccugga

SEQ ID NO: 3221412 - RNA, 13 nt, Mycobacterium leprae
gggcuuugccaau

SEQ ID NO: 3221413 - RNA, 15 nt, Mycobacterium leprae
ggggaaccaucgcac

SEQ ID NO: 3221414 - RNA, 12 nt, Mycobacterium leprae
ggggacgccggc

SEQ ID NO: 3221415 - RNA, 20 nt, Mycobacterium leprae
ggggaucgauguagcgcauc

SEQ ID NO: 3221416 - RNA, 14 nt, Mycobacterium leprae
ggggcaucugucua

SEQ ID NO: 3221417 - RNA, 15 nt, Mycobacterium leprae
ggggccuuaucccac

SEQ ID NO: 3221418 - RNA, 19 nt, Mycobacterium leprae
ggggcgccaccaugaaacg

SEQ ID NO: 3221419 - RNA, 22 nt, Mycobacterium leprae
ggggcguuuuagugugcauguc

SEQ ID NO: 3221420 - RNA, 16 nt, Mycobacterium leprae
ggggcuaaauccgcug

SEQ ID NO: 3221421 - RNA, 23 nt, Mycobacterium leprae
ggggcucgcgucguugcgcugga

SEQ ID NO: 3221422 - RNA, 15 nt, Mycobacterium leprae
ggggcucggccaggu

SEQ ID NO: 3221423 - RNA, 23 nt, Mycobacterium leprae
ggggcucggccaggugugccugg

SEQ ID NO: 3221424 - RNA, 14 nt, Mycobacterium leprae
ggggcugggcaccu

SEQ ID NO: 3221425 - RNA, 13 nt, Mycobacterium leprae
gggggaucgaugu

SEQ ID NO: 3221426 - RNA, 12 nt, Mycobacterium leprae
ggggggcagccc

SEQ ID NO: 3221427 - RNA, 19 nt, Mycobacterium leprae
gggggugcggcagcugcca

SEQ ID NO: 3221428 - RNA, 18 nt, Mycobacterium leprae
gggggugugaugcuccac

SEQ ID NO: 3221429 - RNA, 19 nt, Mycobacterium leprae
ggggguuaccugggccagg

SEQ ID NO: 3221430 - RNA, 13 nt, Mycobacterium leprae
ggggguugcacug

SEQ ID NO: 3221431 - RNA, 20 nt, Mycobacterium leprae
gggguauuggaauagcugug

SEQ ID NO: 3221432 - RNA, 20 nt, Mycobacterium leprae
gggguccugaccgccugugc

SEQ ID NO: 3221433 - RNA, 13 nt, Mycobacterium leprae
ggggugggcagcc

SEQ ID NO: 3221434 - RNA, 20 nt, Mycobacterium leprae
gggguggggaucgugcguga

SEQ ID NO: 3221435 - RNA, 22 nt, Mycobacterium leprae
gggguugaauuguacuuugugu

SEQ ID NO: 3221436 - RNA, 13 nt, Mycobacterium leprae
gggguugcacuga

SEQ ID NO: 3221437 - RNA, 21 nt, Mycobacterium leprae
gggguuuuuguuggugggugg

SEQ ID NO: 3221438 - RNA, 14 nt, Mycobacterium leprae
ggguacgugguggc

SEQ ID NO: 3221439 - RNA, 20 nt, Mycobacterium leprae
ggguaggccgacuucggcaa

SEQ ID NO: 3221440 - RNA, 12 nt, Mycobacterium leprae
ggguauugugcg

SEQ ID NO: 3221441 - RNA, 17 nt, Mycobacterium leprae
gggucaauccguacugg

SEQ ID NO: 3221442 - RNA, 23 nt, Mycobacterium leprae
ggguccagcguaaucgcuuggug

SEQ ID NO: 3221443 - RNA, 20 nt, Mycobacterium leprae
gggucgauagccgugaccga

SEQ ID NO: 3221444 - RNA, 14 nt, Mycobacterium leprae
gggucgcgguagga

SEQ ID NO: 3221445 - RNA, 18 nt, Mycobacterium leprae
gggucggaacgacacuga

SEQ ID NO: 3221446 - RNA, 21 nt, Mycobacterium leprae
gggugauagauggagccacca

SEQ ID NO: 3221447 - RNA, 13 nt, Mycobacterium leprae
gggugcacaaccu

SEQ ID NO: 3221448 - RNA, 15 nt, Mycobacterium leprae
gggugcuacacggcc

SEQ ID NO: 3221449 - RNA, 22 nt, Mycobacterium leprae
ggguggaguaaagggugguggg

SEQ ID NO: 3221450 - RNA, 14 nt, Mycobacterium leprae
ggguggcgccggcg

SEQ ID NO: 3221451 - RNA, 16 nt, Mycobacterium leprae
ggguggcgucaacgua

SEQ ID NO: 3221452 - RNA, 24 nt, Mycobacterium leprae
gggugggaaaagcaggcggaacgg

SEQ ID NO: 3221453 - RNA, 19 nt, Mycobacterium leprae
ggguggggaucgugcguga

SEQ ID NO: 3221454 - RNA, 17 nt, Mycobacterium leprae
ggguggggguggggauc

SEQ ID NO: 3221455 - RNA, 12 nt, Mycobacterium leprae
gggugucgagcu

SEQ ID NO: 3221456 - RNA, 18 nt, Mycobacterium leprae
gggugugggugguugauc

SEQ ID NO: 3221457 - RNA, 17 nt, Mycobacterium leprae
ggguguucauggcgcgc

SEQ ID NO: 3221458 - RNA, 19 nt, Mycobacterium leprae
ggguguucucguaguucgc

SEQ ID NO: 3221459 - RNA, 21 nt, Mycobacterium leprae
ggguguuucauaggugguggg

SEQ ID NO: 3221460 - RNA, 17 nt, Mycobacterium leprae
ggguuaccugggccagg

SEQ ID NO: 3221461 - RNA, 20 nt, Mycobacterium leprae
ggguucacgucgauucgcuc

SEQ ID NO: 3221462 - RNA, 20 nt, Mycobacterium leprae
ggguuuuagauugacaccgc

SEQ ID NO: 3221463 - RNA, 19 nt, Mycobacterium leprae
gguaaacaccuuggugcgg

SEQ ID NO: 3221464 - RNA, 16 nt, Mycobacterium leprae
gguaaacagugccaca

SEQ ID NO: 3221465 - RNA, 17 nt, Mycobacterium leprae
gguaacgcugaccagca

SEQ ID NO: 3221466 - RNA, 16 nt, Mycobacterium leprae
gguaacggaccuggca

SEQ ID NO: 3221467 - RNA, 19 nt, Mycobacterium leprae
gguaacuaauccagacauc

SEQ ID NO: 3221468 - RNA, 14 nt, Mycobacterium leprae
gguaacuggcucga

SEQ ID NO: 3221469 - RNA, 19 nt, Mycobacterium leprae
gguaaguugcuuaacgauc

SEQ ID NO: 3221470 - RNA, 15 nt, Mycobacterium leprae
gguaaugcugccugc

SEQ ID NO: 3221471 - RNA, 20 nt, Mycobacterium leprae
gguaauucuugacaccgaug

SEQ ID NO: 3221472 - RNA, 17 nt, Mycobacterium leprae
gguguggcccgacggcg

SEQ ID NO: 3221473 - RNA, 16 nt, Mycobacterium leprae
ggugugugaggaucug

SEQ ID NO: 3221474 - RNA, 20 nt, Mycobacterium leprae
gguguucgcuccgcccacua

SEQ ID NO: 3221475 - RNA, 17 nt, Mycobacterium leprae
gguguuguuuggcaacg

SEQ ID NO: 3221476 - RNA, 20 nt, Mycobacterium leprae
gguguuucucgccgaccggu

SEQ ID NO: 3221477 - RNA, 21 nt, Mycobacterium leprae
gguuaccagcgccagaccugc

SEQ ID NO: 3221478 - RNA, 18 nt, Mycobacterium leprae
gguuaccgcauacuggca

SEQ ID NO: 3221479 - RNA, 14 nt, Mycobacterium leprae
gguuaccugggcca

SEQ ID NO: 3221480 - RNA, 13 nt, Mycobacterium leprae
gguuacggcuacc

SEQ ID NO: 3221481 - RNA, 19 nt, Mycobacterium leprae
gguuacguccgcggcagcu

SEQ ID NO: 3221482 - RNA, 15 nt, Mycobacterium leprae
gguuagcaucgaccg

SEQ ID NO: 3221483 - RNA, 19 nt, Mycobacterium leprae
gguuaucgacacggcgacc

SEQ ID NO: 3221484 - RNA, 14 nt, Mycobacterium leprae
gguuaugcagugau

SEQ ID NO: 3221485 - RNA, 14 nt, Mycobacterium leprae
gguuauugacguga

SEQ ID NO: 3221486 - RNA, 13 nt, Mycobacterium leprae
gguucauggcugu

SEQ ID NO: 3221487 - RNA, 15 nt, Mycobacterium leprae
gguuccgauuggugu

SEQ ID NO: 3221488 - RNA, 19 nt, Mycobacterium leprae
gguucgaagcguucgacgu

SEQ ID NO: 3221489 - RNA, 15 nt, Mycobacterium leprae
gguucuaccucggcc

SEQ ID NO: 3221490 - RNA, 20 nt, Mycobacterium leprae
gguugaggaggugcuggaug

SEQ ID NO: 3221491 - RNA, 20 nt, Mycobacterium leprae
gguugaucugcgcuagaagg

SEQ ID NO: 3221492 - RNA, 16 nt, Mycobacterium leprae
gguugcguggcugcuu

SEQ ID NO: 3221493 - RNA, 15 nt, Mycobacterium leprae
gguugcuuugggggu

SEQ ID NO: 3221494 - RNA, 13 nt, Mycobacterium leprae
gguuggacgaacg

SEQ ID NO: 3221495 - RNA, 19 nt, Mycobacterium leprae
gguuggccacuggugcugu

SEQ ID NO: 3221496 - RNA, 16 nt, Mycobacterium leprae
gguugguagcuggcuc

SEQ ID NO: 3221497 - RNA, 21 nt, Mycobacterium leprae
gguugguuucauagguggugg

SEQ ID NO: 3221498 - RNA, 19 nt, Mycobacterium leprae
gguuugaggcgcgcgaggc

SEQ ID NO: 3221499 - RNA, 14 nt, Mycobacterium leprae
gguuuuaucugcaa

SEQ ID NO: 3221500 - RNA, 17 nt, Mycobacterium leprae
guaaagccgcgcccggc

SEQ ID NO: 3221501 - RNA, 16 nt, Mycobacterium leprae
guaaagccguuggcuu

SEQ ID NO: 3221502 - RNA, 17 nt, Mycobacterium leprae
guaaagccguuggcuug

SEQ ID NO: 3221503 - RNA, 22 nt, Mycobacterium leprae
guaaaggaguucaacaaaacca

SEQ ID NO: 3221504 - RNA, 19 nt, Mycobacterium leprae
guaaaucucgggcagcugc

SEQ ID NO: 3221505 - RNA, 16 nt, Mycobacterium leprae
guaaccauaagaccuu

SEQ ID NO: 3221506 - RNA, 21 nt, Mycobacterium leprae
guaacugaugguccuggcugc

SEQ ID NO: 3221507 - RNA, 14 nt, Mycobacterium leprae
guaagcacugcacg

SEQ ID NO: 3221508 - RNA, 16 nt, Mycobacterium leprae
guaagcuggcucgguc

SEQ ID NO: 3221509 - RNA, 17 nt, Mycobacterium leprae
guaagcuuggggucgcu

SEQ ID NO: 3221510 - RNA, 15 nt, Mycobacterium leprae
guaaggcucagcgcu

SEQ ID NO: 3221511 - RNA, 21 nt, Mycobacterium leprae
guaaggguaucgaugcuaccg

SEQ ID NO: 3221512 - RNA, 18 nt, Mycobacterium leprae
guaaguggaggugaucaa

SEQ ID NO: 3221513 - RNA, 20 nt, Mycobacterium leprae
guaaucagcccaacgcugcc

SEQ ID NO: 3221514 - RNA, 17 nt, Mycobacterium leprae
guaaucgccgguggcaa

SEQ ID NO: 3221515 - RNA, 17 nt, Mycobacterium leprae
guaaucguaccaacacc

SEQ ID NO: 3221516 - RNA, 18 nt, Mycobacterium leprae
guaaugcaggugaccggc

SEQ ID NO: 3221517 - RNA, 18 nt, Mycobacterium leprae
guacaacgggaucgacaa

SEQ ID NO: 3221518 - RNA, 16 nt, Mycobacterium leprae
guacaaugucuucguc

SEQ ID NO: 3221519 - RNA, 22 nt, Mycobacterium leprae
guacaccaaucaggccaucgcc

SEQ ID NO: 3221520 - RNA, 21 nt, Mycobacterium leprae
guacaccacccaagauagcgc

SEQ ID NO: 3221521 - RNA, 22 nt, Mycobacterium leprae
guacaccauggugcggcgccgc

SEQ ID NO: 3221522 - RNA, 17 nt, Mycobacterium leprae
guacaggcgugugcuau

SEQ ID NO: 3221523 - RNA, 19 nt, Mycobacterium leprae
guaccacucacacguucgg

SEQ ID NO: 3221524 - RNA, 17 nt, Mycobacterium leprae
guaccccagucgagcca

SEQ ID NO: 3221525 - RNA, 18 nt, Mycobacterium leprae
guaccccauucagcggcg

SEQ ID NO: 3221526 - RNA, 15 nt, Mycobacterium leprae
guaccccccaucugc

SEQ ID NO: 3221527 - RNA, 18 nt, Mycobacterium leprae
guaccgcgaacccugguc

SEQ ID NO: 3221528 - RNA, 16 nt, Mycobacterium leprae
guaccguccguccugc

SEQ ID NO: 3221529 - RNA, 18 nt, Mycobacterium leprae
guaccuucuguauggcuc

SEQ ID NO: 3221530 - RNA, 22 nt, Mycobacterium leprae
guacgaaaugaacgucaucguc

SEQ ID NO: 3221531 - RNA, 23 nt, Mycobacterium leprae
guacgacaaaauuuucaggcugu

SEQ ID NO: 3221532 - RNA, 17 nt, Mycobacterium leprae
guacgcguugauggccg

SEQ ID NO: 3221533 - RNA, 19 nt, Mycobacterium leprae
guacggacaucauugcgac

SEQ ID NO: 3221534 - RNA, 19 nt, Mycobacterium leprae
guacggcaaauccgaacag

SEQ ID NO: 3221535 - RNA, 21 nt, Mycobacterium leprae
guacggcggcgauccucaacc

SEQ ID NO: 3221536 - RNA, 23 nt, Mycobacterium leprae
guacgguguagcugcgagucuca

SEQ ID NO: 3221537 - RNA, 19 nt, Mycobacterium leprae
guacuccaccacacgucga

SEQ ID NO: 3221538 - RNA, 22 nt, Mycobacterium leprae
guacugaccgacucaccgguac

SEQ ID NO: 3221539 - RNA, 14 nt, Mycobacterium leprae
guacuggugauaaa

SEQ ID NO: 3221540 - RNA, 15 nt, Mycobacterium leprae
guacuggugauaaau

SEQ ID NO: 3221541 - RNA, 15 nt, Mycobacterium leprae
guacuggugcugugu

SEQ ID NO: 3221542 - RNA, 13 nt, Mycobacterium leprae
guacuuguugauu

SEQ ID NO: 3221543 - RNA, 21 nt, Mycobacterium leprae
guagaccucuucagacuggau

SEQ ID NO: 3221544 - RNA, 16 nt, Mycobacterium leprae
guagacgugcacaaga

SEQ ID NO: 3221545 - RNA, 19 nt, Mycobacterium leprae
guagagguccugcagucuu

SEQ ID NO: 3221546 - RNA, 17 nt, Mycobacterium leprae
guagauaaacaucgagu

SEQ ID NO: 3221547 - RNA, 19 nt, Mycobacterium leprae
guagcaaucuuugccuucg

SEQ ID NO: 3221548 - RNA, 21 nt, Mycobacterium leprae
guagccaugccuugaccuucu

SEQ ID NO: 3221549 - RNA, 12 nt, Mycobacterium leprae
guagcgccgagc

SEQ ID NO: 3221550 - RNA, 14 nt, Mycobacterium leprae
guagcggcggcggc

SEQ ID NO: 3221551 - RNA, 17 nt, Mycobacterium leprae
guagcggucggcgcaca

SEQ ID NO: 3221552 - RNA, 15 nt, Mycobacterium leprae
guagcuaaccacgcg

SEQ ID NO: 3221553 - RNA, 19 nt, Mycobacterium leprae
guagcucaauuggcagagc

SEQ ID NO: 3221554 - RNA, 21 nt, Mycobacterium leprae
guagcuguucggguuggucgu

SEQ ID NO: 3221555 - RNA, 14 nt, Mycobacterium leprae
guaggaaucaccgg

SEQ ID NO: 3221556 - RNA, 13 nt, Mycobacterium leprae
guaggccagguua

SEQ ID NO: 3221557 - RNA, 13 nt, Mycobacterium leprae
guaggccugacgc

SEQ ID NO: 3221558 - RNA, 18 nt, Mycobacterium leprae
guaggcguccgcggcggc

SEQ ID NO: 3221559 - RNA, 20 nt, Mycobacterium leprae
guagggaugaucgauccagu

SEQ ID NO: 3221560 - RNA, 21 nt, Mycobacterium leprae
guagggucgagaucgccacuc

SEQ ID NO: 3221561 - RNA, 13 nt, Mycobacterium leprae
guagugcugcagg

SEQ ID NO: 3221562 - RNA, 17 nt, Mycobacterium leprae
guaguguagcugcagcg

SEQ ID NO: 3221563 - RNA, 18 nt, Mycobacterium leprae
guaguguagcugcagcga

SEQ ID NO: 3221564 - RNA, 18 nt, Mycobacterium leprae
guagugucaaucuacacu

SEQ ID NO: 3221565 - RNA, 23 nt, Mycobacterium leprae
guaguuccgcgcugaauggucau

SEQ ID NO: 3221566 - RNA, 13 nt, Mycobacterium leprae
guaguuguacacg

SEQ ID NO: 3221567 - RNA, 17 nt, Mycobacterium leprae
guaguuguuagcgccgc

SEQ ID NO: 3221568 - RNA, 16 nt, Mycobacterium leprae
guauaauuugaagcug

SEQ ID NO: 3221569 - RNA, 17 nt, Mycobacterium leprae
guauagcgaaaauaacu

SEQ ID NO: 3221570 - RNA, 15 nt, Mycobacterium leprae
guauaucggacacga

SEQ ID NO: 3221571 - RNA, 12 nt, Mycobacterium leprae
guaucacgaugu

SEQ ID NO: 3221572 - RNA, 13 nt, Mycobacterium leprae
guauccaagguga

SEQ ID NO: 3221573 - RNA, 18 nt, Mycobacterium leprae
guauccggaggcggccac

SEQ ID NO: 3221574 - RNA, 13 nt, Mycobacterium leprae
guaucgaccagcc

SEQ ID NO: 3221575 - RNA, 20 nt, Mycobacterium leprae
guaucgaugccguggugaug

SEQ ID NO: 3221576 - RNA, 16 nt, Mycobacterium leprae
guaucggcauauccgc

SEQ ID NO: 3221577 - RNA, 23 nt, Mycobacterium leprae
guaucucgcauauggccgaaccu

SEQ ID NO: 3221578 - RNA, 14 nt, Mycobacterium leprae
guaugugccgccga

SEQ ID NO: 3221579 - RNA, 15 nt, Mycobacterium leprae
guauguguuuuguug

SEQ ID NO: 3221580 - RNA, 13 nt, Mycobacterium leprae
guauucuugauug

SEQ ID NO: 3221581 - RNA, 19 nt, Mycobacterium leprae
guauuggacccgaucgacg

SEQ ID NO: 3221582 - RNA, 14 nt, Mycobacterium leprae
guauugguugccga

SEQ ID NO: 3221583 - RNA, 18 nt, Mycobacterium leprae
guauuuuauuugcgucgu

SEQ ID NO: 3221584 - RNA, 13 nt, Mycobacterium leprae
gucaaaggcuguc

SEQ ID NO: 3221585 - RNA, 13 nt, Mycobacterium leprae
gucgagcagccac

SEQ ID NO: 3221586 - RNA, 15 nt, Mycobacterium leprae
gucgagccuguccgg

SEQ ID NO: 3221587 - RNA, 15 nt, Mycobacterium leprae
gucgagcuggcugug

SEQ ID NO: 3221588 - RNA, 16 nt, Mycobacterium leprae
gucgagcuggcugugc

SEQ ID NO: 3221589 - RNA, 13 nt, Mycobacterium leprae
gucgagcuucggu

SEQ ID NO: 3221590 - RNA, 16 nt, Mycobacterium leprae
gucgaggaccgccaug

SEQ ID NO: 3221591 - RNA, 17 nt, Mycobacterium leprae
gucgagggcucagugua

SEQ ID NO: 3221592 - RNA, 14 nt, Mycobacterium leprae
gucgaggugccgcg

SEQ ID NO: 3221593 - RNA, 19 nt, Mycobacterium leprae
gucgauagaaaucacggag

SEQ ID NO: 3221594 - RNA, 16 nt, Mycobacterium leprae
gucgauauccccgacg

SEQ ID NO: 3221595 - RNA, 20 nt, Mycobacterium leprae
gucgaucagggcgcccccca

SEQ ID NO: 3221596 - RNA, 16 nt, Mycobacterium leprae
gucgaucgcuggucag

SEQ ID NO: 3221597 - RNA, 16 nt, Mycobacterium leprae
gucgaugaugcgcugu

SEQ ID NO: 3221598 - RNA, 18 nt, Mycobacterium leprae
gucgauguugguguggcg

SEQ ID NO: 3221599 - RNA, 15 nt, Mycobacterium leprae
gucgauucaccgauc

SEQ ID NO: 3221600 - RNA, 23 nt, Mycobacterium leprae
gucgcagagguaaaucuggcaag

SEQ ID NO: 3221601 - RNA, 15 nt, Mycobacterium leprae
gucgcagguucugca

SEQ ID NO: 3221602 - RNA, 19 nt, Mycobacterium leprae
gucgccagagccggcgggu

SEQ ID NO: 3221603 - RNA, 22 nt, Mycobacterium leprae
gucgccaguaugugaugcagcu

SEQ ID NO: 3221604 - RNA, 13 nt, Mycobacterium leprae
gucgcccgacggc

SEQ ID NO: 3221605 - RNA, 12 nt, Mycobacterium leprae
gucgccgguagc

SEQ ID NO: 3221606 - RNA, 15 nt, Mycobacterium leprae
gucgcgccugcgcag

SEQ ID NO: 3221607 - RNA, 16 nt, Mycobacterium leprae
gucgcgcgauacccgc

SEQ ID NO: 3221608 - RNA, 17 nt, Mycobacterium leprae
gucgcgggccuggauua

SEQ ID NO: 3221609 - RNA, 16 nt, Mycobacterium leprae
gucgcgggguuggcca

SEQ ID NO: 3221610 - RNA, 14 nt, Mycobacterium leprae
gucgcgguagcgca

SEQ ID NO: 3221611 - RNA, 20 nt, Mycobacterium leprae
gucgcgucggguuaugcagu

SEQ ID NO: 3221612 - RNA, 19 nt, Mycobacterium leprae
gucgcguuaacguucuacc

SEQ ID NO: 3221613 - RNA, 16 nt, Mycobacterium leprae
gucgcguugaggacga

SEQ ID NO: 3221614 - RNA, 17 nt, Mycobacterium leprae
gucgcugcuacccacug

SEQ ID NO: 3221615 - RNA, 22 nt, Mycobacterium leprae
gucgcugcuacccacugguggu

SEQ ID NO: 3221616 - RNA, 13 nt, Mycobacterium leprae
gucgcugugccaa

SEQ ID NO: 3221617 - RNA, 14 nt, Mycobacterium leprae
gucgcuguuggugu

SEQ ID NO: 3221618 - RNA, 17 nt, Mycobacterium leprae
gucgcuguuugccgagu

SEQ ID NO: 3221619 - RNA, 14 nt, Mycobacterium leprae
gucgcuugaugccu

SEQ ID NO: 3221620 - RNA, 16 nt, Mycobacterium leprae
gucggaaccgcagcug

SEQ ID NO: 3221621 - RNA, 12 nt, Mycobacterium leprae
gucggacgucga

SEQ ID NO: 3221622 - RNA, 14 nt, Mycobacterium leprae
gucggacgucgaca

SEQ ID NO: 3221623 - RNA, 13 nt, Mycobacterium leprae
gucggauccccuc

SEQ ID NO: 3221624 - RNA, 16 nt, Mycobacterium leprae
gucggcagcugguugu

SEQ ID NO: 3221625 - RNA, 19 nt, Mycobacterium leprae
gucggcaugugcauccagu

SEQ ID NO: 3221626 - RNA, 12 nt, Mycobacterium leprae
gucggccaggcu

SEQ ID NO: 3221627 - RNA, 18 nt, Mycobacterium leprae
gucggcccagggaugcug

SEQ ID NO: 3221628 - RNA, 13 nt, Mycobacterium leprae
gucggccccccgg

SEQ ID NO: 3221629 - RNA, 19 nt, Mycobacterium leprae
gucggccgaucauggcugg

SEQ ID NO: 3221630 - RNA, 18 nt, Mycobacterium leprae
gucggcgauaacggcguc

SEQ ID NO: 3221631 - RNA, 20 nt, Mycobacterium leprae
gucggcguugagcgcagcca

SEQ ID NO: 3221632 - RNA, 13 nt, Mycobacterium leprae
gucgggcaccugg

SEQ ID NO: 3221633 - RNA, 16 nt, Mycobacterium leprae
gucgggcuuggccucg

SEQ ID NO: 3221634 - RNA, 12 nt, Mycobacterium leprae
gucggucugccu

SEQ ID NO: 3221635 - RNA, 13 nt, Mycobacterium leprae
gucggugccgcca

SEQ ID NO: 3221636 - RNA, 11 nt, Mycobacterium leprae
gucgguggugg

SEQ ID NO: 3221637 - RNA, 17 nt, Mycobacterium leprae
gucgguguuguuuggca

SEQ ID NO: 3221638 - RNA, 17 nt, Mycobacterium leprae
gucgguuguuguggugu

SEQ ID NO: 3221639 - RNA, 17 nt, Mycobacterium leprae
gucguaaaacaccuagu

SEQ ID NO: 3221640 - RNA, 23 nt, Mycobacterium leprae
gucguacggcgacucaucgccaa

SEQ ID NO: 3221641 - RNA, 16 nt, Mycobacterium leprae
gucguacucuggcugg

SEQ ID NO: 3221642 - RNA, 18 nt, Mycobacterium leprae
gucguccgguggucgcga

SEQ ID NO: 3221643 - RNA, 13 nt, Mycobacterium leprae
gucgucgcugcuu

SEQ ID NO: 3221644 - RNA, 14 nt, Mycobacterium leprae
gucgucgucaucgu

SEQ ID NO: 3221645 - RNA, 14 nt, Mycobacterium leprae
gucgugaaucaugc

SEQ ID NO: 3221646 - RNA, 18 nt, Mycobacterium leprae
gucgugauggucauuugg

SEQ ID NO: 3221647 - RNA, 22 nt, Mycobacterium leprae
gucgugcaauuugucacgaauc

SEQ ID NO: 3221648 - RNA, 22 nt, Mycobacterium leprae
gucgugcacuaacgugcagcug

SEQ ID NO: 3221649 - RNA, 23 nt, Mycobacterium leprae
gucgugcccagaugaauucgcug

SEQ ID NO: 3221650 - RNA, 21 nt, Mycobacterium leprae
gucguguuugugucuguggcg

SEQ ID NO: 3221651 - RNA, 14 nt, Mycobacterium leprae
gucguuagcgccga

SEQ ID NO: 3221652 - RNA, 13 nt, Mycobacterium leprae
gucguuccagcuu

SEQ ID NO: 3221653 - RNA, 17 nt, Mycobacterium leprae
gucuagauaagauaaau

SEQ ID NO: 3221654 - RNA, 15 nt, Mycobacterium leprae
gucuaucccggcucc

SEQ ID NO: 3221655 - RNA, 20 nt, Mycobacterium leprae
gucuauuuugucagaucuca

SEQ ID NO: 3221656 - RNA, 15 nt, Mycobacterium leprae
gucucacccaccuug

SEQ ID NO: 3221657 - RNA, 16 nt, Mycobacterium leprae
gucucccacaaguugu

SEQ ID NO: 3221658 - RNA, 17 nt, Mycobacterium leprae
gucuccgccguuuuacc

SEQ ID NO: 3221659 - RNA, 21 nt, Mycobacterium leprae
gucucgacggauuucucgugg

SEQ ID NO: 3221660 - RNA, 15 nt, Mycobacterium leprae
gucucguugccgggg

SEQ ID NO: 3221661 - RNA, 17 nt, Mycobacterium leprae
gucucucaggccgucgu

SEQ ID NO: 3221662 - RNA, 16 nt, Mycobacterium leprae
gucucugugcgacauc

SEQ ID NO: 3221663 - RNA, 19 nt, Mycobacterium leprae
gucucuucgcuguuggugu

SEQ ID NO: 3221664 - RNA, 21 nt, Mycobacterium leprae
gucugaaccaggggucggcgu

SEQ ID NO: 3221665 - RNA, 19 nt, Mycobacterium leprae
gucugaaucggcaaaugcc

SEQ ID NO: 3221666 - RNA, 21 nt, Mycobacterium leprae
gucugaaugggccgaucgcag

SEQ ID NO: 3221667 - RNA, 17 nt, Mycobacterium leprae
gucugcggauuuugccc

SEQ ID NO: 3221668 - RNA, 18 nt, Mycobacterium leprae
gucugcggugcugagcaa

SEQ ID NO: 3221669 - RNA, 17 nt, Mycobacterium leprae
gucuggcggcccacaag

SEQ ID NO: 3221670 - RNA, 16 nt, Mycobacterium leprae
gucuggcggguggugu

SEQ ID NO: 3221671 - RNA, 22 nt, Mycobacterium leprae
gucuggcgggugguguacucgc

SEQ ID NO: 3221672 - RNA, 17 nt, Mycobacterium leprae
gucugggcuggccccgg

SEQ ID NO: 3221673 - RNA, 12 nt, Mycobacterium leprae
gucugguugcac

SEQ ID NO: 3221674 - RNA, 16 nt, Mycobacterium leprae
gucugucagcacaugg

SEQ ID NO: 3221675 - RNA, 18 nt, Mycobacterium leprae
gucuguggcggugaguug

SEQ ID NO: 3221676 - RNA, 16 nt, Mycobacterium leprae
gucuguuaucggugaa

SEQ ID NO: 3221677 - RNA, 12 nt, Mycobacterium leprae
gucuuagcaacg

SEQ ID NO: 3221678 - RNA, 17 nt, Mycobacterium leprae
gucuucgacgacuucga

SEQ ID NO: 3221679 - RNA, 20 nt, Mycobacterium leprae
gucuucuguaguagcccaca

SEQ ID NO: 3221680 - RNA, 17 nt, Mycobacterium leprae
gucuucuuggcgcugag

SEQ ID NO: 3221681 - RNA, 15 nt, Mycobacterium leprae
gucuuggcugacggc

SEQ ID NO: 3221682 - RNA, 17 nt, Mycobacterium leprae
gucuuugcuaacaaggc

SEQ ID NO: 3221683 - RNA, 16 nt, Mycobacterium leprae
gucuuuguuguccacg

SEQ ID NO: 3221684 - RNA, 16 nt, Mycobacterium leprae
gugaaacaagccgagg

SEQ ID NO: 3221685 - RNA, 13 nt, Mycobacterium leprae
gugaaauggcugu

SEQ ID NO: 3221686 - RNA, 20 nt, Mycobacterium leprae
gugaaauucuucucgguguu

SEQ ID NO: 3221687 - RNA, 19 nt, Mycobacterium leprae
gugaacagugcaucgauga

SEQ ID NO: 3221688 - RNA, 14 nt, Mycobacterium leprae
gugaacgccaggcg

SEQ ID NO: 3221689 - RNA, 18 nt, Mycobacterium leprae
gugaacuagccgccgggu

SEQ ID NO: 3221690 - RNA, 13 nt, Mycobacterium leprae
gugaagcagguac

SEQ ID NO: 3221691 - RNA, 14 nt, Mycobacterium leprae
gugaagcugaggcg

SEQ ID NO: 3221692 - RNA, 21 nt, Mycobacterium leprae
gugaauagcuaaagugcugcu

SEQ ID NO: 3221693 - RNA, 19 nt, Mycobacterium leprae
gugaaucaugccgcagcau

SEQ ID NO: 3221694 - RNA, 18 nt, Mycobacterium leprae
gugaaucccgcgacggcc

SEQ ID NO: 3221695 - RNA, 16 nt, Mycobacterium leprae
gugaauuacucgucgg

SEQ ID NO: 3221696 - RNA, 16 nt, Mycobacterium leprae
gugaccaaaauuuaug

SEQ ID NO: 3221697 - RNA, 18 nt, Mycobacterium leprae
gugaccaggaucuucucu

SEQ ID NO: 3221698 - RNA, 20 nt, Mycobacterium leprae
gugaccgcggugcagugccg

SEQ ID NO: 3221699 - RNA, 14 nt, Mycobacterium leprae
guggaucuccuaag

SEQ ID NO: 3221700 - RNA, 13 nt, Mycobacterium leprae
guggcaacgcugc

SEQ ID NO: 3221701 - RNA, 13 nt, Mycobacterium leprae
guggcagcugggu

SEQ ID NO: 3221702 - RNA, 20 nt, Mycobacterium leprae
guggcaucgucuggacucgg

SEQ ID NO: 3221703 - RNA, 21 nt, Mycobacterium leprae
guggcccgacggcgcggcugc

SEQ ID NO: 3221704 - RNA, 23 nt, Mycobacterium leprae
guggcccgacggcgcggcugcuu

SEQ ID NO: 3221705 - RNA, 19 nt, Mycobacterium leprae
guggccgaggucgaggaua

SEQ ID NO: 3221706 - RNA, 14 nt, Mycobacterium leprae
guggccgcaccuga

SEQ ID NO: 3221707 - RNA, 19 nt, Mycobacterium leprae
guggccgcaccugaacagg

SEQ ID NO: 3221708 - RNA, 22 nt, Mycobacterium leprae
guggccuagucgggcagaucuu

SEQ ID NO: 3221709 - RNA, 20 nt, Mycobacterium leprae
guggcgagugcugacgccgg

SEQ ID NO: 3221710 - RNA, 19 nt, Mycobacterium leprae
guggcgauacgcgcuugcc

SEQ ID NO: 3221711 - RNA, 12 nt, Mycobacterium leprae
guggcgaucggc

SEQ ID NO: 3221712 - RNA, 21 nt, Mycobacterium leprae
guggcggagcgcggagcuggu

SEQ ID NO: 3221713 - RNA, 21 nt, Mycobacterium leprae
guggcuaccgguacgcugcau

SEQ ID NO: 3221714 - RNA, 21 nt, Mycobacterium leprae
guggcuaggccagugucggug

SEQ ID NO: 3221715 - RNA, 17 nt, Mycobacterium leprae
guggcugcaaucaauca

SEQ ID NO: 3221716 - RNA, 17 nt, Mycobacterium leprae
guggcuuugggaucuuu

SEQ ID NO: 3221717 - RNA, 14 nt, Mycobacterium leprae
gugggcagccugga

SEQ ID NO: 3221718 - RNA, 17 nt, Mycobacterium leprae
gugggcagccuggacgg

SEQ ID NO: 3221719 - RNA, 17 nt, Mycobacterium leprae
gugggccccugcggcua

SEQ ID NO: 3221720 - RNA, 12 nt, Mycobacterium leprae
gugggcggcggc

SEQ ID NO: 3221721 - RNA, 13 nt, Mycobacterium leprae
gugggcggcggcc

SEQ ID NO: 3221722 - RNA, 21 nt, Mycobacterium leprae
gugggcggcguuggcacggau

SEQ ID NO: 3221723 - RNA, 16 nt, Mycobacterium leprae
gugggcugguggggug

SEQ ID NO: 3221724 - RNA, 22 nt, Mycobacterium leprae
gugggcugguggggugugggug

SEQ ID NO: 3221725 - RNA, 17 nt, Mycobacterium leprae
guggggaucgugcguga

SEQ ID NO: 3221726 - RNA, 12 nt, Mycobacterium leprae
guggguggcuga

SEQ ID NO: 3221727 - RNA, 17 nt, Mycobacterium leprae
gugggugguugaucugc

SEQ ID NO: 3221728 - RNA, 23 nt, Mycobacterium leprae
guggguguuuugucggugguggg

SEQ ID NO: 3221729 - RNA, 18 nt, Mycobacterium leprae
guggguuauccccacaug

SEQ ID NO: 3221730 - RNA, 15 nt, Mycobacterium leprae
guggguuugaggcgc

SEQ ID NO: 3221731 - RNA, 15 nt, Mycobacterium leprae
gugguacaaucccac

SEQ ID NO: 3221732 - RNA, 21 nt, Mycobacterium leprae
gugguagggcguugucuugug

SEQ ID NO: 3221733 - RNA, 15 nt, Mycobacterium leprae
gugguaucugcaccu

SEQ ID NO: 3221734 - RNA, 19 nt, Mycobacterium leprae
guggucaauguggccgcac

SEQ ID NO: 3221735 - RNA, 18 nt, Mycobacterium leprae
guggucacacugguggug

SEQ ID NO: 3221736 - RNA, 18 nt, Mycobacterium leprae
guggucaccgcuguggca

SEQ ID NO: 3221737 - RNA, 12 nt, Mycobacterium leprae
guggucgaggaa

SEQ ID NO: 3221738 - RNA, 19 nt, Mycobacterium leprae
guggucgauuacucacgcg

SEQ ID NO: 3221739 - RNA, 21 nt, Mycobacterium leprae
guggucggcgaaggagcggug

SEQ ID NO: 3221740 - RNA, 16 nt, Mycobacterium leprae
guggucuccaagguua

SEQ ID NO: 3221741 - RNA, 15 nt, Mycobacterium leprae
gugguggaugcugcu

SEQ ID NO: 3221742 - RNA, 15 nt, Mycobacterium leprae
guggugggugcugcu

SEQ ID NO: 3221743 - RNA, 20 nt, Mycobacterium leprae
gugguguucauaucgcgcaa

SEQ ID NO: 3221744 - RNA, 15 nt, Mycobacterium leprae
gugguguuccaguga

SEQ ID NO: 3221745 - RNA, 19 nt, Mycobacterium leprae
gugguguucuuaggcacug

SEQ ID NO: 3221746 - RNA, 16 nt, Mycobacterium leprae
gugguguugucgccga

SEQ ID NO: 3221747 - RNA, 16 nt, Mycobacterium leprae
gugguguugugguggg

SEQ ID NO: 3221748 - RNA, 20 nt, Mycobacterium leprae
gugguuagacagugaugauc

SEQ ID NO: 3221749 - RNA, 22 nt, Mycobacterium leprae
gugguuauuuuuugcugguuug

SEQ ID NO: 3221750 - RNA, 15 nt, Mycobacterium leprae
gugguugaucauggc

SEQ ID NO: 3221751 - RNA, 19 nt, Mycobacterium leprae
gugguugaucauggccgca

SEQ ID NO: 3221752 - RNA, 23 nt, Mycobacterium leprae
gugguugaucauggccgcaguga

SEQ ID NO: 3221753 - RNA, 22 nt, Mycobacterium leprae
gugguuggauuaccggcugcgc

SEQ ID NO: 3221754 - RNA, 23 nt, Mycobacterium leprae
gugguugucggaccacucuggcu

SEQ ID NO: 3221755 - RNA, 13 nt, Mycobacterium leprae
guguaaggccagc

SEQ ID NO: 3221756 - RNA, 12 nt, Mycobacterium leprae
guguagcugagc

SEQ ID NO: 3221757 - RNA, 20 nt, Mycobacterium leprae
guguagcugcagcgacugga

SEQ ID NO: 3221758 - RNA, 17 nt, Mycobacterium leprae
guguaggugaugcuugc

SEQ ID NO: 3221759 - RNA, 11 nt, Mycobacterium leprae
gugucacccgg

SEQ ID NO: 3221760 - RNA, 16 nt, Mycobacterium leprae
gugucacccgggguga

SEQ ID NO: 3221761 - RNA, 16 nt, Mycobacterium leprae
gugucacgcgaccaac

SEQ ID NO: 3221762 - RNA, 12 nt, Mycobacterium leprae
gugucagcagca

SEQ ID NO: 3221763 - RNA, 20 nt, Mycobacterium leprae
guguccgcaaaaugcucccc

SEQ ID NO: 3221764 - RNA, 15 nt, Mycobacterium leprae
guguccgggccgcaa

SEQ ID NO: 3221765 - RNA, 11 nt, Mycobacterium leprae
gugucgaccga

SEQ ID NO: 3221766 - RNA, 20 nt, Mycobacterium leprae
gugucgaugaugcgcuguug

SEQ ID NO: 3221767 - RNA, 23 nt, Mycobacterium leprae
gugucggccccccggggcugccc

SEQ ID NO: 3221768 - RNA, 14 nt, Mycobacterium leprae
gugucgggugguca

SEQ ID NO: 3221769 - RNA, 14 nt, Mycobacterium leprae
gugucuguggcggu

SEQ ID NO: 3221770 - RNA, 15 nt, Mycobacterium leprae
gugucuguggcggug

SEQ ID NO: 3221771 - RNA, 16 nt, Mycobacterium leprae
gugucuguggcgguga

SEQ ID NO: 3221772 - RNA, 22 nt, Mycobacterium leprae
gugucuuccaguggcugcaccg

SEQ ID NO: 3221773 - RNA, 21 nt, Mycobacterium leprae
gugugagcuaugcuagacagc

SEQ ID NO: 3221774 - RNA, 16 nt, Mycobacterium leprae
gugugaggauaguugu

SEQ ID NO: 3221775 - RNA, 13 nt, Mycobacterium leprae
gugugcacugcuu

SEQ ID NO: 3221776 - RNA, 14 nt, Mycobacterium leprae
gugugcucgcugcu

SEQ ID NO: 3221777 - RNA, 22 nt, Mycobacterium leprae
guguggcaccggguauugaacg

SEQ ID NO: 3221778 - RNA, 19 nt, Mycobacterium leprae
gugugggacgugaugcagc

SEQ ID NO: 3221779 - RNA, 20 nt, Mycobacterium leprae
guguggggguccgcgcacgg

SEQ ID NO: 3221780 - RNA, 13 nt, Mycobacterium leprae
gugugggugguug

SEQ ID NO: 3221781 - RNA, 19 nt, Mycobacterium leprae
guguguccuuaacugacug

SEQ ID NO: 3221782 - RNA, 12 nt, Mycobacterium leprae
guguguugcagu

SEQ ID NO: 3221783 - RNA, 18 nt, Mycobacterium leprae
guguguuuuucugcacgg

SEQ ID NO: 3221784 - RNA, 15 nt, Mycobacterium leprae
guguuagugaacagu

SEQ ID NO: 3221785 - RNA, 17 nt, Mycobacterium leprae
guguucuacccaggccu

SEQ ID NO: 3221786 - RNA, 21 nt, Mycobacterium leprae
guguucuggcacccacgcugc

SEQ ID NO: 3221787 - RNA, 15 nt, Mycobacterium leprae
guguugaacaguacu

SEQ ID NO: 3221788 - RNA, 22 nt, Mycobacterium leprae
guguugauagcgcugguguuca

SEQ ID NO: 3221789 - RNA, 17 nt, Mycobacterium leprae
guguugcuggcgguggg

SEQ ID NO: 3221790 - RNA, 15 nt, Mycobacterium leprae
guguuguccgucagc

SEQ ID NO: 3221791 - RNA, 16 nt, Mycobacterium leprae
guguuguccgucagcc

SEQ ID NO: 3221792 - RNA, 14 nt, Mycobacterium leprae
guguugucgccgaa

SEQ ID NO: 3221793 - RNA, 12 nt, Mycobacterium leprae
guguuguggugg

SEQ ID NO: 3221794 - RNA, 22 nt, Mycobacterium leprae
guguuuaucuggugaaacugca

SEQ ID NO: 3221795 - RNA, 22 nt, Mycobacterium leprae
guguuuguuauaguccgcagaa

SEQ ID NO: 3221796 - RNA, 22 nt, Mycobacterium leprae
guuaagagaaguagagaaaaau

SEQ ID NO: 3221797 - RNA, 17 nt, Mycobacterium leprae
guuaauauauuccaggu

SEQ ID NO: 3221798 - RNA, 21 nt, Mycobacterium leprae
guuacaauaguaaguggccaa

SEQ ID NO: 3221799 - RNA, 12 nt, Mycobacterium leprae
guuacaucacag

SEQ ID NO: 3221800 - RNA, 13 nt, Mycobacterium leprae
guuaccagcgcca

SEQ ID NO: 3221801 - RNA, 21 nt, Mycobacterium leprae
guuaccagcgccagaccugcc

SEQ ID NO: 3221802 - RNA, 18 nt, Mycobacterium leprae
guuaccggcgaagacgcc

SEQ ID NO: 3221803 - RNA, 21 nt, Mycobacterium leprae
guuaccggcgucuggcuggcc

SEQ ID NO: 3221804 - RNA, 16 nt, Mycobacterium leprae
guuacguccgcggcag

SEQ ID NO: 3221805 - RNA, 12 nt, Mycobacterium leprae
guuacugccaca

SEQ ID NO: 3221806 - RNA, 15 nt, Mycobacterium leprae
guuacugguggcaag

SEQ ID NO: 3221807 - RNA, 17 nt, Mycobacterium leprae
guuacugucggugccgc

SEQ ID NO: 3221808 - RNA, 17 nt, Mycobacterium leprae
guuagagcaccacacgg

SEQ ID NO: 3221809 - RNA, 16 nt, Mycobacterium leprae
guuagagugacaucgc

SEQ ID NO: 3221810 - RNA, 23 nt, Mycobacterium leprae
guuagcaacuggccugaaggcua

SEQ ID NO: 3221811 - RNA, 19 nt, Mycobacterium leprae
guuagccguuauggcgcug

SEQ ID NO: 3221812 - RNA, 18 nt, Mycobacterium leprae
guuuucagccacauugcc

SEQ ID NO: 3221813 - RNA, 15 nt, Mycobacterium leprae
guuuucucgcagggg

SEQ ID NO: 3221814 - RNA, 18 nt, Mycobacterium leprae
guuuugugggcaggucag

SEQ ID NO: 3221815 - RNA, 20 nt, Mycobacterium leprae
guuuuuggaccccaaccaga

SEQ ID NO: 3221816 - RNA, 21 nt, Mycobacterium leprae
uaaaaccgguuugauccagcc

SEQ ID NO: 3221817 - RNA, 16 nt, Mycobacterium leprae
uaaaacgaaaaucucu

SEQ ID NO: 3221818 - RNA, 18 nt, Mycobacterium leprae
uaaaauucaugccgcgca

SEQ ID NO: 3221819 - RNA, 17 nt, Mycobacterium leprae
uaaaauuuaaaaauuug

SEQ ID NO: 3221820 - RNA, 19 nt, Mycobacterium leprae
uaaacaaaaguguaaccaa

SEQ ID NO: 3221821 - RNA, 22 nt, Mycobacterium leprae
uaaacgaacuucagaagcacga

SEQ ID NO: 3221822 - RNA, 14 nt, Mycobacterium leprae
uaaacgugaugcua

SEQ ID NO: 3221823 - RNA, 20 nt, Mycobacterium leprae
uaaaguaaagcaugcgccuc

SEQ ID NO: 3221824 - RNA, 13 nt, Mycobacterium leprae
uaaagucuucaau

SEQ ID NO: 3221825 - RNA, 15 nt, Mycobacterium leprae
uaaagugcugcugug

SEQ ID NO: 3221826 - RNA, 17 nt, Mycobacterium leprae
uaaaguuauaaguuaua

SEQ ID NO: 3221827 - RNA, 11 nt, Mycobacterium leprae
uaaauauuaau

SEQ ID NO: 3221828 - RNA, 15 nt, Mycobacterium leprae
uaaauccuagaaaau

SEQ ID NO: 3221829 - RNA, 17 nt, Mycobacterium leprae
uaaaucggcaugaugug

SEQ ID NO: 3221830 - RNA, 22 nt, Mycobacterium leprae
uaaaucucgggcagcugcaaca

SEQ ID NO: 3221831 - RNA, 13 nt, Mycobacterium leprae
uaaaugccucgcu

SEQ ID NO: 3221832 - RNA, 14 nt, Mycobacterium leprae
uaaauggacaaaug

SEQ ID NO: 3221833 - RNA, 11 nt, Mycobacterium leprae
uaacaaaucau

SEQ ID NO: 3221834 - RNA, 14 nt, Mycobacterium leprae
uaacaacuugacga

SEQ ID NO: 3221835 - RNA, 16 nt, Mycobacterium leprae
uaacacgauacugcug

SEQ ID NO: 3221836 - RNA, 21 nt, Mycobacterium leprae
uaacacucauuggacccagcc

SEQ ID NO: 3221837 - RNA, 16 nt, Mycobacterium leprae
uaacagagugcaccac

SEQ ID NO: 3221838 - RNA, 14 nt, Mycobacterium leprae
uaacagauuauugc

SEQ ID NO: 3221839 - RNA, 23 nt, Mycobacterium leprae
uaaccaacgcccccgcaagugcg

SEQ ID NO: 3221840 - RNA, 19 nt, Mycobacterium leprae
uaaccgggaaauacggcac

SEQ ID NO: 3221841 - RNA, 22 nt, Mycobacterium leprae
uaaccuucugcgaacacugagu

SEQ ID NO: 3221842 - RNA, 12 nt, Mycobacterium leprae
uaaccuugccgg

SEQ ID NO: 3221843 - RNA, 15 nt, Mycobacterium leprae
uaacgacaucgcagg

SEQ ID NO: 3221844 - RNA, 17 nt, Mycobacterium leprae
uaacgcugaccagcaga

SEQ ID NO: 3221845 - RNA, 22 nt, Mycobacterium leprae
uaacgcuggucggauggccaua

SEQ ID NO: 3221846 - RNA, 13 nt, Mycobacterium leprae
uaacggcgguggc

SEQ ID NO: 3221847 - RNA, 21 nt, Mycobacterium leprae
uaacgguauauuaaccguagu

SEQ ID NO: 3221848 - RNA, 14 nt, Mycobacterium leprae
uaacgugcagcugg

SEQ ID NO: 3221849 - RNA, 16 nt, Mycobacterium leprae
uaacgugcagcuggcc

SEQ ID NO: 3221850 - RNA, 17 nt, Mycobacterium leprae
uaacuacuggauuaaua

SEQ ID NO: 3221851 - RNA, 18 nt, Mycobacterium leprae
uaacuacuggauuaauau

SEQ ID NO: 3221852 - RNA, 19 nt, Mycobacterium leprae
uaacuacuggauuaauauu

SEQ ID NO: 3221853 - RNA, 17 nt, Mycobacterium leprae
uaacuauugugccacaa

SEQ ID NO: 3221854 - RNA, 20 nt, Mycobacterium leprae
uaacucuuucccuauaaccc

SEQ ID NO: 3221855 - RNA, 21 nt, Mycobacterium leprae
uaacugccuaucugcccagag

SEQ ID NO: 3221856 - RNA, 12 nt, Mycobacterium leprae
uaacuuguccgu

SEQ ID NO: 3221857 - RNA, 13 nt, Mycobacterium leprae
uaagaaagaauuu

SEQ ID NO: 3221858 - RNA, 12 nt, Mycobacterium leprae
uaagaagcugcc

SEQ ID NO: 3221859 - RNA, 16 nt, Mycobacterium leprae
uaagaagcugcccuac

SEQ ID NO: 3221860 - RNA, 17 nt, Mycobacterium leprae
uaagagaaguagagaaa

SEQ ID NO: 3221861 - RNA, 14 nt, Mycobacterium leprae
uaagcagcagcgga

SEQ ID NO: 3221862 - RNA, 17 nt, Mycobacterium leprae
uaagcaggcucagcaga

SEQ ID NO: 3221863 - RNA, 15 nt, Mycobacterium leprae
uaagcuugcagucuu

SEQ ID NO: 3221864 - RNA, 14 nt, Mycobacterium leprae
uaaggucccccgcu

SEQ ID NO: 3221865 - RNA, 13 nt, Mycobacterium leprae
uaaguccacaccu

SEQ ID NO: 3221866 - RNA, 16 nt, Mycobacterium leprae
uaaguuuucucuaaaa

SEQ ID NO: 3221867 - RNA, 19 nt, Mycobacterium leprae
uaaguuuucucuaaaagaa

SEQ ID NO: 3221868 - RNA, 11 nt, Mycobacterium leprae
uaauaauaucc

SEQ ID NO: 3221869 - RNA, 16 nt, Mycobacterium leprae
uaauaauauccaaaga

SEQ ID NO: 3221870 - RNA, 20 nt, Mycobacterium leprae
uaauauaccguuaauauacg

SEQ ID NO: 3221871 - RNA, 15 nt, Mycobacterium leprae
uaaucaagaucggcc

SEQ ID NO: 3221872 - RNA, 17 nt, Mycobacterium leprae
uaaucaguaaucgacgc

SEQ ID NO: 3221873 - RNA, 15 nt, Mycobacterium leprae
uaauccguauugguu

SEQ ID NO: 3221874 - RNA, 18 nt, Mycobacterium leprae
uaaucgcgggcaagcccu

SEQ ID NO: 3221875 - RNA, 14 nt, Mycobacterium leprae
uaaucguaccaaca

SEQ ID NO: 3221876 - RNA, 16 nt, Mycobacterium leprae
uaaucguguccacugc

SEQ ID NO: 3221877 - RNA, 13 nt, Mycobacterium leprae
uaaugcaagcgcu

SEQ ID NO: 3221878 - RNA, 16 nt, Mycobacterium leprae
uaauggcgggcuggag

SEQ ID NO: 3221879 - RNA, 18 nt, Mycobacterium leprae
uaauggcgggcuggagga

SEQ ID NO: 3221880 - RNA, 21 nt, Mycobacterium leprae
uaaugucggcgcgacugcagu

SEQ ID NO: 3221881 - RNA, 14 nt, Mycobacterium leprae
uaauucuucucuaa

SEQ ID NO: 3221882 - RNA, 22 nt, Mycobacterium leprae
uacaaagucugcuuccaaguaa

SEQ ID NO: 3221883 - RNA, 15 nt, Mycobacterium leprae
uacaacaaaguuaua

SEQ ID NO: 3221884 - RNA, 21 nt, Mycobacterium leprae
uacaacggaccacuauuucaa

SEQ ID NO: 3221885 - RNA, 17 nt, Mycobacterium leprae
uacaacgggaucgacaa

SEQ ID NO: 3221886 - RNA, 17 nt, Mycobacterium leprae
uacaacuucaaccaagc

SEQ ID NO: 3221887 - RNA, 18 nt, Mycobacterium leprae
uacaacuucaaccaagcc

SEQ ID NO: 3221888 - RNA, 16 nt, Mycobacterium leprae
uacaaucccaccaccc

SEQ ID NO: 3221889 - RNA, 17 nt, Mycobacterium leprae
uacaaucgcggcacaug

SEQ ID NO: 3221890 - RNA, 23 nt, Mycobacterium leprae
uacacccgauccggggccggcua

SEQ ID NO: 3221891 - RNA, 18 nt, Mycobacterium leprae
uacaccuuggccgccggc

SEQ ID NO: 3221892 - RNA, 16 nt, Mycobacterium leprae
uacacgguauaaaggc

SEQ ID NO: 3221893 - RNA, 13 nt, Mycobacterium leprae
uacacuauuuccc

SEQ ID NO: 3221894 - RNA, 12 nt, Mycobacterium leprae
uacagccgaggg

SEQ ID NO: 3221895 - RNA, 23 nt, Mycobacterium leprae
uacagccgaggguacucggaagg

SEQ ID NO: 3221896 - RNA, 14 nt, Mycobacterium leprae
uacagcgugaacca

SEQ ID NO: 3221897 - RNA, 15 nt, Mycobacterium leprae
uacaggcgugugcua

SEQ ID NO: 3221898 - RNA, 18 nt, Mycobacterium leprae
uacaguguuuggcuuguc

SEQ ID NO: 3221899 - RNA, 20 nt, Mycobacterium leprae
uacauccaggauagccgauu

SEQ ID NO: 3221900 - RNA, 23 nt, Mycobacterium leprae
uacaugcuggcaguggcaacuga

SEQ ID NO: 3221901 - RNA, 15 nt, Mycobacterium leprae
uacauucaggugcua

SEQ ID NO: 3221902 - RNA, 21 nt, Mycobacterium leprae
uaccaagccggugccaggcag

SEQ ID NO: 3221903 - RNA, 13 nt, Mycobacterium leprae
uaccagccagacc

SEQ ID NO: 3221904 - RNA, 18 nt, Mycobacterium leprae
uaccagggucggccgggc

SEQ ID NO: 3221905 - RNA, 22 nt, Mycobacterium leprae
uaccauccauuuauuccagagc

SEQ ID NO: 3221906 - RNA, 23 nt, Mycobacterium leprae
uaccauccauuuauuccagagca

SEQ ID NO: 3221907 - RNA, 23 nt, Mycobacterium leprae
uaccaucuaacccgcaaaccaaa

SEQ ID NO: 3221908 - RNA, 18 nt, Mycobacterium leprae
uacccacgaggaccccga

SEQ ID NO: 3221909 - RNA, 13 nt, Mycobacterium leprae
uaccccccaucug

SEQ ID NO: 3221910 - RNA, 18 nt, Mycobacterium leprae
uaccccccaucugcuugu

SEQ ID NO: 3221911 - RNA, 19 nt, Mycobacterium leprae
uaccccgagauacagccau

SEQ ID NO: 3221912 - RNA, 20 nt, Mycobacterium leprae
uaccccgagaucacaguccu

SEQ ID NO: 3221913 - RNA, 14 nt, Mycobacterium leprae
uacccgacacaaag

SEQ ID NO: 3221914 - RNA, 16 nt, Mycobacterium leprae
uacccgcggugacgcu

SEQ ID NO: 3221915 - RNA, 18 nt, Mycobacterium leprae
uacccguggucagccuag

SEQ ID NO: 3221916 - RNA, 22 nt, Mycobacterium leprae
uacccucucagcaaucugcguc

SEQ ID NO: 3221917 - RNA, 20 nt, Mycobacterium leprae
uaccgaaaacacgggcacca

SEQ ID NO: 3221918 - RNA, 17 nt, Mycobacterium leprae
uaccgaaguccaccgga

SEQ ID NO: 3221919 - RNA, 20 nt, Mycobacterium leprae
uaccgacuuggccgcaacuu

SEQ ID NO: 3221920 - RNA, 11 nt, Mycobacterium leprae
uaccgcaucgg

SEQ ID NO: 3221921 - RNA, 22 nt, Mycobacterium leprae
uaccgcggcggccaacuguugc

SEQ ID NO: 3221922 - RNA, 22 nt, Mycobacterium leprae
uaccgcgggauugcaugcaccg

SEQ ID NO: 3221923 - RNA, 18 nt, Mycobacterium leprae
uaccggcgaagacgccgc

SEQ ID NO: 3221924 - RNA, 16 nt, Mycobacterium leprae
uaccgggcucggugaa

SEQ ID NO: 3221925 - RNA, 22 nt, Mycobacterium leprae
uagugauggcggaaguucucuu

SEQ ID NO: 3221926 - RNA, 16 nt, Mycobacterium leprae
uagugguucugcuucg

SEQ ID NO: 3221927 - RNA, 16 nt, Mycobacterium leprae
uagugucaaucuacac

SEQ ID NO: 3221928 - RNA, 11 nt, Mycobacterium leprae
uaguguuccgg

SEQ ID NO: 3221929 - RNA, 22 nt, Mycobacterium leprae
uaguuaacgugccaaccuagca

SEQ ID NO: 3221930 - RNA, 14 nt, Mycobacterium leprae
uaguuacugaaucu

SEQ ID NO: 3221931 - RNA, 18 nt, Mycobacterium leprae
uaguuauaccgugcacgg

SEQ ID NO: 3221932 - RNA, 18 nt, Mycobacterium leprae
uaguuauugauggaguuu

SEQ ID NO: 3221933 - RNA, 13 nt, Mycobacterium leprae
uaguuuuuggauc

SEQ ID NO: 3221934 - RNA, 15 nt, Mycobacterium leprae
uauaaagcgucugcu

SEQ ID NO: 3221935 - RNA, 13 nt, Mycobacterium leprae
uauaacaaaucau

SEQ ID NO: 3221936 - RNA, 21 nt, Mycobacterium leprae
uauaaguucggaccgcaacug

SEQ ID NO: 3221937 - RNA, 21 nt, Mycobacterium leprae
uauaaucccacucuugacuaa

SEQ ID NO: 3221938 - RNA, 21 nt, Mycobacterium leprae
uauacugcuaucgcccaggug

SEQ ID NO: 3221939 - RNA, 20 nt, Mycobacterium leprae
uauagaugccaguuuuggug

SEQ ID NO: 3221940 - RNA, 19 nt, Mycobacterium leprae
uauagcaacagcaagcgag

SEQ ID NO: 3221941 - RNA, 22 nt, Mycobacterium leprae
uauagcgcucaacguggagaug

SEQ ID NO: 3221942 - RNA, 16 nt, Mycobacterium leprae
uauagugacuacgguu

SEQ ID NO: 3221943 - RNA, 21 nt, Mycobacterium leprae
uauagugacuacgguuaauau

SEQ ID NO: 3221944 - RNA, 15 nt, Mycobacterium leprae
uauauauauauuaau

SEQ ID NO: 3221945 - RNA, 15 nt, Mycobacterium leprae
uauauauuaauucuu

SEQ ID NO: 3221946 - RNA, 21 nt, Mycobacterium leprae
uauauauuaauucuucucuaa

SEQ ID NO: 3221947 - RNA, 22 nt, Mycobacterium leprae
uauauuaaccguagucacuaua

SEQ ID NO: 3221948 - RNA, 20 nt, Mycobacterium leprae
uauauuaacgguauauuaac

SEQ ID NO: 3221949 - RNA, 13 nt, Mycobacterium leprae
uauauucaauuuu

SEQ ID NO: 3221950 - RNA, 21 nt, Mycobacterium leprae
uaucagacguugggagcaucu

SEQ ID NO: 3221951 - RNA, 12 nt, Mycobacterium leprae
uaucaucgccaa

SEQ ID NO: 3221952 - RNA, 17 nt, Mycobacterium leprae
uauccaaagaaguuugu

SEQ ID NO: 3221953 - RNA, 19 nt, Mycobacterium leprae
uauccaguguagugucaau

SEQ ID NO: 3221954 - RNA, 17 nt, Mycobacterium leprae
uaucccgaccggcccga

SEQ ID NO: 3221955 - RNA, 14 nt, Mycobacterium leprae
uauccucacacuca

SEQ ID NO: 3221956 - RNA, 12 nt, Mycobacterium leprae
uaucgaccagcc

SEQ ID NO: 3221957 - RNA, 12 nt, Mycobacterium leprae
uaucgaugcagg

SEQ ID NO: 3221958 - RNA, 14 nt, Mycobacterium leprae
uaucgaugccgugg

SEQ ID NO: 3221959 - RNA, 19 nt, Mycobacterium leprae
uaucgaugcuaccgaacuu

SEQ ID NO: 3221960 - RNA, 20 nt, Mycobacterium leprae
uaucgaugcuaccgaacuug

SEQ ID NO: 3221961 - RNA, 24 nt, Mycobacterium leprae
uaucgcaggaucggguagcugcau

SEQ ID NO: 3221962 - RNA, 15 nt, Mycobacterium leprae
uaucgccgguggcua

SEQ ID NO: 3221963 - RNA, 17 nt, Mycobacterium leprae
uaucgcuaaggcugcug

SEQ ID NO: 3221964 - RNA, 19 nt, Mycobacterium leprae
uaucggcgauagcgcagac

SEQ ID NO: 3221965 - RNA, 14 nt, Mycobacterium leprae
uaucggugucggcg

SEQ ID NO: 3221966 - RNA, 15 nt, Mycobacterium leprae
uaucggugucggcgg

SEQ ID NO: 3221967 - RNA, 13 nt, Mycobacterium leprae
uaucucaaucacc

SEQ ID NO: 3221968 - RNA, 15 nt, Mycobacterium leprae
uaucuugaugcugug

SEQ ID NO: 3221969 - RNA, 16 nt, Mycobacterium leprae
uaucuuuuuagagaag

SEQ ID NO: 3221970 - RNA, 20 nt, Mycobacterium leprae
uaugagcaaaaauccgcugc

SEQ ID NO: 3221971 - RNA, 16 nt, Mycobacterium leprae
uaugcccagcagaugg

SEQ ID NO: 3221972 - RNA, 17 nt, Mycobacterium leprae
uaugcggccagccagga

SEQ ID NO: 3221973 - RNA, 16 nt, Mycobacterium leprae
uauguuauuuauagau

SEQ ID NO: 3221974 - RNA, 22 nt, Mycobacterium leprae
uauguucgguagucgugggggg

SEQ ID NO: 3221975 - RNA, 17 nt, Mycobacterium leprae
uauuaaguuuucucuaa

SEQ ID NO: 3221976 - RNA, 15 nt, Mycobacterium leprae
uauuaauccaguagu

SEQ ID NO: 3221977 - RNA, 18 nt, Mycobacterium leprae
uauuaauccaguaguuac

SEQ ID NO: 3221978 - RNA, 20 nt, Mycobacterium leprae
uauucaaccgguuuccucaa

SEQ ID NO: 3221979 - RNA, 22 nt, Mycobacterium leprae
uauuccggucgucaagcucaau

SEQ ID NO: 3221980 - RNA, 14 nt, Mycobacterium leprae
uauuccucuuccug

SEQ ID NO: 3221981 - RNA, 14 nt, Mycobacterium leprae
uauucggucguuag

SEQ ID NO: 3221982 - RNA, 17 nt, Mycobacterium leprae
uauucugcgguaucauc

SEQ ID NO: 3221983 - RNA, 17 nt, Mycobacterium leprae
uauucuuuuagagaaaa

SEQ ID NO: 3221984 - RNA, 19 nt, Mycobacterium leprae
uauugauggaguuuuuguu

SEQ ID NO: 3221985 - RNA, 13 nt, Mycobacterium leprae
uauugcugugucg

SEQ ID NO: 3221986 - RNA, 16 nt, Mycobacterium leprae
uauuggaauagcugug

SEQ ID NO: 3221987 - RNA, 23 nt, Mycobacterium leprae
uauuuauagaugccaguuuuggu

SEQ ID NO: 3221988 - RNA, 17 nt, Mycobacterium leprae
uauuugaugacagaauc

SEQ ID NO: 3221989 - RNA, 17 nt, Mycobacterium leprae
ucaaacgcugcgcgcag

SEQ ID NO: 3221990 - RNA, 23 nt, Mycobacterium leprae
ucaaacgucgaauucccaggauu

SEQ ID NO: 3221991 - RNA, 15 nt, Mycobacterium leprae
ucaaagcccuucacu

SEQ ID NO: 3221992 - RNA, 15 nt, Mycobacterium leprae
ucaaauucaaccgga

SEQ ID NO: 3221993 - RNA, 15 nt, Mycobacterium leprae
ucaaauucaugacgu

SEQ ID NO: 3221994 - RNA, 22 nt, Mycobacterium leprae
ucaacacccaagugacugcguu

SEQ ID NO: 3221995 - RNA, 21 nt, Mycobacterium leprae
ucaacaggaugcgugcccaua

SEQ ID NO: 3221996 - RNA, 23 nt, Mycobacterium leprae
ucaacauugccaucgaacggcgg

SEQ ID NO: 3221997 - RNA, 17 nt, Mycobacterium leprae
ucaacauuuguugaagc

SEQ ID NO: 3221998 - RNA, 15 nt, Mycobacterium leprae
ucaaccagccaaucu

SEQ ID NO: 3221999 - RNA, 18 nt, Mycobacterium leprae
ucaaccaugccgcgcgcc

SEQ ID NO: 3222000 - RNA, 16 nt, Mycobacterium leprae
ucaaccauggucucga

SEQ ID NO: 3222001 - RNA, 23 nt, Mycobacterium leprae
ucaacccgggacuugacuccucu

SEQ ID NO: 3222002 - RNA, 20 nt, Mycobacterium leprae
ucaacgagauccgagaucag

SEQ ID NO: 3222003 - RNA, 12 nt, Mycobacterium leprae
ucaacgccgcga

SEQ ID NO: 3222004 - RNA, 15 nt, Mycobacterium leprae
ucaacggcgccgaca

SEQ ID NO: 3222005 - RNA, 17 nt, Mycobacterium leprae
ucaacggcuacaacaaa

SEQ ID NO: 3222006 - RNA, 15 nt, Mycobacterium leprae
ucaacuauccagccc

SEQ ID NO: 3222007 - RNA, 21 nt, Mycobacterium leprae
ucaagacguugugacaguuca

SEQ ID NO: 3222008 - RNA, 16 nt, Mycobacterium leprae
ucaagagcgagcucga

SEQ ID NO: 3222009 - RNA, 23 nt, Mycobacterium leprae
ucaagcaauagagauagcgccuc

SEQ ID NO: 3222010 - RNA, 18 nt, Mycobacterium leprae
ucaagcacugcaguaacc

SEQ ID NO: 3222011 - RNA, 13 nt, Mycobacterium leprae
ucaagccacacgg

SEQ ID NO: 3222012 - RNA, 21 nt, Mycobacterium leprae
ucaagcugggcuugaaacccg

SEQ ID NO: 3222013 - RNA, 19 nt, Mycobacterium leprae
ucaagggauuccacugcca

SEQ ID NO: 3222014 - RNA, 21 nt, Mycobacterium leprae
ucaaucacgcccagcgcagcc

SEQ ID NO: 3222015 - RNA, 21 nt, Mycobacterium leprae
ucaaucccgaaaaccccacac

SEQ ID NO: 3222016 - RNA, 22 nt, Mycobacterium leprae
ucaauccguacugguucgcgau

SEQ ID NO: 3222017 - RNA, 19 nt, Mycobacterium leprae
ucaauucgcgaacacccug

SEQ ID NO: 3222018 - RNA, 13 nt, Mycobacterium leprae
ucaauucggcgau

SEQ ID NO: 3222019 - RNA, 15 nt, Mycobacterium leprae
ucacaaaccccucgu

SEQ ID NO: 3222020 - RNA, 22 nt, Mycobacterium leprae
ucacaaaccccucgucagguga

SEQ ID NO: 3222021 - RNA, 19 nt, Mycobacterium leprae
ucacaaccaucgcuggcua

SEQ ID NO: 3222022 - RNA, 24 nt, Mycobacterium leprae
ucacaaucacaaggagccaacgau

SEQ ID NO: 3222023 - RNA, 17 nt, Mycobacterium leprae
ucacaccuggugugcgc

SEQ ID NO: 3222024 - RNA, 20 nt, Mycobacterium leprae
ucacaccuggugugcgcgcc

SEQ ID NO: 3222025 - RNA, 14 nt, Mycobacterium leprae
ucacacggcgcgau

SEQ ID NO: 3222026 - RNA, 11 nt, Mycobacterium leprae
ucacagcagag

SEQ ID NO: 3222027 - RNA, 15 nt, Mycobacterium leprae
ucacaguaggccagc

SEQ ID NO: 3222028 - RNA, 17 nt, Mycobacterium leprae
ucacaucagugcugugg

SEQ ID NO: 3222029 - RNA, 19 nt, Mycobacterium leprae
ucacaucgauuuguaaaau

SEQ ID NO: 3222030 - RNA, 23 nt, Mycobacterium leprae
ucacaucgauuuguaaaauuccu

SEQ ID NO: 3222031 - RNA, 17 nt, Mycobacterium leprae
ucacaucucaacaugga

SEQ ID NO: 3222032 - RNA, 20 nt, Mycobacterium leprae
ucacaugucccggugcugcc

SEQ ID NO: 3222033 - RNA, 22 nt, Mycobacterium leprae
ucacaugucccggugcugccug

SEQ ID NO: 3222034 - RNA, 19 nt, Mycobacterium leprae
ucaccaaacuggacuucua

SEQ ID NO: 3222035 - RNA, 13 nt, Mycobacterium leprae
ucaccaaccggcc

SEQ ID NO: 3222036 - RNA, 19 nt, Mycobacterium leprae
ucaccaaguuggugucaac

SEQ ID NO: 3222037 - RNA, 22 nt, Mycobacterium leprae
ucaccagauuggaaaucgcucg

SEQ ID NO: 3222038 - RNA, 22 nt, Mycobacterium leprae
uccaacgugguuggcacgauga

SEQ ID NO: 3222039 - RNA, 14 nt, Mycobacterium leprae
uccaagcacgauga

SEQ ID NO: 3222040 - RNA, 16 nt, Mycobacterium leprae
uccaagccggucggga

SEQ ID NO: 3222041 - RNA, 13 nt, Mycobacterium leprae
uccaagcucaacc

SEQ ID NO: 3222042 - RNA, 15 nt, Mycobacterium leprae
uccaaguggcugcua

SEQ ID NO: 3222043 - RNA, 19 nt, Mycobacterium leprae
uccacaacgucagaagcug

SEQ ID NO: 3222044 - RNA, 16 nt, Mycobacterium leprae
uccacaggcagagcca

SEQ ID NO: 3222045 - RNA, 21 nt, Mycobacterium leprae
uccacaggcagagccaaacau

SEQ ID NO: 3222046 - RNA, 20 nt, Mycobacterium leprae
uccacaucgauguggccgca

SEQ ID NO: 3222047 - RNA, 17 nt, Mycobacterium leprae
uccaccaaggccguguc

SEQ ID NO: 3222048 - RNA, 22 nt, Mycobacterium leprae
uccaccagccgcaggcaccauu

SEQ ID NO: 3222049 - RNA, 19 nt, Mycobacterium leprae
uccaccagccggccggguc

SEQ ID NO: 3222050 - RNA, 16 nt, Mycobacterium leprae
uccaccauacagcuaa

SEQ ID NO: 3222051 - RNA, 22 nt, Mycobacterium leprae
uccacccaaggauucagccaag

SEQ ID NO: 3222052 - RNA, 14 nt, Mycobacterium leprae
uccaccgaaacgca

SEQ ID NO: 3222053 - RNA, 22 nt, Mycobacterium leprae
uccacgccgauaucgaccagcc

SEQ ID NO: 3222054 - RNA, 19 nt, Mycobacterium leprae
uccacgugucugucggcua

SEQ ID NO: 3222055 - RNA, 15 nt, Mycobacterium leprae
uccacguuacuuaug

SEQ ID NO: 3222056 - RNA, 22 nt, Mycobacterium leprae
uccacguuguccgcguggaugc

SEQ ID NO: 3222057 - RNA, 13 nt, Mycobacterium leprae
uccacucgccgcg

SEQ ID NO: 3222058 - RNA, 16 nt, Mycobacterium leprae
uccacugcagggcgag

SEQ ID NO: 3222059 - RNA, 22 nt, Mycobacterium leprae
uccacugcagggcgagcugcgc

SEQ ID NO: 3222060 - RNA, 19 nt, Mycobacterium leprae
uccacugcggcaaagcaca

SEQ ID NO: 3222061 - RNA, 17 nt, Mycobacterium leprae
uccacugucgcccgacg

SEQ ID NO: 3222062 - RNA, 22 nt, Mycobacterium leprae
uccacugucgcccgacggcguc

SEQ ID NO: 3222063 - RNA, 21 nt, Mycobacterium leprae
uccagaaaguacugaccggcu

SEQ ID NO: 3222064 - RNA, 16 nt, Mycobacterium leprae
uccagaaggggcugcg

SEQ ID NO: 3222065 - RNA, 18 nt, Mycobacterium leprae
uccagaaggggcugcggc

SEQ ID NO: 3222066 - RNA, 22 nt, Mycobacterium leprae
uccagagccgcgcgcaagucug

SEQ ID NO: 3222067 - RNA, 16 nt, Mycobacterium leprae
uccagcaaacuccuga

SEQ ID NO: 3222068 - RNA, 15 nt, Mycobacterium leprae
uccagcagaccgcua

SEQ ID NO: 3222069 - RNA, 14 nt, Mycobacterium leprae
uccagccgaacaaa

SEQ ID NO: 3222070 - RNA, 11 nt, Mycobacterium leprae
uccagggcgag

SEQ ID NO: 3222071 - RNA, 15 nt, Mycobacterium leprae
uccaguaaguggagg

SEQ ID NO: 3222072 - RNA, 22 nt, Mycobacterium leprae
uccauagagcauagaucuucuc

SEQ ID NO: 3222073 - RNA, 14 nt, Mycobacterium leprae
uccauauagcgucc

SEQ ID NO: 3222074 - RNA, 22 nt, Mycobacterium leprae
uccaucagcaccgagaauaaau

SEQ ID NO: 3222075 - RNA, 13 nt, Mycobacterium leprae
uccauccugccuc

SEQ ID NO: 3222076 - RNA, 23 nt, Mycobacterium leprae
uccaucgugaggugugaccgugc

SEQ ID NO: 3222077 - RNA, 18 nt, Mycobacterium leprae
uccaugaauuacuaccca

SEQ ID NO: 3222078 - RNA, 22 nt, Mycobacterium leprae
uccauucgccguccacuggcua

SEQ ID NO: 3222079 - RNA, 19 nt, Mycobacterium leprae
uccauucgcgauccaucag

SEQ ID NO: 3222080 - RNA, 18 nt, Mycobacterium leprae
uccauuucaaagcugccg

SEQ ID NO: 3222081 - RNA, 19 nt, Mycobacterium leprae
uccauuuuucuugaaaaau

SEQ ID NO: 3222082 - RNA, 17 nt, Mycobacterium leprae
ucccaaccgcgacgcca

SEQ ID NO: 3222083 - RNA, 21 nt, Mycobacterium leprae
ucccaaccgcgacgccaggcg

SEQ ID NO: 3222084 - RNA, 22 nt, Mycobacterium leprae
ucccaauccuggaugugugcac

SEQ ID NO: 3222085 - RNA, 18 nt, Mycobacterium leprae
ucccagaaucgucggcua

SEQ ID NO: 3222086 - RNA, 10 nt, Mycobacterium leprae
ucccagagcu

SEQ ID NO: 3222087 - RNA, 15 nt, Mycobacterium leprae
ucccagugagugcau

SEQ ID NO: 3222088 - RNA, 17 nt, Mycobacterium leprae
ucccaucggcggccagc

SEQ ID NO: 3222089 - RNA, 17 nt, Mycobacterium leprae
ucccaucggcugcaccg

SEQ ID NO: 3222090 - RNA, 19 nt, Mycobacterium leprae
ucccaugucucuuggucga

SEQ ID NO: 3222091 - RNA, 15 nt, Mycobacterium leprae
uccccggugucaccc

SEQ ID NO: 3222092 - RNA, 17 nt, Mycobacterium leprae
uccccggugucacccgg

SEQ ID NO: 3222093 - RNA, 21 nt, Mycobacterium leprae
uccccgucggggaagacguaa

SEQ ID NO: 3222094 - RNA, 18 nt, Mycobacterium leprae
ucccgaaagccaccauau

SEQ ID NO: 3222095 - RNA, 21 nt, Mycobacterium leprae
ucccgcagccgcguccagaca

SEQ ID NO: 3222096 - RNA, 16 nt, Mycobacterium leprae
ucccgcgacggccggc

SEQ ID NO: 3222097 - RNA, 15 nt, Mycobacterium leprae
ucccgcugagcaauu

SEQ ID NO: 3222098 - RNA, 15 nt, Mycobacterium leprae
ucccggcggccaauu

SEQ ID NO: 3222099 - RNA, 18 nt, Mycobacterium leprae
ucccggugcugccugcgg

SEQ ID NO: 3222100 - RNA, 14 nt, Mycobacterium leprae
ucccggugugcccu

SEQ ID NO: 3222101 - RNA, 16 nt, Mycobacterium leprae
ucccugauccuucuuu

SEQ ID NO: 3222102 - RNA, 21 nt, Mycobacterium leprae
uccgaaacccgaaaccaagcc

SEQ ID NO: 3222103 - RNA, 12 nt, Mycobacterium leprae
uccgaagcagcc

SEQ ID NO: 3222104 - RNA, 23 nt, Mycobacterium leprae
uccgacggcuggcugcugcagac

SEQ ID NO: 3222105 - RNA, 18 nt, Mycobacterium leprae
uccgacggcuucaucagu

SEQ ID NO: 3222106 - RNA, 23 nt, Mycobacterium leprae
uccgagcgcccgcacagcaccau

SEQ ID NO: 3222107 - RNA, 19 nt, Mycobacterium leprae
uccgaucaauggcagccac

SEQ ID NO: 3222108 - RNA, 19 nt, Mycobacterium leprae
uccgaucgcaccggcugca

SEQ ID NO: 3222109 - RNA, 19 nt, Mycobacterium leprae
uccgauuaagcugaucuac

SEQ ID NO: 3222110 - RNA, 16 nt, Mycobacterium leprae
uccgcaaaaugcuccc

SEQ ID NO: 3222111 - RNA, 18 nt, Mycobacterium leprae
uccgcaaaaugcuccccc

SEQ ID NO: 3222112 - RNA, 14 nt, Mycobacterium leprae
uccgcaaaguuaug

SEQ ID NO: 3222113 - RNA, 14 nt, Mycobacterium leprae
uccgcaagaugccc

SEQ ID NO: 3222114 - RNA, 19 nt, Mycobacterium leprae
uccgcagaaugugcucuga

SEQ ID NO: 3222115 - RNA, 20 nt, Mycobacterium leprae
uccgcaggacaaagucagcu

SEQ ID NO: 3222116 - RNA, 13 nt, Mycobacterium leprae
uccgccgacgaug

SEQ ID NO: 3222117 - RNA, 17 nt, Mycobacterium leprae
uccgccgacgaugcgug

SEQ ID NO: 3222118 - RNA, 16 nt, Mycobacterium leprae
uccgccggccgcaccc

SEQ ID NO: 3222119 - RNA, 17 nt, Mycobacterium leprae
uccgccguucucccgcc

SEQ ID NO: 3222120 - RNA, 17 nt, Mycobacterium leprae
uccgcgccccuuccuga

SEQ ID NO: 3222121 - RNA, 22 nt, Mycobacterium leprae
uccgcgccggcgucggccagua

SEQ ID NO: 3222122 - RNA, 14 nt, Mycobacterium leprae
uccgcggcagcugc

SEQ ID NO: 3222123 - RNA, 16 nt, Mycobacterium leprae
uccgcggcagcugcug

SEQ ID NO: 3222124 - RNA, 19 nt, Mycobacterium leprae
uccgcggcggccccuuuca

SEQ ID NO: 3222125 - RNA, 16 nt, Mycobacterium leprae
uccgcgggagcggugc

SEQ ID NO: 3222126 - RNA, 18 nt, Mycobacterium leprae
uccgcguaggcgcacgcu

SEQ ID NO: 3222127 - RNA, 13 nt, Mycobacterium leprae
uccgcgugugccg

SEQ ID NO: 3222128 - RNA, 14 nt, Mycobacterium leprae
uccgcugcaauucg

SEQ ID NO: 3222129 - RNA, 22 nt, Mycobacterium leprae
uccggaaagaucgcccaccgca

SEQ ID NO: 3222130 - RNA, 15 nt, Mycobacterium leprae
uccggaaauacggca

SEQ ID NO: 3222131 - RNA, 22 nt, Mycobacterium leprae
uccggcaccaauguugcccgca

SEQ ID NO: 3222132 - RNA, 15 nt, Mycobacterium leprae
uccggccuauuggga

SEQ ID NO: 3222133 - RNA, 14 nt, Mycobacterium leprae
uccggcgccagccu

SEQ ID NO: 3222134 - RNA, 22 nt, Mycobacterium leprae
uccggcguuaaacgcgaucgga

SEQ ID NO: 3222135 - RNA, 14 nt, Mycobacterium leprae
uccgggccagucgg

SEQ ID NO: 3222136 - RNA, 18 nt, Mycobacterium leprae
uccgggcgcucagcggcc

SEQ ID NO: 3222137 - RNA, 18 nt, Mycobacterium leprae
uccggugcccuagaacaa

SEQ ID NO: 3222138 - RNA, 15 nt, Mycobacterium leprae
uccguccagcuggcc

SEQ ID NO: 3222139 - RNA, 20 nt, Mycobacterium leprae
uccgucggacugucaaccau

SEQ ID NO: 3222140 - RNA, 22 nt, Mycobacterium leprae
uccgugaucggcaucugguagc

SEQ ID NO: 3222141 - RNA, 15 nt, Mycobacterium leprae
uccguugccaucggu

SEQ ID NO: 3222142 - RNA, 19 nt, Mycobacterium leprae
uccguugucccgcccggcc

SEQ ID NO: 3222143 - RNA, 19 nt, Mycobacterium leprae
uccguuuuucaccuccacg

SEQ ID NO: 3222144 - RNA, 19 nt, Mycobacterium leprae
uccuaccggccaaccacag

SEQ ID NO: 3222145 - RNA, 23 nt, Mycobacterium leprae
uccuaucgaaauacgagucgugg

SEQ ID NO: 3222146 - RNA, 18 nt, Mycobacterium leprae
uccucaagacuucaggaa

SEQ ID NO: 3222147 - RNA, 14 nt, Mycobacterium leprae
uccucacacucacg

SEQ ID NO: 3222148 - RNA, 14 nt, Mycobacterium leprae
uccucauuacccgc

SEQ ID NO: 3222149 - RNA, 14 nt, Mycobacterium leprae
uccuccaccuuuuu

SEQ ID NO: 3222150 - RNA, 20 nt, Mycobacterium leprae
uccuccaguuguaugcgcua

SEQ ID NO: 3222151 - RNA, 20 nt, Mycobacterium leprae
ucgccaugaacugacuucag

SEQ ID NO: 3222152 - RNA, 12 nt, Mycobacterium leprae
ucgcccaccgca

SEQ ID NO: 3222153 - RNA, 22 nt, Mycobacterium leprae
ucgcccaccgcaaucgaaaaau

SEQ ID NO: 3222154 - RNA, 15 nt, Mycobacterium leprae
ucgcccagcagguug

SEQ ID NO: 3222155 - RNA, 13 nt, Mycobacterium leprae
ucgcccaggugcu

SEQ ID NO: 3222156 - RNA, 20 nt, Mycobacterium leprae
ucgcccggacgugcacaucg

SEQ ID NO: 3222157 - RNA, 19 nt, Mycobacterium leprae
ucgcccggugacaucaccg

SEQ ID NO: 3222158 - RNA, 22 nt, Mycobacterium leprae
ucgcccucuuugaucagcaagg

SEQ ID NO: 3222159 - RNA, 16 nt, Mycobacterium leprae
ucgcccuguguucggu

SEQ ID NO: 3222160 - RNA, 16 nt, Mycobacterium leprae
ucgccgaaaucggugg

SEQ ID NO: 3222161 - RNA, 14 nt, Mycobacterium leprae
ucgccgagcugauc

SEQ ID NO: 3222162 - RNA, 14 nt, Mycobacterium leprae
ucgccgccggcgug

SEQ ID NO: 3222163 - RNA, 16 nt, Mycobacterium leprae
ucgccgccuucuccgu

SEQ ID NO: 3222164 - RNA, 21 nt, Mycobacterium leprae
ucgccgcgaauggugcucgga

SEQ ID NO: 3222165 - RNA, 16 nt, Mycobacterium leprae
ucgccgcgcaucaucg

SEQ ID NO: 3222166 - RNA, 19 nt, Mycobacterium leprae
ucgccgcgggacacauccg

SEQ ID NO: 3222167 - RNA, 18 nt, Mycobacterium leprae
ucgccuggucauggcuuc

SEQ ID NO: 3222168 - RNA, 21 nt, Mycobacterium leprae
ucgccugugucgagcuggcug

SEQ ID NO: 3222169 - RNA, 22 nt, Mycobacterium leprae
ucgccuuggugcuuaacgccgc

SEQ ID NO: 3222170 - RNA, 18 nt, Mycobacterium leprae
ucgcgagcugaacaggcg

SEQ ID NO: 3222171 - RNA, 17 nt, Mycobacterium leprae
ucgcgagugcuggucaa

SEQ ID NO: 3222172 - RNA, 20 nt, Mycobacterium leprae
ucgcgcaacgacuguggcac

SEQ ID NO: 3222173 - RNA, 21 nt, Mycobacterium leprae
ucgcgcaacgacuguggcacc

SEQ ID NO: 3222174 - RNA, 22 nt, Mycobacterium leprae
ucgcgccguuuccagcgcucgc

SEQ ID NO: 3222175 - RNA, 12 nt, Mycobacterium leprae
ucgcgcgcaccc

SEQ ID NO: 3222176 - RNA, 16 nt, Mycobacterium leprae
ucgcgcgcaccccguu

SEQ ID NO: 3222177 - RNA, 14 nt, Mycobacterium leprae
ucgcgcgugccacc

SEQ ID NO: 3222178 - RNA, 19 nt, Mycobacterium leprae
ucgcggaaguaacgucgaa

SEQ ID NO: 3222179 - RNA, 19 nt, Mycobacterium leprae
ucgcggccacgucgccguu

SEQ ID NO: 3222180 - RNA, 19 nt, Mycobacterium leprae
ucgcggccgcagcgcggcc

SEQ ID NO: 3222181 - RNA, 17 nt, Mycobacterium leprae
ucgcggcugccacugug

SEQ ID NO: 3222182 - RNA, 19 nt, Mycobacterium leprae
ucgcgggacaacaccacuu

SEQ ID NO: 3222183 - RNA, 23 nt, Mycobacterium leprae
ucgcgggacaacaccacuucuug

SEQ ID NO: 3222184 - RNA, 23 nt, Mycobacterium leprae
ucgcgggcaagcccugcccggcc

SEQ ID NO: 3222185 - RNA, 15 nt, Mycobacterium leprae
ucgcgggcuugcucc

SEQ ID NO: 3222186 - RNA, 18 nt, Mycobacterium leprae
ucgcggggaugcugaggu

SEQ ID NO: 3222187 - RNA, 19 nt, Mycobacterium leprae
ucgcgguaggaguuuuuca

SEQ ID NO: 3222188 - RNA, 19 nt, Mycobacterium leprae
ucgcgugcuaugaccucgc

SEQ ID NO: 3222189 - RNA, 17 nt, Mycobacterium leprae
ucgcguugaccaaaccg

SEQ ID NO: 3222190 - RNA, 13 nt, Mycobacterium leprae
ucgcuaaauauua

SEQ ID NO: 3222191 - RNA, 22 nt, Mycobacterium leprae
ucgcuaaauauuaauccaguag

SEQ ID NO: 3222192 - RNA, 15 nt, Mycobacterium leprae
ucgcuaacuucccga

SEQ ID NO: 3222193 - RNA, 19 nt, Mycobacterium leprae
ucgcuacccuugagcaccc

SEQ ID NO: 3222194 - RNA, 18 nt, Mycobacterium leprae
ucgcuaguuuacuaggcc

SEQ ID NO: 3222195 - RNA, 11 nt, Mycobacterium leprae
ucgcucagcau

SEQ ID NO: 3222196 - RNA, 19 nt, Mycobacterium leprae
ucgcucgccgcccgcugga

SEQ ID NO: 3222197 - RNA, 16 nt, Mycobacterium leprae
ucgcugaacucgucgu

SEQ ID NO: 3222198 - RNA, 19 nt, Mycobacterium leprae
ucgcugauacaacuggaag

SEQ ID NO: 3222199 - RNA, 18 nt, Mycobacterium leprae
ucgcugauguccaaagac

SEQ ID NO: 3222200 - RNA, 17 nt, Mycobacterium leprae
ucgcugcagcauaaccc

SEQ ID NO: 3222201 - RNA, 15 nt, Mycobacterium leprae
ucgcugcugcuggcc

SEQ ID NO: 3222202 - RNA, 20 nt, Mycobacterium leprae
ucgcuggcucugucgucgaa

SEQ ID NO: 3222203 - RNA, 13 nt, Mycobacterium leprae
ucgcugugugcgc

SEQ ID NO: 3222204 - RNA, 20 nt, Mycobacterium leprae
ucgcugugugcgcgccgacc

SEQ ID NO: 3222205 - RNA, 18 nt, Mycobacterium leprae
ucgcuuccgaugggacug

SEQ ID NO: 3222206 - RNA, 21 nt, Mycobacterium leprae
ucgcuuugcuggcaagcucgg

SEQ ID NO: 3222207 - RNA, 19 nt, Mycobacterium leprae
ucggaaaaacggcuggcug

SEQ ID NO: 3222208 - RNA, 19 nt, Mycobacterium leprae
ucggaaccgcagcugcucg

SEQ ID NO: 3222209 - RNA, 19 nt, Mycobacterium leprae
ucggacacgagcggccuca

SEQ ID NO: 3222210 - RNA, 19 nt, Mycobacterium leprae
ucggacugucaaccauggu

SEQ ID NO: 3222211 - RNA, 17 nt, Mycobacterium leprae
ucggagaauauagccuu

SEQ ID NO: 3222212 - RNA, 15 nt, Mycobacterium leprae
ucggagcgagcucua

SEQ ID NO: 3222213 - RNA, 21 nt, Mycobacterium leprae
ucggaguuugcgcucgucgau

SEQ ID NO: 3222214 - RNA, 14 nt, Mycobacterium leprae
ucggauccaucaga

SEQ ID NO: 3222215 - RNA, 20 nt, Mycobacterium leprae
ucggaucguuugaggaagaa

SEQ ID NO: 3222216 - RNA, 16 nt, Mycobacterium leprae
ucggauggcagucgau

SEQ ID NO: 3222217 - RNA, 18 nt, Mycobacterium leprae
ucggauuggaaaagauuu

SEQ ID NO: 3222218 - RNA, 22 nt, Mycobacterium leprae
ucggcaaugucaaagcccuuca

SEQ ID NO: 3222219 - RNA, 15 nt, Mycobacterium leprae
ucggcacagugccug

SEQ ID NO: 3222220 - RNA, 21 nt, Mycobacterium leprae
ucggcacgacagaguugggag

SEQ ID NO: 3222221 - RNA, 16 nt, Mycobacterium leprae
ucggcagaugcccuuu

SEQ ID NO: 3222222 - RNA, 18 nt, Mycobacterium leprae
ucggcaggccggccugga

SEQ ID NO: 3222223 - RNA, 19 nt, Mycobacterium leprae
ucggcaggccggccuggaa

SEQ ID NO: 3222224 - RNA, 19 nt, Mycobacterium leprae
ucggcaugugcauccaguc

SEQ ID NO: 3222225 - RNA, 20 nt, Mycobacterium leprae
ucggcauugccggggcugcg

SEQ ID NO: 3222226 - RNA, 14 nt, Mycobacterium leprae
ucggccaccggccg

SEQ ID NO: 3222227 - RNA, 20 nt, Mycobacterium leprae
ucggccaccggccguuuggu

SEQ ID NO: 3222228 - RNA, 19 nt, Mycobacterium leprae
ucggccagcgcaucagcca

SEQ ID NO: 3222229 - RNA, 14 nt, Mycobacterium leprae
ucggccaggugugc

SEQ ID NO: 3222230 - RNA, 14 nt, Mycobacterium leprae
ucggcccacgagaa

SEQ ID NO: 3222231 - RNA, 22 nt, Mycobacterium leprae
ucggcccacgagaaugucgcac

SEQ ID NO: 3222232 - RNA, 12 nt, Mycobacterium leprae
ucggcccaggga

SEQ ID NO: 3222233 - RNA, 18 nt, Mycobacterium leprae
ucggccgaugauggugcc

SEQ ID NO: 3222234 - RNA, 14 nt, Mycobacterium leprae
ucggccuaccgcgc

SEQ ID NO: 3222235 - RNA, 20 nt, Mycobacterium leprae
ucggcgaagucaagaugauc

SEQ ID NO: 3222236 - RNA, 23 nt, Mycobacterium leprae
ucggcgacacagagcgcucggcg

SEQ ID NO: 3222237 - RNA, 19 nt, Mycobacterium leprae
ucggcgauauccgccggcc

SEQ ID NO: 3222238 - RNA, 21 nt, Mycobacterium leprae
ucggcgccucacccaugccuc

SEQ ID NO: 3222239 - RNA, 19 nt, Mycobacterium leprae
ucggcgcuggggcgcuggc

SEQ ID NO: 3222240 - RNA, 23 nt, Mycobacterium leprae
ucggcggcacauacggcaaccuu

SEQ ID NO: 3222241 - RNA, 19 nt, Mycobacterium leprae
ucggcggcgccgaucccau

SEQ ID NO: 3222242 - RNA, 16 nt, Mycobacterium leprae
ucggcgguaccgucua

SEQ ID NO: 3222243 - RNA, 16 nt, Mycobacterium leprae
ucggcgugcacggcga

SEQ ID NO: 3222244 - RNA, 19 nt, Mycobacterium leprae
ucggcucccaucggcggcc

SEQ ID NO: 3222245 - RNA, 15 nt, Mycobacterium leprae
ucggcuccuccagca

SEQ ID NO: 3222246 - RNA, 18 nt, Mycobacterium leprae
ucggcuccuccagcaucg

SEQ ID NO: 3222247 - RNA, 19 nt, Mycobacterium leprae
ucggcuggucguugcccgg

SEQ ID NO: 3222248 - RNA, 22 nt, Mycobacterium leprae
ucgggagaggaucagcgcugcu

SEQ ID NO: 3222249 - RNA, 21 nt, Mycobacterium leprae
ucgggaugccgaaacgcugag

SEQ ID NO: 3222250 - RNA, 17 nt, Mycobacterium leprae
ucgggcagcugcaacac

SEQ ID NO: 3222251 - RNA, 16 nt, Mycobacterium leprae
ucggguaccggcaaac

SEQ ID NO: 3222252 - RNA, 17 nt, Mycobacterium leprae
ucggguagacgaugauc

SEQ ID NO: 3222253 - RNA, 23 nt, Mycobacterium leprae
ucgguaaugcaagcgcuuuuccu

SEQ ID NO: 3222254 - RNA, 19 nt, Mycobacterium leprae
ucgguacauuugcggauga

SEQ ID NO: 3222255 - RNA, 22 nt, Mycobacterium leprae
ucgguaccagcggcagcggcgg

SEQ ID NO: 3222256 - RNA, 20 nt, Mycobacterium leprae
ucggucaccccgagcucggc

SEQ ID NO: 3222257 - RNA, 17 nt, Mycobacterium leprae
ucggucaccugugggac

SEQ ID NO: 3222258 - RNA, 19 nt, Mycobacterium leprae
ucgguccuugaccucaucc

SEQ ID NO: 3222259 - RNA, 12 nt, Mycobacterium leprae
ucggucgauggc

SEQ ID NO: 3222260 - RNA, 20 nt, Mycobacterium leprae
ucggucgccgagcugaucgu

SEQ ID NO: 3222261 - RNA, 19 nt, Mycobacterium leprae
ucggucggcaugugcaucc

SEQ ID NO: 3222262 - RNA, 22 nt, Mycobacterium leprae
ucggucggcaugugcauccagu

SEQ ID NO: 3222263 - RNA, 19 nt, Mycobacterium leprae
ucugcguaaccgccaucgg

SEQ ID NO: 3222264 - RNA, 21 nt, Mycobacterium leprae
ucugcgucgcccucgccggcg

SEQ ID NO: 3222265 - RNA, 15 nt, Mycobacterium leprae
ucugcgugccgagcc

SEQ ID NO: 3222266 - RNA, 14 nt, Mycobacterium leprae
ucugcuacgcuggc

SEQ ID NO: 3222267 - RNA, 14 nt, Mycobacterium leprae
ucugcuggagaucg

SEQ ID NO: 3222268 - RNA, 22 nt, Mycobacterium leprae
ucugcuggaucuguauuaaucu

SEQ ID NO: 3222269 - RNA, 21 nt, Mycobacterium leprae
ucuggaacucuguguugccgu

SEQ ID NO: 3222270 - RNA, 18 nt, Mycobacterium leprae
ucuggaccacgcaauguc

SEQ ID NO: 3222271 - RNA, 18 nt, Mycobacterium leprae
ucuggauggcgcucacga

SEQ ID NO: 3222272 - RNA, 15 nt, Mycobacterium leprae
ucuggcgacucggcg

SEQ ID NO: 3222273 - RNA, 21 nt, Mycobacterium leprae
ucuggcuacaacaaggugugc

SEQ ID NO: 3222274 - RNA, 15 nt, Mycobacterium leprae
ucuggcuagccgcug

SEQ ID NO: 3222275 - RNA, 18 nt, Mycobacterium leprae
ucuggcugggacacggcg

SEQ ID NO: 3222276 - RNA, 12 nt, Mycobacterium leprae
ucugggcuggcc

SEQ ID NO: 3222277 - RNA, 15 nt, Mycobacterium leprae
ucugggugguguggc

SEQ ID NO: 3222278 - RNA, 20 nt, Mycobacterium leprae
ucugguaaagccguuggcuu

SEQ ID NO: 3222279 - RNA, 22 nt, Mycobacterium leprae
ucugguggauccaggugcugca

SEQ ID NO: 3222280 - RNA, 17 nt, Mycobacterium leprae
ucuggugggcacccgca

SEQ ID NO: 3222281 - RNA, 15 nt, Mycobacterium leprae
ucuguagcuucgucg

SEQ ID NO: 3222282 - RNA, 18 nt, Mycobacterium leprae
ucugugcgaaaacacuua

SEQ ID NO: 3222283 - RNA, 19 nt, Mycobacterium leprae
ucugugggcagugccuggc

SEQ ID NO: 3222284 - RNA, 21 nt, Mycobacterium leprae
ucuguugcaggcuucgucaca

SEQ ID NO: 3222285 - RNA, 15 nt, Mycobacterium leprae
ucuguugugggggug

SEQ ID NO: 3222286 - RNA, 19 nt, Mycobacterium leprae
ucuguuguggggguggagu

SEQ ID NO: 3222287 - RNA, 17 nt, Mycobacterium leprae
ucuuacccgagcugacu

SEQ ID NO: 3222288 - RNA, 21 nt, Mycobacterium leprae
ucuuacuggggcguccaguga

SEQ ID NO: 3222289 - RNA, 16 nt, Mycobacterium leprae
ucuucaauuuuccagu

SEQ ID NO: 3222290 - RNA, 21 nt, Mycobacterium leprae
ucuuccaaacuuccucugcca

SEQ ID NO: 3222291 - RNA, 19 nt, Mycobacterium leprae
ucuucgacaccgagcagcc

SEQ ID NO: 3222292 - RNA, 15 nt, Mycobacterium leprae
ucuucgcagccuagg

SEQ ID NO: 3222293 - RNA, 13 nt, Mycobacterium leprae
ucuucgugcagca

SEQ ID NO: 3222294 - RNA, 16 nt, Mycobacterium leprae
ucuucucuaaaaagau

SEQ ID NO: 3222295 - RNA, 14 nt, Mycobacterium leprae
ucuugaacucaucg

SEQ ID NO: 3222296 - RNA, 20 nt, Mycobacterium leprae
ucuugacgggaggaacuccg

SEQ ID NO: 3222297 - RNA, 13 nt, Mycobacterium leprae
ucuugaugccaac

SEQ ID NO: 3222298 - RNA, 21 nt, Mycobacterium leprae
ucuugcagcgaggccguggcc

SEQ ID NO: 3222299 - RNA, 16 nt, Mycobacterium leprae
ucuuggcuugcugucg

SEQ ID NO: 3222300 - RNA, 18 nt, Mycobacterium leprae
ucuuggggacgccggcgg

SEQ ID NO: 3222301 - RNA, 20 nt, Mycobacterium leprae
ucuuggugagagcuccauuu

SEQ ID NO: 3222302 - RNA, 22 nt, Mycobacterium leprae
ucuugugcccgaggacacccgg

SEQ ID NO: 3222303 - RNA, 21 nt, Mycobacterium leprae
ucuugugcguagucgaccgga

SEQ ID NO: 3222304 - RNA, 16 nt, Mycobacterium leprae
ucuuguucuugcgcgu

SEQ ID NO: 3222305 - RNA, 22 nt, Mycobacterium leprae
ucuuguuggcuuccagucuggc

SEQ ID NO: 3222306 - RNA, 15 nt, Mycobacterium leprae
ucuuuaggugguauu

SEQ ID NO: 3222307 - RNA, 18 nt, Mycobacterium leprae
ucuuugaccagacaaauu

SEQ ID NO: 3222308 - RNA, 17 nt, Mycobacterium leprae
ucuuugaucagcaagga

SEQ ID NO: 3222309 - RNA, 13 nt, Mycobacterium leprae
ucuuuuuagagaa

SEQ ID NO: 3222310 - RNA, 17 nt, Mycobacterium leprae
ugaaaguaggcacagcc

SEQ ID NO: 3222311 - RNA, 22 nt, Mycobacterium leprae
ugaaaguaggcacagcccagua

SEQ ID NO: 3222312 - RNA, 19 nt, Mycobacterium leprae
ugaacacgcuuaaucgacu

SEQ ID NO: 3222313 - RNA, 16 nt, Mycobacterium leprae
ugaaccugccauccaa

SEQ ID NO: 3222314 - RNA, 15 nt, Mycobacterium leprae
ugaacgagaagcagc

SEQ ID NO: 3222315 - RNA, 14 nt, Mycobacterium leprae
ugaacuaagcauuu

SEQ ID NO: 3222316 - RNA, 16 nt, Mycobacterium leprae
ugaacuggaucgguca

SEQ ID NO: 3222317 - RNA, 15 nt, Mycobacterium leprae
ugaagauaggucgcc

SEQ ID NO: 3222318 - RNA, 17 nt, Mycobacterium leprae
ugaagcauuuggcucgc

SEQ ID NO: 3222319 - RNA, 20 nt, Mycobacterium leprae
ugaagcggauaguaugccuc

SEQ ID NO: 3222320 - RNA, 16 nt, Mycobacterium leprae
ugaagguuaucgacac

SEQ ID NO: 3222321 - RNA, 21 nt, Mycobacterium leprae
ugaaguauggcuccauagaac

SEQ ID NO: 3222322 - RNA, 18 nt, Mycobacterium leprae
ugaaucagaugaccggcu

SEQ ID NO: 3222323 - RNA, 13 nt, Mycobacterium leprae
ugaaucagucugc

SEQ ID NO: 3222324 - RNA, 16 nt, Mycobacterium leprae
ugaauccgcugcaauu

SEQ ID NO: 3222325 - RNA, 15 nt, Mycobacterium leprae
ugaauccgcugcccu

SEQ ID NO: 3222326 - RNA, 23 nt, Mycobacterium leprae
ugaaugggccgaucgcaggagua

SEQ ID NO: 3222327 - RNA, 18 nt, Mycobacterium leprae
ugaauuguacuuugugug

SEQ ID NO: 3222328 - RNA, 15 nt, Mycobacterium leprae
ugacaaaagugcagu

SEQ ID NO: 3222329 - RNA, 14 nt, Mycobacterium leprae
ugacaacacgaucg

SEQ ID NO: 3222330 - RNA, 17 nt, Mycobacterium leprae
ugacaacacgaucgcag

SEQ ID NO: 3222331 - RNA, 14 nt, Mycobacterium leprae
ugacacaaagaagu

SEQ ID NO: 3222332 - RNA, 13 nt, Mycobacterium leprae
ugacaccgaacag

SEQ ID NO: 3222333 - RNA, 15 nt, Mycobacterium leprae
ugacaccgcaguuga

SEQ ID NO: 3222334 - RNA, 16 nt, Mycobacterium leprae
ugacaccgccggcguc

SEQ ID NO: 3222335 - RNA, 23 nt, Mycobacterium leprae
ugacagcaacggcuacggggugg

SEQ ID NO: 3222336 - RNA, 16 nt, Mycobacterium leprae
ugacagcgcgaacgua

SEQ ID NO: 3222337 - RNA, 20 nt, Mycobacterium leprae
ugacagcgcgaacguagucc

SEQ ID NO: 3222338 - RNA, 20 nt, Mycobacterium leprae
ugacaggcgcguuugucggc

SEQ ID NO: 3222339 - RNA, 20 nt, Mycobacterium leprae
ugacagugcugcaagcaguu

SEQ ID NO: 3222340 - RNA, 21 nt, Mycobacterium leprae
ugacagugcugcaagcaguuc

SEQ ID NO: 3222341 - RNA, 16 nt, Mycobacterium leprae
ugacauauuugggagc

SEQ ID NO: 3222342 - RNA, 15 nt, Mycobacterium leprae
ugacaucagucagca

SEQ ID NO: 3222343 - RNA, 18 nt, Mycobacterium leprae
ugacaucagucagcaucg

SEQ ID NO: 3222344 - RNA, 13 nt, Mycobacterium leprae
ugacaugccgagg

SEQ ID NO: 3222345 - RNA, 18 nt, Mycobacterium leprae
ugaccaaaccgaagauca

SEQ ID NO: 3222346 - RNA, 21 nt, Mycobacterium leprae
ugaccaagaaguuaccgagcc

SEQ ID NO: 3222347 - RNA, 19 nt, Mycobacterium leprae
ugaccacccacaacgccaa

SEQ ID NO: 3222348 - RNA, 22 nt, Mycobacterium leprae
ugaccacccacaacgccaaacu

SEQ ID NO: 3222349 - RNA, 16 nt, Mycobacterium leprae
ugaccagacaaauuga

SEQ ID NO: 3222350 - RNA, 23 nt, Mycobacterium leprae
ugaccagacaaauugacaacguu

SEQ ID NO: 3222351 - RNA, 14 nt, Mycobacterium leprae
ugaccagccgcagc

SEQ ID NO: 3222352 - RNA, 17 nt, Mycobacterium leprae
ugaccagugugccuguc

SEQ ID NO: 3222353 - RNA, 13 nt, Mycobacterium leprae
ugacccaagcgcc

SEQ ID NO: 3222354 - RNA, 14 nt, Mycobacterium leprae
ugacccuguccgag

SEQ ID NO: 3222355 - RNA, 19 nt, Mycobacterium leprae
ugaccgaaccgaugauggc

SEQ ID NO: 3222356 - RNA, 15 nt, Mycobacterium leprae
ugaccgacagcucgu

SEQ ID NO: 3222357 - RNA, 22 nt, Mycobacterium leprae
ugaccgcaccgaucugcccagc

SEQ ID NO: 3222358 - RNA, 14 nt, Mycobacterium leprae
ugaccgccugugcu

SEQ ID NO: 3222359 - RNA, 16 nt, Mycobacterium leprae
ugaccgccugugcugu

SEQ ID NO: 3222360 - RNA, 19 nt, Mycobacterium leprae
ugaccgcggucggcaucug

SEQ ID NO: 3222361 - RNA, 20 nt, Mycobacterium leprae
ugaccgcggugcagugccgc

SEQ ID NO: 3222362 - RNA, 18 nt, Mycobacterium leprae
ugaccggcuaccggcccg

SEQ ID NO: 3222363 - RNA, 16 nt, Mycobacterium leprae
ugaccgucaugcugcu

SEQ ID NO: 3222364 - RNA, 13 nt, Mycobacterium leprae
ugaccgugcagcu

SEQ ID NO: 3222365 - RNA, 19 nt, Mycobacterium leprae
ugaccuccacguuguccgc

SEQ ID NO: 3222366 - RNA, 16 nt, Mycobacterium leprae
ugaccugacaucaagc

SEQ ID NO: 3222367 - RNA, 21 nt, Mycobacterium leprae
ugaccugccgucccucggcca

SEQ ID NO: 3222368 - RNA, 14 nt, Mycobacterium leprae
ugacgaaaauguuu

SEQ ID NO: 3222369 - RNA, 22 nt, Mycobacterium leprae
ugacgaaauucggcggccacua

SEQ ID NO: 3222370 - RNA, 18 nt, Mycobacterium leprae
ugacgaggugucggcgau

SEQ ID NO: 3222371 - RNA, 14 nt, Mycobacterium leprae
ugacgaugcagugg

SEQ ID NO: 3222372 - RNA, 14 nt, Mycobacterium leprae
ugacgcccuccugg

SEQ ID NO: 3222373 - RNA, 20 nt, Mycobacterium leprae
ugacgcccuccuggcgagug

SEQ ID NO: 3222374 - RNA, 11 nt, Mycobacterium leprae
ugacgccgacc

SEQ ID NO: 3222375 - RNA, 17 nt, Mycobacterium leprae
ugacgcgacgccggccg

SEQ ID NO: 3222376 - RNA, 18 nt, Mycobacterium leprae
ugcacaaggaauugcugc

SEQ ID NO: 3222377 - RNA, 21 nt, Mycobacterium leprae
ugcacaaguaccggcucacac

SEQ ID NO: 3222378 - RNA, 20 nt, Mycobacterium leprae
ugcacacggccgugcauuaa

SEQ ID NO: 3222379 - RNA, 23 nt, Mycobacterium leprae
ugcacacuaaaacgccccuaccc

SEQ ID NO: 3222380 - RNA, 19 nt, Mycobacterium leprae
ugcacauucaaccagccaa

SEQ ID NO: 3222381 - RNA, 13 nt, Mycobacterium leprae
ugcaccagcucac

SEQ ID NO: 3222382 - RNA, 23 nt, Mycobacterium leprae
ugcaccagcucacccgcagcacc

SEQ ID NO: 3222383 - RNA, 16 nt, Mycobacterium leprae
ugcacccggccgucgc

SEQ ID NO: 3222384 - RNA, 23 nt, Mycobacterium leprae
ugcacccggcggcaugccugcuu

SEQ ID NO: 3222385 - RNA, 19 nt, Mycobacterium leprae
ugcaccgucuuugcuaaca

SEQ ID NO: 3222386 - RNA, 21 nt, Mycobacterium leprae
ugcaccguggcaacgaccacc

SEQ ID NO: 3222387 - RNA, 18 nt, Mycobacterium leprae
ugcacgaauaucgagcua

SEQ ID NO: 3222388 - RNA, 18 nt, Mycobacterium leprae
ugcacgcgcgccugggug

SEQ ID NO: 3222389 - RNA, 19 nt, Mycobacterium leprae
ugcacgcgcgccuggguga

SEQ ID NO: 3222390 - RNA, 15 nt, Mycobacterium leprae
ugcacggcaaaguca

SEQ ID NO: 3222391 - RNA, 15 nt, Mycobacterium leprae
ugcacggcgugcagg

SEQ ID NO: 3222392 - RNA, 18 nt, Mycobacterium leprae
ugcacggcgugcaggcag

SEQ ID NO: 3222393 - RNA, 15 nt, Mycobacterium leprae
ugcacggggucagcg

SEQ ID NO: 3222394 - RNA, 16 nt, Mycobacterium leprae
ugcacggggucagcgg

SEQ ID NO: 3222395 - RNA, 14 nt, Mycobacterium leprae
ugcacgucggccga

SEQ ID NO: 3222396 - RNA, 23 nt, Mycobacterium leprae
ugcacgucggccgaucauggcug

SEQ ID NO: 3222397 - RNA, 14 nt, Mycobacterium leprae
ugcacgugauggcg

SEQ ID NO: 3222398 - RNA, 16 nt, Mycobacterium leprae
ugcacgugcaaacugc

SEQ ID NO: 3222399 - RNA, 23 nt, Mycobacterium leprae
ugcacgugcaaacugcugcgcaa

SEQ ID NO: 3222400 - RNA, 21 nt, Mycobacterium leprae
ugcacuaacgugcagcuggcc

SEQ ID NO: 3222401 - RNA, 23 nt, Mycobacterium leprae
ugcacuaugucgaucggcagugg

SEQ ID NO: 3222402 - RNA, 22 nt, Mycobacterium leprae
ugcacucgcaucaacgccgaga

SEQ ID NO: 3222403 - RNA, 18 nt, Mycobacterium leprae
ugcacugcuucggccagc

SEQ ID NO: 3222404 - RNA, 14 nt, Mycobacterium leprae
ugcacuugcacuau

SEQ ID NO: 3222405 - RNA, 14 nt, Mycobacterium leprae
ugcagacacgccgc

SEQ ID NO: 3222406 - RNA, 15 nt, Mycobacterium leprae
ugcagagcaucgggc

SEQ ID NO: 3222407 - RNA, 19 nt, Mycobacterium leprae
ugcagauugcgugaccgcg

SEQ ID NO: 3222408 - RNA, 15 nt, Mycobacterium leprae
ugcagcaacagccac

SEQ ID NO: 3222409 - RNA, 20 nt, Mycobacterium leprae
ugcagcacucauugcuguua

SEQ ID NO: 3222410 - RNA, 13 nt, Mycobacterium leprae
ugcagcagccagu

SEQ ID NO: 3222411 - RNA, 14 nt, Mycobacterium leprae
ugcagcagccaguc

SEQ ID NO: 3222412 - RNA, 12 nt, Mycobacterium leprae
ugcagcagcucg

SEQ ID NO: 3222413 - RNA, 23 nt, Mycobacterium leprae
ugcagcaucaggguacucagcug

SEQ ID NO: 3222414 - RNA, 16 nt, Mycobacterium leprae
ugcagcaugugugaac

SEQ ID NO: 3222415 - RNA, 18 nt, Mycobacterium leprae
ugcagcccugagcaccau

SEQ ID NO: 3222416 - RNA, 20 nt, Mycobacterium leprae
ugcagcgaccucaugcccgg

SEQ ID NO: 3222417 - RNA, 19 nt, Mycobacterium leprae
ugcagcggcaguccgcguc

SEQ ID NO: 3222418 - RNA, 20 nt, Mycobacterium leprae
ugcagcgugacgacuugccc

SEQ ID NO: 3222419 - RNA, 19 nt, Mycobacterium leprae
ugcagcuaaucccauggga

SEQ ID NO: 3222420 - RNA, 22 nt, Mycobacterium leprae
ugcagcuaauuuuccacaggca

SEQ ID NO: 3222421 - RNA, 20 nt, Mycobacterium leprae
ugcagcucguccaucgcguc

SEQ ID NO: 3222422 - RNA, 17 nt, Mycobacterium leprae
ugcagcugccaaccggu

SEQ ID NO: 3222423 - RNA, 18 nt, Mycobacterium leprae
ugcagcuggccgcacguu

SEQ ID NO: 3222424 - RNA, 15 nt, Mycobacterium leprae
ugcagcugggauagc

SEQ ID NO: 3222425 - RNA, 14 nt, Mycobacterium leprae
ugcaggaccgugcu

SEQ ID NO: 3222426 - RNA, 15 nt, Mycobacterium leprae
ugcaggaggugcaga

SEQ ID NO: 3222427 - RNA, 23 nt, Mycobacterium leprae
ugcaggauucacccgacgaguuc

SEQ ID NO: 3222428 - RNA, 23 nt, Mycobacterium leprae
ugcagguccaauucacgaacaac

SEQ ID NO: 3222429 - RNA, 23 nt, Mycobacterium leprae
ugcagguugcugucguguuugug

SEQ ID NO: 3222430 - RNA, 16 nt, Mycobacterium leprae
ugcaguacguguggug

SEQ ID NO: 3222431 - RNA, 15 nt, Mycobacterium leprae
ugcagugagcagugg

SEQ ID NO: 3222432 - RNA, 20 nt, Mycobacterium leprae
ugcagugucgcuguucggcg

SEQ ID NO: 3222433 - RNA, 14 nt, Mycobacterium leprae
ugcaguuauaacca

SEQ ID NO: 3222434 - RNA, 17 nt, Mycobacterium leprae
ugcauauauuuguaugc

SEQ ID NO: 3222435 - RNA, 21 nt, Mycobacterium leprae
ugcaucaagcugugagugugc

SEQ ID NO: 3222436 - RNA, 15 nt, Mycobacterium leprae
ugcaucagcaccgcg

SEQ ID NO: 3222437 - RNA, 19 nt, Mycobacterium leprae
ugcaucccuuuuugcuaga

SEQ ID NO: 3222438 - RNA, 13 nt, Mycobacterium leprae
ugcauccgacaaa

SEQ ID NO: 3222439 - RNA, 19 nt, Mycobacterium leprae
ugcauccgacaaagcagca

SEQ ID NO: 3222440 - RNA, 14 nt, Mycobacterium leprae
ugcauccugcagca

SEQ ID NO: 3222441 - RNA, 20 nt, Mycobacterium leprae
ugcaugcaccgacggugcug

SEQ ID NO: 3222442 - RNA, 15 nt, Mycobacterium leprae
ugccaacgcuauugc

SEQ ID NO: 3222443 - RNA, 17 nt, Mycobacterium leprae
ugccaacucaccgcagg

SEQ ID NO: 3222444 - RNA, 21 nt, Mycobacterium leprae
ugccaacucggccgccagguc

SEQ ID NO: 3222445 - RNA, 16 nt, Mycobacterium leprae
ugccaaucagcacucg

SEQ ID NO: 3222446 - RNA, 13 nt, Mycobacterium leprae
ugccaccgcugac

SEQ ID NO: 3222447 - RNA, 16 nt, Mycobacterium leprae
ugccaccguauccugg

SEQ ID NO: 3222448 - RNA, 16 nt, Mycobacterium leprae
ugccacggugcaguca

SEQ ID NO: 3222449 - RNA, 14 nt, Mycobacterium leprae
ugccacgguggccu

SEQ ID NO: 3222450 - RNA, 19 nt, Mycobacterium leprae
ugccacugaacguggcacc

SEQ ID NO: 3222451 - RNA, 23 nt, Mycobacterium leprae
ugccacugacgaggugucggcga

SEQ ID NO: 3222452 - RNA, 17 nt, Mycobacterium leprae
ugccaggggcugggcac

SEQ ID NO: 3222453 - RNA, 17 nt, Mycobacterium leprae
ugccagugaucgccgau

SEQ ID NO: 3222454 - RNA, 15 nt, Mycobacterium leprae
ugccauccaccgccg

SEQ ID NO: 3222455 - RNA, 15 nt, Mycobacterium leprae
ugccauccggugcug

SEQ ID NO: 3222456 - RNA, 19 nt, Mycobacterium leprae
ugccauccucgaugguguc

SEQ ID NO: 3222457 - RNA, 18 nt, Mycobacterium leprae
ugccaucgaacggcgggg

SEQ ID NO: 3222458 - RNA, 17 nt, Mycobacterium leprae
ugccaucgacgccgccg

SEQ ID NO: 3222459 - RNA, 20 nt, Mycobacterium leprae
ugccaucgacgccgccguug

SEQ ID NO: 3222460 - RNA, 18 nt, Mycobacterium leprae
ugccaucgacgccgucuc

SEQ ID NO: 3222461 - RNA, 19 nt, Mycobacterium leprae
ugccaucgacgccgucucc

SEQ ID NO: 3222462 - RNA, 15 nt, Mycobacterium leprae
ugccaucgggccaga

SEQ ID NO: 3222463 - RNA, 22 nt, Mycobacterium leprae
ugccaucgggccagagcugcga

SEQ ID NO: 3222464 - RNA, 16 nt, Mycobacterium leprae
ugccaugcacgccggc

SEQ ID NO: 3222465 - RNA, 12 nt, Mycobacterium leprae
ugccaugccagu

SEQ ID NO: 3222466 - RNA, 18 nt, Mycobacterium leprae
ugccauuggccgcuggua

SEQ ID NO: 3222467 - RNA, 23 nt, Mycobacterium leprae
ugcccaagacucagugaagacca

SEQ ID NO: 3222468 - RNA, 17 nt, Mycobacterium leprae
ugcccaaugcagcaacg

SEQ ID NO: 3222469 - RNA, 19 nt, Mycobacterium leprae
ugcccagaccgaaaaccac

SEQ ID NO: 3222470 - RNA, 20 nt, Mycobacterium leprae
ugcccagaccgaaaaccaca

SEQ ID NO: 3222471 - RNA, 21 nt, Mycobacterium leprae
ugccccggguacacucucaga

SEQ ID NO: 3222472 - RNA, 19 nt, Mycobacterium leprae
ugcccgaaaaguucggcca

SEQ ID NO: 3222473 - RNA, 14 nt, Mycobacterium leprae
ugcccgacagccac

SEQ ID NO: 3222474 - RNA, 21 nt, Mycobacterium leprae
ugcccgcagaggacgggcggc

SEQ ID NO: 3222475 - RNA, 18 nt, Mycobacterium leprae
ugcccggauugauggaug

SEQ ID NO: 3222476 - RNA, 12 nt, Mycobacterium leprae
ugcccgggugaa

SEQ ID NO: 3222477 - RNA, 14 nt, Mycobacterium leprae
ugcccugggccagc

SEQ ID NO: 3222478 - RNA, 15 nt, Mycobacterium leprae
ugcccugggugacca

SEQ ID NO: 3222479 - RNA, 14 nt, Mycobacterium leprae
ugccgaaaucguga

SEQ ID NO: 3222480 - RNA, 19 nt, Mycobacterium leprae
ugccgaagcgaagacaucg

SEQ ID NO: 3222481 - RNA, 12 nt, Mycobacterium leprae
ugccgaaguccc

SEQ ID NO: 3222482 - RNA, 22 nt, Mycobacterium leprae
ugccgaccgccucgaugugcuu

SEQ ID NO: 3222483 - RNA, 20 nt, Mycobacterium leprae
ugccgagcaaguuugagaac

SEQ ID NO: 3222484 - RNA, 16 nt, Mycobacterium leprae
ugccgagcuggccggg

SEQ ID NO: 3222485 - RNA, 19 nt, Mycobacterium leprae
ugccgagguguucuggcac

SEQ ID NO: 3222486 - RNA, 13 nt, Mycobacterium leprae
ugccgauauaccu

SEQ ID NO: 3222487 - RNA, 18 nt, Mycobacterium leprae
ugccgaucagccgcaaca

SEQ ID NO: 3222488 - RNA, 22 nt, Mycobacterium leprae
ugcugcgauuccagcaacucuc

SEQ ID NO: 3222489 - RNA, 16 nt, Mycobacterium leprae
ugcugcggaucggugc

SEQ ID NO: 3222490 - RNA, 16 nt, Mycobacterium leprae
ugcugcggcgcccuag

SEQ ID NO: 3222491 - RNA, 19 nt, Mycobacterium leprae
ugcugcgugccugguuggg

SEQ ID NO: 3222492 - RNA, 15 nt, Mycobacterium leprae
ugcugcugcuggugg

SEQ ID NO: 3222493 - RNA, 22 nt, Mycobacterium leprae
ugcugcugguggugacucugug

SEQ ID NO: 3222494 - RNA, 21 nt, Mycobacterium leprae
ugcugcugguucuuggcuugc

SEQ ID NO: 3222495 - RNA, 14 nt, Mycobacterium leprae
ugcugcuguauucc

SEQ ID NO: 3222496 - RNA, 10 nt, Mycobacterium leprae
ugcuggaggg

SEQ ID NO: 3222497 - RNA, 23 nt, Mycobacterium leprae
ugcuggaugccgggaagcgaccg

SEQ ID NO: 3222498 - RNA, 12 nt, Mycobacterium leprae
ugcuggcagugg

SEQ ID NO: 3222499 - RNA, 20 nt, Mycobacterium leprae
ugcuggccaagaaguacagu

SEQ ID NO: 3222500 - RNA, 13 nt, Mycobacterium leprae
ugcuggccguguu

SEQ ID NO: 3222501 - RNA, 19 nt, Mycobacterium leprae
ugcuggccguguugcugcu

SEQ ID NO: 3222502 - RNA, 14 nt, Mycobacterium leprae
ugcugggucagcau

SEQ ID NO: 3222503 - RNA, 17 nt, Mycobacterium leprae
ugcuggugaucaggaug

SEQ ID NO: 3222504 - RNA, 16 nt, Mycobacterium leprae
ugcugguggaguacug

SEQ ID NO: 3222505 - RNA, 15 nt, Mycobacterium leprae
ugcugucgugcccag

SEQ ID NO: 3222506 - RNA, 19 nt, Mycobacterium leprae
ugcugucguggcugcacaa

SEQ ID NO: 3222507 - RNA, 15 nt, Mycobacterium leprae
ugcugugucgguugc

SEQ ID NO: 3222508 - RNA, 13 nt, Mycobacterium leprae
ugcuguguggcug

SEQ ID NO: 3222509 - RNA, 20 nt, Mycobacterium leprae
ugcuguguuugcuggucagg

SEQ ID NO: 3222510 - RNA, 21 nt, Mycobacterium leprae
ugcuguucggugucguuacgu

SEQ ID NO: 3222511 - RNA, 23 nt, Mycobacterium leprae
ugcuuaccucagugucagcagca

SEQ ID NO: 3222512 - RNA, 12 nt, Mycobacterium leprae
ugcuugagccug

SEQ ID NO: 3222513 - RNA, 18 nt, Mycobacterium leprae
ugcuugcuauguccaaca

SEQ ID NO: 3222514 - RNA, 12 nt, Mycobacterium leprae
ugcuugcuguga

SEQ ID NO: 3222515 - RNA, 23 nt, Mycobacterium leprae
ugcuuuggggguugcacugauuc

SEQ ID NO: 3222516 - RNA, 12 nt, Mycobacterium leprae
uggaacaaccgg

SEQ ID NO: 3222517 - RNA, 14 nt, Mycobacterium leprae
uggaauagcugugg

SEQ ID NO: 3222518 - RNA, 22 nt, Mycobacterium leprae
uggaauccgcgcagggccuggg

SEQ ID NO: 3222519 - RNA, 18 nt, Mycobacterium leprae
uggaauccggcaacugac

SEQ ID NO: 3222520 - RNA, 16 nt, Mycobacterium leprae
uggacaaccugggcgg

SEQ ID NO: 3222521 - RNA, 12 nt, Mycobacterium leprae
uggacagaacac

SEQ ID NO: 3222522 - RNA, 21 nt, Mycobacterium leprae
uggacagaugagcucagucgg

SEQ ID NO: 3222523 - RNA, 17 nt, Mycobacterium leprae
uggaccacaagcaacug

SEQ ID NO: 3222524 - RNA, 21 nt, Mycobacterium leprae
uggaccacaagcaacugcagc

SEQ ID NO: 3222525 - RNA, 21 nt, Mycobacterium leprae
uggaccgaacaggucagcggu

SEQ ID NO: 3222526 - RNA, 14 nt, Mycobacterium leprae
uggaccgcgccgcg

SEQ ID NO: 3222527 - RNA, 17 nt, Mycobacterium leprae
uggacgacggcuuugcu

SEQ ID NO: 3222528 - RNA, 21 nt, Mycobacterium leprae
uggacgcagugaacacgcuga

SEQ ID NO: 3222529 - RNA, 20 nt, Mycobacterium leprae
uggacgcucggugagauagc

SEQ ID NO: 3222530 - RNA, 13 nt, Mycobacterium leprae
uggacucagcaau

SEQ ID NO: 3222531 - RNA, 18 nt, Mycobacterium leprae
uggacuucugcgcgcacc

SEQ ID NO: 3222532 - RNA, 18 nt, Mycobacterium leprae
uggacuuuaaugucgcga

SEQ ID NO: 3222533 - RNA, 18 nt, Mycobacterium leprae
uggagcaccucagcaacu

SEQ ID NO: 3222534 - RNA, 13 nt, Mycobacterium leprae
uggagccaccaca

SEQ ID NO: 3222535 - RNA, 21 nt, Mycobacterium leprae
uggagcgaggggauccgacac

SEQ ID NO: 3222536 - RNA, 15 nt, Mycobacterium leprae
uggaguaaagggugg

SEQ ID NO: 3222537 - RNA, 23 nt, Mycobacterium leprae
uggaguaaaggguggcggugugu

SEQ ID NO: 3222538 - RNA, 20 nt, Mycobacterium leprae
uggagugaccgaugcucgcc

SEQ ID NO: 3222539 - RNA, 16 nt, Mycobacterium leprae
uggaguuauuuggcgc

SEQ ID NO: 3222540 - RNA, 20 nt, Mycobacterium leprae
uggauaaggucaaggcugga

SEQ ID NO: 3222541 - RNA, 17 nt, Mycobacterium leprae
uggauccgaaugacaac

SEQ ID NO: 3222542 - RNA, 18 nt, Mycobacterium leprae
uggaucggggauucaauc

SEQ ID NO: 3222543 - RNA, 15 nt, Mycobacterium leprae
uggaucggucagcca

SEQ ID NO: 3222544 - RNA, 12 nt, Mycobacterium leprae
uggaugcccagg

SEQ ID NO: 3222545 - RNA, 13 nt, Mycobacterium leprae
uggaugcgguggu

SEQ ID NO: 3222546 - RNA, 14 nt, Mycobacterium leprae
uggaugcgguggug

SEQ ID NO: 3222547 - RNA, 12 nt, Mycobacterium leprae
uggauggucggc

SEQ ID NO: 3222548 - RNA, 14 nt, Mycobacterium leprae
uggaugucgcagag

SEQ ID NO: 3222549 - RNA, 21 nt, Mycobacterium leprae
uggauguuccgcagcggcgau

SEQ ID NO: 3222550 - RNA, 19 nt, Mycobacterium leprae
uggauuuguauggcgcggu

SEQ ID NO: 3222551 - RNA, 18 nt, Mycobacterium leprae
uggcaaccgacacaccca

SEQ ID NO: 3222552 - RNA, 15 nt, Mycobacterium leprae
uggcaacgcugccca

SEQ ID NO: 3222553 - RNA, 23 nt, Mycobacterium leprae
uggcaacggguuaccugaccgaa

SEQ ID NO: 3222554 - RNA, 21 nt, Mycobacterium leprae
uggcaccagucgcgcaguguc

SEQ ID NO: 3222555 - RNA, 23 nt, Mycobacterium leprae
uggcaccuaaggccgucgcgggc

SEQ ID NO: 3222556 - RNA, 20 nt, Mycobacterium leprae
uggcagaggcugcagucagu

SEQ ID NO: 3222557 - RNA, 20 nt, Mycobacterium leprae
uggcagcccuugcagcaaca

SEQ ID NO: 3222558 - RNA, 18 nt, Mycobacterium leprae
uggcaguccacaggacuu

SEQ ID NO: 3222559 - RNA, 20 nt, Mycobacterium leprae
uggcagucggcaagaccgag

SEQ ID NO: 3222560 - RNA, 20 nt, Mycobacterium leprae
uggcaucagauauccuaggc

SEQ ID NO: 3222561 - RNA, 21 nt, Mycobacterium leprae
uggcaucagauauccuaggcc

SEQ ID NO: 3222562 - RNA, 16 nt, Mycobacterium leprae
uggcaucggacugaag

SEQ ID NO: 3222563 - RNA, 15 nt, Mycobacterium leprae
uggcaucggcauugc

SEQ ID NO: 3222564 - RNA, 15 nt, Mycobacterium leprae
uggcauuguccagcg

SEQ ID NO: 3222565 - RNA, 14 nt, Mycobacterium leprae
uggccaacgccggg

SEQ ID NO: 3222566 - RNA, 18 nt, Mycobacterium leprae
uggccaccguaacucuau

SEQ ID NO: 3222567 - RNA, 13 nt, Mycobacterium leprae
uggccagccgucc

SEQ ID NO: 3222568 - RNA, 15 nt, Mycobacterium leprae
uggccauauaugaac

SEQ ID NO: 3222569 - RNA, 17 nt, Mycobacterium leprae
uggccaucgcaccgauc

SEQ ID NO: 3222570 - RNA, 20 nt, Mycobacterium leprae
uggccauuguugugcugggc

SEQ ID NO: 3222571 - RNA, 22 nt, Mycobacterium leprae
uggcccacgaauaugcccagca

SEQ ID NO: 3222572 - RNA, 17 nt, Mycobacterium leprae
uggccccaauggcggag

SEQ ID NO: 3222573 - RNA, 21 nt, Mycobacterium leprae
uggcccggcuccgguguggag

SEQ ID NO: 3222574 - RNA, 16 nt, Mycobacterium leprae
uggcccgucgcugcug

SEQ ID NO: 3222575 - RNA, 20 nt, Mycobacterium leprae
uggcccgucgcugcuggaug

SEQ ID NO: 3222576 - RNA, 16 nt, Mycobacterium leprae
uggccgaaccugugcg

SEQ ID NO: 3222577 - RNA, 22 nt, Mycobacterium leprae
uggccgaacgugagcgacagcu

SEQ ID NO: 3222578 - RNA, 11 nt, Mycobacterium leprae
uggccgaggag

SEQ ID NO: 3222579 - RNA, 17 nt, Mycobacterium leprae
uggccgaggucgaggau

SEQ ID NO: 3222580 - RNA, 22 nt, Mycobacterium leprae
uggccgcaccugaacaggcacg

SEQ ID NO: 3222581 - RNA, 15 nt, Mycobacterium leprae
uggccggaacagcau

SEQ ID NO: 3222582 - RNA, 18 nt, Mycobacterium leprae
uggccggugagggacgca

SEQ ID NO: 3222583 - RNA, 16 nt, Mycobacterium leprae
uggccguguugcugcu

SEQ ID NO: 3222584 - RNA, 17 nt, Mycobacterium leprae
uggccuaaacuccgggc

SEQ ID NO: 3222585 - RNA, 19 nt, Mycobacterium leprae
uggccucgaggugcaggag

SEQ ID NO: 3222586 - RNA, 18 nt, Mycobacterium leprae
uggccuuaauagaccagc

SEQ ID NO: 3222587 - RNA, 22 nt, Mycobacterium leprae
uggccuuaauagaccagcgugu

SEQ ID NO: 3222588 - RNA, 17 nt, Mycobacterium leprae
uggccuugaggugucgg

SEQ ID NO: 3222589 - RNA, 18 nt, Mycobacterium leprae
uggccuugcggacuggcu

SEQ ID NO: 3222590 - RNA, 21 nt, Mycobacterium leprae
uggcgaaaacccgcgcgugca

SEQ ID NO: 3222591 - RNA, 14 nt, Mycobacterium leprae
uggcgaacaacaaa

SEQ ID NO: 3222592 - RNA, 20 nt, Mycobacterium leprae
uggcgacaagcagucccaag

SEQ ID NO: 3222593 - RNA, 21 nt, Mycobacterium leprae
uggcgacgaccuccgcagcau

SEQ ID NO: 3222594 - RNA, 22 nt, Mycobacterium leprae
uggcgacgaccuccgcagcauc

SEQ ID NO: 3222595 - RNA, 13 nt, Mycobacterium leprae
uggcgaguggagu

SEQ ID NO: 3222596 - RNA, 18 nt, Mycobacterium leprae
uggcgauuuucuugccgu

SEQ ID NO: 3222597 - RNA, 22 nt, Mycobacterium leprae
uggcgcagaccucuuccgccgc

SEQ ID NO: 3222598 - RNA, 14 nt, Mycobacterium leprae
uggcgccugccacu

SEQ ID NO: 3222599 - RNA, 12 nt, Mycobacterium leprae
uggcgcggcacg

SEQ ID NO: 3222600 - RNA, 15 nt, Mycobacterium leprae
uggcgcggcacguuc

SEQ ID NO: 3222601 - RNA, 13 nt, Mycobacterium leprae
uguauuugcgcgg

SEQ ID NO: 3222602 - RNA, 13 nt, Mycobacterium leprae
ugucaacagcgga

SEQ ID NO: 3222603 - RNA, 16 nt, Mycobacterium leprae
ugucaagcacugcagu

SEQ ID NO: 3222604 - RNA, 17 nt, Mycobacterium leprae
ugucaaugguucagcgg

SEQ ID NO: 3222605 - RNA, 14 nt, Mycobacterium leprae
ugucacccgucgug

SEQ ID NO: 3222606 - RNA, 18 nt, Mycobacterium leprae
ugucacuucccaccgugg

SEQ ID NO: 3222607 - RNA, 13 nt, Mycobacterium leprae
ugucagagugcag

SEQ ID NO: 3222608 - RNA, 23 nt, Mycobacterium leprae
ugucagcuaaaagacggcauguc

SEQ ID NO: 3222609 - RNA, 12 nt, Mycobacterium leprae
ugucaucgaacc

SEQ ID NO: 3222610 - RNA, 20 nt, Mycobacterium leprae
uguccaagccgagacugaau

SEQ ID NO: 3222611 - RNA, 18 nt, Mycobacterium leprae
uguccaccgaacccaucc

SEQ ID NO: 3222612 - RNA, 21 nt, Mycobacterium leprae
uguccacugcggcaaagcaca

SEQ ID NO: 3222613 - RNA, 22 nt, Mycobacterium leprae
uguccacugcggcaaagcacac

SEQ ID NO: 3222614 - RNA, 17 nt, Mycobacterium leprae
uguccacuuaccgcggc

SEQ ID NO: 3222615 - RNA, 22 nt, Mycobacterium leprae
uguccaggugcgguaaucccag

SEQ ID NO: 3222616 - RNA, 18 nt, Mycobacterium leprae
uguccaugccacugucgc

SEQ ID NO: 3222617 - RNA, 12 nt, Mycobacterium leprae
uguccauggcuu

SEQ ID NO: 3222618 - RNA, 22 nt, Mycobacterium leprae
ugucccaccgaguuuuuguucc

SEQ ID NO: 3222619 - RNA, 22 nt, Mycobacterium leprae
uguccgcccugaugguuugcug

SEQ ID NO: 3222620 - RNA, 23 nt, Mycobacterium leprae
uguccuacagcaguguucaggcc

SEQ ID NO: 3222621 - RNA, 17 nt, Mycobacterium leprae
ugucgacguuccggccu

SEQ ID NO: 3222622 - RNA, 17 nt, Mycobacterium leprae
ugucgagcuggcugugc

SEQ ID NO: 3222623 - RNA, 14 nt, Mycobacterium leprae
ugucgauacggcca

SEQ ID NO: 3222624 - RNA, 15 nt, Mycobacterium leprae
ugucgaugaugcgcu

SEQ ID NO: 3222625 - RNA, 22 nt, Mycobacterium leprae
ugucgauggcgguguuagcaug

SEQ ID NO: 3222626 - RNA, 16 nt, Mycobacterium leprae
ugucgcgaccaacccg

SEQ ID NO: 3222627 - RNA, 13 nt, Mycobacterium leprae
ugucggacgucga

SEQ ID NO: 3222628 - RNA, 15 nt, Mycobacterium leprae
ugucggccaccggcc

SEQ ID NO: 3222629 - RNA, 16 nt, Mycobacterium leprae
ugucggccaccggccg

SEQ ID NO: 3222630 - RNA, 16 nt, Mycobacterium leprae
ugucggguggucagca

SEQ ID NO: 3222631 - RNA, 13 nt, Mycobacterium leprae
ugucgguaggcug

SEQ ID NO: 3222632 - RNA, 22 nt, Mycobacterium leprae
ugucgucgaaaccauggucuua

SEQ ID NO: 3222633 - RNA, 12 nt, Mycobacterium leprae
ugucgucggccg

SEQ ID NO: 3222634 - RNA, 12 nt, Mycobacterium leprae
ugucguggcugc

SEQ ID NO: 3222635 - RNA, 15 nt, Mycobacterium leprae
ugucguuguccagca

SEQ ID NO: 3222636 - RNA, 15 nt, Mycobacterium leprae
ugucuaccagcaccc

SEQ ID NO: 3222637 - RNA, 11 nt, Mycobacterium leprae
ugucugggauc

SEQ ID NO: 3222638 - RNA, 15 nt, Mycobacterium leprae
ugucugggcuggccc

SEQ ID NO: 3222639 - RNA, 13 nt, Mycobacterium leprae
ugucugucggcua

SEQ ID NO: 3222640 - RNA, 22 nt, Mycobacterium leprae
ugucuucuacugagcgcgaaca

SEQ ID NO: 3222641 - RNA, 15 nt, Mycobacterium leprae
ugugaacgacaccac

SEQ ID NO: 3222642 - RNA, 19 nt, Mycobacterium leprae
ugugaacuagccgccgggu

SEQ ID NO: 3222643 - RNA, 23 nt, Mycobacterium leprae
ugugacagcgugccgaaguguaa

SEQ ID NO: 3222644 - RNA, 15 nt, Mycobacterium leprae
ugugaccagccaucc

SEQ ID NO: 3222645 - RNA, 18 nt, Mycobacterium leprae
ugugaccgugcagcugcc

SEQ ID NO: 3222646 - RNA, 20 nt, Mycobacterium leprae
ugugagugugcaggcagcga

SEQ ID NO: 3222647 - RNA, 12 nt, Mycobacterium leprae
ugugauccucau

SEQ ID NO: 3222648 - RNA, 13 nt, Mycobacterium leprae
ugugcaccacuau

SEQ ID NO: 3222649 - RNA, 12 nt, Mycobacterium leprae
ugugcagcagcu

SEQ ID NO: 3222650 - RNA, 21 nt, Mycobacterium leprae
ugugcagcugaaaugcucuaa

SEQ ID NO: 3222651 - RNA, 16 nt, Mycobacterium leprae
ugugcagcuuguuggc

SEQ ID NO: 3222652 - RNA, 17 nt, Mycobacterium leprae
ugugcauccgccacaug

SEQ ID NO: 3222653 - RNA, 17 nt, Mycobacterium leprae
ugugcaugucauggccu

SEQ ID NO: 3222654 - RNA, 23 nt, Mycobacterium leprae
ugugccacaacguagggaugauc

SEQ ID NO: 3222655 - RNA, 16 nt, Mycobacterium leprae
ugugccgacaccaucc

SEQ ID NO: 3222656 - RNA, 18 nt, Mycobacterium leprae
ugugccgcugaccagucu

SEQ ID NO: 3222657 - RNA, 16 nt, Mycobacterium leprae
ugugccugucacauau

SEQ ID NO: 3222658 - RNA, 13 nt, Mycobacterium leprae
ugugcgagaguac

SEQ ID NO: 3222659 - RNA, 21 nt, Mycobacterium leprae
ugugcgccaggggaaccaucg

SEQ ID NO: 3222660 - RNA, 14 nt, Mycobacterium leprae
ugugcgcgccgccc

SEQ ID NO: 3222661 - RNA, 16 nt, Mycobacterium leprae
ugugcgcgccgcccag

SEQ ID NO: 3222662 - RNA, 22 nt, Mycobacterium leprae
ugugcgcugcuccguggcccaa

SEQ ID NO: 3222663 - RNA, 20 nt, Mycobacterium leprae
ugugcucccugaacuggugg

SEQ ID NO: 3222664 - RNA, 13 nt, Mycobacterium leprae
ugugcuccugacu

SEQ ID NO: 3222665 - RNA, 21 nt, Mycobacterium leprae
ugugcucggucaguccgauug

SEQ ID NO: 3222666 - RNA, 20 nt, Mycobacterium leprae
uguggcacccacucggcggu

SEQ ID NO: 3222667 - RNA, 16 nt, Mycobacterium leprae
uguggccgcaccugaa

SEQ ID NO: 3222668 - RNA, 20 nt, Mycobacterium leprae
uguggccgcaccugaacagg

SEQ ID NO: 3222669 - RNA, 13 nt, Mycobacterium leprae
uguggccgcacgg

SEQ ID NO: 3222670 - RNA, 14 nt, Mycobacterium leprae
uguggccgcacggg

SEQ ID NO: 3222671 - RNA, 17 nt, Mycobacterium leprae
uguggccgcgcuggccu

SEQ ID NO: 3222672 - RNA, 21 nt, Mycobacterium leprae
uguggccguggauaccacuga

SEQ ID NO: 3222673 - RNA, 23 nt, Mycobacterium leprae
uguggccguggauaccacugacg

SEQ ID NO: 3222674 - RNA, 20 nt, Mycobacterium leprae
ugugggcaaccaccaaaaac

SEQ ID NO: 3222675 - RNA, 13 nt, Mycobacterium leprae
ugugggugguuga

SEQ ID NO: 3222676 - RNA, 19 nt, Mycobacterium leprae
uguggguguuuugucggug

SEQ ID NO: 3222677 - RNA, 15 nt, Mycobacterium leprae
uguggucucaaugac

SEQ ID NO: 3222678 - RNA, 16 nt, Mycobacterium leprae
uguggugggcuggugg

SEQ ID NO: 3222679 - RNA, 15 nt, Mycobacterium leprae
ugugucacuguuacu

SEQ ID NO: 3222680 - RNA, 21 nt, Mycobacterium leprae
uguguccacaaccucggccga

SEQ ID NO: 3222681 - RNA, 13 nt, Mycobacterium leprae
uguguguuuugua

SEQ ID NO: 3222682 - RNA, 22 nt, Mycobacterium leprae
uguguucuacccaggccuguug

SEQ ID NO: 3222683 - RNA, 13 nt, Mycobacterium leprae
uguuauaguccgc

SEQ ID NO: 3222684 - RNA, 19 nt, Mycobacterium leprae
uguucacgcagucauccac

SEQ ID NO: 3222685 - RNA, 21 nt, Mycobacterium leprae
uguucggcaggccggccugga

SEQ ID NO: 3222686 - RNA, 14 nt, Mycobacterium leprae
uguucugccaugcc

SEQ ID NO: 3222687 - RNA, 16 nt, Mycobacterium leprae
uguucugcgcuggcca

SEQ ID NO: 3222688 - RNA, 20 nt, Mycobacterium leprae
uguucuggcacccacgcugc

SEQ ID NO: 3222689 - RNA, 22 nt, Mycobacterium leprae
uguugaccggcccucagccagc

SEQ ID NO: 3222690 - RNA, 19 nt, Mycobacterium leprae
uguugagugcgaccugaac

SEQ ID NO: 3222691 - RNA, 12 nt, Mycobacterium leprae
uguugcagccug

SEQ ID NO: 3222692 - RNA, 17 nt, Mycobacterium leprae
uguugcgggguuuuugu

SEQ ID NO: 3222693 - RNA, 21 nt, Mycobacterium leprae
uguugcucaacgggccgcucg

SEQ ID NO: 3222694 - RNA, 13 nt, Mycobacterium leprae
uguugcugagugu

SEQ ID NO: 3222695 - RNA, 17 nt, Mycobacterium leprae
uguugcuugcccugcgg

SEQ ID NO: 3222696 - RNA, 16 nt, Mycobacterium leprae
uguuggcgccugccac

SEQ ID NO: 3222697 - RNA, 18 nt, Mycobacterium leprae
uguuggcuuccagucugg

SEQ ID NO: 3222698 - RNA, 23 nt, Mycobacterium leprae
uguuggcuuucaguuuccgccgu

SEQ ID NO: 3222699 - RNA, 13 nt, Mycobacterium leprae
uguugguaaccag

SEQ ID NO: 3222700 - RNA, 16 nt, Mycobacterium leprae
uguugguccuugcacc

SEQ ID NO: 3222701 - RNA, 14 nt, Mycobacterium leprae
uguuggucgccagu

SEQ ID NO: 3222702 - RNA, 13 nt, Mycobacterium leprae
uguuggucugcuc

SEQ ID NO: 3222703 - RNA, 14 nt, Mycobacterium leprae
uguuguaagcacug

SEQ ID NO: 3222704 - RNA, 20 nt, Mycobacterium leprae
uguuuaggaaacauuguucu

SEQ ID NO: 3222705 - RNA, 15 nt, Mycobacterium leprae
uguuucucgccgacc

SEQ ID NO: 3222706 - RNA, 12 nt, Mycobacterium leprae
uguuugggucuu

SEQ ID NO: 3222707 - RNA, 18 nt, Mycobacterium leprae
uguuuuaagcgaaaauga

SEQ ID NO: 3222708 - RNA, 16 nt, Mycobacterium leprae
uguuuugcuguguugc

SEQ ID NO: 3222709 - RNA, 13 nt, Mycobacterium leprae
uguuuugucggug

SEQ ID NO: 3222710 - RNA, 21 nt, Mycobacterium leprae
uguuuuuuggugccacugaac

SEQ ID NO: 3222711 - RNA, 18 nt, Mycobacterium leprae
uuaaaauaaaccggcaga

SEQ ID NO: 3222712 - RNA, 17 nt, Mycobacterium leprae
uuaaacaguuaaaggua

SEQ ID NO: 3222713 - RNA, 12 nt, Mycobacterium leprae
uuaaaccuuaca

SEQ ID NO: 3222714 - RNA, 20 nt, Mycobacterium leprae
uuaacaacuugacgaugcug

SEQ ID NO: 3222715 - RNA, 18 nt, Mycobacterium leprae
uugaacuuggcacaacaa

SEQ ID NO: 3222716 - RNA, 22 nt, Mycobacterium leprae
uugacaaagaaaaagagcccgg

SEQ ID NO: 3222717 - RNA, 21 nt, Mycobacterium leprae
uugacaacacgaucgcagccc

SEQ ID NO: 3222718 - RNA, 12 nt, Mycobacterium leprae
uugacacaaaga

SEQ ID NO: 3222719 - RNA, 15 nt, Mycobacterium leprae
uugacacaaagaagu

SEQ ID NO: 3222720 - RNA, 14 nt, Mycobacterium leprae
uugacaccgccggc

SEQ ID NO: 3222721 - RNA, 23 nt, Mycobacterium leprae
uugacaccgccggcgucaggcca

SEQ ID NO: 3222722 - RNA, 16 nt, Mycobacterium leprae
uugaccaccaccgcca

SEQ ID NO: 3222723 - RNA, 18 nt, Mycobacterium leprae
uugaccagccgcagcacc

SEQ ID NO: 3222724 - RNA, 12 nt, Mycobacterium leprae
uugaccaggcaa

SEQ ID NO: 3222725 - RNA, 18 nt, Mycobacterium leprae
uugacgaccggcugcacc

SEQ ID NO: 3222726 - RNA, 13 nt, Mycobacterium leprae
uugacgcccuccu

SEQ ID NO: 3222727 - RNA, 23 nt, Mycobacterium leprae
uugacgcccuccuggcgaguggc

SEQ ID NO: 3222728 - RNA, 19 nt, Mycobacterium leprae
uugacguguuuugcugugu

SEQ ID NO: 3222729 - RNA, 17 nt, Mycobacterium leprae
uugacuggcuugaagcc

SEQ ID NO: 3222730 - RNA, 23 nt, Mycobacterium leprae
uugaucacaaauugucagcuaaa

SEQ ID NO: 3222731 - RNA, 23 nt, Mycobacterium leprae
uugaucauucgauccaaugacua

SEQ ID NO: 3222732 - RNA, 18 nt, Mycobacterium leprae
uugauccgagaaaacucg

SEQ ID NO: 3222733 - RNA, 22 nt, Mycobacterium leprae
uugaucgggcccagcacccggc

SEQ ID NO: 3222734 - RNA, 15 nt, Mycobacterium leprae
uugaucuuggugaug

SEQ ID NO: 3222735 - RNA, 17 nt, Mycobacterium leprae
uugaugagaucacugag

SEQ ID NO: 3222736 - RNA, 21 nt, Mycobacterium leprae
uugaugaugccaggggcuggg

SEQ ID NO: 3222737 - RNA, 22 nt, Mycobacterium leprae
uugaugcugcgaguucguuccu

SEQ ID NO: 3222738 - RNA, 22 nt, Mycobacterium leprae
uugauggugucgaugaugcgcu

SEQ ID NO: 3222739 - RNA, 23 nt, Mycobacterium leprae
uugauguauccaggauugaugcc

SEQ ID NO: 3222740 - RNA, 20 nt, Mycobacterium leprae
uugauuaccugcgaccuggu

SEQ ID NO: 3222741 - RNA, 18 nt, Mycobacterium leprae
uugcacaacauccaacca

SEQ ID NO: 3222742 - RNA, 15 nt, Mycobacterium leprae
uugcacauugggauc

SEQ ID NO: 3222743 - RNA, 23 nt, Mycobacterium leprae
uugcacggcaaagucauguucau

SEQ ID NO: 3222744 - RNA, 15 nt, Mycobacterium leprae
uugcacuucgacggu

SEQ ID NO: 3222745 - RNA, 16 nt, Mycobacterium leprae
uugcagacuuuggagc

SEQ ID NO: 3222746 - RNA, 15 nt, Mycobacterium leprae
uugcaggcuucguca

SEQ ID NO: 3222747 - RNA, 14 nt, Mycobacterium leprae
uugcaugagcacug

SEQ ID NO: 3222748 - RNA, 13 nt, Mycobacterium leprae
uugcauuggcuga

SEQ ID NO: 3222749 - RNA, 13 nt, Mycobacterium leprae
uugccaaggucgu

SEQ ID NO: 3222750 - RNA, 16 nt, Mycobacterium leprae
uugccaccaccacccc

SEQ ID NO: 3222751 - RNA, 23 nt, Mycobacterium leprae
uugccauaaaucaucgcugccau

SEQ ID NO: 3222752 - RNA, 18 nt, Mycobacterium leprae
uugcccaaugcagcaacg

SEQ ID NO: 3222753 - RNA, 19 nt, Mycobacterium leprae
uugcccccgcuaccgcggg

SEQ ID NO: 3222754 - RNA, 13 nt, Mycobacterium leprae
uugcccgcugcca

SEQ ID NO: 3222755 - RNA, 14 nt, Mycobacterium leprae
uugccgagcaaguu

SEQ ID NO: 3222756 - RNA, 22 nt, Mycobacterium leprae
uugccgcuccgcgcacagugug

SEQ ID NO: 3222757 - RNA, 16 nt, Mycobacterium leprae
uugccugaugccauca

SEQ ID NO: 3222758 - RNA, 22 nt, Mycobacterium leprae
uugcgacgaccuccucgggggu

SEQ ID NO: 3222759 - RNA, 20 nt, Mycobacterium leprae
uugcgauaauuaugaguggu

SEQ ID NO: 3222760 - RNA, 20 nt, Mycobacterium leprae
uugcgaucaaacucgcugaa

SEQ ID NO: 3222761 - RNA, 18 nt, Mycobacterium leprae
uugcgcacugcccgggug

SEQ ID NO: 3222762 - RNA, 20 nt, Mycobacterium leprae
uugcggacaauucaacgaau

SEQ ID NO: 3222763 - RNA, 17 nt, Mycobacterium leprae
uugcggcgccccucugc

SEQ ID NO: 3222764 - RNA, 21 nt, Mycobacterium leprae
uugcucuagccgggcuaaguc

SEQ ID NO: 3222765 - RNA, 21 nt, Mycobacterium leprae
uugcucugggcgcggacauac

SEQ ID NO: 3222766 - RNA, 15 nt, Mycobacterium leprae
uugcucuuguugacc

SEQ ID NO: 3222767 - RNA, 18 nt, Mycobacterium leprae
uugcugguggaaggccua

SEQ ID NO: 3222768 - RNA, 12 nt, Mycobacterium leprae
uugcuuaacuuu

SEQ ID NO: 3222769 - RNA, 15 nt, Mycobacterium leprae
uugcuugcugugacc

SEQ ID NO: 3222770 - RNA, 21 nt, Mycobacterium leprae
uuggaaccaucaacggcuaca

SEQ ID NO: 3222771 - RNA, 13 nt, Mycobacterium leprae
uuggaaugugcca

SEQ ID NO: 3222772 - RNA, 16 nt, Mycobacterium leprae
uuggaccccaaccaga

SEQ ID NO: 3222773 - RNA, 13 nt, Mycobacterium leprae
uuggagcaggagc

SEQ ID NO: 3222774 - RNA, 13 nt, Mycobacterium leprae
uuggaugguuagc

SEQ ID NO: 3222775 - RNA, 16 nt, Mycobacterium leprae
uuggaugguuagcaug

SEQ ID NO: 3222776 - RNA, 17 nt, Mycobacterium leprae
uuggauucgguguugcu

SEQ ID NO: 3222777 - RNA, 19 nt, Mycobacterium leprae
uuggcacaacaagagaaga

SEQ ID NO: 3222778 - RNA, 14 nt, Mycobacterium leprae
uuggcagugugcau

SEQ ID NO: 3222779 - RNA, 23 nt, Mycobacterium leprae
uuggcccaccgccggacggcacc

SEQ ID NO: 3222780 - RNA, 12 nt, Mycobacterium leprae
uuggccgcggca

SEQ ID NO: 3222781 - RNA, 22 nt, Mycobacterium leprae
uuggccggauguuuggcuguug

SEQ ID NO: 3222782 - RNA, 23 nt, Mycobacterium leprae
uuggcgaguaucgaaucggugau

SEQ ID NO: 3222783 - RNA, 16 nt, Mycobacterium leprae
uuggcggacugaaaac

SEQ ID NO: 3222784 - RNA, 17 nt, Mycobacterium leprae
uuggcgucgaucagggc

SEQ ID NO: 3222785 - RNA, 15 nt, Mycobacterium leprae
uuggcuugagugcug

SEQ ID NO: 3222786 - RNA, 12 nt, Mycobacterium leprae
uuggcuuguccc

SEQ ID NO: 3222787 - RNA, 16 nt, Mycobacterium leprae
uugggagugcuagcgg

SEQ ID NO: 3222788 - RNA, 21 nt, Mycobacterium leprae
uugggcagcuaagaagcugcc

SEQ ID NO: 3222789 - RNA, 22 nt, Mycobacterium leprae
uugggcgguguugcgcggcgcc

SEQ ID NO: 3222790 - RNA, 15 nt, Mycobacterium leprae
uugggcugcccuccu

SEQ ID NO: 3222791 - RNA, 15 nt, Mycobacterium leprae
uugggugcacaaccu

SEQ ID NO: 3222792 - RNA, 13 nt, Mycobacterium leprae
uugggugguggug

SEQ ID NO: 3222793 - RNA, 18 nt, Mycobacterium leprae
uuggguggugguguugug

SEQ ID NO: 3222794 - RNA, 17 nt, Mycobacterium leprae
uuggguuuggucaaugc

SEQ ID NO: 3222795 - RNA, 22 nt, Mycobacterium leprae
uugguacuugugauucagcgcu

SEQ ID NO: 3222796 - RNA, 21 nt, Mycobacterium leprae
uuggucacgggugguuagaau

SEQ ID NO: 3222797 - RNA, 16 nt, Mycobacterium leprae
uugguccgcuacauug

SEQ ID NO: 3222798 - RNA, 22 nt, Mycobacterium leprae
uuggucggggugcugcacggcu

SEQ ID NO: 3222799 - RNA, 17 nt, Mycobacterium leprae
uuggucuacauguugau

SEQ ID NO: 3222800 - RNA, 18 nt, Mycobacterium leprae
uuggucuacauguugaug

SEQ ID NO: 3222801 - RNA, 19 nt, Mycobacterium leprae
uuggugaugucgacugcuu

SEQ ID NO: 3222802 - RNA, 17 nt, Mycobacterium leprae
uuggugccguccucguc

SEQ ID NO: 3222803 - RNA, 15 nt, Mycobacterium leprae
uugguuaaucaccuc

SEQ ID NO: 3222804 - RNA, 17 nt, Mycobacterium leprae
uugguuauucuaggcga

SEQ ID NO: 3222805 - RNA, 15 nt, Mycobacterium leprae
uugguucauggcagu

SEQ ID NO: 3222806 - RNA, 18 nt, Mycobacterium leprae
uugguuggggaaaugaca

SEQ ID NO: 3222807 - RNA, 15 nt, Mycobacterium leprae
uugguuuuguuguug

SEQ ID NO: 3222808 - RNA, 15 nt, Mycobacterium leprae
uuguacuuugugugc

SEQ ID NO: 3222809 - RNA, 20 nt, Mycobacterium leprae
uuguagaccaugagcacacg

SEQ ID NO: 3222810 - RNA, 22 nt, Mycobacterium leprae
uugucacgccggucgaagugac

SEQ ID NO: 3222811 - RNA, 12 nt, Mycobacterium leprae
uugucagaucuc

SEQ ID NO: 3222812 - RNA, 15 nt, Mycobacterium leprae
uugucagcggacaaa

SEQ ID NO: 3222813 - RNA, 20 nt, Mycobacterium leprae
uugucagguaucucuagaaa

SEQ ID NO: 3222814 - RNA, 15 nt, Mycobacterium leprae
uugucaucgacuacu

SEQ ID NO: 3222815 - RNA, 21 nt, Mycobacterium leprae
uugucgccaguaugugaugca

SEQ ID NO: 3222816 - RNA, 20 nt, Mycobacterium leprae
uugucgcgucggguuaugca

SEQ ID NO: 3222817 - RNA, 21 nt, Mycobacterium leprae
uugucgucggccgcggcgacc

SEQ ID NO: 3222818 - RNA, 12 nt, Mycobacterium leprae
uugucguuaugc

SEQ ID NO: 3222819 - RNA, 15 nt, Mycobacterium leprae
uugucguuccagcuu

SEQ ID NO: 3222820 - RNA, 23 nt, Mycobacterium leprae
uugucguucgucugaaccagggg

SEQ ID NO: 3222821 - RNA, 24 nt, Mycobacterium leprae
uugucuaccacauaaacauugugc

SEQ ID NO: 3222822 - RNA, 17 nt, Mycobacterium leprae
uugucuauuuugucaga

SEQ ID NO: 3222823 - RNA, 14 nt, Mycobacterium leprae
uugugccgcugcau

SEQ ID NO: 3222824 - RNA, 17 nt, Mycobacterium leprae
uugugcggaccguggug

SEQ ID NO: 3222825 - RNA, 16 nt, Mycobacterium leprae
uuguggcggccgacca

SEQ ID NO: 3222826 - RNA, 15 nt, Mycobacterium leprae
uugugggcaggucag

SEQ ID NO: 3222827 - RNA, 16 nt, Mycobacterium leprae
uuguuagcgccgcggg

SEQ ID NO: 3222828 - RNA, 20 nt, Mycobacterium leprae
uuaucgaucucgcauauuca

SEQ ID NO: 3222829 - RNA, 23 nt, Mycobacterium leprae
uuaucgauuucagccagggucac

SEQ ID NO: 3222830 - RNA, 19 nt, Mycobacterium leprae
uuaucguuacggucuuucg

SEQ ID NO: 3222831 - RNA, 14 nt, Mycobacterium leprae
uuaucugcaacuca

SEQ ID NO: 3222832 - RNA, 14 nt, Mycobacterium leprae
uuaugacuguggcu

SEQ ID NO: 3222833 - RNA, 18 nt, Mycobacterium leprae
uuaugcagugauuaagua

SEQ ID NO: 3222834 - RNA, 23 nt, Mycobacterium leprae
uuauguuauuuauagaugccagu

SEQ ID NO: 3222835 - RNA, 13 nt, Mycobacterium leprae
uuauuaccgauaa

SEQ ID NO: 3222836 - RNA, 22 nt, Mycobacterium leprae
uuauucgggagcgucucgcgca

SEQ ID NO: 3222837 - RNA, 14 nt, Mycobacterium leprae
uuauucuuuuagag

SEQ ID NO: 3222838 - RNA, 21 nt, Mycobacterium leprae
uuauugauggaguuuuuguuu

SEQ ID NO: 3222839 - RNA, 12 nt, Mycobacterium leprae
uuauugcugugu

SEQ ID NO: 3222840 - RNA, 23 nt, Mycobacterium leprae
uuauuucgucgucagcugcugaa

SEQ ID NO: 3222841 - RNA, 16 nt, Mycobacterium leprae
uuauuugcgucguggg

SEQ ID NO: 3222842 - RNA, 15 nt, Mycobacterium leprae
uucaagacugcaccc

SEQ ID NO: 3222843 - RNA, 20 nt, Mycobacterium leprae
uucaaggaauugaucacaaa

SEQ ID NO: 3222844 - RNA, 12 nt, Mycobacterium leprae
uucaauaagaaa

SEQ ID NO: 3222845 - RNA, 12 nt, Mycobacterium leprae
uucaauccgcgc

SEQ ID NO: 3222846 - RNA, 18 nt, Mycobacterium leprae
uucaauuaguuacugaau

SEQ ID NO: 3222847 - RNA, 17 nt, Mycobacterium leprae
uucacagugccgaaagc

SEQ ID NO: 3222848 - RNA, 19 nt, Mycobacterium leprae
uucacgaacaacagagcaa

SEQ ID NO: 3222849 - RNA, 23 nt, Mycobacterium leprae
uucacguaucggcgagaugcgcu

SEQ ID NO: 3222850 - RNA, 22 nt, Mycobacterium leprae
uucacuaacacgauacugcugc

SEQ ID NO: 3222851 - RNA, 12 nt, Mycobacterium leprae
uucacuggcccg

SEQ ID NO: 3222852 - RNA, 14 nt, Mycobacterium leprae
uucagagcugcagg

SEQ ID NO: 3222853 - RNA, 13 nt, Mycobacterium leprae
uucagcacuggca

SEQ ID NO: 3222854 - RNA, 15 nt, Mycobacterium leprae
uucagccacauugcc

SEQ ID NO: 3222855 - RNA, 13 nt, Mycobacterium leprae
uucagccgucgcu

SEQ ID NO: 3222856 - RNA, 22 nt, Mycobacterium leprae
uucagcgaagaguuucugcugc

SEQ ID NO: 3222857 - RNA, 14 nt, Mycobacterium leprae
uucaggccaucaga

SEQ ID NO: 3222858 - RNA, 15 nt, Mycobacterium leprae
uucaggugugcugca

SEQ ID NO: 3222859 - RNA, 22 nt, Mycobacterium leprae
uucauagggagaaugccacagg

SEQ ID NO: 3222860 - RNA, 16 nt, Mycobacterium leprae
uucauggcuugcugca

SEQ ID NO: 3222861 - RNA, 23 nt, Mycobacterium leprae
uucauuauugucggucugccuug

SEQ ID NO: 3222862 - RNA, 16 nt, Mycobacterium leprae
uuccaauccugucacc

SEQ ID NO: 3222863 - RNA, 19 nt, Mycobacterium leprae
uuccaauugcgacccgguu

SEQ ID NO: 3222864 - RNA, 20 nt, Mycobacterium leprae
uuccacugccagagaugcgu

SEQ ID NO: 3222865 - RNA, 19 nt, Mycobacterium leprae
uuccaguggcugcaccggc

SEQ ID NO: 3222866 - RNA, 13 nt, Mycobacterium leprae
uuccaugaugguu

SEQ ID NO: 3222867 - RNA, 22 nt, Mycobacterium leprae
uucccaccgugguguugucgcc

SEQ ID NO: 3222868 - RNA, 22 nt, Mycobacterium leprae
uucccgcugagcaauuucuucu

SEQ ID NO: 3222869 - RNA, 12 nt, Mycobacterium leprae
uuccgauuggug

SEQ ID NO: 3222870 - RNA, 21 nt, Mycobacterium leprae
uuccgcagcgacggcaagcug

SEQ ID NO: 3222871 - RNA, 16 nt, Mycobacterium leprae
uuccgccgucgaucuc

SEQ ID NO: 3222872 - RNA, 22 nt, Mycobacterium leprae
uuccgccguucucccgccacuc

SEQ ID NO: 3222873 - RNA, 20 nt, Mycobacterium leprae
uuccgcgcuagacgucuguc

SEQ ID NO: 3222874 - RNA, 17 nt, Mycobacterium leprae
uuccggagacggcagcg

SEQ ID NO: 3222875 - RNA, 19 nt, Mycobacterium leprae
uuccggcgaccagcgagca

SEQ ID NO: 3222876 - RNA, 18 nt, Mycobacterium leprae
uuccuacuucugggucgc

SEQ ID NO: 3222877 - RNA, 20 nt, Mycobacterium leprae
uuccucgcgggcggcgugau

SEQ ID NO: 3222878 - RNA, 22 nt, Mycobacterium leprae
uuccuggcgaucgauccaguag

SEQ ID NO: 3222879 - RNA, 21 nt, Mycobacterium leprae
uucgacaagcccccgcggauc

SEQ ID NO: 3222880 - RNA, 14 nt, Mycobacterium leprae
uucgacccaguacu

SEQ ID NO: 3222881 - RNA, 15 nt, Mycobacterium leprae
uucgacgaucaccgc

SEQ ID NO: 3222882 - RNA, 22 nt, Mycobacterium leprae
uucgagaaaaauuggcaacuuc

SEQ ID NO: 3222883 - RNA, 15 nt, Mycobacterium leprae
uucgcgaucuggaug

SEQ ID NO: 3222884 - RNA, 21 nt, Mycobacterium leprae
uucgcuaacuucccgacggug

SEQ ID NO: 3222885 - RNA, 20 nt, Mycobacterium leprae
uucggaaucgcgugcuauga

SEQ ID NO: 3222886 - RNA, 19 nt, Mycobacterium leprae
uucggacggugcaggugcc

SEQ ID NO: 3222887 - RNA, 13 nt, Mycobacterium leprae
uucggagaucgac

SEQ ID NO: 3222888 - RNA, 15 nt, Mycobacterium leprae
uucggcacccaucca

SEQ ID NO: 3222889 - RNA, 12 nt, Mycobacterium leprae
uucggccagcgc

SEQ ID NO: 3222890 - RNA, 15 nt, Mycobacterium leprae
uucgguagucguggg

SEQ ID NO: 3222891 - RNA, 18 nt, Mycobacterium leprae
uucgguagucgugggggg

SEQ ID NO: 3222892 - RNA, 21 nt, Mycobacterium leprae
uucggucaggucaugccaggg

SEQ ID NO: 3222893 - RNA, 19 nt, Mycobacterium leprae
uucgguccgcucaccgcgg

SEQ ID NO: 3222894 - RNA, 20 nt, Mycobacterium leprae
uucggugacgaacaugcagu

SEQ ID NO: 3222895 - RNA, 22 nt, Mycobacterium leprae
uucgguugggacagaagugguu

SEQ ID NO: 3222896 - RNA, 15 nt, Mycobacterium leprae
uucgguuuccucauu

SEQ ID NO: 3222897 - RNA, 20 nt, Mycobacterium leprae
uucguacaacguguuuagga

SEQ ID NO: 3222898 - RNA, 14 nt, Mycobacterium leprae
uucgucgaguaaug

SEQ ID NO: 3222899 - RNA, 14 nt, Mycobacterium leprae
uucguuaacagcgg

SEQ ID NO: 3222900 - RNA, 22 nt, Mycobacterium leprae
uucguuuggguugggugggggu

SEQ ID NO: 3222901 - RNA, 20 nt, Mycobacterium leprae
uucuaaccggucaaucaggu

SEQ ID NO: 3222902 - RNA, 18 nt, Mycobacterium leprae
uucuaguugauaugcguu

SEQ ID NO: 3222903 - RNA, 19 nt, Mycobacterium leprae
uucuccagucgcauccucg

SEQ ID NO: 3222904 - RNA, 17 nt, Mycobacterium leprae
uucuccguucacagugc

SEQ ID NO: 3222905 - RNA, 16 nt, Mycobacterium leprae
uucucgugguggcugg

SEQ ID NO: 3222906 - RNA, 19 nt, Mycobacterium leprae
uucugcacaacgauacguu

SEQ ID NO: 3222907 - RNA, 15 nt, Mycobacterium leprae
uucugccaugccagu

SEQ ID NO: 3222908 - RNA, 16 nt, Mycobacterium leprae
uucugccucgucgaug

SEQ ID NO: 3222909 - RNA, 21 nt, Mycobacterium leprae
uucugcgccggggauuucagg

SEQ ID NO: 3222910 - RNA, 20 nt, Mycobacterium leprae
uucugcgguaucaucaagca

SEQ ID NO: 3222911 - RNA, 18 nt, Mycobacterium leprae
uucugcugccgcguucgu

SEQ ID NO: 3222912 - RNA, 18 nt, Mycobacterium leprae
uucuggcacccacgcugc

SEQ ID NO: 3222913 - RNA, 18 nt, Mycobacterium leprae
uucugguggggauacagc

SEQ ID NO: 3222914 - RNA, 23 nt, Mycobacterium leprae
uucuguauggcuccaaguggcug

SEQ ID NO: 3222915 - RNA, 15 nt, Mycobacterium leprae
uucuguuauuucugg

SEQ ID NO: 3222916 - RNA, 17 nt, Mycobacterium leprae
uucuucagcuacagcgg

SEQ ID NO: 3222917 - RNA, 15 nt, Mycobacterium leprae
uucuugugaguuguc

SEQ ID NO: 3222918 - RNA, 16 nt, Mycobacterium leprae
uugaacugcagguugu

SEQ ID NO: 3222919 - RNA, 21 nt, Mycobacterium leprae
uugaacugcagguuguugacg

SEQ ID NO: 3222920 - RNA, 23 nt, Mycobacterium leprae
uugacacaaagaaguaaagcccu

SEQ ID NO: 3222921 - RNA, 18 nt, Mycobacterium leprae
uugacaccgcagggcugu

SEQ ID NO: 3222922 - RNA, 17 nt, Mycobacterium leprae
uugaccaccaccgccac

SEQ ID NO: 3222923 - RNA, 18 nt, Mycobacterium leprae
uugaccaccgaaccgggc

SEQ ID NO: 3222924 - RNA, 13 nt, Mycobacterium leprae
uugaccagacaaa

SEQ ID NO: 3222925 - RNA, 14 nt, Mycobacterium leprae
uugaccgucaugcu

SEQ ID NO: 3222926 - RNA, 16 nt, Mycobacterium leprae
uugaccgucaugcugc

SEQ ID NO: 3222927 - RNA, 22 nt, Mycobacterium leprae
uugaccucaucccacagauucg

SEQ ID NO: 3222928 - RNA, 17 nt, Mycobacterium leprae
uugaccucuucaggcaa

SEQ ID NO: 3222929 - RNA, 23 nt, Mycobacterium leprae
uugacgccucagccacacucgac

SEQ ID NO: 3222930 - RNA, 13 nt, Mycobacterium leprae
uugacgcugcuug

SEQ ID NO: 3222931 - RNA, 20 nt, Mycobacterium leprae
uugacgugaucgcagaagcc

SEQ ID NO: 3222932 - RNA, 17 nt, Mycobacterium leprae
uugacuacaucuagcau

SEQ ID NO: 3222933 - RNA, 12 nt, Mycobacterium leprae
uugagcggcacc

SEQ ID NO: 3222934 - RNA, 20 nt, Mycobacterium leprae
uugaggaacgacuugaccag

SEQ ID NO: 3222935 - RNA, 16 nt, Mycobacterium leprae
uugaggucgcacagca

SEQ ID NO: 3222936 - RNA, 18 nt, Mycobacterium leprae
uugaggugucggcguggu

SEQ ID NO: 3222937 - RNA, 17 nt, Mycobacterium leprae
uugagugcgaccugaac

SEQ ID NO: 3222938 - RNA, 13 nt, Mycobacterium leprae
uugaucaacccca

SEQ ID NO: 3222939 - RNA, 20 nt, Mycobacterium leprae
uugaugcacgcgcgccuggg

SEQ ID NO: 3222940 - RNA, 18 nt, Mycobacterium leprae
uuucguguuuucaguuca

SEQ ID NO: 3222941 - RNA, 22 nt, Mycobacterium leprae
uuucucggugucaucuaucucc

SEQ ID NO: 3222942 - RNA, 20 nt, Mycobacterium leprae
uuucucgguugugaaccacu

SEQ ID NO: 3222943 - RNA, 12 nt, Mycobacterium leprae
uuucucuaaaag

SEQ ID NO: 3222944 - RNA, 13 nt, Mycobacterium leprae
uuucugcuaucca

SEQ ID NO: 3222945 - RNA, 14 nt, Mycobacterium leprae
uuugagaacagccu

SEQ ID NO: 3222946 - RNA, 13 nt, Mycobacterium leprae
uuugaggucgaca

SEQ ID NO: 3222947 - RNA, 16 nt, Mycobacterium leprae
uuugaggugcaggcac

SEQ ID NO: 3222948 - RNA, 15 nt, Mycobacterium leprae
uuugcacaacaucca

SEQ ID NO: 3222949 - RNA, 16 nt, Mycobacterium leprae
uuugcaggugcuuucu

SEQ ID NO: 3222950 - RNA, 13 nt, Mycobacterium leprae
uuugcuggucagg

SEQ ID NO: 3222951 - RNA, 21 nt, Mycobacterium leprae
uuugcuucacuuagccauguc

SEQ ID NO: 3222952 - RNA, 22 nt, Mycobacterium leprae
uuuggcaguaccaaaguggauu

SEQ ID NO: 3222953 - RNA, 18 nt, Mycobacterium leprae
uuuggccuccaaguauac

SEQ ID NO: 3222954 - RNA, 13 nt, Mycobacterium leprae
uuuggugcugccc

SEQ ID NO: 3222955 - RNA, 13 nt, Mycobacterium leprae
uuugucagauaac

SEQ ID NO: 3222956 - RNA, 16 nt, Mycobacterium leprae
uuugugggcaggucag

SEQ ID NO: 3222957 - RNA, 10 nt, Mycobacterium leprae
uuuguuugga

SEQ ID NO: 3222958 - RNA, 18 nt, Mycobacterium leprae
uuuuaagcgaaaaugaaa

SEQ ID NO: 3222959 - RNA, 20 nt, Mycobacterium leprae
uuuucguugugccgcugcau

SEQ ID NO: 3222960 - RNA, 16 nt, Mycobacterium leprae
uuuugaacuuucggcg

SEQ ID NO: 3222961 - RNA, 16 nt, Mycobacterium leprae
uuuugcccaaugcagc

SEQ ID NO: 3222962 - RNA, 13 nt, Mycobacterium leprae
uuuugcguuuuau

SEQ ID NO: 3222963 - RNA, 19 nt, Mycobacterium leprae
uuuugcuagauaucucgcc

SEQ ID NO: 3222964 - RNA, 23 nt, Mycobacterium leprae
uuuuggccgcggucgugcugcug

SEQ ID NO: 3222965 - RNA, 21 nt, Mycobacterium leprae
uuuuguuguuguugauuuuuu

SEQ ID NO: 3222966 - RNA, 23 nt, Mycobacterium leprae
uuuuuggaccccaaccagaccca

SEQ ID NO: 3222967 - RNA, 14 nt, Mycobacterium leprae
ugugaagcugaggc

SEQ ID NO: 3222968 - RNA, 16 nt, Mycobacterium leprae
ugugaagcugaggcga

SEQ ID NO: 3222969 - RNA, 20 nt, Mycobacterium leprae
ugugaccagccauccgaaac

SEQ ID NO: 3222970 - RNA, 22 nt, Mycobacterium leprae
ugugacguucgaugccccaucu

SEQ ID NO: 3222971 - RNA, 15 nt, Mycobacterium leprae
ugugaggguaguugu

SEQ ID NO: 3222972 - RNA, 15 nt, Mycobacterium leprae
ugugaggucauuaac

SEQ ID NO: 3222973 - RNA, 23 nt, Mycobacterium leprae
ugugaucgagaagggagugcagu

SEQ ID NO: 3222974 - RNA, 17 nt, Mycobacterium leprae
ugugaugccgaagcaga

SEQ ID NO: 3222975 - RNA, 14 nt, Mycobacterium leprae
ugugcaaucgaucc

SEQ ID NO: 3222976 - RNA, 18 nt, Mycobacterium leprae
ugugcaggaccgugcuau

SEQ ID NO: 3222977 - RNA, 20 nt, Mycobacterium leprae
ugugccacgucgaucagcgg

SEQ ID NO: 3222978 - RNA, 17 nt, Mycobacterium leprae
ugugccagcgcucgcug

SEQ ID NO: 3222979 - RNA, 13 nt, Mycobacterium leprae
ugugccgccgacg

SEQ ID NO: 3222980 - RNA, 21 nt, Mycobacterium leprae
ugugccgcugaccagucuucc

SEQ ID NO: 3222981 - RNA, 18 nt, Mycobacterium leprae
ugugccgcugcauccgca

SEQ ID NO: 3222982 - RNA, 19 nt, Mycobacterium leprae
ugugccgcugcauccgcag

SEQ ID NO: 3222983 - RNA, 16 nt, Mycobacterium leprae
ugugcgacaucuuuuc

SEQ ID NO: 3222984 - RNA, 15 nt, Mycobacterium leprae
ugugcuaaccgggcc

SEQ ID NO: 3222985 - RNA, 21 nt, Mycobacterium leprae
ugugcuagcugauuuggccgc

SEQ ID NO: 3222986 - RNA, 18 nt, Mycobacterium leprae
ugugcugaaggcgauauc

SEQ ID NO: 3222987 - RNA, 13 nt, Mycobacterium leprae
ugugcugagagca

SEQ ID NO: 3222988 - RNA, 20 nt, Mycobacterium leprae
ugugcugggcggauguguca

SEQ ID NO: 3222989 - RNA, 12 nt, Mycobacterium leprae
uguggagccugc

SEQ ID NO: 3222990 - RNA, 18 nt, Mycobacterium leprae
uguggcacccacucggcg

SEQ ID NO: 3222991 - RNA, 14 nt, Mycobacterium leprae
uguggcauccgcca

SEQ ID NO: 3222992 - RNA, 22 nt, Mycobacterium leprae
uguggccaaugcgcguugugcc

SEQ ID NO: 3222993 - RNA, 22 nt, Mycobacterium leprae
uguggccgcaccugaacaggca

SEQ ID NO: 3222994 - RNA, 16 nt, Mycobacterium leprae
uguggccgcgcuggcc

SEQ ID NO: 3222995 - RNA, 20 nt, Mycobacterium leprae
uguggcgauacgcgcuugcc

SEQ ID NO: 3222996 - RNA, 17 nt, Mycobacterium leprae
ugugggcagugccuggc

SEQ ID NO: 3222997 - RNA, 13 nt, Mycobacterium leprae
ugugugaccagcc

SEQ ID NO: 3222998 - RNA, 22 nt, Mycobacterium leprae
ugugugaccagccauccgaaac

SEQ ID NO: 3222999 - RNA, 14 nt, Mycobacterium leprae
ugugugcuggccaa

SEQ ID NO: 3223000 - RNA, 13 nt, Mycobacterium leprae
uguguugaacagu

SEQ ID NO: 3223001 - RNA, 13 nt, Mycobacterium leprae
uguguugccaucg

SEQ ID NO: 3223002 - RNA, 15 nt, Mycobacterium leprae
uguguuugguuuugu

SEQ ID NO: 3223003 - RNA, 18 nt, Mycobacterium leprae
uguuaaaauaaaccggca

SEQ ID NO: 3223004 - RNA, 20 nt, Mycobacterium leprae
uguuaaacaguuaaagguaa

SEQ ID NO: 3223005 - RNA, 14 nt, Mycobacterium leprae
uguuagugcugcug

SEQ ID NO: 3223006 - RNA, 19 nt, Mycobacterium leprae
uguuauuucuggcuauugu

SEQ ID NO: 3223007 - RNA, 16 nt, Mycobacterium leprae
uguucaaaagccacac

SEQ ID NO: 3223008 - RNA, 13 nt, Mycobacterium leprae
uguucaacaacaa

SEQ ID NO: 3223009 - RNA, 22 nt, Mycobacterium leprae
uguucaccucguucaagauacu

SEQ ID NO: 3223010 - RNA, 23 nt, Mycobacterium leprae
uguucacgcagucauccacugcg

SEQ ID NO: 3223011 - RNA, 13 nt, Mycobacterium leprae
uguucacuaacac

SEQ ID NO: 3223012 - RNA, 22 nt, Mycobacterium leprae
uguucauaucgcgcaacgacug

SEQ ID NO: 3223013 - RNA, 16 nt, Mycobacterium leprae
uguucauugaugaaug

SEQ ID NO: 3223014 - RNA, 13 nt, Mycobacterium leprae
uguuccgguucca

SEQ ID NO: 3223015 - RNA, 22 nt, Mycobacterium leprae
uguuccuauguuggucugcuca

SEQ ID NO: 3223016 - RNA, 16 nt, Mycobacterium leprae
uguucgaccaggaugu

SEQ ID NO: 3223017 - RNA, 16 nt, Mycobacterium leprae
uguucgcuccgcccac

SEQ ID NO: 3223018 - RNA, 18 nt, Mycobacterium leprae
uguucggcacccauccaa

SEQ ID NO: 3223019 - RNA, 18 nt, Mycobacterium leprae
uguucugggaacugccgg

SEQ ID NO: 3223020 - RNA, 19 nt, Mycobacterium leprae
uguucuuaggcacuggcca

SEQ ID NO: 3223021 - RNA, 14 nt, Mycobacterium leprae
uguugaacauucuc

SEQ ID NO: 3223022 - RNA, 23 nt, Mycobacterium leprae
uguugacgaugaucuuggcccgg

SEQ ID NO: 3223023 - RNA, 12 nt, Mycobacterium leprae
uguugaucgacg

SEQ ID NO: 3223024 - RNA, 11 nt, Mycobacterium leprae
uguugcagugu

SEQ ID NO: 3223025 - RNA, 21 nt, Mycobacterium leprae
uguugccaucgacgccgccgu

SEQ ID NO: 3223026 - RNA, 15 nt, Mycobacterium leprae
uguugcuuguugccg

SEQ ID NO: 3223027 - RNA, 22 nt, Mycobacterium leprae
uguuggacaacacguuucugca

SEQ ID NO: 3223028 - RNA, 14 nt, Mycobacterium leprae
uguuggccagcagc

SEQ ID NO: 3223029 - RNA, 17 nt, Mycobacterium leprae
uguuguaagaauaaggu

SEQ ID NO: 3223030 - RNA, 15 nt, Mycobacterium leprae
uguugucgccgaaac

SEQ ID NO: 3223031 - RNA, 19 nt, Mycobacterium leprae
uguuguggugggcuggugg

SEQ ID NO: 3223032 - RNA, 12 nt, Mycobacterium leprae
uguuuaggaaac

SEQ ID NO: 3223033 - RNA, 17 nt, Mycobacterium leprae
uguuucagcguggcuag

SEQ ID NO: 3223034 - RNA, 16 nt, Mycobacterium leprae
uguuucgauguggcuu

SEQ ID NO: 3223035 - RNA, 13 nt, Mycobacterium leprae
gcgacacggcugu

SEQ ID NO: 3223036 - RNA, 16 nt, Mycobacterium leprae
gcgacacuacuguugu

SEQ ID NO: 3223037 - RNA, 19 nt, Mycobacterium leprae
gcgacagguaguagccgcu

SEQ ID NO: 3223038 - RNA, 16 nt, Mycobacterium leprae
gcgacaguaucgacca

SEQ ID NO: 3223039 - RNA, 20 nt, Mycobacterium leprae
gcgacaguaucgaccagcca

SEQ ID NO: 3223040 - RNA, 23 nt, Mycobacterium leprae
gcgacaguaucgaccagccacgc

SEQ ID NO: 3223041 - RNA, 21 nt, Mycobacterium leprae
gcgacauacaaucgcggcaca

SEQ ID NO: 3223042 - RNA, 22 nt, Mycobacterium leprae
gcgacauauucgcuacgcccga

SEQ ID NO: 3223043 - RNA, 18 nt, Mycobacterium leprae
gcgacaucucggucaggu

SEQ ID NO: 3223044 - RNA, 16 nt, Mycobacterium leprae
gcgacauucaccagua

SEQ ID NO: 3223045 - RNA, 14 nt, Mycobacterium leprae
gcgaccaacgccga

SEQ ID NO: 3223046 - RNA, 17 nt, Mycobacterium leprae
gcgaccaacgccgagcc

SEQ ID NO: 3223047 - RNA, 14 nt, Mycobacterium leprae
gcgaccagcgagca

SEQ ID NO: 3223048 - RNA, 20 nt, Mycobacterium leprae
gcgaccaguuuacaucggag

SEQ ID NO: 3223049 - RNA, 15 nt, Mycobacterium leprae
gcgaccgagcgcgac

SEQ ID NO: 3223050 - RNA, 15 nt, Mycobacterium leprae
gcgaccggaugaaca

SEQ ID NO: 3223051 - RNA, 15 nt, Mycobacterium leprae
gcgaccugaacauua

SEQ ID NO: 3223052 - RNA, 15 nt, Mycobacterium leprae
gcgaccuggucgagc

SEQ ID NO: 3223053 - RNA, 17 nt, Mycobacterium leprae
gcgacgaaauccucacc

SEQ ID NO: 3223054 - RNA, 19 nt, Mycobacterium leprae
gcgacgaccuccgcagcau

SEQ ID NO: 3223055 - RNA, 15 nt, Mycobacterium leprae
gcgacgaccuccucg

SEQ ID NO: 3223056 - RNA, 12 nt, Mycobacterium leprae
gcgacgccaggc

SEQ ID NO: 3223057 - RNA, 17 nt, Mycobacterium leprae
gcgacgucccaagcgcu

SEQ ID NO: 3223058 - RNA, 13 nt, Mycobacterium leprae
gcgacugcagugu

SEQ ID NO: 3223059 - RNA, 14 nt, Mycobacterium leprae
gcgacuucgaugcg

SEQ ID NO: 3223060 - RNA, 19 nt, Mycobacterium leprae
gcgacuucgaugcgaugcg

SEQ ID NO: 3223061 - RNA, 19 nt, Mycobacterium leprae
gcgagaauuuugugcugcg

SEQ ID NO: 3223062 - RNA, 15 nt, Mycobacterium leprae
gcgagaucggguuga

SEQ ID NO: 3223063 - RNA, 19 nt, Mycobacterium leprae
gcgagaucggguugacgcu

SEQ ID NO: 3223064 - RNA, 15 nt, Mycobacterium leprae
gcgagauugccaccg

SEQ ID NO: 3223065 - RNA, 14 nt, Mycobacterium leprae
gcgagcaucuggcc

SEQ ID NO: 3223066 - RNA, 21 nt, Mycobacterium leprae
gcgagcaucuggccgugcggc

SEQ ID NO: 3223067 - RNA, 23 nt, Mycobacterium leprae
gcgagccacuccgguugcggcga

SEQ ID NO: 3223068 - RNA, 19 nt, Mycobacterium leprae
gcgagcccagugugucggc

SEQ ID NO: 3223069 - RNA, 19 nt, Mycobacterium leprae
gcgagcuggggcggccgcc

SEQ ID NO: 3223070 - RNA, 15 nt, Mycobacterium leprae
gcgaggaccaccugg

SEQ ID NO: 3223071 - RNA, 20 nt, Mycobacterium leprae
gcgaggcguccguuuuucac

SEQ ID NO: 3223072 - RNA, 19 nt, Mycobacterium leprae
gcgaggucaacguuugucg

SEQ ID NO: 3223073 - RNA, 17 nt, Mycobacterium leprae
gcgaguacguccgcgcc

SEQ ID NO: 3223074 - RNA, 21 nt, Mycobacterium leprae
gcgaguaucgaaucggugauc

SEQ ID NO: 3223075 - RNA, 20 nt, Mycobacterium leprae
gcgagugcugacgccgggca

SEQ ID NO: 3223076 - RNA, 12 nt, Mycobacterium leprae
gcgagugcuggu

SEQ ID NO: 3223077 - RNA, 15 nt, Mycobacterium leprae
gcgagugcuggucaa

SEQ ID NO: 3223078 - RNA, 17 nt, Mycobacterium leprae
gcgauauauaccuacga

SEQ ID NO: 3223079 - RNA, 15 nt, Mycobacterium leprae
gcgauauccgccggc

SEQ ID NO: 3223080 - RNA, 19 nt, Mycobacterium leprae
gcgauaucgaugcaggcgu

SEQ ID NO: 3223081 - RNA, 17 nt, Mycobacterium leprae
gcgaucaugagcaacac

SEQ ID NO: 3223082 - RNA, 13 nt, Mycobacterium leprae
gcgauccgcguga

SEQ ID NO: 3223083 - RNA, 15 nt, Mycobacterium leprae
gcgaucgcagucauc

SEQ ID NO: 3223084 - RNA, 18 nt, Mycobacterium leprae
gcgaucgcagucaucacc

SEQ ID NO: 3223085 - RNA, 18 nt, Mycobacterium leprae
gcgaucugcauucugagu

SEQ ID NO: 3223086 - RNA, 21 nt, Mycobacterium leprae
gcgaucuggauggccgccagc

SEQ ID NO: 3223087 - RNA, 22 nt, Mycobacterium leprae
gcgaucuggauggccgccagca

SEQ ID NO: 3223088 - RNA, 16 nt, Mycobacterium leprae
gcgaugaaauccgcag

SEQ ID NO: 3223089 - RNA, 18 nt, Mycobacterium leprae
gcgaugaccggcgguggc

SEQ ID NO: 3223090 - RNA, 20 nt, Mycobacterium leprae
gcgaugagauucgagcgggc

SEQ ID NO: 3223091 - RNA, 16 nt, Mycobacterium leprae
gcgauggggggcagca

SEQ ID NO: 3223092 - RNA, 18 nt, Mycobacterium leprae
gcgaugucgagcggacca

SEQ ID NO: 3223093 - RNA, 20 nt, Mycobacterium leprae
gcgauuccagcaacucucaa

SEQ ID NO: 3223094 - RNA, 17 nt, Mycobacterium leprae
gcgauugaugcacgcgc

SEQ ID NO: 3223095 - RNA, 21 nt, Mycobacterium leprae
gcgauugaugcacgcgcgccu

SEQ ID NO: 3223096 - RNA, 15 nt, Mycobacterium leprae
gcgauugccaccacc

SEQ ID NO: 3223097 - RNA, 16 nt, Mycobacterium leprae
gcgauugccaccacca

SEQ ID NO: 3223098 - RNA, 22 nt, Mycobacterium leprae
gcgcaacacccaggucggugga

SEQ ID NO: 3223099 - RNA, 16 nt, Mycobacterium leprae
gcgcaauuuggugauc

SEQ ID NO: 3223100 - RNA, 14 nt, Mycobacterium leprae
gcgcacaaaaaucc

SEQ ID NO: 3223101 - RNA, 14 nt, Mycobacterium leprae
gcgcacacccggua

SEQ ID NO: 3223102 - RNA, 15 nt, Mycobacterium leprae
gcgcacccgagcggc

SEQ ID NO: 3223103 - RNA, 16 nt, Mycobacterium leprae
gcgcacccgagcggca

SEQ ID NO: 3223104 - RNA, 19 nt, Mycobacterium leprae
gcgcaccucgcugcagcau

SEQ ID NO: 3223105 - RNA, 20 nt, Mycobacterium leprae
gcgcaccugccacggccccg

SEQ ID NO: 3223106 - RNA, 16 nt, Mycobacterium leprae
gcgcacguaagcaugu

SEQ ID NO: 3223107 - RNA, 22 nt, Mycobacterium leprae
gcgcagacgucgucgucaucgu

SEQ ID NO: 3223108 - RNA, 14 nt, Mycobacterium leprae
gcgcagagcgcugu

SEQ ID NO: 3223109 - RNA, 14 nt, Mycobacterium leprae
gcgcagcaaucaau

SEQ ID NO: 3223110 - RNA, 19 nt, Mycobacterium leprae
gcgcagcaauugacgccga

SEQ ID NO: 3223111 - RNA, 23 nt, Mycobacterium leprae
gcgcaggucacccuccucgcggc

SEQ ID NO: 3223112 - RNA, 19 nt, Mycobacterium leprae
gcgcaguggguggacgacg

SEQ ID NO: 3223113 - RNA, 22 nt, Mycobacterium leprae
gcgcagugucaucgcguaguga

SEQ ID NO: 3223114 - RNA, 23 nt, Mycobacterium leprae
gcgcaguuaguuuaacgccugcu

SEQ ID NO: 3223115 - RNA, 15 nt, Mycobacterium leprae
gcgcauacacggcag

SEQ ID NO: 3223116 - RNA, 23 nt, Mycobacterium leprae
gcgcaucacuucagcgacaggca

SEQ ID NO: 3223117 - RNA, 16 nt, Mycobacterium leprae
gcgcaucagccaacac

SEQ ID NO: 3223118 - RNA, 17 nt, Mycobacterium leprae
gcgcaucagccaacacc

SEQ ID NO: 3223119 - RNA, 21 nt, Mycobacterium leprae
gcgcaucaucgcccaccgcaa

SEQ ID NO: 3223120 - RNA, 14 nt, Mycobacterium leprae
gcgcaucgcgcagg

SEQ ID NO: 3223121 - RNA, 21 nt, Mycobacterium leprae
gcgcaucugccgugcagcgac

SEQ ID NO: 3223122 - RNA, 18 nt, Mycobacterium leprae
gcgccaaacacggccagc

SEQ ID NO: 3223123 - RNA, 20 nt, Mycobacterium leprae
gcgccaacacuagcggcuaa

SEQ ID NO: 3223124 - RNA, 17 nt, Mycobacterium leprae
gcgccaauuccuccgcu

SEQ ID NO: 3223125 - RNA, 23 nt, Mycobacterium leprae
gcgccagcgacacagccggccgg

SEQ ID NO: 3223126 - RNA, 19 nt, Mycobacterium leprae
gcgccaggacucgguuggc

SEQ ID NO: 3223127 - RNA, 22 nt, Mycobacterium leprae
gcgccaucgaauccucgauggc

SEQ ID NO: 3223128 - RNA, 16 nt, Mycobacterium leprae
gcgccauuucgacggc

SEQ ID NO: 3223129 - RNA, 15 nt, Mycobacterium leprae
gcgccgaagccgggc

SEQ ID NO: 3223130 - RNA, 16 nt, Mycobacterium leprae
gcgccgagugguacaa

SEQ ID NO: 3223131 - RNA, 19 nt, Mycobacterium leprae
gcgccgaucccaucggcug

SEQ ID NO: 3223132 - RNA, 21 nt, Mycobacterium leprae
gcgccgaucccaucggcugca

SEQ ID NO: 3223133 - RNA, 14 nt, Mycobacterium leprae
gcgccguucgucga

SEQ ID NO: 3223134 - RNA, 20 nt, Mycobacterium leprae
gcgccucccgauuuucgauc

SEQ ID NO: 3223135 - RNA, 21 nt, Mycobacterium leprae
gcgccugaacuggaucgguca

SEQ ID NO: 3223136 - RNA, 24 nt, Mycobacterium leprae
gcgccugaagguuaucgacacggc

SEQ ID NO: 3223137 - RNA, 18 nt, Mycobacterium leprae
gcgccugagcgggccagc

SEQ ID NO: 3223138 - RNA, 14 nt, Mycobacterium leprae
gcgccugccacuga

SEQ ID NO: 3223139 - RNA, 16 nt, Mycobacterium leprae
gcgccuugcaagccac

SEQ ID NO: 3223140 - RNA, 18 nt, Mycobacterium leprae
gcgcgacaguaucgacca

SEQ ID NO: 3223141 - RNA, 16 nt, Mycobacterium leprae
gcgcgcagcuggccaa

SEQ ID NO: 3223142 - RNA, 16 nt, Mycobacterium leprae
gcgcgccgcccagcag

SEQ ID NO: 3223143 - RNA, 19 nt, Mycobacterium leprae
gcgcgccugcgcuuucagu

SEQ ID NO: 3223144 - RNA, 23 nt, Mycobacterium leprae
gcgcgcuaguucgacaccggcca

SEQ ID NO: 3223145 - RNA, 18 nt, Mycobacterium leprae
gcgcgcuauucgggccag

SEQ ID NO: 3223146 - RNA, 16 nt, Mycobacterium leprae
gcgcgcucagaucuga

SEQ ID NO: 3223147 - RNA, 21 nt, Mycobacterium leprae
gcgcggacucuccccacugca

SEQ ID NO: 3223148 - RNA, 14 nt, Mycobacterium leprae
gcgcggcgcacgua

SEQ ID NO: 3223149 - RNA, 12 nt, Mycobacterium leprae
gcgcggcugcuu

SEQ ID NO: 3223150 - RNA, 14 nt, Mycobacterium leprae
gcgcggguccgcgu

SEQ ID NO: 3223151 - RNA, 17 nt, Mycobacterium leprae
gcgcgguucuugccaag

SEQ ID NO: 3223152 - RNA, 22 nt, Mycobacterium leprae
gcgcucaacuaguacgcccccc

SEQ ID NO: 3223153 - RNA, 12 nt, Mycobacterium leprae
gcgcucacagca

SEQ ID NO: 3223154 - RNA, 18 nt, Mycobacterium leprae
gcgcucaccgacggaugc

SEQ ID NO: 3223155 - RNA, 21 nt, Mycobacterium leprae
gcgcuccgccggcgacaacug

SEQ ID NO: 3223156 - RNA, 19 nt, Mycobacterium leprae
gcgcucgcuaucgccacac

SEQ ID NO: 3223157 - RNA, 15 nt, Mycobacterium leprae
gcgcucgucgaugcg

SEQ ID NO: 3223158 - RNA, 19 nt, Mycobacterium leprae
gcgcucgucgaugcgcaga

SEQ ID NO: 3223159 - RNA, 17 nt, Mycobacterium leprae
gcgcucgucgcgggcgg

SEQ ID NO: 3223160 - RNA, 22 nt, Mycobacterium leprae
gcgcugaauggucauuggaagc

SEQ ID NO: 3223161 - RNA, 16 nt, Mycobacterium leprae
gcgcugauaucggcga

SEQ ID NO: 3223162 - RNA, 16 nt, Mycobacterium leprae
gcgcugaugcgagcgg

SEQ ID NO: 3223163 - RNA, 13 nt, Mycobacterium leprae
gcgcuggccacaa

SEQ ID NO: 3223164 - RNA, 15 nt, Mycobacterium leprae
gcgcuggccgcaagu

SEQ ID NO: 3223165 - RNA, 17 nt, Mycobacterium leprae
gcgcugggacaugaagc

SEQ ID NO: 3223166 - RNA, 20 nt, Mycobacterium leprae
gcgcugugauuggcugcugg

SEQ ID NO: 3223167 - RNA, 17 nt, Mycobacterium leprae
gcgcuucaucagcucug

SEQ ID NO: 3223168 - RNA, 16 nt, Mycobacterium leprae
gcgcuuucaguuggau

SEQ ID NO: 3223169 - RNA, 23 nt, Mycobacterium leprae
gcggaaauaacgggcaugcagua

SEQ ID NO: 3223170 - RNA, 17 nt, Mycobacterium leprae
gcggaagccgcucuacg

SEQ ID NO: 3223171 - RNA, 19 nt, Mycobacterium leprae
gcggaagcuccauguuagg

SEQ ID NO: 3223172 - RNA, 19 nt, Mycobacterium leprae
gcggacaauucaacgaaua

SEQ ID NO: 3223173 - RNA, 20 nt, Mycobacterium leprae
gcggacauacugcugcccgc

SEQ ID NO: 3223174 - RNA, 18 nt, Mycobacterium leprae
gcggaccauggcgcucaa

SEQ ID NO: 3223175 - RNA, 22 nt, Mycobacterium leprae
gcggaccgucgcgcgugccacc

SEQ ID NO: 3223176 - RNA, 20 nt, Mycobacterium leprae
gcggacgacgcugagaggcg

SEQ ID NO: 3223177 - RNA, 16 nt, Mycobacterium leprae
gcggacugcuagccgg

SEQ ID NO: 3223178 - RNA, 13 nt, Mycobacterium leprae
gcggacuggcugu

SEQ ID NO: 3223179 - RNA, 14 nt, Mycobacterium leprae
gcggagacccccgu

SEQ ID NO: 3223180 - RNA, 20 nt, Mycobacterium leprae
gcggagcgcggagcugguga

SEQ ID NO: 3223181 - RNA, 16 nt, Mycobacterium leprae
gcggagcuugagcagc

SEQ ID NO: 3223182 - RNA, 13 nt, Mycobacterium leprae
gcggaggcugggc

SEQ ID NO: 3223183 - RNA, 23 nt, Mycobacterium leprae
gcggaucgcagugcguauucggc

SEQ ID NO: 3223184 - RNA, 18 nt, Mycobacterium leprae
gcggaugugucagcaccg

SEQ ID NO: 3223185 - RNA, 23 nt, Mycobacterium leprae
gcggaugugucagcaccggcaug

SEQ ID NO: 3223186 - RNA, 15 nt, Mycobacterium leprae
gcggcaaguagggug

SEQ ID NO: 3223187 - RNA, 16 nt, Mycobacterium leprae
gcggcaaguagggugg

SEQ ID NO: 3223188 - RNA, 20 nt, Mycobacterium leprae
gcggcacagaccgaaaucaa

SEQ ID NO: 3223189 - RNA, 16 nt, Mycobacterium leprae
gcggcaccuguacuug

SEQ ID NO: 3223190 - RNA, 22 nt, Mycobacterium leprae
gcggcaccuuaccguccaccga

SEQ ID NO: 3223191 - RNA, 17 nt, Mycobacterium leprae
gcggcacgauaggcagu

SEQ ID NO: 3223192 - RNA, 16 nt, Mycobacterium leprae
gcggcagcugccauug

SEQ ID NO: 3223193 - RNA, 14 nt, Mycobacterium leprae
gcggcauucccaac

SEQ ID NO: 3223194 - RNA, 20 nt, Mycobacterium leprae
gcggccacauugaccacgcc

SEQ ID NO: 3223195 - RNA, 12 nt, Mycobacterium leprae
gcggccagccag

SEQ ID NO: 3223196 - RNA, 22 nt, Mycobacterium leprae
gcggccccuuucacgucggcgu

SEQ ID NO: 3223197 - RNA, 18 nt, Mycobacterium leprae
gcggccgaauucgaggac

SEQ ID NO: 3223198 - RNA, 15 nt, Mycobacterium leprae
gcggccgcccaggug

SEQ ID NO: 3223199 - RNA, 23 nt, Mycobacterium leprae
gcggccgcccaggugucuuccag

SEQ ID NO: 3223200 - RNA, 18 nt, Mycobacterium leprae
gcggcgaucaugguggug

SEQ ID NO: 3223201 - RNA, 19 nt, Mycobacterium leprae
gcggcgaucaugguggugu

SEQ ID NO: 3223202 - RNA, 21 nt, Mycobacterium leprae
gcggcgaucauggugguguuc

SEQ ID NO: 3223203 - RNA, 14 nt, Mycobacterium leprae
gcggcgcccagcac

SEQ ID NO: 3223204 - RNA, 14 nt, Mycobacterium leprae
gcggcgccgcccgg

SEQ ID NO: 3223205 - RNA, 17 nt, Mycobacterium leprae
gcggcgccugaacugga

SEQ ID NO: 3223206 - RNA, 13 nt, Mycobacterium leprae
gcggcgcuaacaa

SEQ ID NO: 3223207 - RNA, 17 nt, Mycobacterium leprae
gcggcggacgaucgaga

SEQ ID NO: 3223208 - RNA, 14 nt, Mycobacterium leprae
gcggcggccgugau

SEQ ID NO: 3223209 - RNA, 17 nt, Mycobacterium leprae
gcggcggccgugauuuu

SEQ ID NO: 3223210 - RNA, 14 nt, Mycobacterium leprae
gcggcggcggccag

SEQ ID NO: 3223211 - RNA, 15 nt, Mycobacterium leprae
gcggcggcggccagc

SEQ ID NO: 3223212 - RNA, 16 nt, Mycobacterium leprae
gcggcgggaucgccga

SEQ ID NO: 3223213 - RNA, 22 nt, Mycobacterium leprae
gcggcgugauauccgccguucu

SEQ ID NO: 3223214 - RNA, 15 nt, Mycobacterium leprae
gcggcuacucugcgu

SEQ ID NO: 3223215 - RNA, 22 nt, Mycobacterium leprae
gcggcuacucugcguaggccag

SEQ ID NO: 3223216 - RNA, 22 nt, Mycobacterium leprae
gcggcucguggcagucucgcug

SEQ ID NO: 3223217 - RNA, 16 nt, Mycobacterium leprae
gcggcugggcagccga

SEQ ID NO: 3223218 - RNA, 18 nt, Mycobacterium leprae
gcggcugggcagccgagg

SEQ ID NO: 3223219 - RNA, 14 nt, Mycobacterium leprae
gcggcuuguggcua

SEQ ID NO: 3223220 - RNA, 21 nt, Mycobacterium leprae
gcgggaacccgcuuggugauc

SEQ ID NO: 3223221 - RNA, 15 nt, Mycobacterium leprae
gcgggacgugcacug

SEQ ID NO: 3223222 - RNA, 16 nt, Mycobacterium leprae
gcgggacgugcacugg

SEQ ID NO: 3223223 - RNA, 22 nt, Mycobacterium leprae
gcgggaugaugauugccgccgg

SEQ ID NO: 3223224 - RNA, 16 nt, Mycobacterium leprae
gcgggcuugaccugga

SEQ ID NO: 3223225 - RNA, 20 nt, Mycobacterium leprae
gcgggcuugaccuggaugcc

SEQ ID NO: 3223226 - RNA, 21 nt, Mycobacterium leprae
gcgggcuugcuccgaggaacg

SEQ ID NO: 3223227 - RNA, 17 nt, Mycobacterium leprae
gcggggcuaugccgcgc

SEQ ID NO: 3223228 - RNA, 22 nt, Mycobacterium leprae
gcggguaccccauucagcggcg

SEQ ID NO: 3223229 - RNA, 19 nt, Mycobacterium leprae
gcgggugguguacucgcga

SEQ ID NO: 3223230 - RNA, 17 nt, Mycobacterium leprae
gcgguaaccugcugauc

SEQ ID NO: 3223231 - RNA, 19 nt, Mycobacterium leprae
gcgguaugcggccgcaaaa

SEQ ID NO: 3223232 - RNA, 17 nt, Mycobacterium leprae
gcgguauugacguggug

SEQ ID NO: 3223233 - RNA, 18 nt, Mycobacterium leprae
gcggucacagagcugugu

SEQ ID NO: 3223234 - RNA, 13 nt, Mycobacterium leprae
gcggucacauugu

SEQ ID NO: 3223235 - RNA, 17 nt, Mycobacterium leprae
gcgguccgguuuucgga

SEQ ID NO: 3223236 - RNA, 16 nt, Mycobacterium leprae
gcgguccuguccaggu

SEQ ID NO: 3223237 - RNA, 20 nt, Mycobacterium leprae
gcggugacugaaaucauugc

SEQ ID NO: 3223238 - RNA, 15 nt, Mycobacterium leprae
gcggugagagcuucc

SEQ ID NO: 3223239 - RNA, 16 nt, Mycobacterium leprae
gcggugccaacgcgca

SEQ ID NO: 3223240 - RNA, 22 nt, Mycobacterium leprae
gcggugcuuuagcccgccgcgg

SEQ ID NO: 3223241 - RNA, 24 nt, Mycobacterium leprae
gcggugcuuuagcccgccgcggcg

SEQ ID NO: 3223242 - RNA, 14 nt, Mycobacterium leprae
gcgguggcagccgc

SEQ ID NO: 3223243 - RNA, 13 nt, Mycobacterium leprae
gcgguggcagcgu

SEQ ID NO: 3223244 - RNA, 22 nt, Mycobacterium leprae
gcgguggcagcguagaaccagu

SEQ ID NO: 3223245 - RNA, 19 nt, Mycobacterium leprae
gcggugggcuuccagcaga

SEQ ID NO: 3223246 - RNA, 21 nt, Mycobacterium leprae
gcggugguacaaucccaccac

SEQ ID NO: 3223247 - RNA, 22 nt, Mycobacterium leprae
gcgguguccaaaugcgguggcu

SEQ ID NO: 3223248 - RNA, 17 nt, Mycobacterium leprae
gcgguguguugcagugu

SEQ ID NO: 3223249 - RNA, 17 nt, Mycobacterium leprae
gcgguguugcgcggcgc

SEQ ID NO: 3223250 - RNA, 17 nt, Mycobacterium leprae
gcgguguuucucgccga

SEQ ID NO: 3223251 - RNA, 16 nt, Mycobacterium leprae
gcgguuccgacuggug

SEQ ID NO: 3223252 - RNA, 22 nt, Mycobacterium leprae
gcgguucuauuuguguuggccg

SEQ ID NO: 3223253 - RNA, 18 nt, Mycobacterium leprae
gcgguuuauggcuaagcu

SEQ ID NO: 3223254 - RNA, 22 nt, Mycobacterium leprae
gcgguuugguaccgaguuuggc

SEQ ID NO: 3223255 - RNA, 19 nt, Mycobacterium leprae
gcguaaucgccgguggcaa

SEQ ID NO: 3223256 - RNA, 19 nt, Mycobacterium leprae
gcguaaucgcuuggugcug

SEQ ID NO: 3223257 - RNA, 18 nt, Mycobacterium leprae
gcguagcaagguguugcg

SEQ ID NO: 3223258 - RNA, 16 nt, Mycobacterium leprae
gcguagggucaagucu

SEQ ID NO: 3223259 - RNA, 19 nt, Mycobacterium leprae
gcgucaaguccagcacgau

SEQ ID NO: 3223260 - RNA, 14 nt, Mycobacterium leprae
gcguccgcggcggc

SEQ ID NO: 3223261 - RNA, 16 nt, Mycobacterium leprae
gcguccucaucccaug

SEQ ID NO: 3223262 - RNA, 16 nt, Mycobacterium leprae
gcgucgacaucaccgg

SEQ ID NO: 3223263 - RNA, 16 nt, Mycobacterium leprae
gcgucgcccucgccgg

SEQ ID NO: 3223264 - RNA, 18 nt, Mycobacterium leprae
gcgucgcccucgccggcg

SEQ ID NO: 3223265 - RNA, 12 nt, Mycobacterium leprae
gcgucgcgccug

SEQ ID NO: 3223266 - RNA, 20 nt, Mycobacterium leprae
gcgucgcucacggccaccau

SEQ ID NO: 3223267 - RNA, 15 nt, Mycobacterium leprae
gcgucgcuucaucgu

SEQ ID NO: 3223268 - RNA, 17 nt, Mycobacterium leprae
gcgucgguagacguggc

SEQ ID NO: 3223269 - RNA, 20 nt, Mycobacterium leprae
gcgucggugacucugaccga

SEQ ID NO: 3223270 - RNA, 22 nt, Mycobacterium leprae
gcgucggugacucugaccgaca

SEQ ID NO: 3223271 - RNA, 16 nt, Mycobacterium leprae
gcgucgguggcagcau

SEQ ID NO: 3223272 - RNA, 14 nt, Mycobacterium leprae
gcgucguagcucuc

SEQ ID NO: 3223273 - RNA, 18 nt, Mycobacterium leprae
gcgucgugaccgcggggc

SEQ ID NO: 3223274 - RNA, 16 nt, Mycobacterium leprae
gcgucguugcgcugga

SEQ ID NO: 3223275 - RNA, 13 nt, Mycobacterium leprae
gcgucguuuuggc

SEQ ID NO: 3223276 - RNA, 16 nt, Mycobacterium leprae
gcgucuggauggcuga

SEQ ID NO: 3223277 - RNA, 21 nt, Mycobacterium leprae
gcgucuggauggcugagcggc

SEQ ID NO: 3223278 - RNA, 22 nt, Mycobacterium leprae
gcgucuggcuggccucgugcgg

SEQ ID NO: 3223279 - RNA, 23 nt, Mycobacterium leprae
gcgugagccggucggcggcgccg

SEQ ID NO: 3223280 - RNA, 16 nt, Mycobacterium leprae
gcgugagguguugccg

SEQ ID NO: 3223281 - RNA, 15 nt, Mycobacterium leprae
gcgugagugugagga

SEQ ID NO: 3223282 - RNA, 16 nt, Mycobacterium leprae
gcgugagugugaggau

SEQ ID NO: 3223283 - RNA, 17 nt, Mycobacterium leprae
gcgugcggauauugauc

SEQ ID NO: 3223284 - RNA, 18 nt, Mycobacterium leprae
gcgugcuaugaccucgcc

SEQ ID NO: 3223285 - RNA, 22 nt, Mycobacterium leprae
gcgugcuaugaccucgccgucg

SEQ ID NO: 3223286 - RNA, 14 nt, Mycobacterium leprae
gcguggauggcuuc

SEQ ID NO: 3223287 - RNA, 15 nt, Mycobacterium leprae
gcgugggugugagga

SEQ ID NO: 3223288 - RNA, 17 nt, Mycobacterium leprae
gcguggucaauguggcc

SEQ ID NO: 3223289 - RNA, 20 nt, Mycobacterium leprae
gcguguuauaccgguagcgu

SEQ ID NO: 3223290 - RNA, 15 nt, Mycobacterium leprae
gcguguucaucaucu

SEQ ID NO: 3223291 - RNA, 18 nt, Mycobacterium leprae
gcguuaauuuucaacggu

SEQ ID NO: 3223292 - RNA, 15 nt, Mycobacterium leprae
gcguucaauaagaaa

SEQ ID NO: 3223293 - RNA, 17 nt, Mycobacterium leprae
gcguucgguuucacagc

SEQ ID NO: 3223294 - RNA, 15 nt, Mycobacterium leprae
gcguugccguccccu

SEQ ID NO: 3223295 - RNA, 18 nt, Mycobacterium leprae
gcguugcgauugaugcac

SEQ ID NO: 3223296 - RNA, 13 nt, Mycobacterium leprae
gcguuggaccgaa

SEQ ID NO: 3223297 - RNA, 20 nt, Mycobacterium leprae
gcguuggaucccgacagcau

SEQ ID NO: 3223298 - RNA, 15 nt, Mycobacterium leprae
gcguuggcucgacgu

SEQ ID NO: 3223299 - RNA, 14 nt, Mycobacterium leprae
gcguugugcgguga

SEQ ID NO: 3223300 - RNA, 18 nt, Mycobacterium leprae
gcguuguugauggugucg

SEQ ID NO: 3223301 - RNA, 12 nt, Mycobacterium leprae
gcuaaaagacgg

SEQ ID NO: 3223302 - RNA, 13 nt, Mycobacterium leprae
gcuaaauauuaau

SEQ ID NO: 3223303 - RNA, 15 nt, Mycobacterium leprae
gcuaaccgauccggu

SEQ ID NO: 3223304 - RNA, 12 nt, Mycobacterium leprae
gcuaaggcagcc

SEQ ID NO: 3223305 - RNA, 18 nt, Mycobacterium leprae
gcuaaucgcgggcaagcc

SEQ ID NO: 3223306 - RNA, 17 nt, Mycobacterium leprae
gcuacaacaaaguuaua

SEQ ID NO: 3223307 - RNA, 18 nt, Mycobacterium leprae
gcuacacugcagcgguca

SEQ ID NO: 3223308 - RNA, 13 nt, Mycobacterium leprae
gcuaccagggucg

SEQ ID NO: 3223309 - RNA, 21 nt, Mycobacterium leprae
gcuaccaguguccgucgacgu

SEQ ID NO: 3223310 - RNA, 16 nt, Mycobacterium leprae
gcuacccacugguggu

SEQ ID NO: 3223311 - RNA, 22 nt, Mycobacterium leprae
gcuaccucgacucgucagccuu

SEQ ID NO: 3223312 - RNA, 21 nt, Mycobacterium leprae
gcuacggcaaccgcaacaaug

SEQ ID NO: 3223313 - RNA, 23 nt, Mycobacterium leprae
gcuacggcgguguuucucgccga

SEQ ID NO: 3223314 - RNA, 22 nt, Mycobacterium leprae
gcuacggcgguuacgcgcucgc

SEQ ID NO: 3223315 - RNA, 13 nt, Mycobacterium leprae
gcuagacagcucg

SEQ ID NO: 3223316 - RNA, 14 nt, Mycobacterium leprae
gcuagacccgaacc

SEQ ID NO: 3223317 - RNA, 16 nt, Mycobacterium leprae
gcuagacgucugucac

SEQ ID NO: 3223318 - RNA, 20 nt, Mycobacterium leprae
gcuagacgucugucacccgu

SEQ ID NO: 3223319 - RNA, 23 nt, Mycobacterium leprae
gcuagacgucugucacccgucgu

SEQ ID NO: 3223320 - RNA, 15 nt, Mycobacterium leprae
gcuagaucaacagcg

SEQ ID NO: 3223321 - RNA, 11 nt, Mycobacterium leprae
gcuagcaucga

SEQ ID NO: 3223322 - RNA, 14 nt, Mycobacterium leprae
gcuagcaucgacca

SEQ ID NO: 3223323 - RNA, 13 nt, Mycobacterium leprae
gcuagccagagac

SEQ ID NO: 3223324 - RNA, 12 nt, Mycobacterium leprae
gcuagcggcgcc

SEQ ID NO: 3223325 - RNA, 17 nt, Mycobacterium leprae
gcuaggacaacagagca

SEQ ID NO: 3223326 - RNA, 14 nt, Mycobacterium leprae
gcuagucggccggc

SEQ ID NO: 3223327 - RNA, 16 nt, Mycobacterium leprae
gcuaguugccuggccu

SEQ ID NO: 3223328 - RNA, 17 nt, Mycobacterium leprae
gcuauagcacaccaggg

SEQ ID NO: 3223329 - RNA, 13 nt, Mycobacterium leprae
gcuauccgcggug

SEQ ID NO: 3223330 - RNA, 14 nt, Mycobacterium leprae
gcuaugguucuguu

SEQ ID NO: 3223331 - RNA, 17 nt, Mycobacterium leprae
gcuauguccaacaaggu

SEQ ID NO: 3223332 - RNA, 13 nt, Mycobacterium leprae
gcuauguuggcca

SEQ ID NO: 3223333 - RNA, 19 nt, Mycobacterium leprae
gcuauucgggccaguuuca

SEQ ID NO: 3223334 - RNA, 19 nt, Mycobacterium leprae
gcucaacagaguuuggcca

SEQ ID NO: 3223335 - RNA, 21 nt, Mycobacterium leprae
gcucaaccaugccgcgcgccu

SEQ ID NO: 3223336 - RNA, 14 nt, Mycobacterium leprae
gcucaaccgugcug

SEQ ID NO: 3223337 - RNA, 14 nt, Mycobacterium leprae
gcucaaucagcgac

SEQ ID NO: 3223338 - RNA, 15 nt, Mycobacterium leprae
gcucaaucagcgacu

SEQ ID NO: 3223339 - RNA, 22 nt, Mycobacterium leprae
gcucaaucagcgacuccacucc

SEQ ID NO: 3223340 - RNA, 14 nt, Mycobacterium leprae
gcucaaucgcccgc

SEQ ID NO: 3223341 - RNA, 13 nt, Mycobacterium leprae
gcucacagcaguc

SEQ ID NO: 3223342 - RNA, 13 nt, Mycobacterium leprae
gcucaccgcggcc

SEQ ID NO: 3223343 - RNA, 13 nt, Mycobacterium leprae
gcucacggccacc

SEQ ID NO: 3223344 - RNA, 18 nt, Mycobacterium leprae
gcucagcaccauucuggu

SEQ ID NO: 3223345 - RNA, 13 nt, Mycobacterium leprae
gcucagcagaucg

SEQ ID NO: 3223346 - RNA, 12 nt, Mycobacterium leprae
gcucagcggcua

SEQ ID NO: 3223347 - RNA, 19 nt, Mycobacterium leprae
gcucaggacgaacgcuggc

SEQ ID NO: 3223348 - RNA, 20 nt, Mycobacterium leprae
gcucagugacguguuggucg

SEQ ID NO: 3223349 - RNA, 21 nt, Mycobacterium leprae
gcucagugaucagguggagca

SEQ ID NO: 3223350 - RNA, 23 nt, Mycobacterium leprae
gcucaguguaucgcgagugcgag

SEQ ID NO: 3223351 - RNA, 23 nt, Mycobacterium leprae
gcucauagcuaguguacagaccg

SEQ ID NO: 3223352 - RNA, 22 nt, Mycobacterium leprae
gcucaucggcgacugggauaga

SEQ ID NO: 3223353 - RNA, 16 nt, Mycobacterium leprae
gcucauuuucgagcaa

SEQ ID NO: 3223354 - RNA, 22 nt, Mycobacterium leprae
gcucauuuucgagcaacgcggu

SEQ ID NO: 3223355 - RNA, 17 nt, Mycobacterium leprae
gcuccaaguggcugcua

SEQ ID NO: 3223356 - RNA, 16 nt, Mycobacterium leprae
gcuccacaucgucuac

SEQ ID NO: 3223357 - RNA, 16 nt, Mycobacterium leprae
gcuccauagaacaccg

SEQ ID NO: 3223358 - RNA, 21 nt, Mycobacterium leprae
gcuccauugcguuugaugucg

SEQ ID NO: 3223359 - RNA, 22 nt, Mycobacterium leprae
gcuccauuugucaucggcgugc

SEQ ID NO: 3223360 - RNA, 22 nt, Mycobacterium leprae
gcuccauuuuucuugaaaaaua

SEQ ID NO: 3223361 - RNA, 23 nt, Mycobacterium leprae
gcuccauuuuucuugaaaaauaa

SEQ ID NO: 3223362 - RNA, 15 nt, Mycobacterium leprae
gcucccaucggcggc

SEQ ID NO: 3223363 - RNA, 16 nt, Mycobacterium leprae
gcucccaucggcggcc

SEQ ID NO: 3223364 - RNA, 15 nt, Mycobacterium leprae
gcuccccgagccgcu

SEQ ID NO: 3223365 - RNA, 21 nt, Mycobacterium leprae
gcuccccgagccgcuuuuugu

SEQ ID NO: 3223366 - RNA, 18 nt, Mycobacterium leprae
gcucccgggucgagcagc

SEQ ID NO: 3223367 - RNA, 20 nt, Mycobacterium leprae
gcucccgggucgagcagcca

SEQ ID NO: 3223368 - RNA, 22 nt, Mycobacterium leprae
gcucccgggucgagcagccacc

SEQ ID NO: 3223369 - RNA, 21 nt, Mycobacterium leprae
gcuccgaagcaccagcagugg

SEQ ID NO: 3223370 - RNA, 20 nt, Mycobacterium leprae
gcuccugagacaucgccacc

SEQ ID NO: 3223371 - RNA, 20 nt, Mycobacterium leprae
gcuccuucuuaucucaucgu

SEQ ID NO: 3223372 - RNA, 14 nt, Mycobacterium leprae
gcucgacagcaggu

SEQ ID NO: 3223373 - RNA, 15 nt, Mycobacterium leprae
gcucgacgggcggca

SEQ ID NO: 3223374 - RNA, 18 nt, Mycobacterium leprae
gcucgacguugauguccc

SEQ ID NO: 3223375 - RNA, 20 nt, Mycobacterium leprae
gcucgaggaagcgcagcucg

SEQ ID NO: 3223376 - RNA, 13 nt, Mycobacterium leprae
gcucgaugccucg

SEQ ID NO: 3223377 - RNA, 17 nt, Mycobacterium leprae
gcucgauggccagccgu

SEQ ID NO: 3223378 - RNA, 17 nt, Mycobacterium leprae
gcucgauggugccauug

SEQ ID NO: 3223379 - RNA, 18 nt, Mycobacterium leprae
gcucgcacacaacgccga

SEQ ID NO: 3223380 - RNA, 20 nt, Mycobacterium leprae
gcucgcagcgguacccgcca

SEQ ID NO: 3223381 - RNA, 15 nt, Mycobacterium leprae
gcucgcauccgcaac

SEQ ID NO: 3223382 - RNA, 19 nt, Mycobacterium leprae
gcucgccgcccgcuggauc

SEQ ID NO: 3223383 - RNA, 12 nt, Mycobacterium leprae
gcucgccgcgca

SEQ ID NO: 3223384 - RNA, 21 nt, Mycobacterium leprae
gcucgccggggugucgagcuu

SEQ ID NO: 3223385 - RNA, 23 nt, Mycobacterium leprae
gcucgcggugggcuuccagcaga

SEQ ID NO: 3223386 - RNA, 18 nt, Mycobacterium leprae
gcucgcuuugcuggcaag

SEQ ID NO: 3223387 - RNA, 12 nt, Mycobacterium leprae
gcucggacaaga

SEQ ID NO: 3223388 - RNA, 23 nt, Mycobacterium leprae
gcucggacaagaucgaggccagc

SEQ ID NO: 3223389 - RNA, 17 nt, Mycobacterium leprae
gcucgggugguccgggu

SEQ ID NO: 3223390 - RNA, 14 nt, Mycobacterium leprae
gcucgguaagcugg

SEQ ID NO: 3223391 - RNA, 13 nt, Mycobacterium leprae
gcucguagcggcg

SEQ ID NO: 3223392 - RNA, 17 nt, Mycobacterium leprae
gcucguauaaaugaaca

SEQ ID NO: 3223393 - RNA, 21 nt, Mycobacterium leprae
gcucguuggguaucagcgcgc

SEQ ID NO: 3223394 - RNA, 16 nt, Mycobacterium leprae
gcucuaauacagagcg

SEQ ID NO: 3223395 - RNA, 22 nt, Mycobacterium leprae
gcucuacgacgaguaugcugcc

SEQ ID NO: 3223396 - RNA, 16 nt, Mycobacterium leprae
gcucuagccgggcuaa

SEQ ID NO: 3223397 - RNA, 22 nt, Mycobacterium leprae
gcucuauguuuuucucgguugu

SEQ ID NO: 3223398 - RNA, 17 nt, Mycobacterium leprae
gcucugguggccaccga

SEQ ID NO: 3223399 - RNA, 17 nt, Mycobacterium leprae
gcucuguccagaagggg

SEQ ID NO: 3223400 - RNA, 18 nt, Mycobacterium leprae
gcucuguucuggugggga

SEQ ID NO: 3223401 - RNA, 19 nt, Mycobacterium leprae
gcugaaauccucgggcgca

SEQ ID NO: 3223402 - RNA, 18 nt, Mycobacterium leprae
gcugaaccgcgucggcgu

SEQ ID NO: 3223403 - RNA, 17 nt, Mycobacterium leprae
gcugaagggccggguaa

SEQ ID NO: 3223404 - RNA, 17 nt, Mycobacterium leprae
gcugaauggucauugga

SEQ ID NO: 3223405 - RNA, 21 nt, Mycobacterium leprae
gcugacaaaaccgcggagcuu

SEQ ID NO: 3223406 - RNA, 19 nt, Mycobacterium leprae
gcugacaugacaucacugg

SEQ ID NO: 3223407 - RNA, 14 nt, Mycobacterium leprae
gcugaccagcagau

SEQ ID NO: 3223408 - RNA, 17 nt, Mycobacterium leprae
gcugacggaaagugccg

SEQ ID NO: 3223409 - RNA, 17 nt, Mycobacterium leprae
gcugacugcgauccggc

SEQ ID NO: 3223410 - RNA, 20 nt, Mycobacterium leprae
gcugagaccgguccaccugc

SEQ ID NO: 3223411 - RNA, 22 nt, Mycobacterium leprae
gcugaggguggcgccggcgugc

SEQ ID NO: 3223412 - RNA, 14 nt, Mycobacterium leprae
gcugagguguuggg

SEQ ID NO: 3223413 - RNA, 18 nt, Mycobacterium leprae
gcugagucggcgcucugu

SEQ ID NO: 3223414 - RNA, 15 nt, Mycobacterium leprae
gcugauaucggcgau

SEQ ID NO: 3223415 - RNA, 16 nt, Mycobacterium leprae
gcugauaucggcgaug

SEQ ID NO: 3223416 - RNA, 20 nt, Mycobacterium leprae
gcugaucgaauugaccgacg

SEQ ID NO: 3223417 - RNA, 18 nt, Mycobacterium leprae
gcugaugcgaucccgaaa

SEQ ID NO: 3223418 - RNA, 13 nt, Mycobacterium leprae
gcugaugcgguca

SEQ ID NO: 3223419 - RNA, 14 nt, Mycobacterium leprae
gcugauggccgcca

SEQ ID NO: 3223420 - RNA, 18 nt, Mycobacterium leprae
gcugaugucuuggcugac

SEQ ID NO: 3223421 - RNA, 14 nt, Mycobacterium leprae
gcugcaaugccgga

SEQ ID NO: 3223422 - RNA, 14 nt, Mycobacterium leprae
gcugcaauucgcua

SEQ ID NO: 3223423 - RNA, 23 nt, Mycobacterium leprae
gcugcacaagcuuguuuggucac

SEQ ID NO: 3223424 - RNA, 20 nt, Mycobacterium leprae
gcugcacauucaaccagcca

SEQ ID NO: 3223425 - RNA, 16 nt, Mycobacterium leprae
gcugcacccgucgcug

SEQ ID NO: 3223426 - RNA, 17 nt, Mycobacterium leprae
gcugcacccgucgcuga

SEQ ID NO: 3223427 - RNA, 12 nt, Mycobacterium leprae
gcugcaccgagc

SEQ ID NO: 3223428 - RNA, 14 nt, Mycobacterium leprae
gcugcacgaaaaga

SEQ ID NO: 3223429 - RNA, 18 nt, Mycobacterium leprae
gcugcacgaaaagaaacg

SEQ ID NO: 3223430 - RNA, 13 nt, Mycobacterium leprae
gcugcacggcugc

SEQ ID NO: 3223431 - RNA, 19 nt, Mycobacterium leprae
gcugcacggcugcguuggc

SEQ ID NO: 3223432 - RNA, 18 nt, Mycobacterium leprae
gcugcagcauaacccgau

SEQ ID NO: 3223433 - RNA, 18 nt, Mycobacterium leprae
gcugcaggccaccguugg

SEQ ID NO: 3223434 - RNA, 13 nt, Mycobacterium leprae
gcugcauccgaca

SEQ ID NO: 3223435 - RNA, 16 nt, Mycobacterium leprae
gcugcauguugugggu

SEQ ID NO: 3223436 - RNA, 12 nt, Mycobacterium leprae
gcugcauugugc

SEQ ID NO: 3223437 - RNA, 23 nt, Mycobacterium leprae
gcugccaaaguuagcggagaccc

SEQ ID NO: 3223438 - RNA, 19 nt, Mycobacterium leprae
gcugccagcuucgcagaca

SEQ ID NO: 3223439 - RNA, 17 nt, Mycobacterium leprae
gcugccauuggccgcug

SEQ ID NO: 3223440 - RNA, 21 nt, Mycobacterium leprae
gcugcccaugcuuaaggcaga

SEQ ID NO: 3223441 - RNA, 22 nt, Mycobacterium leprae
gcugcccugcaacgcuucgugc

SEQ ID NO: 3223442 - RNA, 20 nt, Mycobacterium leprae
gcugccgcaccgcuucagag

SEQ ID NO: 3223443 - RNA, 23 nt, Mycobacterium leprae
gcugccgcaguaauccaguccgg

SEQ ID NO: 3223444 - RNA, 14 nt, Mycobacterium leprae
gcugccggcggcag

SEQ ID NO: 3223445 - RNA, 22 nt, Mycobacterium leprae
gcugccggugaccgggccggcc

SEQ ID NO: 3223446 - RNA, 15 nt, Mycobacterium leprae
gcugcgacaacaccu

SEQ ID NO: 3223447 - RNA, 21 nt, Mycobacterium leprae
gcugcgaguucguuccuggcu

SEQ ID NO: 3223448 - RNA, 14 nt, Mycobacterium leprae
gcugcgcaagguug

SEQ ID NO: 3223449 - RNA, 18 nt, Mycobacterium leprae
gcugcgcagagcgcugug

SEQ ID NO: 3223450 - RNA, 12 nt, Mycobacterium leprae
gcugcgcggcug

SEQ ID NO: 3223451 - RNA, 12 nt, Mycobacterium leprae
gcugcggcgccc

SEQ ID NO: 3223452 - RNA, 18 nt, Mycobacterium leprae
gcugcggcgccugcaucg

SEQ ID NO: 3223453 - RNA, 16 nt, Mycobacterium leprae
gcugcggugacggucg

SEQ ID NO: 3223454 - RNA, 23 nt, Mycobacterium leprae
gcugcgugaagcagguacggauc

SEQ ID NO: 3223455 - RNA, 23 nt, Mycobacterium leprae
gcugcgugccugguugggcaucg

SEQ ID NO: 3223456 - RNA, 22 nt, Mycobacterium leprae
gcugcuaacaacgaccagcgcu

SEQ ID NO: 3223457 - RNA, 18 nt, Mycobacterium leprae
gcugcuacccacuggugg

SEQ ID NO: 3223458 - RNA, 17 nt, Mycobacterium leprae
gcugcuacgugacugcg

SEQ ID NO: 3223459 - RNA, 20 nt, Mycobacterium leprae
gcugcuacgugacugcggcu

SEQ ID NO: 3223460 - RNA, 17 nt, Mycobacterium leprae
gcugcucaaccaugccg

SEQ ID NO: 3223461 - RNA, 15 nt, Mycobacterium leprae
gcugcucgagcagcc

SEQ ID NO: 3223462 - RNA, 17 nt, Mycobacterium leprae
gcugcucgagcagccga

SEQ ID NO: 3223463 - RNA, 16 nt, Mycobacterium leprae
gcugcugagcguggcu

SEQ ID NO: 3223464 - RNA, 14 nt, Mycobacterium leprae
gcugcugcagaccg

SEQ ID NO: 3223465 - RNA, 13 nt, Mycobacterium leprae
gcugcugcuggcc

SEQ ID NO: 3223466 - RNA, 18 nt, Mycobacterium leprae
gcugcuuacucgcgccgu

SEQ ID NO: 3223467 - RNA, 15 nt, Mycobacterium leprae
gcugcuucaaucaac

SEQ ID NO: 3223468 - RNA, 23 nt, Mycobacterium leprae
gcuggagagaucgccugguucac

SEQ ID NO: 3223469 - RNA, 22 nt, Mycobacterium leprae
gcuggagcgcuauuaagucggc

SEQ ID NO: 3223470 - RNA, 22 nt, Mycobacterium leprae
gcuggaucggugcuaugguucu

SEQ ID NO: 3223471 - RNA, 22 nt, Mycobacterium leprae
gcuggaucuguauuaaucuggc

SEQ ID NO: 3223472 - RNA, 17 nt, Mycobacterium leprae
gcuggcaguggcaacug

SEQ ID NO: 3223473 - RNA, 17 nt, Mycobacterium leprae
gcuggccaucgcaccga

SEQ ID NO: 3223474 - RNA, 17 nt, Mycobacterium leprae
gcuggccccggacccga

SEQ ID NO: 3223475 - RNA, 18 nt, Mycobacterium leprae
gcuggccgugcuagucgu

SEQ ID NO: 3223476 - RNA, 19 nt, Mycobacterium leprae
gcuggccuguucauggugu

SEQ ID NO: 3223477 - RNA, 17 nt, Mycobacterium leprae
gcuggcgacaguguguu

SEQ ID NO: 3223478 - RNA, 20 nt, Mycobacterium leprae
gcuggcgcagaccucuuccg

SEQ ID NO: 3223479 - RNA, 22 nt, Mycobacterium leprae
gcuggcgcagaccucuuccgcc

SEQ ID NO: 3223480 - RNA, 16 nt, Mycobacterium leprae
gcuggcggugugugca

SEQ ID NO: 3223481 - RNA, 22 nt, Mycobacterium leprae
gcuggcgucguuuuggcgcguc

SEQ ID NO: 3223482 - RNA, 23 nt, Mycobacterium leprae
gcuggcuaauggcgggcuggagg

SEQ ID NO: 3223483 - RNA, 16 nt, Mycobacterium leprae
gcuggcuccauccugc

SEQ ID NO: 3223484 - RNA, 20 nt, Mycobacterium leprae
gcuggcuccauccugccuca

SEQ ID NO: 3223485 - RNA, 15 nt, Mycobacterium leprae
gcuggcucuggucac

SEQ ID NO: 3223486 - RNA, 23 nt, Mycobacterium leprae
gcuggcugagggccggucaacaa

SEQ ID NO: 3223487 - RNA, 15 nt, Mycobacterium leprae
gcuggcugcugcaga

SEQ ID NO: 3223488 - RNA, 20 nt, Mycobacterium leprae
gcugggcaccugggcugugc

SEQ ID NO: 3223489 - RNA, 12 nt, Mycobacterium leprae
gcugggcagccg

SEQ ID NO: 3223490 - RNA, 12 nt, Mycobacterium leprae
gcuggggcaagu

SEQ ID NO: 3223491 - RNA, 16 nt, Mycobacterium leprae
gcuggggucgcggacc

SEQ ID NO: 3223492 - RNA, 15 nt, Mycobacterium leprae
gcugggugagcugug

SEQ ID NO: 3223493 - RNA, 18 nt, Mycobacterium leprae
gcugggugagcugugccg

SEQ ID NO: 3223494 - RNA, 19 nt, Mycobacterium leprae
gcugguaacugaugguccu

SEQ ID NO: 3223495 - RNA, 21 nt, Mycobacterium leprae
gcuggucagguccaacgcggc

SEQ ID NO: 3223496 - RNA, 15 nt, Mycobacterium leprae
gcuggucccacagcc

SEQ ID NO: 3223497 - RNA, 12 nt, Mycobacterium leprae
gcuggugcuggc

SEQ ID NO: 3223498 - RNA, 17 nt, Mycobacterium leprae
gcuggugcuggcgucgu

SEQ ID NO: 3223499 - RNA, 18 nt, Mycobacterium leprae
gcugguggccgaggucga

SEQ ID NO: 3223500 - RNA, 21 nt, Mycobacterium leprae
gcuggugguccuguugauuuu

SEQ ID NO: 3223501 - RNA, 14 nt, Mycobacterium leprae
gcuguaucguccuc

SEQ ID NO: 3223502 - RNA, 16 nt, Mycobacterium leprae
gcugucagagugcaga

SEQ ID NO: 3223503 - RNA, 12 nt, Mycobacterium leprae
gcugucaguguc

SEQ ID NO: 3223504 - RNA, 21 nt, Mycobacterium leprae
gcugucauccucacgaccguu

SEQ ID NO: 3223505 - RNA, 19 nt, Mycobacterium leprae
gcuguccaccgaacccauc

SEQ ID NO: 3223506 - RNA, 18 nt, Mycobacterium leprae
gcugucccgggggccagc

SEQ ID NO: 3223507 - RNA, 14 nt, Mycobacterium leprae
gcugucgggcaccu

SEQ ID NO: 3223508 - RNA, 18 nt, Mycobacterium leprae
gcugucgggcaccuggug

SEQ ID NO: 3223509 - RNA, 17 nt, Mycobacterium leprae
gcugucgugcccagaug

SEQ ID NO: 3223510 - RNA, 12 nt, Mycobacterium leprae
gcugucguggcu

SEQ ID NO: 3223511 - RNA, 14 nt, Mycobacterium leprae
gcugucguggcugc

SEQ ID NO: 3223512 - RNA, 19 nt, Mycobacterium leprae
gcugucguguuugugucug

SEQ ID NO: 3223513 - RNA, 19 nt, Mycobacterium leprae
gcuguguugcgggguuuuu

SEQ ID NO: 3223514 - RNA, 15 nt, Mycobacterium leprae
gcuguguugugggug

SEQ ID NO: 3223515 - RNA, 18 nt, Mycobacterium leprae
gcuguguuugcuggucag

SEQ ID NO: 3223516 - RNA, 19 nt, Mycobacterium leprae
gcuguguuugcuggucagg

SEQ ID NO: 3223517 - RNA, 13 nt, Mycobacterium leprae
gcuguucggugac

SEQ ID NO: 3223518 - RNA, 23 nt, Mycobacterium leprae
gcuguucgugaucgacggcuggc

SEQ ID NO: 3223519 - RNA, 14 nt, Mycobacterium leprae
gcuguuguaagcac

SEQ ID NO: 3223520 - RNA, 18 nt, Mycobacterium leprae
gcuguuguaagcacugca

SEQ ID NO: 3223521 - RNA, 18 nt, Mycobacterium leprae
gcuguugucaccccagac

SEQ ID NO: 3223522 - RNA, 17 nt, Mycobacterium leprae
gcuuaauguagcaugua

SEQ ID NO: 3223523 - RNA, 16 nt, Mycobacterium leprae
gcuuacggacugacac

SEQ ID NO: 3223524 - RNA, 22 nt, Mycobacterium leprae
gcuuacucugccgccucgaugc

SEQ ID NO: 3223525 - RNA, 16 nt, Mycobacterium leprae
gcuuagcuaugcagug

SEQ ID NO: 3223526 - RNA, 15 nt, Mycobacterium leprae
gcuucacuuagccau

SEQ ID NO: 3223527 - RNA, 20 nt, Mycobacterium leprae
gcuucagagugcaccggugu

SEQ ID NO: 3223528 - RNA, 23 nt, Mycobacterium leprae
gcuucaucguagcgcacaucgau

SEQ ID NO: 3223529 - RNA, 20 nt, Mycobacterium leprae
gcuuccgauuguccaugcca

SEQ ID NO: 3223530 - RNA, 20 nt, Mycobacterium leprae
gcuuccucgacagucaacau

SEQ ID NO: 3223531 - RNA, 14 nt, Mycobacterium leprae
gcuucgauccaggc

SEQ ID NO: 3223532 - RNA, 16 nt, Mycobacterium leprae
gcuucgccuugcugcc

SEQ ID NO: 3223533 - RNA, 21 nt, Mycobacterium leprae
gcuucgguuuuggcggugcca

SEQ ID NO: 3223534 - RNA, 20 nt, Mycobacterium leprae
gcuucguugcaaaucaccag

SEQ ID NO: 3223535 - RNA, 23 nt, Mycobacterium leprae
gcuucuccagucccgcgcuguug

SEQ ID NO: 3223536 - RNA, 21 nt, Mycobacterium leprae
gcuucucggggcgaugaaauc

SEQ ID NO: 3223537 - RNA, 14 nt, Mycobacterium leprae
gcuugaaacccgga

SEQ ID NO: 3223538 - RNA, 14 nt, Mycobacterium leprae
gcuugagcagcacg

SEQ ID NO: 3223539 - RNA, 20 nt, Mycobacterium leprae
gcuugauacagacccagcua

SEQ ID NO: 3223540 - RNA, 21 nt, Mycobacterium leprae
gcuugcgaucaaacucgcuga

SEQ ID NO: 3223541 - RNA, 18 nt, Mycobacterium leprae
gcuuggccggaacagcau

SEQ ID NO: 3223542 - RNA, 17 nt, Mycobacterium leprae
gcuuggucuacauguug

SEQ ID NO: 3223543 - RNA, 13 nt, Mycobacterium leprae
gcuuggugcugcu

SEQ ID NO: 3223544 - RNA, 16 nt, Mycobacterium leprae
gcuugguugacagcag

SEQ ID NO: 3223545 - RNA, 15 nt, Mycobacterium leprae
gcuuguaaggccagc

SEQ ID NO: 3223546 - RNA, 19 nt, Mycobacterium leprae
gcuugugaucguggcaccg

SEQ ID NO: 3223547 - RNA, 19 nt, Mycobacterium leprae
gcuuuaccuucaggucuac

SEQ ID NO: 3223548 - RNA, 21 nt, Mycobacterium leprae
gcuuuccgcgccccuuccuga

SEQ ID NO: 3223549 - RNA, 14 nt, Mycobacterium leprae
gcuuucgaugaggc

SEQ ID NO: 3223550 - RNA, 17 nt, Mycobacterium leprae
gcuuugcaaagcagaau

SEQ ID NO: 3223551 - RNA, 21 nt, Mycobacterium leprae
gcuuugccgcaguggacacga

SEQ ID NO: 3223552 - RNA, 16 nt, Mycobacterium leprae
gcuuugcuggcaagcu

SEQ ID NO: 3223553 - RNA, 21 nt, Mycobacterium leprae
gcuuugggaucuuuugaccag

SEQ ID NO: 3223554 - RNA, 19 nt, Mycobacterium leprae
gcuuuggggguugcacuga

SEQ ID NO: 3223555 - RNA, 21 nt, Mycobacterium leprae
ggaaaacugccgguagccugg

SEQ ID NO: 3223556 - RNA, 15 nt, Mycobacterium leprae
ggaaaagcaggcgga

SEQ ID NO: 3223557 - RNA, 17 nt, Mycobacterium leprae
ggaaaagucguggagca

SEQ ID NO: 3223558 - RNA, 16 nt, Mycobacterium leprae
ggaaacacagcaagca

SEQ ID NO: 3223559 - RNA, 22 nt, Mycobacterium leprae
ggaaaccuucgauuccagcuga

SEQ ID NO: 3223560 - RNA, 19 nt, Mycobacterium leprae
ggaaagcaauacuggcagu

SEQ ID NO: 3223561 - RNA, 14 nt, Mycobacterium leprae
ggaacaacagacac

SEQ ID NO: 3223562 - RNA, 17 nt, Mycobacterium leprae
ggaacauagccagcauc

SEQ ID NO: 3223563 - RNA, 19 nt, Mycobacterium leprae
ggaacgacggauaagucca

SEQ ID NO: 3223564 - RNA, 18 nt, Mycobacterium leprae
ggaacgacuugaccagcc

SEQ ID NO: 3223565 - RNA, 21 nt, Mycobacterium leprae
ggaacgauaugagcuccacug

SEQ ID NO: 3223566 - RNA, 23 nt, Mycobacterium leprae
ggaacguccaucuuguuggccgg

SEQ ID NO: 3223567 - RNA, 20 nt, Mycobacterium leprae
ggaacgucuuuauuagcaug

SEQ ID NO: 3223568 - RNA, 18 nt, Mycobacterium leprae
ggaagaaauacccaccca

SEQ ID NO: 3223569 - RNA, 23 nt, Mycobacterium leprae
ggaagaugacucggcgugccacu

SEQ ID NO: 3223570 - RNA, 21 nt, Mycobacterium leprae
ggaagcgaugggugaaucgcu

SEQ ID NO: 3223571 - RNA, 23 nt, Mycobacterium leprae
ggaaggccuagcuggcagucggc

SEQ ID NO: 3223572 - RNA, 18 nt, Mycobacterium leprae
ggaaucccagcagcuggg

SEQ ID NO: 3223573 - RNA, 23 nt, Mycobacterium leprae
ggaaucggcacuucgcugagcga

SEQ ID NO: 3223574 - RNA, 12 nt, Mycobacterium leprae
ggaauggcggca

SEQ ID NO: 3223575 - RNA, 12 nt, Mycobacterium leprae
ggaauugcugcg

SEQ ID NO: 3223576 - RNA, 12 nt, Mycobacterium leprae
ggaauuuacccg

SEQ ID NO: 3223577 - RNA, 16 nt, Mycobacterium leprae
ggaauuuacuggccgg

SEQ ID NO: 3223578 - RNA, 18 nt, Mycobacterium leprae
ggacacgagcggccucag

SEQ ID NO: 3223579 - RNA, 18 nt, Mycobacterium leprae
ggacacgauacgcgucug

SEQ ID NO: 3223580 - RNA, 14 nt, Mycobacterium leprae
ggacaggccguagc

SEQ ID NO: 3223581 - RNA, 15 nt, Mycobacterium leprae
ggaccacgcaauguc

SEQ ID NO: 3223582 - RNA, 20 nt, Mycobacterium leprae
ggaccacgcaaugucgccgg

SEQ ID NO: 3223583 - RNA, 19 nt, Mycobacterium leprae
ggaccacuauuucaaagcg

SEQ ID NO: 3223584 - RNA, 13 nt, Mycobacterium leprae
ggaccaucgucag

SEQ ID NO: 3223585 - RNA, 12 nt, Mycobacterium leprae
ggacccagcgau

SEQ ID NO: 3223586 - RNA, 23 nt, Mycobacterium leprae
ggacccgagccgcaggucucaca

SEQ ID NO: 3223587 - RNA, 23 nt, Mycobacterium leprae
ggaccgcaacugguugaccccgc

SEQ ID NO: 3223588 - RNA, 18 nt, Mycobacterium leprae
ggaccggugcugcagcca

SEQ ID NO: 3223589 - RNA, 19 nt, Mycobacterium leprae
ggacgacgugccgcaggca

SEQ ID NO: 3223590 - RNA, 16 nt, Mycobacterium leprae
ggacgaucgagaagua

SEQ ID NO: 3223591 - RNA, 16 nt, Mycobacterium leprae
ggacgugaugcagcau

SEQ ID NO: 3223592 - RNA, 18 nt, Mycobacterium leprae
ggacuaccgagauggcgu

SEQ ID NO: 3223593 - RNA, 19 nt, Mycobacterium leprae
ggacucagcaaugcucugc

SEQ ID NO: 3223594 - RNA, 14 nt, Mycobacterium leprae
ggacucccuucgcc

SEQ ID NO: 3223595 - RNA, 22 nt, Mycobacterium leprae
ggacugaaaacagcgccucacc

SEQ ID NO: 3223596 - RNA, 21 nt, Mycobacterium leprae
ggacugucaaccauggucucg

SEQ ID NO: 3223597 - RNA, 13 nt, Mycobacterium leprae
ggacuucugcgcg

SEQ ID NO: 3223598 - RNA, 17 nt, Mycobacterium leprae
ggagaauauagccuugg

SEQ ID NO: 3223599 - RNA, 18 nt, Mycobacterium leprae
ggagacggccugcucugu

SEQ ID NO: 3223600 - RNA, 19 nt, Mycobacterium leprae
ggagagcgccgcuaaacgg

SEQ ID NO: 3223601 - RNA, 17 nt, Mycobacterium leprae
ggagaggaucagcgcug

SEQ ID NO: 3223602 - RNA, 14 nt, Mycobacterium leprae
ggagcaggagcugu

SEQ ID NO: 3223603 - RNA, 13 nt, Mycobacterium leprae
ggagccagggcag

SEQ ID NO: 3223604 - RNA, 21 nt, Mycobacterium leprae
ggagccgaguccgcuaaggca

SEQ ID NO: 3223605 - RNA, 17 nt, Mycobacterium leprae
ggagcugggcgaaaaca

SEQ ID NO: 3223606 - RNA, 22 nt, Mycobacterium leprae
ggagcuguuggguuuggucaau

SEQ ID NO: 3223607 - RNA, 11 nt, Mycobacterium leprae
ggaggcuguac

SEQ ID NO: 3223608 - RNA, 22 nt, Mycobacterium leprae
ggaggugcagacuuugagcugu

SEQ ID NO: 3223609 - RNA, 13 nt, Mycobacterium leprae
ggagguggucaag

SEQ ID NO: 3223610 - RNA, 13 nt, Mycobacterium leprae
ggagucaucccca

SEQ ID NO: 3223611 - RNA, 19 nt, Mycobacterium leprae
ggagucuugaugccaaccu

SEQ ID NO: 3223612 - RNA, 20 nt, Mycobacterium leprae
ggagugaggcaugggugcgu

SEQ ID NO: 3223613 - RNA, 16 nt, Mycobacterium leprae
ggaguugagcgguuca

SEQ ID NO: 3223614 - RNA, 12 nt, Mycobacterium leprae
ggauaaguccac

SEQ ID NO: 3223615 - RNA, 22 nt, Mycobacterium leprae
ggauacguagcgucggcgguca

SEQ ID NO: 3223616 - RNA, 14 nt, Mycobacterium leprae
ggaucagccgcgca

SEQ ID NO: 3223617 - RNA, 14 nt, Mycobacterium leprae
ggaucagcgcgcca

SEQ ID NO: 3223618 - RNA, 13 nt, Mycobacterium leprae
ggaucagcgcugc

SEQ ID NO: 3223619 - RNA, 18 nt, Mycobacterium leprae
ggaucaguuugccgucgg

SEQ ID NO: 3223620 - RNA, 15 nt, Mycobacterium leprae
ggaucccgacagcau

SEQ ID NO: 3223621 - RNA, 16 nt, Mycobacterium leprae
ggaucccgacagcaug

SEQ ID NO: 3223622 - RNA, 15 nt, Mycobacterium leprae
ggaucgagggaucca

SEQ ID NO: 3223623 - RNA, 21 nt, Mycobacterium leprae
ggaucggggauucaaucagac

SEQ ID NO: 3223624 - RNA, 23 nt, Mycobacterium leprae
ggaucggguagcugcaucggcag

SEQ ID NO: 3223625 - RNA, 21 nt, Mycobacterium leprae
ggaucguacgaaagaugcugc

SEQ ID NO: 3223626 - RNA, 17 nt, Mycobacterium leprae
ggaucgucucacgcacc

SEQ ID NO: 3223627 - RNA, 20 nt, Mycobacterium leprae
ggaucguuugaggaagaacg

SEQ ID NO: 3223628 - RNA, 17 nt, Mycobacterium leprae
ggaucuaugguuuuggc

SEQ ID NO: 3223629 - RNA, 16 nt, Mycobacterium leprae
ggaucugcacaacacc

SEQ ID NO: 3223630 - RNA, 13 nt, Mycobacterium leprae
ggaucugguuuuu

SEQ ID NO: 3223631 - RNA, 19 nt, Mycobacterium leprae
ggaucuguagggaaucggc

SEQ ID NO: 3223632 - RNA, 17 nt, Mycobacterium leprae
ggaucuuuugaccagca

SEQ ID NO: 3223633 - RNA, 19 nt, Mycobacterium leprae
ggaugaauaucaucgccaa

SEQ ID NO: 3223634 - RNA, 15 nt, Mycobacterium leprae
ggaugaucgauccag

SEQ ID NO: 3223635 - RNA, 11 nt, Mycobacterium leprae
ggaugcccagc

SEQ ID NO: 3223636 - RNA, 23 nt, Mycobacterium leprae
ggaugccguucaucgucgggugc

SEQ ID NO: 3223637 - RNA, 16 nt, Mycobacterium leprae
ggaugcugggucagca

SEQ ID NO: 3223638 - RNA, 16 nt, Mycobacterium leprae
ggauggccugcuggcc

SEQ ID NO: 3223639 - RNA, 15 nt, Mycobacterium leprae
ggauggucggcagcu

SEQ ID NO: 3223640 - RNA, 14 nt, Mycobacterium leprae
ggauuccagucgcg

SEQ ID NO: 3223641 - RNA, 16 nt, Mycobacterium leprae
ggauugauccggucac

SEQ ID NO: 3223642 - RNA, 18 nt, Mycobacterium leprae
ggauugaucguccgcaac

SEQ ID NO: 3223643 - RNA, 20 nt, Mycobacterium leprae
ggauugcguugaccgccgcc

SEQ ID NO: 3223644 - RNA, 22 nt, Mycobacterium leprae
ggauugggcauccugcuguaau

SEQ ID NO: 3223645 - RNA, 13 nt, Mycobacterium leprae
ggcaaccgugcug

SEQ ID NO: 3223646 - RNA, 17 nt, Mycobacterium leprae
ggcaacgcugcccacca

SEQ ID NO: 3223647 - RNA, 20 nt, Mycobacterium leprae
ggcaacggguuaccugaccg

SEQ ID NO: 3223648 - RNA, 22 nt, Mycobacterium leprae
ggcaacugaagauuuggcgagu

SEQ ID NO: 3223649 - RNA, 15 nt, Mycobacterium leprae
ggcaagaccgcccgg

SEQ ID NO: 3223650 - RNA, 17 nt, Mycobacterium leprae
ggcaagccauugcucgg

SEQ ID NO: 3223651 - RNA, 14 nt, Mycobacterium leprae
ggcaagcgguuguc

SEQ ID NO: 3223652 - RNA, 18 nt, Mycobacterium leprae
ggcaaggucggugggcaa

SEQ ID NO: 3223653 - RNA, 14 nt, Mycobacterium leprae
ggcaagugguugga

SEQ ID NO: 3223654 - RNA, 22 nt, Mycobacterium leprae
ggcacaacaagagaagagcugg

SEQ ID NO: 3223655 - RNA, 15 nt, Mycobacterium leprae
ggcacaccguguccg

SEQ ID NO: 3223656 - RNA, 18 nt, Mycobacterium leprae
ggcacacgaggcaggacu

SEQ ID NO: 3223657 - RNA, 19 nt, Mycobacterium leprae
ggcacagugacgcccggga

SEQ ID NO: 3223658 - RNA, 17 nt, Mycobacterium leprae
ggcacagugccugacca

SEQ ID NO: 3223659 - RNA, 20 nt, Mycobacterium leprae
ggcacccacgcugcgcggcu

SEQ ID NO: 3223660 - RNA, 18 nt, Mycobacterium leprae
ggcacccauaacgugcug

SEQ ID NO: 3223661 - RNA, 20 nt, Mycobacterium leprae
ggcacccguugaagccguug

SEQ ID NO: 3223662 - RNA, 19 nt, Mycobacterium leprae
ggcaccgcgguaggccagg

SEQ ID NO: 3223663 - RNA, 20 nt, Mycobacterium leprae
ggcaccgcgguaggccaggu

SEQ ID NO: 3223664 - RNA, 12 nt, Mycobacterium leprae
ggcaccgugucg

SEQ ID NO: 3223665 - RNA, 18 nt, Mycobacterium leprae
ggcaccuggugcccgaca

SEQ ID NO: 3223666 - RNA, 22 nt, Mycobacterium leprae
ggcacgagggcggugccccggg

SEQ ID NO: 3223667 - RNA, 23 nt, Mycobacterium leprae
ggcacggguuggguuauacgcuc

SEQ ID NO: 3223668 - RNA, 15 nt, Mycobacterium leprae
ggcacgugcggcggc

SEQ ID NO: 3223669 - RNA, 19 nt, Mycobacterium leprae
ggcacuacccgacacaaag

SEQ ID NO: 3223670 - RNA, 21 nt, Mycobacterium leprae
ggcacugagaguacugaccga

SEQ ID NO: 3223671 - RNA, 15 nt, Mycobacterium leprae
ggcagaaauggugca

SEQ ID NO: 3223672 - RNA, 20 nt, Mycobacterium leprae
ggcagaccuuuuagcugcgc

SEQ ID NO: 3223673 - RNA, 14 nt, Mycobacterium leprae
ggcagaggcaccug

SEQ ID NO: 3223674 - RNA, 18 nt, Mycobacterium leprae
ggcagaguagucccgagc

SEQ ID NO: 3223675 - RNA, 24 nt, Mycobacterium leprae
ggcagcaaccgcacagagcccagc

SEQ ID NO: 3223676 - RNA, 19 nt, Mycobacterium leprae
ggcagcaggaucacgugug

SEQ ID NO: 3223677 - RNA, 14 nt, Mycobacterium leprae
ggcagcauccgccg

SEQ ID NO: 3223678 - RNA, 16 nt, Mycobacterium leprae
ggcagcauccgccgac

SEQ ID NO: 3223679 - RNA, 17 nt, Mycobacterium leprae
ggcagcauccgccgacg

SEQ ID NO: 3223680 - RNA, 22 nt, Mycobacterium leprae
ggcagcauccgccgacgaugcg

SEQ ID NO: 3223681 - RNA, 13 nt, Mycobacterium leprae
ggcagccaccauc

SEQ ID NO: 3223682 - RNA, 17 nt, Mycobacterium leprae
ggcagcccggaauccug

SEQ ID NO: 3223683 - RNA, 12 nt, Mycobacterium leprae
ggcagccgaggu

SEQ ID NO: 3223684 - RNA, 20 nt, Mycobacterium leprae
ggcagccgucgaagcccugc

SEQ ID NO: 3223685 - RNA, 14 nt, Mycobacterium leprae
ggcagcgauuggga

SEQ ID NO: 3223686 - RNA, 17 nt, Mycobacterium leprae
ggcagcgauugggaucg

SEQ ID NO: 3223687 - RNA, 16 nt, Mycobacterium leprae
ggcagcuacagcgggc

SEQ ID NO: 3223688 - RNA, 20 nt, Mycobacterium leprae
ggcagcugccauuggccgcu

SEQ ID NO: 3223689 - RNA, 12 nt, Mycobacterium leprae
ggcagcugggua

SEQ ID NO: 3223690 - RNA, 16 nt, Mycobacterium leprae
ggcaggaucugcuugg

SEQ ID NO: 3223691 - RNA, 19 nt, Mycobacterium leprae
ggcagucggcaagaccgag

SEQ ID NO: 3223692 - RNA, 22 nt, Mycobacterium leprae
ggcauauccgccccggcuaccu

SEQ ID NO: 3223693 - RNA, 18 nt, Mycobacterium leprae
ggcauccaacacgccgau

SEQ ID NO: 3223694 - RNA, 23 nt, Mycobacterium leprae
ggcauccagaaaguacugaccgg

SEQ ID NO: 3223695 - RNA, 17 nt, Mycobacterium leprae
ggcaucgccgugguggc

SEQ ID NO: 3223696 - RNA, 16 nt, Mycobacterium leprae
ggcaucggccucaccu

SEQ ID NO: 3223697 - RNA, 18 nt, Mycobacterium leprae
ggcaucgucggcaaauuu

SEQ ID NO: 3223698 - RNA, 23 nt, Mycobacterium leprae
ggcaucuuacuggggcguccagu

SEQ ID NO: 3223699 - RNA, 15 nt, Mycobacterium leprae
ggcaugaaccucacc

SEQ ID NO: 3223700 - RNA, 12 nt, Mycobacterium leprae
ggcaugccgccg

SEQ ID NO: 3223701 - RNA, 14 nt, Mycobacterium leprae
ggcauugaucgcuc

SEQ ID NO: 3223702 - RNA, 20 nt, Mycobacterium leprae
ggcauugaucgcucguggca

SEQ ID NO: 3223703 - RNA, 19 nt, Mycobacterium leprae
ggccaaagagcgggcggca

SEQ ID NO: 3223704 - RNA, 21 nt, Mycobacterium leprae
ggccaaagagcgggcggcagc

SEQ ID NO: 3223705 - RNA, 14 nt, Mycobacterium leprae
ggccaaccacagca

SEQ ID NO: 3223706 - RNA, 19 nt, Mycobacterium leprae
ggccaacccuacgggaaca

SEQ ID NO: 3223707 - RNA, 23 nt, Mycobacterium leprae
ggccaagccgcccggccugccga

SEQ ID NO: 3223708 - RNA, 23 nt, Mycobacterium leprae
ggccaauaccgaaguccaccgga

SEQ ID NO: 3223709 - RNA, 15 nt, Mycobacterium leprae
ggccaauccagccga

SEQ ID NO: 3223710 - RNA, 18 nt, Mycobacterium leprae
ggccaauccagccgaggg

SEQ ID NO: 3223711 - RNA, 15 nt, Mycobacterium leprae
ggccaaucgcaagcc

SEQ ID NO: 3223712 - RNA, 21 nt, Mycobacterium leprae
ggccacauugaccacgccgac

SEQ ID NO: 3223713 - RNA, 16 nt, Mycobacterium leprae
ggccaccagggcgugg

SEQ ID NO: 3223714 - RNA, 15 nt, Mycobacterium leprae
ggccaccgccaccga

SEQ ID NO: 3223715 - RNA, 14 nt, Mycobacterium leprae
ggccaccggugaug

SEQ ID NO: 3223716 - RNA, 22 nt, Mycobacterium leprae
ggccacgagacccagccguggu

SEQ ID NO: 3223717 - RNA, 19 nt, Mycobacterium leprae
ggccacgauuccggcuagg

SEQ ID NO: 3223718 - RNA, 15 nt, Mycobacterium leprae
ggccacgucgugcug

SEQ ID NO: 3223719 - RNA, 19 nt, Mycobacterium leprae
ggccacuaguggaggggcg

SEQ ID NO: 3223720 - RNA, 14 nt, Mycobacterium leprae
ggccacuucgcccg

SEQ ID NO: 3223721 - RNA, 13 nt, Mycobacterium leprae
ggccagacaccau

SEQ ID NO: 3223722 - RNA, 21 nt, Mycobacterium leprae
ggccagauggcgccaagaccu

SEQ ID NO: 3223723 - RNA, 12 nt, Mycobacterium leprae
ggccagcacuug

SEQ ID NO: 3223724 - RNA, 14 nt, Mycobacterium leprae
ggccagccguccca

SEQ ID NO: 3223725 - RNA, 13 nt, Mycobacterium leprae
ggccagccugcga

SEQ ID NO: 3223726 - RNA, 17 nt, Mycobacterium leprae
ggccagcgaucuaccuc

SEQ ID NO: 3223727 - RNA, 16 nt, Mycobacterium leprae
ggccagcgcacccauc

SEQ ID NO: 3223728 - RNA, 17 nt, Mycobacterium leprae
ggccagcgcacccaucc

SEQ ID NO: 3223729 - RNA, 15 nt, Mycobacterium leprae
ggccaggcagcgccu

SEQ ID NO: 3223730 - RNA, 14 nt, Mycobacterium leprae
ggccaggccgagug

SEQ ID NO: 3223731 - RNA, 18 nt, Mycobacterium leprae
ggccaggccgagugcagg

SEQ ID NO: 3223732 - RNA, 19 nt, Mycobacterium leprae
ggccaguaccuccagccgc

SEQ ID NO: 3223733 - RNA, 17 nt, Mycobacterium leprae
ggccagugucggugccg

SEQ ID NO: 3223734 - RNA, 20 nt, Mycobacterium leprae
ggccaguuagugccaguucc

SEQ ID NO: 3223735 - RNA, 21 nt, Mycobacterium leprae
ggccaugcagucgcucaggcu

SEQ ID NO: 3223736 - RNA, 17 nt, Mycobacterium leprae
ggccaugggacuaccgg

SEQ ID NO: 3223737 - RNA, 20 nt, Mycobacterium leprae
ggccauuggcaccguuggcg

SEQ ID NO: 3223738 - RNA, 22 nt, Mycobacterium leprae
ggcccaaaccguugaagagcga

SEQ ID NO: 3223739 - RNA, 18 nt, Mycobacterium leprae
ggcccagcaccacugcgg

SEQ ID NO: 3223740 - RNA, 19 nt, Mycobacterium leprae
ggcccauacgcgccggcua

SEQ ID NO: 3223741 - RNA, 22 nt, Mycobacterium leprae
ggccccgcaucuucgcccagca

SEQ ID NO: 3223742 - RNA, 16 nt, Mycobacterium leprae
ggccccuuucacgucg

SEQ ID NO: 3223743 - RNA, 18 nt, Mycobacterium leprae
ggcccgacggcgcggcug

SEQ ID NO: 3223744 - RNA, 19 nt, Mycobacterium leprae
ggcccgaggagaggcaggg

SEQ ID NO: 3223745 - RNA, 20 nt, Mycobacterium leprae
ggcccgaggagaggcagggc

SEQ ID NO: 3223746 - RNA, 18 nt, Mycobacterium leprae
ggcccgguaccguccguc

SEQ ID NO: 3223747 - RNA, 19 nt, Mycobacterium leprae
ggcccucagccagcaagca

SEQ ID NO: 3223748 - RNA, 21 nt, Mycobacterium leprae
ggccgaacgugagcgacagcu

SEQ ID NO: 3223749 - RNA, 12 nt, Mycobacterium leprae
ggccgaggcgca

SEQ ID NO: 3223750 - RNA, 23 nt, Mycobacterium leprae
ggccgaucucggcgcgcucucug

SEQ ID NO: 3223751 - RNA, 14 nt, Mycobacterium leprae
ggccgauuuggcgg

SEQ ID NO: 3223752 - RNA, 19 nt, Mycobacterium leprae
ggccgcaacuuuguacgac

SEQ ID NO: 3223753 - RNA, 16 nt, Mycobacterium leprae
ggccgcacccggcagc

SEQ ID NO: 3223754 - RNA, 14 nt, Mycobacterium leprae
ggccgcccaggugu

SEQ ID NO: 3223755 - RNA, 22 nt, Mycobacterium leprae
ggccgcggaaauaacgggcaug

SEQ ID NO: 3223756 - RNA, 18 nt, Mycobacterium leprae
ggccgcuauaggcgagcu

SEQ ID NO: 3223757 - RNA, 19 nt, Mycobacterium leprae
ggccgcuggucaagcuggg

SEQ ID NO: 3223758 - RNA, 19 nt, Mycobacterium leprae
ggccggcaagcugcccggc

SEQ ID NO: 3223759 - RNA, 12 nt, Mycobacterium leprae
ggccggccugga

SEQ ID NO: 3223760 - RNA, 21 nt, Mycobacterium leprae
ggccggguaaguucuaccgac

SEQ ID NO: 3223761 - RNA, 14 nt, Mycobacterium leprae
ggccgggucuuccu

SEQ ID NO: 3223762 - RNA, 18 nt, Mycobacterium leprae
ggccggucaacaagccgc

SEQ ID NO: 3223763 - RNA, 23 nt, Mycobacterium leprae
ggccguaaucaagaucggccagc

SEQ ID NO: 3223764 - RNA, 14 nt, Mycobacterium leprae
ggccgucggcaacu

SEQ ID NO: 3223765 - RNA, 15 nt, Mycobacterium leprae
ggccgucguugccga

SEQ ID NO: 3223766 - RNA, 23 nt, Mycobacterium leprae
ggccgugcuagucguaacgcuga

SEQ ID NO: 3223767 - RNA, 17 nt, Mycobacterium leprae
ggccguggacgaacugg

SEQ ID NO: 3223768 - RNA, 15 nt, Mycobacterium leprae
ggccuagucgggcag

SEQ ID NO: 3223769 - RNA, 20 nt, Mycobacterium leprae
ggccucaccugcgacagccg

SEQ ID NO: 3223770 - RNA, 20 nt, Mycobacterium leprae
ggccucagcagcaggcugac

SEQ ID NO: 3223771 - RNA, 15 nt, Mycobacterium leprae
ggccuccaggugaag

SEQ ID NO: 3223772 - RNA, 18 nt, Mycobacterium leprae
ggccuccgacaggucagu

SEQ ID NO: 3223773 - RNA, 17 nt, Mycobacterium leprae
ggccucgaggugcagga

SEQ ID NO: 3223774 - RNA, 15 nt, Mycobacterium leprae
ggccucgugcugcgu

SEQ ID NO: 3223775 - RNA, 17 nt, Mycobacterium leprae
ggccucgugcugcgugc

SEQ ID NO: 3223776 - RNA, 21 nt, Mycobacterium leprae
ggccugccgaacucacaggua

SEQ ID NO: 3223777 - RNA, 15 nt, Mycobacterium leprae
ggccuggauuagcuc

SEQ ID NO: 3223778 - RNA, 21 nt, Mycobacterium leprae
ggccuggucguucauccucgg

SEQ ID NO: 3223779 - RNA, 16 nt, Mycobacterium leprae
ggccuguucauggugu

SEQ ID NO: 3223780 - RNA, 18 nt, Mycobacterium leprae
ggccuucgucagcuggaa

SEQ ID NO: 3223781 - RNA, 22 nt, Mycobacterium leprae
ggcgaaaacauucaggaugcug

SEQ ID NO: 3223782 - RNA, 23 nt, Mycobacterium leprae
ggcgaaaacccgcgcgugcacaa

SEQ ID NO: 3223783 - RNA, 14 nt, Mycobacterium leprae
ggcgaaacguucau

SEQ ID NO: 3223784 - RNA, 21 nt, Mycobacterium leprae
ggcgaagacgccgccggagcg

SEQ ID NO: 3223785 - RNA, 22 nt, Mycobacterium leprae
ggcgaaucggucuggaaccggu

SEQ ID NO: 3223786 - RNA, 15 nt, Mycobacterium leprae
ggcgacaaagaagaa

SEQ ID NO: 3223787 - RNA, 19 nt, Mycobacterium leprae
ggcgaccaguuuacaucgg

SEQ ID NO: 3223788 - RNA, 22 nt, Mycobacterium leprae
ggcgaccuggucgagcagcucc

SEQ ID NO: 3223789 - RNA, 21 nt, Mycobacterium leprae
ggcgacgaccuccgcagcauc

SEQ ID NO: 3223790 - RNA, 18 nt, Mycobacterium leprae
ggcgacgucgcuugugau

SEQ ID NO: 3223791 - RNA, 10 nt, Mycobacterium leprae
ggcgagcaag

SEQ ID NO: 3223792 - RNA, 22 nt, Mycobacterium leprae
ggcgaguacguccgcgccggcg

SEQ ID NO: 3223793 - RNA, 16 nt, Mycobacterium leprae
ggcgagugcugacgcc

SEQ ID NO: 3223794 - RNA, 19 nt, Mycobacterium leprae
ggcgagugcugacgccggg

SEQ ID NO: 3223795 - RNA, 15 nt, Mycobacterium leprae
ggcgaguggagugag

SEQ ID NO: 3223796 - RNA, 15 nt, Mycobacterium leprae
ggcgauacgcgcuug

SEQ ID NO: 3223797 - RNA, 21 nt, Mycobacterium leprae
ggcgauagaggaucugcacaa

SEQ ID NO: 3223798 - RNA, 14 nt, Mycobacterium leprae
ggcgauauccgccg

SEQ ID NO: 3223799 - RNA, 13 nt, Mycobacterium leprae
ggcgaucagcagg

SEQ ID NO: 3223800 - RNA, 13 nt, Mycobacterium leprae
ggcgaucgaucca

SEQ ID NO: 3223801 - RNA, 15 nt, Mycobacterium leprae
ggcgaugaccggacg

SEQ ID NO: 3223802 - RNA, 15 nt, Mycobacterium leprae
ggcgauucgagccgc

SEQ ID NO: 3223803 - RNA, 16 nt, Mycobacterium leprae
ggcgauucgagccgca

SEQ ID NO: 3223804 - RNA, 16 nt, Mycobacterium leprae
ggcgauucgggccgcu

SEQ ID NO: 3223805 - RNA, 21 nt, Mycobacterium leprae
ggcgauuucgauccaucguga

SEQ ID NO: 3223806 - RNA, 14 nt, Mycobacterium leprae
ggcgcaaagucgac

SEQ ID NO: 3223807 - RNA, 17 nt, Mycobacterium leprae
ggcgcacaaaaauccuc

SEQ ID NO: 3223808 - RNA, 19 nt, Mycobacterium leprae
ggcgcacaaaaauccuccc

SEQ ID NO: 3223809 - RNA, 23 nt, Mycobacterium leprae
ggcgcacguaagcaugucggugg

SEQ ID NO: 3223810 - RNA, 18 nt, Mycobacterium leprae
ggcgcagaccucuuccgc

SEQ ID NO: 3223811 - RNA, 23 nt, Mycobacterium leprae
ggcgccauauccucgaccaccag

SEQ ID NO: 3223812 - RNA, 20 nt, Mycobacterium leprae
ggcgccgauuugggggucua

SEQ ID NO: 3223813 - RNA, 12 nt, Mycobacterium leprae
ggcgccgcccgg

SEQ ID NO: 3223814 - RNA, 17 nt, Mycobacterium leprae
ggcgccucgucggccag

SEQ ID NO: 3223815 - RNA, 21 nt, Mycobacterium leprae
ggcgccucgucggccagcacu

SEQ ID NO: 3223816 - RNA, 18 nt, Mycobacterium leprae
ggcgccugcaucgcagcg

SEQ ID NO: 3223817 - RNA, 14 nt, Mycobacterium leprae
ggcgcgaagugcga

SEQ ID NO: 3223818 - RNA, 19 nt, Mycobacterium leprae
ggcgcgcuauucgggccag

SEQ ID NO: 3223819 - RNA, 16 nt, Mycobacterium leprae
ggcgcggucgucaagu

SEQ ID NO: 3223820 - RNA, 20 nt, Mycobacterium leprae
ggcgcuccaauuuggagccu

SEQ ID NO: 3223821 - RNA, 15 nt, Mycobacterium leprae
ggcgcugagcagucc

SEQ ID NO: 3223822 - RNA, 19 nt, Mycobacterium leprae
ggcgcuuguaaggccagca

SEQ ID NO: 3223823 - RNA, 21 nt, Mycobacterium leprae
ggcggaaacguuuguggugcu

SEQ ID NO: 3223824 - RNA, 18 nt, Mycobacterium leprae
ggcggagauguggauccg

SEQ ID NO: 3223825 - RNA, 20 nt, Mycobacterium leprae
ggcggagcgcggagcuggug

SEQ ID NO: 3223826 - RNA, 15 nt, Mycobacterium leprae
ggcggaggcugggca

SEQ ID NO: 3223827 - RNA, 14 nt, Mycobacterium leprae
ggcggagucaccgc

SEQ ID NO: 3223828 - RNA, 22 nt, Mycobacterium leprae
ggcggagucaccgcagccggag

SEQ ID NO: 3223829 - RNA, 22 nt, Mycobacterium leprae
ggcggcaaggucggugggcaau

SEQ ID NO: 3223830 - RNA, 12 nt, Mycobacterium leprae
ggcggcagcugg

SEQ ID NO: 3223831 - RNA, 12 nt, Mycobacterium leprae
ggcggcauuccc

SEQ ID NO: 3223832 - RNA, 15 nt, Mycobacterium leprae
ggcggccagcucagc

SEQ ID NO: 3223833 - RNA, 14 nt, Mycobacterium leprae
ggcggccaggcagg

SEQ ID NO: 3223834 - RNA, 17 nt, Mycobacterium leprae
ggcggccggcaagaagu

SEQ ID NO: 3223835 - RNA, 14 nt, Mycobacterium leprae
ggcggcggccagcu

SEQ ID NO: 3223836 - RNA, 12 nt, Mycobacterium leprae
ggcggcguuggc

SEQ ID NO: 3223837 - RNA, 22 nt, Mycobacterium leprae
ggcggguuucccagagcucccg

SEQ ID NO: 3223838 - RNA, 19 nt, Mycobacterium leprae
ggcgguaaacagagcugau

SEQ ID NO: 3223839 - RNA, 18 nt, Mycobacterium leprae
ggcgguagcguggguucg

SEQ ID NO: 3223840 - RNA, 20 nt, Mycobacterium leprae
ggcgguauugacgugguggu

SEQ ID NO: 3223841 - RNA, 14 nt, Mycobacterium leprae
ggcggucggcggcu

SEQ ID NO: 3223842 - RNA, 20 nt, Mycobacterium leprae
ggcggugacugaaaucauug

SEQ ID NO: 3223843 - RNA, 18 nt, Mycobacterium leprae
ggcggugucggcuaccaa

SEQ ID NO: 3223844 - RNA, 17 nt, Mycobacterium leprae
ggcgguguguugcagug

SEQ ID NO: 3223845 - RNA, 18 nt, Mycobacterium leprae
ggcgguguguugcagugu

SEQ ID NO: 3223846 - RNA, 17 nt, Mycobacterium leprae
ggcgguguuucucgccg

SEQ ID NO: 3223847 - RNA, 19 nt, Mycobacterium leprae
ggcgguucacauucgucga

SEQ ID NO: 3223848 - RNA, 22 nt, Mycobacterium leprae
ggcgguugcguaauggccggcg

SEQ ID NO: 3223849 - RNA, 15 nt, Mycobacterium leprae
ggcguacuggucaac

SEQ ID NO: 3223850 - RNA, 14 nt, Mycobacterium leprae
ggcguaugaccgcg

SEQ ID NO: 3223851 - RNA, 14 nt, Mycobacterium leprae
ggcgucaggccagg

SEQ ID NO: 3223852 - RNA, 16 nt, Mycobacterium leprae
ggcguccgcggcggcc

SEQ ID NO: 3223853 - RNA, 17 nt, Mycobacterium leprae
ggcgucgacaucaccgg

SEQ ID NO: 3223854 - RNA, 21 nt, Mycobacterium leprae
ggcgucgacaucaccggcggu

SEQ ID NO: 3223855 - RNA, 22 nt, Mycobacterium leprae
ggcgucgacaucaccggcggug

SEQ ID NO: 3223856 - RNA, 23 nt, Mycobacterium leprae
ggcgucgcaccgauauccggccu

SEQ ID NO: 3223857 - RNA, 17 nt, Mycobacterium leprae
ggcguuauccacgccga

SEQ ID NO: 3223858 - RNA, 20 nt, Mycobacterium leprae
ggcguuccgauguacuccga

SEQ ID NO: 3223859 - RNA, 13 nt, Mycobacterium leprae
ggcguuccggccu

SEQ ID NO: 3223860 - RNA, 15 nt, Mycobacterium leprae
ggcguuccggccucg

SEQ ID NO: 3223861 - RNA, 15 nt, Mycobacterium leprae
ggcguugccgucccc

SEQ ID NO: 3223862 - RNA, 15 nt, Mycobacterium leprae
ggcguugucuugugg

SEQ ID NO: 3223863 - RNA, 19 nt, Mycobacterium leprae
ggcuaaggugcguugugcg

SEQ ID NO: 3223864 - RNA, 22 nt, Mycobacterium leprae
ggcuaaguccggccugcccgca

SEQ ID NO: 3223865 - RNA, 18 nt, Mycobacterium leprae
ggcuaauggcgggcugga

SEQ ID NO: 3223866 - RNA, 12 nt, Mycobacterium leprae
ggcuacacggua

SEQ ID NO: 3223867 - RNA, 18 nt, Mycobacterium leprae
ggcuacaucgacaaaaac

SEQ ID NO: 3223868 - RNA, 13 nt, Mycobacterium leprae
ggcuaccgagcuc

SEQ ID NO: 3223869 - RNA, 22 nt, Mycobacterium leprae
ggcuacucugcguaggccaggu

SEQ ID NO: 3223870 - RNA, 16 nt, Mycobacterium leprae
ggcuagccgugcagcc

SEQ ID NO: 3223871 - RNA, 20 nt, Mycobacterium leprae
ggcuaugacaagaccaccgu

SEQ ID NO: 3223872 - RNA, 15 nt, Mycobacterium leprae
ggcucaagucgacga

SEQ ID NO: 3223873 - RNA, 13 nt, Mycobacterium leprae
ggcucaccgacug

SEQ ID NO: 3223874 - RNA, 13 nt, Mycobacterium leprae
ggcucagcaccau

SEQ ID NO: 3223875 - RNA, 17 nt, Mycobacterium leprae
ggcucagcgcugaucaa

SEQ ID NO: 3223876 - RNA, 16 nt, Mycobacterium leprae
ggcuccaaguggcugc

SEQ ID NO: 3223877 - RNA, 13 nt, Mycobacterium leprae
ggcuccauccugc

SEQ ID NO: 3223878 - RNA, 24 nt, Mycobacterium leprae
ggcuccauuugucaucggcgugcc

SEQ ID NO: 3223879 - RNA, 20 nt, Mycobacterium leprae
ggcucccaucggcggccagc

SEQ ID NO: 3223880 - RNA, 19 nt, Mycobacterium leprae
ggcucccgggucgagcagc

SEQ ID NO: 3223881 - RNA, 14 nt, Mycobacterium leprae
ggcucgcauccgca

SEQ ID NO: 3223882 - RNA, 15 nt, Mycobacterium leprae
ggcucgcauccgcaa

SEQ ID NO: 3223883 - RNA, 18 nt, Mycobacterium leprae
ggcucgcggggaugcuga

SEQ ID NO: 3223884 - RNA, 19 nt, Mycobacterium leprae
ggcucgcggggaugcugag

SEQ ID NO: 3223885 - RNA, 17 nt, Mycobacterium leprae
ggcucgcucgacuguau

SEQ ID NO: 3223886 - RNA, 19 nt, Mycobacterium leprae
ggcucugucgucgaaacca

SEQ ID NO: 3223887 - RNA, 16 nt, Mycobacterium leprae
ggcucuuucggcgaga

SEQ ID NO: 3223888 - RNA, 15 nt, Mycobacterium leprae
ggcugcaacgacugg

SEQ ID NO: 3223889 - RNA, 20 nt, Mycobacterium leprae
ggcugccgcaccgcuucaga

SEQ ID NO: 3223890 - RNA, 22 nt, Mycobacterium leprae
ggcugcgauggcauugaucgcu

SEQ ID NO: 3223891 - RNA, 20 nt, Mycobacterium leprae
ggcugcucaaucagcgacuc

SEQ ID NO: 3223892 - RNA, 17 nt, Mycobacterium leprae
ggcugcugcagaccgga

SEQ ID NO: 3223893 - RNA, 21 nt, Mycobacterium leprae
ggcugcugcagaccggauaca

SEQ ID NO: 3223894 - RNA, 22 nt, Mycobacterium leprae
ggcugcuuguagcguucguaga

SEQ ID NO: 3223895 - RNA, 18 nt, Mycobacterium leprae
ggcuggaggagcccgacg

SEQ ID NO: 3223896 - RNA, 18 nt, Mycobacterium leprae
ggcuggccaucgcaccga

SEQ ID NO: 3223897 - RNA, 11 nt, Mycobacterium leprae
ggcuggcuucc

SEQ ID NO: 3223898 - RNA, 16 nt, Mycobacterium leprae
ggcugguggccgaggu

SEQ ID NO: 3223899 - RNA, 12 nt, Mycobacterium leprae
ggcugguggggu

SEQ ID NO: 3223900 - RNA, 22 nt, Mycobacterium leprae
ggcugguuaacuuaaucgccgg

SEQ ID NO: 3223901 - RNA, 20 nt, Mycobacterium leprae
ggcuguagugggacacucga

SEQ ID NO: 3223902 - RNA, 19 nt, Mycobacterium leprae
ggcuguccuugccggcgcc

SEQ ID NO: 3223903 - RNA, 20 nt, Mycobacterium leprae
ggcuguugucaccccagacg

SEQ ID NO: 3223904 - RNA, 21 nt, Mycobacterium leprae
ggcuucauucuuguguccaua

SEQ ID NO: 3223905 - RNA, 16 nt, Mycobacterium leprae
ggcuuccagcagaccg

SEQ ID NO: 3223906 - RNA, 22 nt, Mycobacterium leprae
ggcuuccucuccuagggugccu

SEQ ID NO: 3223907 - RNA, 23 nt, Mycobacterium leprae
ggcuugcgaucaaacucgcugaa

SEQ ID NO: 3223908 - RNA, 16 nt, Mycobacterium leprae
ggcuugucacgccggu

SEQ ID NO: 3223909 - RNA, 15 nt, Mycobacterium leprae
ggcuuucgcuggcuc

SEQ ID NO: 3223910 - RNA, 15 nt, Mycobacterium leprae
ggcuuuucgacauug

SEQ ID NO: 3223911 - RNA, 20 nt, Mycobacterium leprae
gggaacauaaccacauugug

SEQ ID NO: 3223912 - RNA, 22 nt, Mycobacterium leprae
gggaagacguaacggucgguaa

SEQ ID NO: 3223913 - RNA, 15 nt, Mycobacterium leprae
gggaaggacgcaucc

SEQ ID NO: 3223914 - RNA, 18 nt, Mycobacterium leprae
gggaaggacgcauccauc

SEQ ID NO: 3223915 - RNA, 14 nt, Mycobacterium leprae
gggaaggccaagcg

SEQ ID NO: 3223916 - RNA, 23 nt, Mycobacterium leprae
gggaaggccaagcggaauaucgg

SEQ ID NO: 3223917 - RNA, 17 nt, Mycobacterium leprae
gggacaagucaaaacca

SEQ ID NO: 3223918 - RNA, 15 nt, Mycobacterium leprae
gggacgccggcggcc

SEQ ID NO: 3223919 - RNA, 21 nt, Mycobacterium leprae
gggacgccggcggccaccgcg

SEQ ID NO: 3223920 - RNA, 22 nt, Mycobacterium leprae
gggacgcgucaccaugugcaca

SEQ ID NO: 3223921 - RNA, 17 nt, Mycobacterium leprae
gggacgugaugcagcau

SEQ ID NO: 3223922 - RNA, 18 nt, Mycobacterium leprae
gggacugcgaagcgcagc

SEQ ID NO: 3223923 - RNA, 13 nt, Mycobacterium leprae
gggagaccagaga

SEQ ID NO: 3223924 - RNA, 18 nt, Mycobacterium leprae
gggagacggccugcucug

SEQ ID NO: 3223925 - RNA, 16 nt, Mycobacterium leprae
gggaggcguugcacug

SEQ ID NO: 3223926 - RNA, 23 nt, Mycobacterium leprae
gggagucgauaucgggccgagcu

SEQ ID NO: 3223927 - RNA, 19 nt, Mycobacterium leprae
gggagugcuagcggcgcca

SEQ ID NO: 3223928 - RNA, 15 nt, Mycobacterium leprae
gggaguggcaucguc

SEQ ID NO: 3223929 - RNA, 14 nt, Mycobacterium leprae
gggaucgacaaaau

SEQ ID NO: 3223930 - RNA, 14 nt, Mycobacterium leprae
gggaucggcggcac

SEQ ID NO: 3223931 - RNA, 19 nt, Mycobacterium leprae
gggaucuuuugaccagcac

SEQ ID NO: 3223932 - RNA, 19 nt, Mycobacterium leprae
gggaugagucagacacuug

SEQ ID NO: 3223933 - RNA, 18 nt, Mycobacterium leprae
gggaugcugggucagcau

SEQ ID NO: 3223934 - RNA, 21 nt, Mycobacterium leprae
gggauguuggcgccugccacu

SEQ ID NO: 3223935 - RNA, 17 nt, Mycobacterium leprae
gggcaacaccucaagca

SEQ ID NO: 3223936 - RNA, 18 nt, Mycobacterium leprae
gggcaagccauugcucgg

SEQ ID NO: 3223937 - RNA, 12 nt, Mycobacterium leprae
gggcaagcccgg

SEQ ID NO: 3223938 - RNA, 16 nt, Mycobacterium leprae
gggcaccugggcugug

SEQ ID NO: 3223939 - RNA, 18 nt, Mycobacterium leprae
gggcacgagggcggugcc

SEQ ID NO: 3223940 - RNA, 14 nt, Mycobacterium leprae
gggcagccuggacg

SEQ ID NO: 3223941 - RNA, 14 nt, Mycobacterium leprae
gggcagcgccacgc

SEQ ID NO: 3223942 - RNA, 12 nt, Mycobacterium leprae
gggcaggucagc

SEQ ID NO: 3223943 - RNA, 13 nt, Mycobacterium leprae
gggccaacuagga

SEQ ID NO: 3223944 - RNA, 18 nt, Mycobacterium leprae
gggccacgagacccagcc

SEQ ID NO: 3223945 - RNA, 18 nt, Mycobacterium leprae
gggccacuaauggcgucc

SEQ ID NO: 3223946 - RNA, 15 nt, Mycobacterium leprae
gggccagagcugcga

SEQ ID NO: 3223947 - RNA, 23 nt, Mycobacterium leprae
gggccagcaccaaccuguagacg

SEQ ID NO: 3223948 - RNA, 16 nt, Mycobacterium leprae
gggccgaagcagccgg

SEQ ID NO: 3223949 - RNA, 17 nt, Mycobacterium leprae
gggccgaagcagccggg

SEQ ID NO: 3223950 - RNA, 14 nt, Mycobacterium leprae
gggccgggcugcug

SEQ ID NO: 3223951 - RNA, 18 nt, Mycobacterium leprae
gggccguuauccacagca

SEQ ID NO: 3223952 - RNA, 20 nt, Mycobacterium leprae
gggcgaugccaucgggccag

SEQ ID NO: 3223953 - RNA, 20 nt, Mycobacterium leprae
gggcgcaagcgugcaggcug

SEQ ID NO: 3223954 - RNA, 15 nt, Mycobacterium leprae
gggcgcccggucaag

SEQ ID NO: 3223955 - RNA, 19 nt, Mycobacterium leprae
gggcggccgccggcuaguu

SEQ ID NO: 3223956 - RNA, 11 nt, Mycobacterium leprae
gggcggcggcc

SEQ ID NO: 3223957 - RNA, 23 nt, Mycobacterium leprae
gggcuagaaucuucacgcggaag

SEQ ID NO: 3223958 - RNA, 23 nt, Mycobacterium leprae
gggcuauccucgggugcgcacgg

SEQ ID NO: 3223959 - RNA, 15 nt, Mycobacterium leprae
gggcuaugccgcgcg

SEQ ID NO: 3223960 - RNA, 16 nt, Mycobacterium leprae
gggcuaugccgcgcgu

SEQ ID NO: 3223961 - RNA, 14 nt, Mycobacterium leprae
gggcucgaccaacg

SEQ ID NO: 3223962 - RNA, 12 nt, Mycobacterium leprae
gggcugggacgg

SEQ ID NO: 3223963 - RNA, 17 nt, Mycobacterium leprae
gggcugguggccgaggu

SEQ ID NO: 3223964 - RNA, 15 nt, Mycobacterium leprae
gggcuuccagcagac

SEQ ID NO: 3223965 - RNA, 13 nt, Mycobacterium leprae
ggggacgccggcg

SEQ ID NO: 3223966 - RNA, 22 nt, Mycobacterium leprae
ggggagucgauaucgggccgag

SEQ ID NO: 3223967 - RNA, 16 nt, Mycobacterium leprae
ggggauuucaggugac

SEQ ID NO: 3223968 - RNA, 12 nt, Mycobacterium leprae
ggggcagcccgg

SEQ ID NO: 3223969 - RNA, 20 nt, Mycobacterium leprae
ggggcaggccugaucuccaa

SEQ ID NO: 3223970 - RNA, 22 nt, Mycobacterium leprae
ggggcgcgguaugcggccgcaa

SEQ ID NO: 3223971 - RNA, 22 nt, Mycobacterium leprae
ggggcgcggucgccgaugcgcu

SEQ ID NO: 3223972 - RNA, 14 nt, Mycobacterium leprae
ggggcguccaguga

SEQ ID NO: 3223973 - RNA, 16 nt, Mycobacterium leprae
ggggcguccagugaug

SEQ ID NO: 3223974 - RNA, 19 nt, Mycobacterium leprae
ggggcuacaaucuaguaga

SEQ ID NO: 3223975 - RNA, 19 nt, Mycobacterium leprae
ggggcuauccucgggugcg

SEQ ID NO: 3223976 - RNA, 12 nt, Mycobacterium leprae
ggggcugggucc

SEQ ID NO: 3223977 - RNA, 21 nt, Mycobacterium leprae
gggggaucggggcgauguuau

SEQ ID NO: 3223978 - RNA, 16 nt, Mycobacterium leprae
gggggccuuaucccac

SEQ ID NO: 3223979 - RNA, 10 nt, Mycobacterium leprae
ggggguggga

SEQ ID NO: 3223980 - RNA, 19 nt, Mycobacterium leprae
ggggucagcgggggugggc

SEQ ID NO: 3223981 - RNA, 12 nt, Mycobacterium leprae
gggguggugaug

SEQ ID NO: 3223982 - RNA, 17 nt, Mycobacterium leprae
ggggugugaugcuccac

SEQ ID NO: 3223983 - RNA, 14 nt, Mycobacterium leprae
gggguguugcacca

SEQ ID NO: 3223984 - RNA, 15 nt, Mycobacterium leprae
gggguguuggcccaa

SEQ ID NO: 3223985 - RNA, 16 nt, Mycobacterium leprae
ggguacgagugguuga

SEQ ID NO: 3223986 - RNA, 14 nt, Mycobacterium leprae
ggguacgccaggua

SEQ ID NO: 3223987 - RNA, 14 nt, Mycobacterium leprae
ggguacucagcugg

SEQ ID NO: 3223988 - RNA, 15 nt, Mycobacterium leprae
ggguagcugcaucgg

SEQ ID NO: 3223989 - RNA, 22 nt, Mycobacterium leprae
ggguagcugcaucggcaggcug

SEQ ID NO: 3223990 - RNA, 13 nt, Mycobacterium leprae
ggguaucgaugcu

SEQ ID NO: 3223991 - RNA, 19 nt, Mycobacterium leprae
gggucacaaaccccucguc

SEQ ID NO: 3223992 - RNA, 16 nt, Mycobacterium leprae
gggucagcgggggugg

SEQ ID NO: 3223993 - RNA, 14 nt, Mycobacterium leprae
ggguccggaccugg

SEQ ID NO: 3223994 - RNA, 17 nt, Mycobacterium leprae
gggucgacccgguggug

SEQ ID NO: 3223995 - RNA, 13 nt, Mycobacterium leprae
gggucgagcuacc

SEQ ID NO: 3223996 - RNA, 20 nt, Mycobacterium leprae
gggucgcccaauggugcggc

SEQ ID NO: 3223997 - RNA, 20 nt, Mycobacterium leprae
gggucggcugcaccacgguc

SEQ ID NO: 3223998 - RNA, 17 nt, Mycobacterium leprae
gggugaaauggcuguuu

SEQ ID NO: 3223999 - RNA, 15 nt, Mycobacterium leprae
gggugaccacccaca

SEQ ID NO: 3224000 - RNA, 18 nt, Mycobacterium leprae
gggugaccacccacaacg

SEQ ID NO: 3224001 - RNA, 12 nt, Mycobacterium leprae
gggugcguaauc

SEQ ID NO: 3224002 - RNA, 14 nt, Mycobacterium leprae
gggugggcagccug

SEQ ID NO: 3224003 - RNA, 15 nt, Mycobacterium leprae
gggugggucgaugau

SEQ ID NO: 3224004 - RNA, 21 nt, Mycobacterium leprae
ggguggugaugaugcgaacga

SEQ ID NO: 3224005 - RNA, 19 nt, Mycobacterium leprae
ggguguggcacguuggaug

SEQ ID NO: 3224006 - RNA, 21 nt, Mycobacterium leprae
ggguguugcaccauaccgacg

SEQ ID NO: 3224007 - RNA, 14 nt, Mycobacterium leprae
ggguguugugggug

SEQ ID NO: 3224008 - RNA, 16 nt, Mycobacterium leprae
ggguguuuugucggug

SEQ ID NO: 3224009 - RNA, 21 nt, Mycobacterium leprae
ggguguuuugucggugguggg

SEQ ID NO: 3224010 - RNA, 13 nt, Mycobacterium leprae
ggguugcacugau

SEQ ID NO: 3224011 - RNA, 23 nt, Mycobacterium leprae
ggguugcuuguaccuucuguaug

SEQ ID NO: 3224012 - RNA, 13 nt, Mycobacterium leprae
ggguugggugggg

SEQ ID NO: 3224013 - RNA, 11 nt, Mycobacterium leprae
gguaaacagug

SEQ ID NO: 3224014 - RNA, 12 nt, Mycobacterium leprae
gguaaccgguuu

SEQ ID NO: 3224015 - RNA, 24 nt, Mycobacterium leprae
gguaacugaugguccuggcugcga

SEQ ID NO: 3224016 - RNA, 17 nt, Mycobacterium leprae
gguaagaaaccugaucu

SEQ ID NO: 3224017 - RNA, 19 nt, Mycobacterium leprae
gguaagguuguugacgaug

SEQ ID NO: 3224018 - RNA, 18 nt, Mycobacterium leprae
gguaaucaguaaucgacg

SEQ ID NO: 3224019 - RNA, 19 nt, Mycobacterium leprae
gguaaugcugccugcguca

SEQ ID NO: 3224020 - RNA, 21 nt, Mycobacterium leprae
gguacaaggcuucgccgagcu

SEQ ID NO: 3224021 - RNA, 18 nt, Mycobacterium leprae
gguacacucucagagagc

SEQ ID NO: 3224022 - RNA, 23 nt, Mycobacterium leprae
gguaccacugcucaggucgacga

SEQ ID NO: 3224023 - RNA, 19 nt, Mycobacterium leprae
gguaccagcggcagcggcg

SEQ ID NO: 3224024 - RNA, 22 nt, Mycobacterium leprae
gguaccagcggcagcggcggcc

SEQ ID NO: 3224025 - RNA, 20 nt, Mycobacterium leprae
gguaccgaguuuggcugaca

SEQ ID NO: 3224026 - RNA, 15 nt, Mycobacterium leprae
gguaccgaugugcug

SEQ ID NO: 3224027 - RNA, 20 nt, Mycobacterium leprae
gguaccggcaaaccagagau

SEQ ID NO: 3224028 - RNA, 13 nt, Mycobacterium leprae
gguacgcugcaug

SEQ ID NO: 3224029 - RNA, 14 nt, Mycobacterium leprae
gguacgugguggcu

SEQ ID NO: 3224030 - RNA, 17 nt, Mycobacterium leprae
gguacgugguggcugca

SEQ ID NO: 3224031 - RNA, 14 nt, Mycobacterium leprae
gguacucagcuggu

SEQ ID NO: 3224032 - RNA, 22 nt, Mycobacterium leprae
gguagacgaugaucggcuugcc

SEQ ID NO: 3224033 - RNA, 16 nt, Mycobacterium leprae
gguagcccguuggggu

SEQ ID NO: 3224034 - RNA, 17 nt, Mycobacterium leprae
gguagccguucggcuac

SEQ ID NO: 3224035 - RNA, 22 nt, Mycobacterium leprae
gguaguucuugguuagguuggu

SEQ ID NO: 3224036 - RNA, 14 nt, Mycobacterium leprae
gguaucaaagcgau

SEQ ID NO: 3224037 - RNA, 22 nt, Mycobacterium leprae
gguaucgaugccguggugaugc

SEQ ID NO: 3224038 - RNA, 18 nt, Mycobacterium leprae
gguauugacgugguggua

SEQ ID NO: 3224039 - RNA, 22 nt, Mycobacterium leprae
ggucaacaggaugcgugcccau

SEQ ID NO: 3224040 - RNA, 21 nt, Mycobacterium leprae
ggucaacauugccaucgaacg

SEQ ID NO: 3224041 - RNA, 15 nt, Mycobacterium leprae
ggucaacggccucac

SEQ ID NO: 3224042 - RNA, 13 nt, Mycobacterium leprae
ggucaacgggacu

SEQ ID NO: 3224043 - RNA, 19 nt, Mycobacterium leprae
ggucaacguuugucguguu

SEQ ID NO: 3224044 - RNA, 17 nt, Mycobacterium leprae
ggucaagugucgggugg

SEQ ID NO: 3224045 - RNA, 17 nt, Mycobacterium leprae
ggucacacuggugguga

SEQ ID NO: 3224046 - RNA, 13 nt, Mycobacterium leprae
ggucacccuccuc

SEQ ID NO: 3224047 - RNA, 16 nt, Mycobacterium leprae
ggucagcauggcgaug

SEQ ID NO: 3224048 - RNA, 17 nt, Mycobacterium leprae
ggucagcaugucggcca

SEQ ID NO: 3224049 - RNA, 13 nt, Mycobacterium leprae
ggucaggugucug

SEQ ID NO: 3224050 - RNA, 18 nt, Mycobacterium leprae
ggucaguguauuggcggg

SEQ ID NO: 3224051 - RNA, 18 nt, Mycobacterium leprae
ggucaguuucaucgacga

SEQ ID NO: 3224052 - RNA, 15 nt, Mycobacterium leprae
ggucaugagcgucgc

SEQ ID NO: 3224053 - RNA, 16 nt, Mycobacterium leprae
ggucaugaugcaggua

SEQ ID NO: 3224054 - RNA, 19 nt, Mycobacterium leprae
ggucauuaacgcuggucgg

SEQ ID NO: 3224055 - RNA, 15 nt, Mycobacterium leprae
ggucauuggaagcug

SEQ ID NO: 3224056 - RNA, 21 nt, Mycobacterium leprae
ggucauuuggugguuauuuuu

SEQ ID NO: 3224057 - RNA, 21 nt, Mycobacterium leprae
gguccaauucacgaacaacag

SEQ ID NO: 3224058 - RNA, 19 nt, Mycobacterium leprae
gguccacccgcaugcccug

SEQ ID NO: 3224059 - RNA, 19 nt, Mycobacterium leprae
gguccacuugacuggcuug

SEQ ID NO: 3224060 - RNA, 19 nt, Mycobacterium leprae
ggucccaucgcugaccggu

SEQ ID NO: 3224061 - RNA, 12 nt, Mycobacterium leprae
ggucccgcagcc

SEQ ID NO: 3224062 - RNA, 15 nt, Mycobacterium leprae
gguccgacggcuggc

SEQ ID NO: 3224063 - RNA, 21 nt, Mycobacterium leprae
gguccgacggcuggcugcugc

SEQ ID NO: 3224064 - RNA, 21 nt, Mycobacterium leprae
gguccgaucgcaccggcugca

SEQ ID NO: 3224065 - RNA, 12 nt, Mycobacterium leprae
gguccgccagcg

SEQ ID NO: 3224066 - RNA, 14 nt, Mycobacterium leprae
gguccgccagcgac

SEQ ID NO: 3224067 - RNA, 23 nt, Mycobacterium leprae
gguccgcguuccguugauggugu

SEQ ID NO: 3224068 - RNA, 14 nt, Mycobacterium leprae
gguccggaccugga

SEQ ID NO: 3224069 - RNA, 15 nt, Mycobacterium leprae
gguccggaccuggac

SEQ ID NO: 3224070 - RNA, 15 nt, Mycobacterium leprae
gguccguucgugucg

SEQ ID NO: 3224071 - RNA, 20 nt, Mycobacterium leprae
ggucgaacaaggguacgcca

SEQ ID NO: 3224072 - RNA, 15 nt, Mycobacterium leprae
ggucgacacgaggau

SEQ ID NO: 3224073 - RNA, 20 nt, Mycobacterium leprae
ggucgacuaacgcuucugcc

SEQ ID NO: 3224074 - RNA, 21 nt, Mycobacterium leprae
ggucgagacacagaucgagcg

SEQ ID NO: 3224075 - RNA, 19 nt, Mycobacterium leprae
ggucgagcagccacccgca

SEQ ID NO: 3224076 - RNA, 16 nt, Mycobacterium leprae
ggucgaggaaggaagc

SEQ ID NO: 3224077 - RNA, 22 nt, Mycobacterium leprae
ggucgauagccgugaccgacag

SEQ ID NO: 3224078 - RNA, 14 nt, Mycobacterium leprae
ggucgauggcuacc

SEQ ID NO: 3224079 - RNA, 21 nt, Mycobacterium leprae
ggucgauuugcaauccccagu

SEQ ID NO: 3224080 - RNA, 14 nt, Mycobacterium leprae
ggucgccgaggcga

SEQ ID NO: 3224081 - RNA, 17 nt, Mycobacterium leprae
ggucgcuaucauagcca

SEQ ID NO: 3224082 - RNA, 21 nt, Mycobacterium leprae
ggucgcucggacugggcucau

SEQ ID NO: 3224083 - RNA, 15 nt, Mycobacterium leprae
ggucguacggcgacu

SEQ ID NO: 3224084 - RNA, 17 nt, Mycobacterium leprae
ggucguacggcgacuca

SEQ ID NO: 3224085 - RNA, 20 nt, Mycobacterium leprae
ggucguguugcuugcuguga

SEQ ID NO: 3224086 - RNA, 17 nt, Mycobacterium leprae
ggucguuagcgccgaga

SEQ ID NO: 3224087 - RNA, 18 nt, Mycobacterium leprae
ggucuacauguugaugau

SEQ ID NO: 3224088 - RNA, 22 nt, Mycobacterium leprae
ggucucccaauccuggaugugu

SEQ ID NO: 3224089 - RNA, 15 nt, Mycobacterium leprae
ggucuccggacuacc

SEQ ID NO: 3224090 - RNA, 17 nt, Mycobacterium leprae
ggucucuuucggcagcg

SEQ ID NO: 3224091 - RNA, 15 nt, Mycobacterium leprae
ggucugaaguggggu

SEQ ID NO: 3224092 - RNA, 17 nt, Mycobacterium leprae
ggucugcggugcugagc

SEQ ID NO: 3224093 - RNA, 16 nt, Mycobacterium leprae
ggucugcgguuugggc

SEQ ID NO: 3224094 - RNA, 19 nt, Mycobacterium leprae
ggucuuuucgcgcgcaccc

SEQ ID NO: 3224095 - RNA, 21 nt, Mycobacterium leprae
ggugaaaauauccaccauaca

SEQ ID NO: 3224096 - RNA, 15 nt, Mycobacterium leprae
ggugaaauggcuguu

SEQ ID NO: 3224097 - RNA, 18 nt, Mycobacterium leprae
ggugaacuaagcauuuac

SEQ ID NO: 3224098 - RNA, 15 nt, Mycobacterium leprae
ggugaccacccacaa

SEQ ID NO: 3224099 - RNA, 18 nt, Mycobacterium leprae
ggugaccgaacuguggau

SEQ ID NO: 3224100 - RNA, 19 nt, Mycobacterium leprae
ggugaccgggccggccgcg

SEQ ID NO: 3224101 - RNA, 15 nt, Mycobacterium leprae
ggugacggcuggauc

SEQ ID NO: 3224102 - RNA, 15 nt, Mycobacterium leprae
ggugacggucgugcu

SEQ ID NO: 3224103 - RNA, 17 nt, Mycobacterium leprae
ggugacggucgugcugu

SEQ ID NO: 3224104 - RNA, 13 nt, Mycobacterium leprae
ggugacgguggcg

SEQ ID NO: 3224105 - RNA, 23 nt, Mycobacterium leprae
ggugagacauuucgacaggcugu

SEQ ID NO: 3224106 - RNA, 17 nt, Mycobacterium leprae
ggugagagcuuccaagu

SEQ ID NO: 3224107 - RNA, 16 nt, Mycobacterium leprae
ggugagcguugugggc

SEQ ID NO: 3224108 - RNA, 17 nt, Mycobacterium leprae
ggugagcguugugggca

SEQ ID NO: 3224109 - RNA, 19 nt, Mycobacterium leprae
ggugagcguugugggcagc

SEQ ID NO: 3224110 - RNA, 22 nt, Mycobacterium leprae
ggugagucgcccagcagguuga

SEQ ID NO: 3224111 - RNA, 20 nt, Mycobacterium leprae
ggugaucgcugccggcggca

SEQ ID NO: 3224112 - RNA, 15 nt, Mycobacterium leprae
ggugaucgugguggg

SEQ ID NO: 3224113 - RNA, 16 nt, Mycobacterium leprae
ggugaugucggcgucc

SEQ ID NO: 3224114 - RNA, 23 nt, Mycobacterium leprae
ggugcaccagcucacccgcagca

SEQ ID NO: 3224115 - RNA, 16 nt, Mycobacterium leprae
ggugcagugccgccga

SEQ ID NO: 3224116 - RNA, 19 nt, Mycobacterium leprae
ggugcagugccgccgaucg

SEQ ID NO: 3224117 - RNA, 21 nt, Mycobacterium leprae
ggugcauggaucaguuugccg

SEQ ID NO: 3224118 - RNA, 13 nt, Mycobacterium leprae
ggugccaggcagc

SEQ ID NO: 3224119 - RNA, 16 nt, Mycobacterium leprae
ggugccaggcagcugu

SEQ ID NO: 3224120 - RNA, 15 nt, Mycobacterium leprae
ggugccgaucccggc

SEQ ID NO: 3224121 - RNA, 22 nt, Mycobacterium leprae
ggugccgaucccggcgcugucc

SEQ ID NO: 3224122 - RNA, 20 nt, Mycobacterium leprae
ggugccgccauugcccccgc

SEQ ID NO: 3224123 - RNA, 15 nt, Mycobacterium leprae
ggugcgcugcugacg

SEQ ID NO: 3224124 - RNA, 21 nt, Mycobacterium leprae
ggugcggccacauugaccacg

SEQ ID NO: 3224125 - RNA, 16 nt, Mycobacterium leprae
ggugcggcgccgcccg

SEQ ID NO: 3224126 - RNA, 18 nt, Mycobacterium leprae
ggugcgguaaucccagcg

SEQ ID NO: 3224127 - RNA, 21 nt, Mycobacterium leprae
ggugcguaaucgccgguggca

SEQ ID NO: 3224128 - RNA, 17 nt, Mycobacterium leprae
ggugcgucaggucgcaa

SEQ ID NO: 3224129 - RNA, 23 nt, Mycobacterium leprae
ggugcgugagguguugccgaggg

SEQ ID NO: 3224130 - RNA, 17 nt, Mycobacterium leprae
ggugcugcacggcugcg

SEQ ID NO: 3224131 - RNA, 23 nt, Mycobacterium leprae
ggugcugcagccacgaaaaucug

SEQ ID NO: 3224132 - RNA, 19 nt, Mycobacterium leprae
ggugcuuuagcccgccgcg

SEQ ID NO: 3224133 - RNA, 20 nt, Mycobacterium leprae
gguggacgaaccggacagca

SEQ ID NO: 3224134 - RNA, 18 nt, Mycobacterium leprae
gguggaguaaaggguggc

SEQ ID NO: 3224135 - RNA, 20 nt, Mycobacterium leprae
gguggaguaaaggguggcgg

SEQ ID NO: 3224136 - RNA, 21 nt, Mycobacterium leprae
gguggaguaaagggugguggg

SEQ ID NO: 3224137 - RNA, 17 nt, Mycobacterium leprae
gguggaguucgucugaa

SEQ ID NO: 3224138 - RNA, 19 nt, Mycobacterium leprae
gguggauccaggugcugca

SEQ ID NO: 3224139 - RNA, 17 nt, Mycobacterium leprae
gguggauuccagcuacc

SEQ ID NO: 3224140 - RNA, 17 nt, Mycobacterium leprae
gguggcacuugaaauuu

SEQ ID NO: 3224141 - RNA, 19 nt, Mycobacterium leprae
gguggcagccacagcgacg

SEQ ID NO: 3224142 - RNA, 14 nt, Mycobacterium leprae
gguggcagccgcca

SEQ ID NO: 3224143 - RNA, 17 nt, Mycobacterium leprae
gguggcgccggcgugcg

SEQ ID NO: 3224144 - RNA, 19 nt, Mycobacterium leprae
gguggcugucgggcaccug

SEQ ID NO: 3224145 - RNA, 14 nt, Mycobacterium leprae
ggugggcagccugg

SEQ ID NO: 3224146 - RNA, 21 nt, Mycobacterium leprae
ggugggcgaucaggagguggu

SEQ ID NO: 3224147 - RNA, 21 nt, Mycobacterium leprae
ggugggguguugguucgucga

SEQ ID NO: 3224148 - RNA, 12 nt, Mycobacterium leprae
gguggguggcug

SEQ ID NO: 3224149 - RNA, 19 nt, Mycobacterium leprae
gguggguuauccccacaug

SEQ ID NO: 3224150 - RNA, 15 nt, Mycobacterium leprae
ggugguccggguugc

SEQ ID NO: 3224151 - RNA, 13 nt, Mycobacterium leprae
ggugguggaugcu

SEQ ID NO: 3224152 - RNA, 17 nt, Mycobacterium leprae
ggugguguggcccgacg

SEQ ID NO: 3224153 - RNA, 19 nt, Mycobacterium leprae
gguguauaauuugaagcug

SEQ ID NO: 3224154 - RNA, 17 nt, Mycobacterium leprae
ggugucccgaugaucca

SEQ ID NO: 3224155 - RNA, 14 nt, Mycobacterium leprae
gguguccguaagcg

SEQ ID NO: 3224156 - RNA, 21 nt, Mycobacterium leprae
ggugugaccgugcagcugcca

SEQ ID NO: 3224157 - RNA, 22 nt, Mycobacterium leprae
ggugugcguugccugaaaacua

SEQ ID NO: 3224158 - RNA, 13 nt, Mycobacterium leprae
ggugugugaggau

SEQ ID NO: 3224159 - RNA, 17 nt, Mycobacterium leprae
gguguugguucgucgag

SEQ ID NO: 3224160 - RNA, 14 nt, Mycobacterium leprae
gguguugugguggg

SEQ ID NO: 3224161 - RNA, 20 nt, Mycobacterium leprae
gguguuucacaaccaucgcu

SEQ ID NO: 3224162 - RNA, 20 nt, Mycobacterium leprae
gguguuuugucggugguggg

SEQ ID NO: 3224163 - RNA, 20 nt, Mycobacterium leprae
gguuaaagucaugccccgcg

SEQ ID NO: 3224164 - RNA, 20 nt, Mycobacterium leprae
gguuacgcgcucgccggggu

SEQ ID NO: 3224165 - RNA, 21 nt, Mycobacterium leprae
gguuaugucggcugucgcgga

SEQ ID NO: 3224166 - RNA, 14 nt, Mycobacterium leprae
gguucauggcuguu

SEQ ID NO: 3224167 - RNA, 14 nt, Mycobacterium leprae
gguuccgcaauuuc

SEQ ID NO: 3224168 - RNA, 14 nt, Mycobacterium leprae
gguucgaguccugg

SEQ ID NO: 3224169 - RNA, 14 nt, Mycobacterium leprae
gguucgccgccggc

SEQ ID NO: 3224170 - RNA, 19 nt, Mycobacterium leprae
gguugacccgcgguagcgg

SEQ ID NO: 3224171 - RNA, 14 nt, Mycobacterium leprae
gguugccgagcugu

SEQ ID NO: 3224172 - RNA, 22 nt, Mycobacterium leprae
gguugccgcgguuuccgcggca

SEQ ID NO: 3224173 - RNA, 15 nt, Mycobacterium leprae
gguugcggguacgac

SEQ ID NO: 3224174 - RNA, 18 nt, Mycobacterium leprae
gguugcuuuggggguugc

SEQ ID NO: 3224175 - RNA, 14 nt, Mycobacterium leprae
gguuggccaacugu

SEQ ID NO: 3224176 - RNA, 17 nt, Mycobacterium leprae
gguuggcuagcgugcuu

SEQ ID NO: 3224177 - RNA, 14 nt, Mycobacterium leprae
gguugggugggggu

SEQ ID NO: 3224178 - RNA, 12 nt, Mycobacterium leprae
gguuggugguga

SEQ ID NO: 3224179 - RNA, 22 nt, Mycobacterium leprae
gguugguuucauaggugguggg

SEQ ID NO: 3224180 - RNA, 17 nt, Mycobacterium leprae
gguuguggaccggauca

SEQ ID NO: 3224181 - RNA, 16 nt, Mycobacterium leprae
gguuguucgacaagcu

SEQ ID NO: 3224182 - RNA, 16 nt, Mycobacterium leprae
gguuuccaugaugguu

SEQ ID NO: 3224183 - RNA, 14 nt, Mycobacterium leprae
gguuuccggcacca

SEQ ID NO: 3224184 - RNA, 21 nt, Mycobacterium leprae
gguuucguguuuucaguucac

SEQ ID NO: 3224185 - RNA, 16 nt, Mycobacterium leprae
gguuugaucugcgucg

SEQ ID NO: 3224186 - RNA, 16 nt, Mycobacterium leprae
guaaacaaaaguguaa

SEQ ID NO: 3224187 - RNA, 18 nt, Mycobacterium leprae
guaaagccgcgcccggcc

SEQ ID NO: 3224188 - RNA, 14 nt, Mycobacterium leprae
guaaaggguggugg

SEQ ID NO: 3224189 - RNA, 17 nt, Mycobacterium leprae
guaaaucuggcaagugc

SEQ ID NO: 3224190 - RNA, 21 nt, Mycobacterium leprae
guaacacucauuggacccagc

SEQ ID NO: 3224191 - RNA, 19 nt, Mycobacterium leprae
guaaccgcucgauggccag

SEQ ID NO: 3224192 - RNA, 23 nt, Mycobacterium leprae
guaaccggggaccucauccucgg

SEQ ID NO: 3224193 - RNA, 15 nt, Mycobacterium leprae
guaacgauuagcaug

SEQ ID NO: 3224194 - RNA, 17 nt, Mycobacterium leprae
guaacgcugaccagcag

SEQ ID NO: 3224195 - RNA, 20 nt, Mycobacterium leprae
guaacgcugauugccaacuc

SEQ ID NO: 3224196 - RNA, 21 nt, Mycobacterium leprae
guaacgcugauugccaacuca

SEQ ID NO: 3224197 - RNA, 16 nt, Mycobacterium leprae
guaacgggcccgguac

SEQ ID NO: 3224198 - RNA, 16 nt, Mycobacterium leprae
guaacuaauccagaca

SEQ ID NO: 3224199 - RNA, 18 nt, Mycobacterium leprae
guaacuggcucgauucca

SEQ ID NO: 3224200 - RNA, 21 nt, Mycobacterium leprae
guaacuuguccguuuagacuu

SEQ ID NO: 3224201 - RNA, 18 nt, Mycobacterium leprae
guaagaauaagguaccac

SEQ ID NO: 3224202 - RNA, 22 nt, Mycobacterium leprae
guaagagguuuaccgccaucgg

SEQ ID NO: 3224203 - RNA, 14 nt, Mycobacterium leprae
guaagauacugcaa

SEQ ID NO: 3224204 - RNA, 20 nt, Mycobacterium leprae
guaagauuccaaugucccac

SEQ ID NO: 3224205 - RNA, 16 nt, Mycobacterium leprae
guaagcuugcagucuu

SEQ ID NO: 3224206 - RNA, 19 nt, Mycobacterium leprae
guaagguuguugacgauga

SEQ ID NO: 3224207 - RNA, 23 nt, Mycobacterium leprae
guaaguugcuuaacgaucgcacu

SEQ ID NO: 3224208 - RNA, 16 nt, Mycobacterium leprae
guaauaauauccaaag

SEQ ID NO: 3224209 - RNA, 16 nt, Mycobacterium leprae
guaaucgcuuggugcu

SEQ ID NO: 3224210 - RNA, 19 nt, Mycobacterium leprae
guaaugcaagcgcuuuucc

SEQ ID NO: 3224211 - RNA, 15 nt, Mycobacterium leprae
guaaugugcuaucac

SEQ ID NO: 3224212 - RNA, 15 nt, Mycobacterium leprae
guaauugacaccgcc

SEQ ID NO: 3224213 - RNA, 19 nt, Mycobacterium leprae
guacaaggcuucgccgagc

SEQ ID NO: 3224214 - RNA, 22 nt, Mycobacterium leprae
guacaccaagaacuucaagcuc

SEQ ID NO: 3224215 - RNA, 16 nt, Mycobacterium leprae
guacacuaagccccgu

SEQ ID NO: 3224216 - RNA, 19 nt, Mycobacterium leprae
guacagcgauucuguggua

SEQ ID NO: 3224217 - RNA, 15 nt, Mycobacterium leprae
guacaugcuggcagu

SEQ ID NO: 3224218 - RNA, 22 nt, Mycobacterium leprae
guaccacugcucaggucgacga

SEQ ID NO: 3224219 - RNA, 20 nt, Mycobacterium leprae
guaccagcggcagcggcggc

SEQ ID NO: 3224220 - RNA, 20 nt, Mycobacterium leprae
guacccggccagauccagca

SEQ ID NO: 3224221 - RNA, 14 nt, Mycobacterium leprae
guaccggucaacgc

SEQ ID NO: 3224222 - RNA, 20 nt, Mycobacterium leprae
guaccgucuaguggcgcggc

SEQ ID NO: 3224223 - RNA, 17 nt, Mycobacterium leprae
guaccuccagccgcggg

SEQ ID NO: 3224224 - RNA, 21 nt, Mycobacterium leprae
guaccugauaagggucaucca

SEQ ID NO: 3224225 - RNA, 13 nt, Mycobacterium leprae
guacgagugcuaa

SEQ ID NO: 3224226 - RNA, 20 nt, Mycobacterium leprae
guacggagauagacaugugu

SEQ ID NO: 3224227 - RNA, 13 nt, Mycobacterium leprae
guacggaucgaaa

SEQ ID NO: 3224228 - RNA, 21 nt, Mycobacterium leprae
guacucaauggccugcucaug

SEQ ID NO: 3224229 - RNA, 15 nt, Mycobacterium leprae
guacucauagcggcg

SEQ ID NO: 3224230 - RNA, 20 nt, Mycobacterium leprae
guacuccagcagcgugguca

SEQ ID NO: 3224231 - RNA, 14 nt, Mycobacterium leprae
guacucuggcuggu

SEQ ID NO: 3224232 - RNA, 12 nt, Mycobacterium leprae
guacugaccggc

SEQ ID NO: 3224233 - RNA, 17 nt, Mycobacterium leprae
guacugacuggggagug

SEQ ID NO: 3224234 - RNA, 13 nt, Mycobacterium leprae
guacuggcggccg

SEQ ID NO: 3224235 - RNA, 16 nt, Mycobacterium leprae
guacuggugcuguguu

SEQ ID NO: 3224236 - RNA, 12 nt, Mycobacterium leprae
guacugucuacc

SEQ ID NO: 3224237 - RNA, 14 nt, Mycobacterium leprae
guacuuugugugca

SEQ ID NO: 3224238 - RNA, 16 nt, Mycobacterium leprae
guagaccaugagcaca

SEQ ID NO: 3224239 - RNA, 22 nt, Mycobacterium leprae
guagaccaugagcacacgcugc

SEQ ID NO: 3224240 - RNA, 15 nt, Mycobacterium leprae
guagaccucuucaga

SEQ ID NO: 3224241 - RNA, 18 nt, Mycobacterium leprae
guagagaagucaggcugu

SEQ ID NO: 3224242 - RNA, 19 nt, Mycobacterium leprae
guagagagccgagcgcagc

SEQ ID NO: 3224243 - RNA, 17 nt, Mycobacterium leprae
guagagccuacucccgg

SEQ ID NO: 3224244 - RNA, 18 nt, Mycobacterium leprae
guagauaucuacugggcc

SEQ ID NO: 3224245 - RNA, 13 nt, Mycobacterium leprae
guagaugcaacug

SEQ ID NO: 3224246 - RNA, 22 nt, Mycobacterium leprae
guagccuggaagaugacucggc

SEQ ID NO: 3224247 - RNA, 24 nt, Mycobacterium leprae
guagcgagcgcaucaagucggucg

SEQ ID NO: 3224248 - RNA, 22 nt, Mycobacterium leprae
guagcggucggcgcacaggugu

SEQ ID NO: 3224249 - RNA, 16 nt, Mycobacterium leprae
guagcuagaccgaauc

SEQ ID NO: 3224250 - RNA, 21 nt, Mycobacterium leprae
guagcuaguuuaccgugguug

SEQ ID NO: 3224251 - RNA, 14 nt, Mycobacterium leprae
guagcucaauuggc

SEQ ID NO: 3224252 - RNA, 14 nt, Mycobacterium leprae
guaggaguuuuuca

SEQ ID NO: 3224253 - RNA, 18 nt, Mycobacterium leprae
guaggaguuuuucagcgg

SEQ ID NO: 3224254 - RNA, 22 nt, Mycobacterium leprae
guaggcugucugcggauuuugc

SEQ ID NO: 3224255 - RNA, 21 nt, Mycobacterium leprae
guaggggcguuuuagugugca

SEQ ID NO: 3224256 - RNA, 13 nt, Mycobacterium leprae
guagguguaguuu

SEQ ID NO: 3224257 - RNA, 17 nt, Mycobacterium leprae
guagguugaugagggga

SEQ ID NO: 3224258 - RNA, 22 nt, Mycobacterium leprae
guaguuacuaacuuaguuuaga

SEQ ID NO: 3224259 - RNA, 17 nt, Mycobacterium leprae
guaguuuccugagcagc

SEQ ID NO: 3224260 - RNA, 13 nt, Mycobacterium leprae
guauaaccugcuu

SEQ ID NO: 3224261 - RNA, 16 nt, Mycobacterium leprae
guauagugguucugcu

SEQ ID NO: 3224262 - RNA, 15 nt, Mycobacterium leprae
guaucaaaacuauug

SEQ ID NO: 3224263 - RNA, 19 nt, Mycobacterium leprae
guaucacgauguagagcug

SEQ ID NO: 3224264 - RNA, 15 nt, Mycobacterium leprae
guaucgccgaucaau

SEQ ID NO: 3224265 - RNA, 18 nt, Mycobacterium leprae
guaucggugucggcggcu

SEQ ID NO: 3224266 - RNA, 13 nt, Mycobacterium leprae
guaucgugccucc

SEQ ID NO: 3224267 - RNA, 17 nt, Mycobacterium leprae
guaugcaccgcggcggg

SEQ ID NO: 3224268 - RNA, 11 nt, Mycobacterium leprae
guaugcaugcu

SEQ ID NO: 3224269 - RNA, 23 nt, Mycobacterium leprae
guaugguguaauuggcaacacag

SEQ ID NO: 3224270 - RNA, 18 nt, Mycobacterium leprae
guauuacguuggcuaaca

SEQ ID NO: 3224271 - RNA, 22 nt, Mycobacterium leprae
guauugcuuagcuaugcaguga

SEQ ID NO: 3224272 - RNA, 19 nt, Mycobacterium leprae
guauugggcgguguugcgc

SEQ ID NO: 3224273 - RNA, 11 nt, Mycobacterium leprae
guauuuccuaa

SEQ ID NO: 3224274 - RNA, 12 nt, Mycobacterium leprae
gucaaaaacuca

SEQ ID NO: 3224275 - RNA, 16 nt, Mycobacterium leprae
gucaaagcccuucacu

SEQ ID NO: 3224276 - RNA, 19 nt, Mycobacterium leprae
gucaaagcccuucacuucc

SEQ ID NO: 3224277 - RNA, 20 nt, Mycobacterium leprae
gucaaagcuagccaccaagu

SEQ ID NO: 3224278 - RNA, 18 nt, Mycobacterium leprae
gucaaauuacgcgugcca

SEQ ID NO: 3224279 - RNA, 16 nt, Mycobacterium leprae
gucaaauucaaccgga

SEQ ID NO: 3224280 - RNA, 13 nt, Mycobacterium leprae
gucaacggccuca

SEQ ID NO: 3224281 - RNA, 19 nt, Mycobacterium leprae
gucaacgggacugacggag

SEQ ID NO: 3224282 - RNA, 14 nt, Mycobacterium leprae
gucaagaugaucgu

SEQ ID NO: 3224283 - RNA, 21 nt, Mycobacterium leprae
gucaagcggguugacuuuaac

SEQ ID NO: 3224284 - RNA, 17 nt, Mycobacterium leprae
gucaaggugaaacuccc

SEQ ID NO: 3224285 - RNA, 21 nt, Mycobacterium leprae
gucaaucagguugacaaucga

SEQ ID NO: 3224286 - RNA, 22 nt, Mycobacterium leprae
gucaaugcguccaccgagacgu

SEQ ID NO: 3224287 - RNA, 16 nt, Mycobacterium leprae
gucacacuggugguga

SEQ ID NO: 3224288 - RNA, 23 nt, Mycobacterium leprae
gucacagguaaacaaaaguguaa

SEQ ID NO: 3224289 - RNA, 17 nt, Mycobacterium leprae
gucaccccgagcucggc

SEQ ID NO: 3224290 - RNA, 19 nt, Mycobacterium leprae
gucacccuccucgcggcgg

SEQ ID NO: 3224291 - RNA, 15 nt, Mycobacterium leprae
gucaccgcuguggca

SEQ ID NO: 3224292 - RNA, 19 nt, Mycobacterium leprae
gucaccugugggacgacaa

SEQ ID NO: 3224293 - RNA, 15 nt, Mycobacterium leprae
gucacgagaccacgg

SEQ ID NO: 3224294 - RNA, 19 nt, Mycobacterium leprae
gucacgccggucgaaguga

SEQ ID NO: 3224295 - RNA, 22 nt, Mycobacterium leprae
gucacgccggucgaagugaccu

SEQ ID NO: 3224296 - RNA, 20 nt, Mycobacterium leprae
gucacgcuagaaacaggcau

SEQ ID NO: 3224297 - RNA, 13 nt, Mycobacterium leprae
gucacgcugcucg

SEQ ID NO: 3224298 - RNA, 16 nt, Mycobacterium leprae
gucacgggucggcggg

SEQ ID NO: 3224299 - RNA, 16 nt, Mycobacterium leprae
gucacgguugcccgcu

SEQ ID NO: 3224300 - RNA, 17 nt, Mycobacterium leprae
gucacgguugcccgcug

SEQ ID NO: 3224301 - RNA, 18 nt, Mycobacterium leprae
gucacgucgacggcggcc

SEQ ID NO: 3224302 - RNA, 21 nt, Mycobacterium leprae
gucacuacguuggccagcacg

SEQ ID NO: 3224303 - RNA, 14 nt, Mycobacterium leprae
gucacuauaauuua

SEQ ID NO: 3224304 - RNA, 18 nt, Mycobacterium leprae
gucacuccacgauucugc

SEQ ID NO: 3224305 - RNA, 13 nt, Mycobacterium leprae
gucagaguuucau

SEQ ID NO: 3224306 - RNA, 12 nt, Mycobacterium leprae
gucagcacaugg

SEQ ID NO: 3224307 - RNA, 15 nt, Mycobacterium leprae
gucagcaugcccaga

SEQ ID NO: 3224308 - RNA, 12 nt, Mycobacterium leprae
gucagccacauc

SEQ ID NO: 3224309 - RNA, 17 nt, Mycobacterium leprae
gucagccacauccucgg

SEQ ID NO: 3224310 - RNA, 18 nt, Mycobacterium leprae
gucagccuagcagcaucg

SEQ ID NO: 3224311 - RNA, 12 nt, Mycobacterium leprae
gucagcgauuug

SEQ ID NO: 3224312 - RNA, 21 nt, Mycobacterium leprae
gucagcgauuugugauaccgu

SEQ ID NO: 3224313 - RNA, 17 nt, Mycobacterium leprae
gucagcggacugcuagc

SEQ ID NO: 3224314 - RNA, 18 nt, Mycobacterium leprae
gucagcgucguggcugug

SEQ ID NO: 3224315 - RNA, 18 nt, Mycobacterium leprae
gucagcuggaauccccca

SEQ ID NO: 3224316 - RNA, 22 nt, Mycobacterium leprae
gucagcuugucgauguuggugu

SEQ ID NO: 3224317 - RNA, 14 nt, Mycobacterium leprae
gucaggauaccgaa

SEQ ID NO: 3224318 - RNA, 16 nt, Mycobacterium leprae
gucaggccaggcagcg

SEQ ID NO: 3224319 - RNA, 22 nt, Mycobacterium leprae
gucaggcugccaacguccagug

SEQ ID NO: 3224320 - RNA, 23 nt, Mycobacterium leprae
gucaggucaugccagggcaugcu

SEQ ID NO: 3224321 - RNA, 21 nt, Mycobacterium leprae
gucagguggcuugaguuuuga

SEQ ID NO: 3224322 - RNA, 13 nt, Mycobacterium leprae
gucaguggcgaca

SEQ ID NO: 3224323 - RNA, 19 nt, Mycobacterium leprae
gucaguggcgacacuacug

SEQ ID NO: 3224324 - RNA, 16 nt, Mycobacterium leprae
gucaguggcgacgacc

SEQ ID NO: 3224325 - RNA, 21 nt, Mycobacterium leprae
gucauacacgugguccuuccg

SEQ ID NO: 3224326 - RNA, 23 nt, Mycobacterium leprae
gucauagacaaggguuagcagaa

SEQ ID NO: 3224327 - RNA, 15 nt, Mycobacterium leprae
gucaucagaaauguc

SEQ ID NO: 3224328 - RNA, 17 nt, Mycobacterium leprae
gucaucagaaauguccu

SEQ ID NO: 3224329 - RNA, 21 nt, Mycobacterium leprae
gucaucagaaauguccuugag

SEQ ID NO: 3224330 - RNA, 22 nt, Mycobacterium leprae
gucaucagauucacagucggcg

SEQ ID NO: 3224331 - RNA, 16 nt, Mycobacterium leprae
gucaucgacgaugcca

SEQ ID NO: 3224332 - RNA, 13 nt, Mycobacterium leprae
gucaucggcgucg

SEQ ID NO: 3224333 - RNA, 18 nt, Mycobacterium leprae
gucaucuaaacugacgcu

SEQ ID NO: 3224334 - RNA, 12 nt, Mycobacterium leprae
gucaugcagaug

SEQ ID NO: 3224335 - RNA, 20 nt, Mycobacterium leprae
gucauggcacugggcugcuc

SEQ ID NO: 3224336 - RNA, 18 nt, Mycobacterium leprae
gucauggcuucgucaccc

SEQ ID NO: 3224337 - RNA, 20 nt, Mycobacterium leprae
gucauguucccugacuguuu

SEQ ID NO: 3224338 - RNA, 13 nt, Mycobacterium leprae
gucauuaacgcug

SEQ ID NO: 3224339 - RNA, 19 nt, Mycobacterium leprae
guccaacaagguucuuaug

SEQ ID NO: 3224340 - RNA, 19 nt, Mycobacterium leprae
guccaccagccgcaggcac

SEQ ID NO: 3224341 - RNA, 14 nt, Mycobacterium leprae
guccaccgccaggc

SEQ ID NO: 3224342 - RNA, 15 nt, Mycobacterium leprae
guccaccgccaggcu

SEQ ID NO: 3224343 - RNA, 13 nt, Mycobacterium leprae
guccaccugccag

SEQ ID NO: 3224344 - RNA, 12 nt, Mycobacterium leprae
guccacgucggu

SEQ ID NO: 3224345 - RNA, 13 nt, Mycobacterium leprae
guccacgugucug

SEQ ID NO: 3224346 - RNA, 20 nt, Mycobacterium leprae
guccacugcagggcgagcug

SEQ ID NO: 3224347 - RNA, 22 nt, Mycobacterium leprae
guccacugcggcaaagcacacg

SEQ ID NO: 3224348 - RNA, 18 nt, Mycobacterium leprae
guccacugguaaguauaa

SEQ ID NO: 3224349 - RNA, 18 nt, Mycobacterium leprae
guccacuugacuggcuug

SEQ ID NO: 3224350 - RNA, 19 nt, Mycobacterium leprae
guccagcgguaacuggcuc

SEQ ID NO: 3224351 - RNA, 13 nt, Mycobacterium leprae
guccagcuggccg

SEQ ID NO: 3224352 - RNA, 17 nt, Mycobacterium leprae
guccaucgcgucgucuu

SEQ ID NO: 3224353 - RNA, 19 nt, Mycobacterium leprae
guccaugccacugucgcga

SEQ ID NO: 3224354 - RNA, 14 nt, Mycobacterium leprae
gucccaagcgcuga

SEQ ID NO: 3224355 - RNA, 14 nt, Mycobacterium leprae
gucccacagccgcg

SEQ ID NO: 3224356 - RNA, 22 nt, Mycobacterium leprae
gucccagguuuccgugucaagu

SEQ ID NO: 3224357 - RNA, 15 nt, Mycobacterium leprae
gucccgaaacgccuc

SEQ ID NO: 3224358 - RNA, 20 nt, Mycobacterium leprae
gucccgaacaaauugugggg

SEQ ID NO: 3224359 - RNA, 22 nt, Mycobacterium leprae
gucccgcagccgcguccagaca

SEQ ID NO: 3224360 - RNA, 15 nt, Mycobacterium leprae
gucccgggggccagc

SEQ ID NO: 3224361 - RNA, 20 nt, Mycobacterium leprae
gucccgggggccagcguugg

SEQ ID NO: 3224362 - RNA, 22 nt, Mycobacterium leprae
gucccggugugcccucgcugcc

SEQ ID NO: 3224363 - RNA, 15 nt, Mycobacterium leprae
gucccuguccuucaa

SEQ ID NO: 3224364 - RNA, 13 nt, Mycobacterium leprae
gucccuucgccga

SEQ ID NO: 3224365 - RNA, 23 nt, Mycobacterium leprae
guccgaucgcaccggcugcaccc

SEQ ID NO: 3224366 - RNA, 14 nt, Mycobacterium leprae
guccgcaaaaugcu

SEQ ID NO: 3224367 - RNA, 20 nt, Mycobacterium leprae
guccgcacaaacuucgacga

SEQ ID NO: 3224368 - RNA, 14 nt, Mycobacterium leprae
guccgccagcgaca

SEQ ID NO: 3224369 - RNA, 16 nt, Mycobacterium leprae
guccgcccugaugguu

SEQ ID NO: 3224370 - RNA, 17 nt, Mycobacterium leprae
guccgcuacauugcucc

SEQ ID NO: 3224371 - RNA, 17 nt, Mycobacterium leprae
guccggagagcagaugg

SEQ ID NO: 3224372 - RNA, 18 nt, Mycobacterium leprae
guccgguugcguggcugc

SEQ ID NO: 3224373 - RNA, 20 nt, Mycobacterium leprae
guccucgaaucggaugcgau

SEQ ID NO: 3224374 - RNA, 15 nt, Mycobacterium leprae
guccugacagauacu

SEQ ID NO: 3224375 - RNA, 21 nt, Mycobacterium leprae
guccugcccggacaagucagc

SEQ ID NO: 3224376 - RNA, 16 nt, Mycobacterium leprae
guccugcgacaucucg

SEQ ID NO: 3224377 - RNA, 16 nt, Mycobacterium leprae
guccugggauugggca

SEQ ID NO: 3224378 - RNA, 22 nt, Mycobacterium leprae
guccugguaccccagcaaaaag

SEQ ID NO: 3224379 - RNA, 18 nt, Mycobacterium leprae
guccugguggcaacgcug

SEQ ID NO: 3224380 - RNA, 21 nt, Mycobacterium leprae
guccugugggucgacccggug

SEQ ID NO: 3224381 - RNA, 12 nt, Mycobacterium leprae
gucgaaacguca

SEQ ID NO: 3224382 - RNA, 19 nt, Mycobacterium leprae
gucgaaggugagucgacag

SEQ ID NO: 3224383 - RNA, 20 nt, Mycobacterium leprae
gucgaaggugagucgacagc

SEQ ID NO: 3224384 - RNA, 17 nt, Mycobacterium leprae
gucgaagugcgccagcg

SEQ ID NO: 3224385 - RNA, 14 nt, Mycobacterium leprae
gucgaauucuuaag

SEQ ID NO: 3224386 - RNA, 14 nt, Mycobacterium leprae
gucgacaagcaucu

SEQ ID NO: 3224387 - RNA, 14 nt, Mycobacterium leprae
gucgacaguguccc

SEQ ID NO: 3224388 - RNA, 21 nt, Mycobacterium leprae
gucgacagugucccuguccuu

SEQ ID NO: 3224389 - RNA, 13 nt, Mycobacterium leprae
gucgacgcgugcg

SEQ ID NO: 3224390 - RNA, 20 nt, Mycobacterium leprae
gucgacguguucacgcaguc

SEQ ID NO: 3224391 - RNA, 21 nt, Mycobacterium leprae
gucgacguguucacgcaguca

SEQ ID NO: 3224392 - RNA, 23 nt, Mycobacterium leprae
gucgacguguucacgcagucauc

SEQ ID NO: 3224393 - RNA, 14 nt, Mycobacterium leprae
gucgacugaccagc

SEQ ID NO: 3224394 - RNA, 18 nt, Mycobacterium leprae
gucgacugaccagcgauc

SEQ ID NO: 3224395 - RNA, 16 nt, Mycobacterium leprae
gucgacuucgcagcca

SEQ ID NO: 3224396 - RNA, 11 nt, Mycobacterium leprae
gucgagcagcu

SEQ ID NO: 3224397 - RNA, 12 nt, Mycobacterium leprae
gucgagcagcuc

SEQ ID NO: 3224398 - RNA, 12 nt, Mycobacterium leprae
gucgaggccaga

SEQ ID NO: 3224399 - RNA, 16 nt, Mycobacterium leprae
gucgagggcucagugu

SEQ ID NO: 3224400 - RNA, 20 nt, Mycobacterium leprae
gucgagucauguucccugac

SEQ ID NO: 3224401 - RNA, 20 nt, Mycobacterium leprae
gucgagugguccccuguagc

SEQ ID NO: 3224402 - RNA, 13 nt, Mycobacterium leprae
gucgaucagggcg

SEQ ID NO: 3224403 - RNA, 16 nt, Mycobacterium leprae
gucgaucagggcgccc

SEQ ID NO: 3224404 - RNA, 14 nt, Mycobacterium leprae
gucgaucgcagccg

SEQ ID NO: 3224405 - RNA, 23 nt, Mycobacterium leprae
gucgaucggcagugguaaucgac

SEQ ID NO: 3224406 - RNA, 14 nt, Mycobacterium leprae
gucgaugaugaaaa

SEQ ID NO: 3224407 - RNA, 15 nt, Mycobacterium leprae
gucgauuaccacugc

SEQ ID NO: 3224408 - RNA, 14 nt, Mycobacterium leprae
gucgauuacucacg

SEQ ID NO: 3224409 - RNA, 20 nt, Mycobacterium leprae
gucgauucaccgaucgacaa

SEQ ID NO: 3224410 - RNA, 21 nt, Mycobacterium leprae
gucgcacccugccgccacagc

SEQ ID NO: 3224411 - RNA, 14 nt, Mycobacterium leprae
gucgcaccgauauc

SEQ ID NO: 3224412 - RNA, 12 nt, Mycobacterium leprae
gucgcagcggcg

SEQ ID NO: 3224413 - RNA, 14 nt, Mycobacterium leprae
gucgcaggagaucc

SEQ ID NO: 3224414 - RNA, 22 nt, Mycobacterium leprae
gucgcccgcuuaaccaucagaa

SEQ ID NO: 3224415 - RNA, 19 nt, Mycobacterium leprae
gucgccgggugcgcugcug

SEQ ID NO: 3224416 - RNA, 17 nt, Mycobacterium leprae
gucgccgguagcagcgg

SEQ ID NO: 3224417 - RNA, 14 nt, Mycobacterium leprae
gucgccuacaccag

SEQ ID NO: 3224418 - RNA, 15 nt, Mycobacterium leprae
gucgcgagcugaaca

SEQ ID NO: 3224419 - RNA, 16 nt, Mycobacterium leprae
gucgcggaaguaacgu

SEQ ID NO: 3224420 - RNA, 16 nt, Mycobacterium leprae
gucgcggaauucaguu

SEQ ID NO: 3224421 - RNA, 14 nt, Mycobacterium leprae
gucgcggaccgucg

SEQ ID NO: 3224422 - RNA, 18 nt, Mycobacterium leprae
gucgcggaccgucgcgcg

SEQ ID NO: 3224423 - RNA, 23 nt, Mycobacterium leprae
gucgcgucuuugcuggucagcgu

SEQ ID NO: 3224424 - RNA, 19 nt, Mycobacterium leprae
gucgcucgguaagcuggcu

SEQ ID NO: 3224425 - RNA, 15 nt, Mycobacterium leprae
gucgcugcuggauga

SEQ ID NO: 3224426 - RNA, 21 nt, Mycobacterium leprae
gucgcugucaguugcgggaca

SEQ ID NO: 3224427 - RNA, 20 nt, Mycobacterium leprae
gucgcugugucgauagaaau

SEQ ID NO: 3224428 - RNA, 15 nt, Mycobacterium leprae
gucgcuucaucguga

SEQ ID NO: 3224429 - RNA, 22 nt, Mycobacterium leprae
gucggaaacacagcaagcagau

SEQ ID NO: 3224430 - RNA, 16 nt, Mycobacterium leprae
gucggagucaucgacu

SEQ ID NO: 3224431 - RNA, 22 nt, Mycobacterium leprae
gucggaucuaugguuuuggccg

SEQ ID NO: 3224432 - RNA, 15 nt, Mycobacterium leprae
gucggauggcagucg

SEQ ID NO: 3224433 - RNA, 21 nt, Mycobacterium leprae
gucggauuuaauuacaucggc

SEQ ID NO: 3224434 - RNA, 16 nt, Mycobacterium leprae
gucggccacucguagg

SEQ ID NO: 3224435 - RNA, 12 nt, Mycobacterium leprae
gucggccagcac

SEQ ID NO: 3224436 - RNA, 18 nt, Mycobacterium leprae
gucggccaguaccuccag

SEQ ID NO: 3224437 - RNA, 19 nt, Mycobacterium leprae
gucggccaguaccuccagc

SEQ ID NO: 3224438 - RNA, 16 nt, Mycobacterium leprae
gucggcgaaacguuca

SEQ ID NO: 3224439 - RNA, 21 nt, Mycobacterium leprae
gucggcggcgccgaucccauc

SEQ ID NO: 3224440 - RNA, 22 nt, Mycobacterium leprae
gucggcguugagcgcagccacc

SEQ ID NO: 3224441 - RNA, 15 nt, Mycobacterium leprae
gucggcuccuccagc

SEQ ID NO: 3224442 - RNA, 23 nt, Mycobacterium leprae
gucggcugaaccgcugugacagc

SEQ ID NO: 3224443 - RNA, 22 nt, Mycobacterium leprae
gucggcuuugcgguugagcucg

SEQ ID NO: 3224444 - RNA, 22 nt, Mycobacterium leprae
gucgggaggauggcgacgucgc

SEQ ID NO: 3224445 - RNA, 15 nt, Mycobacterium leprae
gucgggcaucgacga

SEQ ID NO: 3224446 - RNA, 14 nt, Mycobacterium leprae
gucggggugcugca

SEQ ID NO: 3224447 - RNA, 17 nt, Mycobacterium leprae
gucgggugccgaucaca

SEQ ID NO: 3224448 - RNA, 22 nt, Mycobacterium leprae
gucgguaaugcaagcgcuuuuc

SEQ ID NO: 3224449 - RNA, 20 nt, Mycobacterium leprae
gucgguagacguggcagucg

SEQ ID NO: 3224450 - RNA, 23 nt, Mycobacterium leprae
gucggugccgccauugcccccgc

SEQ ID NO: 3224451 - RNA, 16 nt, Mycobacterium leprae
gucgguggcggucggu

SEQ ID NO: 3224452 - RNA, 13 nt, Mycobacterium leprae
gucggugguggau

SEQ ID NO: 3224453 - RNA, 17 nt, Mycobacterium leprae
gucggugguggaugcug

SEQ ID NO: 3224454 - RNA, 12 nt, Mycobacterium leprae
gucggugguggg

SEQ ID NO: 3224455 - RNA, 13 nt, Mycobacterium leprae
gucgguguggugc

SEQ ID NO: 3224456 - RNA, 22 nt, Mycobacterium leprae
gucguaacaccagagacaccug

SEQ ID NO: 3224457 - RNA, 15 nt, Mycobacterium leprae
gucguacucuggcug

SEQ ID NO: 3224458 - RNA, 17 nt, Mycobacterium leprae
gucguagcucuccauua

SEQ ID NO: 3224459 - RNA, 20 nt, Mycobacterium leprae
gucguagucacgcggaguca

SEQ ID NO: 3224460 - RNA, 14 nt, Mycobacterium leprae
gucgucagcugcug

SEQ ID NO: 3224461 - RNA, 15 nt, Mycobacterium leprae
gucgucaucguugcc

SEQ ID NO: 3224462 - RNA, 14 nt, Mycobacterium leprae
gucgucggccaggc

SEQ ID NO: 3224463 - RNA, 15 nt, Mycobacterium leprae
gucgucggccgcggc

SEQ ID NO: 3224464 - RNA, 14 nt, Mycobacterium leprae
gucgugaucggcau

SEQ ID NO: 3224465 - RNA, 23 nt, Mycobacterium leprae
gucgugauggucauuuggugguu

SEQ ID NO: 3224466 - RNA, 21 nt, Mycobacterium leprae
gucgugcguuguugauggugu

SEQ ID NO: 3224467 - RNA, 15 nt, Mycobacterium leprae
gucguggagcaccuc

SEQ ID NO: 3224468 - RNA, 17 nt, Mycobacterium leprae
gucguggugugcauccg

SEQ ID NO: 3224469 - RNA, 13 nt, Mycobacterium leprae
gucguguuugugu

SEQ ID NO: 3224470 - RNA, 16 nt, Mycobacterium leprae
gucguuaguggccaau

SEQ ID NO: 3224471 - RNA, 16 nt, Mycobacterium leprae
gucguucagcauuccu

SEQ ID NO: 3224472 - RNA, 16 nt, Mycobacterium leprae
gucguucgcugacagc

SEQ ID NO: 3224473 - RNA, 17 nt, Mycobacterium leprae
gucguucgucugaacca

SEQ ID NO: 3224474 - RNA, 21 nt, Mycobacterium leprae
gucguuggcaacguggccaca

SEQ ID NO: 3224475 - RNA, 22 nt, Mycobacterium leprae
gucguuggcaacguggccacac

SEQ ID NO: 3224476 - RNA, 16 nt, Mycobacterium leprae
gucguuguccagcacc

SEQ ID NO: 3224477 - RNA, 14 nt, Mycobacterium leprae
gucuaggauagacu

SEQ ID NO: 3224478 - RNA, 15 nt, Mycobacterium leprae
gucuaggauagacuc

SEQ ID NO: 3224479 - RNA, 15 nt, Mycobacterium leprae
gucucaccaauagcc

SEQ ID NO: 3224480 - RNA, 12 nt, Mycobacterium leprae
gucucacgcacc

SEQ ID NO: 3224481 - RNA, 19 nt, Mycobacterium leprae
gucucccaauccuggaugu

SEQ ID NO: 3224482 - RNA, 18 nt, Mycobacterium leprae
gucucccacaaguugucc

SEQ ID NO: 3224483 - RNA, 18 nt, Mycobacterium leprae
gucuccguccagcuggcc

SEQ ID NO: 3224484 - RNA, 18 nt, Mycobacterium leprae
gucuccuggucuccucgc

SEQ ID NO: 3224485 - RNA, 23 nt, Mycobacterium leprae
gucucucaggccgucguugccga

SEQ ID NO: 3224486 - RNA, 19 nt, Mycobacterium leprae
gucugcgguucagggguug

SEQ ID NO: 3224487 - RNA, 17 nt, Mycobacterium leprae
gucugcuggacagugcg

SEQ ID NO: 3224488 - RNA, 22 nt, Mycobacterium leprae
gucuggcgcaauuuggugauca

SEQ ID NO: 3224489 - RNA, 17 nt, Mycobacterium leprae
gucuggcggguggugua

SEQ ID NO: 3224490 - RNA, 13 nt, Mycobacterium leprae
gucuggcuggccu

SEQ ID NO: 3224491 - RNA, 13 nt, Mycobacterium leprae
gucugggcuggcc

SEQ ID NO: 3224492 - RNA, 20 nt, Mycobacterium leprae
gucuggucuggcggguggug

SEQ ID NO: 3224493 - RNA, 12 nt, Mycobacterium leprae
guggcaucagau

SEQ ID NO: 3224494 - RNA, 20 nt, Mycobacterium leprae
guggcaucagauauccuagg

SEQ ID NO: 3224495 - RNA, 13 nt, Mycobacterium leprae
guggcaucgucug

SEQ ID NO: 3224496 - RNA, 19 nt, Mycobacterium leprae
guggccaagcuaucggucc

SEQ ID NO: 3224497 - RNA, 22 nt, Mycobacterium leprae
guggccaaugcgcguugugcca

SEQ ID NO: 3224498 - RNA, 12 nt, Mycobacterium leprae
guggccgaggaa

SEQ ID NO: 3224499 - RNA, 17 nt, Mycobacterium leprae
guggccuagucgggcag

SEQ ID NO: 3224500 - RNA, 16 nt, Mycobacterium leprae
guggcgaguggcuaug

SEQ ID NO: 3224501 - RNA, 13 nt, Mycobacterium leprae
guggcgcgagcgu

SEQ ID NO: 3224502 - RNA, 17 nt, Mycobacterium leprae
guggcggugaguuguuc

SEQ ID NO: 3224503 - RNA, 12 nt, Mycobacterium leprae
guggcuauaccc

SEQ ID NO: 3224504 - RNA, 22 nt, Mycobacterium leprae
guggcuauacccccugucuauc

SEQ ID NO: 3224505 - RNA, 18 nt, Mycobacterium leprae
guggcugaugucuuggcu

SEQ ID NO: 3224506 - RNA, 23 nt, Mycobacterium leprae
guggcugaugucuuggcugacgg

SEQ ID NO: 3224507 - RNA, 16 nt, Mycobacterium leprae
guggcuugaguuuuga

SEQ ID NO: 3224508 - RNA, 20 nt, Mycobacterium leprae
guggcuuuaaaggccggcaa

SEQ ID NO: 3224509 - RNA, 15 nt, Mycobacterium leprae
gugggaaaagcaggc

SEQ ID NO: 3224510 - RNA, 21 nt, Mycobacterium leprae
gugggacgugaugcagcaugu

SEQ ID NO: 3224511 - RNA, 22 nt, Mycobacterium leprae
gugggcgaucaggaggugguca

SEQ ID NO: 3224512 - RNA, 17 nt, Mycobacterium leprae
gugggcucguguuguuc

SEQ ID NO: 3224513 - RNA, 17 nt, Mycobacterium leprae
guggggauacagccucu

SEQ ID NO: 3224514 - RNA, 12 nt, Mycobacterium leprae
guggggguggag

SEQ ID NO: 3224515 - RNA, 15 nt, Mycobacterium leprae
guggggugugggugg

SEQ ID NO: 3224516 - RNA, 19 nt, Mycobacterium leprae
guggguacgugguggcugc

SEQ ID NO: 3224517 - RNA, 19 nt, Mycobacterium leprae
gugggucgacccgguggug

SEQ ID NO: 3224518 - RNA, 14 nt, Mycobacterium leprae
gugguagggccaca

SEQ ID NO: 3224519 - RNA, 22 nt, Mycobacterium leprae
gugguaucugcaccucuucgac

SEQ ID NO: 3224520 - RNA, 19 nt, Mycobacterium leprae
guggucaagugucgggugg

SEQ ID NO: 3224521 - RNA, 15 nt, Mycobacterium leprae
guggucaccgcugug

SEQ ID NO: 3224522 - RNA, 18 nt, Mycobacterium leprae
gugguccuuccggccucc

SEQ ID NO: 3224523 - RNA, 23 nt, Mycobacterium leprae
guggucgagacacagaucgagcg

SEQ ID NO: 3224524 - RNA, 18 nt, Mycobacterium leprae
guggucgauuacucacgc

SEQ ID NO: 3224525 - RNA, 21 nt, Mycobacterium leprae
guggucgauuacucacgcgca

SEQ ID NO: 3224526 - RNA, 17 nt, Mycobacterium leprae
guggucugaaguggggu

SEQ ID NO: 3224527 - RNA, 20 nt, Mycobacterium leprae
guggucuugauucucgagcg

SEQ ID NO: 3224528 - RNA, 19 nt, Mycobacterium leprae
agggugauagauggagcca

SEQ ID NO: 3224529 - RNA, 15 nt, Mycobacterium leprae
aggguggcgccggcg

SEQ ID NO: 3224530 - RNA, 11 nt, Mycobacterium leprae
agggugguggg

SEQ ID NO: 3224531 - RNA, 20 nt, Mycobacterium leprae
aggguuggaugguuagcaug

SEQ ID NO: 3224532 - RNA, 18 nt, Mycobacterium leprae
agguaagauuccaauguc

SEQ ID NO: 3224533 - RNA, 18 nt, Mycobacterium leprae
agguaaugcugccugcgu

SEQ ID NO: 3224534 - RNA, 21 nt, Mycobacterium leprae
agguacuagcacgcugucuua

SEQ ID NO: 3224535 - RNA, 20 nt, Mycobacterium leprae
agguagcuacguggucugaa

SEQ ID NO: 3224536 - RNA, 16 nt, Mycobacterium leprae
agguagugaguacacc

SEQ ID NO: 3224537 - RNA, 13 nt, Mycobacterium leprae
agguagugugaca

SEQ ID NO: 3224538 - RNA, 18 nt, Mycobacterium leprae
aggucacccuccucgcgg

SEQ ID NO: 3224539 - RNA, 18 nt, Mycobacterium leprae
aggucauccuugcgcugg

SEQ ID NO: 3224540 - RNA, 17 nt, Mycobacterium leprae
aggucaugccagggcau

SEQ ID NO: 3224541 - RNA, 17 nt, Mycobacterium leprae
aggucauuaacgcuggu

SEQ ID NO: 3224542 - RNA, 20 nt, Mycobacterium leprae
aggucgaaacuaagccgagu

SEQ ID NO: 3224543 - RNA, 22 nt, Mycobacterium leprae
aggucgccgaaagacauugucc

SEQ ID NO: 3224544 - RNA, 14 nt, Mycobacterium leprae
aggucgccgccgaa

SEQ ID NO: 3224545 - RNA, 18 nt, Mycobacterium leprae
aggucguuagcgccgaga

SEQ ID NO: 3224546 - RNA, 17 nt, Mycobacterium leprae
aggucuacucgccugau

SEQ ID NO: 3224547 - RNA, 18 nt, Mycobacterium leprae
aggucucacacccgcaca

SEQ ID NO: 3224548 - RNA, 15 nt, Mycobacterium leprae
aggucuccuggucuc

SEQ ID NO: 3224549 - RNA, 14 nt, Mycobacterium leprae
aggucugaccuauc

SEQ ID NO: 3224550 - RNA, 18 nt, Mycobacterium leprae
aggugaaacuccccacgu

SEQ ID NO: 3224551 - RNA, 20 nt, Mycobacterium leprae
aggugaauaguuaccggugu

SEQ ID NO: 3224552 - RNA, 21 nt, Mycobacterium leprae
aggugaucaaaugacuugcgg

SEQ ID NO: 3224553 - RNA, 21 nt, Mycobacterium leprae
aggugaucguaggucgcccgg

SEQ ID NO: 3224554 - RNA, 15 nt, Mycobacterium leprae
aggugaugauggcau

SEQ ID NO: 3224555 - RNA, 16 nt, Mycobacterium leprae
aggugaugcccaucau

SEQ ID NO: 3224556 - RNA, 22 nt, Mycobacterium leprae
aggugcaaucccauuaguucga

SEQ ID NO: 3224557 - RNA, 23 nt, Mycobacterium leprae
aggugcaggagcgugggucggaa

SEQ ID NO: 3224558 - RNA, 20 nt, Mycobacterium leprae
aggugccagugaucgccgau

SEQ ID NO: 3224559 - RNA, 23 nt, Mycobacterium leprae
aggugccagugaucgccgaugcu

SEQ ID NO: 3224560 - RNA, 16 nt, Mycobacterium leprae
aggugcugcaguugga

SEQ ID NO: 3224561 - RNA, 17 nt, Mycobacterium leprae
aggugcuggcugcgccg

SEQ ID NO: 3224562 - RNA, 15 nt, Mycobacterium leprae
agguggcauugucca

SEQ ID NO: 3224563 - RNA, 16 nt, Mycobacterium leprae
agguggcggcgacacg

SEQ ID NO: 3224564 - RNA, 20 nt, Mycobacterium leprae
agguggucaagugucgggug

SEQ ID NO: 3224565 - RNA, 23 nt, Mycobacterium leprae
aggugucgacggugaaugucugg

SEQ ID NO: 3224566 - RNA, 22 nt, Mycobacterium leprae
aggugucggcguggucaaugug

SEQ ID NO: 3224567 - RNA, 19 nt, Mycobacterium leprae
aggugugccuggaugggca

SEQ ID NO: 3224568 - RNA, 19 nt, Mycobacterium leprae
agguucggggcuaaugucc

SEQ ID NO: 3224569 - RNA, 18 nt, Mycobacterium leprae
agguucguccgucccggu

SEQ ID NO: 3224570 - RNA, 21 nt, Mycobacterium leprae
agguucucggcguuccccggu

SEQ ID NO: 3224571 - RNA, 22 nt, Mycobacterium leprae
agguugacaaucgacucaccac

SEQ ID NO: 3224572 - RNA, 21 nt, Mycobacterium leprae
agguugccguaugugccgccg

SEQ ID NO: 3224573 - RNA, 22 nt, Mycobacterium leprae
agguugccguaugugccgccga

SEQ ID NO: 3224574 - RNA, 23 nt, Mycobacterium leprae
agguuggcuuuaagcaaucccac

SEQ ID NO: 3224575 - RNA, 20 nt, Mycobacterium leprae
agguuguuuguucagugccg

SEQ ID NO: 3224576 - RNA, 21 nt, Mycobacterium leprae
agguuguuuguucagugccgu

SEQ ID NO: 3224577 - RNA, 22 nt, Mycobacterium leprae
agguuuaccgccaucggcuggu

SEQ ID NO: 3224578 - RNA, 16 nt, Mycobacterium leprae
agguuucugagucgga

SEQ ID NO: 3224579 - RNA, 16 nt, Mycobacterium leprae
aguaaacaaacguuuc

SEQ ID NO: 3224580 - RNA, 16 nt, Mycobacterium leprae
aguaaagggugguggg

SEQ ID NO: 3224581 - RNA, 19 nt, Mycobacterium leprae
aguaaagggugguggguca

SEQ ID NO: 3224582 - RNA, 23 nt, Mycobacterium leprae
aguaaaggguggugggucagugu

SEQ ID NO: 3224583 - RNA, 21 nt, Mycobacterium leprae
aguaaaucuugauugggcuuu

SEQ ID NO: 3224584 - RNA, 19 nt, Mycobacterium leprae
aguaaucgcauuuaccgag

SEQ ID NO: 3224585 - RNA, 20 nt, Mycobacterium leprae
aguaauggcauuuucguugu

SEQ ID NO: 3224586 - RNA, 18 nt, Mycobacterium leprae
aguacaccacccaagaua

SEQ ID NO: 3224587 - RNA, 15 nt, Mycobacterium leprae
aguacagaccgaagc

SEQ ID NO: 3224588 - RNA, 22 nt, Mycobacterium leprae
aguaccgaaaacacgggcacca

SEQ ID NO: 3224589 - RNA, 21 nt, Mycobacterium leprae
aguaccgugccgcgaccgcca

SEQ ID NO: 3224590 - RNA, 18 nt, Mycobacterium leprae
aguacgaaaugaacguca

SEQ ID NO: 3224591 - RNA, 22 nt, Mycobacterium leprae
aguacgcuagagucaucccgcg

SEQ ID NO: 3224592 - RNA, 12 nt, Mycobacterium leprae
aguacuucgccc

SEQ ID NO: 3224593 - RNA, 19 nt, Mycobacterium leprae
aguagaccagaagcuguug

SEQ ID NO: 3224594 - RNA, 18 nt, Mycobacterium leprae
aguagagaaaaaugcugc

SEQ ID NO: 3224595 - RNA, 22 nt, Mycobacterium leprae
aguagcuagcuguccaauguca

SEQ ID NO: 3224596 - RNA, 18 nt, Mycobacterium leprae
aguagcuaguuuaccgug

SEQ ID NO: 3224597 - RNA, 15 nt, Mycobacterium leprae
aguaggcgaagagcg

SEQ ID NO: 3224598 - RNA, 19 nt, Mycobacterium leprae
aguaguccucugcgguauc

SEQ ID NO: 3224599 - RNA, 14 nt, Mycobacterium leprae
aguaucgaaucggu

SEQ ID NO: 3224600 - RNA, 15 nt, Mycobacterium leprae
aguaucgaccagcca

SEQ ID NO: 3224601 - RNA, 17 nt, Mycobacterium leprae
aguaucgaccagccacg

SEQ ID NO: 3224602 - RNA, 22 nt, Mycobacterium leprae
aguaucgcguugacagccgucc

SEQ ID NO: 3224603 - RNA, 14 nt, Mycobacterium leprae
aguaucugugggca

SEQ ID NO: 3224604 - RNA, 13 nt, Mycobacterium leprae
agucaaaaccagc

SEQ ID NO: 3224605 - RNA, 16 nt, Mycobacterium leprae
agucaagaugaucguc

SEQ ID NO: 3224606 - RNA, 14 nt, Mycobacterium leprae
agucagacacuuga

SEQ ID NO: 3224607 - RNA, 14 nt, Mycobacterium leprae
agucagcaucgggu

SEQ ID NO: 3224608 - RNA, 17 nt, Mycobacterium leprae
agucaucgacuugcugc

SEQ ID NO: 3224609 - RNA, 20 nt, Mycobacterium leprae
agucaucgacuugcugccac

SEQ ID NO: 3224610 - RNA, 21 nt, Mycobacterium leprae
agucaugcagaugcaagauua

SEQ ID NO: 3224611 - RNA, 20 nt, Mycobacterium leprae
agucaugccccgcgcucugg

SEQ ID NO: 3224612 - RNA, 22 nt, Mycobacterium leprae
agucauguucaucacggguggu

SEQ ID NO: 3224613 - RNA, 14 nt, Mycobacterium leprae
agucauguucccug

SEQ ID NO: 3224614 - RNA, 14 nt, Mycobacterium leprae
aguccaagcacgau

SEQ ID NO: 3224615 - RNA, 17 nt, Mycobacterium leprae
aguccaugaauuacuac

SEQ ID NO: 3224616 - RNA, 21 nt, Mycobacterium leprae
agucccgaacaaauugugggg

SEQ ID NO: 3224617 - RNA, 23 nt, Mycobacterium leprae
agucccgaacaaauugugggggu

SEQ ID NO: 3224618 - RNA, 16 nt, Mycobacterium leprae
aguccgcuaaggcagc

SEQ ID NO: 3224619 - RNA, 14 nt, Mycobacterium leprae
aguccgcucaggug

SEQ ID NO: 3224620 - RNA, 22 nt, Mycobacterium leprae
aguccgucacuuuuccaccggc

SEQ ID NO: 3224621 - RNA, 14 nt, Mycobacterium leprae
agucgaaggugagu

SEQ ID NO: 3224622 - RNA, 14 nt, Mycobacterium leprae
agucgaccgccgaa

SEQ ID NO: 3224623 - RNA, 20 nt, Mycobacterium leprae
agucgaccgccgaagcagcc

SEQ ID NO: 3224624 - RNA, 21 nt, Mycobacterium leprae
agucgaccgccgaagcagcca

SEQ ID NO: 3224625 - RNA, 21 nt, Mycobacterium leprae
agucgaggccagauggcgcca

SEQ ID NO: 3224626 - RNA, 14 nt, Mycobacterium leprae
agucgauuagccgg

SEQ ID NO: 3224627 - RNA, 16 nt, Mycobacterium leprae
agucgcauccucgacu

SEQ ID NO: 3224628 - RNA, 16 nt, Mycobacterium leprae
agucgccuacaccagc

SEQ ID NO: 3224629 - RNA, 20 nt, Mycobacterium leprae
agucgcgggcuugcuccgag

SEQ ID NO: 3224630 - RNA, 20 nt, Mycobacterium leprae
agucgcgucuuugcugguca

SEQ ID NO: 3224631 - RNA, 16 nt, Mycobacterium leprae
agucgcuaaauauuaa

SEQ ID NO: 3224632 - RNA, 18 nt, Mycobacterium leprae
agucggaaccgcagcugc

SEQ ID NO: 3224633 - RNA, 13 nt, Mycobacterium leprae
agucggagugucu

SEQ ID NO: 3224634 - RNA, 15 nt, Mycobacterium leprae
agucggagugucucu

SEQ ID NO: 3224635 - RNA, 16 nt, Mycobacterium leprae
agucggagugucucug

SEQ ID NO: 3224636 - RNA, 17 nt, Mycobacterium leprae
agucgggccaggccgag

SEQ ID NO: 3224637 - RNA, 21 nt, Mycobacterium leprae
agucgggcuuggccucgaggu

SEQ ID NO: 3224638 - RNA, 12 nt, Mycobacterium leprae
agucggucgccg

SEQ ID NO: 3224639 - RNA, 15 nt, Mycobacterium leprae
agucuaucccggcuc

SEQ ID NO: 3224640 - RNA, 16 nt, Mycobacterium leprae
auauaccguuaauaua

SEQ ID NO: 3224641 - RNA, 23 nt, Mycobacterium leprae
auauaccugcgucgcuucaucgu

SEQ ID NO: 3224642 - RNA, 14 nt, Mycobacterium leprae
auauaccuucuaac

SEQ ID NO: 3224643 - RNA, 20 nt, Mycobacterium leprae
auauauguuccuauguuggu

SEQ ID NO: 3224644 - RNA, 23 nt, Mycobacterium leprae
auaucaacggcugcgugucgacc

SEQ ID NO: 3224645 - RNA, 13 nt, Mycobacterium leprae
auauccaccauac

SEQ ID NO: 3224646 - RNA, 22 nt, Mycobacterium leprae
auaucgaugcaggcgugggugu

SEQ ID NO: 3224647 - RNA, 22 nt, Mycobacterium leprae
auaucgccuucagcacagccca

SEQ ID NO: 3224648 - RNA, 16 nt, Mycobacterium leprae
auaucgcggcgcgcuc

SEQ ID NO: 3224649 - RNA, 22 nt, Mycobacterium leprae
auaucuaauugggaucgacacc

SEQ ID NO: 3224650 - RNA, 16 nt, Mycobacterium leprae
auaugagcuccacugu

SEQ ID NO: 3224651 - RNA, 19 nt, Mycobacterium leprae
auaugccguuccugagugu

SEQ ID NO: 3224652 - RNA, 13 nt, Mycobacterium leprae
auauggcgaucau

SEQ ID NO: 3224653 - RNA, 15 nt, Mycobacterium leprae
auauggcuaugacaa

SEQ ID NO: 3224654 - RNA, 20 nt, Mycobacterium leprae
auaugugcuauagcacacca

SEQ ID NO: 3224655 - RNA, 17 nt, Mycobacterium leprae
auauuaacgguauauua

SEQ ID NO: 3224656 - RNA, 22 nt, Mycobacterium leprae
auauuaauucuucucuaaaaag

SEQ ID NO: 3224657 - RNA, 14 nt, Mycobacterium leprae
auauuccaggucaa

SEQ ID NO: 3224658 - RNA, 17 nt, Mycobacterium leprae
auauucgcgaucuggau

SEQ ID NO: 3224659 - RNA, 14 nt, Mycobacterium leprae
auauuuagcgacua

SEQ ID NO: 3224660 - RNA, 14 nt, Mycobacterium leprae
aucaacaacugcgg

SEQ ID NO: 3224661 - RNA, 23 nt, Mycobacterium leprae
aucaacauguagaccaagcagca

SEQ ID NO: 3224662 - RNA, 16 nt, Mycobacterium leprae
aucaacauuuguugaa

SEQ ID NO: 3224663 - RNA, 13 nt, Mycobacterium leprae
aucaacgccagca

SEQ ID NO: 3224664 - RNA, 15 nt, Mycobacterium leprae
aucaacgccagcaag

SEQ ID NO: 3224665 - RNA, 23 nt, Mycobacterium leprae
aucaacggcuacaacaaaguuau

SEQ ID NO: 3224666 - RNA, 16 nt, Mycobacterium leprae
aucaacgugcgcagcg

SEQ ID NO: 3224667 - RNA, 17 nt, Mycobacterium leprae
aucaacgugcgcagcgu

SEQ ID NO: 3224668 - RNA, 13 nt, Mycobacterium leprae
aucaagaucggcc

SEQ ID NO: 3224669 - RNA, 20 nt, Mycobacterium leprae
aucaagcugugagugugcag

SEQ ID NO: 3224670 - RNA, 22 nt, Mycobacterium leprae
aucaagggauuccacugccaga

SEQ ID NO: 3224671 - RNA, 20 nt, Mycobacterium leprae
aucaaucacgcccagcgcag

SEQ ID NO: 3224672 - RNA, 18 nt, Mycobacterium leprae
aucaaucgggcugcccgu

SEQ ID NO: 3224673 - RNA, 21 nt, Mycobacterium leprae
aucaauggcagccaccaucug

SEQ ID NO: 3224674 - RNA, 23 nt, Mycobacterium leprae
aucaauucgcuguauugaucaac

SEQ ID NO: 3224675 - RNA, 16 nt, Mycobacterium leprae
aucacacggcgcgauc

SEQ ID NO: 3224676 - RNA, 21 nt, Mycobacterium leprae
aucaccggacagcggcccaac

SEQ ID NO: 3224677 - RNA, 17 nt, Mycobacterium leprae
aucaccguggccggccc

SEQ ID NO: 3224678 - RNA, 16 nt, Mycobacterium leprae
aucaccuagaacagca

SEQ ID NO: 3224679 - RNA, 15 nt, Mycobacterium leprae
aucacgcccagcgca

SEQ ID NO: 3224680 - RNA, 23 nt, Mycobacterium leprae
aucacggguggugcccaggugaa

SEQ ID NO: 3224681 - RNA, 15 nt, Mycobacterium leprae
aucacugaucccaga

SEQ ID NO: 3224682 - RNA, 13 nt, Mycobacterium leprae
aucacuugguguc

SEQ ID NO: 3224683 - RNA, 18 nt, Mycobacterium leprae
aucagaagaccaggugau

SEQ ID NO: 3224684 - RNA, 19 nt, Mycobacterium leprae
aucagacacggaagcccuc

SEQ ID NO: 3224685 - RNA, 17 nt, Mycobacterium leprae
aucagacguugggagca

SEQ ID NO: 3224686 - RNA, 19 nt, Mycobacterium leprae
aucagauccgguggcgaca

SEQ ID NO: 3224687 - RNA, 21 nt, Mycobacterium leprae
aucagcaggaaucccagcagc

SEQ ID NO: 3224688 - RNA, 15 nt, Mycobacterium leprae
aucagcaucgacagc

SEQ ID NO: 3224689 - RNA, 18 nt, Mycobacterium leprae
aucagcggccccgcaucu

SEQ ID NO: 3224690 - RNA, 19 nt, Mycobacterium leprae
aucagcgucggacgccgga

SEQ ID NO: 3224691 - RNA, 18 nt, Mycobacterium leprae
aucaggguacucagcugg

SEQ ID NO: 3224692 - RNA, 18 nt, Mycobacterium leprae
aucaguaaucgacgcagc

SEQ ID NO: 3224693 - RNA, 16 nt, Mycobacterium leprae
aucagugcaauaccua

SEQ ID NO: 3224694 - RNA, 15 nt, Mycobacterium leprae
aucagugcucuagaa

SEQ ID NO: 3224695 - RNA, 16 nt, Mycobacterium leprae
aucauagugaccaaaa

SEQ ID NO: 3224696 - RNA, 17 nt, Mycobacterium leprae
aucauagugaccaaaau

SEQ ID NO: 3224697 - RNA, 22 nt, Mycobacterium leprae
aucauccgcaagcgcgccgagu

SEQ ID NO: 3224698 - RNA, 16 nt, Mycobacterium leprae
aucaucgaucagaccc

SEQ ID NO: 3224699 - RNA, 22 nt, Mycobacterium leprae
aucauggcuggacagaagcaag

SEQ ID NO: 3224700 - RNA, 22 nt, Mycobacterium leprae
aucauucacccuuucgggaggu

SEQ ID NO: 3224701 - RNA, 16 nt, Mycobacterium leprae
aucauucgauccaaug

SEQ ID NO: 3224702 - RNA, 17 nt, Mycobacterium leprae
aucauucgauccaauga

SEQ ID NO: 3224703 - RNA, 14 nt, Mycobacterium leprae
aucauuuucaacgc

SEQ ID NO: 3224704 - RNA, 23 nt, Mycobacterium leprae
auccaaagggucguaauaauauc

SEQ ID NO: 3224705 - RNA, 22 nt, Mycobacterium leprae
auccaacgugaccagcuccgaa

SEQ ID NO: 3224706 - RNA, 22 nt, Mycobacterium leprae
auccacgccgauaucgaccagc

SEQ ID NO: 3224707 - RNA, 23 nt, Mycobacterium leprae
auccacgccgauaucgaccagcc

SEQ ID NO: 3224708 - RNA, 22 nt, Mycobacterium leprae
aucccaccggcggcuggugcgg

SEQ ID NO: 3224709 - RNA, 19 nt, Mycobacterium leprae
aucccagaaucgucggcua

SEQ ID NO: 3224710 - RNA, 22 nt, Mycobacterium leprae
aucccagaauuuucggcggcac

SEQ ID NO: 3224711 - RNA, 11 nt, Mycobacterium leprae
aucccagccua

SEQ ID NO: 3224712 - RNA, 21 nt, Mycobacterium leprae
aucccaucggggcuacaaagc

SEQ ID NO: 3224713 - RNA, 20 nt, Mycobacterium leprae
aucccgaagugaucggcgac

SEQ ID NO: 3224714 - RNA, 13 nt, Mycobacterium leprae
aucccgacagcau

SEQ ID NO: 3224715 - RNA, 16 nt, Mycobacterium leprae
aucccgcgaucuacgc

SEQ ID NO: 3224716 - RNA, 14 nt, Mycobacterium leprae
auccgaaacccgaa

SEQ ID NO: 3224717 - RNA, 19 nt, Mycobacterium leprae
auccgauuaagcugaucua

SEQ ID NO: 3224718 - RNA, 19 nt, Mycobacterium leprae
auccgcaacgaaaccaugc

SEQ ID NO: 3224719 - RNA, 13 nt, Mycobacterium leprae
auccgccgauccc

SEQ ID NO: 3224720 - RNA, 16 nt, Mycobacterium leprae
auccgccggccgcacc

SEQ ID NO: 3224721 - RNA, 12 nt, Mycobacterium leprae
auccgccgugcg

SEQ ID NO: 3224722 - RNA, 19 nt, Mycobacterium leprae
auccgcuacuuguguucgg

SEQ ID NO: 3224723 - RNA, 14 nt, Mycobacterium leprae
auccgcuggagcac

SEQ ID NO: 3224724 - RNA, 17 nt, Mycobacterium leprae
auccgcuggagcaccug

SEQ ID NO: 3224725 - RNA, 21 nt, Mycobacterium leprae
auccgcuuacucugccgccuc

SEQ ID NO: 3224726 - RNA, 19 nt, Mycobacterium leprae
auccggcacaucgaaccga

SEQ ID NO: 3224727 - RNA, 21 nt, Mycobacterium leprae
auccgggcgcucagcggccag

SEQ ID NO: 3224728 - RNA, 14 nt, Mycobacterium leprae
auccgugaauacau

SEQ ID NO: 3224729 - RNA, 19 nt, Mycobacterium leprae
auccgugugaacuugaaac

SEQ ID NO: 3224730 - RNA, 14 nt, Mycobacterium leprae
auccuaggccacug

SEQ ID NO: 3224731 - RNA, 18 nt, Mycobacterium leprae
auccucaaccagcgugca

SEQ ID NO: 3224732 - RNA, 23 nt, Mycobacterium leprae
auccucagcgucccaaccaaucu

SEQ ID NO: 3224733 - RNA, 18 nt, Mycobacterium leprae
auccucgaccaccagggc

SEQ ID NO: 3224734 - RNA, 15 nt, Mycobacterium leprae
auccucgacccacca

SEQ ID NO: 3224735 - RNA, 21 nt, Mycobacterium leprae
auccucgacgggucacaggua

SEQ ID NO: 3224736 - RNA, 23 nt, Mycobacterium leprae
auccucgacgggucacagguaaa

SEQ ID NO: 3224737 - RNA, 17 nt, Mycobacterium leprae
auccucgggcgcaagcg

SEQ ID NO: 3224738 - RNA, 24 nt, Mycobacterium leprae
auccugcguucgguagcgcgcuga

SEQ ID NO: 3224739 - RNA, 18 nt, Mycobacterium leprae
auccuguugacuggaacc

SEQ ID NO: 3224740 - RNA, 17 nt, Mycobacterium leprae
aucgacaccucaccauc

SEQ ID NO: 3224741 - RNA, 16 nt, Mycobacterium leprae
aucgacacggcgaccg

SEQ ID NO: 3224742 - RNA, 19 nt, Mycobacterium leprae
aucgacaggcaaccgcccg

SEQ ID NO: 3224743 - RNA, 19 nt, Mycobacterium leprae
aucgacauagugcaagugc

SEQ ID NO: 3224744 - RNA, 13 nt, Mycobacterium leprae
aucgaccagccaa

SEQ ID NO: 3224745 - RNA, 14 nt, Mycobacterium leprae
aucgaccagccacg

SEQ ID NO: 3224746 - RNA, 15 nt, Mycobacterium leprae
aucgacccaagcauc

SEQ ID NO: 3224747 - RNA, 16 nt, Mycobacterium leprae
aucgacgaggucgccg

SEQ ID NO: 3224748 - RNA, 13 nt, Mycobacterium leprae
aucgacgaugcca

SEQ ID NO: 3224749 - RNA, 14 nt, Mycobacterium leprae
aucgacgaugccau

SEQ ID NO: 3224750 - RNA, 20 nt, Mycobacterium leprae
aucgacgcaacugagaaggu

SEQ ID NO: 3224751 - RNA, 15 nt, Mycobacterium leprae
aucgacgcugcgccg

SEQ ID NO: 3224752 - RNA, 15 nt, Mycobacterium leprae
augacaagagugaaa

SEQ ID NO: 3224753 - RNA, 12 nt, Mycobacterium leprae
augacaccgaac

SEQ ID NO: 3224754 - RNA, 23 nt, Mycobacterium leprae
augacaccgaacagcucgacagc

SEQ ID NO: 3224755 - RNA, 15 nt, Mycobacterium leprae
augaccagggaagug

SEQ ID NO: 3224756 - RNA, 17 nt, Mycobacterium leprae
augacgucccggcaccg

SEQ ID NO: 3224757 - RNA, 22 nt, Mycobacterium leprae
augacuuauagucauguuguug

SEQ ID NO: 3224758 - RNA, 18 nt, Mycobacterium leprae
augagacgaaugcugacc

SEQ ID NO: 3224759 - RNA, 16 nt, Mycobacterium leprae
augagauaucgucggc

SEQ ID NO: 3224760 - RNA, 17 nt, Mycobacterium leprae
augagauucgagcgggc

SEQ ID NO: 3224761 - RNA, 14 nt, Mycobacterium leprae
augagcaucgagga

SEQ ID NO: 3224762 - RNA, 13 nt, Mycobacterium leprae
augagcucagucg

SEQ ID NO: 3224763 - RNA, 19 nt, Mycobacterium leprae
augaggcuucgugugcuuu

SEQ ID NO: 3224764 - RNA, 13 nt, Mycobacterium leprae
augagugaucugc

SEQ ID NO: 3224765 - RNA, 15 nt, Mycobacterium leprae
augaguuucggcgcc

SEQ ID NO: 3224766 - RNA, 16 nt, Mycobacterium leprae
augaucgauccagugc

SEQ ID NO: 3224767 - RNA, 14 nt, Mycobacterium leprae
augaucuaaccgac

SEQ ID NO: 3224768 - RNA, 18 nt, Mycobacterium leprae
augaugccaggggcuggg

SEQ ID NO: 3224769 - RNA, 22 nt, Mycobacterium leprae
augaugccaggggcugggcacc

SEQ ID NO: 3224770 - RNA, 22 nt, Mycobacterium leprae
augaugguuuggcugccagaau

SEQ ID NO: 3224771 - RNA, 16 nt, Mycobacterium leprae
augauucuuaccugag

SEQ ID NO: 3224772 - RNA, 23 nt, Mycobacterium leprae
augcaaccacacccuggcugggc

SEQ ID NO: 3224773 - RNA, 19 nt, Mycobacterium leprae
augcaacuaugcggcggga

SEQ ID NO: 3224774 - RNA, 15 nt, Mycobacterium leprae
augcacacuaaaacg

SEQ ID NO: 3224775 - RNA, 15 nt, Mycobacterium leprae
augcacgugauggcg

SEQ ID NO: 3224776 - RNA, 19 nt, Mycobacterium leprae
augcacugugucaccugaa

SEQ ID NO: 3224777 - RNA, 16 nt, Mycobacterium leprae
augcacuguucacuaa

SEQ ID NO: 3224778 - RNA, 16 nt, Mycobacterium leprae
augcaggaggugcaga

SEQ ID NO: 3224779 - RNA, 16 nt, Mycobacterium leprae
augcagggccagcccg

SEQ ID NO: 3224780 - RNA, 16 nt, Mycobacterium leprae
augcagguggucugca

SEQ ID NO: 3224781 - RNA, 19 nt, Mycobacterium leprae
augcagguggucugcauuc

SEQ ID NO: 3224782 - RNA, 18 nt, Mycobacterium leprae
augcagucgcucaggcua

SEQ ID NO: 3224783 - RNA, 16 nt, Mycobacterium leprae
augcagugagcagugg

SEQ ID NO: 3224784 - RNA, 20 nt, Mycobacterium leprae
augcagugcacgagcgggug

SEQ ID NO: 3224785 - RNA, 12 nt, Mycobacterium leprae
augccaaccugu

SEQ ID NO: 3224786 - RNA, 14 nt, Mycobacterium leprae
augccaacgcuauu

SEQ ID NO: 3224787 - RNA, 17 nt, Mycobacterium leprae
augccagccaacggcua

SEQ ID NO: 3224788 - RNA, 22 nt, Mycobacterium leprae
augccagccaacggcuagccag

SEQ ID NO: 3224789 - RNA, 17 nt, Mycobacterium leprae
augccaggggcugggca

SEQ ID NO: 3224790 - RNA, 22 nt, Mycobacterium leprae
augccaggggcugggcaccugg

SEQ ID NO: 3224791 - RNA, 17 nt, Mycobacterium leprae
augccaucgggccagag

SEQ ID NO: 3224792 - RNA, 19 nt, Mycobacterium leprae
augcccagaccgaaaacca

SEQ ID NO: 3224793 - RNA, 17 nt, Mycobacterium leprae
augcccagcagauggcc

SEQ ID NO: 3224794 - RNA, 14 nt, Mycobacterium leprae
augcccagccagga

SEQ ID NO: 3224795 - RNA, 13 nt, Mycobacterium leprae
augcccaugccag

SEQ ID NO: 3224796 - RNA, 24 nt, Mycobacterium leprae
augcccgaaaaguucggccauggc

SEQ ID NO: 3224797 - RNA, 16 nt, Mycobacterium leprae
augcccugggccagcg

SEQ ID NO: 3224798 - RNA, 15 nt, Mycobacterium leprae
augccgaagcagacu

SEQ ID NO: 3224799 - RNA, 21 nt, Mycobacterium leprae
augccgaucugggggugcacc

SEQ ID NO: 3224800 - RNA, 10 nt, Mycobacterium leprae
augccgccga

SEQ ID NO: 3224801 - RNA, 17 nt, Mycobacterium leprae
augccgccgggugcagc

SEQ ID NO: 3224802 - RNA, 22 nt, Mycobacterium leprae
augccgcgcacccgagcggcac

SEQ ID NO: 3224803 - RNA, 19 nt, Mycobacterium leprae
augccgcgcgccugcgcuu

SEQ ID NO: 3224804 - RNA, 23 nt, Mycobacterium leprae
augccggauuccgaacgaccuug

SEQ ID NO: 3224805 - RNA, 14 nt, Mycobacterium leprae
augccggugcagcu

SEQ ID NO: 3224806 - RNA, 15 nt, Mycobacterium leprae
augccgguggccagc

SEQ ID NO: 3224807 - RNA, 14 nt, Mycobacterium leprae
augccgugguaguc

SEQ ID NO: 3224808 - RNA, 13 nt, Mycobacterium leprae
augccguggugau

SEQ ID NO: 3224809 - RNA, 20 nt, Mycobacterium leprae
augccuacccuagagucgac

SEQ ID NO: 3224810 - RNA, 19 nt, Mycobacterium leprae
augcgcagccgcgguaacg

SEQ ID NO: 3224811 - RNA, 23 nt, Mycobacterium leprae
augcgcugaggcagcagcucgac

SEQ ID NO: 3224812 - RNA, 12 nt, Mycobacterium leprae
augcggccagcc

SEQ ID NO: 3224813 - RNA, 20 nt, Mycobacterium leprae
augcggcgggaucgccgaug

SEQ ID NO: 3224814 - RNA, 22 nt, Mycobacterium leprae
augcggcgggaucgccgaugac

SEQ ID NO: 3224815 - RNA, 21 nt, Mycobacterium leprae
augcgucguacucuggcuggu

SEQ ID NO: 3224816 - RNA, 12 nt, Mycobacterium leprae
augcgugaagua

SEQ ID NO: 3224817 - RNA, 22 nt, Mycobacterium leprae
augcguucgguuucacagcaga

SEQ ID NO: 3224818 - RNA, 19 nt, Mycobacterium leprae
augcuagggcugcuguuca

SEQ ID NO: 3224819 - RNA, 14 nt, Mycobacterium leprae
augcuaucgccggu

SEQ ID NO: 3224820 - RNA, 13 nt, Mycobacterium leprae
augcucgcagcgg

SEQ ID NO: 3224821 - RNA, 19 nt, Mycobacterium leprae
augcucguagcgcccagua

SEQ ID NO: 3224822 - RNA, 14 nt, Mycobacterium leprae
augcucugcugauc

SEQ ID NO: 3224823 - RNA, 14 nt, Mycobacterium leprae
augcugacaucggc

SEQ ID NO: 3224824 - RNA, 19 nt, Mycobacterium leprae
augcugccugcgucaguaa

SEQ ID NO: 3224825 - RNA, 18 nt, Mycobacterium leprae
augcugcgcagagcgcug

SEQ ID NO: 3224826 - RNA, 16 nt, Mycobacterium leprae
augcuggcaguggcaa

SEQ ID NO: 3224827 - RNA, 20 nt, Mycobacterium leprae
augcugucgcggagcuccgc

SEQ ID NO: 3224828 - RNA, 21 nt, Mycobacterium leprae
augcuguguggcuguuucugc

SEQ ID NO: 3224829 - RNA, 20 nt, Mycobacterium leprae
augcuguucggugacuucgg

SEQ ID NO: 3224830 - RNA, 13 nt, Mycobacterium leprae
augcuuaaggcag

SEQ ID NO: 3224831 - RNA, 17 nt, Mycobacterium leprae
auggaaggcggagaugu

SEQ ID NO: 3224832 - RNA, 17 nt, Mycobacterium leprae
auggacccacugggcaa

SEQ ID NO: 3224833 - RNA, 16 nt, Mycobacterium leprae
auggagccaccacaaa

SEQ ID NO: 3224834 - RNA, 23 nt, Mycobacterium leprae
auggauacucaauugcagcgcga

SEQ ID NO: 3224835 - RNA, 20 nt, Mycobacterium leprae
auggcacuacccgacacaaa

SEQ ID NO: 3224836 - RNA, 14 nt, Mycobacterium leprae
auggcagccaccau

SEQ ID NO: 3224837 - RNA, 17 nt, Mycobacterium leprae
auggcaguccacaggac

SEQ ID NO: 3224838 - RNA, 22 nt, Mycobacterium leprae
auggcaguccacaggacuucaa

SEQ ID NO: 3224839 - RNA, 13 nt, Mycobacterium leprae
auggccagccguc

SEQ ID NO: 3224840 - RNA, 22 nt, Mycobacterium leprae
auggcccgucgcugcuggauga

SEQ ID NO: 3224841 - RNA, 20 nt, Mycobacterium leprae
auggccgaccuaccgcaucc

SEQ ID NO: 3224842 - RNA, 20 nt, Mycobacterium leprae
auggccgaggagucggcaau

SEQ ID NO: 3224843 - RNA, 11 nt, Mycobacterium leprae
auggccgccag

SEQ ID NO: 3224844 - RNA, 18 nt, Mycobacterium leprae
auggccugcucauggcac

SEQ ID NO: 3224845 - RNA, 16 nt, Mycobacterium leprae
auggccuugagguguc

SEQ ID NO: 3224846 - RNA, 23 nt, Mycobacterium leprae
auggcgacgucgcuugugaucgu

SEQ ID NO: 3224847 - RNA, 15 nt, Mycobacterium leprae
auggcgagcaucugg

SEQ ID NO: 3224848 - RNA, 16 nt, Mycobacterium leprae
auggcgccguggaggu

SEQ ID NO: 3224849 - RNA, 16 nt, Mycobacterium leprae
auggcgggcuggagga

SEQ ID NO: 3224850 - RNA, 24 nt, Mycobacterium leprae
auggcgguguuagcaugcuuguca

SEQ ID NO: 3224851 - RNA, 18 nt, Mycobacterium leprae
auggcuccaaguggcugc

SEQ ID NO: 3224852 - RNA, 21 nt, Mycobacterium leprae
augggggugggaaaagcaggc

SEQ ID NO: 3224853 - RNA, 16 nt, Mycobacterium leprae
auggguuuggugggca

SEQ ID NO: 3224854 - RNA, 23 nt, Mycobacterium leprae
augguaagaauaccggugauguc

SEQ ID NO: 3224855 - RNA, 17 nt, Mycobacterium leprae
auggucauuuggugguu

SEQ ID NO: 3224856 - RNA, 19 nt, Mycobacterium leprae
augguccaacgugguuggc

SEQ ID NO: 3224857 - RNA, 19 nt, Mycobacterium leprae
auggucggcagcugguugu

SEQ ID NO: 3224858 - RNA, 15 nt, Mycobacterium leprae
auggucgucgcugcu

SEQ ID NO: 3224859 - RNA, 19 nt, Mycobacterium leprae
auggugccgagcgcaucgg

SEQ ID NO: 3224860 - RNA, 16 nt, Mycobacterium leprae
augguguaaggccagg

SEQ ID NO: 3224861 - RNA, 20 nt, Mycobacterium leprae
augguguaaggccaggaugg

SEQ ID NO: 3224862 - RNA, 14 nt, Mycobacterium leprae
augguuagcaugag

SEQ ID NO: 3224863 - RNA, 12 nt, Mycobacterium leprae
augguuggcaga

SEQ ID NO: 3224864 - RNA, 13 nt, Mycobacterium leprae
augguuggucggc

SEQ ID NO: 3224865 - RNA, 20 nt, Mycobacterium leprae
auuuguuuuccugugcaggu

SEQ ID NO: 3224866 - RNA, 23 nt, Mycobacterium leprae
auuuguuuuccugugcaggucga

SEQ ID NO: 3224867 - RNA, 20 nt, Mycobacterium leprae
auuuucauagggagaaugcc

SEQ ID NO: 3224868 - RNA, 14 nt, Mycobacterium leprae
auuuuccacaggca

SEQ ID NO: 3224869 - RNA, 22 nt, Mycobacterium leprae
auuuucgauccgcucaaagccu

SEQ ID NO: 3224870 - RNA, 21 nt, Mycobacterium leprae
auuuucucggcagcaguuuuc

SEQ ID NO: 3224871 - RNA, 23 nt, Mycobacterium leprae
auuuuucuugaaaaauaaggaua

SEQ ID NO: 3224872 - RNA, 23 nt, Mycobacterium leprae
auuuuuguucuguccgcacaaac

SEQ ID NO: 3224873 - RNA, 12 nt, Mycobacterium leprae
caaaaccagccg

SEQ ID NO: 3224874 - RNA, 21 nt, Mycobacterium leprae
caaaacgucgaucuggggaau

SEQ ID NO: 3224875 - RNA, 18 nt, Mycobacterium leprae
caaaacucacguuguuau

SEQ ID NO: 3224876 - RNA, 12 nt, Mycobacterium leprae
caaaauggcacg

SEQ ID NO: 3224877 - RNA, 14 nt, Mycobacterium leprae
caaaauuuauggua

SEQ ID NO: 3224878 - RNA, 14 nt, Mycobacterium leprae
caaacaacaacccg

SEQ ID NO: 3224879 - RNA, 21 nt, Mycobacterium leprae
caaacaacuggaguacuggcg

SEQ ID NO: 3224880 - RNA, 13 nt, Mycobacterium leprae
caaaccaaacaac

SEQ ID NO: 3224881 - RNA, 21 nt, Mycobacterium leprae
caaacgacaugacauauugua

SEQ ID NO: 3224882 - RNA, 23 nt, Mycobacterium leprae
caaacgccguagcgcaccaaucc

SEQ ID NO: 3224883 - RNA, 15 nt, Mycobacterium leprae
caaacuauugacggu

SEQ ID NO: 3224884 - RNA, 14 nt, Mycobacterium leprae
caaacucgcugaac

SEQ ID NO: 3224885 - RNA, 19 nt, Mycobacterium leprae
caaacuggucaacgcagcg

SEQ ID NO: 3224886 - RNA, 21 nt, Mycobacterium leprae
caaacuuccucugccaacaaa

SEQ ID NO: 3224887 - RNA, 16 nt, Mycobacterium leprae
caaagaaauuuuaucg

SEQ ID NO: 3224888 - RNA, 22 nt, Mycobacterium leprae
caaagaacgcgaccuguuggug

SEQ ID NO: 3224889 - RNA, 18 nt, Mycobacterium leprae
caaagagcgggcggcagc

SEQ ID NO: 3224890 - RNA, 20 nt, Mycobacterium leprae
caaagaucgggccauuugga

SEQ ID NO: 3224891 - RNA, 18 nt, Mycobacterium leprae
caaagcccacgccuagcu

SEQ ID NO: 3224892 - RNA, 18 nt, Mycobacterium leprae
caaagcuggcgaacaaca

SEQ ID NO: 3224893 - RNA, 22 nt, Mycobacterium leprae
caaagcuggcgaacaacaaaaa

SEQ ID NO: 3224894 - RNA, 20 nt, Mycobacterium leprae
caaagucagcuugucgaugu

SEQ ID NO: 3224895 - RNA, 16 nt, Mycobacterium leprae
caaaguccaugugcug

SEQ ID NO: 3224896 - RNA, 23 nt, Mycobacterium leprae
caaagucgacguugcgcacugcc

SEQ ID NO: 3224897 - RNA, 18 nt, Mycobacterium leprae
caaagucgcgggcuugcu

SEQ ID NO: 3224898 - RNA, 17 nt, Mycobacterium leprae
caaagucugcuuccaag

SEQ ID NO: 3224899 - RNA, 18 nt, Mycobacterium leprae
caaaguuaugcaacgcac

SEQ ID NO: 3224900 - RNA, 22 nt, Mycobacterium leprae
caaauaucgcguuugcagugac

SEQ ID NO: 3224901 - RNA, 13 nt, Mycobacterium leprae
caaaucaccagcg

SEQ ID NO: 3224902 - RNA, 14 nt, Mycobacterium leprae
caaaucaccagcga

SEQ ID NO: 3224903 - RNA, 23 nt, Mycobacterium leprae
caaaucgauguuguagguugaug

SEQ ID NO: 3224904 - RNA, 15 nt, Mycobacterium leprae
caaaugcgguggcua

SEQ ID NO: 3224905 - RNA, 18 nt, Mycobacterium leprae
caaauuaaggcugagcca

SEQ ID NO: 3224906 - RNA, 14 nt, Mycobacterium leprae
caaauugugggggu

SEQ ID NO: 3224907 - RNA, 17 nt, Mycobacterium leprae
caacaacgaugccucuc

SEQ ID NO: 3224908 - RNA, 21 nt, Mycobacterium leprae
caacaacggaucggcuacauc

SEQ ID NO: 3224909 - RNA, 18 nt, Mycobacterium leprae
caacaagagaagagcugg

SEQ ID NO: 3224910 - RNA, 18 nt, Mycobacterium leprae
caacaagccgccgacacc

SEQ ID NO: 3224911 - RNA, 16 nt, Mycobacterium leprae
caacaccagcgacugg

SEQ ID NO: 3224912 - RNA, 14 nt, Mycobacterium leprae
caacaccaugguga

SEQ ID NO: 3224913 - RNA, 17 nt, Mycobacterium leprae
caacacccaggucggug

SEQ ID NO: 3224914 - RNA, 19 nt, Mycobacterium leprae
caacaccccgauuccaccu

SEQ ID NO: 3224915 - RNA, 17 nt, Mycobacterium leprae
caacaccuugcgccccg

SEQ ID NO: 3224916 - RNA, 16 nt, Mycobacterium leprae
caacacgaucgcagcc

SEQ ID NO: 3224917 - RNA, 21 nt, Mycobacterium leprae
caacacgugcugaggguggcg

SEQ ID NO: 3224918 - RNA, 23 nt, Mycobacterium leprae
caacacguuucugcaugcauaua

SEQ ID NO: 3224919 - RNA, 15 nt, Mycobacterium leprae
caacagcgcagugug

SEQ ID NO: 3224920 - RNA, 21 nt, Mycobacterium leprae
caacauagucagaucaaccaa

SEQ ID NO: 3224921 - RNA, 12 nt, Mycobacterium leprae
caacauucaccc

SEQ ID NO: 3224922 - RNA, 21 nt, Mycobacterium leprae
caacauuguaaucagcccaac

SEQ ID NO: 3224923 - RNA, 14 nt, Mycobacterium leprae
caaccaacaugugc

SEQ ID NO: 3224924 - RNA, 17 nt, Mycobacterium leprae
caaccaaggcucccaag

SEQ ID NO: 3224925 - RNA, 17 nt, Mycobacterium leprae
caaccaaucuccggugg

SEQ ID NO: 3224926 - RNA, 19 nt, Mycobacterium leprae
caaccagccccucgacaac

SEQ ID NO: 3224927 - RNA, 15 nt, Mycobacterium leprae
caacccgacggcaca

SEQ ID NO: 3224928 - RNA, 18 nt, Mycobacterium leprae
caacccggcagaggcacc

SEQ ID NO: 3224929 - RNA, 21 nt, Mycobacterium leprae
caacccgggacuugacuccuc

SEQ ID NO: 3224930 - RNA, 14 nt, Mycobacterium leprae
caacccgggucaua

SEQ ID NO: 3224931 - RNA, 21 nt, Mycobacterium leprae
caacccgggucauacacgugg

SEQ ID NO: 3224932 - RNA, 16 nt, Mycobacterium leprae
caaccgauacgccagu

SEQ ID NO: 3224933 - RNA, 17 nt, Mycobacterium leprae
caaccgaugcagggcca

SEQ ID NO: 3224934 - RNA, 16 nt, Mycobacterium leprae
caaccgcacagagccc

SEQ ID NO: 3224935 - RNA, 13 nt, Mycobacterium leprae
caaccggccggcc

SEQ ID NO: 3224936 - RNA, 17 nt, Mycobacterium leprae
caaccuagcaaguuguu

SEQ ID NO: 3224937 - RNA, 20 nt, Mycobacterium leprae
caaccuauaaagcgucugcu

SEQ ID NO: 3224938 - RNA, 19 nt, Mycobacterium leprae
caaccuuccgcaaaguuau

SEQ ID NO: 3224939 - RNA, 21 nt, Mycobacterium leprae
caaccuuugucgccaguaugu

SEQ ID NO: 3224940 - RNA, 23 nt, Mycobacterium leprae
caacgcaccgcguaacagauuau

SEQ ID NO: 3224941 - RNA, 20 nt, Mycobacterium leprae
caacgcaucaccggaaagcu

SEQ ID NO: 3224942 - RNA, 22 nt, Mycobacterium leprae
caacgccaaacuggucaacgca

SEQ ID NO: 3224943 - RNA, 23 nt, Mycobacterium leprae
caacgccgagccuguuguugugc

SEQ ID NO: 3224944 - RNA, 20 nt, Mycobacterium leprae
caacgccggucugauagugu

SEQ ID NO: 3224945 - RNA, 15 nt, Mycobacterium leprae
caacgccuccacugc

SEQ ID NO: 3224946 - RNA, 12 nt, Mycobacterium leprae
caacgcgcaccu

SEQ ID NO: 3224947 - RNA, 17 nt, Mycobacterium leprae
caacgcggcggcggcca

SEQ ID NO: 3224948 - RNA, 14 nt, Mycobacterium leprae
caacggcaccaaac

SEQ ID NO: 3224949 - RNA, 16 nt, Mycobacterium leprae
caacggcaccaaaccc

SEQ ID NO: 3224950 - RNA, 23 nt, Mycobacterium leprae
caacggccucacaguaggccagc

SEQ ID NO: 3224951 - RNA, 21 nt, Mycobacterium leprae
caacggcuacaacaaaguuau

SEQ ID NO: 3224952 - RNA, 15 nt, Mycobacterium leprae
caacgggaucgacaa

SEQ ID NO: 3224953 - RNA, 17 nt, Mycobacterium leprae
caacgggccgcucgacc

SEQ ID NO: 3224954 - RNA, 23 nt, Mycobacterium leprae
caacggucgcucggacugggcuc

SEQ ID NO: 3224955 - RNA, 17 nt, Mycobacterium leprae
caacggugagcggcaga

SEQ ID NO: 3224956 - RNA, 16 nt, Mycobacterium leprae
caacguacugcaaugc

SEQ ID NO: 3224957 - RNA, 23 nt, Mycobacterium leprae
caacgucacgucgacggcggccg

SEQ ID NO: 3224958 - RNA, 22 nt, Mycobacterium leprae
caacgucagaagcugguggccc

SEQ ID NO: 3224959 - RNA, 20 nt, Mycobacterium leprae
caacgugaccagcuccgaag

SEQ ID NO: 3224960 - RNA, 20 nt, Mycobacterium leprae
caacgugggcgauucgggcc

SEQ ID NO: 3224961 - RNA, 16 nt, Mycobacterium leprae
caacguguaaggccag

SEQ ID NO: 3224962 - RNA, 18 nt, Mycobacterium leprae
caacguguaaggccagcg

SEQ ID NO: 3224963 - RNA, 19 nt, Mycobacterium leprae
caacguguaaggccagcgc

SEQ ID NO: 3224964 - RNA, 20 nt, Mycobacterium leprae
caacgugugugacggcuggu

SEQ ID NO: 3224965 - RNA, 19 nt, Mycobacterium leprae
caacguuuugccgagcaag

SEQ ID NO: 3224966 - RNA, 21 nt, Mycobacterium leprae
caacguuuuggcguaccuggg

SEQ ID NO: 3224967 - RNA, 14 nt, Mycobacterium leprae
caacuaugcuggcu

SEQ ID NO: 3224968 - RNA, 18 nt, Mycobacterium leprae
caacucaucggcucccau

SEQ ID NO: 3224969 - RNA, 12 nt, Mycobacterium leprae
caacugagcgcg

SEQ ID NO: 3224970 - RNA, 16 nt, Mycobacterium leprae
caacuggaaguacugu

SEQ ID NO: 3224971 - RNA, 19 nt, Mycobacterium leprae
caacuggaguacuggcggc

SEQ ID NO: 3224972 - RNA, 21 nt, Mycobacterium leprae
caagaaguacagucccgaaca

SEQ ID NO: 3224973 - RNA, 12 nt, Mycobacterium leprae
caagacugcacc

SEQ ID NO: 3224974 - RNA, 15 nt, Mycobacterium leprae
caagacugcacccgg

SEQ ID NO: 3224975 - RNA, 16 nt, Mycobacterium leprae
caagagccgcggguuu

SEQ ID NO: 3224976 - RNA, 16 nt, Mycobacterium leprae
caagagcgagcucgag

SEQ ID NO: 3224977 - RNA, 23 nt, Mycobacterium leprae
cacagccgcgcuagcgauguagc

SEQ ID NO: 3224978 - RNA, 18 nt, Mycobacterium leprae
cacagccguugcugcugc

SEQ ID NO: 3224979 - RNA, 14 nt, Mycobacterium leprae
cacagcgccaacaa

SEQ ID NO: 3224980 - RNA, 13 nt, Mycobacterium leprae
cacaggacuucaa

SEQ ID NO: 3224981 - RNA, 18 nt, Mycobacterium leprae
cacaggcagagccaaaca

SEQ ID NO: 3224982 - RNA, 17 nt, Mycobacterium leprae
cacagugccugaccauc

SEQ ID NO: 3224983 - RNA, 22 nt, Mycobacterium leprae
cacaguuguuggccuugcugug

SEQ ID NO: 3224984 - RNA, 12 nt, Mycobacterium leprae
cacauacggcaa

SEQ ID NO: 3224985 - RNA, 20 nt, Mycobacterium leprae
cacauaucuaauugggaucg

SEQ ID NO: 3224986 - RNA, 22 nt, Mycobacterium leprae
cacaucaucgaucagacccuug

SEQ ID NO: 3224987 - RNA, 20 nt, Mycobacterium leprae
cacauggggcuaaucguucc

SEQ ID NO: 3224988 - RNA, 17 nt, Mycobacterium leprae
cacaugucccggugcug

SEQ ID NO: 3224989 - RNA, 17 nt, Mycobacterium leprae
cacaugugcgccagggg

SEQ ID NO: 3224990 - RNA, 17 nt, Mycobacterium leprae
cacauugggaucccacc

SEQ ID NO: 3224991 - RNA, 14 nt, Mycobacterium leprae
caccaaacccgccg

SEQ ID NO: 3224992 - RNA, 13 nt, Mycobacterium leprae
caccaacaguccc

SEQ ID NO: 3224993 - RNA, 22 nt, Mycobacterium leprae
caccaagcccauccguccaccc

SEQ ID NO: 3224994 - RNA, 15 nt, Mycobacterium leprae
caccaagcgcagaug

SEQ ID NO: 3224995 - RNA, 15 nt, Mycobacterium leprae
caccaagucuucgau

SEQ ID NO: 3224996 - RNA, 14 nt, Mycobacterium leprae
caccaauagccgac

SEQ ID NO: 3224997 - RNA, 16 nt, Mycobacterium leprae
caccacaucaucgauc

SEQ ID NO: 3224998 - RNA, 19 nt, Mycobacterium leprae
caccaccccuacccaaauc

SEQ ID NO: 3224999 - RNA, 15 nt, Mycobacterium leprae
caccacccugcgcug

SEQ ID NO: 3225000 - RNA, 14 nt, Mycobacterium leprae
caccaccgccaccu

SEQ ID NO: 3225001 - RNA, 20 nt, Mycobacterium leprae
caccacgcacacgacagccg

SEQ ID NO: 3225002 - RNA, 23 nt, Mycobacterium leprae
caccacuguacggaauggccaug

SEQ ID NO: 3225003 - RNA, 13 nt, Mycobacterium leprae
caccagaucagca

SEQ ID NO: 3225004 - RNA, 22 nt, Mycobacterium leprae
caccagauuggaaaucgcucga

SEQ ID NO: 3225005 - RNA, 20 nt, Mycobacterium leprae
caccagcucacccgcagcac

SEQ ID NO: 3225006 - RNA, 16 nt, Mycobacterium leprae
caccagggauuccugu

SEQ ID NO: 3225007 - RNA, 21 nt, Mycobacterium leprae
caccagggauuccuguucuac

SEQ ID NO: 3225008 - RNA, 15 nt, Mycobacterium leprae
caccaguaaccacgc

SEQ ID NO: 3225009 - RNA, 16 nt, Mycobacterium leprae
caccaguaaccacgca

SEQ ID NO: 3225010 - RNA, 20 nt, Mycobacterium leprae
caccaguggcucgccgcgca

SEQ ID NO: 3225011 - RNA, 17 nt, Mycobacterium leprae
caccauccggcgggcgu

SEQ ID NO: 3225012 - RNA, 21 nt, Mycobacterium leprae
caccauccggcgggcgugcug

SEQ ID NO: 3225013 - RNA, 18 nt, Mycobacterium leprae
caccaucugcucucagca

SEQ ID NO: 3225014 - RNA, 18 nt, Mycobacterium leprae
caccaugcggcggacgau

SEQ ID NO: 3225015 - RNA, 19 nt, Mycobacterium leprae
caccauggugaacaacgca

SEQ ID NO: 3225016 - RNA, 22 nt, Mycobacterium leprae
caccauggugcggcgccgcccg

SEQ ID NO: 3225017 - RNA, 14 nt, Mycobacterium leprae
caccaugugcacag

SEQ ID NO: 3225018 - RNA, 16 nt, Mycobacterium leprae
cacccaagauagcgca

SEQ ID NO: 3225019 - RNA, 16 nt, Mycobacterium leprae
cacccaauugccuggc

SEQ ID NO: 3225020 - RNA, 18 nt, Mycobacterium leprae
cacccacaacgccaaacu

SEQ ID NO: 3225021 - RNA, 17 nt, Mycobacterium leprae
cacccaggucgguggau

SEQ ID NO: 3225022 - RNA, 23 nt, Mycobacterium leprae
cacccaguaugcaccgcggcggg

SEQ ID NO: 3225023 - RNA, 15 nt, Mycobacterium leprae
cacccauaacgugcu

SEQ ID NO: 3225024 - RNA, 13 nt, Mycobacterium leprae
cacccgcagcacc

SEQ ID NO: 3225025 - RNA, 18 nt, Mycobacterium leprae
cacccgcgauagcuugca

SEQ ID NO: 3225026 - RNA, 14 nt, Mycobacterium leprae
cacccgcgccgccu

SEQ ID NO: 3225027 - RNA, 16 nt, Mycobacterium leprae
cacccgcgccgccugc

SEQ ID NO: 3225028 - RNA, 15 nt, Mycobacterium leprae
cacccgcuggugcgu

SEQ ID NO: 3225029 - RNA, 13 nt, Mycobacterium leprae
cacccggcagcau

SEQ ID NO: 3225030 - RNA, 17 nt, Mycobacterium leprae
cacccggcggcaugccu

SEQ ID NO: 3225031 - RNA, 19 nt, Mycobacterium leprae
cacccggcggcaugccugc

SEQ ID NO: 3225032 - RNA, 22 nt, Mycobacterium leprae
cacccggcggcaugccugcuug

SEQ ID NO: 3225033 - RNA, 23 nt, Mycobacterium leprae
cacccgucgcugauacaacugga

SEQ ID NO: 3225034 - RNA, 16 nt, Mycobacterium leprae
cacccgucguggccga

SEQ ID NO: 3225035 - RNA, 18 nt, Mycobacterium leprae
cacccuccucgcggcggu

SEQ ID NO: 3225036 - RNA, 18 nt, Mycobacterium leprae
cacccugccgccacagca

SEQ ID NO: 3225037 - RNA, 17 nt, Mycobacterium leprae
cacccuggaauccgcgc

SEQ ID NO: 3225038 - RNA, 16 nt, Mycobacterium leprae
caccgaacccagacgc

SEQ ID NO: 3225039 - RNA, 13 nt, Mycobacterium leprae
caccgaacccauc

SEQ ID NO: 3225040 - RNA, 16 nt, Mycobacterium leprae
caccgaauauuuucaa

SEQ ID NO: 3225041 - RNA, 22 nt, Mycobacterium leprae
caccgaauauuuucaagacugc

SEQ ID NO: 3225042 - RNA, 21 nt, Mycobacterium leprae
caccgacaugcuuacgugcgc

SEQ ID NO: 3225043 - RNA, 13 nt, Mycobacterium leprae
caccgaccgccuu

SEQ ID NO: 3225044 - RNA, 14 nt, Mycobacterium leprae
caccgaccuucgcg

SEQ ID NO: 3225045 - RNA, 15 nt, Mycobacterium leprae
caccgacgagcaacc

SEQ ID NO: 3225046 - RNA, 17 nt, Mycobacterium leprae
caccgacuagcaggucu

SEQ ID NO: 3225047 - RNA, 17 nt, Mycobacterium leprae
caccgagacguugcugg

SEQ ID NO: 3225048 - RNA, 19 nt, Mycobacterium leprae
caccgagacguugcuggga

SEQ ID NO: 3225049 - RNA, 22 nt, Mycobacterium leprae
caccgagaucuuaaucgagcca

SEQ ID NO: 3225050 - RNA, 12 nt, Mycobacterium leprae
caccgagcgacc

SEQ ID NO: 3225051 - RNA, 14 nt, Mycobacterium leprae
caccgaucugccca

SEQ ID NO: 3225052 - RNA, 18 nt, Mycobacterium leprae
caccgcaggcgagcaccg

SEQ ID NO: 3225053 - RNA, 14 nt, Mycobacterium leprae
caccgccgacgaau

SEQ ID NO: 3225054 - RNA, 17 nt, Mycobacterium leprae
caccgccggucaucgcu

SEQ ID NO: 3225055 - RNA, 16 nt, Mycobacterium leprae
caccgcgaacgccucg

SEQ ID NO: 3225056 - RNA, 18 nt, Mycobacterium leprae
caccgcgaacgccucggc

SEQ ID NO: 3225057 - RNA, 21 nt, Mycobacterium leprae
caccgcgaacgccucggcaag

SEQ ID NO: 3225058 - RNA, 16 nt, Mycobacterium leprae
caccgcgaagccguug

SEQ ID NO: 3225059 - RNA, 12 nt, Mycobacterium leprae
caccgcggaucg

SEQ ID NO: 3225060 - RNA, 23 nt, Mycobacterium leprae
caccgcggcguuauccacgccga

SEQ ID NO: 3225061 - RNA, 20 nt, Mycobacterium leprae
caccgcggugagcggucgca

SEQ ID NO: 3225062 - RNA, 21 nt, Mycobacterium leprae
caccgcggugcugagucggcg

SEQ ID NO: 3225063 - RNA, 15 nt, Mycobacterium leprae
caccgcuacggcggu

SEQ ID NO: 3225064 - RNA, 21 nt, Mycobacterium leprae
caccgcuacggcgguguuucu

SEQ ID NO: 3225065 - RNA, 14 nt, Mycobacterium leprae
caccgcuguggcag

SEQ ID NO: 3225066 - RNA, 16 nt, Mycobacterium leprae
caccggcacacccaau

SEQ ID NO: 3225067 - RNA, 20 nt, Mycobacterium leprae
caccggcaucggacaggauc

SEQ ID NO: 3225068 - RNA, 15 nt, Mycobacterium leprae
caccggcauggccgc

SEQ ID NO: 3225069 - RNA, 16 nt, Mycobacterium leprae
caccggcauggccgcu

SEQ ID NO: 3225070 - RNA, 18 nt, Mycobacterium leprae
caccggccaaaagccuug

SEQ ID NO: 3225071 - RNA, 19 nt, Mycobacterium leprae
caccggccaaaagccuugc

SEQ ID NO: 3225072 - RNA, 21 nt, Mycobacterium leprae
caccggcgcuuguaaggccag

SEQ ID NO: 3225073 - RNA, 18 nt, Mycobacterium leprae
caccggcgggccgaugcg

SEQ ID NO: 3225074 - RNA, 23 nt, Mycobacterium leprae
caccggcggugucggcuaccaau

SEQ ID NO: 3225075 - RNA, 14 nt, Mycobacterium leprae
caccggcugcaccc

SEQ ID NO: 3225076 - RNA, 16 nt, Mycobacterium leprae
caccggcugcacccgu

SEQ ID NO: 3225077 - RNA, 17 nt, Mycobacterium leprae
caccggcuuagcccgcu

SEQ ID NO: 3225078 - RNA, 17 nt, Mycobacterium leprae
caccguaaacgucaugc

SEQ ID NO: 3225079 - RNA, 22 nt, Mycobacterium leprae
caccguaacucuauaaaauuua

SEQ ID NO: 3225080 - RNA, 17 nt, Mycobacterium leprae
caccgucuuugcuaaca

SEQ ID NO: 3225081 - RNA, 18 nt, Mycobacterium leprae
caccguggucacgguugc

SEQ ID NO: 3225082 - RNA, 17 nt, Mycobacterium leprae
caccguuacggccaugu

SEQ ID NO: 3225083 - RNA, 22 nt, Mycobacterium leprae
caccguuguggaucgaccuccu

SEQ ID NO: 3225084 - RNA, 15 nt, Mycobacterium leprae
caccuacaacuucaa

SEQ ID NO: 3225085 - RNA, 18 nt, Mycobacterium leprae
caccucaaggccaugaca

SEQ ID NO: 3225086 - RNA, 19 nt, Mycobacterium leprae
caccuccacgguuggaugc

SEQ ID NO: 3225087 - RNA, 16 nt, Mycobacterium leprae
caccuccccgcccaag

SEQ ID NO: 3225088 - RNA, 16 nt, Mycobacterium leprae
caccucgcugcagcau

SEQ ID NO: 3225089 - RNA, 23 nt, Mycobacterium leprae
caccucguucaagauacuggauu

SEQ ID NO: 3225090 - RNA, 14 nt, Mycobacterium leprae
cagaaccaucccaa

SEQ ID NO: 3225091 - RNA, 14 nt, Mycobacterium leprae
cagaaccgcgguaa

SEQ ID NO: 3225092 - RNA, 16 nt, Mycobacterium leprae
cagaagcuguugugaa

SEQ ID NO: 3225093 - RNA, 20 nt, Mycobacterium leprae
cagaagcuguugugaagcug

SEQ ID NO: 3225094 - RNA, 19 nt, Mycobacterium leprae
cagaaguggucgauuugca

SEQ ID NO: 3225095 - RNA, 21 nt, Mycobacterium leprae
cagaauggaguuggugucugg

SEQ ID NO: 3225096 - RNA, 17 nt, Mycobacterium leprae
cagaauucuauaucuau

SEQ ID NO: 3225097 - RNA, 17 nt, Mycobacterium leprae
cagacaccacugccagc

SEQ ID NO: 3225098 - RNA, 22 nt, Mycobacterium leprae
cagacacgccgcggcugggcag

SEQ ID NO: 3225099 - RNA, 18 nt, Mycobacterium leprae
cagacacggaagcccucc

SEQ ID NO: 3225100 - RNA, 13 nt, Mycobacterium leprae
cagaccaacauga

SEQ ID NO: 3225101 - RNA, 15 nt, Mycobacterium leprae
cagacccuuggucga

SEQ ID NO: 3225102 - RNA, 21 nt, Mycobacterium leprae
cagaccgaaaaccacaagcag

SEQ ID NO: 3225103 - RNA, 18 nt, Mycobacterium leprae
cagaccgaaaucaaagcc

SEQ ID NO: 3225104 - RNA, 22 nt, Mycobacterium leprae
cagaccucccugacgcacaccg

SEQ ID NO: 3225105 - RNA, 17 nt, Mycobacterium leprae
cagaccucuuccgccgc

SEQ ID NO: 3225106 - RNA, 16 nt, Mycobacterium leprae
cagacgcgaccgccac

SEQ ID NO: 3225107 - RNA, 22 nt, Mycobacterium leprae
cagacgcgaccgccaccagauc

SEQ ID NO: 3225108 - RNA, 22 nt, Mycobacterium leprae
cagacggauucaaaggucgaca

SEQ ID NO: 3225109 - RNA, 13 nt, Mycobacterium leprae
cagacugcccaga

SEQ ID NO: 3225110 - RNA, 16 nt, Mycobacterium leprae
cagacuucagcgagcg

SEQ ID NO: 3225111 - RNA, 15 nt, Mycobacterium leprae
cagagacucgugagc

SEQ ID NO: 3225112 - RNA, 15 nt, Mycobacterium leprae
cagagcaagccgcac

SEQ ID NO: 3225113 - RNA, 23 nt, Mycobacterium leprae
cagagcauucggcuguuaaccga

SEQ ID NO: 3225114 - RNA, 15 nt, Mycobacterium leprae
cagagcccagcacgc

SEQ ID NO: 3225115 - RNA, 19 nt, Mycobacterium leprae
cagagcccagcacgcgcga

SEQ ID NO: 3225116 - RNA, 14 nt, Mycobacterium leprae
cagagccgcgcgca

SEQ ID NO: 3225117 - RNA, 20 nt, Mycobacterium leprae
cagagccgcgcgcaagucug

SEQ ID NO: 3225118 - RNA, 14 nt, Mycobacterium leprae
cagagcgcugugau

SEQ ID NO: 3225119 - RNA, 14 nt, Mycobacterium leprae
cagagcucacuggg

SEQ ID NO: 3225120 - RNA, 16 nt, Mycobacterium leprae
cagagcucacugggcu

SEQ ID NO: 3225121 - RNA, 17 nt, Mycobacterium leprae
cagagcucacugggcuu

SEQ ID NO: 3225122 - RNA, 14 nt, Mycobacterium leprae
cagagcugauggcc

SEQ ID NO: 3225123 - RNA, 18 nt, Mycobacterium leprae
cagagcugauggccgcca

SEQ ID NO: 3225124 - RNA, 15 nt, Mycobacterium leprae
cagagcugcagguca

SEQ ID NO: 3225125 - RNA, 16 nt, Mycobacterium leprae
cagagcugcaggucag

SEQ ID NO: 3225126 - RNA, 21 nt, Mycobacterium leprae
cagagcugcgacggacaggcc

SEQ ID NO: 3225127 - RNA, 20 nt, Mycobacterium leprae
cagagcuguugucgcggaag

SEQ ID NO: 3225128 - RNA, 13 nt, Mycobacterium leprae
cagagcuuccucg

SEQ ID NO: 3225129 - RNA, 20 nt, Mycobacterium leprae
cagagcuucgacuaagccgc

SEQ ID NO: 3225130 - RNA, 22 nt, Mycobacterium leprae
cagaggacgggcggccaggcag

SEQ ID NO: 3225131 - RNA, 18 nt, Mycobacterium leprae
cagaggcgcgccgugcca

SEQ ID NO: 3225132 - RNA, 14 nt, Mycobacterium leprae
cagaggcugcaguc

SEQ ID NO: 3225133 - RNA, 18 nt, Mycobacterium leprae
cagagguucuagguagaa

SEQ ID NO: 3225134 - RNA, 14 nt, Mycobacterium leprae
cagaguaaccacuu

SEQ ID NO: 3225135 - RNA, 17 nt, Mycobacterium leprae
cagagugcaccacugua

SEQ ID NO: 3225136 - RNA, 13 nt, Mycobacterium leprae
cagauaccauuac

SEQ ID NO: 3225137 - RNA, 19 nt, Mycobacterium leprae
cagauaccauuacgcacua

SEQ ID NO: 3225138 - RNA, 22 nt, Mycobacterium leprae
cagauaucgcacacagcggcca

SEQ ID NO: 3225139 - RNA, 14 nt, Mycobacterium leprae
cagaucacauuggu

SEQ ID NO: 3225140 - RNA, 19 nt, Mycobacterium leprae
cagaucacauuggucgacg

SEQ ID NO: 3225141 - RNA, 13 nt, Mycobacterium leprae
cagauccugggcg

SEQ ID NO: 3225142 - RNA, 16 nt, Mycobacterium leprae
cagaucgacagcggcc

SEQ ID NO: 3225143 - RNA, 22 nt, Mycobacterium leprae
cagaucgaucucgacggcagug

SEQ ID NO: 3225144 - RNA, 17 nt, Mycobacterium leprae
cagaugaauucgcugau

SEQ ID NO: 3225145 - RNA, 13 nt, Mycobacterium leprae
cagaugacagcgc

SEQ ID NO: 3225146 - RNA, 20 nt, Mycobacterium leprae
cagaugauacguucgaucac

SEQ ID NO: 3225147 - RNA, 19 nt, Mycobacterium leprae
cagaugccguuuucaccaa

SEQ ID NO: 3225148 - RNA, 19 nt, Mycobacterium leprae
cagaugcgaucgcagucau

SEQ ID NO: 3225149 - RNA, 21 nt, Mycobacterium leprae
cagaugcgaucgcagucauca

SEQ ID NO: 3225150 - RNA, 22 nt, Mycobacterium leprae
cagaugcgaucgcagucaucac

SEQ ID NO: 3225151 - RNA, 21 nt, Mycobacterium leprae
cagauucacagucggcgcagu

SEQ ID NO: 3225152 - RNA, 14 nt, Mycobacterium leprae
cagauugcagucca

SEQ ID NO: 3225153 - RNA, 13 nt, Mycobacterium leprae
cagcaaaaagucc

SEQ ID NO: 3225154 - RNA, 22 nt, Mycobacterium leprae
cagcaacauucaccccccagga

SEQ ID NO: 3225155 - RNA, 22 nt, Mycobacterium leprae
cagcaaccgcacagagcccagc

SEQ ID NO: 3225156 - RNA, 20 nt, Mycobacterium leprae
cagcaagcgagccaucgcaa

SEQ ID NO: 3225157 - RNA, 13 nt, Mycobacterium leprae
cagcaagcggccg

SEQ ID NO: 3225158 - RNA, 15 nt, Mycobacterium leprae
cagcaagcggccgcc

SEQ ID NO: 3225159 - RNA, 19 nt, Mycobacterium leprae
cagcaagugaccaccaggg

SEQ ID NO: 3225160 - RNA, 14 nt, Mycobacterium leprae
cagcaaucaaugug

SEQ ID NO: 3225161 - RNA, 14 nt, Mycobacterium leprae
cagcaaucugcguc

SEQ ID NO: 3225162 - RNA, 18 nt, Mycobacterium leprae
cagcaaugcucugcugau

SEQ ID NO: 3225163 - RNA, 15 nt, Mycobacterium leprae
cagcaaugugcgcug

SEQ ID NO: 3225164 - RNA, 19 nt, Mycobacterium leprae
cagcaauugacgccgaccg

SEQ ID NO: 3225165 - RNA, 15 nt, Mycobacterium leprae
cagcaauuguucgac

SEQ ID NO: 3225166 - RNA, 13 nt, Mycobacterium leprae
cagcaccaaccug

SEQ ID NO: 3225167 - RNA, 15 nt, Mycobacterium leprae
cagcaccacagcgcc

SEQ ID NO: 3225168 - RNA, 16 nt, Mycobacterium leprae
cagcaccacagcgcca

SEQ ID NO: 3225169 - RNA, 21 nt, Mycobacterium leprae
cagcaccacagcgccaacaac

SEQ ID NO: 3225170 - RNA, 21 nt, Mycobacterium leprae
cagcaccauggaacagcguuc

SEQ ID NO: 3225171 - RNA, 16 nt, Mycobacterium leprae
cagcaccauucugguc

SEQ ID NO: 3225172 - RNA, 21 nt, Mycobacterium leprae
cagcaccucgaaucagcaucg

SEQ ID NO: 3225173 - RNA, 14 nt, Mycobacterium leprae
cagcaccuugggcg

SEQ ID NO: 3225174 - RNA, 23 nt, Mycobacterium leprae
cagcacgcaaccgccggcaagcc

SEQ ID NO: 3225175 - RNA, 17 nt, Mycobacterium leprae
cagcacgggguguuggc

SEQ ID NO: 3225176 - RNA, 18 nt, Mycobacterium leprae
cagcacuaaagucuucaa

SEQ ID NO: 3225177 - RNA, 14 nt, Mycobacterium leprae
cagcacucgacuca

SEQ ID NO: 3225178 - RNA, 12 nt, Mycobacterium leprae
cagcagcauugc

SEQ ID NO: 3225179 - RNA, 11 nt, Mycobacterium leprae
cagcagccacu

SEQ ID NO: 3225180 - RNA, 21 nt, Mycobacterium leprae
cagcagcguggucaccgcugu

SEQ ID NO: 3225181 - RNA, 19 nt, Mycobacterium leprae
cagcaggaaucccagcagc

SEQ ID NO: 3225182 - RNA, 23 nt, Mycobacterium leprae
cagcagguagacgcgcuaaaccu

SEQ ID NO: 3225183 - RNA, 20 nt, Mycobacterium leprae
cagcaguggguugcuauuug

SEQ ID NO: 3225184 - RNA, 21 nt, Mycobacterium leprae
cagcaguggucggcgaaggag

SEQ ID NO: 3225185 - RNA, 16 nt, Mycobacterium leprae
cagcaguguucaggcc

SEQ ID NO: 3225186 - RNA, 16 nt, Mycobacterium leprae
cagcaguuuccaacaa

SEQ ID NO: 3225187 - RNA, 15 nt, Mycobacterium leprae
cagcauauggaaagu

SEQ ID NO: 3225188 - RNA, 22 nt, Mycobacterium leprae
cagcauauggaaagucagcauc

SEQ ID NO: 3225189 - RNA, 17 nt, Mycobacterium leprae
cagcaucaacgccagca

SEQ ID NO: 3225190 - RNA, 15 nt, Mycobacterium leprae
cagcaucagacagag

SEQ ID NO: 3225191 - RNA, 15 nt, Mycobacterium leprae
cagcauccucggcac

SEQ ID NO: 3225192 - RNA, 22 nt, Mycobacterium leprae
cagcauccucggcacagugacg

SEQ ID NO: 3225193 - RNA, 22 nt, Mycobacterium leprae
cagcauggcgaugcgcagccgc

SEQ ID NO: 3225194 - RNA, 20 nt, Mycobacterium leprae
cagcaugucggccacugcac

SEQ ID NO: 3225195 - RNA, 17 nt, Mycobacterium leprae
cagcauuauccgggcug

SEQ ID NO: 3225196 - RNA, 14 nt, Mycobacterium leprae
cagcauucagccgc

SEQ ID NO: 3225197 - RNA, 16 nt, Mycobacterium leprae
cagcauuggcuccugg

SEQ ID NO: 3225198 - RNA, 15 nt, Mycobacterium leprae
cagccaacaccacca

SEQ ID NO: 3225199 - RNA, 21 nt, Mycobacterium leprae
cagccaacauagucauugccu

SEQ ID NO: 3225200 - RNA, 20 nt, Mycobacterium leprae
cagccaacggcuagccagag

SEQ ID NO: 3225201 - RNA, 21 nt, Mycobacterium leprae
cagccaacggcuagccagaga

SEQ ID NO: 3225202 - RNA, 14 nt, Mycobacterium leprae
cagccaacgggaac

SEQ ID NO: 3225203 - RNA, 15 nt, Mycobacterium leprae
caggacccagcgaua

SEQ ID NO: 3225204 - RNA, 14 nt, Mycobacterium leprae
caggaccgugcuau

SEQ ID NO: 3225205 - RNA, 18 nt, Mycobacterium leprae
caggacuacgccacagaa

SEQ ID NO: 3225206 - RNA, 21 nt, Mycobacterium leprae
caggacucggauccaucagac

SEQ ID NO: 3225207 - RNA, 13 nt, Mycobacterium leprae
caggacuucaaau

SEQ ID NO: 3225208 - RNA, 22 nt, Mycobacterium leprae
caggagaaacaaaggugcccac

SEQ ID NO: 3225209 - RNA, 18 nt, Mycobacterium leprae
caggagaagcgcugcagc

SEQ ID NO: 3225210 - RNA, 15 nt, Mycobacterium leprae
caggagauacucuga

SEQ ID NO: 3225211 - RNA, 21 nt, Mycobacterium leprae
caggagcuucaacaccauggu

SEQ ID NO: 3225212 - RNA, 14 nt, Mycobacterium leprae
caggaguaauaacu

SEQ ID NO: 3225213 - RNA, 16 nt, Mycobacterium leprae
caggaguugaccaggc

SEQ ID NO: 3225214 - RNA, 17 nt, Mycobacterium leprae
caggauauggcagagua

SEQ ID NO: 3225215 - RNA, 17 nt, Mycobacterium leprae
caggaucacguguggcc

SEQ ID NO: 3225216 - RNA, 24 nt, Mycobacterium leprae
caggaucgcaaaacaacguaccua

SEQ ID NO: 3225217 - RNA, 15 nt, Mycobacterium leprae
caggaucugcucgau

SEQ ID NO: 3225218 - RNA, 17 nt, Mycobacterium leprae
caggaugcgugcccaua

SEQ ID NO: 3225219 - RNA, 19 nt, Mycobacterium leprae
caggaugcgugcccauauc

SEQ ID NO: 3225220 - RNA, 21 nt, Mycobacterium leprae
caggaugcugucgcggagcuc

SEQ ID NO: 3225221 - RNA, 23 nt, Mycobacterium leprae
caggauucggucacgggucggcg

SEQ ID NO: 3225222 - RNA, 23 nt, Mycobacterium leprae
caggauuuuuacgacguagaaca

SEQ ID NO: 3225223 - RNA, 15 nt, Mycobacterium leprae
caggcaacacgugcu

SEQ ID NO: 3225224 - RNA, 15 nt, Mycobacterium leprae
caggcaaccaagaug

SEQ ID NO: 3225225 - RNA, 15 nt, Mycobacterium leprae
caggcaaccgcccgc

SEQ ID NO: 3225226 - RNA, 18 nt, Mycobacterium leprae
caggcaaccgcccgcagu

SEQ ID NO: 3225227 - RNA, 19 nt, Mycobacterium leprae
caggcaccauugauggaac

SEQ ID NO: 3225228 - RNA, 15 nt, Mycobacterium leprae
caggcagagccaaac

SEQ ID NO: 3225229 - RNA, 20 nt, Mycobacterium leprae
caggcagucuuucagugccg

SEQ ID NO: 3225230 - RNA, 15 nt, Mycobacterium leprae
caggcaugccgccgg

SEQ ID NO: 3225231 - RNA, 17 nt, Mycobacterium leprae
caggcaugggcauuggc

SEQ ID NO: 3225232 - RNA, 12 nt, Mycobacterium leprae
caggccaccggu

SEQ ID NO: 3225233 - RNA, 13 nt, Mycobacterium leprae
caggccaggcagc

SEQ ID NO: 3225234 - RNA, 17 nt, Mycobacterium leprae
caggccaggcagcgccu

SEQ ID NO: 3225235 - RNA, 20 nt, Mycobacterium leprae
caggccaucagauccggugg

SEQ ID NO: 3225236 - RNA, 14 nt, Mycobacterium leprae
caggccggccugga

SEQ ID NO: 3225237 - RNA, 16 nt, Mycobacterium leprae
caggccggccuggaaa

SEQ ID NO: 3225238 - RNA, 17 nt, Mycobacterium leprae
caggccgucguugccga

SEQ ID NO: 3225239 - RNA, 15 nt, Mycobacterium leprae
caggccguggacgaa

SEQ ID NO: 3225240 - RNA, 16 nt, Mycobacterium leprae
caggccugaucuccaa

SEQ ID NO: 3225241 - RNA, 21 nt, Mycobacterium leprae
caggccuggucguucauccuc

SEQ ID NO: 3225242 - RNA, 17 nt, Mycobacterium leprae
caggcgacgucacgcug

SEQ ID NO: 3225243 - RNA, 13 nt, Mycobacterium leprae
caggcgccgcagc

SEQ ID NO: 3225244 - RNA, 14 nt, Mycobacterium leprae
caggcguccucauc

SEQ ID NO: 3225245 - RNA, 18 nt, Mycobacterium leprae
caggcgugagugugagga

SEQ ID NO: 3225246 - RNA, 17 nt, Mycobacterium leprae
caggcgugggugugagg

SEQ ID NO: 3225247 - RNA, 12 nt, Mycobacterium leprae
caggcgugugcu

SEQ ID NO: 3225248 - RNA, 13 nt, Mycobacterium leprae
caggcgugugcua

SEQ ID NO: 3225249 - RNA, 18 nt, Mycobacterium leprae
caggcugcauccugcagc

SEQ ID NO: 3225250 - RNA, 16 nt, Mycobacterium leprae
caggcugucaucagaa

SEQ ID NO: 3225251 - RNA, 20 nt, Mycobacterium leprae
cagggaagugacgccacagu

SEQ ID NO: 3225252 - RNA, 19 nt, Mycobacterium leprae
cagggauaagcuugggaaa

SEQ ID NO: 3225253 - RNA, 14 nt, Mycobacterium leprae
cagggcagccuaga

SEQ ID NO: 3225254 - RNA, 22 nt, Mycobacterium leprae
cagggcagccuagacugaccca

SEQ ID NO: 3225255 - RNA, 15 nt, Mycobacterium leprae
cagggccgaagcagc

SEQ ID NO: 3225256 - RNA, 21 nt, Mycobacterium leprae
cagggccgaagcagccggggu

SEQ ID NO: 3225257 - RNA, 16 nt, Mycobacterium leprae
cagggcgagcugcgcc

SEQ ID NO: 3225258 - RNA, 21 nt, Mycobacterium leprae
cagggcgaguacguccgcgcc

SEQ ID NO: 3225259 - RNA, 21 nt, Mycobacterium leprae
cagggcggcauucccaaccgc

SEQ ID NO: 3225260 - RNA, 23 nt, Mycobacterium leprae
cagggcggcauucccaaccgcga

SEQ ID NO: 3225261 - RNA, 17 nt, Mycobacterium leprae
cagggcguugccguccc

SEQ ID NO: 3225262 - RNA, 19 nt, Mycobacterium leprae
cagggcuguuuggccucca

SEQ ID NO: 3225263 - RNA, 22 nt, Mycobacterium leprae
cagggcuguuuggccuccaagu

SEQ ID NO: 3225264 - RNA, 17 nt, Mycobacterium leprae
caggggcugggcaccug

SEQ ID NO: 3225265 - RNA, 15 nt, Mycobacterium leprae
caggggguaguucuu

SEQ ID NO: 3225266 - RNA, 22 nt, Mycobacterium leprae
cagggguuccaagauggcguca

SEQ ID NO: 3225267 - RNA, 13 nt, Mycobacterium leprae
caggguacucagc

SEQ ID NO: 3225268 - RNA, 19 nt, Mycobacterium leprae
cagggugacauguacggaa

SEQ ID NO: 3225269 - RNA, 18 nt, Mycobacterium leprae
cagggugcgugacaaugu

SEQ ID NO: 3225270 - RNA, 21 nt, Mycobacterium leprae
cagguaauagaccgagucccc

SEQ ID NO: 3225271 - RNA, 16 nt, Mycobacterium leprae
cagguaauugacaccg

SEQ ID NO: 3225272 - RNA, 12 nt, Mycobacterium leprae
cagguagugagu

SEQ ID NO: 3225273 - RNA, 23 nt, Mycobacterium leprae
cagguagugaguacaccacccaa

SEQ ID NO: 3225274 - RNA, 19 nt, Mycobacterium leprae
caggucaacgucuccaaau

SEQ ID NO: 3225275 - RNA, 14 nt, Mycobacterium leprae
caggucacccuccu

SEQ ID NO: 3225276 - RNA, 22 nt, Mycobacterium leprae
caggucacccuccucgcggcgg

SEQ ID NO: 3225277 - RNA, 13 nt, Mycobacterium leprae
caggucauccuug

SEQ ID NO: 3225278 - RNA, 14 nt, Mycobacterium leprae
cagguccaacgcgg

SEQ ID NO: 3225279 - RNA, 14 nt, Mycobacterium leprae
cagguccacccgca

SEQ ID NO: 3225280 - RNA, 21 nt, Mycobacterium leprae
caggucgagcgauggcugccg

SEQ ID NO: 3225281 - RNA, 18 nt, Mycobacterium leprae
caggugaaucggcgcaca

SEQ ID NO: 3225282 - RNA, 16 nt, Mycobacterium leprae
caggugacgguguugg

SEQ ID NO: 3225283 - RNA, 19 nt, Mycobacterium leprae
cagguggcaucagauaucc

SEQ ID NO: 3225284 - RNA, 18 nt, Mycobacterium leprae
caggugguaucugcaccu

SEQ ID NO: 3225285 - RNA, 11 nt, Mycobacterium leprae
caggugucuga

SEQ ID NO: 3225286 - RNA, 16 nt, Mycobacterium leprae
cagguucugcacccca

SEQ ID NO: 3225287 - RNA, 21 nt, Mycobacterium leprae
cagguugcugucguguuugug

SEQ ID NO: 3225288 - RNA, 18 nt, Mycobacterium leprae
caguaagucccgucagga

SEQ ID NO: 3225289 - RNA, 15 nt, Mycobacterium leprae
caguaauccaguccg

SEQ ID NO: 3225290 - RNA, 21 nt, Mycobacterium leprae
caguacccgugcccaagacuc

SEQ ID NO: 3225291 - RNA, 13 nt, Mycobacterium leprae
caguaccuccagc

SEQ ID NO: 3225292 - RNA, 19 nt, Mycobacterium leprae
caguacuggugcuguguug

SEQ ID NO: 3225293 - RNA, 22 nt, Mycobacterium leprae
caguaggccagcccggcgugca

SEQ ID NO: 3225294 - RNA, 14 nt, Mycobacterium leprae
caguaguccucugc

SEQ ID NO: 3225295 - RNA, 22 nt, Mycobacterium leprae
caguaguuaccguauauuaacg

SEQ ID NO: 3225296 - RNA, 14 nt, Mycobacterium leprae
caguaucgaccagc

SEQ ID NO: 3225297 - RNA, 16 nt, Mycobacterium leprae
caguaucgaccagcca

SEQ ID NO: 3225298 - RNA, 21 nt, Mycobacterium leprae
caguaugugaugcagcuggag

SEQ ID NO: 3225299 - RNA, 15 nt, Mycobacterium leprae
cagucagcaucgggu

SEQ ID NO: 3225300 - RNA, 15 nt, Mycobacterium leprae
cagucagucaccacu

SEQ ID NO: 3225301 - RNA, 16 nt, Mycobacterium leprae
cagucaguuuggcgcu

SEQ ID NO: 3225302 - RNA, 19 nt, Mycobacterium leprae
cagucaguuuggcgcugcu

SEQ ID NO: 3225303 - RNA, 20 nt, Mycobacterium leprae
cagucaguuuggcgcugcug

SEQ ID NO: 3225304 - RNA, 12 nt, Mycobacterium leprae
cagucaugaagc

SEQ ID NO: 3225305 - RNA, 15 nt, Mycobacterium leprae
cagucccuucgccga

SEQ ID NO: 3225306 - RNA, 20 nt, Mycobacterium leprae
cagucgaaggugagucgaca

SEQ ID NO: 3225307 - RNA, 22 nt, Mycobacterium leprae
cagucgccagagccggcggguu

SEQ ID NO: 3225308 - RNA, 19 nt, Mycobacterium leprae
cagucggaaccgcagcugc

SEQ ID NO: 3225309 - RNA, 20 nt, Mycobacterium leprae
cagucggaaccgcagcugcu

SEQ ID NO: 3225310 - RNA, 14 nt, Mycobacterium leprae
cagucggcaagacc

SEQ ID NO: 3225311 - RNA, 20 nt, Mycobacterium leprae
cagucggcacggguuggguu

SEQ ID NO: 3225312 - RNA, 16 nt, Mycobacterium leprae
cagucggcucaaccac

SEQ ID NO: 3225313 - RNA, 20 nt, Mycobacterium leprae
cagucggucugcucggcgaa

SEQ ID NO: 3225314 - RNA, 14 nt, Mycobacterium leprae
cagucguugacgau

SEQ ID NO: 3225315 - RNA, 15 nt, Mycobacterium leprae
cagucguugacgaua

SEQ ID NO: 3225316 - RNA, 16 nt, Mycobacterium leprae
caucggacugaagcuc

SEQ ID NO: 3225317 - RNA, 12 nt, Mycobacterium leprae
caucggcauccc

SEQ ID NO: 3225318 - RNA, 20 nt, Mycobacterium leprae
caucggcggccagcucagca

SEQ ID NO: 3225319 - RNA, 18 nt, Mycobacterium leprae
caucggcgugccuggccc

SEQ ID NO: 3225320 - RNA, 19 nt, Mycobacterium leprae
caucggcgugccuggccca

SEQ ID NO: 3225321 - RNA, 17 nt, Mycobacterium leprae
caucggcucccaucggc

SEQ ID NO: 3225322 - RNA, 14 nt, Mycobacterium leprae
caucggcugcaccg

SEQ ID NO: 3225323 - RNA, 17 nt, Mycobacterium leprae
caucggggcuacaaagc

SEQ ID NO: 3225324 - RNA, 15 nt, Mycobacterium leprae
caucgguaucggcau

SEQ ID NO: 3225325 - RNA, 13 nt, Mycobacterium leprae
caucggucggcgu

SEQ ID NO: 3225326 - RNA, 14 nt, Mycobacterium leprae
caucgguugugggc

SEQ ID NO: 3225327 - RNA, 20 nt, Mycobacterium leprae
caucguauagcacacgaccg

SEQ ID NO: 3225328 - RNA, 23 nt, Mycobacterium leprae
caucgucaacgaccugcaacgcu

SEQ ID NO: 3225329 - RNA, 19 nt, Mycobacterium leprae
caucgucggcccagggaug

SEQ ID NO: 3225330 - RNA, 21 nt, Mycobacterium leprae
caucgucgggugcgcagcaau

SEQ ID NO: 3225331 - RNA, 17 nt, Mycobacterium leprae
caucgugaggugugacc

SEQ ID NO: 3225332 - RNA, 22 nt, Mycobacterium leprae
caucuaaacugacgcugcgcug

SEQ ID NO: 3225333 - RNA, 15 nt, Mycobacterium leprae
caucuagcauuccuc

SEQ ID NO: 3225334 - RNA, 12 nt, Mycobacterium leprae
caucuauaguac

SEQ ID NO: 3225335 - RNA, 13 nt, Mycobacterium leprae
caucuaucuccac

SEQ ID NO: 3225336 - RNA, 18 nt, Mycobacterium leprae
caucuaugcuggccuugc

SEQ ID NO: 3225337 - RNA, 15 nt, Mycobacterium leprae
caucucgacaaccuc

SEQ ID NO: 3225338 - RNA, 18 nt, Mycobacterium leprae
caucugccgugcagcgac

SEQ ID NO: 3225339 - RNA, 15 nt, Mycobacterium leprae
caucugcucucagca

SEQ ID NO: 3225340 - RNA, 20 nt, Mycobacterium leprae
caucuggcgacucggcgcca

SEQ ID NO: 3225341 - RNA, 15 nt, Mycobacterium leprae
caucuucgcccagca

SEQ ID NO: 3225342 - RNA, 21 nt, Mycobacterium leprae
caucuugaccagugugccugu

SEQ ID NO: 3225343 - RNA, 22 nt, Mycobacterium leprae
caucuugaccagugugccuguc

SEQ ID NO: 3225344 - RNA, 18 nt, Mycobacterium leprae
caucuuguuggccggugc

SEQ ID NO: 3225345 - RNA, 15 nt, Mycobacterium leprae
caucuuuaaaggugg

SEQ ID NO: 3225346 - RNA, 13 nt, Mycobacterium leprae
caucuuuucucaa

SEQ ID NO: 3225347 - RNA, 20 nt, Mycobacterium leprae
caucuuuucucaagcgggca

SEQ ID NO: 3225348 - RNA, 15 nt, Mycobacterium leprae
caugaaccucaccca

SEQ ID NO: 3225349 - RNA, 17 nt, Mycobacterium leprae
caugaaccucacccagu

SEQ ID NO: 3225350 - RNA, 12 nt, Mycobacterium leprae
caugaauuacua

SEQ ID NO: 3225351 - RNA, 18 nt, Mycobacterium leprae
caugacaugcacacuaaa

SEQ ID NO: 3225352 - RNA, 14 nt, Mycobacterium leprae
caugaccgagcugg

SEQ ID NO: 3225353 - RNA, 18 nt, Mycobacterium leprae
caugacggcgcaguugac

SEQ ID NO: 3225354 - RNA, 14 nt, Mycobacterium leprae
caugacgggccgcg

SEQ ID NO: 3225355 - RNA, 19 nt, Mycobacterium leprae
caugagcgucgcuccuucu

SEQ ID NO: 3225356 - RNA, 16 nt, Mycobacterium leprae
caugaguuguuugcua

SEQ ID NO: 3225357 - RNA, 15 nt, Mycobacterium leprae
caugaucaauaccac

SEQ ID NO: 3225358 - RNA, 16 nt, Mycobacterium leprae
caugaucaauaccaca

SEQ ID NO: 3225359 - RNA, 16 nt, Mycobacterium leprae
caugauccagcuguca

SEQ ID NO: 3225360 - RNA, 17 nt, Mycobacterium leprae
caugauccguacaccaa

SEQ ID NO: 3225361 - RNA, 14 nt, Mycobacterium leprae
caugauucgagaaa

SEQ ID NO: 3225362 - RNA, 16 nt, Mycobacterium leprae
caugauugcagauguu

SEQ ID NO: 3225363 - RNA, 16 nt, Mycobacterium leprae
caugcaagaucaagac

SEQ ID NO: 3225364 - RNA, 14 nt, Mycobacterium leprae
caugcccaugccag

SEQ ID NO: 3225365 - RNA, 15 nt, Mycobacterium leprae
caugcccaugccagc

SEQ ID NO: 3225366 - RNA, 20 nt, Mycobacterium leprae
caugcccgggauggcugggc

SEQ ID NO: 3225367 - RNA, 16 nt, Mycobacterium leprae
caugcccugggccagc

SEQ ID NO: 3225368 - RNA, 20 nt, Mycobacterium leprae
caugccgaguucggaugcgg

SEQ ID NO: 3225369 - RNA, 21 nt, Mycobacterium leprae
caugccgaucagccgcaacaa

SEQ ID NO: 3225370 - RNA, 18 nt, Mycobacterium leprae
caugccgccgaagccgcg

SEQ ID NO: 3225371 - RNA, 17 nt, Mycobacterium leprae
caugcgccuccagcucg

SEQ ID NO: 3225372 - RNA, 22 nt, Mycobacterium leprae
caugcgcugaggcagcagcucg

SEQ ID NO: 3225373 - RNA, 14 nt, Mycobacterium leprae
caugcugccgucga

SEQ ID NO: 3225374 - RNA, 23 nt, Mycobacterium leprae
caugcugccgucgaucucggugc

SEQ ID NO: 3225375 - RNA, 15 nt, Mycobacterium leprae
caugcugcgcagagc

SEQ ID NO: 3225376 - RNA, 16 nt, Mycobacterium leprae
caugcuggccuccagu

SEQ ID NO: 3225377 - RNA, 20 nt, Mycobacterium leprae
caugcuuacgugcgccgcgc

SEQ ID NO: 3225378 - RNA, 18 nt, Mycobacterium leprae
caugcuugucaugcggaa

SEQ ID NO: 3225379 - RNA, 15 nt, Mycobacterium leprae
cauggaaucguugac

SEQ ID NO: 3225380 - RNA, 21 nt, Mycobacterium leprae
cauggacaaccugggcggcau

SEQ ID NO: 3225381 - RNA, 21 nt, Mycobacterium leprae
cauggacgauaucgcuaaggc

SEQ ID NO: 3225382 - RNA, 18 nt, Mycobacterium leprae
cauggagguucuggguag

SEQ ID NO: 3225383 - RNA, 13 nt, Mycobacterium leprae
cauggauuaccua

SEQ ID NO: 3225384 - RNA, 13 nt, Mycobacterium leprae
cauggcagccgau

SEQ ID NO: 3225385 - RNA, 16 nt, Mycobacterium leprae
cauggcaguccacagg

SEQ ID NO: 3225386 - RNA, 18 nt, Mycobacterium leprae
cauggcgaugcgcagccg

SEQ ID NO: 3225387 - RNA, 23 nt, Mycobacterium leprae
cauggcgcugguuguucaugcuc

SEQ ID NO: 3225388 - RNA, 22 nt, Mycobacterium leprae
caugguagugcacacggccgug

SEQ ID NO: 3225389 - RNA, 16 nt, Mycobacterium leprae
cauggucgucgcugcu

SEQ ID NO: 3225390 - RNA, 17 nt, Mycobacterium leprae
cauggugcggcgccgcc

SEQ ID NO: 3225391 - RNA, 21 nt, Mycobacterium leprae
caugucaugaacguagccguc

SEQ ID NO: 3225392 - RNA, 15 nt, Mycobacterium leprae
caugucccggugcug

SEQ ID NO: 3225393 - RNA, 18 nt, Mycobacterium leprae
caugucgaacaaccgaac

SEQ ID NO: 3225394 - RNA, 16 nt, Mycobacterium leprae
caugucggccacugca

SEQ ID NO: 3225395 - RNA, 15 nt, Mycobacterium leprae
caugucgguggugga

SEQ ID NO: 3225396 - RNA, 21 nt, Mycobacterium leprae
caugugaccgcggugcagugc

SEQ ID NO: 3225397 - RNA, 21 nt, Mycobacterium leprae
caugugcauccagucguugac

SEQ ID NO: 3225398 - RNA, 14 nt, Mycobacterium leprae
caugugcgcacugg

SEQ ID NO: 3225399 - RNA, 15 nt, Mycobacterium leprae
cauguuaaaauaaac

SEQ ID NO: 3225400 - RNA, 17 nt, Mycobacterium leprae
cauguucaucacgggug

SEQ ID NO: 3225401 - RNA, 13 nt, Mycobacterium leprae
cauguuccgcuga

SEQ ID NO: 3225402 - RNA, 14 nt, Mycobacterium leprae
cauuaucgcaugug

SEQ ID NO: 3225403 - RNA, 19 nt, Mycobacterium leprae
cauuaucgcaugugauacu

SEQ ID NO: 3225404 - RNA, 16 nt, Mycobacterium leprae
cauuauggggguggga

SEQ ID NO: 3225405 - RNA, 19 nt, Mycobacterium leprae
cauuauugucggucugccu

SEQ ID NO: 3225406 - RNA, 23 nt, Mycobacterium leprae
cauuauuucgucgucagcugcug

SEQ ID NO: 3225407 - RNA, 21 nt, Mycobacterium leprae
cauucaccaguaaccacgcau

SEQ ID NO: 3225408 - RNA, 19 nt, Mycobacterium leprae
cauucagccgcgaauggac

SEQ ID NO: 3225409 - RNA, 18 nt, Mycobacterium leprae
cauucaggaaaauacuac

SEQ ID NO: 3225410 - RNA, 19 nt, Mycobacterium leprae
cauucgccguccacuggcu

SEQ ID NO: 3225411 - RNA, 14 nt, Mycobacterium leprae
cauucuccugucac

SEQ ID NO: 3225412 - RNA, 15 nt, Mycobacterium leprae
cauugaucgcucgug

SEQ ID NO: 3225413 - RNA, 19 nt, Mycobacterium leprae
cauugcaagggacauccgc

SEQ ID NO: 3225414 - RNA, 16 nt, Mycobacterium leprae
cauugcuucgaggcau

SEQ ID NO: 3225415 - RNA, 18 nt, Mycobacterium leprae
cauuggacccagccgucg

SEQ ID NO: 3225416 - RNA, 22 nt, Mycobacterium leprae
cauuggccgcugguagguguuc

SEQ ID NO: 3225417 - RNA, 23 nt, Mycobacterium leprae
cauuggccgcugguagguguucu

SEQ ID NO: 3225418 - RNA, 15 nt, Mycobacterium leprae
cauuggcucgacauu

SEQ ID NO: 3225419 - RNA, 17 nt, Mycobacterium leprae
cauuggucggggugcug

SEQ ID NO: 3225420 - RNA, 15 nt, Mycobacterium leprae
cauuggugggaugag

SEQ ID NO: 3225421 - RNA, 20 nt, Mycobacterium leprae
cauuucaccucuguugugau

SEQ ID NO: 3225422 - RNA, 21 nt, Mycobacterium leprae
cauuuccggaacaacagacac

SEQ ID NO: 3225423 - RNA, 14 nt, Mycobacterium leprae
cauuugcgcggcgu

SEQ ID NO: 3225424 - RNA, 23 nt, Mycobacterium leprae
cauuugcgcggcguaaacguuga

SEQ ID NO: 3225425 - RNA, 21 nt, Mycobacterium leprae
cauuuguggcgauacgcgcuu

SEQ ID NO: 3225426 - RNA, 22 nt, Mycobacterium leprae
cauuuuagcuuauacugcugcg

SEQ ID NO: 3225427 - RNA, 19 nt, Mycobacterium leprae
cauuuucguaucaaaacua

SEQ ID NO: 3225428 - RNA, 15 nt, Mycobacterium leprae
cauuuuucuugaaaa

SEQ ID NO: 3225429 - RNA, 22 nt, Mycobacterium leprae
ccagccccucgacaaccucguu

SEQ ID NO: 3225430 - RNA, 19 nt, Mycobacterium leprae
ccagccccuggcaucauca

SEQ ID NO: 3225431 - RNA, 18 nt, Mycobacterium leprae
ccagcgacacagccggcc

SEQ ID NO: 3225432 - RNA, 13 nt, Mycobacterium leprae
ccagcgacuggcu

SEQ ID NO: 3225433 - RNA, 19 nt, Mycobacterium leprae
ccagcgauaucaagcugcg

SEQ ID NO: 3225434 - RNA, 19 nt, Mycobacterium leprae
ccagcgaucgacccaagca

SEQ ID NO: 3225435 - RNA, 21 nt, Mycobacterium leprae
ccagcgaucuaccucgccaac

SEQ ID NO: 3225436 - RNA, 11 nt, Mycobacterium leprae
ccagcgcaccc

SEQ ID NO: 3225437 - RNA, 14 nt, Mycobacterium leprae
ccagcgcagcccgc

SEQ ID NO: 3225438 - RNA, 15 nt, Mycobacterium leprae
ccagcgcaucagcca

SEQ ID NO: 3225439 - RNA, 21 nt, Mycobacterium leprae
ccagcgcuaaaucuggccaac

SEQ ID NO: 3225440 - RNA, 16 nt, Mycobacterium leprae
ccagcgguaacuggcu

SEQ ID NO: 3225441 - RNA, 15 nt, Mycobacterium leprae
ccagcguaaucgcuu

SEQ ID NO: 3225442 - RNA, 21 nt, Mycobacterium leprae
ccagcgucgcucacggccacc

SEQ ID NO: 3225443 - RNA, 16 nt, Mycobacterium leprae
ccagcgugugaugugu

SEQ ID NO: 3225444 - RNA, 18 nt, Mycobacterium leprae
ccagcgugugauguguau

SEQ ID NO: 3225445 - RNA, 13 nt, Mycobacterium leprae
ccagcuagggaug

SEQ ID NO: 3225446 - RNA, 14 nt, Mycobacterium leprae
ccagcucacccgca

SEQ ID NO: 3225447 - RNA, 20 nt, Mycobacterium leprae
ccagcucacccgcagcaccu

SEQ ID NO: 3225448 - RNA, 14 nt, Mycobacterium leprae
ccagcuucgcagac

SEQ ID NO: 3225449 - RNA, 18 nt, Mycobacterium leprae
ccagcuucgcagacacag

SEQ ID NO: 3225450 - RNA, 23 nt, Mycobacterium leprae
ccagcuuggcacgccgguaugug

SEQ ID NO: 3225451 - RNA, 12 nt, Mycobacterium leprae
ccagcuugggag

SEQ ID NO: 3225452 - RNA, 19 nt, Mycobacterium leprae
ccagcuuucgcacccagca

SEQ ID NO: 3225453 - RNA, 13 nt, Mycobacterium leprae
ccaggcagcgccu

SEQ ID NO: 3225454 - RNA, 12 nt, Mycobacterium leprae
ccaggcgacguc

SEQ ID NO: 3225455 - RNA, 22 nt, Mycobacterium leprae
ccaggcgccgcagcaucugucg

SEQ ID NO: 3225456 - RNA, 21 nt, Mycobacterium leprae
ccagggaagugacgccacagu

SEQ ID NO: 3225457 - RNA, 14 nt, Mycobacterium leprae
ccagggcgccgauu

SEQ ID NO: 3225458 - RNA, 17 nt, Mycobacterium leprae
ccagggcguggucgagg

SEQ ID NO: 3225459 - RNA, 19 nt, Mycobacterium leprae
ccagggucauuacucacga

SEQ ID NO: 3225460 - RNA, 17 nt, Mycobacterium leprae
ccagggucggccgggcu

SEQ ID NO: 3225461 - RNA, 22 nt, Mycobacterium leprae
ccaggucaucuaaacugacgcu

SEQ ID NO: 3225462 - RNA, 13 nt, Mycobacterium leprae
ccaggugaagccg

SEQ ID NO: 3225463 - RNA, 14 nt, Mycobacterium leprae
ccaguaaugugcua

SEQ ID NO: 3225464 - RNA, 13 nt, Mycobacterium leprae
ccaguaggcacca

SEQ ID NO: 3225465 - RNA, 23 nt, Mycobacterium leprae
ccaguaggcaccacgcacacgac

SEQ ID NO: 3225466 - RNA, 21 nt, Mycobacterium leprae
ccagucagccgucgagccgau

SEQ ID NO: 3225467 - RNA, 16 nt, Mycobacterium leprae
ccagucgaaggugagu

SEQ ID NO: 3225468 - RNA, 18 nt, Mycobacterium leprae
ccagucgagauaguccga

SEQ ID NO: 3225469 - RNA, 14 nt, Mycobacterium leprae
ccagucgcagggcg

SEQ ID NO: 3225470 - RNA, 13 nt, Mycobacterium leprae
ccagugcacugag

SEQ ID NO: 3225471 - RNA, 15 nt, Mycobacterium leprae
ccagugcacugagca

SEQ ID NO: 3225472 - RNA, 21 nt, Mycobacterium leprae
ccagugcggcgauccagcgaa

SEQ ID NO: 3225473 - RNA, 15 nt, Mycobacterium leprae
ccaguggcugcaccg

SEQ ID NO: 3225474 - RNA, 19 nt, Mycobacterium leprae
ccaguggcugcaccggcuc

SEQ ID NO: 3225475 - RNA, 14 nt, Mycobacterium leprae
ccaguggcuuuaaa

SEQ ID NO: 3225476 - RNA, 15 nt, Mycobacterium leprae
ccagugugccagcgc

SEQ ID NO: 3225477 - RNA, 18 nt, Mycobacterium leprae
ccagugugccugucacau

SEQ ID NO: 3225478 - RNA, 17 nt, Mycobacterium leprae
ccaguuuugugggcagg

SEQ ID NO: 3225479 - RNA, 14 nt, Mycobacterium leprae
ccauaaugcagcgg

SEQ ID NO: 3225480 - RNA, 20 nt, Mycobacterium leprae
ccauagcacccucacccgac

SEQ ID NO: 3225481 - RNA, 22 nt, Mycobacterium leprae
ccauauaagcgaaguccuugcu

SEQ ID NO: 3225482 - RNA, 18 nt, Mycobacterium leprae
ccauauacaaaccccaga

SEQ ID NO: 3225483 - RNA, 19 nt, Mycobacterium leprae
ccauauacaaaccccagac

SEQ ID NO: 3225484 - RNA, 17 nt, Mycobacterium leprae
ccauauagcgucccagc

SEQ ID NO: 3225485 - RNA, 18 nt, Mycobacterium leprae
ccaucaacggcuacaaca

SEQ ID NO: 3225486 - RNA, 14 nt, Mycobacterium leprae
ccaucaauucgcug

SEQ ID NO: 3225487 - RNA, 21 nt, Mycobacterium leprae
ccaucagauccgguggcgaca

SEQ ID NO: 3225488 - RNA, 14 nt, Mycobacterium leprae
ccauccaacgugac

SEQ ID NO: 3225489 - RNA, 21 nt, Mycobacterium leprae
ccauccauuuauuccagagca

SEQ ID NO: 3225490 - RNA, 20 nt, Mycobacterium leprae
ccauccgaucaauggcagcc

SEQ ID NO: 3225491 - RNA, 15 nt, Mycobacterium leprae
ccauccgggccaguc

SEQ ID NO: 3225492 - RNA, 22 nt, Mycobacterium leprae
ccauccgguuguguuguuggca

SEQ ID NO: 3225493 - RNA, 16 nt, Mycobacterium leprae
ccaucgaauccucgau

SEQ ID NO: 3225494 - RNA, 12 nt, Mycobacterium leprae
ccaucggacaag

SEQ ID NO: 3225495 - RNA, 22 nt, Mycobacterium leprae
ccaucggcagaucgaucucgac

SEQ ID NO: 3225496 - RNA, 23 nt, Mycobacterium leprae
ccaucggcagaucgaucucgacg

SEQ ID NO: 3225497 - RNA, 16 nt, Mycobacterium leprae
ccaucggcggccagcu

SEQ ID NO: 3225498 - RNA, 14 nt, Mycobacterium leprae
ccaucggcugcacc

SEQ ID NO: 3225499 - RNA, 15 nt, Mycobacterium leprae
ccaucggcugcaccg

SEQ ID NO: 3225500 - RNA, 20 nt, Mycobacterium leprae
ccaucuaacccgcaaaccaa

SEQ ID NO: 3225501 - RNA, 22 nt, Mycobacterium leprae
ccaucuaacccgcaaaccaaac

SEQ ID NO: 3225502 - RNA, 19 nt, Mycobacterium leprae
ccaucucaucuugaccagu

SEQ ID NO: 3225503 - RNA, 15 nt, Mycobacterium leprae
ccaucucuauuuggu

SEQ ID NO: 3225504 - RNA, 19 nt, Mycobacterium leprae
ccaucugcucucagcacau

SEQ ID NO: 3225505 - RNA, 17 nt, Mycobacterium leprae
ccaucuggcgacucggc

SEQ ID NO: 3225506 - RNA, 22 nt, Mycobacterium leprae
ccaucuggcgacucggcgccau

SEQ ID NO: 3225507 - RNA, 20 nt, Mycobacterium leprae
ccaucuuguuggccggugcu

SEQ ID NO: 3225508 - RNA, 23 nt, Mycobacterium leprae
ccaugacaugacgccugggaacc

SEQ ID NO: 3225509 - RNA, 14 nt, Mycobacterium leprae
ccaugaucuucuga

SEQ ID NO: 3225510 - RNA, 18 nt, Mycobacterium leprae
ccaugcaaccacacccug

SEQ ID NO: 3225511 - RNA, 20 nt, Mycobacterium leprae
ccaugcagucgcucaggcua

SEQ ID NO: 3225512 - RNA, 17 nt, Mycobacterium leprae
ccaugccgccgaagccg

SEQ ID NO: 3225513 - RNA, 23 nt, Mycobacterium leprae
ccaugccucuagcaaggcgcggu

SEQ ID NO: 3225514 - RNA, 16 nt, Mycobacterium leprae
ccaugcggcggacgau

SEQ ID NO: 3225515 - RNA, 14 nt, Mycobacterium leprae
ccauggcagccgau

SEQ ID NO: 3225516 - RNA, 14 nt, Mycobacterium leprae
ccauggcagucuug

SEQ ID NO: 3225517 - RNA, 20 nt, Mycobacterium leprae
ccauggucgucgcugcuucc

SEQ ID NO: 3225518 - RNA, 17 nt, Mycobacterium leprae
ccaugucuaagacacuu

SEQ ID NO: 3225519 - RNA, 13 nt, Mycobacterium leprae
ccaugucuaccug

SEQ ID NO: 3225520 - RNA, 18 nt, Mycobacterium leprae
ccaugugaccgcggugca

SEQ ID NO: 3225521 - RNA, 18 nt, Mycobacterium leprae
ccaugugcugacagacau

SEQ ID NO: 3225522 - RNA, 21 nt, Mycobacterium leprae
ccauuauuucgucgucagcug

SEQ ID NO: 3225523 - RNA, 22 nt, Mycobacterium leprae
ccauuauuucgucgucagcugc

SEQ ID NO: 3225524 - RNA, 19 nt, Mycobacterium leprae
ccauucggaaucgcgugcu

SEQ ID NO: 3225525 - RNA, 13 nt, Mycobacterium leprae
ccauugaccucuu

SEQ ID NO: 3225526 - RNA, 22 nt, Mycobacterium leprae
ccauugccagcguaaacgugau

SEQ ID NO: 3225527 - RNA, 13 nt, Mycobacterium leprae
ccauuggcucgac

SEQ ID NO: 3225528 - RNA, 19 nt, Mycobacterium leprae
ccauuguugugcugggcgg

SEQ ID NO: 3225529 - RNA, 13 nt, Mycobacterium leprae
cccaacugguuga

SEQ ID NO: 3225530 - RNA, 12 nt, Mycobacterium leprae
cccaaugcagca

SEQ ID NO: 3225531 - RNA, 18 nt, Mycobacterium leprae
cccaauggcggaggcugg

SEQ ID NO: 3225532 - RNA, 21 nt, Mycobacterium leprae
cccaauucgacugcaacucga

SEQ ID NO: 3225533 - RNA, 23 nt, Mycobacterium leprae
cccaccggcggcuggugcggcgg

SEQ ID NO: 3225534 - RNA, 19 nt, Mycobacterium leprae
cccaccgugcauccugcgu

SEQ ID NO: 3225535 - RNA, 15 nt, Mycobacterium leprae
cccacgacaucuuga

SEQ ID NO: 3225536 - RNA, 21 nt, Mycobacterium leprae
cccacgagaaugucgcacccu

SEQ ID NO: 3225537 - RNA, 12 nt, Mycobacterium leprae
cccacgaggacc

SEQ ID NO: 3225538 - RNA, 21 nt, Mycobacterium leprae
cccacucuugacuaaagucau

SEQ ID NO: 3225539 - RNA, 15 nt, Mycobacterium leprae
cccacugggcaagca

SEQ ID NO: 3225540 - RNA, 15 nt, Mycobacterium leprae
cccacuugggcaaca

SEQ ID NO: 3225541 - RNA, 16 nt, Mycobacterium leprae
cccagaaccaucccaa

SEQ ID NO: 3225542 - RNA, 22 nt, Mycobacterium leprae
ccgaccgaaagccgcaccaggu

SEQ ID NO: 3225543 - RNA, 22 nt, Mycobacterium leprae
ccgaccgcccgguagcaccaag

SEQ ID NO: 3225544 - RNA, 17 nt, Mycobacterium leprae
ccgaccucggcgcuggg

SEQ ID NO: 3225545 - RNA, 13 nt, Mycobacterium leprae
ccgacgaaggugg

SEQ ID NO: 3225546 - RNA, 16 nt, Mycobacterium leprae
ccgacgcaacugcugg

SEQ ID NO: 3225547 - RNA, 21 nt, Mycobacterium leprae
ccgacgcuauguuggccagca

SEQ ID NO: 3225548 - RNA, 14 nt, Mycobacterium leprae
ccgacggaugccca

SEQ ID NO: 3225549 - RNA, 12 nt, Mycobacterium leprae
ccgacggcgccg

SEQ ID NO: 3225550 - RNA, 16 nt, Mycobacterium leprae
ccgacggcgccgcaca

SEQ ID NO: 3225551 - RNA, 18 nt, Mycobacterium leprae
ccgacggcgccgcacagc

SEQ ID NO: 3225552 - RNA, 13 nt, Mycobacterium leprae
ccgacgucuucaa

SEQ ID NO: 3225553 - RNA, 17 nt, Mycobacterium leprae
ccgacgucuucaauacc

SEQ ID NO: 3225554 - RNA, 14 nt, Mycobacterium leprae
ccgacucaccggua

SEQ ID NO: 3225555 - RNA, 19 nt, Mycobacterium leprae
ccgacucgcgaucccacgc

SEQ ID NO: 3225556 - RNA, 15 nt, Mycobacterium leprae
ccgacuggugggcgc

SEQ ID NO: 3225557 - RNA, 18 nt, Mycobacterium leprae
ccgagaaaacucgaucga

SEQ ID NO: 3225558 - RNA, 21 nt, Mycobacterium leprae
ccgagaaaacucgaucgaggu

SEQ ID NO: 3225559 - RNA, 16 nt, Mycobacterium leprae
ccgagacguugcuggg

SEQ ID NO: 3225560 - RNA, 22 nt, Mycobacterium leprae
ccgagaucacaguccugcccgg

SEQ ID NO: 3225561 - RNA, 17 nt, Mycobacterium leprae
ccgagccgcaggucuca

SEQ ID NO: 3225562 - RNA, 15 nt, Mycobacterium leprae
ccgagccggucgauc

SEQ ID NO: 3225563 - RNA, 15 nt, Mycobacterium leprae
ccgagcgcagcaagc

SEQ ID NO: 3225564 - RNA, 17 nt, Mycobacterium leprae
ccgagcguaccaggucg

SEQ ID NO: 3225565 - RNA, 20 nt, Mycobacterium leprae
ccgagcguacuggugauaaa

SEQ ID NO: 3225566 - RNA, 17 nt, Mycobacterium leprae
ccgagcucuggucuggu

SEQ ID NO: 3225567 - RNA, 15 nt, Mycobacterium leprae
ccgaggggccgucgg

SEQ ID NO: 3225568 - RNA, 19 nt, Mycobacterium leprae
ccgaggggccgucggcaac

SEQ ID NO: 3225569 - RNA, 14 nt, Mycobacterium leprae
ccgaggugggcccc

SEQ ID NO: 3225570 - RNA, 19 nt, Mycobacterium leprae
ccgagucucuggugcgcca

SEQ ID NO: 3225571 - RNA, 15 nt, Mycobacterium leprae
ccgaguuuuuguucc

SEQ ID NO: 3225572 - RNA, 21 nt, Mycobacterium leprae
ccgauaucgaccagccaagcc

SEQ ID NO: 3225573 - RNA, 16 nt, Mycobacterium leprae
ccgaucagccgcaaca

SEQ ID NO: 3225574 - RNA, 16 nt, Mycobacterium leprae
ccgaucccaaguggaa

SEQ ID NO: 3225575 - RNA, 12 nt, Mycobacterium leprae
ccgaucccagga

SEQ ID NO: 3225576 - RNA, 13 nt, Mycobacterium leprae
ccgaucccgaaag

SEQ ID NO: 3225577 - RNA, 24 nt, Mycobacterium leprae
ccgauccggcggccggcaagaagu

SEQ ID NO: 3225578 - RNA, 12 nt, Mycobacterium leprae
ccgaucgacaua

SEQ ID NO: 3225579 - RNA, 14 nt, Mycobacterium leprae
ccgaucgacauagu

SEQ ID NO: 3225580 - RNA, 16 nt, Mycobacterium leprae
ccgaucgcaccggcug

SEQ ID NO: 3225581 - RNA, 14 nt, Mycobacterium leprae
ccgaucgcccgccc

SEQ ID NO: 3225582 - RNA, 13 nt, Mycobacterium leprae
ccgaucgugugca

SEQ ID NO: 3225583 - RNA, 15 nt, Mycobacterium leprae
ccgaugauggccgac

SEQ ID NO: 3225584 - RNA, 17 nt, Mycobacterium leprae
ccgaugcagcugguggu

SEQ ID NO: 3225585 - RNA, 17 nt, Mycobacterium leprae
ccgaugcagggccagcc

SEQ ID NO: 3225586 - RNA, 22 nt, Mycobacterium leprae
ccgaugcgcuguuggguucggu

SEQ ID NO: 3225587 - RNA, 12 nt, Mycobacterium leprae
ccgauuccaccu

SEQ ID NO: 3225588 - RNA, 13 nt, Mycobacterium leprae
ccgauuuggaugg

SEQ ID NO: 3225589 - RNA, 15 nt, Mycobacterium leprae
ccgauuuucgauccg

SEQ ID NO: 3225590 - RNA, 20 nt, Mycobacterium leprae
ccgcaagugcguuggauccc

SEQ ID NO: 3225591 - RNA, 16 nt, Mycobacterium leprae
ccgcacagagcccagc

SEQ ID NO: 3225592 - RNA, 17 nt, Mycobacterium leprae
ccgcacagcaccaugga

SEQ ID NO: 3225593 - RNA, 19 nt, Mycobacterium leprae
ccgcacaguuaccacgacg

SEQ ID NO: 3225594 - RNA, 13 nt, Mycobacterium leprae
ccgcacccggcag

SEQ ID NO: 3225595 - RNA, 14 nt, Mycobacterium leprae
ccgcacccggcagc

SEQ ID NO: 3225596 - RNA, 14 nt, Mycobacterium leprae
ccgcaccgaucugc

SEQ ID NO: 3225597 - RNA, 19 nt, Mycobacterium leprae
ccgcaccugaacaggcacg

SEQ ID NO: 3225598 - RNA, 20 nt, Mycobacterium leprae
ccgcacgggaggcguugcac

SEQ ID NO: 3225599 - RNA, 14 nt, Mycobacterium leprae
ccgcagcaucggca

SEQ ID NO: 3225600 - RNA, 14 nt, Mycobacterium leprae
ccgcaggcaccauu

SEQ ID NO: 3225601 - RNA, 14 nt, Mycobacterium leprae
ccgcagucgguuga

SEQ ID NO: 3225602 - RNA, 19 nt, Mycobacterium leprae
ccgcauaccaugacaugac

SEQ ID NO: 3225603 - RNA, 19 nt, Mycobacterium leprae
ccgcauacuggcacgccag

SEQ ID NO: 3225604 - RNA, 11 nt, Mycobacterium leprae
ccgcaucaccg

SEQ ID NO: 3225605 - RNA, 23 nt, Mycobacterium leprae
ccgcaucguugucggcuccucca

SEQ ID NO: 3225606 - RNA, 22 nt, Mycobacterium leprae
ccgcaucuucgcccagcacgca

SEQ ID NO: 3225607 - RNA, 18 nt, Mycobacterium leprae
ccgccacagcaagucgcc

SEQ ID NO: 3225608 - RNA, 15 nt, Mycobacterium leprae
ccgccaccagaucca

SEQ ID NO: 3225609 - RNA, 12 nt, Mycobacterium leprae
ccgccacgacca

SEQ ID NO: 3225610 - RNA, 16 nt, Mycobacterium leprae
ccgccagaccggcgau

SEQ ID NO: 3225611 - RNA, 16 nt, Mycobacterium leprae
ccgccagacuggccgg

SEQ ID NO: 3225612 - RNA, 17 nt, Mycobacterium leprae
ccgccagaugccgaucu

SEQ ID NO: 3225613 - RNA, 22 nt, Mycobacterium leprae
ccgccagcgacaccaccacggu

SEQ ID NO: 3225614 - RNA, 18 nt, Mycobacterium leprae
ccgccagcgucaucgucu

SEQ ID NO: 3225615 - RNA, 22 nt, Mycobacterium leprae
ccgccagggcggcauucccaac

SEQ ID NO: 3225616 - RNA, 23 nt, Mycobacterium leprae
ccgccagucgcagggcgcgcagc

SEQ ID NO: 3225617 - RNA, 12 nt, Mycobacterium leprae
ccgccaucucug

SEQ ID NO: 3225618 - RNA, 16 nt, Mycobacterium leprae
ccgcccaagaaggucc

SEQ ID NO: 3225619 - RNA, 14 nt, Mycobacterium leprae
ccgccgaagcagcc

SEQ ID NO: 3225620 - RNA, 19 nt, Mycobacterium leprae
ccgccgaagccgcgcaucu

SEQ ID NO: 3225621 - RNA, 15 nt, Mycobacterium leprae
ccgccgagcgcacca

SEQ ID NO: 3225622 - RNA, 16 nt, Mycobacterium leprae
ccgccgagcgcaccaa

SEQ ID NO: 3225623 - RNA, 12 nt, Mycobacterium leprae
ccgccgaucggu

SEQ ID NO: 3225624 - RNA, 19 nt, Mycobacterium leprae
ccgccgcggcgggcaagcc

SEQ ID NO: 3225625 - RNA, 12 nt, Mycobacterium leprae
ccgccggccgca

SEQ ID NO: 3225626 - RNA, 22 nt, Mycobacterium leprae
ccgccggcgucaggccaggcag

SEQ ID NO: 3225627 - RNA, 15 nt, Mycobacterium leprae
ccgccgggugcagca

SEQ ID NO: 3225628 - RNA, 22 nt, Mycobacterium leprae
ccgccggucaucgcuucguggu

SEQ ID NO: 3225629 - RNA, 16 nt, Mycobacterium leprae
ccgccucaggguacga

SEQ ID NO: 3225630 - RNA, 23 nt, Mycobacterium leprae
ccgccucgaucagcaacacuggc

SEQ ID NO: 3225631 - RNA, 17 nt, Mycobacterium leprae
ccgccuucacgaaugcc

SEQ ID NO: 3225632 - RNA, 16 nt, Mycobacterium leprae
ccgccuugucggcaau

SEQ ID NO: 3225633 - RNA, 19 nt, Mycobacterium leprae
ccgccuugucggcaauguc

SEQ ID NO: 3225634 - RNA, 17 nt, Mycobacterium leprae
ccgcgaagauugacaaa

SEQ ID NO: 3225635 - RNA, 18 nt, Mycobacterium leprae
ccgcgaagcugaccacuc

SEQ ID NO: 3225636 - RNA, 13 nt, Mycobacterium leprae
ccgcgacaguccg

SEQ ID NO: 3225637 - RNA, 21 nt, Mycobacterium leprae
ccgcgauuuagguucggggcu

SEQ ID NO: 3225638 - RNA, 13 nt, Mycobacterium leprae
ccgcgcacagugu

SEQ ID NO: 3225639 - RNA, 17 nt, Mycobacterium leprae
ccgcgcaucaucgccca

SEQ ID NO: 3225640 - RNA, 17 nt, Mycobacterium leprae
ccgcgccgccugcugca

SEQ ID NO: 3225641 - RNA, 20 nt, Mycobacterium leprae
ccgcgcgcaagucuggaguc

SEQ ID NO: 3225642 - RNA, 13 nt, Mycobacterium leprae
ccgcgcgugcaca

SEQ ID NO: 3225643 - RNA, 21 nt, Mycobacterium leprae
ccgcgcuagcgauguagccaa

SEQ ID NO: 3225644 - RNA, 22 nt, Mycobacterium leprae
ccgcgcuagcgauguagccaac

SEQ ID NO: 3225645 - RNA, 16 nt, Mycobacterium leprae
ccgcggauuccagagc

SEQ ID NO: 3225646 - RNA, 11 nt, Mycobacterium leprae
ccgcggcggcc

SEQ ID NO: 3225647 - RNA, 17 nt, Mycobacterium leprae
ccgcggcugggcagccg

SEQ ID NO: 3225648 - RNA, 17 nt, Mycobacterium leprae
ccgcgguagauaucuac

SEQ ID NO: 3225649 - RNA, 15 nt, Mycobacterium leprae
ccgcggucaaugguc

SEQ ID NO: 3225650 - RNA, 20 nt, Mycobacterium leprae
ccgcggugagcggucgcagc

SEQ ID NO: 3225651 - RNA, 15 nt, Mycobacterium leprae
ccgcgguggcgugcu

SEQ ID NO: 3225652 - RNA, 23 nt, Mycobacterium leprae
ccgcgucggcgucgacaucaccg

SEQ ID NO: 3225653 - RNA, 14 nt, Mycobacterium leprae
ccgcguugcggcgc

SEQ ID NO: 3225654 - RNA, 14 nt, Mycobacterium leprae
ccgcuaaggcagcc

SEQ ID NO: 3225655 - RNA, 14 nt, Mycobacterium leprae
ccgcucaaagccug

SEQ ID NO: 3225656 - RNA, 22 nt, Mycobacterium leprae
ccgucuuuauucuuuuagagaa

SEQ ID NO: 3225657 - RNA, 15 nt, Mycobacterium leprae
ccgugaccgacagcu

SEQ ID NO: 3225658 - RNA, 13 nt, Mycobacterium leprae
ccgugacucaaca

SEQ ID NO: 3225659 - RNA, 16 nt, Mycobacterium leprae
ccgugacucaacauaa

SEQ ID NO: 3225660 - RNA, 19 nt, Mycobacterium leprae
ccgugaggucgaagcugcc

SEQ ID NO: 3225661 - RNA, 21 nt, Mycobacterium leprae
ccgugaggucgaagcugcccu

SEQ ID NO: 3225662 - RNA, 20 nt, Mycobacterium leprae
ccgugcagcgaccucaugcc

SEQ ID NO: 3225663 - RNA, 20 nt, Mycobacterium leprae
ccgugcagcugccaaccggu

SEQ ID NO: 3225664 - RNA, 13 nt, Mycobacterium leprae
ccgugccaacacu

SEQ ID NO: 3225665 - RNA, 17 nt, Mycobacterium leprae
ccgugcccaagacucag

SEQ ID NO: 3225666 - RNA, 17 nt, Mycobacterium leprae
ccguggaggugcggcug

SEQ ID NO: 3225667 - RNA, 15 nt, Mycobacterium leprae
ccgugucgucuuccg

SEQ ID NO: 3225668 - RNA, 18 nt, Mycobacterium leprae
ccgugugaacuugaaacc

SEQ ID NO: 3225669 - RNA, 19 nt, Mycobacterium leprae
ccguuauccacagcaucaa

SEQ ID NO: 3225670 - RNA, 12 nt, Mycobacterium leprae
ccguucaguggc

SEQ ID NO: 3225671 - RNA, 14 nt, Mycobacterium leprae
ccguucucccgcca

SEQ ID NO: 3225672 - RNA, 22 nt, Mycobacterium leprae
ccguucucgcgcaggucacccu

SEQ ID NO: 3225673 - RNA, 16 nt, Mycobacterium leprae
ccguugacguggugau

SEQ ID NO: 3225674 - RNA, 15 nt, Mycobacterium leprae
ccguugagcugcaug

SEQ ID NO: 3225675 - RNA, 21 nt, Mycobacterium leprae
ccguugcuaacgcuuaaccau

SEQ ID NO: 3225676 - RNA, 16 nt, Mycobacterium leprae
ccguuggggucgugca

SEQ ID NO: 3225677 - RNA, 19 nt, Mycobacterium leprae
ccguugucaagcacugcag

SEQ ID NO: 3225678 - RNA, 18 nt, Mycobacterium leprae
ccguugucccgcccggcc

SEQ ID NO: 3225679 - RNA, 18 nt, Mycobacterium leprae
ccguuguggucggacgau

SEQ ID NO: 3225680 - RNA, 18 nt, Mycobacterium leprae
ccguuucgcggggggauc

SEQ ID NO: 3225681 - RNA, 17 nt, Mycobacterium leprae
ccuacaacuucaaccaa

SEQ ID NO: 3225682 - RNA, 13 nt, Mycobacterium leprae
ccuacagcagugu

SEQ ID NO: 3225683 - RNA, 13 nt, Mycobacterium leprae
ccuaccccgcggc

SEQ ID NO: 3225684 - RNA, 16 nt, Mycobacterium leprae
ccuacccucucagcaa

SEQ ID NO: 3225685 - RNA, 15 nt, Mycobacterium leprae
ccuaccgcaucggca

SEQ ID NO: 3225686 - RNA, 21 nt, Mycobacterium leprae
ccuagagaauaaugguggugc

SEQ ID NO: 3225687 - RNA, 17 nt, Mycobacterium leprae
ccuagagucgaccgccg

SEQ ID NO: 3225688 - RNA, 15 nt, Mycobacterium leprae
ccuagcuucgaucca

SEQ ID NO: 3225689 - RNA, 20 nt, Mycobacterium leprae
ccuagggugccuugacuucu

SEQ ID NO: 3225690 - RNA, 17 nt, Mycobacterium leprae
ccuagguccacuugacu

SEQ ID NO: 3225691 - RNA, 15 nt, Mycobacterium leprae
ccuauaucgcggcgc

SEQ ID NO: 3225692 - RNA, 16 nt, Mycobacterium leprae
ccuaucgcuguggcca

SEQ ID NO: 3225693 - RNA, 20 nt, Mycobacterium leprae
ccuauugguuggggaaauga

SEQ ID NO: 3225694 - RNA, 19 nt, Mycobacterium leprae
ccucaaugcagacacgccg

SEQ ID NO: 3225695 - RNA, 20 nt, Mycobacterium leprae
ccucacccaugccucuagca

SEQ ID NO: 3225696 - RNA, 15 nt, Mycobacterium leprae
ccucacgaauccuac

SEQ ID NO: 3225697 - RNA, 22 nt, Mycobacterium leprae
ccucacuuauguguacuguuug

SEQ ID NO: 3225698 - RNA, 14 nt, Mycobacterium leprae
ccucagcgucccaa

SEQ ID NO: 3225699 - RNA, 16 nt, Mycobacterium leprae
ccucagugucagcagc

SEQ ID NO: 3225700 - RNA, 20 nt, Mycobacterium leprae
ccucagugucagcagcaguu

SEQ ID NO: 3225701 - RNA, 19 nt, Mycobacterium leprae
ccucauauuuagcgaccgg

SEQ ID NO: 3225702 - RNA, 14 nt, Mycobacterium leprae
ccucauugaccgca

SEQ ID NO: 3225703 - RNA, 19 nt, Mycobacterium leprae
ccuccggagguauccacgu

SEQ ID NO: 3225704 - RNA, 21 nt, Mycobacterium leprae
ccuccguugucccgcccggcc

SEQ ID NO: 3225705 - RNA, 15 nt, Mycobacterium leprae
ccuccuugaccacca

SEQ ID NO: 3225706 - RNA, 16 nt, Mycobacterium leprae
ccuccuuuucgccggc

SEQ ID NO: 3225707 - RNA, 14 nt, Mycobacterium leprae
ccucgaauccgccu

SEQ ID NO: 3225708 - RNA, 17 nt, Mycobacterium leprae
ccucgaauccgccucgg

SEQ ID NO: 3225709 - RNA, 14 nt, Mycobacterium leprae
ccucgacaaccucg

SEQ ID NO: 3225710 - RNA, 13 nt, Mycobacterium leprae
ccucgacuuccgg

SEQ ID NO: 3225711 - RNA, 14 nt, Mycobacterium leprae
ccucgacuuccggc

SEQ ID NO: 3225712 - RNA, 17 nt, Mycobacterium leprae
ccucgagcaaaccaggu

SEQ ID NO: 3225713 - RNA, 17 nt, Mycobacterium leprae
ccucgaucagcaacacu

SEQ ID NO: 3225714 - RNA, 21 nt, Mycobacterium leprae
ccucgauuugcucagugacgu

SEQ ID NO: 3225715 - RNA, 19 nt, Mycobacterium leprae
ccucgcugcagcauaaccc

SEQ ID NO: 3225716 - RNA, 23 nt, Mycobacterium leprae
ccucggucaccccgagcucggcc

SEQ ID NO: 3225717 - RNA, 13 nt, Mycobacterium leprae
ccucgugcgguca

SEQ ID NO: 3225718 - RNA, 16 nt, Mycobacterium leprae
ccucgugcugcgugcc

SEQ ID NO: 3225719 - RNA, 18 nt, Mycobacterium leprae
ccucgugcugcgugccug

SEQ ID NO: 3225720 - RNA, 14 nt, Mycobacterium leprae
ccucguugacgccc

SEQ ID NO: 3225721 - RNA, 15 nt, Mycobacterium leprae
ccucugcgaucauug

SEQ ID NO: 3225722 - RNA, 17 nt, Mycobacterium leprae
ccucuguugugauccuc

SEQ ID NO: 3225723 - RNA, 18 nt, Mycobacterium leprae
ccucuucaggcaacacgu

SEQ ID NO: 3225724 - RNA, 15 nt, Mycobacterium leprae
ccucuuccgccgcua

SEQ ID NO: 3225725 - RNA, 18 nt, Mycobacterium leprae
ccucuucgacaccgagca

SEQ ID NO: 3225726 - RNA, 21 nt, Mycobacterium leprae
ccucuuggauuucggugguaa

SEQ ID NO: 3225727 - RNA, 17 nt, Mycobacterium leprae
ccugaacaacgcucaac

SEQ ID NO: 3225728 - RNA, 17 nt, Mycobacterium leprae
ccugacaucaagccucc

SEQ ID NO: 3225729 - RNA, 22 nt, Mycobacterium leprae
ccugacaucaagccuccagaau

SEQ ID NO: 3225730 - RNA, 16 nt, Mycobacterium leprae
ccugaccgccugugcu

SEQ ID NO: 3225731 - RNA, 16 nt, Mycobacterium leprae
ccugaccucggcgaaa

SEQ ID NO: 3225732 - RNA, 15 nt, Mycobacterium leprae
ccugacgcacaccgu

SEQ ID NO: 3225733 - RNA, 16 nt, Mycobacterium leprae
ccugacgcacaccguu

SEQ ID NO: 3225734 - RNA, 16 nt, Mycobacterium leprae
ccugagacaucgccac

SEQ ID NO: 3225735 - RNA, 14 nt, Mycobacterium leprae
ccugagcaccaucu

SEQ ID NO: 3225736 - RNA, 21 nt, Mycobacterium leprae
ccugagugugaugccgaagca

SEQ ID NO: 3225737 - RNA, 18 nt, Mycobacterium leprae
ccugauaagggucaucca

SEQ ID NO: 3225738 - RNA, 21 nt, Mycobacterium leprae
ccugauaagggucauccaacg

SEQ ID NO: 3225739 - RNA, 21 nt, Mycobacterium leprae
ccugauccagcaaacuccuga

SEQ ID NO: 3225740 - RNA, 20 nt, Mycobacterium leprae
ccugauuaauaacgccggcc

SEQ ID NO: 3225741 - RNA, 19 nt, Mycobacterium leprae
ccugauugucaacaaccga

SEQ ID NO: 3225742 - RNA, 22 nt, Mycobacterium leprae
ccugcaaagccgaagccgccag

SEQ ID NO: 3225743 - RNA, 22 nt, Mycobacterium leprae
ccugcacuugcacuucgacggu

SEQ ID NO: 3225744 - RNA, 22 nt, Mycobacterium leprae
ccugcagucuuugggccaucgg

SEQ ID NO: 3225745 - RNA, 18 nt, Mycobacterium leprae
ccugcauugcuucgaggc

SEQ ID NO: 3225746 - RNA, 15 nt, Mycobacterium leprae
ccugccacugacgag

SEQ ID NO: 3225747 - RNA, 16 nt, Mycobacterium leprae
ccugccgauauaccug

SEQ ID NO: 3225748 - RNA, 22 nt, Mycobacterium leprae
ccugccggugcggucccaucgc

SEQ ID NO: 3225749 - RNA, 15 nt, Mycobacterium leprae
ccugccuagcaacgu

SEQ ID NO: 3225750 - RNA, 20 nt, Mycobacterium leprae
ccugcgacagccgugccucg

SEQ ID NO: 3225751 - RNA, 22 nt, Mycobacterium leprae
ccugcgacagccgugccucgcu

SEQ ID NO: 3225752 - RNA, 15 nt, Mycobacterium leprae
ccugcgcgaagugag

SEQ ID NO: 3225753 - RNA, 13 nt, Mycobacterium leprae
ccugcgguggugg

SEQ ID NO: 3225754 - RNA, 15 nt, Mycobacterium leprae
ccugcgucaguaagu

SEQ ID NO: 3225755 - RNA, 20 nt, Mycobacterium leprae
ccugcguucgguagcgcgcu

SEQ ID NO: 3225756 - RNA, 21 nt, Mycobacterium leprae
ccugcuugaggucgcacagca

SEQ ID NO: 3225757 - RNA, 17 nt, Mycobacterium leprae
ccuggaccgaccagagc

SEQ ID NO: 3225758 - RNA, 21 nt, Mycobacterium leprae
ccuggauugucgacaagcugg

SEQ ID NO: 3225759 - RNA, 23 nt, Mycobacterium leprae
ccuggauugucgacaagcugguc

SEQ ID NO: 3225760 - RNA, 13 nt, Mycobacterium leprae
ccuggcaccgugu

SEQ ID NO: 3225761 - RNA, 14 nt, Mycobacterium leprae
ccuggcgauuuucu

SEQ ID NO: 3225762 - RNA, 19 nt, Mycobacterium leprae
ccuggcguuuggugcugcg

SEQ ID NO: 3225763 - RNA, 17 nt, Mycobacterium leprae
ccuggcuggccaucgca

SEQ ID NO: 3225764 - RNA, 12 nt, Mycobacterium leprae
ccuggcugggcu

SEQ ID NO: 3225765 - RNA, 14 nt, Mycobacterium leprae
ccugggaacccauu

SEQ ID NO: 3225766 - RNA, 23 nt, Mycobacterium leprae
ccugggcggcuagucggccggcu

SEQ ID NO: 3225767 - RNA, 21 nt, Mycobacterium leprae
ccuggggcugcauugugcugc

SEQ ID NO: 3225768 - RNA, 14 nt, Mycobacterium leprae
ccuggucgagcagc

SEQ ID NO: 3225769 - RNA, 21 nt, Mycobacterium leprae
cgacagccugccgauauaccu

SEQ ID NO: 3225770 - RNA, 19 nt, Mycobacterium leprae
cgacaggaaaccuuccggc

SEQ ID NO: 3225771 - RNA, 24 nt, Mycobacterium leprae
cgacaggaaaccuuccggcgguca

SEQ ID NO: 3225772 - RNA, 23 nt, Mycobacterium leprae
cgacaggagcuucaacaccaugg

SEQ ID NO: 3225773 - RNA, 18 nt, Mycobacterium leprae
cgacaguaucgaccagcc

SEQ ID NO: 3225774 - RNA, 19 nt, Mycobacterium leprae
cgacaguaucgaccagcca

SEQ ID NO: 3225775 - RNA, 18 nt, Mycobacterium leprae
cgacagugucccuguccu

SEQ ID NO: 3225776 - RNA, 20 nt, Mycobacterium leprae
cgacaguuuaccgugccuug

SEQ ID NO: 3225777 - RNA, 16 nt, Mycobacterium leprae
cgacaucccagcaacg

SEQ ID NO: 3225778 - RNA, 15 nt, Mycobacterium leprae
cgaccaccagggccg

SEQ ID NO: 3225779 - RNA, 13 nt, Mycobacterium leprae
cgaccagccaagc

SEQ ID NO: 3225780 - RNA, 14 nt, Mycobacterium leprae
cgaccagccaagcc

SEQ ID NO: 3225781 - RNA, 13 nt, Mycobacterium leprae
cgaccagccacgc

SEQ ID NO: 3225782 - RNA, 21 nt, Mycobacterium leprae
cgaccaugugaccgcggugca

SEQ ID NO: 3225783 - RNA, 22 nt, Mycobacterium leprae
cgaccaugugaccgcggugcag

SEQ ID NO: 3225784 - RNA, 17 nt, Mycobacterium leprae
cgaccgcacggcaagcc

SEQ ID NO: 3225785 - RNA, 16 nt, Mycobacterium leprae
cgaccgcaucgauaag

SEQ ID NO: 3225786 - RNA, 16 nt, Mycobacterium leprae
cgaccggaccaucguc

SEQ ID NO: 3225787 - RNA, 15 nt, Mycobacterium leprae
cgaccggaugaacac

SEQ ID NO: 3225788 - RNA, 15 nt, Mycobacterium leprae
cgaccgucgauaacg

SEQ ID NO: 3225789 - RNA, 21 nt, Mycobacterium leprae
cgaccuagcuucgauccaggc

SEQ ID NO: 3225790 - RNA, 15 nt, Mycobacterium leprae
cgaccucaugcccgg

SEQ ID NO: 3225791 - RNA, 16 nt, Mycobacterium leprae
cgaccuccgcagcauc

SEQ ID NO: 3225792 - RNA, 17 nt, Mycobacterium leprae
cgaccuccgcagcaucg

SEQ ID NO: 3225793 - RNA, 11 nt, Mycobacterium leprae
cgaccuccgcu

SEQ ID NO: 3225794 - RNA, 18 nt, Mycobacterium leprae
cgaccuccuugaccacca

SEQ ID NO: 3225795 - RNA, 19 nt, Mycobacterium leprae
cgaccugcaacgcugcaag

SEQ ID NO: 3225796 - RNA, 15 nt, Mycobacterium leprae
cgaccugucgauacg

SEQ ID NO: 3225797 - RNA, 20 nt, Mycobacterium leprae
cgaccugucgauacggccaa

SEQ ID NO: 3225798 - RNA, 15 nt, Mycobacterium leprae
cgaccuucgcgaugu

SEQ ID NO: 3225799 - RNA, 19 nt, Mycobacterium leprae
cgaccuugcggcgccccuc

SEQ ID NO: 3225800 - RNA, 14 nt, Mycobacterium leprae
cgacgaaaacgucc

SEQ ID NO: 3225801 - RNA, 15 nt, Mycobacterium leprae
cgacgaaaacgucca

SEQ ID NO: 3225802 - RNA, 19 nt, Mycobacterium leprae
cgacgaccuccgcagcauc

SEQ ID NO: 3225803 - RNA, 20 nt, Mycobacterium leprae
cgacgacucaguggcgggcu

SEQ ID NO: 3225804 - RNA, 15 nt, Mycobacterium leprae
cgacgaggcggugac

SEQ ID NO: 3225805 - RNA, 15 nt, Mycobacterium leprae
cgacgaggucgccgc

SEQ ID NO: 3225806 - RNA, 17 nt, Mycobacterium leprae
cgacgaggucgccgccg

SEQ ID NO: 3225807 - RNA, 18 nt, Mycobacterium leprae
cgacgaggugacucgccg

SEQ ID NO: 3225808 - RNA, 14 nt, Mycobacterium leprae
cgacgaucaccgcc

SEQ ID NO: 3225809 - RNA, 24 nt, Mycobacterium leprae
cgacgaugcgugccccggccgccg

SEQ ID NO: 3225810 - RNA, 17 nt, Mycobacterium leprae
cgacgauuccuggaaag

SEQ ID NO: 3225811 - RNA, 13 nt, Mycobacterium leprae
cgacgcagaccgg

SEQ ID NO: 3225812 - RNA, 18 nt, Mycobacterium leprae
cgacgcagaccgggcgcc

SEQ ID NO: 3225813 - RNA, 13 nt, Mycobacterium leprae
cgacgccggccgu

SEQ ID NO: 3225814 - RNA, 18 nt, Mycobacterium leprae
cgacgccgucuccgccgu

SEQ ID NO: 3225815 - RNA, 17 nt, Mycobacterium leprae
cgacgccuagagagugc

SEQ ID NO: 3225816 - RNA, 13 nt, Mycobacterium leprae
cgacgcggaacgc

SEQ ID NO: 3225817 - RNA, 17 nt, Mycobacterium leprae
cgacgcgguugccggcg

SEQ ID NO: 3225818 - RNA, 21 nt, Mycobacterium leprae
cgacgcuauguuggccagcag

SEQ ID NO: 3225819 - RNA, 14 nt, Mycobacterium leprae
cgacggaugcccag

SEQ ID NO: 3225820 - RNA, 19 nt, Mycobacterium leprae
cgacggaugcccagccagg

SEQ ID NO: 3225821 - RNA, 15 nt, Mycobacterium leprae
cgacggccgcacagc

SEQ ID NO: 3225822 - RNA, 13 nt, Mycobacterium leprae
cgacggcgccgca

SEQ ID NO: 3225823 - RNA, 17 nt, Mycobacterium leprae
cgacggcgccgcacagc

SEQ ID NO: 3225824 - RNA, 18 nt, Mycobacterium leprae
cgacggcuggcugcugca

SEQ ID NO: 3225825 - RNA, 22 nt, Mycobacterium leprae
cgacggcuggcugcugcagacc

SEQ ID NO: 3225826 - RNA, 22 nt, Mycobacterium leprae
cgacgguaaguuuucagccaca

SEQ ID NO: 3225827 - RNA, 18 nt, Mycobacterium leprae
cgacgguauugcgucggc

SEQ ID NO: 3225828 - RNA, 19 nt, Mycobacterium leprae
cgacggugaaucagucugc

SEQ ID NO: 3225829 - RNA, 13 nt, Mycobacterium leprae
cgacgucgccgau

SEQ ID NO: 3225830 - RNA, 13 nt, Mycobacterium leprae
cgacgucuucaau

SEQ ID NO: 3225831 - RNA, 16 nt, Mycobacterium leprae
cgacgugaaacaagcc

SEQ ID NO: 3225832 - RNA, 21 nt, Mycobacterium leprae
cgacguugaugucccuggcga

SEQ ID NO: 3225833 - RNA, 21 nt, Mycobacterium leprae
cgacguuguuuccggguacgg

SEQ ID NO: 3225834 - RNA, 20 nt, Mycobacterium leprae
cgagcgauggcugccgggcg

SEQ ID NO: 3225835 - RNA, 18 nt, Mycobacterium leprae
cgagcggaccauggcgcu

SEQ ID NO: 3225836 - RNA, 14 nt, Mycobacterium leprae
cgagcggagcuggg

SEQ ID NO: 3225837 - RNA, 15 nt, Mycobacterium leprae
cgagcggagcugggc

SEQ ID NO: 3225838 - RNA, 18 nt, Mycobacterium leprae
cgagcggccucagcagca

SEQ ID NO: 3225839 - RNA, 22 nt, Mycobacterium leprae
cgagcggccucagcagcaggcu

SEQ ID NO: 3225840 - RNA, 12 nt, Mycobacterium leprae
cgagcgugucau

SEQ ID NO: 3225841 - RNA, 14 nt, Mycobacterium leprae
cgagcuggcugugc

SEQ ID NO: 3225842 - RNA, 23 nt, Mycobacterium leprae
cgagcuggcugugcccguuaacg

SEQ ID NO: 3225843 - RNA, 18 nt, Mycobacterium leprae
cgagcuggggcggccgcc

SEQ ID NO: 3225844 - RNA, 22 nt, Mycobacterium leprae
cgagcuguuccucuugacggga

SEQ ID NO: 3225845 - RNA, 22 nt, Mycobacterium leprae
cgaggacacccggguggcguca

SEQ ID NO: 3225846 - RNA, 15 nt, Mycobacterium leprae
cgaggagaggcaggg

SEQ ID NO: 3225847 - RNA, 19 nt, Mycobacterium leprae
cgaggagcacggcucgucc

SEQ ID NO: 3225848 - RNA, 23 nt, Mycobacterium leprae
cgaggaguuagaggguccggacc

SEQ ID NO: 3225849 - RNA, 16 nt, Mycobacterium leprae
cgaggaucgucucggg

SEQ ID NO: 3225850 - RNA, 13 nt, Mycobacterium leprae
cgaggcaggacug

SEQ ID NO: 3225851 - RNA, 13 nt, Mycobacterium leprae
cgaggcggugacc

SEQ ID NO: 3225852 - RNA, 17 nt, Mycobacterium leprae
cgaggcguccguuuuuc

SEQ ID NO: 3225853 - RNA, 18 nt, Mycobacterium leprae
cgagggcggugccccggg

SEQ ID NO: 3225854 - RNA, 16 nt, Mycobacterium leprae
cgaggggccgucggca

SEQ ID NO: 3225855 - RNA, 15 nt, Mycobacterium leprae
cgagguggcggcgac

SEQ ID NO: 3225856 - RNA, 23 nt, Mycobacterium leprae
cgaggugggccccugcggcuaac

SEQ ID NO: 3225857 - RNA, 14 nt, Mycobacterium leprae
cgagucucacccac

SEQ ID NO: 3225858 - RNA, 19 nt, Mycobacterium leprae
cgagugcuggucaacagug

SEQ ID NO: 3225859 - RNA, 15 nt, Mycobacterium leprae
cgaguggcgaacggg

SEQ ID NO: 3225860 - RNA, 14 nt, Mycobacterium leprae
cgagugguccccug

SEQ ID NO: 3225861 - RNA, 17 nt, Mycobacterium leprae
cgagugugaaaaagcac

SEQ ID NO: 3225862 - RNA, 15 nt, Mycobacterium leprae
cgaguucugcaccga

SEQ ID NO: 3225863 - RNA, 21 nt, Mycobacterium leprae
cgaguuggccgagcgucgaau

SEQ ID NO: 3225864 - RNA, 21 nt, Mycobacterium leprae
cgaguugggccaugcagucgc

SEQ ID NO: 3225865 - RNA, 15 nt, Mycobacterium leprae
cgauaacagaccucc

SEQ ID NO: 3225866 - RNA, 22 nt, Mycobacterium leprae
cgauaagaaguuguagcugugg

SEQ ID NO: 3225867 - RNA, 13 nt, Mycobacterium leprae
cgauaaucaaagg

SEQ ID NO: 3225868 - RNA, 17 nt, Mycobacterium leprae
cgauacagucauugucc

SEQ ID NO: 3225869 - RNA, 18 nt, Mycobacterium leprae
cgauagcacuuaaguggc

SEQ ID NO: 3225870 - RNA, 21 nt, Mycobacterium leprae
cgauagggguucgccgccggc

SEQ ID NO: 3225871 - RNA, 15 nt, Mycobacterium leprae
cgauaucaagcugcg

SEQ ID NO: 3225872 - RNA, 16 nt, Mycobacterium leprae
cgauauccccgacguc

SEQ ID NO: 3225873 - RNA, 23 nt, Mycobacterium leprae
cgauauccccgacgucucgcggu

SEQ ID NO: 3225874 - RNA, 14 nt, Mycobacterium leprae
cgauauccgccggc

SEQ ID NO: 3225875 - RNA, 18 nt, Mycobacterium leprae
cgauaucgaugcaggcgu

SEQ ID NO: 3225876 - RNA, 13 nt, Mycobacterium leprae
cgauaucgcgucg

SEQ ID NO: 3225877 - RNA, 20 nt, Mycobacterium leprae
cgaucaccuagaacagcauc

SEQ ID NO: 3225878 - RNA, 17 nt, Mycobacterium leprae
cgaucagacccuugguc

SEQ ID NO: 3225879 - RNA, 13 nt, Mycobacterium leprae
cgaucaggaggug

SEQ ID NO: 3225880 - RNA, 13 nt, Mycobacterium leprae
cgaucagggcgcc

SEQ ID NO: 3225881 - RNA, 22 nt, Mycobacterium leprae
cgaucaguucuucgauagccau

SEQ ID NO: 3225882 - RNA, 12 nt, Mycobacterium leprae
cgauccacuuga

SEQ ID NO: 3225883 - RNA, 15 nt, Mycobacterium leprae
cgauccaugccgagu

SEQ ID NO: 3225884 - RNA, 11 nt, Mycobacterium leprae
cgaucccaagu

SEQ ID NO: 3225885 - RNA, 13 nt, Mycobacterium leprae
cgaucccaggauc

SEQ ID NO: 3225886 - RNA, 19 nt, Mycobacterium leprae
cgaucccaucggcugcacc

SEQ ID NO: 3225887 - RNA, 22 nt, Mycobacterium leprae
cgaucccgguuacguccgcggc

SEQ ID NO: 3225888 - RNA, 16 nt, Mycobacterium leprae
cgauccgcgugaugau

SEQ ID NO: 3225889 - RNA, 18 nt, Mycobacterium leprae
cgauccggaucgucagau

SEQ ID NO: 3225890 - RNA, 13 nt, Mycobacterium leprae
cgauccggcggcu

SEQ ID NO: 3225891 - RNA, 21 nt, Mycobacterium leprae
cgauccucgacgggucacagg

SEQ ID NO: 3225892 - RNA, 19 nt, Mycobacterium leprae
cgauccucgugacaucgac

SEQ ID NO: 3225893 - RNA, 14 nt, Mycobacterium leprae
cgaucgcaccggcu

SEQ ID NO: 3225894 - RNA, 19 nt, Mycobacterium leprae
cgaucuacgccaucguuca

SEQ ID NO: 3225895 - RNA, 16 nt, Mycobacterium leprae
cgaucuaucugacgac

SEQ ID NO: 3225896 - RNA, 19 nt, Mycobacterium leprae
cgaucuaucugacgacuuc

SEQ ID NO: 3225897 - RNA, 21 nt, Mycobacterium leprae
cgaucucagccaggagaagcg

SEQ ID NO: 3225898 - RNA, 21 nt, Mycobacterium leprae
cgaucucgcauauucagaauu

SEQ ID NO: 3225899 - RNA, 19 nt, Mycobacterium leprae
cgaucucggugcgaggacc

SEQ ID NO: 3225900 - RNA, 20 nt, Mycobacterium leprae
cgaucucgucgcucauaucg

SEQ ID NO: 3225901 - RNA, 13 nt, Mycobacterium leprae
cgaucugcccagc

SEQ ID NO: 3225902 - RNA, 18 nt, Mycobacterium leprae
cgaucuggucccacggcg

SEQ ID NO: 3225903 - RNA, 21 nt, Mycobacterium leprae
cgaucugugacacuucuccaa

SEQ ID NO: 3225904 - RNA, 14 nt, Mycobacterium leprae
cgaucuuccaccau

SEQ ID NO: 3225905 - RNA, 14 nt, Mycobacterium leprae
cgaucuugccccgu

SEQ ID NO: 3225906 - RNA, 23 nt, Mycobacterium leprae
cgaugaccuugaaagcgcgagau

SEQ ID NO: 3225907 - RNA, 19 nt, Mycobacterium leprae
cgaugaggcucgugcacug

SEQ ID NO: 3225908 - RNA, 18 nt, Mycobacterium leprae
cgaugauccggccgucgg

SEQ ID NO: 3225909 - RNA, 15 nt, Mycobacterium leprae
cgaugauucguugac

SEQ ID NO: 3225910 - RNA, 13 nt, Mycobacterium leprae
cgaugcagcuggu

SEQ ID NO: 3225911 - RNA, 17 nt, Mycobacterium leprae
cgaugcagggccagccc

SEQ ID NO: 3225912 - RNA, 18 nt, Mycobacterium leprae
cgaugcagggccagcccg

SEQ ID NO: 3225913 - RNA, 22 nt, Mycobacterium leprae
cgaugccauagacuucuggauc

SEQ ID NO: 3225914 - RNA, 20 nt, Mycobacterium leprae
cgaugcgcagccgcgguaac

SEQ ID NO: 3225915 - RNA, 19 nt, Mycobacterium leprae
cgaugcggaauacaucggc

SEQ ID NO: 3225916 - RNA, 23 nt, Mycobacterium leprae
cgaugcggaauacaucggcacga

SEQ ID NO: 3225917 - RNA, 14 nt, Mycobacterium leprae
cgaugcgugccccg

SEQ ID NO: 3225918 - RNA, 15 nt, Mycobacterium leprae
cgaugcuaccgaacu

SEQ ID NO: 3225919 - RNA, 23 nt, Mycobacterium leprae
cgauggcgguguuagcaugcuug

SEQ ID NO: 3225920 - RNA, 15 nt, Mycobacterium leprae
cgauggugugcagua

SEQ ID NO: 3225921 - RNA, 22 nt, Mycobacterium leprae
cgauguacuccgaaugugggau

SEQ ID NO: 3225922 - RNA, 23 nt, Mycobacterium leprae
cgaugugcuuagcauagcggccg

SEQ ID NO: 3225923 - RNA, 22 nt, Mycobacterium leprae
cgauguuguagguugaugaggg

SEQ ID NO: 3225924 - RNA, 22 nt, Mycobacterium leprae
cgauguuuuggaccgcgccgcg

SEQ ID NO: 3225925 - RNA, 23 nt, Mycobacterium leprae
cgauuacguuguggcgcgagcgu

SEQ ID NO: 3225926 - RNA, 12 nt, Mycobacterium leprae
cgauuagcgcgg

SEQ ID NO: 3225927 - RNA, 14 nt, Mycobacterium leprae
cgauuagcgcggcg

SEQ ID NO: 3225928 - RNA, 15 nt, Mycobacterium leprae
cgauuccuggaaaga

SEQ ID NO: 3225929 - RNA, 11 nt, Mycobacterium leprae
cgauucugccc

SEQ ID NO: 3225930 - RNA, 13 nt, Mycobacterium leprae
cgauucugcccgg

SEQ ID NO: 3225931 - RNA, 20 nt, Mycobacterium leprae
cgauugauugugcgcagugg

SEQ ID NO: 3225932 - RNA, 15 nt, Mycobacterium leprae
cgauugccaccacca

SEQ ID NO: 3225933 - RNA, 22 nt, Mycobacterium leprae
cgauuguguaacgauuagcaug

SEQ ID NO: 3225934 - RNA, 16 nt, Mycobacterium leprae
cgauuugcucagugac

SEQ ID NO: 3225935 - RNA, 21 nt, Mycobacterium leprae
cgauuuggauggucggcagcu

SEQ ID NO: 3225936 - RNA, 14 nt, Mycobacterium leprae
cgcaaaggccaauc

SEQ ID NO: 3225937 - RNA, 17 nt, Mycobacterium leprae
cgcaacagucagccgcg

SEQ ID NO: 3225938 - RNA, 18 nt, Mycobacterium leprae
cgcaacagucagccgcgg

SEQ ID NO: 3225939 - RNA, 14 nt, Mycobacterium leprae
cgcaaccccgugcc

SEQ ID NO: 3225940 - RNA, 22 nt, Mycobacterium leprae
cgcaacgaaaccaugccgccga

SEQ ID NO: 3225941 - RNA, 14 nt, Mycobacterium leprae
cgcaacgggacaag

SEQ ID NO: 3225942 - RNA, 17 nt, Mycobacterium leprae
cgcaacugguugacccc

SEQ ID NO: 3225943 - RNA, 23 nt, Mycobacterium leprae
cgcaacugguugaccccgcccca

SEQ ID NO: 3225944 - RNA, 23 nt, Mycobacterium leprae
cgcaagcaaauuuuuugacgggu

SEQ ID NO: 3225945 - RNA, 13 nt, Mycobacterium leprae
cgcaagcgcgccg

SEQ ID NO: 3225946 - RNA, 15 nt, Mycobacterium leprae
cgcaagcgcgccgag

SEQ ID NO: 3225947 - RNA, 22 nt, Mycobacterium leprae
cgcaagucuggagucaucccca

SEQ ID NO: 3225948 - RNA, 16 nt, Mycobacterium leprae
cgcaagugcggcgccc

SEQ ID NO: 3225949 - RNA, 19 nt, Mycobacterium leprae
cgcaagugcggcgcccagc

SEQ ID NO: 3225950 - RNA, 20 nt, Mycobacterium leprae
cgcaagugcggcgcccagca

SEQ ID NO: 3225951 - RNA, 22 nt, Mycobacterium leprae
cgcaagugcggcgcccagcacc

SEQ ID NO: 3225952 - RNA, 22 nt, Mycobacterium leprae
cgcacaaacuucgacgaucacc

SEQ ID NO: 3225953 - RNA, 17 nt, Mycobacterium leprae
cgcacacgacagccgca

SEQ ID NO: 3225954 - RNA, 20 nt, Mycobacterium leprae
cgcacacgacagccgcaauc

SEQ ID NO: 3225955 - RNA, 18 nt, Mycobacterium leprae
cgcacagagcccagcacg

SEQ ID NO: 3225956 - RNA, 14 nt, Mycobacterium leprae
cgcacagcaggucg

SEQ ID NO: 3225957 - RNA, 20 nt, Mycobacterium leprae
cgcacagcaggucgccgacg

SEQ ID NO: 3225958 - RNA, 12 nt, Mycobacterium leprae
cgcacagcucuc

SEQ ID NO: 3225959 - RNA, 16 nt, Mycobacterium leprae
cgcacaguuccagugc

SEQ ID NO: 3225960 - RNA, 14 nt, Mycobacterium leprae
cgcaccaauccacc

SEQ ID NO: 3225961 - RNA, 16 nt, Mycobacterium leprae
cgcacccggcagcauc

SEQ ID NO: 3225962 - RNA, 16 nt, Mycobacterium leprae
cgcacccugccgccac

SEQ ID NO: 3225963 - RNA, 19 nt, Mycobacterium leprae
cgcacccugccgccacagc

SEQ ID NO: 3225964 - RNA, 20 nt, Mycobacterium leprae
cgcacccugccgccacagca

SEQ ID NO: 3225965 - RNA, 24 nt, Mycobacterium leprae
cgcacccugccgccacagcaaguc

SEQ ID NO: 3225966 - RNA, 16 nt, Mycobacterium leprae
cgcaccgauauccggc

SEQ ID NO: 3225967 - RNA, 18 nt, Mycobacterium leprae
cgcaccgauccggcggcc

SEQ ID NO: 3225968 - RNA, 12 nt, Mycobacterium leprae
cgcaccgcguaa

SEQ ID NO: 3225969 - RNA, 21 nt, Mycobacterium leprae
cgcaccgcuucagagugcacc

SEQ ID NO: 3225970 - RNA, 22 nt, Mycobacterium leprae
cgcaccggcugaggcggccggc

SEQ ID NO: 3225971 - RNA, 15 nt, Mycobacterium leprae
cgcaccggcugcacc

SEQ ID NO: 3225972 - RNA, 17 nt, Mycobacterium leprae
cgcaccugaucggucag

SEQ ID NO: 3225973 - RNA, 22 nt, Mycobacterium leprae
cgcacgaaauggcgccaccgug

SEQ ID NO: 3225974 - RNA, 23 nt, Mycobacterium leprae
cgcacgggauggccaagccgccc

SEQ ID NO: 3225975 - RNA, 15 nt, Mycobacterium leprae
cgcacguaguuguac

SEQ ID NO: 3225976 - RNA, 14 nt, Mycobacterium leprae
cgcagaacacgacg

SEQ ID NO: 3225977 - RNA, 18 nt, Mycobacterium leprae
cgcagaaugugcucugac

SEQ ID NO: 3225978 - RNA, 15 nt, Mycobacterium leprae
cgcagauaucgcaca

SEQ ID NO: 3225979 - RNA, 20 nt, Mycobacterium leprae
cgcagauaucgcacacagcg

SEQ ID NO: 3225980 - RNA, 13 nt, Mycobacterium leprae
cgcagcaacuguu

SEQ ID NO: 3225981 - RNA, 19 nt, Mycobacterium leprae
cgcagcaagcggccgccca

SEQ ID NO: 3225982 - RNA, 13 nt, Mycobacterium leprae
cgcagcacuaaag

SEQ ID NO: 3225983 - RNA, 21 nt, Mycobacterium leprae
cgcagcacuaaagucuucaau

SEQ ID NO: 3225984 - RNA, 15 nt, Mycobacterium leprae
cgcagcaucagggcu

SEQ ID NO: 3225985 - RNA, 12 nt, Mycobacterium leprae
cgcagccaccac

SEQ ID NO: 3225986 - RNA, 22 nt, Mycobacterium leprae
cgcagccaccacucucaucgcg

SEQ ID NO: 3225987 - RNA, 14 nt, Mycobacterium leprae
cgcagccggagggu

SEQ ID NO: 3225988 - RNA, 16 nt, Mycobacterium leprae
cgcaggacaaagucag

SEQ ID NO: 3225989 - RNA, 19 nt, Mycobacterium leprae
cgcaggacaaagucagcuu

SEQ ID NO: 3225990 - RNA, 16 nt, Mycobacterium leprae
cgcaggagauccacgu

SEQ ID NO: 3225991 - RNA, 19 nt, Mycobacterium leprae
cgcaggaguaauaacugug

SEQ ID NO: 3225992 - RNA, 14 nt, Mycobacterium leprae
cgcagggcgcgcag

SEQ ID NO: 3225993 - RNA, 22 nt, Mycobacterium leprae
cgcaguaauccaguccggugcu

SEQ ID NO: 3225994 - RNA, 20 nt, Mycobacterium leprae
cgcaguacuggugcuguguu

SEQ ID NO: 3225995 - RNA, 13 nt, Mycobacterium leprae
cgcagucaucacc

SEQ ID NO: 3225996 - RNA, 15 nt, Mycobacterium leprae
cgcagucauccacug

SEQ ID NO: 3225997 - RNA, 13 nt, Mycobacterium leprae
cgcagucgguuga

SEQ ID NO: 3225998 - RNA, 23 nt, Mycobacterium leprae
cgcaguggacacgauuagcgcgg

SEQ ID NO: 3225999 - RNA, 21 nt, Mycobacterium leprae
cgcagugugcuuucggcucaa

SEQ ID NO: 3226000 - RNA, 20 nt, Mycobacterium leprae
cgcaguguuucuuaccccgc

SEQ ID NO: 3226001 - RNA, 16 nt, Mycobacterium leprae
cgcaguuggccacugu

SEQ ID NO: 3226002 - RNA, 21 nt, Mycobacterium leprae
cgcaucagccaacaccaccag

SEQ ID NO: 3226003 - RNA, 16 nt, Mycobacterium leprae
cgcaucgauaagcagc

SEQ ID NO: 3226004 - RNA, 18 nt, Mycobacterium leprae
cgcaucggugaucguggu

SEQ ID NO: 3226005 - RNA, 15 nt, Mycobacterium leprae
cgcaucgguggcacg

SEQ ID NO: 3226006 - RNA, 15 nt, Mycobacterium leprae
cgcaugacacccccg

SEQ ID NO: 3226007 - RNA, 15 nt, Mycobacterium leprae
cgcaugccaaccugu

SEQ ID NO: 3226008 - RNA, 15 nt, Mycobacterium leprae
cgcaugcccugggcc

SEQ ID NO: 3226009 - RNA, 23 nt, Mycobacterium leprae
cgcauuaccugguucuuuugauu

SEQ ID NO: 3226010 - RNA, 23 nt, Mycobacterium leprae
cgcauuauuuuuuagauccaacg

SEQ ID NO: 3226011 - RNA, 16 nt, Mycobacterium leprae
cgccaaacacggccag

SEQ ID NO: 3226012 - RNA, 22 nt, Mycobacterium leprae
cgccaacgguaucuccccaggu

SEQ ID NO: 3226013 - RNA, 23 nt, Mycobacterium leprae
cgccacagagaagcaaugccaaa

SEQ ID NO: 3226014 - RNA, 13 nt, Mycobacterium leprae
cgccaccgccggu

SEQ ID NO: 3226015 - RNA, 15 nt, Mycobacterium leprae
cgccaccgccgguca

SEQ ID NO: 3226016 - RNA, 16 nt, Mycobacterium leprae
cgccacgccggacugc

SEQ ID NO: 3226017 - RNA, 17 nt, Mycobacterium leprae
cgccacucauauccgag

SEQ ID NO: 3226018 - RNA, 15 nt, Mycobacterium leprae
cgccagaccugccgg

SEQ ID NO: 3226019 - RNA, 17 nt, Mycobacterium leprae
cgccagcgacacagccg

SEQ ID NO: 3226020 - RNA, 22 nt, Mycobacterium leprae
cgccagcgacacagccggccgg

SEQ ID NO: 3226021 - RNA, 14 nt, Mycobacterium leprae
cgccaggcgaauug

SEQ ID NO: 3226022 - RNA, 12 nt, Mycobacterium leprae
cgccagggcggc

SEQ ID NO: 3226023 - RNA, 17 nt, Mycobacterium leprae
cgccaggguacccgugc

SEQ ID NO: 3226024 - RNA, 12 nt, Mycobacterium leprae
cgccagugcgca

SEQ ID NO: 3226025 - RNA, 22 nt, Mycobacterium leprae
cgccaguguagagggccacuaa

SEQ ID NO: 3226026 - RNA, 21 nt, Mycobacterium leprae
cgccauauccucgaccaccag

SEQ ID NO: 3226027 - RNA, 15 nt, Mycobacterium leprae
cgcccaacguaucgg

SEQ ID NO: 3226028 - RNA, 16 nt, Mycobacterium leprae
cgcccaccgcaacgcc

SEQ ID NO: 3226029 - RNA, 20 nt, Mycobacterium leprae
cgcccaccgcaacgccucca

SEQ ID NO: 3226030 - RNA, 21 nt, Mycobacterium leprae
cgcccacguucagaagacauu

SEQ ID NO: 3226031 - RNA, 22 nt, Mycobacterium leprae
cgcccagcaguuacugguggca

SEQ ID NO: 3226032 - RNA, 17 nt, Mycobacterium leprae
cgcccagugacgucgga

SEQ ID NO: 3226033 - RNA, 16 nt, Mycobacterium leprae
cgccccaccauaaccg

SEQ ID NO: 3226034 - RNA, 16 nt, Mycobacterium leprae
cgccccccagugguga

SEQ ID NO: 3226035 - RNA, 21 nt, Mycobacterium leprae
cgcccgaccaguucgacuggc

SEQ ID NO: 3226036 - RNA, 15 nt, Mycobacterium leprae
cgcccgcgcauguaa

SEQ ID NO: 3226037 - RNA, 13 nt, Mycobacterium leprae
cgcccggccagua

SEQ ID NO: 3226038 - RNA, 20 nt, Mycobacterium leprae
cgcccgggaaggacgcaucc

SEQ ID NO: 3226039 - RNA, 18 nt, Mycobacterium leprae
cgcccggucaagacguug

SEQ ID NO: 3226040 - RNA, 16 nt, Mycobacterium leprae
cgcccuccuggcgagu

SEQ ID NO: 3226041 - RNA, 20 nt, Mycobacterium leprae
cgcccucgccggcgguacug

SEQ ID NO: 3226042 - RNA, 16 nt, Mycobacterium leprae
cgcccucggacguggu

SEQ ID NO: 3226043 - RNA, 21 nt, Mycobacterium leprae
cgcccugcuuaugcgugcuga

SEQ ID NO: 3226044 - RNA, 16 nt, Mycobacterium leprae
cgcccuggaccgcagc

SEQ ID NO: 3226045 - RNA, 20 nt, Mycobacterium leprae
cgccgaaaucgacguuugca

SEQ ID NO: 3226046 - RNA, 16 nt, Mycobacterium leprae
cgccgaagccgcgcau

SEQ ID NO: 3226047 - RNA, 17 nt, Mycobacterium leprae
cgccgaagccgcgcauc

SEQ ID NO: 3226048 - RNA, 14 nt, Mycobacterium leprae
cgccgacaccucaa

SEQ ID NO: 3226049 - RNA, 22 nt, Mycobacterium leprae
cgccgacgaugcgugccccggc

SEQ ID NO: 3226050 - RNA, 14 nt, Mycobacterium leprae
cgccgacgcgaacg

SEQ ID NO: 3226051 - RNA, 14 nt, Mycobacterium leprae
cgccgacggccgga

SEQ ID NO: 3226052 - RNA, 16 nt, Mycobacterium leprae
cgccgagcugaucgug

SEQ ID NO: 3226053 - RNA, 18 nt, Mycobacterium leprae
cgccgaggaugccguaga

SEQ ID NO: 3226054 - RNA, 16 nt, Mycobacterium leprae
cgccgaggugggcccc

SEQ ID NO: 3226055 - RNA, 13 nt, Mycobacterium leprae
cgccgagucgcug

SEQ ID NO: 3226056 - RNA, 17 nt, Mycobacterium leprae
cgccgauaucgaccagc

SEQ ID NO: 3226057 - RNA, 19 nt, Mycobacterium leprae
cgccgauaucgaccagcca

SEQ ID NO: 3226058 - RNA, 22 nt, Mycobacterium leprae
cgccgauaucgaccagccaagc

SEQ ID NO: 3226059 - RNA, 23 nt, Mycobacterium leprae
cgccgaucccaucggcugcaccg

SEQ ID NO: 3226060 - RNA, 23 nt, Mycobacterium leprae
cgccgccuuuacgaagccgccac

SEQ ID NO: 3226061 - RNA, 18 nt, Mycobacterium leprae
cgccgcgcaucaucgccc

SEQ ID NO: 3226062 - RNA, 23 nt, Mycobacterium leprae
cgccgcgcaucaucgcccaccgc

SEQ ID NO: 3226063 - RNA, 14 nt, Mycobacterium leprae
cgccgcggcugccg

SEQ ID NO: 3226064 - RNA, 19 nt, Mycobacterium leprae
cgccgcuacacugcagcgg

SEQ ID NO: 3226065 - RNA, 20 nt, Mycobacterium leprae
cgccggagcgaagcacccgg

SEQ ID NO: 3226066 - RNA, 20 nt, Mycobacterium leprae
cgccggccgcacccggcagc

SEQ ID NO: 3226067 - RNA, 21 nt, Mycobacterium leprae
cgccggccgcacccggcagca

SEQ ID NO: 3226068 - RNA, 17 nt, Mycobacterium leprae
cgccggcggccaccgcg

SEQ ID NO: 3226069 - RNA, 22 nt, Mycobacterium leprae
cgccggcgucaaagucgcgggc

SEQ ID NO: 3226070 - RNA, 23 nt, Mycobacterium leprae
cgccggcgucggccaguaccucc

SEQ ID NO: 3226071 - RNA, 16 nt, Mycobacterium leprae
cgccggcuacuggacg

SEQ ID NO: 3226072 - RNA, 23 nt, Mycobacterium leprae
cgccgggcacuugggucaccgcc

SEQ ID NO: 3226073 - RNA, 18 nt, Mycobacterium leprae
cgccggggauuucaggug

SEQ ID NO: 3226074 - RNA, 17 nt, Mycobacterium leprae
cgccggucgugcaugcg

SEQ ID NO: 3226075 - RNA, 20 nt, Mycobacterium leprae
cgccggucgugcaugcggau

SEQ ID NO: 3226076 - RNA, 21 nt, Mycobacterium leprae
cgccgucauauaacggcuuca

SEQ ID NO: 3226077 - RNA, 20 nt, Mycobacterium leprae
cgccguggaggugcggcugg

SEQ ID NO: 3226078 - RNA, 21 nt, Mycobacterium leprae
cgccuaaucuagccucgguca

SEQ ID NO: 3226079 - RNA, 20 nt, Mycobacterium leprae
cgccuagagagugcggugcu

SEQ ID NO: 3226080 - RNA, 21 nt, Mycobacterium leprae
cgccucaaugcagacacgccg

SEQ ID NO: 3226081 - RNA, 19 nt, Mycobacterium leprae
cgccucgucggccagcacu

SEQ ID NO: 3226082 - RNA, 21 nt, Mycobacterium leprae
cgccugcuugaggucgcacag

SEQ ID NO: 3226083 - RNA, 16 nt, Mycobacterium leprae
cgccugggaacccauu

SEQ ID NO: 3226084 - RNA, 18 nt, Mycobacterium leprae
cgccuuccaacgcggccg

SEQ ID NO: 3226085 - RNA, 20 nt, Mycobacterium leprae
cgccuucgaaccgauuuucu

SEQ ID NO: 3226086 - RNA, 22 nt, Mycobacterium leprae
cgccuucgaaccgauuuucucg

SEQ ID NO: 3226087 - RNA, 13 nt, Mycobacterium leprae
cgccuugcaagcc

SEQ ID NO: 3226088 - RNA, 16 nt, Mycobacterium leprae
cgccuugcugccggcg

SEQ ID NO: 3226089 - RNA, 15 nt, Mycobacterium leprae
cgcgaauauguugcu

SEQ ID NO: 3226090 - RNA, 20 nt, Mycobacterium leprae
cgcgacaaucucggcaucca

SEQ ID NO: 3226091 - RNA, 17 nt, Mycobacterium leprae
cgcgacaguaucgacca

SEQ ID NO: 3226092 - RNA, 22 nt, Mycobacterium leprae
cgcgacaguaucgaccagccac

SEQ ID NO: 3226093 - RNA, 16 nt, Mycobacterium leprae
cgcgaccaacccggcg

SEQ ID NO: 3226094 - RNA, 12 nt, Mycobacterium leprae
cgcgaccaacgc

SEQ ID NO: 3226095 - RNA, 15 nt, Mycobacterium leprae
cgcgaccgccaccag

SEQ ID NO: 3226096 - RNA, 18 nt, Mycobacterium leprae
cgcgaccuugcggcgccc

SEQ ID NO: 3226097 - RNA, 14 nt, Mycobacterium leprae
cgcgacgccgccau

SEQ ID NO: 3226098 - RNA, 15 nt, Mycobacterium leprae
cgcgacgccgccaua

SEQ ID NO: 3226099 - RNA, 22 nt, Mycobacterium leprae
cgcgacgccggccgucgcggga

SEQ ID NO: 3226100 - RNA, 13 nt, Mycobacterium leprae
cgcgacggcaagu

SEQ ID NO: 3226101 - RNA, 19 nt, Mycobacterium leprae
cgcgagaaaaucagaugua

SEQ ID NO: 3226102 - RNA, 20 nt, Mycobacterium leprae
cgcgagaauuuugugcugcg

SEQ ID NO: 3226103 - RNA, 13 nt, Mycobacterium leprae
cgcgagugcuggu

SEQ ID NO: 3226104 - RNA, 14 nt, Mycobacterium leprae
cgcgauaccggcga

SEQ ID NO: 3226105 - RNA, 21 nt, Mycobacterium leprae
cgcgaucuggauggccgccag

SEQ ID NO: 3226106 - RNA, 22 nt, Mycobacterium leprae
cgcgaucuggauggccgccagc

SEQ ID NO: 3226107 - RNA, 23 nt, Mycobacterium leprae
cgcgaucuggauggccgccagca

SEQ ID NO: 3226108 - RNA, 18 nt, Mycobacterium leprae
cgcgauggggggcagcag

SEQ ID NO: 3226109 - RNA, 13 nt, Mycobacterium leprae
cgcgauguuuugg

SEQ ID NO: 3226110 - RNA, 14 nt, Mycobacterium leprae
cgcgcagaacacga

SEQ ID NO: 3226111 - RNA, 15 nt, Mycobacterium leprae
cgcgcauacacggca

SEQ ID NO: 3226112 - RNA, 17 nt, Mycobacterium leprae
cgcgcauacacggcagc

SEQ ID NO: 3226113 - RNA, 14 nt, Mycobacterium leprae
cgcgcaucaucgcc

SEQ ID NO: 3226114 - RNA, 15 nt, Mycobacterium leprae
cgcgcaucaucgccc

SEQ ID NO: 3226115 - RNA, 16 nt, Mycobacterium leprae
cgcgcaucaucgccca

SEQ ID NO: 3226116 - RNA, 20 nt, Mycobacterium leprae
cgcgcaucaucgcccaccgc

SEQ ID NO: 3226117 - RNA, 13 nt, Mycobacterium leprae
cgcgcauuggcca

SEQ ID NO: 3226118 - RNA, 22 nt, Mycobacterium leprae
cgcgccaaacacggccagcgcg

SEQ ID NO: 3226119 - RNA, 15 nt, Mycobacterium leprae
cgcgcccgagccguu

SEQ ID NO: 3226120 - RNA, 18 nt, Mycobacterium leprae
cgcgccgaccucggcgcu

SEQ ID NO: 3226121 - RNA, 18 nt, Mycobacterium leprae
cgcgccgcgugggggucc

SEQ ID NO: 3226122 - RNA, 22 nt, Mycobacterium leprae
cgcgcgacaguaucgaccagcc

SEQ ID NO: 3226123 - RNA, 19 nt, Mycobacterium leprae
cgcgcgcuaguucgacacc

SEQ ID NO: 3226124 - RNA, 14 nt, Mycobacterium leprae
cgcgcgcucacagc

SEQ ID NO: 3226125 - RNA, 24 nt, Mycobacterium leprae
cgcgcuccgccggcgacaacuguu

SEQ ID NO: 3226126 - RNA, 17 nt, Mycobacterium leprae
cgcgcugaagccgcugg

SEQ ID NO: 3226127 - RNA, 22 nt, Mycobacterium leprae
cgcgcuuucggagaucgacuug

SEQ ID NO: 3226128 - RNA, 19 nt, Mycobacterium leprae
cgcggacagauucccgcug

SEQ ID NO: 3226129 - RNA, 21 nt, Mycobacterium leprae
cgcggagucaugauccagcug

SEQ ID NO: 3226130 - RNA, 20 nt, Mycobacterium leprae
cgcggcaacaacggaucggc

SEQ ID NO: 3226131 - RNA, 15 nt, Mycobacterium leprae
cgcggccgcagcgcg

SEQ ID NO: 3226132 - RNA, 23 nt, Mycobacterium leprae
cgcggcgggcaagccauugcucg

SEQ ID NO: 3226133 - RNA, 15 nt, Mycobacterium leprae
cgcggcugccacugu

SEQ ID NO: 3226134 - RNA, 17 nt, Mycobacterium leprae
cgcgggagcggugccgc

SEQ ID NO: 3226135 - RNA, 21 nt, Mycobacterium leprae
cgcgggcggucgcaugaguga

SEQ ID NO: 3226136 - RNA, 13 nt, Mycobacterium leprae
cgcgggcuugcuc

SEQ ID NO: 3226137 - RNA, 14 nt, Mycobacterium leprae
cgcggggaugcuga

SEQ ID NO: 3226138 - RNA, 18 nt, Mycobacterium leprae
cgcggggcgaugucgacc

SEQ ID NO: 3226139 - RNA, 17 nt, Mycobacterium leprae
cgcggggggaucggggc

SEQ ID NO: 3226140 - RNA, 21 nt, Mycobacterium leprae
cgcgguacaaucagucgggcc

SEQ ID NO: 3226141 - RNA, 12 nt, Mycobacterium leprae
cgcgguagauau

SEQ ID NO: 3226142 - RNA, 19 nt, Mycobacterium leprae
cgcgguaguuuccugagca

SEQ ID NO: 3226143 - RNA, 16 nt, Mycobacterium leprae
cgcgguccuguccagg

SEQ ID NO: 3226144 - RNA, 20 nt, Mycobacterium leprae
cgcggugggcuuccagcaga

SEQ ID NO: 3226145 - RNA, 22 nt, Mycobacterium leprae
cgcggugggcuuccagcagacc

SEQ ID NO: 3226146 - RNA, 18 nt, Mycobacterium leprae
cgcggugugucccgucug

SEQ ID NO: 3226147 - RNA, 16 nt, Mycobacterium leprae
cgcgguuuccgcggca

SEQ ID NO: 3226148 - RNA, 16 nt, Mycobacterium leprae
cgcguacuccagcagc

SEQ ID NO: 3226149 - RNA, 13 nt, Mycobacterium leprae
cgcguagugaugg

SEQ ID NO: 3226150 - RNA, 20 nt, Mycobacterium leprae
cgcgugaucgcuccugcagc

SEQ ID NO: 3226151 - RNA, 15 nt, Mycobacterium leprae
cgcgugccagcgcug

SEQ ID NO: 3226152 - RNA, 14 nt, Mycobacterium leprae
cgcgugcggcgccc

SEQ ID NO: 3226153 - RNA, 13 nt, Mycobacterium leprae
cgcguguuugcgg

SEQ ID NO: 3226154 - RNA, 18 nt, Mycobacterium leprae
cgcguuaggucuccuggu

SEQ ID NO: 3226155 - RNA, 15 nt, Mycobacterium leprae
cgcguucguugcuga

SEQ ID NO: 3226156 - RNA, 16 nt, Mycobacterium leprae
cgcguugaccaaaccg

SEQ ID NO: 3226157 - RNA, 18 nt, Mycobacterium leprae
cgcuaacuucccgacggu

SEQ ID NO: 3226158 - RNA, 20 nt, Mycobacterium leprae
cgcuaagaaagacacgacag

SEQ ID NO: 3226159 - RNA, 14 nt, Mycobacterium leprae
cgcuaaggcugcug

SEQ ID NO: 3226160 - RNA, 20 nt, Mycobacterium leprae
cgcuaagguggagcgaccga

SEQ ID NO: 3226161 - RNA, 22 nt, Mycobacterium leprae
cgcuaagguggagcgaccgagc

SEQ ID NO: 3226162 - RNA, 14 nt, Mycobacterium leprae
cgcuacaaccuucc

SEQ ID NO: 3226163 - RNA, 23 nt, Mycobacterium leprae
cgcuacaaccuuccgcaaaguua

SEQ ID NO: 3226164 - RNA, 14 nt, Mycobacterium leprae
cgcuacccuugagc

SEQ ID NO: 3226165 - RNA, 17 nt, Mycobacterium leprae
cgcuaccgaggaaugcc

SEQ ID NO: 3226166 - RNA, 20 nt, Mycobacterium leprae
cgcuacgauuuugcaacgga

SEQ ID NO: 3226167 - RNA, 23 nt, Mycobacterium leprae
cgcuacggcgguguuucucgccg

SEQ ID NO: 3226168 - RNA, 17 nt, Mycobacterium leprae
cgcuagaaacaggcaua

SEQ ID NO: 3226169 - RNA, 22 nt, Mycobacterium leprae
cgcuaucauagccacucgccac

SEQ ID NO: 3226170 - RNA, 16 nt, Mycobacterium leprae
cgcuaugccauccacc

SEQ ID NO: 3226171 - RNA, 21 nt, Mycobacterium leprae
cgcuaugccauccaccgccga

SEQ ID NO: 3226172 - RNA, 21 nt, Mycobacterium leprae
cgcuaugcggacggacacugu

SEQ ID NO: 3226173 - RNA, 19 nt, Mycobacterium leprae
cgcuauggauacucaauug

SEQ ID NO: 3226174 - RNA, 19 nt, Mycobacterium leprae
cgcuaugugcaaucgaucc

SEQ ID NO: 3226175 - RNA, 23 nt, Mycobacterium leprae
cgcuaugugcaaucgauccggcg

SEQ ID NO: 3226176 - RNA, 17 nt, Mycobacterium leprae
cgcucaaagccugcguc

SEQ ID NO: 3226177 - RNA, 18 nt, Mycobacterium leprae
cgcucacagcaguccgcu

SEQ ID NO: 3226178 - RNA, 14 nt, Mycobacterium leprae
cgcucacccgcgcc

SEQ ID NO: 3226179 - RNA, 17 nt, Mycobacterium leprae
cgcucacccgcgccgcc

SEQ ID NO: 3226180 - RNA, 22 nt, Mycobacterium leprae
cgcucaccgacggaugcccagc

SEQ ID NO: 3226181 - RNA, 15 nt, Mycobacterium leprae
cgcucagcauugcuc

SEQ ID NO: 3226182 - RNA, 20 nt, Mycobacterium leprae
cgcucagcggccagacacca

SEQ ID NO: 3226183 - RNA, 17 nt, Mycobacterium leprae
cgcucaggcuaccgagc

SEQ ID NO: 3226184 - RNA, 16 nt, Mycobacterium leprae
cgcucauccgacggcu

SEQ ID NO: 3226185 - RNA, 12 nt, Mycobacterium leprae
cgcuccacaucg

SEQ ID NO: 3226186 - RNA, 13 nt, Mycobacterium leprae
cgcucccaggggg

SEQ ID NO: 3226187 - RNA, 20 nt, Mycobacterium leprae
cgcuccugcagcgcggacuc

SEQ ID NO: 3226188 - RNA, 21 nt, Mycobacterium leprae
cgcuccuucuuaucucaucgu

SEQ ID NO: 3226189 - RNA, 15 nt, Mycobacterium leprae
cgcucgaaagccucg

SEQ ID NO: 3226190 - RNA, 19 nt, Mycobacterium leprae
cgcucgauucucgagcggc

SEQ ID NO: 3226191 - RNA, 11 nt, Mycobacterium leprae
cgcucgccggg

SEQ ID NO: 3226192 - RNA, 18 nt, Mycobacterium leprae
cgcucgcuuuccgcgccc

SEQ ID NO: 3226193 - RNA, 14 nt, Mycobacterium leprae
cgcucgguaagcug

SEQ ID NO: 3226194 - RNA, 22 nt, Mycobacterium leprae
cgcucggugagauagcggcggu

SEQ ID NO: 3226195 - RNA, 18 nt, Mycobacterium leprae
cgcucuaauacagagcgu

SEQ ID NO: 3226196 - RNA, 17 nt, Mycobacterium leprae
cgcugaaccgcgucggc

SEQ ID NO: 3226197 - RNA, 14 nt, Mycobacterium leprae
cgcugaccagcaga

SEQ ID NO: 3226198 - RNA, 16 nt, Mycobacterium leprae
cgcugaggcagcagcu

SEQ ID NO: 3226199 - RNA, 21 nt, Mycobacterium leprae
cgcugaucgcgauaccggcga

SEQ ID NO: 3226200 - RNA, 22 nt, Mycobacterium leprae
cgcugauguccaaagacgccuc

SEQ ID NO: 3226201 - RNA, 16 nt, Mycobacterium leprae
cgcugauugccaacuc

SEQ ID NO: 3226202 - RNA, 17 nt, Mycobacterium leprae
cgcugcacauucaacca

SEQ ID NO: 3226203 - RNA, 18 nt, Mycobacterium leprae
cgcugcacauucaaccag

SEQ ID NO: 3226204 - RNA, 21 nt, Mycobacterium leprae
cgcugcacauucaaccagcca

SEQ ID NO: 3226205 - RNA, 15 nt, Mycobacterium leprae
cgcugcagcaacagc

SEQ ID NO: 3226206 - RNA, 14 nt, Mycobacterium leprae
cgcugcauccgcag

SEQ ID NO: 3226207 - RNA, 16 nt, Mycobacterium leprae
cgcugcccaccaguag

SEQ ID NO: 3226208 - RNA, 19 nt, Mycobacterium leprae
cgcugccggaguacaccaa

SEQ ID NO: 3226209 - RNA, 22 nt, Mycobacterium leprae
cgcugcgcagcgucgucuuucu

SEQ ID NO: 3226210 - RNA, 14 nt, Mycobacterium leprae
cgcugcgugaagca

SEQ ID NO: 3226211 - RNA, 13 nt, Mycobacterium leprae
cgcuggagcaccu

SEQ ID NO: 3226212 - RNA, 14 nt, Mycobacterium leprae
cgcuggaucggugc

SEQ ID NO: 3226213 - RNA, 15 nt, Mycobacterium leprae
cgcuggcccugccug

SEQ ID NO: 3226214 - RNA, 17 nt, Mycobacterium leprae
cgcuggcccugccuguu

SEQ ID NO: 3226215 - RNA, 12 nt, Mycobacterium leprae
cgcuggccgccg

SEQ ID NO: 3226216 - RNA, 15 nt, Mycobacterium leprae
cgcuggccgccgggc

SEQ ID NO: 3226217 - RNA, 17 nt, Mycobacterium leprae
cgcugggacaugaagcc

SEQ ID NO: 3226218 - RNA, 21 nt, Mycobacterium leprae
cgcugugcaaauacgcgcgcu

SEQ ID NO: 3226219 - RNA, 20 nt, Mycobacterium leprae
cgcuguucgugaucgacggc

SEQ ID NO: 3226220 - RNA, 21 nt, Mycobacterium leprae
cgcuguuguuggucggcgcug

SEQ ID NO: 3226221 - RNA, 17 nt, Mycobacterium leprae
cgcuucaacguugaagc

SEQ ID NO: 3226222 - RNA, 16 nt, Mycobacterium leprae
cgcuucaucagcucug

SEQ ID NO: 3226223 - RNA, 18 nt, Mycobacterium leprae
cgcuucaucgugaaucag

SEQ ID NO: 3226224 - RNA, 19 nt, Mycobacterium leprae
cgcuugguugcggguacga

SEQ ID NO: 3226225 - RNA, 18 nt, Mycobacterium leprae
cgcuuguaaggccagcag

SEQ ID NO: 3226226 - RNA, 19 nt, Mycobacterium leprae
cgcuuuccgcgccccuucc

SEQ ID NO: 3226227 - RNA, 17 nt, Mycobacterium leprae
cgcuuugcuggcaagcu

SEQ ID NO: 3226228 - RNA, 17 nt, Mycobacterium leprae
cgcuuuuugugaacaua

SEQ ID NO: 3226229 - RNA, 18 nt, Mycobacterium leprae
cggaaagaucgcccaccg

SEQ ID NO: 3226230 - RNA, 20 nt, Mycobacterium leprae
cggaaagugccgcggucuag

SEQ ID NO: 3226231 - RNA, 20 nt, Mycobacterium leprae
cggaaauaacgggcaugcag

SEQ ID NO: 3226232 - RNA, 20 nt, Mycobacterium leprae
cggaaauacggcagugagcu

SEQ ID NO: 3226233 - RNA, 18 nt, Mycobacterium leprae
cggaacaacagacacauu

SEQ ID NO: 3226234 - RNA, 12 nt, Mycobacterium leprae
cggaacagcauc

SEQ ID NO: 3226235 - RNA, 18 nt, Mycobacterium leprae
cggaacaucacacggcgc

SEQ ID NO: 3226236 - RNA, 19 nt, Mycobacterium leprae
cggaacaucgcgaaugacg

SEQ ID NO: 3226237 - RNA, 17 nt, Mycobacterium leprae
cggaacgacacugaacc

SEQ ID NO: 3226238 - RNA, 20 nt, Mycobacterium leprae
cggaagcccucccagccauc

SEQ ID NO: 3226239 - RNA, 18 nt, Mycobacterium leprae
cggaaguuagcgcagcug

SEQ ID NO: 3226240 - RNA, 19 nt, Mycobacterium leprae
cggaauaaucacagccucc

SEQ ID NO: 3226241 - RNA, 21 nt, Mycobacterium leprae
cggaauacaucggcacgacag

SEQ ID NO: 3226242 - RNA, 13 nt, Mycobacterium leprae
cggaauggcggca

SEQ ID NO: 3226243 - RNA, 17 nt, Mycobacterium leprae
cggaauguccaccagcc

SEQ ID NO: 3226244 - RNA, 18 nt, Mycobacterium leprae
cggaauguccaccagccg

SEQ ID NO: 3226245 - RNA, 15 nt, Mycobacterium leprae
cggacaagcaguguc

SEQ ID NO: 3226246 - RNA, 21 nt, Mycobacterium leprae
cggacaagcagugucugggcc

SEQ ID NO: 3226247 - RNA, 19 nt, Mycobacterium leprae
cggacaagccguuccauuc

SEQ ID NO: 3226248 - RNA, 18 nt, Mycobacterium leprae
cggacagcacccccggcc

SEQ ID NO: 3226249 - RNA, 18 nt, Mycobacterium leprae
cggacagcggcccaaccc

SEQ ID NO: 3226250 - RNA, 17 nt, Mycobacterium leprae
cggacaguccaccgcca

SEQ ID NO: 3226251 - RNA, 18 nt, Mycobacterium leprae
cggacaucauugcgacga

SEQ ID NO: 3226252 - RNA, 13 nt, Mycobacterium leprae
cggaccacuauuu

SEQ ID NO: 3226253 - RNA, 18 nt, Mycobacterium leprae
cggaccccauagcgccuc

SEQ ID NO: 3226254 - RNA, 13 nt, Mycobacterium leprae
cggacgcugaaac

SEQ ID NO: 3226255 - RNA, 16 nt, Mycobacterium leprae
cggacggcccagcacc

SEQ ID NO: 3226256 - RNA, 11 nt, Mycobacterium leprae
cggacgugguc

SEQ ID NO: 3226257 - RNA, 20 nt, Mycobacterium leprae
cggacucuccccacugcagg

SEQ ID NO: 3226258 - RNA, 14 nt, Mycobacterium leprae
cggacugacaccgc

SEQ ID NO: 3226259 - RNA, 15 nt, Mycobacterium leprae
cggacugcuugggcg

SEQ ID NO: 3226260 - RNA, 18 nt, Mycobacterium leprae
cggagaauauagccuugg

SEQ ID NO: 3226261 - RNA, 17 nt, Mycobacterium leprae
cggagauagacaugugu

SEQ ID NO: 3226262 - RNA, 23 nt, Mycobacterium leprae
cggagcaagcgcuaugccaucca

SEQ ID NO: 3226263 - RNA, 21 nt, Mycobacterium leprae
cggagcgauccgguaggccga

SEQ ID NO: 3226264 - RNA, 17 nt, Mycobacterium leprae
cggagcgcggagcuggu

SEQ ID NO: 3226265 - RNA, 12 nt, Mycobacterium leprae
cggaggcggcca

SEQ ID NO: 3226266 - RNA, 20 nt, Mycobacterium leprae
cggaggcggccacgugcaca

SEQ ID NO: 3226267 - RNA, 19 nt, Mycobacterium leprae
cggaggguugccgacggcc

SEQ ID NO: 3226268 - RNA, 22 nt, Mycobacterium leprae
cggaguacaccaagaacuucaa

SEQ ID NO: 3226269 - RNA, 16 nt, Mycobacterium leprae
cggaguucuucacacg

SEQ ID NO: 3226270 - RNA, 21 nt, Mycobacterium leprae
cggaguuugcgcucgucgaug

SEQ ID NO: 3226271 - RNA, 19 nt, Mycobacterium leprae
cggauccaucagaccaccu

SEQ ID NO: 3226272 - RNA, 17 nt, Mycobacterium leprae
cggauccuguugacugg

SEQ ID NO: 3226273 - RNA, 17 nt, Mycobacterium leprae
cggaugaauaucaucgc

SEQ ID NO: 3226274 - RNA, 18 nt, Mycobacterium leprae
cggaugaauaucaucgcc

SEQ ID NO: 3226275 - RNA, 14 nt, Mycobacterium leprae
cggaugagcuccau

SEQ ID NO: 3226276 - RNA, 17 nt, Mycobacterium leprae
cggaugauagccguagu

SEQ ID NO: 3226277 - RNA, 15 nt, Mycobacterium leprae
cggaugcccagccag

SEQ ID NO: 3226278 - RNA, 13 nt, Mycobacterium leprae
cggaugccuuugu

SEQ ID NO: 3226279 - RNA, 17 nt, Mycobacterium leprae
cggaugugucagcaccg

SEQ ID NO: 3226280 - RNA, 23 nt, Mycobacterium leprae
cggauucguugggagccgcgcgc

SEQ ID NO: 3226281 - RNA, 17 nt, Mycobacterium leprae
cggauuugcagagcauc

SEQ ID NO: 3226282 - RNA, 12 nt, Mycobacterium leprae
cggcaaccgcaa

SEQ ID NO: 3226283 - RNA, 19 nt, Mycobacterium leprae
cggcaacggcaccaaaccc

SEQ ID NO: 3226284 - RNA, 18 nt, Mycobacterium leprae
cggcaagaagugcgacga

SEQ ID NO: 3226285 - RNA, 14 nt, Mycobacterium leprae
cggcaagcugcccg

SEQ ID NO: 3226286 - RNA, 15 nt, Mycobacterium leprae
cggcaagcugcccgg

SEQ ID NO: 3226287 - RNA, 19 nt, Mycobacterium leprae
cggcaagcugcccggcgaa

SEQ ID NO: 3226288 - RNA, 21 nt, Mycobacterium leprae
cggcacagugccugaccaucg

SEQ ID NO: 3226289 - RNA, 18 nt, Mycobacterium leprae
cggcacaucgaaccgacg

SEQ ID NO: 3226290 - RNA, 18 nt, Mycobacterium leprae
cggcacaucgucggccca

SEQ ID NO: 3226291 - RNA, 21 nt, Mycobacterium leprae
cggcaccaauguugcccgcaa

SEQ ID NO: 3226292 - RNA, 22 nt, Mycobacterium leprae
cggcaccgcgaagccguugaug

SEQ ID NO: 3226293 - RNA, 19 nt, Mycobacterium leprae
cggcacgauaggcagugcu

SEQ ID NO: 3226294 - RNA, 22 nt, Mycobacterium leprae
cggcacguucgaucggcagcca

SEQ ID NO: 3226295 - RNA, 14 nt, Mycobacterium leprae
cggcagagcccggc

SEQ ID NO: 3226296 - RNA, 14 nt, Mycobacterium leprae
cggcagagcguucg

SEQ ID NO: 3226297 - RNA, 14 nt, Mycobacterium leprae
cggcagaucgaucu

SEQ ID NO: 3226298 - RNA, 16 nt, Mycobacterium leprae
cggcagcauccgccga

SEQ ID NO: 3226299 - RNA, 15 nt, Mycobacterium leprae
cggcagcuggaaagu

SEQ ID NO: 3226300 - RNA, 22 nt, Mycobacterium leprae
cggcagcuggaaagucgggauc

SEQ ID NO: 3226301 - RNA, 14 nt, Mycobacterium leprae
cggcagcugguugu

SEQ ID NO: 3226302 - RNA, 19 nt, Mycobacterium leprae
cggcagcugguuguccacg

SEQ ID NO: 3226303 - RNA, 16 nt, Mycobacterium leprae
cggcaggccggccugg

SEQ ID NO: 3226304 - RNA, 17 nt, Mycobacterium leprae
cggcaggccggccugga

SEQ ID NO: 3226305 - RNA, 22 nt, Mycobacterium leprae
cggcagguggaucgucggccgg

SEQ ID NO: 3226306 - RNA, 19 nt, Mycobacterium leprae
cggcaguccuuuccagcca

SEQ ID NO: 3226307 - RNA, 22 nt, Mycobacterium leprae
cggcagugguaaucgacaggca

SEQ ID NO: 3226308 - RNA, 21 nt, Mycobacterium leprae
cggcaucugguagccguucgg

SEQ ID NO: 3226309 - RNA, 16 nt, Mycobacterium leprae
cggcauucccaaccgc

SEQ ID NO: 3226310 - RNA, 18 nt, Mycobacterium leprae
cggcauucccaaccgcga

SEQ ID NO: 3226311 - RNA, 17 nt, Mycobacterium leprae
cggcauugccggggcug

SEQ ID NO: 3226312 - RNA, 22 nt, Mycobacterium leprae
cggcauugccggggcugcgcug

SEQ ID NO: 3226313 - RNA, 18 nt, Mycobacterium leprae
cggccacauugaccacgc

SEQ ID NO: 3226314 - RNA, 22 nt, Mycobacterium leprae
cggccaccgcgaacgccucggc

SEQ ID NO: 3226315 - RNA, 15 nt, Mycobacterium leprae
cggccacgugcacau

SEQ ID NO: 3226316 - RNA, 16 nt, Mycobacterium leprae
cggccacugcacgacc

SEQ ID NO: 3226317 - RNA, 17 nt, Mycobacterium leprae
cggccacugcacgacca

SEQ ID NO: 3226318 - RNA, 17 nt, Mycobacterium leprae
cggccagacacuggcgg

SEQ ID NO: 3226319 - RNA, 18 nt, Mycobacterium leprae
cggccagacacuggcgga

SEQ ID NO: 3226320 - RNA, 14 nt, Mycobacterium leprae
cggccagauccagc

SEQ ID NO: 3226321 - RNA, 16 nt, Mycobacterium leprae
cggccagccaggaugc

SEQ ID NO: 3226322 - RNA, 10 nt, Mycobacterium leprae
cggccagcgc

SEQ ID NO: 3226323 - RNA, 13 nt, Mycobacterium leprae
cggccagcgcauc

SEQ ID NO: 3226324 - RNA, 20 nt, Mycobacterium leprae
cggccagcgcaucagccaac

SEQ ID NO: 3226325 - RNA, 23 nt, Mycobacterium leprae
cggccagcgcaucagccaacacc

SEQ ID NO: 3226326 - RNA, 16 nt, Mycobacterium leprae
cggccagggccguugg

SEQ ID NO: 3226327 - RNA, 13 nt, Mycobacterium leprae
cggccaguaacca

SEQ ID NO: 3226328 - RNA, 16 nt, Mycobacterium leprae
cggcccagugcacuga

SEQ ID NO: 3226329 - RNA, 15 nt, Mycobacterium leprae
cggccccccggggcu

SEQ ID NO: 3226330 - RNA, 21 nt, Mycobacterium leprae
cggccccuuucacgucggcgu

SEQ ID NO: 3226331 - RNA, 17 nt, Mycobacterium leprae
cggcccucgcgcggggc

SEQ ID NO: 3226332 - RNA, 16 nt, Mycobacterium leprae
cggcccuggccggcac

SEQ ID NO: 3226333 - RNA, 13 nt, Mycobacterium leprae
cggccgaacuugg

SEQ ID NO: 3226334 - RNA, 14 nt, Mycobacterium leprae
cggccgaucauggc

SEQ ID NO: 3226335 - RNA, 17 nt, Mycobacterium leprae
cggccgaucauggcugg

SEQ ID NO: 3226336 - RNA, 23 nt, Mycobacterium leprae
cggccgaucgugugcacugcuuc

SEQ ID NO: 3226337 - RNA, 14 nt, Mycobacterium leprae
cggccgcacccggc

SEQ ID NO: 3226338 - RNA, 13 nt, Mycobacterium leprae
cggccgccacgcc

SEQ ID NO: 3226339 - RNA, 19 nt, Mycobacterium leprae
cggccgccacgccgugcuu

SEQ ID NO: 3226340 - RNA, 14 nt, Mycobacterium leprae
cggccgccaggucc

SEQ ID NO: 3226341 - RNA, 21 nt, Mycobacterium leprae
cggccgcccaggugucuucca

SEQ ID NO: 3226342 - RNA, 14 nt, Mycobacterium leprae
cggccgcggacaag

SEQ ID NO: 3226343 - RNA, 15 nt, Mycobacterium leprae
cggccgcggacaaga

SEQ ID NO: 3226344 - RNA, 20 nt, Mycobacterium leprae
cggccgcggcgaccuggucg

SEQ ID NO: 3226345 - RNA, 23 nt, Mycobacterium leprae
cggccgcgguggcgugcucuucc

SEQ ID NO: 3226346 - RNA, 14 nt, Mycobacterium leprae
cggccggcaagcug

SEQ ID NO: 3226347 - RNA, 15 nt, Mycobacterium leprae
cggccggccccugag

SEQ ID NO: 3226348 - RNA, 19 nt, Mycobacterium leprae
cggccgggcaaaccacuua

SEQ ID NO: 3226349 - RNA, 16 nt, Mycobacterium leprae
cggccggugaugacga

SEQ ID NO: 3226350 - RNA, 16 nt, Mycobacterium leprae
cggccguaaucaagau

SEQ ID NO: 3226351 - RNA, 21 nt, Mycobacterium leprae
cggccgucgcgggugggucga

SEQ ID NO: 3226352 - RNA, 14 nt, Mycobacterium leprae
cggccgucgcucgg

SEQ ID NO: 3226353 - RNA, 15 nt, Mycobacterium leprae
cggccgucggcggca

SEQ ID NO: 3226354 - RNA, 18 nt, Mycobacterium leprae
cggccucacaguaggcca

SEQ ID NO: 3226355 - RNA, 20 nt, Mycobacterium leprae
cggccucacaguaggccagc

SEQ ID NO: 3226356 - RNA, 22 nt, Mycobacterium leprae
cggccucacaguaggccagccc

SEQ ID NO: 3226357 - RNA, 13 nt, Mycobacterium leprae
cggccucgugcug

SEQ ID NO: 3226358 - RNA, 15 nt, Mycobacterium leprae
cggccuguugauggg

SEQ ID NO: 3226359 - RNA, 15 nt, Mycobacterium leprae
cggccuuaucgucuu

SEQ ID NO: 3226360 - RNA, 20 nt, Mycobacterium leprae
cggccuuaucgucuugcagc

SEQ ID NO: 3226361 - RNA, 14 nt, Mycobacterium leprae
cggccuuggcagcc

SEQ ID NO: 3226362 - RNA, 15 nt, Mycobacterium leprae
cggcgaaagucgcua

SEQ ID NO: 3226363 - RNA, 15 nt, Mycobacterium leprae
cggcgaaucggucug

SEQ ID NO: 3226364 - RNA, 18 nt, Mycobacterium leprae
cggcgacacagagcgcuc

SEQ ID NO: 3226365 - RNA, 19 nt, Mycobacterium leprae
cggcgaccuggucgagcag

SEQ ID NO: 3226366 - RNA, 14 nt, Mycobacterium leprae
cggcgacguuuugu

SEQ ID NO: 3226367 - RNA, 13 nt, Mycobacterium leprae
cggcgagcaagcg

SEQ ID NO: 3226368 - RNA, 13 nt, Mycobacterium leprae
cggcgauaacggc

SEQ ID NO: 3226369 - RNA, 15 nt, Mycobacterium leprae
cggcgauauccgccg

SEQ ID NO: 3226370 - RNA, 16 nt, Mycobacterium leprae
cggcgauauccgccgg

SEQ ID NO: 3226371 - RNA, 19 nt, Mycobacterium leprae
cggcgauauccgccggccg

SEQ ID NO: 3226372 - RNA, 20 nt, Mycobacterium leprae
cggcgauauccgccggccgc

SEQ ID NO: 3226373 - RNA, 21 nt, Mycobacterium leprae
cggcgauauccgccggccgca

SEQ ID NO: 3226374 - RNA, 15 nt, Mycobacterium leprae
cggcgauugccacca

SEQ ID NO: 3226375 - RNA, 19 nt, Mycobacterium leprae
cggcgauugccaccaccac

SEQ ID NO: 3226376 - RNA, 19 nt, Mycobacterium leprae
cggcgcacguaagcauguc

SEQ ID NO: 3226377 - RNA, 20 nt, Mycobacterium leprae
cggcgccaggcguccucauc

SEQ ID NO: 3226378 - RNA, 15 nt, Mycobacterium leprae
cggcgcccagcaccu

SEQ ID NO: 3226379 - RNA, 13 nt, Mycobacterium leprae
cggcgccgcccgg

SEQ ID NO: 3226380 - RNA, 16 nt, Mycobacterium leprae
cggcgccugaacugga

SEQ ID NO: 3226381 - RNA, 23 nt, Mycobacterium leprae
cggcgccugaacuggaucgguca

SEQ ID NO: 3226382 - RNA, 14 nt, Mycobacterium leprae
cggcggacgaucga

SEQ ID NO: 3226383 - RNA, 21 nt, Mycobacterium leprae
cggcggcacgguguugaccca

SEQ ID NO: 3226384 - RNA, 18 nt, Mycobacterium leprae
cggcggcagauguuggcc

SEQ ID NO: 3226385 - RNA, 21 nt, Mycobacterium leprae
cggcggcagauguuggcccgu

SEQ ID NO: 3226386 - RNA, 20 nt, Mycobacterium leprae
cggcggccaauucgccgacc

SEQ ID NO: 3226387 - RNA, 12 nt, Mycobacterium leprae
cggcggccagcu

SEQ ID NO: 3226388 - RNA, 22 nt, Mycobacterium leprae
cggcggccccuuucacgucggc

SEQ ID NO: 3226389 - RNA, 21 nt, Mycobacterium leprae
cggcggccgccacgccgugcu

SEQ ID NO: 3226390 - RNA, 21 nt, Mycobacterium leprae
cggcggccuuggcagccgcug

SEQ ID NO: 3226391 - RNA, 20 nt, Mycobacterium leprae
cggcggcuuguugaccggcc

SEQ ID NO: 3226392 - RNA, 17 nt, Mycobacterium leprae
cggcggguagucggcgc

SEQ ID NO: 3226393 - RNA, 23 nt, Mycobacterium leprae
cggcggguugggaaccggcggca

SEQ ID NO: 3226394 - RNA, 15 nt, Mycobacterium leprae
cggcggucaggauac

SEQ ID NO: 3226395 - RNA, 22 nt, Mycobacterium leprae
cggcguaaccgggaaauacggc

SEQ ID NO: 3226396 - RNA, 20 nt, Mycobacterium leprae
cggcguacguaugccgccaa

SEQ ID NO: 3226397 - RNA, 19 nt, Mycobacterium leprae
cggcgucauucacccgcgu

SEQ ID NO: 3226398 - RNA, 16 nt, Mycobacterium leprae
cggcgucgguggcagc

SEQ ID NO: 3226399 - RNA, 16 nt, Mycobacterium leprae
cggcgucgugaucggc

SEQ ID NO: 3226400 - RNA, 14 nt, Mycobacterium leprae
cggcgucuggcugg

SEQ ID NO: 3226401 - RNA, 16 nt, Mycobacterium leprae
cggcgucuggcuggcc

SEQ ID NO: 3226402 - RNA, 15 nt, Mycobacterium leprae
cggcguucaauaaga

SEQ ID NO: 3226403 - RNA, 17 nt, Mycobacterium leprae
cggcguucaauaagaaa

SEQ ID NO: 3226404 - RNA, 17 nt, Mycobacterium leprae
cggcguucgauaagaag

SEQ ID NO: 3226405 - RNA, 19 nt, Mycobacterium leprae
cggcguugagcgcagccac

SEQ ID NO: 3226406 - RNA, 17 nt, Mycobacterium leprae
cggcuaccgaguugucc

SEQ ID NO: 3226407 - RNA, 18 nt, Mycobacterium leprae
cggcuaugagacgaaugc

SEQ ID NO: 3226408 - RNA, 22 nt, Mycobacterium leprae
cggcucagcaccauucuggucg

SEQ ID NO: 3226409 - RNA, 14 nt, Mycobacterium leprae
cggcucccaucggc

SEQ ID NO: 3226410 - RNA, 18 nt, Mycobacterium leprae
cggcucccaucggcggcc

SEQ ID NO: 3226411 - RNA, 16 nt, Mycobacterium leprae
cggcugaaaggaacga

SEQ ID NO: 3226412 - RNA, 21 nt, Mycobacterium leprae
cggcugacuucgucagacgaa

SEQ ID NO: 3226413 - RNA, 22 nt, Mycobacterium leprae
cggcugacuucgucagacgaaa

SEQ ID NO: 3226414 - RNA, 11 nt, Mycobacterium leprae
cggcugcaccc

SEQ ID NO: 3226415 - RNA, 13 nt, Mycobacterium leprae
cggcugcacccgu

SEQ ID NO: 3226416 - RNA, 12 nt, Mycobacterium leprae
cggcugccgcac

SEQ ID NO: 3226417 - RNA, 17 nt, Mycobacterium leprae
cggcugcgcucaccucg

SEQ ID NO: 3226418 - RNA, 19 nt, Mycobacterium leprae
cggcugcguuaccggcguc

SEQ ID NO: 3226419 - RNA, 20 nt, Mycobacterium leprae
cggcuggcuccauccugccu

SEQ ID NO: 3226420 - RNA, 18 nt, Mycobacterium leprae
cggcugucagagugcaga

SEQ ID NO: 3226421 - RNA, 19 nt, Mycobacterium leprae
cggcuucaucagugugucc

SEQ ID NO: 3226422 - RNA, 23 nt, Mycobacterium leprae
cggcuucauucuuguguccauaa

SEQ ID NO: 3226423 - RNA, 22 nt, Mycobacterium leprae
cggcuucuccagucccgcgcug

SEQ ID NO: 3226424 - RNA, 16 nt, Mycobacterium leprae
cggcuuuucgacauug

SEQ ID NO: 3226425 - RNA, 22 nt, Mycobacterium leprae
cgggaaaaauccgcgcaacacc

SEQ ID NO: 3226426 - RNA, 15 nt, Mycobacterium leprae
cgggaaagcugagau

SEQ ID NO: 3226427 - RNA, 16 nt, Mycobacterium leprae
cgggagaucuugccau

SEQ ID NO: 3226428 - RNA, 17 nt, Mycobacterium leprae
cgggaggccuuaagcug

SEQ ID NO: 3226429 - RNA, 18 nt, Mycobacterium leprae
cgggauaggucaguucuc

SEQ ID NO: 3226430 - RNA, 16 nt, Mycobacterium leprae
cgggaucgccgaugac

SEQ ID NO: 3226431 - RNA, 13 nt, Mycobacterium leprae
cgggaucgcggca

SEQ ID NO: 3226432 - RNA, 22 nt, Mycobacterium leprae
cgggaugccgaaacgcugagga

SEQ ID NO: 3226433 - RNA, 17 nt, Mycobacterium leprae
cgggaugugugcgcgcc

SEQ ID NO: 3226434 - RNA, 14 nt, Mycobacterium leprae
cgggauugcaugca

SEQ ID NO: 3226435 - RNA, 15 nt, Mycobacterium leprae
cgggauuuggugcug

SEQ ID NO: 3226436 - RNA, 19 nt, Mycobacterium leprae
cgggcaagcccugcccggc

SEQ ID NO: 3226437 - RNA, 19 nt, Mycobacterium leprae
cgggcaccagauggcuccc

SEQ ID NO: 3226438 - RNA, 14 nt, Mycobacterium leprae
cgggcagcugcaac

SEQ ID NO: 3226439 - RNA, 14 nt, Mycobacterium leprae
cgggccacgagacc

SEQ ID NO: 3226440 - RNA, 17 nt, Mycobacterium leprae
cgggccagcaccaaccu

SEQ ID NO: 3226441 - RNA, 16 nt, Mycobacterium leprae
cgggcccggacggccc

SEQ ID NO: 3226442 - RNA, 20 nt, Mycobacterium leprae
cgggcccggacggcccagca

SEQ ID NO: 3226443 - RNA, 15 nt, Mycobacterium leprae
cgggcccgucguggu

SEQ ID NO: 3226444 - RNA, 20 nt, Mycobacterium leprae
cgggccguuauccacagcau

SEQ ID NO: 3226445 - RNA, 14 nt, Mycobacterium leprae
cgggcgaacuggac

SEQ ID NO: 3226446 - RNA, 23 nt, Mycobacterium leprae
cgggcgagcuggggcggccgccg

SEQ ID NO: 3226447 - RNA, 16 nt, Mycobacterium leprae
cgggcgaugccaucgg

SEQ ID NO: 3226448 - RNA, 14 nt, Mycobacterium leprae
cgggcgcaagcgug

SEQ ID NO: 3226449 - RNA, 19 nt, Mycobacterium leprae
cgggcggccaggcaggauc

SEQ ID NO: 3226450 - RNA, 22 nt, Mycobacterium leprae
cgggcuaaguccggccugcccg

SEQ ID NO: 3226451 - RNA, 13 nt, Mycobacterium leprae
cgggcucggugaa

SEQ ID NO: 3226452 - RNA, 16 nt, Mycobacterium leprae
cgggcugcaccgagcg

SEQ ID NO: 3226453 - RNA, 15 nt, Mycobacterium leprae
cgggcugcggugacg

SEQ ID NO: 3226454 - RNA, 12 nt, Mycobacterium leprae
cgggcuggagga

SEQ ID NO: 3226455 - RNA, 13 nt, Mycobacterium leprae
cgggcuugaccug

SEQ ID NO: 3226456 - RNA, 16 nt, Mycobacterium leprae
cgggcuugaccuggau

SEQ ID NO: 3226457 - RNA, 18 nt, Mycobacterium leprae
cgggcuuggccucgaggu

SEQ ID NO: 3226458 - RNA, 22 nt, Mycobacterium leprae
cggggauucaaucagacacgga

SEQ ID NO: 3226459 - RNA, 14 nt, Mycobacterium leprae
cggggcgaugucga

SEQ ID NO: 3226460 - RNA, 13 nt, Mycobacterium leprae
cggggcgucgcug

SEQ ID NO: 3226461 - RNA, 15 nt, Mycobacterium leprae
cggggcuaugccgcg

SEQ ID NO: 3226462 - RNA, 12 nt, Mycobacterium leprae
cggggcugcccg

SEQ ID NO: 3226463 - RNA, 19 nt, Mycobacterium leprae
cggggcuggguccccggac

SEQ ID NO: 3226464 - RNA, 23 nt, Mycobacterium leprae
cgggggagucgauaucgggccga

SEQ ID NO: 3226465 - RNA, 15 nt, Mycobacterium leprae
cgggggccagcguug

SEQ ID NO: 3226466 - RNA, 19 nt, Mycobacterium leprae
cgggguacaauaaacuggc

SEQ ID NO: 3226467 - RNA, 13 nt, Mycobacterium leprae
cgggguaggggcg

SEQ ID NO: 3226468 - RNA, 16 nt, Mycobacterium leprae
cggggugggcagccug

SEQ ID NO: 3226469 - RNA, 19 nt, Mycobacterium leprae
cggggugggcagccuggac

SEQ ID NO: 3226470 - RNA, 18 nt, Mycobacterium leprae
cgggguuggccacuggug

SEQ ID NO: 3226471 - RNA, 16 nt, Mycobacterium leprae
cgggguuugacaccgc

SEQ ID NO: 3226472 - RNA, 17 nt, Mycobacterium leprae
cgggguuuuuguuggug

SEQ ID NO: 3226473 - RNA, 16 nt, Mycobacterium leprae
cggguacggucuggcc

SEQ ID NO: 3226474 - RNA, 17 nt, Mycobacterium leprae
cggguagacgaugaucg

SEQ ID NO: 3226475 - RNA, 16 nt, Mycobacterium leprae
cgggucacgcucaaca

SEQ ID NO: 3226476 - RNA, 17 nt, Mycobacterium leprae
cgggucgagcagccacc

SEQ ID NO: 3226477 - RNA, 11 nt, Mycobacterium leprae
cgggucgcggg

SEQ ID NO: 3226478 - RNA, 16 nt, Mycobacterium leprae
cgggugaacgccaggc

SEQ ID NO: 3226479 - RNA, 16 nt, Mycobacterium leprae
cgggugcagcaguauc

SEQ ID NO: 3226480 - RNA, 13 nt, Mycobacterium leprae
cgggugcgcagca

SEQ ID NO: 3226481 - RNA, 18 nt, Mycobacterium leprae
cggguggacgaaccggac

SEQ ID NO: 3226482 - RNA, 14 nt, Mycobacterium leprae
cgggugggucgaug

SEQ ID NO: 3226483 - RNA, 14 nt, Mycobacterium leprae
cggguggugcccag

SEQ ID NO: 3226484 - RNA, 20 nt, Mycobacterium leprae
cggguugacgcugcuugcuc

SEQ ID NO: 3226485 - RNA, 21 nt, Mycobacterium leprae
cggguuuuagauugacaccgc

SEQ ID NO: 3226486 - RNA, 23 nt, Mycobacterium leprae
cggguuuuagauugacaccgccg

SEQ ID NO: 3226487 - RNA, 18 nt, Mycobacterium leprae
cgguaaacagagcugaug

SEQ ID NO: 3226488 - RNA, 22 nt, Mycobacterium leprae
cgguaacgcugaccagcagauc

SEQ ID NO: 3226489 - RNA, 21 nt, Mycobacterium leprae
cgguaacuacuggauuaauau

SEQ ID NO: 3226490 - RNA, 19 nt, Mycobacterium leprae
cgguaaguuuucagccaca

SEQ ID NO: 3226491 - RNA, 20 nt, Mycobacterium leprae
cgguaaguuuucagccacau

SEQ ID NO: 3226492 - RNA, 16 nt, Mycobacterium leprae
cgguaccagcggcagc

SEQ ID NO: 3226493 - RNA, 14 nt, Mycobacterium leprae
cgguacccgccagg

SEQ ID NO: 3226494 - RNA, 22 nt, Mycobacterium leprae
cgguaccugugggucaccacug

SEQ ID NO: 3226495 - RNA, 15 nt, Mycobacterium leprae
cgguacgaggugaca

SEQ ID NO: 3226496 - RNA, 17 nt, Mycobacterium leprae
cgguacgaggugacauu

SEQ ID NO: 3226497 - RNA, 18 nt, Mycobacterium leprae
cgguagacguggcagucg

SEQ ID NO: 3226498 - RNA, 16 nt, Mycobacterium leprae
cgguagcagcgguacc

SEQ ID NO: 3226499 - RNA, 20 nt, Mycobacterium leprae
cgguagcgcgcugaucgggc

SEQ ID NO: 3226500 - RNA, 16 nt, Mycobacterium leprae
cgguaggccagguuag

SEQ ID NO: 3226501 - RNA, 15 nt, Mycobacterium leprae
cgguaggccgaacau

SEQ ID NO: 3226502 - RNA, 12 nt, Mycobacterium leprae
cgguaucgccga

SEQ ID NO: 3226503 - RNA, 12 nt, Mycobacterium leprae
cgguaucucccc

SEQ ID NO: 3226504 - RNA, 16 nt, Mycobacterium leprae
cgguaugcggccgcaa

SEQ ID NO: 3226505 - RNA, 18 nt, Mycobacterium leprae
cgguauugggcgguguug

SEQ ID NO: 3226506 - RNA, 22 nt, Mycobacterium leprae
cgguauuugcugucguggcugc

SEQ ID NO: 3226507 - RNA, 16 nt, Mycobacterium leprae
cggucacagagcugug

SEQ ID NO: 3226508 - RNA, 15 nt, Mycobacterium leprae
cggucaccccgagcu

SEQ ID NO: 3226509 - RNA, 19 nt, Mycobacterium leprae
cggucaccggaucaugccc

SEQ ID NO: 3226510 - RNA, 14 nt, Mycobacterium leprae
cggucagguauuca

SEQ ID NO: 3226511 - RNA, 15 nt, Mycobacterium leprae
cgguccagccaacgg

SEQ ID NO: 3226512 - RNA, 22 nt, Mycobacterium leprae
cggucccaucgcugaccggugc

SEQ ID NO: 3226513 - RNA, 15 nt, Mycobacterium leprae
cgguccuugaccuca

SEQ ID NO: 3226514 - RNA, 21 nt, Mycobacterium leprae
cggucgcacgaccuugccgcg

SEQ ID NO: 3226515 - RNA, 12 nt, Mycobacterium leprae
cggucgccgaug

SEQ ID NO: 3226516 - RNA, 16 nt, Mycobacterium leprae
cggucgccgaugcgcu

SEQ ID NO: 3226517 - RNA, 17 nt, Mycobacterium leprae
cggucggaguucuucac

SEQ ID NO: 3226518 - RNA, 17 nt, Mycobacterium leprae
cggucgggaccuaccgc

SEQ ID NO: 3226519 - RNA, 17 nt, Mycobacterium leprae
cggucgguaaauccacc

SEQ ID NO: 3226520 - RNA, 18 nt, Mycobacterium leprae
cggucguagaccucuuca

SEQ ID NO: 3226521 - RNA, 21 nt, Mycobacterium leprae
cggucgucuccguccagcugg

SEQ ID NO: 3226522 - RNA, 13 nt, Mycobacterium leprae
cggucgugcugcu

SEQ ID NO: 3226523 - RNA, 14 nt, Mycobacterium leprae
cggucgugcugcug

SEQ ID NO: 3226524 - RNA, 16 nt, Mycobacterium leprae
cggucugcggugcuga

SEQ ID NO: 3226525 - RNA, 24 nt, Mycobacterium leprae
cggugaaaauauccaccauacagc

SEQ ID NO: 3226526 - RNA, 14 nt, Mycobacterium leprae
cggugagcggcaga

SEQ ID NO: 3226527 - RNA, 15 nt, Mycobacterium leprae
cggugauauggccga

SEQ ID NO: 3226528 - RNA, 21 nt, Mycobacterium leprae
cggugaucgcugccggcggca

SEQ ID NO: 3226529 - RNA, 23 nt, Mycobacterium leprae
cggugcaccagcucacccgcagc

SEQ ID NO: 3226530 - RNA, 20 nt, Mycobacterium leprae
cggugcagcucguccaucgc

SEQ ID NO: 3226531 - RNA, 19 nt, Mycobacterium leprae
cggugccaggcagcugugc

SEQ ID NO: 3226532 - RNA, 19 nt, Mycobacterium leprae
cggugcccuagaacaaacg

SEQ ID NO: 3226533 - RNA, 19 nt, Mycobacterium leprae
cggugccgaggcucugcuc

SEQ ID NO: 3226534 - RNA, 21 nt, Mycobacterium leprae
cggugccgccauugcccccgc

SEQ ID NO: 3226535 - RNA, 22 nt, Mycobacterium leprae
cggugccuauuucacuggcccg

SEQ ID NO: 3226536 - RNA, 18 nt, Mycobacterium leprae
cggugcugagucggcgcu

SEQ ID NO: 3226537 - RNA, 18 nt, Mycobacterium leprae
cggugcugauggccggcc

SEQ ID NO: 3226538 - RNA, 20 nt, Mycobacterium leprae
cggugcuuuagcccgccgcg

SEQ ID NO: 3226539 - RNA, 14 nt, Mycobacterium leprae
cgguggauuaggcg

SEQ ID NO: 3226540 - RNA, 13 nt, Mycobacterium leprae
cgguggcaccagu

SEQ ID NO: 3226541 - RNA, 13 nt, Mycobacterium leprae
cgguggcggucgg

SEQ ID NO: 3226542 - RNA, 19 nt, Mycobacterium leprae
cggugggcaauucgccaau

SEQ ID NO: 3226543 - RNA, 17 nt, Mycobacterium leprae
cggugggcuuccagcag

SEQ ID NO: 3226544 - RNA, 13 nt, Mycobacterium leprae
cggugggugcaca

SEQ ID NO: 3226545 - RNA, 14 nt, Mycobacterium leprae
cgguguagcugcga

SEQ ID NO: 3226546 - RNA, 18 nt, Mycobacterium leprae
cgguguauggcgugacgg

SEQ ID NO: 3226547 - RNA, 23 nt, Mycobacterium leprae
cggugucaucuaucuccaccagc

SEQ ID NO: 3226548 - RNA, 15 nt, Mycobacterium leprae
cgguguccaaaugcg

SEQ ID NO: 3226549 - RNA, 17 nt, Mycobacterium leprae
cggugucggauccccuc

SEQ ID NO: 3226550 - RNA, 19 nt, Mycobacterium leprae
cggugugcgucggaugugc

SEQ ID NO: 3226551 - RNA, 21 nt, Mycobacterium leprae
cggugugggacgugaugcagc

SEQ ID NO: 3226552 - RNA, 16 nt, Mycobacterium leprae
cgguguguugcagugu

SEQ ID NO: 3226553 - RNA, 16 nt, Mycobacterium leprae
cgguguuagcaugcuu

SEQ ID NO: 3226554 - RNA, 16 nt, Mycobacterium leprae
cgguguucgcuccgcc

SEQ ID NO: 3226555 - RNA, 22 nt, Mycobacterium leprae
cgguguucgcuccgcccacuaa

SEQ ID NO: 3226556 - RNA, 14 nt, Mycobacterium leprae
cgguguugcgcggc

SEQ ID NO: 3226557 - RNA, 16 nt, Mycobacterium leprae
cgguguugcgcggcgc

SEQ ID NO: 3226558 - RNA, 20 nt, Mycobacterium leprae
cgguuacaucgucaacgacc

SEQ ID NO: 3226559 - RNA, 18 nt, Mycobacterium leprae
cgguuacgcgcucgccgg

SEQ ID NO: 3226560 - RNA, 12 nt, Mycobacterium leprae
cgguucaacggg

SEQ ID NO: 3226561 - RNA, 15 nt, Mycobacterium leprae
cgguuccagucgaag

SEQ ID NO: 3226562 - RNA, 13 nt, Mycobacterium leprae
cgguucggugacg

SEQ ID NO: 3226563 - RNA, 23 nt, Mycobacterium leprae
cgguugcguaauggccggcgccu

SEQ ID NO: 3226564 - RNA, 23 nt, Mycobacterium leprae
cgguugguuucauaggugguggg

SEQ ID NO: 3226565 - RNA, 16 nt, Mycobacterium leprae
cgguuucgggaaagcu

SEQ ID NO: 3226566 - RNA, 17 nt, Mycobacterium leprae
cgguuugauccagccga

SEQ ID NO: 3226567 - RNA, 21 nt, Mycobacterium leprae
cguaacagauuauugccgccc

SEQ ID NO: 3226568 - RNA, 13 nt, Mycobacterium leprae
cguaagcaugucg

SEQ ID NO: 3226569 - RNA, 19 nt, Mycobacterium leprae
cguaagcgucucgacggau

SEQ ID NO: 3226570 - RNA, 15 nt, Mycobacterium leprae
cguaauuccugcagc

SEQ ID NO: 3226571 - RNA, 12 nt, Mycobacterium leprae
cguacaacgugu

SEQ ID NO: 3226572 - RNA, 19 nt, Mycobacterium leprae
cguacccaccgaauccucg

SEQ ID NO: 3226573 - RNA, 17 nt, Mycobacterium leprae
cguaccggaucgacggc

SEQ ID NO: 3226574 - RNA, 22 nt, Mycobacterium leprae
cguaccuggguuauggaccuga

SEQ ID NO: 3226575 - RNA, 17 nt, Mycobacterium leprae
cguacguaugccgccaa

SEQ ID NO: 3226576 - RNA, 14 nt, Mycobacterium leprae
cguagaacaagugc

SEQ ID NO: 3226577 - RNA, 13 nt, Mycobacterium leprae
cguagcggcggcg

SEQ ID NO: 3226578 - RNA, 16 nt, Mycobacterium leprae
cguagcggucggcgca

SEQ ID NO: 3226579 - RNA, 18 nt, Mycobacterium leprae
cguaguguagcugcagcg

SEQ ID NO: 3226580 - RNA, 19 nt, Mycobacterium leprae
cguaguguagcugcagcga

SEQ ID NO: 3226581 - RNA, 15 nt, Mycobacterium leprae
cguauaccggcugaa

SEQ ID NO: 3226582 - RNA, 13 nt, Mycobacterium leprae
cguaucaaaacua

SEQ ID NO: 3226583 - RNA, 16 nt, Mycobacterium leprae
cguaugaccgcggucg

SEQ ID NO: 3226584 - RNA, 16 nt, Mycobacterium leprae
cguaugccgccaaaau

SEQ ID NO: 3226585 - RNA, 12 nt, Mycobacterium leprae
cguauggccgcg

SEQ ID NO: 3226586 - RNA, 23 nt, Mycobacterium leprae
cguauggcgccguggaggugcgg

SEQ ID NO: 3226587 - RNA, 21 nt, Mycobacterium leprae
cguauugguugccgagcuguu

SEQ ID NO: 3226588 - RNA, 17 nt, Mycobacterium leprae
cgucaagcagcaccaca

SEQ ID NO: 3226589 - RNA, 23 nt, Mycobacterium leprae
cgucaagcucaaucgcaacccuu

SEQ ID NO: 3226590 - RNA, 16 nt, Mycobacterium leprae
cgucaccaagcgcaga

SEQ ID NO: 3226591 - RNA, 21 nt, Mycobacterium leprae
cgucacccggucaagagccgc

SEQ ID NO: 3226592 - RNA, 19 nt, Mycobacterium leprae
cgucacgcugcucgagcag

SEQ ID NO: 3226593 - RNA, 14 nt, Mycobacterium leprae
cgucacggucgacu

SEQ ID NO: 3226594 - RNA, 19 nt, Mycobacterium leprae
cgucacggucgacuucgca

SEQ ID NO: 3226595 - RNA, 17 nt, Mycobacterium leprae
cgucacgucgacggcgg

SEQ ID NO: 3226596 - RNA, 19 nt, Mycobacterium leprae
cgucacgucgacggcggcc

SEQ ID NO: 3226597 - RNA, 23 nt, Mycobacterium leprae
cgucagcuggaaucccccauucg

SEQ ID NO: 3226598 - RNA, 14 nt, Mycobacterium leprae
cgucagggcagcag

SEQ ID NO: 3226599 - RNA, 14 nt, Mycobacterium leprae
cgucaucagauuca

SEQ ID NO: 3226600 - RNA, 18 nt, Mycobacterium leprae
cgucaucgacaucccagc

SEQ ID NO: 3226601 - RNA, 13 nt, Mycobacterium leprae
cguccacgucgcc

SEQ ID NO: 3226602 - RNA, 17 nt, Mycobacterium leprae
cguccacgucgcccaac

SEQ ID NO: 3226603 - RNA, 19 nt, Mycobacterium leprae
cguccagacaccacugcca

SEQ ID NO: 3226604 - RNA, 22 nt, Mycobacterium leprae
cguccagcuggccgggaucggc

SEQ ID NO: 3226605 - RNA, 19 nt, Mycobacterium leprae
cguccaucuuguuggccgg

SEQ ID NO: 3226606 - RNA, 13 nt, Mycobacterium leprae
cgucccacgccaa

SEQ ID NO: 3226607 - RNA, 20 nt, Mycobacterium leprae
cgucccagguuuccguguca

SEQ ID NO: 3226608 - RNA, 11 nt, Mycobacterium leprae
cgucccgcagc

SEQ ID NO: 3226609 - RNA, 19 nt, Mycobacterium leprae
cguccgauaacagaccucc

SEQ ID NO: 3226610 - RNA, 15 nt, Mycobacterium leprae
cguccgcaaccgaua

SEQ ID NO: 3226611 - RNA, 18 nt, Mycobacterium leprae
cguccgcggcagcugcug

SEQ ID NO: 3226612 - RNA, 17 nt, Mycobacterium leprae
cguccgcggcggccccu

SEQ ID NO: 3226613 - RNA, 18 nt, Mycobacterium leprae
cguccucaucccaugagu

SEQ ID NO: 3226614 - RNA, 19 nt, Mycobacterium leprae
cguccuccaccuuuuucgg

SEQ ID NO: 3226615 - RNA, 14 nt, Mycobacterium leprae
cguccucggcggca

SEQ ID NO: 3226616 - RNA, 15 nt, Mycobacterium leprae
cguccucgucgguga

SEQ ID NO: 3226617 - RNA, 13 nt, Mycobacterium leprae
cguccuguguguc

SEQ ID NO: 3226618 - RNA, 16 nt, Mycobacterium leprae
cgucgacgaguuccag

SEQ ID NO: 3226619 - RNA, 13 nt, Mycobacterium leprae
cgucgagccgauu

SEQ ID NO: 3226620 - RNA, 14 nt, Mycobacterium leprae
cgucgaucucgacg

SEQ ID NO: 3226621 - RNA, 16 nt, Mycobacterium leprae
cgucgauuuugcaggc

SEQ ID NO: 3226622 - RNA, 21 nt, Mycobacterium leprae
cgucgcaucggugaucguggu

SEQ ID NO: 3226623 - RNA, 19 nt, Mycobacterium leprae
cgucgcccaacguaucggc

SEQ ID NO: 3226624 - RNA, 15 nt, Mycobacterium leprae
cgucgcccucgccgg

SEQ ID NO: 3226625 - RNA, 19 nt, Mycobacterium leprae
cgucgcccucgccggcggu

SEQ ID NO: 3226626 - RNA, 17 nt, Mycobacterium leprae
cgucgccgguagcagcg

SEQ ID NO: 3226627 - RNA, 16 nt, Mycobacterium leprae
cgucgccuuagccgaa

SEQ ID NO: 3226628 - RNA, 21 nt, Mycobacterium leprae
cgucgcgggccuggauuagcu

SEQ ID NO: 3226629 - RNA, 15 nt, Mycobacterium leprae
cgucgcggguggguc

SEQ ID NO: 3226630 - RNA, 16 nt, Mycobacterium leprae
cgucgcugcuggauga

SEQ ID NO: 3226631 - RNA, 17 nt, Mycobacterium leprae
cgucgcugcuuccugaa

SEQ ID NO: 3226632 - RNA, 19 nt, Mycobacterium leprae
cgucgcugugugcgcgccg

SEQ ID NO: 3226633 - RNA, 19 nt, Mycobacterium leprae
cgucggaaacacagcaagc

SEQ ID NO: 3226634 - RNA, 17 nt, Mycobacterium leprae
cgucggcauaucgaccg

SEQ ID NO: 3226635 - RNA, 13 nt, Mycobacterium leprae
cgucggccagcac

SEQ ID NO: 3226636 - RNA, 16 nt, Mycobacterium leprae
cgucggccgcggcgac

SEQ ID NO: 3226637 - RNA, 22 nt, Mycobacterium leprae
cgucggccuggggcaacacggg

SEQ ID NO: 3226638 - RNA, 18 nt, Mycobacterium leprae
cgucgggaccgggcgcgc

SEQ ID NO: 3226639 - RNA, 13 nt, Mycobacterium leprae
cgucgggcaucga

SEQ ID NO: 3226640 - RNA, 19 nt, Mycobacterium leprae
cgucgguagccucggcgcu

SEQ ID NO: 3226641 - RNA, 21 nt, Mycobacterium leprae
cgucggugagguguucgggau

SEQ ID NO: 3226642 - RNA, 12 nt, Mycobacterium leprae
cgucgucagcug

SEQ ID NO: 3226643 - RNA, 17 nt, Mycobacterium leprae
cgucgucagcugcugaa

SEQ ID NO: 3226644 - RNA, 14 nt, Mycobacterium leprae
cgucguccggcaau

SEQ ID NO: 3226645 - RNA, 17 nt, Mycobacterium leprae
cgucgucgcaucgguga

SEQ ID NO: 3226646 - RNA, 13 nt, Mycobacterium leprae
cgucgugaaucau

SEQ ID NO: 3226647 - RNA, 21 nt, Mycobacterium leprae
cgucgugaaucaugccgcagc

SEQ ID NO: 3226648 - RNA, 22 nt, Mycobacterium leprae
cgucgugaaucaugccgcagca

SEQ ID NO: 3226649 - RNA, 17 nt, Mycobacterium leprae
cgucgugaccgcggggc

SEQ ID NO: 3226650 - RNA, 22 nt, Mycobacterium leprae
cgucguuguuugauguggccaa

SEQ ID NO: 3226651 - RNA, 20 nt, Mycobacterium leprae
cgucuacgucuucaccaugg

SEQ ID NO: 3226652 - RNA, 13 nt, Mycobacterium leprae
cgucucacgcacc

SEQ ID NO: 3226653 - RNA, 21 nt, Mycobacterium leprae
cgucucacgcaccugaucggu

SEQ ID NO: 3226654 - RNA, 13 nt, Mycobacterium leprae
cgucuccgcgcaa

SEQ ID NO: 3226655 - RNA, 17 nt, Mycobacterium leprae
cgucucgcgcauacacg

SEQ ID NO: 3226656 - RNA, 20 nt, Mycobacterium leprae
cgucuggacucggucugcug

SEQ ID NO: 3226657 - RNA, 22 nt, Mycobacterium leprae
cgucuggacucggucugcugga

SEQ ID NO: 3226658 - RNA, 14 nt, Mycobacterium leprae
cgucuuccaaacuu

SEQ ID NO: 3226659 - RNA, 16 nt, Mycobacterium leprae
cgucuucuauacuuua

SEQ ID NO: 3226660 - RNA, 21 nt, Mycobacterium leprae
cgucuuucucauuguggcugg

SEQ ID NO: 3226661 - RNA, 18 nt, Mycobacterium leprae
cgucuuugcuaacaaggc

SEQ ID NO: 3226662 - RNA, 13 nt, Mycobacterium leprae
cgucuuugcuggu

SEQ ID NO: 3226663 - RNA, 20 nt, Mycobacterium leprae
cgugaagauaggucgccgaa

SEQ ID NO: 3226664 - RNA, 20 nt, Mycobacterium leprae
cgugaaucaugccgcagcau

SEQ ID NO: 3226665 - RNA, 16 nt, Mycobacterium leprae
cgugacaucgacccgu

SEQ ID NO: 3226666 - RNA, 15 nt, Mycobacterium leprae
cgugaccgcggggcu

SEQ ID NO: 3226667 - RNA, 19 nt, Mycobacterium leprae
cgugacgcgggcgccgcag

SEQ ID NO: 3226668 - RNA, 22 nt, Mycobacterium leprae
cgugacugcggcucaccgacug

SEQ ID NO: 3226669 - RNA, 20 nt, Mycobacterium leprae
cgugagaucaccagcaaggg

SEQ ID NO: 3226670 - RNA, 22 nt, Mycobacterium leprae
cgugaggugugaccgugcagcu

SEQ ID NO: 3226671 - RNA, 15 nt, Mycobacterium leprae
cgugaugaacuucgg

SEQ ID NO: 3226672 - RNA, 23 nt, Mycobacterium leprae
cgugauggucauuuggugguuau

SEQ ID NO: 3226673 - RNA, 22 nt, Mycobacterium leprae
cgugauucgggacagugucuua

SEQ ID NO: 3226674 - RNA, 16 nt, Mycobacterium leprae
cgugcaaacugcugcg

SEQ ID NO: 3226675 - RNA, 23 nt, Mycobacterium leprae
cgugcaauuugucacgaaucgcu

SEQ ID NO: 3226676 - RNA, 15 nt, Mycobacterium leprae
cgugcacacgucgag

SEQ ID NO: 3226677 - RNA, 13 nt, Mycobacterium leprae
cgugcagcacuuc

SEQ ID NO: 3226678 - RNA, 21 nt, Mycobacterium leprae
cgugcagcgaccucaugcccg

SEQ ID NO: 3226679 - RNA, 15 nt, Mycobacterium leprae
cgugcaggcagucuu

SEQ ID NO: 3226680 - RNA, 22 nt, Mycobacterium leprae
cgugcaggcugcauccugcagc

SEQ ID NO: 3226681 - RNA, 18 nt, Mycobacterium leprae
cgugcaucggguuauggu

SEQ ID NO: 3226682 - RNA, 17 nt, Mycobacterium leprae
cgugccaacucggccgc

SEQ ID NO: 3226683 - RNA, 14 nt, Mycobacterium leprae
cgugccccggccgc

SEQ ID NO: 3226684 - RNA, 14 nt, Mycobacterium leprae
cgugccgagccugg

SEQ ID NO: 3226685 - RNA, 17 nt, Mycobacterium leprae
cgugccgagcuggccgg

SEQ ID NO: 3226686 - RNA, 16 nt, Mycobacterium leprae
cgugccgaugcggaau

SEQ ID NO: 3226687 - RNA, 14 nt, Mycobacterium leprae
cgugccggccucgu

SEQ ID NO: 3226688 - RNA, 15 nt, Mycobacterium leprae
cgugccuugcggcag

SEQ ID NO: 3226689 - RNA, 23 nt, Mycobacterium leprae
cgugcgcguauuucgagcgugac

SEQ ID NO: 3226690 - RNA, 12 nt, Mycobacterium leprae
cgugcggcggcc

SEQ ID NO: 3226691 - RNA, 21 nt, Mycobacterium leprae
cgugcggucaaaggcuguccu

SEQ ID NO: 3226692 - RNA, 20 nt, Mycobacterium leprae
cgugcgucauggcacugggc

SEQ ID NO: 3226693 - RNA, 18 nt, Mycobacterium leprae
cgugcugaucaccggcca

SEQ ID NO: 3226694 - RNA, 21 nt, Mycobacterium leprae
cgugcugucgugcccagauga

SEQ ID NO: 3226695 - RNA, 13 nt, Mycobacterium leprae
cgugcuguuaugu

SEQ ID NO: 3226696 - RNA, 20 nt, Mycobacterium leprae
cguggauaccacugacgggu

SEQ ID NO: 3226697 - RNA, 21 nt, Mycobacterium leprae
cguggauggcuuccacaucga

SEQ ID NO: 3226698 - RNA, 19 nt, Mycobacterium leprae
cguggauuuguauggcgcg

SEQ ID NO: 3226699 - RNA, 15 nt, Mycobacterium leprae
cguggcaccuaaggc

SEQ ID NO: 3226700 - RNA, 17 nt, Mycobacterium leprae
cguggcagucucgcugg

SEQ ID NO: 3226701 - RNA, 13 nt, Mycobacterium leprae
cguggccgugauc

SEQ ID NO: 3226702 - RNA, 18 nt, Mycobacterium leprae
cguggcgagacacccggc

SEQ ID NO: 3226703 - RNA, 21 nt, Mycobacterium leprae
cguggcgagugcugacgccgg

SEQ ID NO: 3226704 - RNA, 20 nt, Mycobacterium leprae
cguggguacgugguggcugc

SEQ ID NO: 3226705 - RNA, 17 nt, Mycobacterium leprae
cgugguaaggcaugacg

SEQ ID NO: 3226706 - RNA, 22 nt, Mycobacterium leprae
cgugguaaggcaugacggcgca

SEQ ID NO: 3226707 - RNA, 15 nt, Mycobacterium leprae
cgugguagucagcac

SEQ ID NO: 3226708 - RNA, 23 nt, Mycobacterium leprae
cguggucaauguggccgcaccug

SEQ ID NO: 3226709 - RNA, 18 nt, Mycobacterium leprae
cguggucaccgcuguggc

SEQ ID NO: 3226710 - RNA, 14 nt, Mycobacterium leprae
cgugguccgaucgc

SEQ ID NO: 3226711 - RNA, 22 nt, Mycobacterium leprae
cguggucgagucgacagugucc

SEQ ID NO: 3226712 - RNA, 12 nt, Mycobacterium leprae
cguggucggcga

SEQ ID NO: 3226713 - RNA, 17 nt, Mycobacterium leprae
cguggucggugccgagg

SEQ ID NO: 3226714 - RNA, 18 nt, Mycobacterium leprae
cguggucggugccgaggc

SEQ ID NO: 3226715 - RNA, 12 nt, Mycobacterium leprae
cgugguggcugc

SEQ ID NO: 3226716 - RNA, 12 nt, Mycobacterium leprae
cgugguggcugg

SEQ ID NO: 3226717 - RNA, 13 nt, Mycobacterium leprae
cgugguggcuggc

SEQ ID NO: 3226718 - RNA, 15 nt, Mycobacterium leprae
cguguaaggccagcg

SEQ ID NO: 3226719 - RNA, 14 nt, Mycobacterium leprae
cguguccacugcgg

SEQ ID NO: 3226720 - RNA, 14 nt, Mycobacterium leprae
cgugucgugucgga

SEQ ID NO: 3226721 - RNA, 17 nt, Mycobacterium leprae
cgugucuucgaccgaca

SEQ ID NO: 3226722 - RNA, 23 nt, Mycobacterium leprae
cgugugaacuugaaaccggccgc

SEQ ID NO: 3226723 - RNA, 22 nt, Mycobacterium leprae
cgugugcacugcuucggccagc

SEQ ID NO: 3226724 - RNA, 14 nt, Mycobacterium leprae
cgugugcuaugcuc

SEQ ID NO: 3226725 - RNA, 19 nt, Mycobacterium leprae
cguguggaucaagcggugu

SEQ ID NO: 3226726 - RNA, 14 nt, Mycobacterium leprae
cguguucguuguuc

SEQ ID NO: 3226727 - RNA, 20 nt, Mycobacterium leprae
cguguugcuugcugugacca

SEQ ID NO: 3226728 - RNA, 13 nt, Mycobacterium leprae
cguguuugugucu

SEQ ID NO: 3226729 - RNA, 16 nt, Mycobacterium leprae
cguguuugugucugug

SEQ ID NO: 3226730 - RNA, 14 nt, Mycobacterium leprae
cguguuuugcugug

SEQ ID NO: 3226731 - RNA, 16 nt, Mycobacterium leprae
cguguuuugcuguguu

SEQ ID NO: 3226732 - RNA, 17 nt, Mycobacterium leprae
cguguuuugcuguguug

SEQ ID NO: 3226733 - RNA, 14 nt, Mycobacterium leprae
cguuaaacaaccug

SEQ ID NO: 3226734 - RNA, 17 nt, Mycobacterium leprae
cguuaccgacaccgccg

SEQ ID NO: 3226735 - RNA, 17 nt, Mycobacterium leprae
cguuacggucuuucgca

SEQ ID NO: 3226736 - RNA, 14 nt, Mycobacterium leprae
cguuagucuggcug

SEQ ID NO: 3226737 - RNA, 22 nt, Mycobacterium leprae
cguuaguuucgggccucgccgu

SEQ ID NO: 3226738 - RNA, 16 nt, Mycobacterium leprae
cguuauccacagcauc

SEQ ID NO: 3226739 - RNA, 15 nt, Mycobacterium leprae
cguucaagagcgagc

SEQ ID NO: 3226740 - RNA, 18 nt, Mycobacterium leprae
cguucaagauacuggauu

SEQ ID NO: 3226741 - RNA, 21 nt, Mycobacterium leprae
cguuccggccuucgucagcug

SEQ ID NO: 3226742 - RNA, 15 nt, Mycobacterium leprae
cguuccuaccggcca

SEQ ID NO: 3226743 - RNA, 21 nt, Mycobacterium leprae
cguuccuggcuggccaucgca

SEQ ID NO: 3226744 - RNA, 22 nt, Mycobacterium leprae
cguucggcuacugcgacagcag

SEQ ID NO: 3226745 - RNA, 23 nt, Mycobacterium leprae
cguucggcuacugcgacagcagc

SEQ ID NO: 3226746 - RNA, 19 nt, Mycobacterium leprae
cguucggggugucaacagc

SEQ ID NO: 3226747 - RNA, 22 nt, Mycobacterium leprae
cguucggguugcggucaucagg

SEQ ID NO: 3226748 - RNA, 18 nt, Mycobacterium leprae
cguucgucggaagcugcc

SEQ ID NO: 3226749 - RNA, 18 nt, Mycobacterium leprae
cguugaccgccgccaucc

SEQ ID NO: 3226750 - RNA, 13 nt, Mycobacterium leprae
cguugacguggug

SEQ ID NO: 3226751 - RNA, 16 nt, Mycobacterium leprae
cguugagcgcagccac

SEQ ID NO: 3226752 - RNA, 15 nt, Mycobacterium leprae
cguugagcugcaugu

SEQ ID NO: 3226753 - RNA, 21 nt, Mycobacterium leprae
cguugaugaauuugccgcgag

SEQ ID NO: 3226754 - RNA, 21 nt, Mycobacterium leprae
cguugauguuugcaucagcac

SEQ ID NO: 3226755 - RNA, 18 nt, Mycobacterium leprae
cguugauuuccgcggcga

SEQ ID NO: 3226756 - RNA, 16 nt, Mycobacterium leprae
cguugcaaaucaccag

SEQ ID NO: 3226757 - RNA, 18 nt, Mycobacterium leprae
cguugcaaaucaccagcg

SEQ ID NO: 3226758 - RNA, 15 nt, Mycobacterium leprae
cguugccguccccuc

SEQ ID NO: 3226759 - RNA, 21 nt, Mycobacterium leprae
cguugcuaaaaccaccguaaa

SEQ ID NO: 3226760 - RNA, 19 nt, Mycobacterium leprae
cguuggaucccgacagcau

SEQ ID NO: 3226761 - RNA, 14 nt, Mycobacterium leprae
cguuggcaacgugg

SEQ ID NO: 3226762 - RNA, 17 nt, Mycobacterium leprae
cguuggcgaucagcagg

SEQ ID NO: 3226763 - RNA, 14 nt, Mycobacterium leprae
cguuggcuaacaag

SEQ ID NO: 3226764 - RNA, 16 nt, Mycobacterium leprae
cguuggcuaacaaggu

SEQ ID NO: 3226765 - RNA, 19 nt, Mycobacterium leprae
cguuggcuugagugcugcc

SEQ ID NO: 3226766 - RNA, 23 nt, Mycobacterium leprae
cguugucgaaaugcauuggauga

SEQ ID NO: 3226767 - RNA, 17 nt, Mycobacterium leprae
cguugugccgcugcauc

SEQ ID NO: 3226768 - RNA, 16 nt, Mycobacterium leprae
cguuuccaaaacccac

SEQ ID NO: 3226769 - RNA, 19 nt, Mycobacterium leprae
cguuucgaggucuuggucu

SEQ ID NO: 3226770 - RNA, 21 nt, Mycobacterium leprae
cguuucucauucucugccuug

SEQ ID NO: 3226771 - RNA, 20 nt, Mycobacterium leprae
cguuuuggcguaccuggguu

SEQ ID NO: 3226772 - RNA, 16 nt, Mycobacterium leprae
cuaaaaagauauuaag

SEQ ID NO: 3226773 - RNA, 15 nt, Mycobacterium leprae
cuaaacugcgugauc

SEQ ID NO: 3226774 - RNA, 14 nt, Mycobacterium leprae
cuaaagucuucaau

SEQ ID NO: 3226775 - RNA, 19 nt, Mycobacterium leprae
cuaaagucuucaauccgcg

SEQ ID NO: 3226776 - RNA, 12 nt, Mycobacterium leprae
cuaaauauuaau

SEQ ID NO: 3226777 - RNA, 19 nt, Mycobacterium leprae
cuaaaugccauaucguucc

SEQ ID NO: 3226778 - RNA, 22 nt, Mycobacterium leprae
cuaacaacgaccagcgcuaaau

SEQ ID NO: 3226779 - RNA, 20 nt, Mycobacterium leprae
cuaacaaggugaugcccauc

SEQ ID NO: 3226780 - RNA, 20 nt, Mycobacterium leprae
cuaacacgauacugcugcac

SEQ ID NO: 3226781 - RNA, 16 nt, Mycobacterium leprae
cuaacgugcagcuggc

SEQ ID NO: 3226782 - RNA, 19 nt, Mycobacterium leprae
cuaacuuaguuuagagugc

SEQ ID NO: 3226783 - RNA, 15 nt, Mycobacterium leprae
cuaagguggcuagcu

SEQ ID NO: 3226784 - RNA, 21 nt, Mycobacterium leprae
cuaauaaaguguuaugagaua

SEQ ID NO: 3226785 - RNA, 19 nt, Mycobacterium leprae
cuaauggcguccugcgaca

SEQ ID NO: 3226786 - RNA, 16 nt, Mycobacterium leprae
cuaauuuuugccgaug

SEQ ID NO: 3226787 - RNA, 20 nt, Mycobacterium leprae
cuacacccgauccggggccg

SEQ ID NO: 3226788 - RNA, 17 nt, Mycobacterium leprae
cuacacgguauaaaggc

SEQ ID NO: 3226789 - RNA, 14 nt, Mycobacterium leprae
cuacacugcagcgg

SEQ ID NO: 3226790 - RNA, 17 nt, Mycobacterium leprae
cuacacugcagcgguca

SEQ ID NO: 3226791 - RNA, 13 nt, Mycobacterium leprae
cuacauguugaug

SEQ ID NO: 3226792 - RNA, 16 nt, Mycobacterium leprae
cuaccacauaaacauu

SEQ ID NO: 3226793 - RNA, 23 nt, Mycobacterium leprae
cuaccagggucggccgggcuacc

SEQ ID NO: 3226794 - RNA, 14 nt, Mycobacterium leprae
cuaccaugccaccu

SEQ ID NO: 3226795 - RNA, 22 nt, Mycobacterium leprae
cuacccaaaucagcaccauccg

SEQ ID NO: 3226796 - RNA, 22 nt, Mycobacterium leprae
cuacccacuggugguggccucg

SEQ ID NO: 3226797 - RNA, 20 nt, Mycobacterium leprae
cuacccaggccuguugcggc

SEQ ID NO: 3226798 - RNA, 20 nt, Mycobacterium leprae
cuaccccgcggcgcuaacaa

SEQ ID NO: 3226799 - RNA, 14 nt, Mycobacterium leprae
cuacccgacacaaa

SEQ ID NO: 3226800 - RNA, 16 nt, Mycobacterium leprae
cuaccgagcucugguc

SEQ ID NO: 3226801 - RNA, 18 nt, Mycobacterium leprae
cuaccgaguuguccagau

SEQ ID NO: 3226802 - RNA, 16 nt, Mycobacterium leprae
cuaccgguacgcugca

SEQ ID NO: 3226803 - RNA, 15 nt, Mycobacterium leprae
cuacgcagcucugga

SEQ ID NO: 3226804 - RNA, 20 nt, Mycobacterium leprae
cuacgcuaaucgcgggcaag

SEQ ID NO: 3226805 - RNA, 16 nt, Mycobacterium leprae
cuacgggaacacgucg

SEQ ID NO: 3226806 - RNA, 20 nt, Mycobacterium leprae
cuacggggugggcagccugg

SEQ ID NO: 3226807 - RNA, 18 nt, Mycobacterium leprae
cuacggucaggugucuga

SEQ ID NO: 3226808 - RNA, 14 nt, Mycobacterium leprae
cuacgguuaauaua

SEQ ID NO: 3226809 - RNA, 18 nt, Mycobacterium leprae
cuacguggucugaagugg

SEQ ID NO: 3226810 - RNA, 22 nt, Mycobacterium leprae
cuacucguuucucauucucugc

SEQ ID NO: 3226811 - RNA, 19 nt, Mycobacterium leprae
cuacucuaauauagacuau

SEQ ID NO: 3226812 - RNA, 14 nt, Mycobacterium leprae
cuacucucugcaag

SEQ ID NO: 3226813 - RNA, 22 nt, Mycobacterium leprae
cuacugcgacagcagccacuga

SEQ ID NO: 3226814 - RNA, 11 nt, Mycobacterium leprae
cuacuggaugc

SEQ ID NO: 3226815 - RNA, 20 nt, Mycobacterium leprae
cuacuguugucaguggcgac

SEQ ID NO: 3226816 - RNA, 18 nt, Mycobacterium leprae
cuacuuuucgugcugccg

SEQ ID NO: 3226817 - RNA, 15 nt, Mycobacterium leprae
cuagaaaauccaagu

SEQ ID NO: 3226818 - RNA, 16 nt, Mycobacterium leprae
cuagaaaauccaaguc

SEQ ID NO: 3226819 - RNA, 14 nt, Mycobacterium leprae
cuagaaauugaaaa

SEQ ID NO: 3226820 - RNA, 22 nt, Mycobacterium leprae
cuagacgggaggaagauauccg

SEQ ID NO: 3226821 - RNA, 17 nt, Mycobacterium leprae
cuagacgucugucaccc

SEQ ID NO: 3226822 - RNA, 13 nt, Mycobacterium leprae
cuagacuuuugcu

SEQ ID NO: 3226823 - RNA, 14 nt, Mycobacterium leprae
cuagagucgaccgc

SEQ ID NO: 3226824 - RNA, 23 nt, Mycobacterium leprae
cuagagucgaccgccgaagcagc

SEQ ID NO: 3226825 - RNA, 23 nt, Mycobacterium leprae
cuagaugggcgacaaugugucag

SEQ ID NO: 3226826 - RNA, 18 nt, Mycobacterium leprae
cuagccgaagcggccgga

SEQ ID NO: 3226827 - RNA, 12 nt, Mycobacterium leprae
cuagccgccggg

SEQ ID NO: 3226828 - RNA, 18 nt, Mycobacterium leprae
cuagccucggucauaaca

SEQ ID NO: 3226829 - RNA, 22 nt, Mycobacterium leprae
cuagcguaaggaccaaccgcgc

SEQ ID NO: 3226830 - RNA, 21 nt, Mycobacterium leprae
cuagcugauuuggccgccauc

SEQ ID NO: 3226831 - RNA, 17 nt, Mycobacterium leprae
cuaggacaacagagcac

SEQ ID NO: 3226832 - RNA, 17 nt, Mycobacterium leprae
cuaggacgccgcccucu

SEQ ID NO: 3226833 - RNA, 18 nt, Mycobacterium leprae
cuaggagcgcaucgcgca

SEQ ID NO: 3226834 - RNA, 18 nt, Mycobacterium leprae
cuaggauagauccaccau

SEQ ID NO: 3226835 - RNA, 17 nt, Mycobacterium leprae
cuaggccacccgccaga

SEQ ID NO: 3226836 - RNA, 17 nt, Mycobacterium leprae
cuaggccacugggcuga

SEQ ID NO: 3226837 - RNA, 23 nt, Mycobacterium leprae
cuaggcgccaguucggcaguccu

SEQ ID NO: 3226838 - RNA, 22 nt, Mycobacterium leprae
cuaggggggcggugaacuaagc

SEQ ID NO: 3226839 - RNA, 18 nt, Mycobacterium leprae
cuagguaccccagucgag

SEQ ID NO: 3226840 - RNA, 22 nt, Mycobacterium leprae
cuaggucgguaaaugccucgcu

SEQ ID NO: 3226841 - RNA, 20 nt, Mycobacterium leprae
cuaguguacagaccgucgaa

SEQ ID NO: 3226842 - RNA, 21 nt, Mycobacterium leprae
cuauaaaacacuucaacaucg

SEQ ID NO: 3226843 - RNA, 15 nt, Mycobacterium leprae
cuauaaggcagcucg

SEQ ID NO: 3226844 - RNA, 20 nt, Mycobacterium leprae
cuauaaucccacucuugacu

SEQ ID NO: 3226845 - RNA, 14 nt, Mycobacterium leprae
cuauacuggcauua

SEQ ID NO: 3226846 - RNA, 17 nt, Mycobacterium leprae
cuaucaacauuuguuga

SEQ ID NO: 3226847 - RNA, 14 nt, Mycobacterium leprae
cuaucaagccacac

SEQ ID NO: 3226848 - RNA, 16 nt, Mycobacterium leprae
cuaucguaccggucaa

SEQ ID NO: 3226849 - RNA, 20 nt, Mycobacterium leprae
cuaucugacgacuucuucug

SEQ ID NO: 3226850 - RNA, 14 nt, Mycobacterium leprae
cuaugacaagacca

SEQ ID NO: 3226851 - RNA, 17 nt, Mycobacterium leprae
cuaugacaagaccaccg

SEQ ID NO: 3226852 - RNA, 23 nt, Mycobacterium leprae
cuaugagacgaaugcugaccauu

SEQ ID NO: 3226853 - RNA, 18 nt, Mycobacterium leprae
cuaugauaauuuggcuga

SEQ ID NO: 3226854 - RNA, 23 nt, Mycobacterium leprae
cuaugauuucaucugccaggcgc

SEQ ID NO: 3226855 - RNA, 15 nt, Mycobacterium leprae
cuaugcggccagcca

SEQ ID NO: 3226856 - RNA, 16 nt, Mycobacterium leprae
cuaugcggccagccag

SEQ ID NO: 3226857 - RNA, 18 nt, Mycobacterium leprae
cuaugcggccagccagga

SEQ ID NO: 3226858 - RNA, 16 nt, Mycobacterium leprae
cuaugcucaaccgugc

SEQ ID NO: 3226859 - RNA, 18 nt, Mycobacterium leprae
cuaugcugagcuaauaaa

SEQ ID NO: 3226860 - RNA, 12 nt, Mycobacterium leprae
cuaugcuggcua

SEQ ID NO: 3226861 - RNA, 21 nt, Mycobacterium leprae
cuaugucacuucccaccgugg

SEQ ID NO: 3226862 - RNA, 16 nt, Mycobacterium leprae
cuauguccaacaaggu

SEQ ID NO: 3226863 - RNA, 14 nt, Mycobacterium leprae
cuauucgggccagu

SEQ ID NO: 3226864 - RNA, 17 nt, Mycobacterium leprae
cuauugacgguaacuga

SEQ ID NO: 3226865 - RNA, 18 nt, Mycobacterium leprae
cuauugacgguaacugac

SEQ ID NO: 3226866 - RNA, 14 nt, Mycobacterium leprae
cuauugcauuggcu

SEQ ID NO: 3226867 - RNA, 18 nt, Mycobacterium leprae
cuauugcggucuugguga

SEQ ID NO: 3226868 - RNA, 19 nt, Mycobacterium leprae
cuauuuguuuuccugugca

SEQ ID NO: 3226869 - RNA, 21 nt, Mycobacterium leprae
cucaaagccugcguccacguc

SEQ ID NO: 3226870 - RNA, 14 nt, Mycobacterium leprae
cucaaccaugccgc

SEQ ID NO: 3226871 - RNA, 14 nt, Mycobacterium leprae
cucaaccgugcugu

SEQ ID NO: 3226872 - RNA, 15 nt, Mycobacterium leprae
cucaacuaguacgcc

SEQ ID NO: 3226873 - RNA, 18 nt, Mycobacterium leprae
cucaacuaguacgccccc

SEQ ID NO: 3226874 - RNA, 21 nt, Mycobacterium leprae
cucaagacuucaggaauucag

SEQ ID NO: 3226875 - RNA, 21 nt, Mycobacterium leprae
cucaagggcguguuuuaaacc

SEQ ID NO: 3226876 - RNA, 14 nt, Mycobacterium leprae
cucaaugcacguga

SEQ ID NO: 3226877 - RNA, 22 nt, Mycobacterium leprae
cucaauggccugcucauggcac

SEQ ID NO: 3226878 - RNA, 21 nt, Mycobacterium leprae
cucaauuuaguuaacgugcca

SEQ ID NO: 3226879 - RNA, 15 nt, Mycobacterium leprae
cucacaauugacaac

SEQ ID NO: 3226880 - RNA, 17 nt, Mycobacterium leprae
cucacaauugacaacac

SEQ ID NO: 3226881 - RNA, 13 nt, Mycobacterium leprae
cucacaggcagca

SEQ ID NO: 3226882 - RNA, 18 nt, Mycobacterium leprae
cucacccaagggcuucca

SEQ ID NO: 3226883 - RNA, 16 nt, Mycobacterium leprae
cucacccaccuuggcg

SEQ ID NO: 3226884 - RNA, 14 nt, Mycobacterium leprae
cucacccgcagcac

SEQ ID NO: 3226885 - RNA, 16 nt, Mycobacterium leprae
cucacccgcgaucucg

SEQ ID NO: 3226886 - RNA, 22 nt, Mycobacterium leprae
cucacccgcgccgccugcugca

SEQ ID NO: 3226887 - RNA, 20 nt, Mycobacterium leprae
cucaccgacggaugcccagc

SEQ ID NO: 3226888 - RNA, 22 nt, Mycobacterium leprae
cucaccucgguuaucggggucc

SEQ ID NO: 3226889 - RNA, 18 nt, Mycobacterium leprae
cucaccugcgacagccgu

SEQ ID NO: 3226890 - RNA, 14 nt, Mycobacterium leprae
cucacgccugcauc

SEQ ID NO: 3226891 - RNA, 21 nt, Mycobacterium leprae
cucacguugucgaaaaaucag

SEQ ID NO: 3226892 - RNA, 21 nt, Mycobacterium leprae
cucacguuguuauugccgggg

SEQ ID NO: 3226893 - RNA, 19 nt, Mycobacterium leprae
cucagaaaucguucgacca

SEQ ID NO: 3226894 - RNA, 19 nt, Mycobacterium leprae
cucagccagcaagcaggca

SEQ ID NO: 3226895 - RNA, 16 nt, Mycobacterium leprae
cucagcggccagacac

SEQ ID NO: 3226896 - RNA, 14 nt, Mycobacterium leprae
cucagcgucccaac

SEQ ID NO: 3226897 - RNA, 15 nt, Mycobacterium leprae
cucagcuccgaagca

SEQ ID NO: 3226898 - RNA, 14 nt, Mycobacterium leprae
cucagucgaagaga

SEQ ID NO: 3226899 - RNA, 12 nt, Mycobacterium leprae
cucagugaagug

SEQ ID NO: 3226900 - RNA, 18 nt, Mycobacterium leprae
cucagugacguguugguc

SEQ ID NO: 3226901 - RNA, 23 nt, Mycobacterium leprae
cucagugaucagguggagcaauu

SEQ ID NO: 3226902 - RNA, 16 nt, Mycobacterium leprae
cucaucgaaagcaggc

SEQ ID NO: 3226903 - RNA, 13 nt, Mycobacterium leprae
cucaucgccaacc

SEQ ID NO: 3226904 - RNA, 16 nt, Mycobacterium leprae
cucaucgcggcugcca

SEQ ID NO: 3226905 - RNA, 17 nt, Mycobacterium leprae
cucaucgcggcugccac

SEQ ID NO: 3226906 - RNA, 15 nt, Mycobacterium leprae
cucaugacgggccgc

SEQ ID NO: 3226907 - RNA, 17 nt, Mycobacterium leprae
cucaugacuuauaguca

SEQ ID NO: 3226908 - RNA, 16 nt, Mycobacterium leprae
cucaugaucgcaggca

SEQ ID NO: 3226909 - RNA, 15 nt, Mycobacterium leprae
cucauucucugccuu

SEQ ID NO: 3226910 - RNA, 15 nt, Mycobacterium leprae
cucauuguggcuggc

SEQ ID NO: 3226911 - RNA, 11 nt, Mycobacterium leprae
cuccaagguua

SEQ ID NO: 3226912 - RNA, 15 nt, Mycobacterium leprae
cuccaccagccggcc

SEQ ID NO: 3226913 - RNA, 23 nt, Mycobacterium leprae
cuccacuauucggguagacgaug

SEQ ID NO: 3226914 - RNA, 20 nt, Mycobacterium leprae
cuccauuuuucuugaaaaau

SEQ ID NO: 3226915 - RNA, 22 nt, Mycobacterium leprae
cucccacaaguuguccgccccg

SEQ ID NO: 3226916 - RNA, 22 nt, Mycobacterium leprae
cucccacgacggugcggcuggc

SEQ ID NO: 3226917 - RNA, 19 nt, Mycobacterium leprae
cucccgauuuucgauccgc

SEQ ID NO: 3226918 - RNA, 22 nt, Mycobacterium leprae
cucccugaacugguggcagcca

SEQ ID NO: 3226919 - RNA, 15 nt, Mycobacterium leprae
cucccuucuccgcaa

SEQ ID NO: 3226920 - RNA, 20 nt, Mycobacterium leprae
cuccgcagcaccugccgcag

SEQ ID NO: 3226921 - RNA, 18 nt, Mycobacterium leprae
cuccgccguuuuaccccg

SEQ ID NO: 3226922 - RNA, 15 nt, Mycobacterium leprae
cuccggaaauacggc

SEQ ID NO: 3226923 - RNA, 18 nt, Mycobacterium leprae
cuccggcuaucaggaucu

SEQ ID NO: 3226924 - RNA, 13 nt, Mycobacterium leprae
cuccgggcuggga

SEQ ID NO: 3226925 - RNA, 15 nt, Mycobacterium leprae
cuccggguuaucuaa

SEQ ID NO: 3226926 - RNA, 17 nt, Mycobacterium leprae
cuccgguugcggcgagc

SEQ ID NO: 3226927 - RNA, 14 nt, Mycobacterium leprae
cuccguccagcugg

SEQ ID NO: 3226928 - RNA, 19 nt, Mycobacterium leprae
cuccguggcccaaaccguu

SEQ ID NO: 3226929 - RNA, 19 nt, Mycobacterium leprae
cuccguugucccgcccggc

SEQ ID NO: 3226930 - RNA, 16 nt, Mycobacterium leprae
cuccugagacaucgcc

SEQ ID NO: 3226931 - RNA, 19 nt, Mycobacterium leprae
cuccugagacaucgccacc

SEQ ID NO: 3226932 - RNA, 20 nt, Mycobacterium leprae
cuccugagacaucgccaccg

SEQ ID NO: 3226933 - RNA, 21 nt, Mycobacterium leprae
cuccugagacaucgccaccga

SEQ ID NO: 3226934 - RNA, 21 nt, Mycobacterium leprae
cuccugcagguugcugucgug

SEQ ID NO: 3226935 - RNA, 14 nt, Mycobacterium leprae
cuccuggcgagugg

SEQ ID NO: 3226936 - RNA, 18 nt, Mycobacterium leprae
cuccuguuucaauucacc

SEQ ID NO: 3226937 - RNA, 15 nt, Mycobacterium leprae
cuccuucaugcuggc

SEQ ID NO: 3226938 - RNA, 21 nt, Mycobacterium leprae
cuccuucaugcuggccuccag

SEQ ID NO: 3226939 - RNA, 20 nt, Mycobacterium leprae
cuccuucuuaucucaucguc

SEQ ID NO: 3226940 - RNA, 19 nt, Mycobacterium leprae
cuccuugaccaccaccgcc

SEQ ID NO: 3226941 - RNA, 13 nt, Mycobacterium leprae
cucgaaagccucg

SEQ ID NO: 3226942 - RNA, 17 nt, Mycobacterium leprae
cucgaacuuguucuuug

SEQ ID NO: 3226943 - RNA, 14 nt, Mycobacterium leprae
cucgacagcaggua

SEQ ID NO: 3226944 - RNA, 22 nt, Mycobacterium leprae
cucgacgcgagaaaaucagaug

SEQ ID NO: 3226945 - RNA, 23 nt, Mycobacterium leprae
cucgacguugaugucccuggcga

SEQ ID NO: 3226946 - RNA, 21 nt, Mycobacterium leprae
cucgagcggcgcaugccaacc

SEQ ID NO: 3226947 - RNA, 22 nt, Mycobacterium leprae
cucgaggaagcgcagcucgcca

SEQ ID NO: 3226948 - RNA, 15 nt, Mycobacterium leprae
cucgauggccagccg

SEQ ID NO: 3226949 - RNA, 19 nt, Mycobacterium leprae
cucgaugucggacaaugag

SEQ ID NO: 3226950 - RNA, 17 nt, Mycobacterium leprae
cucgauuugcucaguga

SEQ ID NO: 3226951 - RNA, 16 nt, Mycobacterium leprae
cucgcacacaacgccg

SEQ ID NO: 3226952 - RNA, 15 nt, Mycobacterium leprae
cucgcaucaacgccg

SEQ ID NO: 3226953 - RNA, 23 nt, Mycobacterium leprae
cucgccaacgguaucuccccagg

SEQ ID NO: 3226954 - RNA, 13 nt, Mycobacterium leprae
cucgccaaggucg

SEQ ID NO: 3226955 - RNA, 14 nt, Mycobacterium leprae
cucgccgccuucuc

SEQ ID NO: 3226956 - RNA, 15 nt, Mycobacterium leprae
cucgccggcgguacu

SEQ ID NO: 3226957 - RNA, 22 nt, Mycobacterium leprae
cucgccggggugucgagcuucg

SEQ ID NO: 3226958 - RNA, 21 nt, Mycobacterium leprae
cucgcgcagcaaucaaugugc

SEQ ID NO: 3226959 - RNA, 21 nt, Mycobacterium leprae
cucgcgcaggucacccuccuc

SEQ ID NO: 3226960 - RNA, 23 nt, Mycobacterium leprae
cucgcgcaggucacccuccucgc

SEQ ID NO: 3226961 - RNA, 18 nt, Mycobacterium leprae
cucgcgcugaagccgcug

SEQ ID NO: 3226962 - RNA, 17 nt, Mycobacterium leprae
cucgcggugggcuucca

SEQ ID NO: 3226963 - RNA, 15 nt, Mycobacterium leprae
cucgcgucguugcgc

SEQ ID NO: 3226964 - RNA, 17 nt, Mycobacterium leprae
cucgcuaucgccacacu

SEQ ID NO: 3226965 - RNA, 16 nt, Mycobacterium leprae
cucgcuggucagcacu

SEQ ID NO: 3226966 - RNA, 19 nt, Mycobacterium leprae
cucggauccaucagaccac

SEQ ID NO: 3226967 - RNA, 12 nt, Mycobacterium leprae
cucggcaucggc

SEQ ID NO: 3226968 - RNA, 21 nt, Mycobacterium leprae
cucggcgaaagucgcuacgau

SEQ ID NO: 3226969 - RNA, 13 nt, Mycobacterium leprae
cucggcgaucggc

SEQ ID NO: 3226970 - RNA, 16 nt, Mycobacterium leprae
cucggcgcgcucucug

SEQ ID NO: 3226971 - RNA, 18 nt, Mycobacterium leprae
cucggcgguaccgucuag

SEQ ID NO: 3226972 - RNA, 21 nt, Mycobacterium leprae
cucggcguguauuugaugaca

SEQ ID NO: 3226973 - RNA, 18 nt, Mycobacterium leprae
cucggggguugauccucc

SEQ ID NO: 3226974 - RNA, 18 nt, Mycobacterium leprae
cucgggguuugacaccgc

SEQ ID NO: 3226975 - RNA, 13 nt, Mycobacterium leprae
cucggucgauggc

SEQ ID NO: 3226976 - RNA, 18 nt, Mycobacterium leprae
cucggucugcuggacagu

SEQ ID NO: 3226977 - RNA, 13 nt, Mycobacterium leprae
cucggugcgagga

SEQ ID NO: 3226978 - RNA, 20 nt, Mycobacterium leprae
cucgguguucgcuccgccca

SEQ ID NO: 3226979 - RNA, 16 nt, Mycobacterium leprae
cucgguugugaaccac

SEQ ID NO: 3226980 - RNA, 16 nt, Mycobacterium leprae
cucguaguucgccgag

SEQ ID NO: 3226981 - RNA, 21 nt, Mycobacterium leprae
cucgucccaugucucuugguc

SEQ ID NO: 3226982 - RNA, 15 nt, Mycobacterium leprae
cucgucgacaaggcg

SEQ ID NO: 3226983 - RNA, 16 nt, Mycobacterium leprae
cucgucggccagcacu

SEQ ID NO: 3226984 - RNA, 20 nt, Mycobacterium leprae
cucgucggccagcacuugca

SEQ ID NO: 3226985 - RNA, 12 nt, Mycobacterium leprae
cucgucggugag

SEQ ID NO: 3226986 - RNA, 22 nt, Mycobacterium leprae
cucgugcguuauauuugagugg

SEQ ID NO: 3226987 - RNA, 14 nt, Mycobacterium leprae
cucgugggcggcgg

SEQ ID NO: 3226988 - RNA, 19 nt, Mycobacterium leprae
cucguggguacgugccaac

SEQ ID NO: 3226989 - RNA, 20 nt, Mycobacterium leprae
cucguucaguuugguccagg

SEQ ID NO: 3226990 - RNA, 22 nt, Mycobacterium leprae
cucguucaguuugguccaggcg

SEQ ID NO: 3226991 - RNA, 23 nt, Mycobacterium leprae
cucguucaguuugguccaggcga

SEQ ID NO: 3226992 - RNA, 18 nt, Mycobacterium leprae
cucuaaaaagauauuaag

SEQ ID NO: 3226993 - RNA, 17 nt, Mycobacterium leprae
cucuaaagucguuggcc

SEQ ID NO: 3226994 - RNA, 20 nt, Mycobacterium leprae
cucuaccucggucggcaugu

SEQ ID NO: 3226995 - RNA, 15 nt, Mycobacterium leprae
cucuagauaacuauu

SEQ ID NO: 3226996 - RNA, 19 nt, Mycobacterium leprae
cucuagcuggucccacagc

SEQ ID NO: 3226997 - RNA, 13 nt, Mycobacterium leprae
cucucaggccguc

SEQ ID NO: 3226998 - RNA, 20 nt, Mycobacterium leprae
cucucugguaacggaccugg

SEQ ID NO: 3226999 - RNA, 23 nt, Mycobacterium leprae
cucugaggucaccggccaccggc

SEQ ID NO: 3227000 - RNA, 15 nt, Mycobacterium leprae
cucugcgguaucgcc

SEQ ID NO: 3227001 - RNA, 16 nt, Mycobacterium leprae
cucugcgguaucgccg

SEQ ID NO: 3227002 - RNA, 23 nt, Mycobacterium leprae
cucugggccgauuuggcggucag

SEQ ID NO: 3227003 - RNA, 20 nt, Mycobacterium leprae
cucugguaacggaccuggca

SEQ ID NO: 3227004 - RNA, 22 nt, Mycobacterium leprae
cucugguaacggaccuggcaaa

SEQ ID NO: 3227005 - RNA, 12 nt, Mycobacterium leprae
cucugguggcca

SEQ ID NO: 3227006 - RNA, 16 nt, Mycobacterium leprae
cucugguggccaccga

SEQ ID NO: 3227007 - RNA, 15 nt, Mycobacterium leprae
cucuuaacaacuuga

SEQ ID NO: 3227008 - RNA, 13 nt, Mycobacterium leprae
cucuucagacugg

SEQ ID NO: 3227009 - RNA, 14 nt, Mycobacterium leprae
cucuuguugaccaa

SEQ ID NO: 3227010 - RNA, 13 nt, Mycobacterium leprae
cucuuucggcgag

SEQ ID NO: 3227011 - RNA, 17 nt, Mycobacterium leprae
cugaaaggaacgacgga

SEQ ID NO: 3227012 - RNA, 16 nt, Mycobacterium leprae
cugaacauuaguuccu

SEQ ID NO: 3227013 - RNA, 16 nt, Mycobacterium leprae
cugaacgagaagcagc

SEQ ID NO: 3227014 - RNA, 22 nt, Mycobacterium leprae
cugaacuggaucggucagccac

SEQ ID NO: 3227015 - RNA, 22 nt, Mycobacterium leprae
cugaauggucauuggaagcuga

SEQ ID NO: 3227016 - RNA, 20 nt, Mycobacterium leprae
cugaauucagccgugcccaa

SEQ ID NO: 3227017 - RNA, 13 nt, Mycobacterium leprae
cugaauucguggu

SEQ ID NO: 3227018 - RNA, 19 nt, Mycobacterium leprae
cugacaccgcaguugaucc

SEQ ID NO: 3227019 - RNA, 21 nt, Mycobacterium leprae
cugacacuucuuacacgugcc

SEQ ID NO: 3227020 - RNA, 14 nt, Mycobacterium leprae
cugacagacauggc

SEQ ID NO: 3227021 - RNA, 16 nt, Mycobacterium leprae
cugacagacauggcug

SEQ ID NO: 3227022 - RNA, 18 nt, Mycobacterium leprae
cugacagauacucagcga

SEQ ID NO: 3227023 - RNA, 15 nt, Mycobacterium leprae
cugacaucaagccuc

SEQ ID NO: 3227024 - RNA, 18 nt, Mycobacterium leprae
cugaccguugcgucgcug

SEQ ID NO: 3227025 - RNA, 20 nt, Mycobacterium leprae
cugacgccgauuguuacuga

SEQ ID NO: 3227026 - RNA, 14 nt, Mycobacterium leprae
cugacgcugcgcug

SEQ ID NO: 3227027 - RNA, 22 nt, Mycobacterium leprae
cugacucucgcacgaguuggau

SEQ ID NO: 3227028 - RNA, 21 nt, Mycobacterium leprae
cugacuucgucagacgaaauu

SEQ ID NO: 3227029 - RNA, 11 nt, Mycobacterium leprae
cugagcgaagu

SEQ ID NO: 3227030 - RNA, 21 nt, Mycobacterium leprae
cugagcggcagauguccuuca

SEQ ID NO: 3227031 - RNA, 22 nt, Mycobacterium leprae
cugagcgggccagcaccaaccu

SEQ ID NO: 3227032 - RNA, 22 nt, Mycobacterium leprae
cugagcuagucccgauggcaac

SEQ ID NO: 3227033 - RNA, 18 nt, Mycobacterium leprae
cugaggcgauuguguaac

SEQ ID NO: 3227034 - RNA, 21 nt, Mycobacterium leprae
cugaggcggccggcacugaga

SEQ ID NO: 3227035 - RNA, 14 nt, Mycobacterium leprae
cugaggguggcgcc

SEQ ID NO: 3227036 - RNA, 22 nt, Mycobacterium leprae
cugaggguggcgccggcgugcg

SEQ ID NO: 3227037 - RNA, 21 nt, Mycobacterium leprae
cugaggguguuggucuguuug

SEQ ID NO: 3227038 - RNA, 12 nt, Mycobacterium leprae
cugagguacccg

SEQ ID NO: 3227039 - RNA, 19 nt, Mycobacterium leprae
cugagguacccgccucgau

SEQ ID NO: 3227040 - RNA, 17 nt, Mycobacterium leprae
cugaggucaccggccac

SEQ ID NO: 3227041 - RNA, 22 nt, Mycobacterium leprae
cugagguguugggagcgaagac

SEQ ID NO: 3227042 - RNA, 18 nt, Mycobacterium leprae
cugaguccgaugaugguu

SEQ ID NO: 3227043 - RNA, 15 nt, Mycobacterium leprae
cugagucggauuuau

SEQ ID NO: 3227044 - RNA, 16 nt, Mycobacterium leprae
cugaguucgcaagcaa

SEQ ID NO: 3227045 - RNA, 19 nt, Mycobacterium leprae
cugauaaggucuggcaccg

SEQ ID NO: 3227046 - RNA, 20 nt, Mycobacterium leprae
cugauaauuuggcgccagac

SEQ ID NO: 3227047 - RNA, 15 nt, Mycobacterium leprae
cugauacaacuggaa

SEQ ID NO: 3227048 - RNA, 16 nt, Mycobacterium leprae
cugauacaacuggaag

SEQ ID NO: 3227049 - RNA, 21 nt, Mycobacterium leprae
cugauaguguaagccaucacc

SEQ ID NO: 3227050 - RNA, 17 nt, Mycobacterium leprae
cugaucaccggccagcc

SEQ ID NO: 3227051 - RNA, 14 nt, Mycobacterium leprae
cugaucgcucaccc

SEQ ID NO: 3227052 - RNA, 17 nt, Mycobacterium leprae
cugaucgggcugcggug

SEQ ID NO: 3227053 - RNA, 16 nt, Mycobacterium leprae
cugaucggucagcucg

SEQ ID NO: 3227054 - RNA, 23 nt, Mycobacterium leprae
cugaucuuggagaagguuucccg

SEQ ID NO: 3227055 - RNA, 18 nt, Mycobacterium leprae
cugaugcggucaugcguc

SEQ ID NO: 3227056 - RNA, 20 nt, Mycobacterium leprae
cugaugcugccuagaugaug

SEQ ID NO: 3227057 - RNA, 16 nt, Mycobacterium leprae
cugaugcuguguggcu

SEQ ID NO: 3227058 - RNA, 21 nt, Mycobacterium leprae
cugauggccuaaacuccgggc

SEQ ID NO: 3227059 - RNA, 13 nt, Mycobacterium leprae
cugaugguaaccg

SEQ ID NO: 3227060 - RNA, 17 nt, Mycobacterium leprae
cugaugugcugagagca

SEQ ID NO: 3227061 - RNA, 18 nt, Mycobacterium leprae
cugaugugcugagagcag

SEQ ID NO: 3227062 - RNA, 16 nt, Mycobacterium leprae
cugauguuaucccuug

SEQ ID NO: 3227063 - RNA, 22 nt, Mycobacterium leprae
cugauguuaucccuugcaccau

SEQ ID NO: 3227064 - RNA, 21 nt, Mycobacterium leprae
cugauugccaacucaccgcag

SEQ ID NO: 3227065 - RNA, 17 nt, Mycobacterium leprae
cugcaacgacuggauga

SEQ ID NO: 3227066 - RNA, 23 nt, Mycobacterium leprae
cugcaacgcuucgugcaucgggu

SEQ ID NO: 3227067 - RNA, 17 nt, Mycobacterium leprae
cugcaacucaucggcuc

SEQ ID NO: 3227068 - RNA, 20 nt, Mycobacterium leprae
cugcaacucaucggcuccca

SEQ ID NO: 3227069 - RNA, 18 nt, Mycobacterium leprae
cugcaagcccccucggcg

SEQ ID NO: 3227070 - RNA, 19 nt, Mycobacterium leprae
cugcaagcccccucggcga

SEQ ID NO: 3227071 - RNA, 20 nt, Mycobacterium leprae
cugcaaggucguguugccac

SEQ ID NO: 3227072 - RNA, 19 nt, Mycobacterium leprae
cugcaaggugggcgaucag

SEQ ID NO: 3227073 - RNA, 21 nt, Mycobacterium leprae
cugcaauccguggagagcaug

SEQ ID NO: 3227074 - RNA, 21 nt, Mycobacterium leprae
cugcaaugccggacuggcuga

SEQ ID NO: 3227075 - RNA, 17 nt, Mycobacterium leprae
cugcacauucaaccagc

SEQ ID NO: 3227076 - RNA, 15 nt, Mycobacterium leprae
cugcaccccaggcua

SEQ ID NO: 3227077 - RNA, 18 nt, Mycobacterium leprae
cugcacccgccagggcgg

SEQ ID NO: 3227078 - RNA, 17 nt, Mycobacterium leprae
cugcacccggccgucgc

SEQ ID NO: 3227079 - RNA, 13 nt, Mycobacterium leprae
cugcacccggcgg

SEQ ID NO: 3227080 - RNA, 23 nt, Mycobacterium leprae
cugcacccggcggcaugccugcu

SEQ ID NO: 3227081 - RNA, 20 nt, Mycobacterium leprae
cugcaccucuucgacaccga

SEQ ID NO: 3227082 - RNA, 15 nt, Mycobacterium leprae
cugcaccugaucuag

SEQ ID NO: 3227083 - RNA, 17 nt, Mycobacterium leprae
cugcaccuguugcucaa

SEQ ID NO: 3227084 - RNA, 15 nt, Mycobacterium leprae
cugcacgaccacacu

SEQ ID NO: 3227085 - RNA, 22 nt, Mycobacterium leprae
cugcacgaccacacugugccug

SEQ ID NO: 3227086 - RNA, 14 nt, Mycobacterium leprae
cugcacggcgugca

SEQ ID NO: 3227087 - RNA, 22 nt, Mycobacterium leprae
cugcacuauaaggcagcucgcc

SEQ ID NO: 3227088 - RNA, 18 nt, Mycobacterium leprae
cugcagcaacagccacac

SEQ ID NO: 3227089 - RNA, 22 nt, Mycobacterium leprae
cugcagcaacagccacacccga

SEQ ID NO: 3227090 - RNA, 18 nt, Mycobacterium leprae
cugcagcauaacccgauc

SEQ ID NO: 3227091 - RNA, 22 nt, Mycobacterium leprae
cugcagcauuggcuccugggaa

SEQ ID NO: 3227092 - RNA, 23 nt, Mycobacterium leprae
cugcagcauuggcuccugggaag

SEQ ID NO: 3227093 - RNA, 22 nt, Mycobacterium leprae
cugcagccacgaaaaucuggcg

SEQ ID NO: 3227094 - RNA, 19 nt, Mycobacterium leprae
cugcagcuacucgggguuu

SEQ ID NO: 3227095 - RNA, 18 nt, Mycobacterium leprae
cugcagguugcugucgug

SEQ ID NO: 3227096 - RNA, 16 nt, Mycobacterium leprae
cugcagguuguugacg

SEQ ID NO: 3227097 - RNA, 17 nt, Mycobacterium leprae
cugcagugcuacgaagg

SEQ ID NO: 3227098 - RNA, 17 nt, Mycobacterium leprae
cugcauaugcagcugcc

SEQ ID NO: 3227099 - RNA, 19 nt, Mycobacterium leprae
cugcauccgacaaagcagc

SEQ ID NO: 3227100 - RNA, 19 nt, Mycobacterium leprae
cugcaucgguaaccauaag

SEQ ID NO: 3227101 - RNA, 16 nt, Mycobacterium leprae
cugcauggacgauauc

SEQ ID NO: 3227102 - RNA, 13 nt, Mycobacterium leprae
cugcauucugcug

SEQ ID NO: 3227103 - RNA, 18 nt, Mycobacterium leprae
cugcauugcaagggacau

SEQ ID NO: 3227104 - RNA, 15 nt, Mycobacterium leprae
cugccaaaguccaug

SEQ ID NO: 3227105 - RNA, 18 nt, Mycobacterium leprae
cugccaaucagcacucga

SEQ ID NO: 3227106 - RNA, 20 nt, Mycobacterium leprae
cugccacauguuuccggcaa

SEQ ID NO: 3227107 - RNA, 17 nt, Mycobacterium leprae
cugccacggccccggau

SEQ ID NO: 3227108 - RNA, 20 nt, Mycobacterium leprae
cugccacugacgaggugucg

SEQ ID NO: 3227109 - RNA, 21 nt, Mycobacterium leprae
cugccagcuucgcagacacag

SEQ ID NO: 3227110 - RNA, 22 nt, Mycobacterium leprae
cugccaucgacgccgucuccgc

SEQ ID NO: 3227111 - RNA, 12 nt, Mycobacterium leprae
cugccaugccag

SEQ ID NO: 3227112 - RNA, 20 nt, Mycobacterium leprae
cugcccaugcuuaaggcaga

SEQ ID NO: 3227113 - RNA, 14 nt, Mycobacterium leprae
cugcccgcgggggu

SEQ ID NO: 3227114 - RNA, 21 nt, Mycobacterium leprae
cugcccggacaagucagccua

SEQ ID NO: 3227115 - RNA, 23 nt, Mycobacterium leprae
cugcccugcaacgcuucgugcau

SEQ ID NO: 3227116 - RNA, 20 nt, Mycobacterium leprae
cugcccugccccgguggcug

SEQ ID NO: 3227117 - RNA, 20 nt, Mycobacterium leprae
cugccgaaccuccaccacuc

SEQ ID NO: 3227118 - RNA, 20 nt, Mycobacterium leprae
cugccgaccgccucgaugug

SEQ ID NO: 3227119 - RNA, 22 nt, Mycobacterium leprae
cugccgauauaccugcgucgcu

SEQ ID NO: 3227120 - RNA, 12 nt, Mycobacterium leprae
cugccgcuggua

SEQ ID NO: 3227121 - RNA, 14 nt, Mycobacterium leprae
cugccggcaaccag

SEQ ID NO: 3227122 - RNA, 13 nt, Mycobacterium leprae
cugccggugaccg

SEQ ID NO: 3227123 - RNA, 17 nt, Mycobacterium leprae
cugccggugaccgggcc

SEQ ID NO: 3227124 - RNA, 22 nt, Mycobacterium leprae
cugccggugaccgggccggccg

SEQ ID NO: 3227125 - RNA, 21 nt, Mycobacterium leprae
cugccggugcggucccaucgc

SEQ ID NO: 3227126 - RNA, 18 nt, Mycobacterium leprae
cugccgucgaauucuuaa

SEQ ID NO: 3227127 - RNA, 16 nt, Mycobacterium leprae
cugccuagcaacguca

SEQ ID NO: 3227128 - RNA, 23 nt, Mycobacterium leprae
cugccuugaugagaucacugagu

SEQ ID NO: 3227129 - RNA, 13 nt, Mycobacterium leprae
cugcgaacagccg

SEQ ID NO: 3227130 - RNA, 18 nt, Mycobacterium leprae
cugcgaccgaccaaccgu

SEQ ID NO: 3227131 - RNA, 15 nt, Mycobacterium leprae
cugcgacgucccaag

SEQ ID NO: 3227132 - RNA, 19 nt, Mycobacterium leprae
cugcgauccggcacaucga

SEQ ID NO: 3227133 - RNA, 16 nt, Mycobacterium leprae
cugcgaucgcaaauau

SEQ ID NO: 3227134 - RNA, 20 nt, Mycobacterium leprae
cugcgcaauacggugcacca

SEQ ID NO: 3227135 - RNA, 19 nt, Mycobacterium leprae
cugcgcaccugccacggcc

SEQ ID NO: 3227136 - RNA, 18 nt, Mycobacterium leprae
cugcgccggggauuucag

SEQ ID NO: 3227137 - RNA, 23 nt, Mycobacterium leprae
cugcgccuuucguccaaacaccg

SEQ ID NO: 3227138 - RNA, 16 nt, Mycobacterium leprae
cugcgcgcacccaagc

SEQ ID NO: 3227139 - RNA, 21 nt, Mycobacterium leprae
cugcgcgcacccaagccaugu

SEQ ID NO: 3227140 - RNA, 18 nt, Mycobacterium leprae
cugcgcggcugccgcacc

SEQ ID NO: 3227141 - RNA, 15 nt, Mycobacterium leprae
cugcgcucaccucgg

SEQ ID NO: 3227142 - RNA, 21 nt, Mycobacterium leprae
cugcgcugagagugccaccgc

SEQ ID NO: 3227143 - RNA, 15 nt, Mycobacterium leprae
cugcggcucaccgac

SEQ ID NO: 3227144 - RNA, 17 nt, Mycobacterium leprae
cugcggcugcugugcga

SEQ ID NO: 3227145 - RNA, 19 nt, Mycobacterium leprae
cugcggggagcuguauuua

SEQ ID NO: 3227146 - RNA, 13 nt, Mycobacterium leprae
cugcgguguccgu

SEQ ID NO: 3227147 - RNA, 20 nt, Mycobacterium leprae
cugcguauagugguucugcu

SEQ ID NO: 3227148 - RNA, 19 nt, Mycobacterium leprae
cugcgugauccgucgcacg

SEQ ID NO: 3227149 - RNA, 18 nt, Mycobacterium leprae
cugcguguaaacuggcga

SEQ ID NO: 3227150 - RNA, 14 nt, Mycobacterium leprae
cugcgugucgaccc

SEQ ID NO: 3227151 - RNA, 15 nt, Mycobacterium leprae
cugcguguucaucau

SEQ ID NO: 3227152 - RNA, 17 nt, Mycobacterium leprae
cugcguguucaucaucu

SEQ ID NO: 3227153 - RNA, 16 nt, Mycobacterium leprae
cugcguucagcgaaga

SEQ ID NO: 3227154 - RNA, 15 nt, Mycobacterium leprae
cugcuacgugacugc

SEQ ID NO: 3227155 - RNA, 16 nt, Mycobacterium leprae
cugcucaaccaugccg

SEQ ID NO: 3227156 - RNA, 24 nt, Mycobacterium leprae
cugcucaaccaugccgcgcgccug

SEQ ID NO: 3227157 - RNA, 15 nt, Mycobacterium leprae
cugcucauggcaccg

SEQ ID NO: 3227158 - RNA, 17 nt, Mycobacterium leprae
cugcucauucaggccga

SEQ ID NO: 3227159 - RNA, 14 nt, Mycobacterium leprae
cugcuccugagaca

SEQ ID NO: 3227160 - RNA, 15 nt, Mycobacterium leprae
cugcucggccagagc

SEQ ID NO: 3227161 - RNA, 12 nt, Mycobacterium leprae
cugcucggcgaa

SEQ ID NO: 3227162 - RNA, 17 nt, Mycobacterium leprae
cugcugaauagucggca

SEQ ID NO: 3227163 - RNA, 23 nt, Mycobacterium leprae
cugcugaccgggguucaaucucu

SEQ ID NO: 3227164 - RNA, 18 nt, Mycobacterium leprae
cugcugagcguggcugcu

SEQ ID NO: 3227165 - RNA, 19 nt, Mycobacterium leprae
cugcugcaagcccccucgg

SEQ ID NO: 3227166 - RNA, 16 nt, Mycobacterium leprae
cugcugcgcaagguug

SEQ ID NO: 3227167 - RNA, 14 nt, Mycobacterium leprae
cugcugcuggugga

SEQ ID NO: 3227168 - RNA, 23 nt, Mycobacterium leprae
cugcugggaaugccggauuccga

SEQ ID NO: 3227169 - RNA, 14 nt, Mycobacterium leprae
cugcugguggagua

SEQ ID NO: 3227170 - RNA, 21 nt, Mycobacterium leprae
cugcugguggaguacugggca

SEQ ID NO: 3227171 - RNA, 15 nt, Mycobacterium leprae
cugcugguucuuggc

SEQ ID NO: 3227172 - RNA, 17 nt, Mycobacterium leprae
cugcuguguuugcuggu

SEQ ID NO: 3227173 - RNA, 14 nt, Mycobacterium leprae
cugcuguucaugcc

SEQ ID NO: 3227174 - RNA, 22 nt, Mycobacterium leprae
cugcuucgauguguugaacagu

SEQ ID NO: 3227175 - RNA, 15 nt, Mycobacterium leprae
cugcuucggccagcg

SEQ ID NO: 3227176 - RNA, 18 nt, Mycobacterium leprae
cugcuucgggagucgcuc

SEQ ID NO: 3227177 - RNA, 13 nt, Mycobacterium leprae
cugcuugcuggcu

SEQ ID NO: 3227178 - RNA, 18 nt, Mycobacterium leprae
cugcuugcuggcugaggg

SEQ ID NO: 3227179 - RNA, 18 nt, Mycobacterium leprae
cuggaaagaguuacuaua

SEQ ID NO: 3227180 - RNA, 20 nt, Mycobacterium leprae
cuggaacguuuauuccuaau

SEQ ID NO: 3227181 - RNA, 13 nt, Mycobacterium leprae
cuggaccgcagca

SEQ ID NO: 3227182 - RNA, 14 nt, Mycobacterium leprae
cuggagaauguugu

SEQ ID NO: 3227183 - RNA, 17 nt, Mycobacterium leprae
cuggagcgccaccaugc

SEQ ID NO: 3227184 - RNA, 20 nt, Mycobacterium leprae
cuggagucauccccaucgcu

SEQ ID NO: 3227185 - RNA, 19 nt, Mycobacterium leprae
cuggaucacacucuguugg

SEQ ID NO: 3227186 - RNA, 21 nt, Mycobacterium leprae
cuggaucagcgcgccaaacac

SEQ ID NO: 3227187 - RNA, 22 nt, Mycobacterium leprae
cuggaucgguaccagcggcagc

SEQ ID NO: 3227188 - RNA, 14 nt, Mycobacterium leprae
cuggauggauuggu

SEQ ID NO: 3227189 - RNA, 14 nt, Mycobacterium leprae
cuggauggccgcca

SEQ ID NO: 3227190 - RNA, 17 nt, Mycobacterium leprae
cuggauggcgaucgccu

SEQ ID NO: 3227191 - RNA, 12 nt, Mycobacterium leprae
cuggauggcgcu

SEQ ID NO: 3227192 - RNA, 15 nt, Mycobacterium leprae
cuggauuaauauuua

SEQ ID NO: 3227193 - RNA, 14 nt, Mycobacterium leprae
cuggauuagcggga

SEQ ID NO: 3227194 - RNA, 15 nt, Mycobacterium leprae
cuggcaagcucgggu

SEQ ID NO: 3227195 - RNA, 16 nt, Mycobacterium leprae
cuggcaagcucgggug

SEQ ID NO: 3227196 - RNA, 19 nt, Mycobacterium leprae
cuggcaagugccgcgggug

SEQ ID NO: 3227197 - RNA, 22 nt, Mycobacterium leprae
cuggcacccacgcugcgcggcu

SEQ ID NO: 3227198 - RNA, 20 nt, Mycobacterium leprae
cuggcaccgugucgucuucc

SEQ ID NO: 3227199 - RNA, 17 nt, Mycobacterium leprae
cuggcacgccagcuggu

SEQ ID NO: 3227200 - RNA, 23 nt, Mycobacterium leprae
cuggcacgccagcugguggucac

SEQ ID NO: 3227201 - RNA, 15 nt, Mycobacterium leprae
cuggcaguggcaacu

SEQ ID NO: 3227202 - RNA, 20 nt, Mycobacterium leprae
cuggcaguuagcaugagcug

SEQ ID NO: 3227203 - RNA, 15 nt, Mycobacterium leprae
cuggcaugagccgac

SEQ ID NO: 3227204 - RNA, 14 nt, Mycobacterium leprae
cuggcauuacgcga

SEQ ID NO: 3227205 - RNA, 16 nt, Mycobacterium leprae
cuggccaucgcaccga

SEQ ID NO: 3227206 - RNA, 17 nt, Mycobacterium leprae
cuggcccauccgggcca

SEQ ID NO: 3227207 - RNA, 13 nt, Mycobacterium leprae
cuggccccgucgu

SEQ ID NO: 3227208 - RNA, 21 nt, Mycobacterium leprae
cuggcccuguuccucgcgggc

SEQ ID NO: 3227209 - RNA, 20 nt, Mycobacterium leprae
cuggccgggaucggcggcac

SEQ ID NO: 3227210 - RNA, 16 nt, Mycobacterium leprae
cuggccggggccaagc

SEQ ID NO: 3227211 - RNA, 19 nt, Mycobacterium leprae
cuggccuaccgggcgcuca

SEQ ID NO: 3227212 - RNA, 19 nt, Mycobacterium leprae
cuggccuguucauggugug

SEQ ID NO: 3227213 - RNA, 21 nt, Mycobacterium leprae
cuggccuguucaugguguguu

SEQ ID NO: 3227214 - RNA, 14 nt, Mycobacterium leprae
cuggcgaguggagu

SEQ ID NO: 3227215 - RNA, 16 nt, Mycobacterium leprae
cuggcgaguggaguga

SEQ ID NO: 3227216 - RNA, 22 nt, Mycobacterium leprae
cuggcgauuuucuugccgucga

SEQ ID NO: 3227217 - RNA, 16 nt, Mycobacterium leprae
cuggcgcaacagucag

SEQ ID NO: 3227218 - RNA, 18 nt, Mycobacterium leprae
cuggcgccuuuuuaugaa

SEQ ID NO: 3227219 - RNA, 19 nt, Mycobacterium leprae
cuggcgcuuaauguagcau

SEQ ID NO: 3227220 - RNA, 22 nt, Mycobacterium leprae
cuggcggcccacaaguccaggg

SEQ ID NO: 3227221 - RNA, 15 nt, Mycobacterium leprae
cuggcggugggugca

SEQ ID NO: 3227222 - RNA, 15 nt, Mycobacterium leprae
cuggcguagcggagc

SEQ ID NO: 3227223 - RNA, 15 nt, Mycobacterium leprae
cuggcgugcaucccu

SEQ ID NO: 3227224 - RNA, 21 nt, Mycobacterium leprae
cuggcguuuggugcugcgcuc

SEQ ID NO: 3227225 - RNA, 22 nt, Mycobacterium leprae
cuggcuaauggcgggcuggagg

SEQ ID NO: 3227226 - RNA, 17 nt, Mycobacterium leprae
cuggcuccauccugccu

SEQ ID NO: 3227227 - RNA, 14 nt, Mycobacterium leprae
cuggcugccgccac

SEQ ID NO: 3227228 - RNA, 14 nt, Mycobacterium leprae
cuggcugcgccggc

SEQ ID NO: 3227229 - RNA, 15 nt, Mycobacterium leprae
cuggcugcgccggcu

SEQ ID NO: 3227230 - RNA, 12 nt, Mycobacterium leprae
cuggcugcugca

SEQ ID NO: 3227231 - RNA, 14 nt, Mycobacterium leprae
cuggcuugucacca

SEQ ID NO: 3227232 - RNA, 21 nt, Mycobacterium leprae
cuggcuugucaccagauugga

SEQ ID NO: 3227233 - RNA, 20 nt, Mycobacterium leprae
cugggaacugccggcaacca

SEQ ID NO: 3227234 - RNA, 20 nt, Mycobacterium leprae
cugggacauccgcugauugg

SEQ ID NO: 3227235 - RNA, 16 nt, Mycobacterium leprae
cugggaccaccugaga

SEQ ID NO: 3227236 - RNA, 12 nt, Mycobacterium leprae
cugggcaccacc

SEQ ID NO: 3227237 - RNA, 16 nt, Mycobacterium leprae
cugggccgaucucggc

SEQ ID NO: 3227238 - RNA, 13 nt, Mycobacterium leprae
cugggcgaaaaca

SEQ ID NO: 3227239 - RNA, 23 nt, Mycobacterium leprae
cugggcggcuagucggccggcuc

SEQ ID NO: 3227240 - RNA, 16 nt, Mycobacterium leprae
cuggggcguccaguga

SEQ ID NO: 3227241 - RNA, 17 nt, Mycobacterium leprae
cuggguagcaggacgca

SEQ ID NO: 3227242 - RNA, 15 nt, Mycobacterium leprae
cugggugguguggcc

SEQ ID NO: 3227243 - RNA, 16 nt, Mycobacterium leprae
cuggguuauggaccug

SEQ ID NO: 3227244 - RNA, 13 nt, Mycobacterium leprae
cuggucaacgcag

SEQ ID NO: 3227245 - RNA, 14 nt, Mycobacterium leprae
cuggucaacgcagc

SEQ ID NO: 3227246 - RNA, 18 nt, Mycobacterium leprae
cuggucauggcuucguca

SEQ ID NO: 3227247 - RNA, 16 nt, Mycobacterium leprae
cuggucgagcagcucc

SEQ ID NO: 3227248 - RNA, 22 nt, Mycobacterium leprae
cuggucuucuuggcgcugagca

SEQ ID NO: 3227249 - RNA, 15 nt, Mycobacterium leprae
cuggucuuguggaac

SEQ ID NO: 3227250 - RNA, 18 nt, Mycobacterium leprae
cuggucuuguggaacgga

SEQ ID NO: 3227251 - RNA, 23 nt, Mycobacterium leprae
cuggugaauagcuaaagugcugc

SEQ ID NO: 3227252 - RNA, 15 nt, Mycobacterium leprae
cuggugccccagucg

SEQ ID NO: 3227253 - RNA, 16 nt, Mycobacterium leprae
cuggugcuguguugug

SEQ ID NO: 3227254 - RNA, 17 nt, Mycobacterium leprae
cuggugcuuggcagccc

SEQ ID NO: 3227255 - RNA, 21 nt, Mycobacterium leprae
cugguggauccaggugcugca

SEQ ID NO: 3227256 - RNA, 16 nt, Mycobacterium leprae
cugguggcaacgcugc

SEQ ID NO: 3227257 - RNA, 12 nt, Mycobacterium leprae
cugguggcaagu

SEQ ID NO: 3227258 - RNA, 22 nt, Mycobacterium leprae
cugguggcagccacagcgacgg

SEQ ID NO: 3227259 - RNA, 17 nt, Mycobacterium leprae
cugguggggugugggug

SEQ ID NO: 3227260 - RNA, 22 nt, Mycobacterium leprae
cugguggggugugggugguuga

SEQ ID NO: 3227261 - RNA, 18 nt, Mycobacterium leprae
cugguguccuacagcagu

SEQ ID NO: 3227262 - RNA, 15 nt, Mycobacterium leprae
cuggugugcgcgccg

SEQ ID NO: 3227263 - RNA, 22 nt, Mycobacterium leprae
cuggugugcgcgccgcccagca

SEQ ID NO: 3227264 - RNA, 19 nt, Mycobacterium leprae
cugguucacuaagccacuc

SEQ ID NO: 3227265 - RNA, 16 nt, Mycobacterium leprae
cugguucagccauucu

SEQ ID NO: 3227266 - RNA, 20 nt, Mycobacterium leprae
cugguucuuggcuugcuguc

SEQ ID NO: 3227267 - RNA, 23 nt, Mycobacterium leprae
cugguuggcgcgcuuucggagau

SEQ ID NO: 3227268 - RNA, 16 nt, Mycobacterium leprae
cugguuguccacggca

SEQ ID NO: 3227269 - RNA, 20 nt, Mycobacterium leprae
cugguuguccacggcagcua

SEQ ID NO: 3227270 - RNA, 23 nt, Mycobacterium leprae
cugguuuggguuugggugguggu

SEQ ID NO: 3227271 - RNA, 20 nt, Mycobacterium leprae
cuguaauuacuucggucagg

SEQ ID NO: 3227272 - RNA, 21 nt, Mycobacterium leprae
cuguagcucaauuggcagagc

SEQ ID NO: 3227273 - RNA, 16 nt, Mycobacterium leprae
cuguagggaaucggca

SEQ ID NO: 3227274 - RNA, 21 nt, Mycobacterium leprae
cuguauaacaaaucauaguga

SEQ ID NO: 3227275 - RNA, 22 nt, Mycobacterium leprae
cuguauaacaaaucauagugac

SEQ ID NO: 3227276 - RNA, 22 nt, Mycobacterium leprae
cuguauggcuccaaguggcugc

SEQ ID NO: 3227277 - RNA, 21 nt, Mycobacterium leprae
cuguauugccguagaguucua

SEQ ID NO: 3227278 - RNA, 23 nt, Mycobacterium leprae
cugucacuacguccacuagccag

SEQ ID NO: 3227279 - RNA, 12 nt, Mycobacterium leprae
cugucagagugc

SEQ ID NO: 3227280 - RNA, 19 nt, Mycobacterium leprae
cugucccgggggccagcgu

SEQ ID NO: 3227281 - RNA, 12 nt, Mycobacterium leprae
cuguccgcacaa

SEQ ID NO: 3227282 - RNA, 19 nt, Mycobacterium leprae
cuguccgcacaaacuucga

SEQ ID NO: 3227283 - RNA, 22 nt, Mycobacterium leprae
cuguccgcacaaacuucgacga

SEQ ID NO: 3227284 - RNA, 13 nt, Mycobacterium leprae
cugucgaaaaccu

SEQ ID NO: 3227285 - RNA, 13 nt, Mycobacterium leprae
cugucgauacggc

SEQ ID NO: 3227286 - RNA, 16 nt, Mycobacterium leprae
cugucgauacggccaa

SEQ ID NO: 3227287 - RNA, 19 nt, Mycobacterium leprae
cugucgauuaccacugccg

SEQ ID NO: 3227288 - RNA, 23 nt, Mycobacterium leprae
cugucguaacaccagagacaccu

SEQ ID NO: 3227289 - RNA, 12 nt, Mycobacterium leprae
cugucgucgaaa

SEQ ID NO: 3227290 - RNA, 14 nt, Mycobacterium leprae
cugucguggcugca

SEQ ID NO: 3227291 - RNA, 20 nt, Mycobacterium leprae
cugucuacggucaggugucu

SEQ ID NO: 3227292 - RNA, 14 nt, Mycobacterium leprae
cugucuaucacauc

SEQ ID NO: 3227293 - RNA, 17 nt, Mycobacterium leprae
cugugacacuucuccaa

SEQ ID NO: 3227294 - RNA, 12 nt, Mycobacterium leprae
cugugcacgugc

SEQ ID NO: 3227295 - RNA, 17 nt, Mycobacterium leprae
cugugcaugcacgugca

SEQ ID NO: 3227296 - RNA, 13 nt, Mycobacterium leprae
cugugccagcucg

SEQ ID NO: 3227297 - RNA, 14 nt, Mycobacterium leprae
cugugccugguagg

SEQ ID NO: 3227298 - RNA, 17 nt, Mycobacterium leprae
cuguggcacccacucgg

SEQ ID NO: 3227299 - RNA, 16 nt, Mycobacterium leprae
cuguggcagagacggu

SEQ ID NO: 3227300 - RNA, 17 nt, Mycobacterium leprae
cuguggcggugaguugu

SEQ ID NO: 3227301 - RNA, 15 nt, Mycobacterium leprae
cugugggcagugccu

SEQ ID NO: 3227302 - RNA, 14 nt, Mycobacterium leprae
cugugggucgaccc

SEQ ID NO: 3227303 - RNA, 15 nt, Mycobacterium leprae
cuguguacgaagccu

SEQ ID NO: 3227304 - RNA, 20 nt, Mycobacterium leprae
cuguguacgaagccugagac

SEQ ID NO: 3227305 - RNA, 22 nt, Mycobacterium leprae
cugugucacgcgaccaacgccg

SEQ ID NO: 3227306 - RNA, 18 nt, Mycobacterium leprae
cugugucggucuuguccu

SEQ ID NO: 3227307 - RNA, 14 nt, Mycobacterium leprae
cugugugcagcuug

SEQ ID NO: 3227308 - RNA, 14 nt, Mycobacterium leprae
cuguguugccaucg

SEQ ID NO: 3227309 - RNA, 19 nt, Mycobacterium leprae
cuguguugcgggguuuuug

SEQ ID NO: 3227310 - RNA, 20 nt, Mycobacterium leprae
cuguguuguggguguuuugu

SEQ ID NO: 3227311 - RNA, 16 nt, Mycobacterium leprae
cuguuagaucuugagu

SEQ ID NO: 3227312 - RNA, 15 nt, Mycobacterium leprae
cuguuaugugguugu

SEQ ID NO: 3227313 - RNA, 12 nt, Mycobacterium leprae
cuguuccucuug

SEQ ID NO: 3227314 - RNA, 18 nt, Mycobacterium leprae
cuguucgugaucgacggc

SEQ ID NO: 3227315 - RNA, 23 nt, Mycobacterium leprae
cuguugaauauacgaaucccgcu

SEQ ID NO: 3227316 - RNA, 15 nt, Mycobacterium leprae
cuguugacuuguacu

SEQ ID NO: 3227317 - RNA, 21 nt, Mycobacterium leprae
cuguugacuuguacuuugugu

SEQ ID NO: 3227318 - RNA, 18 nt, Mycobacterium leprae
cuguugcaggcuucguca

SEQ ID NO: 3227319 - RNA, 19 nt, Mycobacterium leprae
cuguugcucaacgggccgc

SEQ ID NO: 3227320 - RNA, 19 nt, Mycobacterium leprae
cuguuggugugugaggauc

SEQ ID NO: 3227321 - RNA, 16 nt, Mycobacterium leprae
cuguuguaagcacugc

SEQ ID NO: 3227322 - RNA, 17 nt, Mycobacterium leprae
cuguuguaagcacugca

SEQ ID NO: 3227323 - RNA, 18 nt, Mycobacterium leprae
cuguuguaagcacugcac

SEQ ID NO: 3227324 - RNA, 17 nt, Mycobacterium leprae
cuguugucaccccagac

SEQ ID NO: 3227325 - RNA, 16 nt, Mycobacterium leprae
cuguugugggggugga

SEQ ID NO: 3227326 - RNA, 22 nt, Mycobacterium leprae
cuguuguggucaacgggacuga

SEQ ID NO: 3227327 - RNA, 12 nt, Mycobacterium leprae
cuguuguugguc

SEQ ID NO: 3227328 - RNA, 18 nt, Mycobacterium leprae
cuguuuuccgcggcaagu

SEQ ID NO: 3227329 - RNA, 18 nt, Mycobacterium leprae
cuuaacgccaguugcauu

SEQ ID NO: 3227330 - RNA, 13 nt, Mycobacterium leprae
cuuaacgccgccu

SEQ ID NO: 3227331 - RNA, 20 nt, Mycobacterium leprae
cuuaacgcucacagcagucc

SEQ ID NO: 3227332 - RNA, 21 nt, Mycobacterium leprae
cuuaagcugcauaugcagcug

SEQ ID NO: 3227333 - RNA, 17 nt, Mycobacterium leprae
cuuaaggcagaacugga

SEQ ID NO: 3227334 - RNA, 21 nt, Mycobacterium leprae
cuuaaguggcuggcuuaggag

SEQ ID NO: 3227335 - RNA, 21 nt, Mycobacterium leprae
cuuaaguuauuuggaguuauu

SEQ ID NO: 3227336 - RNA, 14 nt, Mycobacterium leprae
cuuaauaucuuuuu

SEQ ID NO: 3227337 - RNA, 17 nt, Mycobacterium leprae
cuuaauaucuuuuuaga

SEQ ID NO: 3227338 - RNA, 21 nt, Mycobacterium leprae
cuuaaugaucgcguugaccaa

SEQ ID NO: 3227339 - RNA, 23 nt, Mycobacterium leprae
cuuaaugaucgcguugaccaaac

SEQ ID NO: 3227340 - RNA, 19 nt, Mycobacterium leprae
cuuacaccaacauagucag

SEQ ID NO: 3227341 - RNA, 15 nt, Mycobacterium leprae
cuuaccucaguguca

SEQ ID NO: 3227342 - RNA, 20 nt, Mycobacterium leprae
cuuacggcuuugcaaagcag

SEQ ID NO: 3227343 - RNA, 15 nt, Mycobacterium leprae
cuuacgugcgccgcg

SEQ ID NO: 3227344 - RNA, 21 nt, Mycobacterium leprae
cuuagcaacguguaaggccag

SEQ ID NO: 3227345 - RNA, 14 nt, Mycobacterium leprae
cuuagcauagcggc

SEQ ID NO: 3227346 - RNA, 18 nt, Mycobacterium leprae
cuuagcauagcggccgcc

SEQ ID NO: 3227347 - RNA, 20 nt, Mycobacterium leprae
cuuagccaacaccgcggcga

SEQ ID NO: 3227348 - RNA, 21 nt, Mycobacterium leprae
cuuagcgauguggcucaucuc

SEQ ID NO: 3227349 - RNA, 19 nt, Mycobacterium leprae
cuuagcgugagccuggcac

SEQ ID NO: 3227350 - RNA, 14 nt, Mycobacterium leprae
cuuauacugcugcg

SEQ ID NO: 3227351 - RNA, 14 nt, Mycobacterium leprae
cuuaugcgugcuga

SEQ ID NO: 3227352 - RNA, 18 nt, Mycobacterium leprae
cuuauuuauauucaauuu

SEQ ID NO: 3227353 - RNA, 14 nt, Mycobacterium leprae
cuucaaccaagccg

SEQ ID NO: 3227354 - RNA, 21 nt, Mycobacterium leprae
cuucaauaccgaccgaaagcc

SEQ ID NO: 3227355 - RNA, 15 nt, Mycobacterium leprae
cuucaauccgcgcau

SEQ ID NO: 3227356 - RNA, 16 nt, Mycobacterium leprae
cuucacacgagccgca

SEQ ID NO: 3227357 - RNA, 18 nt, Mycobacterium leprae
cuucaccaauccagccaa

SEQ ID NO: 3227358 - RNA, 18 nt, Mycobacterium leprae
cuucacgaaugccaucgg

SEQ ID NO: 3227359 - RNA, 18 nt, Mycobacterium leprae
cuucacuuagccaugucu

SEQ ID NO: 3227360 - RNA, 18 nt, Mycobacterium leprae
cuucagaaaguugaagua

SEQ ID NO: 3227361 - RNA, 22 nt, Mycobacterium leprae
cuucagaagcacgacacuagcu

SEQ ID NO: 3227362 - RNA, 13 nt, Mycobacterium leprae
cuucagcacagcc

SEQ ID NO: 3227363 - RNA, 17 nt, Mycobacterium leprae
cuucagcgagcguguca

SEQ ID NO: 3227364 - RNA, 12 nt, Mycobacterium leprae
cuucaggcaaca

SEQ ID NO: 3227365 - RNA, 13 nt, Mycobacterium leprae
cuucagucaggca

SEQ ID NO: 3227366 - RNA, 21 nt, Mycobacterium leprae
cuucauguccuacacaaacaa

SEQ ID NO: 3227367 - RNA, 19 nt, Mycobacterium leprae
cuucauuggcuagccagac

SEQ ID NO: 3227368 - RNA, 18 nt, Mycobacterium leprae
cuuccaccauuuccggaa

SEQ ID NO: 3227369 - RNA, 18 nt, Mycobacterium leprae
cuucccgacggugaauca

SEQ ID NO: 3227370 - RNA, 16 nt, Mycobacterium leprae
cuucccuugaacugca

SEQ ID NO: 3227371 - RNA, 18 nt, Mycobacterium leprae
cuuccgcuuugccgcugu

SEQ ID NO: 3227372 - RNA, 19 nt, Mycobacterium leprae
cuuccuaaaacaucgacuu

SEQ ID NO: 3227373 - RNA, 15 nt, Mycobacterium leprae
cuuccuacggcuucc

SEQ ID NO: 3227374 - RNA, 19 nt, Mycobacterium leprae
cuuccuaugucgugcugac

SEQ ID NO: 3227375 - RNA, 16 nt, Mycobacterium leprae
cuuccugacaaccguu

SEQ ID NO: 3227376 - RNA, 17 nt, Mycobacterium leprae
cuuccugcggugguggc

SEQ ID NO: 3227377 - RNA, 14 nt, Mycobacterium leprae
cuuccugcuggccc

SEQ ID NO: 3227378 - RNA, 15 nt, Mycobacterium leprae
cuucgaccgacauca

SEQ ID NO: 3227379 - RNA, 21 nt, Mycobacterium leprae
cuucgacgguguaaugcugcu

SEQ ID NO: 3227380 - RNA, 14 nt, Mycobacterium leprae
cuucgauccaggcg

SEQ ID NO: 3227381 - RNA, 22 nt, Mycobacterium leprae
cuucgauguguugaacaguacu

SEQ ID NO: 3227382 - RNA, 16 nt, Mycobacterium leprae
cuucgcagacacagcc

SEQ ID NO: 3227383 - RNA, 14 nt, Mycobacterium leprae
cuucgcagccaccg

SEQ ID NO: 3227384 - RNA, 15 nt, Mycobacterium leprae
cuucgccuuagcacg

SEQ ID NO: 3227385 - RNA, 13 nt, Mycobacterium leprae
cuucggccagcgc

SEQ ID NO: 3227386 - RNA, 14 nt, Mycobacterium leprae
cuucggccagcgca

SEQ ID NO: 3227387 - RNA, 15 nt, Mycobacterium leprae
cuucgguaacgcuga

SEQ ID NO: 3227388 - RNA, 13 nt, Mycobacterium leprae
cuucgguuccgaa

SEQ ID NO: 3227389 - RNA, 16 nt, Mycobacterium leprae
cuucgguuccgaagcc

SEQ ID NO: 3227390 - RNA, 23 nt, Mycobacterium leprae
cuucgguugggacagaagugguu

SEQ ID NO: 3227391 - RNA, 18 nt, Mycobacterium leprae
cuucgucaauucggcgau

SEQ ID NO: 3227392 - RNA, 20 nt, Mycobacterium leprae
cuucgucagcuggaaucccc

SEQ ID NO: 3227393 - RNA, 16 nt, Mycobacterium leprae
cuucuaaaccgaccuc

SEQ ID NO: 3227394 - RNA, 16 nt, Mycobacterium leprae
cuucuccguucacagu

SEQ ID NO: 3227395 - RNA, 19 nt, Mycobacterium leprae
cuucucgaccauaaggauu

SEQ ID NO: 3227396 - RNA, 20 nt, Mycobacterium leprae
cuucucggggcgaugaaauc

SEQ ID NO: 3227397 - RNA, 23 nt, Mycobacterium leprae
cuucucggggcgaugaaauccgc

SEQ ID NO: 3227398 - RNA, 14 nt, Mycobacterium leprae
cuucugcacccgcc

SEQ ID NO: 3227399 - RNA, 16 nt, Mycobacterium leprae
cuucugcacccgccag

SEQ ID NO: 3227400 - RNA, 18 nt, Mycobacterium leprae
cuucugcgcgcacccaag

SEQ ID NO: 3227401 - RNA, 14 nt, Mycobacterium leprae
cuucuguauggcuc

SEQ ID NO: 3227402 - RNA, 17 nt, Mycobacterium leprae
cuucuguuauuucuggc

SEQ ID NO: 3227403 - RNA, 22 nt, Mycobacterium leprae
cuucuuuucgagggcagcgcuc

SEQ ID NO: 3227404 - RNA, 15 nt, Mycobacterium leprae
cuugaccaccaccgc

SEQ ID NO: 3227405 - RNA, 22 nt, Mycobacterium leprae
cuugaccaccgaaccgggcagc

SEQ ID NO: 3227406 - RNA, 16 nt, Mycobacterium leprae
cuugaccagugugccu

SEQ ID NO: 3227407 - RNA, 16 nt, Mycobacterium leprae
cuugaccgucaugcug

SEQ ID NO: 3227408 - RNA, 16 nt, Mycobacterium leprae
cuugaccugccguccc

SEQ ID NO: 3227409 - RNA, 23 nt, Mycobacterium leprae
cuugacgggaggaacuccgugac

SEQ ID NO: 3227410 - RNA, 18 nt, Mycobacterium leprae
cuugacggucgagcugga

SEQ ID NO: 3227411 - RNA, 19 nt, Mycobacterium leprae
cuugagcacccgcccaagc

SEQ ID NO: 3227412 - RNA, 15 nt, Mycobacterium leprae
cuugaggucgcacag

SEQ ID NO: 3227413 - RNA, 14 nt, Mycobacterium leprae
cuugaggugucggc

SEQ ID NO: 3227414 - RNA, 16 nt, Mycobacterium leprae
cuugaggugucggcgu

SEQ ID NO: 3227415 - RNA, 20 nt, Mycobacterium leprae
cuugagucuuggacaucacu

SEQ ID NO: 3227416 - RNA, 16 nt, Mycobacterium leprae
cuugagugcugccagg

SEQ ID NO: 3227417 - RNA, 14 nt, Mycobacterium leprae
cuugaguguagcag

SEQ ID NO: 3227418 - RNA, 18 nt, Mycobacterium leprae
cuugauauucaagucaca

SEQ ID NO: 3227419 - RNA, 21 nt, Mycobacterium leprae
cuugauccgagaaaacucgau

SEQ ID NO: 3227420 - RNA, 15 nt, Mycobacterium leprae
cuugaucgaccucga

SEQ ID NO: 3227421 - RNA, 19 nt, Mycobacterium leprae
cuugauugcugcaucugaa

SEQ ID NO: 3227422 - RNA, 19 nt, Mycobacterium leprae
cuugcaaaacgucgaucuc

SEQ ID NO: 3227423 - RNA, 20 nt, Mycobacterium leprae
cuugcaagccacauccgagc

SEQ ID NO: 3227424 - RNA, 16 nt, Mycobacterium leprae
cuugcagcacucauug

SEQ ID NO: 3227425 - RNA, 20 nt, Mycobacterium leprae
cuugccgaacguaccaccgc

SEQ ID NO: 3227426 - RNA, 17 nt, Mycobacterium leprae
cuugccgaagcucuggc

SEQ ID NO: 3227427 - RNA, 19 nt, Mycobacterium leprae
cuugccgcuccgcgcacag

SEQ ID NO: 3227428 - RNA, 21 nt, Mycobacterium leprae
cuugccggccuuaaugcagga

SEQ ID NO: 3227429 - RNA, 13 nt, Mycobacterium leprae
cuugccgucgauu

SEQ ID NO: 3227430 - RNA, 15 nt, Mycobacterium leprae
cuugcggcgccccuc

SEQ ID NO: 3227431 - RNA, 19 nt, Mycobacterium leprae
cuugcuaaccgucggaaac

SEQ ID NO: 3227432 - RNA, 16 nt, Mycobacterium leprae
cuugcugccacauguu

SEQ ID NO: 3227433 - RNA, 18 nt, Mycobacterium leprae
cuugcugucguaacacca

SEQ ID NO: 3227434 - RNA, 19 nt, Mycobacterium leprae
cuuggcacaacaagagaag

SEQ ID NO: 3227435 - RNA, 17 nt, Mycobacterium leprae
cuuggcagugugcaugu

SEQ ID NO: 3227436 - RNA, 16 nt, Mycobacterium leprae
cuuggcgcugagcagu

SEQ ID NO: 3227437 - RNA, 18 nt, Mycobacterium leprae
cuugggcacaaugggugu

SEQ ID NO: 3227438 - RNA, 20 nt, Mycobacterium leprae
cuugggcgccucgucggcca

SEQ ID NO: 3227439 - RNA, 14 nt, Mycobacterium leprae
cuuggggacgccgg

SEQ ID NO: 3227440 - RNA, 19 nt, Mycobacterium leprae
cuuggggacgccggcggcc

SEQ ID NO: 3227441 - RNA, 15 nt, Mycobacterium leprae
cuugggucaccgccu

SEQ ID NO: 3227442 - RNA, 19 nt, Mycobacterium leprae
cuuggucaaggugaaacuc

SEQ ID NO: 3227443 - RNA, 21 nt, Mycobacterium leprae
cuuggucaaggugaaacuccc

SEQ ID NO: 3227444 - RNA, 14 nt, Mycobacterium leprae
cuuggucacgggug

SEQ ID NO: 3227445 - RNA, 18 nt, Mycobacterium leprae
cuuggugcccacgagggg

SEQ ID NO: 3227446 - RNA, 19 nt, Mycobacterium leprae
cuugguuagguugguggug

SEQ ID NO: 3227447 - RNA, 19 nt, Mycobacterium leprae
cuugguuauucuaggcgau

SEQ ID NO: 3227448 - RNA, 16 nt, Mycobacterium leprae
cuuguaguagcagguc

SEQ ID NO: 3227449 - RNA, 17 nt, Mycobacterium leprae
cuugucagguaucucua

SEQ ID NO: 3227450 - RNA, 21 nt, Mycobacterium leprae
cuugucgauguugguguggcg

SEQ ID NO: 3227451 - RNA, 21 nt, Mycobacterium leprae
cuuguuuggucacaccuggug

SEQ ID NO: 3227452 - RNA, 21 nt, Mycobacterium leprae
cuuuacguauagcgaaaauaa

SEQ ID NO: 3227453 - RNA, 21 nt, Mycobacterium leprae
cuuuacgugcguaagguggcc

SEQ ID NO: 3227454 - RNA, 15 nt, Mycobacterium leprae
cuuuagcccgccgcg

SEQ ID NO: 3227455 - RNA, 15 nt, Mycobacterium leprae
cuuuauauacuuugu

SEQ ID NO: 3227456 - RNA, 20 nt, Mycobacterium leprae
cuuucagcucgauggugcca

SEQ ID NO: 3227457 - RNA, 15 nt, Mycobacterium leprae
cuuuccagccacggc

SEQ ID NO: 3227458 - RNA, 16 nt, Mycobacterium leprae
cuuuccagccacggcg

SEQ ID NO: 3227459 - RNA, 18 nt, Mycobacterium leprae
cuuucgacagcuaagccu

SEQ ID NO: 3227460 - RNA, 19 nt, Mycobacterium leprae
cuuucgcagaagaccgugc

SEQ ID NO: 3227461 - RNA, 16 nt, Mycobacterium leprae
cuuucucauuguggcu

SEQ ID NO: 3227462 - RNA, 14 nt, Mycobacterium leprae
cuuucuuguucuug

SEQ ID NO: 3227463 - RNA, 19 nt, Mycobacterium leprae
cuuugaccagacaaauuga

SEQ ID NO: 3227464 - RNA, 20 nt, Mycobacterium leprae
cuuugauccgcuggagcacc

SEQ ID NO: 3227465 - RNA, 18 nt, Mycobacterium leprae
cuuugcaaagcagaauau

SEQ ID NO: 3227466 - RNA, 16 nt, Mycobacterium leprae
cuuugccgaauauggc

SEQ ID NO: 3227467 - RNA, 16 nt, Mycobacterium leprae
cuuugccgcugugaua

SEQ ID NO: 3227468 - RNA, 15 nt, Mycobacterium leprae
cuuugcgguguggga

SEQ ID NO: 3227469 - RNA, 23 nt, Mycobacterium leprae
cuuugcgguugagcucgaggaga

SEQ ID NO: 3227470 - RNA, 15 nt, Mycobacterium leprae
cuuugcguccuccac

SEQ ID NO: 3227471 - RNA, 13 nt, Mycobacterium leprae
cuuugcuggcaag

SEQ ID NO: 3227472 - RNA, 20 nt, Mycobacterium leprae
cuuugcuggucagcgucagu

SEQ ID NO: 3227473 - RNA, 12 nt, Mycobacterium leprae
cuuugcuggugg

SEQ ID NO: 3227474 - RNA, 20 nt, Mycobacterium leprae
cuuugggaucuuuugaccag

SEQ ID NO: 3227475 - RNA, 19 nt, Mycobacterium leprae
cuuugggccaucggcagau

SEQ ID NO: 3227476 - RNA, 12 nt, Mycobacterium leprae
cuuuuagagaaa

SEQ ID NO: 3227477 - RNA, 15 nt, Mycobacterium leprae
cuuuucgacauugcc

SEQ ID NO: 3227478 - RNA, 12 nt, Mycobacterium leprae
cuuuucgccggc

SEQ ID NO: 3227479 - RNA, 15 nt, Mycobacterium leprae
cuuuugaccagcacu

SEQ ID NO: 3227480 - RNA, 20 nt, Mycobacterium leprae
cuuuugaguuuaugcggcuc

SEQ ID NO: 3227481 - RNA, 13 nt, Mycobacterium leprae
cuuuugauuggug

SEQ ID NO: 3227482 - RNA, 20 nt, Mycobacterium leprae
cuuuuguccugacagauacu

SEQ ID NO: 3227483 - RNA, 13 nt, Mycobacterium leprae
cuuuuuagagaag

SEQ ID NO: 3227484 - RNA, 19 nt, Mycobacterium leprae
cuuuuugugaacauaucca

SEQ ID NO: 3227485 - RNA, 17 nt, Mycobacterium leprae
gaaaaacggcuggcugu

SEQ ID NO: 3227486 - RNA, 14 nt, Mycobacterium leprae
gaaaaagaaagcuc

SEQ ID NO: 3227487 - RNA, 18 nt, Mycobacterium leprae
gaaaacacuuacaccaac

SEQ ID NO: 3227488 - RNA, 20 nt, Mycobacterium leprae
gaaaacacuuacaccaacau

SEQ ID NO: 3227489 - RNA, 12 nt, Mycobacterium leprae
gaaaacauucag

SEQ ID NO: 3227490 - RNA, 14 nt, Mycobacterium leprae
gaaaaccaagcugu

SEQ ID NO: 3227491 - RNA, 14 nt, Mycobacterium leprae
gaaaaccacaagca

SEQ ID NO: 3227492 - RNA, 16 nt, Mycobacterium leprae
gaaaaccccacacuga

SEQ ID NO: 3227493 - RNA, 13 nt, Mycobacterium leprae
gaaaaccucacga

SEQ ID NO: 3227494 - RNA, 14 nt, Mycobacterium leprae
gaaaacucgaucga

SEQ ID NO: 3227495 - RNA, 17 nt, Mycobacterium leprae
gaaaacucgaucgaggu

SEQ ID NO: 3227496 - RNA, 20 nt, Mycobacterium leprae
gaaaacuuaauaucuuuuua

SEQ ID NO: 3227497 - RNA, 22 nt, Mycobacterium leprae
gaaaagucguggagcaccucag

SEQ ID NO: 3227498 - RNA, 22 nt, Mycobacterium leprae
gaaaauauccaccauacagcua

SEQ ID NO: 3227499 - RNA, 17 nt, Mycobacterium leprae
gaaaaugaaaacaauau

SEQ ID NO: 3227500 - RNA, 22 nt, Mycobacterium leprae
gaaacagggccgaagcagccgg

SEQ ID NO: 3227501 - RNA, 15 nt, Mycobacterium leprae
gaaacauuguucugc

SEQ ID NO: 3227502 - RNA, 16 nt, Mycobacterium leprae
gaaaccaagccaauua

SEQ ID NO: 3227503 - RNA, 13 nt, Mycobacterium leprae
gaaacccuucaca

SEQ ID NO: 3227504 - RNA, 18 nt, Mycobacterium leprae
gaaacccuucacaagugg

SEQ ID NO: 3227505 - RNA, 14 nt, Mycobacterium leprae
gaaaccggccgcgg

SEQ ID NO: 3227506 - RNA, 17 nt, Mycobacterium leprae
gaaacgcuauggauacu

SEQ ID NO: 3227507 - RNA, 14 nt, Mycobacterium leprae
gaaagaauuuaccg

SEQ ID NO: 3227508 - RNA, 19 nt, Mycobacterium leprae
gaaagacccccggauaccg

SEQ ID NO: 3227509 - RNA, 17 nt, Mycobacterium leprae
gaaagcuucugguccgu

SEQ ID NO: 3227510 - RNA, 13 nt, Mycobacterium leprae
gaaaggguagccg

SEQ ID NO: 3227511 - RNA, 23 nt, Mycobacterium leprae
gaaagucaccugucauucugaca

SEQ ID NO: 3227512 - RNA, 15 nt, Mycobacterium leprae
gaaagucagcaucag

SEQ ID NO: 3227513 - RNA, 16 nt, Mycobacterium leprae
gaaagucagcaucaga

SEQ ID NO: 3227514 - RNA, 16 nt, Mycobacterium leprae
gaaagugccgcggucu

SEQ ID NO: 3227515 - RNA, 15 nt, Mycobacterium leprae
gaaauacaaugcagu

SEQ ID NO: 3227516 - RNA, 22 nt, Mycobacterium leprae
gaaauacccacccaguuaggua

SEQ ID NO: 3227517 - RNA, 17 nt, Mycobacterium leprae
gaaaucguccaggguga

SEQ ID NO: 3227518 - RNA, 17 nt, Mycobacterium leprae
gaaauggcuguuuuugc

SEQ ID NO: 3227519 - RNA, 20 nt, Mycobacterium leprae
gaaauucagcgccaggacuc

SEQ ID NO: 3227520 - RNA, 22 nt, Mycobacterium leprae
gaaauucgcgcuacgauuuugc

SEQ ID NO: 3227521 - RNA, 12 nt, Mycobacterium leprae
gaacaacagaca

SEQ ID NO: 3227522 - RNA, 16 nt, Mycobacterium leprae
gaacaacagagcaagc

SEQ ID NO: 3227523 - RNA, 20 nt, Mycobacterium leprae
gaacaaccgguaaacagugc

SEQ ID NO: 3227524 - RNA, 22 nt, Mycobacterium leprae
gaacacgaucggcuccgcauac

SEQ ID NO: 3227525 - RNA, 21 nt, Mycobacterium leprae
gaacagcauccucggcacagu

SEQ ID NO: 3227526 - RNA, 21 nt, Mycobacterium leprae
gaacagcaucguauagcacac

SEQ ID NO: 3227527 - RNA, 22 nt, Mycobacterium leprae
gaacagcggcguaaccgggaaa

SEQ ID NO: 3227528 - RNA, 14 nt, Mycobacterium leprae
gaacauagccagca

SEQ ID NO: 3227529 - RNA, 13 nt, Mycobacterium leprae
gaacauauccagu

SEQ ID NO: 3227530 - RNA, 22 nt, Mycobacterium leprae
gaacaugacggucgcacgaccu

SEQ ID NO: 3227531 - RNA, 23 nt, Mycobacterium leprae
gaaccaguucuugguaaucaggu

SEQ ID NO: 3227532 - RNA, 23 nt, Mycobacterium leprae
gaacccagacgcgaccgccacca

SEQ ID NO: 3227533 - RNA, 23 nt, Mycobacterium leprae
gaacccauauucgucaaaaaacu

SEQ ID NO: 3227534 - RNA, 15 nt, Mycobacterium leprae
gaaccggacagcacc

SEQ ID NO: 3227535 - RNA, 18 nt, Mycobacterium leprae
gaaccguucgacuucugg

SEQ ID NO: 3227536 - RNA, 15 nt, Mycobacterium leprae
gaaccuacaguggca

SEQ ID NO: 3227537 - RNA, 14 nt, Mycobacterium leprae
gaaccugccaucca

SEQ ID NO: 3227538 - RNA, 16 nt, Mycobacterium leprae
gaaccuggaccgacca

SEQ ID NO: 3227539 - RNA, 21 nt, Mycobacterium leprae
gaaccuggaccgaccagagcu

SEQ ID NO: 3227540 - RNA, 18 nt, Mycobacterium leprae
gaacgaauccucagcguc

SEQ ID NO: 3227541 - RNA, 15 nt, Mycobacterium leprae
gaacgagaagcagcu

SEQ ID NO: 3227542 - RNA, 14 nt, Mycobacterium leprae
gaacgccaggcgcc

SEQ ID NO: 3227543 - RNA, 17 nt, Mycobacterium leprae
gaacgggccucaugacg

SEQ ID NO: 3227544 - RNA, 18 nt, Mycobacterium leprae
gaacguccaucuuguugg

SEQ ID NO: 3227545 - RNA, 18 nt, Mycobacterium leprae
gaacguccgacuacccga

SEQ ID NO: 3227546 - RNA, 17 nt, Mycobacterium leprae
gaacgugagcgacagcu

SEQ ID NO: 3227547 - RNA, 21 nt, Mycobacterium leprae
gaacuaacugccuaucugccc

SEQ ID NO: 3227548 - RNA, 22 nt, Mycobacterium leprae
gaacuagagucccucagcggca

SEQ ID NO: 3227549 - RNA, 12 nt, Mycobacterium leprae
gaacuagccgaa

SEQ ID NO: 3227550 - RNA, 17 nt, Mycobacterium leprae
gaacucgucguccggca

SEQ ID NO: 3227551 - RNA, 21 nt, Mycobacterium leprae
gaacugcacuauaaggcagcu

SEQ ID NO: 3227552 - RNA, 23 nt, Mycobacterium leprae
gaacugcgcaauacggugcacca

SEQ ID NO: 3227553 - RNA, 14 nt, Mycobacterium leprae
gaacugggugacca

SEQ ID NO: 3227554 - RNA, 19 nt, Mycobacterium leprae
gaacugggugaccacccac

SEQ ID NO: 3227555 - RNA, 17 nt, Mycobacterium leprae
gaacuggugagacauuu

SEQ ID NO: 3227556 - RNA, 22 nt, Mycobacterium leprae
gaacuucuggauuucagggcac

SEQ ID NO: 3227557 - RNA, 14 nt, Mycobacterium leprae
gaagaauuaauaua

SEQ ID NO: 3227558 - RNA, 15 nt, Mycobacterium leprae
gaagacauucgacga

SEQ ID NO: 3227559 - RNA, 12 nt, Mycobacterium leprae
gaagaccgugcu

SEQ ID NO: 3227560 - RNA, 13 nt, Mycobacterium leprae
gaagaucucagcc

SEQ ID NO: 3227561 - RNA, 20 nt, Mycobacterium leprae
gaagcaagucccaggacaua

SEQ ID NO: 3227562 - RNA, 16 nt, Mycobacterium leprae
gaagcacuaaaugcca

SEQ ID NO: 3227563 - RNA, 20 nt, Mycobacterium leprae
gaagcagccaaugcugcagc

SEQ ID NO: 3227564 - RNA, 21 nt, Mycobacterium leprae
gaagcagccaaugcugcagcu

SEQ ID NO: 3227565 - RNA, 19 nt, Mycobacterium leprae
gaagccguugggcugcccu

SEQ ID NO: 3227566 - RNA, 14 nt, Mycobacterium leprae
gaagccugagacca

SEQ ID NO: 3227567 - RNA, 22 nt, Mycobacterium leprae
gaagcgcugcagcgauaccagc

SEQ ID NO: 3227568 - RNA, 16 nt, Mycobacterium leprae
gaagcggauaguaugc

SEQ ID NO: 3227569 - RNA, 20 nt, Mycobacterium leprae
gaagcgguugaucuggugga

SEQ ID NO: 3227570 - RNA, 18 nt, Mycobacterium leprae
gaagcguuguaaggucac

SEQ ID NO: 3227571 - RNA, 20 nt, Mycobacterium leprae
gaagcucuggcuaagaucuu

SEQ ID NO: 3227572 - RNA, 16 nt, Mycobacterium leprae
gaagcugaauggucau

SEQ ID NO: 3227573 - RNA, 18 nt, Mycobacterium leprae
gaagcugaccacucgcga

SEQ ID NO: 3227574 - RNA, 13 nt, Mycobacterium leprae
gaaggaagcaaag

SEQ ID NO: 3227575 - RNA, 16 nt, Mycobacterium leprae
gaaggagccgaggcac

SEQ ID NO: 3227576 - RNA, 21 nt, Mycobacterium leprae
gaaggaucgagcggagcuggg

SEQ ID NO: 3227577 - RNA, 14 nt, Mycobacterium leprae
gaaggcauaauaca

SEQ ID NO: 3227578 - RNA, 17 nt, Mycobacterium leprae
gaaggccuagcuggcag

SEQ ID NO: 3227579 - RNA, 22 nt, Mycobacterium leprae
gaaggcgauaucgaugcaggcg

SEQ ID NO: 3227580 - RNA, 12 nt, Mycobacterium leprae
gaagggaaugcg

SEQ ID NO: 3227581 - RNA, 15 nt, Mycobacterium leprae
gaaguaaagcccugu

SEQ ID NO: 3227582 - RNA, 13 nt, Mycobacterium leprae
gaaguaauaaaua

SEQ ID NO: 3227583 - RNA, 14 nt, Mycobacterium leprae
gaaguagagaaaaa

SEQ ID NO: 3227584 - RNA, 14 nt, Mycobacterium leprae
gaaguccuugcugg

SEQ ID NO: 3227585 - RNA, 21 nt, Mycobacterium leprae
gaagugauucgaaggcgguga

SEQ ID NO: 3227586 - RNA, 23 nt, Mycobacterium leprae
gaaguggcuugucacgccggucg

SEQ ID NO: 3227587 - RNA, 14 nt, Mycobacterium leprae
gaaguggugauaca

SEQ ID NO: 3227588 - RNA, 20 nt, Mycobacterium leprae
gaaguguuguuugagaacuc

SEQ ID NO: 3227589 - RNA, 14 nt, Mycobacterium leprae
gaaguuaccgagcc

SEQ ID NO: 3227590 - RNA, 21 nt, Mycobacterium leprae
gaaguucucuucgugcagcac

SEQ ID NO: 3227591 - RNA, 19 nt, Mycobacterium leprae
gaauaacugccaaucagca

SEQ ID NO: 3227592 - RNA, 24 nt, Mycobacterium leprae
gaauaacugccaaucagcacucga

SEQ ID NO: 3227593 - RNA, 16 nt, Mycobacterium leprae
gaauacacuauuuccc

SEQ ID NO: 3227594 - RNA, 19 nt, Mycobacterium leprae
gaauaguuauaccgugcac

SEQ ID NO: 3227595 - RNA, 14 nt, Mycobacterium leprae
gaauaucaucgcca

SEQ ID NO: 3227596 - RNA, 20 nt, Mycobacterium leprae
gaauaucgagcuaaacagca

SEQ ID NO: 3227597 - RNA, 15 nt, Mycobacterium leprae
gaauauuuucaagac

SEQ ID NO: 3227598 - RNA, 15 nt, Mycobacterium leprae
gaaucaccgcugggu

SEQ ID NO: 3227599 - RNA, 15 nt, Mycobacterium leprae
gaaucagaugaccgg

SEQ ID NO: 3227600 - RNA, 16 nt, Mycobacterium leprae
gaaucagaugaccggc

SEQ ID NO: 3227601 - RNA, 15 nt, Mycobacterium leprae
gaaucagcaucgaca

SEQ ID NO: 3227602 - RNA, 16 nt, Mycobacterium leprae
gaaucaugaagaucga

SEQ ID NO: 3227603 - RNA, 17 nt, Mycobacterium leprae
gaaucaugccgcagcau

SEQ ID NO: 3227604 - RNA, 17 nt, Mycobacterium leprae
gaauccacuugagcggc

SEQ ID NO: 3227605 - RNA, 18 nt, Mycobacterium leprae
gaaucccagcagcugggu

SEQ ID NO: 3227606 - RNA, 20 nt, Mycobacterium leprae
gaaucccgcgacggccggcg

SEQ ID NO: 3227607 - RNA, 18 nt, Mycobacterium leprae
gaauccgcgcagggccug

SEQ ID NO: 3227608 - RNA, 15 nt, Mycobacterium leprae
gaauccuacauccac

SEQ ID NO: 3227609 - RNA, 22 nt, Mycobacterium leprae
gaauccuguugacguguuuugc

SEQ ID NO: 3227610 - RNA, 18 nt, Mycobacterium leprae
gaaucgguacauuugcgg

SEQ ID NO: 3227611 - RNA, 12 nt, Mycobacterium leprae
gaaucugugccu

SEQ ID NO: 3227612 - RNA, 22 nt, Mycobacterium leprae
gaaucuuugaucugcugcaggu

SEQ ID NO: 3227613 - RNA, 16 nt, Mycobacterium leprae
gaaugcgaugcuggcc

SEQ ID NO: 3227614 - RNA, 15 nt, Mycobacterium leprae
gaauggcggcagcgc

SEQ ID NO: 3227615 - RNA, 17 nt, Mycobacterium leprae
gaauggcggcagcgcca

SEQ ID NO: 3227616 - RNA, 23 nt, Mycobacterium leprae
gaaugucucggugucggacuugu

SEQ ID NO: 3227617 - RNA, 18 nt, Mycobacterium leprae
gaaugucugggcuggccc

SEQ ID NO: 3227618 - RNA, 11 nt, Mycobacterium leprae
gaauuaauaua

SEQ ID NO: 3227619 - RNA, 20 nt, Mycobacterium leprae
gaauuaggcggauggggcau

SEQ ID NO: 3227620 - RNA, 22 nt, Mycobacterium leprae
gaauucagagcugcaggucagg

SEQ ID NO: 3227621 - RNA, 19 nt, Mycobacterium leprae
gaauucaguucaauggugc

SEQ ID NO: 3227622 - RNA, 11 nt, Mycobacterium leprae
gaauucaucga

SEQ ID NO: 3227623 - RNA, 18 nt, Mycobacterium leprae
gaauugcacggucucuuu

SEQ ID NO: 3227624 - RNA, 14 nt, Mycobacterium leprae
gaauugcuaccugg

SEQ ID NO: 3227625 - RNA, 16 nt, Mycobacterium leprae
gaauugguggucgcgg

SEQ ID NO: 3227626 - RNA, 17 nt, Mycobacterium leprae
gaauugucuucuacuga

SEQ ID NO: 3227627 - RNA, 15 nt, Mycobacterium leprae
gaauuuaccggcguu

SEQ ID NO: 3227628 - RNA, 15 nt, Mycobacterium leprae
gacaaaccaggcgac

SEQ ID NO: 3227629 - RNA, 12 nt, Mycobacterium leprae
gacaaagcucag

SEQ ID NO: 3227630 - RNA, 23 nt, Mycobacterium leprae
gacaaagcucaggccguggacga

SEQ ID NO: 3227631 - RNA, 18 nt, Mycobacterium leprae
gacaaagucagcuugucg

SEQ ID NO: 3227632 - RNA, 21 nt, Mycobacterium leprae
gacaacacgaucgcagcccag

SEQ ID NO: 3227633 - RNA, 21 nt, Mycobacterium leprae
gacaaccucguuacgauccau

SEQ ID NO: 3227634 - RNA, 15 nt, Mycobacterium leprae
gacaaccugggcggc

SEQ ID NO: 3227635 - RNA, 17 nt, Mycobacterium leprae
gacaacggcggcaaggu

SEQ ID NO: 3227636 - RNA, 19 nt, Mycobacterium leprae
gacaagcagugucugggcc

SEQ ID NO: 3227637 - RNA, 13 nt, Mycobacterium leprae
gacaagcccccgc

SEQ ID NO: 3227638 - RNA, 19 nt, Mycobacterium leprae
gacaaggguuagcagaaac

SEQ ID NO: 3227639 - RNA, 16 nt, Mycobacterium leprae
gacaagucaaaaccag

SEQ ID NO: 3227640 - RNA, 15 nt, Mycobacterium leprae
gacaauucaacgaau

SEQ ID NO: 3227641 - RNA, 23 nt, Mycobacterium leprae
gacacaaagcuggcgaacaacaa

SEQ ID NO: 3227642 - RNA, 22 nt, Mycobacterium leprae
gacacagaucgagcgauugugc

SEQ ID NO: 3227643 - RNA, 18 nt, Mycobacterium leprae
gacacccggguggcguca

SEQ ID NO: 3227644 - RNA, 17 nt, Mycobacterium leprae
gacaccgaacagcucga

SEQ ID NO: 3227645 - RNA, 21 nt, Mycobacterium leprae
gacaccgaacagcucgacagc

SEQ ID NO: 3227646 - RNA, 14 nt, Mycobacterium leprae
gacaccgagcagcc

SEQ ID NO: 3227647 - RNA, 19 nt, Mycobacterium leprae
gacaccguccucggcggca

SEQ ID NO: 3227648 - RNA, 22 nt, Mycobacterium leprae
gacaccgucuuuauucuuuuag

SEQ ID NO: 3227649 - RNA, 21 nt, Mycobacterium leprae
gacaccucaaggccaugacau

SEQ ID NO: 3227650 - RNA, 17 nt, Mycobacterium leprae
gacacgagcggccucag

SEQ ID NO: 3227651 - RNA, 19 nt, Mycobacterium leprae
gacacgagcggccucagca

SEQ ID NO: 3227652 - RNA, 20 nt, Mycobacterium leprae
gacacgauuagcgcggcgca

SEQ ID NO: 3227653 - RNA, 16 nt, Mycobacterium leprae
gacacguucucgcugg

SEQ ID NO: 3227654 - RNA, 20 nt, Mycobacterium leprae
gacacuacuguugucagugg

SEQ ID NO: 3227655 - RNA, 16 nt, Mycobacterium leprae
gacagacgagcucuca

SEQ ID NO: 3227656 - RNA, 17 nt, Mycobacterium leprae
gacagaugcgaucgcag

SEQ ID NO: 3227657 - RNA, 18 nt, Mycobacterium leprae
gacagaugcgaucgcagu

SEQ ID NO: 3227658 - RNA, 22 nt, Mycobacterium leprae
gacagcaacggcuacggggugg

SEQ ID NO: 3227659 - RNA, 21 nt, Mycobacterium leprae
gacagcaagacgggggaugcu

SEQ ID NO: 3227660 - RNA, 13 nt, Mycobacterium leprae
gacagcacccagc

SEQ ID NO: 3227661 - RNA, 14 nt, Mycobacterium leprae
gacagcacccagcu

SEQ ID NO: 3227662 - RNA, 14 nt, Mycobacterium leprae
gacagcgaugacau

SEQ ID NO: 3227663 - RNA, 16 nt, Mycobacterium leprae
gacagcggcccaaccc

SEQ ID NO: 3227664 - RNA, 20 nt, Mycobacterium leprae
gacaggaucggugauaucga

SEQ ID NO: 3227665 - RNA, 21 nt, Mycobacterium leprae
gacaguggggggcauggcacu

SEQ ID NO: 3227666 - RNA, 18 nt, Mycobacterium leprae
gacagugucccuguccuu

SEQ ID NO: 3227667 - RNA, 13 nt, Mycobacterium leprae
gacauagaacauc

SEQ ID NO: 3227668 - RNA, 18 nt, Mycobacterium leprae
gacaucacuggguggcac

SEQ ID NO: 3227669 - RNA, 17 nt, Mycobacterium leprae
gacaucacuugcugacc

SEQ ID NO: 3227670 - RNA, 15 nt, Mycobacterium leprae
gacaucgccaccgac

SEQ ID NO: 3227671 - RNA, 22 nt, Mycobacterium leprae
gacaucggaaucgccgcgacga

SEQ ID NO: 3227672 - RNA, 17 nt, Mycobacterium leprae
gacaucgguaucggcau

SEQ ID NO: 3227673 - RNA, 23 nt, Mycobacterium leprae
gacaugauugcagauguugcagc

SEQ ID NO: 3227674 - RNA, 20 nt, Mycobacterium leprae
gacaugccgagguggcagcu

SEQ ID NO: 3227675 - RNA, 22 nt, Mycobacterium leprae
gacaugccgagguggcagcugg

SEQ ID NO: 3227676 - RNA, 22 nt, Mycobacterium leprae
gacaugcuuacgugcgccgcgc

SEQ ID NO: 3227677 - RNA, 16 nt, Mycobacterium leprae
gacauggaagccgccg

SEQ ID NO: 3227678 - RNA, 15 nt, Mycobacterium leprae
gacauguucacagga

SEQ ID NO: 3227679 - RNA, 14 nt, Mycobacterium leprae
gacauucgacgagu

SEQ ID NO: 3227680 - RNA, 20 nt, Mycobacterium leprae
gacauuguccgucgcagcag

SEQ ID NO: 3227681 - RNA, 12 nt, Mycobacterium leprae
gacauuucgaca

SEQ ID NO: 3227682 - RNA, 16 nt, Mycobacterium leprae
gacauuucgccaacuc

SEQ ID NO: 3227683 - RNA, 23 nt, Mycobacterium leprae
gaccaaaauuuaugguagucagu

SEQ ID NO: 3227684 - RNA, 16 nt, Mycobacterium leprae
gaccaaccuaaaauuu

SEQ ID NO: 3227685 - RNA, 14 nt, Mycobacterium leprae
gaccaacgccgagc

SEQ ID NO: 3227686 - RNA, 15 nt, Mycobacterium leprae
gaccaccaccgccac

SEQ ID NO: 3227687 - RNA, 17 nt, Mycobacterium leprae
gaccaccgaaccgggca

SEQ ID NO: 3227688 - RNA, 21 nt, Mycobacterium leprae
gaccacgucgggcagcaaccg

SEQ ID NO: 3227689 - RNA, 23 nt, Mycobacterium leprae
gaccacgucgggcagcaaccgca

SEQ ID NO: 3227690 - RNA, 18 nt, Mycobacterium leprae
gaccagagguucuaggua

SEQ ID NO: 3227691 - RNA, 17 nt, Mycobacterium leprae
gaccagccaagccgcca

SEQ ID NO: 3227692 - RNA, 14 nt, Mycobacterium leprae
gaccagccgcagca

SEQ ID NO: 3227693 - RNA, 14 nt, Mycobacterium leprae
gaccagcgagcaac

SEQ ID NO: 3227694 - RNA, 17 nt, Mycobacterium leprae
gaccagcuccgaagcac

SEQ ID NO: 3227695 - RNA, 14 nt, Mycobacterium leprae
gaccagggaaguga

SEQ ID NO: 3227696 - RNA, 20 nt, Mycobacterium leprae
gaccagggaagugacgccac

SEQ ID NO: 3227697 - RNA, 22 nt, Mycobacterium leprae
gaccaggugaugauggcaucca

SEQ ID NO: 3227698 - RNA, 21 nt, Mycobacterium leprae
gaccauaacacuacuugcgcu

SEQ ID NO: 3227699 - RNA, 20 nt, Mycobacterium leprae
gaccauaaugcagcggcagu

SEQ ID NO: 3227700 - RNA, 20 nt, Mycobacterium leprae
gaccauaguuacgacgucgc

SEQ ID NO: 3227701 - RNA, 20 nt, Mycobacterium leprae
gaccaucgucagucggccuu

SEQ ID NO: 3227702 - RNA, 17 nt, Mycobacterium leprae
gaccaugaccagggaag

SEQ ID NO: 3227703 - RNA, 14 nt, Mycobacterium leprae
gaccaugugaccgc

SEQ ID NO: 3227704 - RNA, 18 nt, Mycobacterium leprae
gacccaagcaucccccgu

SEQ ID NO: 3227705 - RNA, 14 nt, Mycobacterium leprae
gacccacagcugcg

SEQ ID NO: 3227706 - RNA, 17 nt, Mycobacterium leprae
gacccagccgugguggu

SEQ ID NO: 3227707 - RNA, 19 nt, Mycobacterium leprae
gacccagcgauaucaagcu

SEQ ID NO: 3227708 - RNA, 23 nt, Mycobacterium leprae
gaccccaaccagacccacagcug

SEQ ID NO: 3227709 - RNA, 13 nt, Mycobacterium leprae
gacccccgucgug

SEQ ID NO: 3227710 - RNA, 19 nt, Mycobacterium leprae
gacccgacgcgcacuagca

SEQ ID NO: 3227711 - RNA, 13 nt, Mycobacterium leprae
gacccgguggugu

SEQ ID NO: 3227712 - RNA, 17 nt, Mycobacterium leprae
gaccgaaagccgcacca

SEQ ID NO: 3227713 - RNA, 18 nt, Mycobacterium leprae
gaccgaacuguggaucgu

SEQ ID NO: 3227714 - RNA, 21 nt, Mycobacterium leprae
gaccgaacuguggaucguuga

SEQ ID NO: 3227715 - RNA, 17 nt, Mycobacterium leprae
gaccgacggcgccgcac

SEQ ID NO: 3227716 - RNA, 16 nt, Mycobacterium leprae
gaccgagcgcgacaau

SEQ ID NO: 3227717 - RNA, 18 nt, Mycobacterium leprae
gaccgagcgcgacaaucu

SEQ ID NO: 3227718 - RNA, 21 nt, Mycobacterium leprae
gaccgaguugggccaugcagu

SEQ ID NO: 3227719 - RNA, 22 nt, Mycobacterium leprae
gaccgaguugggccaugcaguc

SEQ ID NO: 3227720 - RNA, 12 nt, Mycobacterium leprae
gaccgcagcacg

SEQ ID NO: 3227721 - RNA, 19 nt, Mycobacterium leprae
gaccgcaucaccgaucacg

SEQ ID NO: 3227722 - RNA, 17 nt, Mycobacterium leprae
gaccgccagacgaucca

SEQ ID NO: 3227723 - RNA, 20 nt, Mycobacterium leprae
gaccgccccgcuguaucguc

SEQ ID NO: 3227724 - RNA, 17 nt, Mycobacterium leprae
gaccgcccgguagcacc

SEQ ID NO: 3227725 - RNA, 20 nt, Mycobacterium leprae
gaccgcccuggaccgcagca

SEQ ID NO: 3227726 - RNA, 21 nt, Mycobacterium leprae
gaccgccgguuucgccccaac

SEQ ID NO: 3227727 - RNA, 14 nt, Mycobacterium leprae
gaccgcggauucca

SEQ ID NO: 3227728 - RNA, 16 nt, Mycobacterium leprae
gaccgcggucggcauc

SEQ ID NO: 3227729 - RNA, 15 nt, Mycobacterium leprae
gaccgcggugcagug

SEQ ID NO: 3227730 - RNA, 13 nt, Mycobacterium leprae
gaccgcuaugcgg

SEQ ID NO: 3227731 - RNA, 15 nt, Mycobacterium leprae
gaccggccagugcaa

SEQ ID NO: 3227732 - RNA, 24 nt, Mycobacterium leprae
gaccggcccucagccagcaagcag

SEQ ID NO: 3227733 - RNA, 14 nt, Mycobacterium leprae
gaccgggccggccg

SEQ ID NO: 3227734 - RNA, 18 nt, Mycobacterium leprae
gaccgucgcgcgugccac

SEQ ID NO: 3227735 - RNA, 20 nt, Mycobacterium leprae
gaccgucgcgcgugccacca

SEQ ID NO: 3227736 - RNA, 14 nt, Mycobacterium leprae
gaccgucuggaaca

SEQ ID NO: 3227737 - RNA, 23 nt, Mycobacterium leprae
gaccgugcuauccgcugauaauu

SEQ ID NO: 3227738 - RNA, 16 nt, Mycobacterium leprae
gaccguugcgucgcug

SEQ ID NO: 3227739 - RNA, 23 nt, Mycobacterium leprae
gaccuccacguuguccgcgugga

SEQ ID NO: 3227740 - RNA, 17 nt, Mycobacterium leprae
gaccuccgcagcaucgg

SEQ ID NO: 3227741 - RNA, 12 nt, Mycobacterium leprae
gaccuccucggg

SEQ ID NO: 3227742 - RNA, 17 nt, Mycobacterium leprae
gaccucgaacuuguucu

SEQ ID NO: 3227743 - RNA, 14 nt, Mycobacterium leprae
gaccugacccgacg

SEQ ID NO: 3227744 - RNA, 22 nt, Mycobacterium leprae
gaccugaccguugcgucgcugu

SEQ ID NO: 3227745 - RNA, 22 nt, Mycobacterium leprae
gaccugccgucccucggccauc

SEQ ID NO: 3227746 - RNA, 20 nt, Mycobacterium leprae
gaccugggcgauuucuucau

SEQ ID NO: 3227747 - RNA, 21 nt, Mycobacterium leprae
gaccuucggagucuugaugcc

SEQ ID NO: 3227748 - RNA, 13 nt, Mycobacterium leprae
gaccuugaaagcg

SEQ ID NO: 3227749 - RNA, 16 nt, Mycobacterium leprae
gacgaacaugcaguac

SEQ ID NO: 3227750 - RNA, 19 nt, Mycobacterium leprae
gacgaacccgucgaugauc

SEQ ID NO: 3227751 - RNA, 19 nt, Mycobacterium leprae
gacgaccuccgcagcaucg

SEQ ID NO: 3227752 - RNA, 21 nt, Mycobacterium leprae
gacgaugccauagacuucugg

SEQ ID NO: 3227753 - RNA, 17 nt, Mycobacterium leprae
gacgcaacugcuggagg

SEQ ID NO: 3227754 - RNA, 19 nt, Mycobacterium leprae
gacgcaaucuacuggaugc

SEQ ID NO: 3227755 - RNA, 22 nt, Mycobacterium leprae
gacgccgacuaauuguggcuuc

SEQ ID NO: 3227756 - RNA, 15 nt, Mycobacterium leprae
gacgccgcggcugcc

SEQ ID NO: 3227757 - RNA, 14 nt, Mycobacterium leprae
gacgccggccgucg

SEQ ID NO: 3227758 - RNA, 17 nt, Mycobacterium leprae
gacgccggccgucgcgg

SEQ ID NO: 3227759 - RNA, 18 nt, Mycobacterium leprae
gacgccuagagagugcgg

SEQ ID NO: 3227760 - RNA, 13 nt, Mycobacterium leprae
gacgcgaccgcca

SEQ ID NO: 3227761 - RNA, 15 nt, Mycobacterium leprae
gacgcgaccgccacc

SEQ ID NO: 3227762 - RNA, 16 nt, Mycobacterium leprae
gacgcgacgccggccg

SEQ ID NO: 3227763 - RNA, 18 nt, Mycobacterium leprae
gacgcggaaagcuucugg

SEQ ID NO: 3227764 - RNA, 20 nt, Mycobacterium leprae
gacgcucggugagauagcgg

SEQ ID NO: 3227765 - RNA, 13 nt, Mycobacterium leprae
gacgcugcgcuga

SEQ ID NO: 3227766 - RNA, 14 nt, Mycobacterium leprae
gacgcugcgcugag

SEQ ID NO: 3227767 - RNA, 22 nt, Mycobacterium leprae
gacgcugcuugcucuggguggu

SEQ ID NO: 3227768 - RNA, 18 nt, Mycobacterium leprae
gacgcuuucgagcaguag

SEQ ID NO: 3227769 - RNA, 20 nt, Mycobacterium leprae
gacggacacuguccacucgg

SEQ ID NO: 3227770 - RNA, 16 nt, Mycobacterium leprae
gacggagcgcaggaac

SEQ ID NO: 3227771 - RNA, 14 nt, Mycobacterium leprae
gacggauaagucca

SEQ ID NO: 3227772 - RNA, 20 nt, Mycobacterium leprae
gacggauucaaaggucgaca

SEQ ID NO: 3227773 - RNA, 23 nt, Mycobacterium leprae
gacggauuucucgugguggcugg

SEQ ID NO: 3227774 - RNA, 23 nt, Mycobacterium leprae
gacggccaaucuuugaccagaca

SEQ ID NO: 3227775 - RNA, 14 nt, Mycobacterium leprae
gacggcccagcacc

SEQ ID NO: 3227776 - RNA, 15 nt, Mycobacterium leprae
gacggcccagcacca

SEQ ID NO: 3227777 - RNA, 17 nt, Mycobacterium leprae
gacggccggaucaucga

SEQ ID NO: 3227778 - RNA, 16 nt, Mycobacterium leprae
gacggcggcagcugga

SEQ ID NO: 3227779 - RNA, 20 nt, Mycobacterium leprae
gacggcuaggguuggauggu

SEQ ID NO: 3227780 - RNA, 15 nt, Mycobacterium leprae
gacgggaaguggugg

SEQ ID NO: 3227781 - RNA, 17 nt, Mycobacterium leprae
gacgggcaguaucuacc

SEQ ID NO: 3227782 - RNA, 16 nt, Mycobacterium leprae
gacgguaacugaccaa

SEQ ID NO: 3227783 - RNA, 14 nt, Mycobacterium leprae
gacggugcggcugg

SEQ ID NO: 3227784 - RNA, 19 nt, Mycobacterium leprae
gacggugcugauggccggc

SEQ ID NO: 3227785 - RNA, 15 nt, Mycobacterium leprae
gacgguguauaauuu

SEQ ID NO: 3227786 - RNA, 19 nt, Mycobacterium leprae
gacgguuucacaacccggc

SEQ ID NO: 3227787 - RNA, 18 nt, Mycobacterium leprae
gacgguuucgggaaagcu

SEQ ID NO: 3227788 - RNA, 21 nt, Mycobacterium leprae
gacgucacgcugcucgagcag

SEQ ID NO: 3227789 - RNA, 14 nt, Mycobacterium leprae
gacgucgcuuguga

SEQ ID NO: 3227790 - RNA, 13 nt, Mycobacterium leprae
gacgugaucgacg

SEQ ID NO: 3227791 - RNA, 13 nt, Mycobacterium leprae
gacgugcuacugc

SEQ ID NO: 3227792 - RNA, 22 nt, Mycobacterium leprae
gacguguucacgcagucaucca

SEQ ID NO: 3227793 - RNA, 18 nt, Mycobacterium leprae
gacguguuuugcuguguu

SEQ ID NO: 3227794 - RNA, 21 nt, Mycobacterium leprae
gacguguuuugcuguguugcg

SEQ ID NO: 3227795 - RNA, 16 nt, Mycobacterium leprae
gacguuccggccuucg

SEQ ID NO: 3227796 - RNA, 20 nt, Mycobacterium leprae
gacguugggagcaucuucag

SEQ ID NO: 3227797 - RNA, 19 nt, Mycobacterium leprae
gacguugugacaguucagc

SEQ ID NO: 3227798 - RNA, 14 nt, Mycobacterium leprae
gacguuuuguugcu

SEQ ID NO: 3227799 - RNA, 22 nt, Mycobacterium leprae
gacuaccggagguucucggcgu

SEQ ID NO: 3227800 - RNA, 20 nt, Mycobacterium leprae
gacuaugauuucaucugcca

SEQ ID NO: 3227801 - RNA, 12 nt, Mycobacterium leprae
gacuauggcucu

SEQ ID NO: 3227802 - RNA, 14 nt, Mycobacterium leprae
gacucaaacgucga

SEQ ID NO: 3227803 - RNA, 15 nt, Mycobacterium leprae
gacucaacauaacac

SEQ ID NO: 3227804 - RNA, 18 nt, Mycobacterium leprae
gacucagcaaugcucugc

SEQ ID NO: 3227805 - RNA, 15 nt, Mycobacterium leprae
gacucaguggcgggc

SEQ ID NO: 3227806 - RNA, 18 nt, Mycobacterium leprae
gacuccuuuagcuugguu

SEQ ID NO: 3227807 - RNA, 19 nt, Mycobacterium leprae
gacucggcgugccacuuca

SEQ ID NO: 3227808 - RNA, 13 nt, Mycobacterium leprae
gacucggucugcu

SEQ ID NO: 3227809 - RNA, 13 nt, Mycobacterium leprae
gacucgucagccu

SEQ ID NO: 3227810 - RNA, 17 nt, Mycobacterium leprae
gacucuccccacugcag

SEQ ID NO: 3227811 - RNA, 14 nt, Mycobacterium leprae
gacugaaaacagcg

SEQ ID NO: 3227812 - RNA, 15 nt, Mycobacterium leprae
gacugaaaucauugc

SEQ ID NO: 3227813 - RNA, 17 nt, Mycobacterium leprae
gacugaaaucauugcuc

SEQ ID NO: 3227814 - RNA, 21 nt, Mycobacterium leprae
gacugaaugcgaugcuggccg

SEQ ID NO: 3227815 - RNA, 20 nt, Mycobacterium leprae
gacugccugcuuucgaugag

SEQ ID NO: 3227816 - RNA, 14 nt, Mycobacterium leprae
gacugcgaaaaauc

SEQ ID NO: 3227817 - RNA, 15 nt, Mycobacterium leprae
gacugcuagccggcu

SEQ ID NO: 3227818 - RNA, 13 nt, Mycobacterium leprae
gacuggcuguagu

SEQ ID NO: 3227819 - RNA, 22 nt, Mycobacterium leprae
gacuggggaguggcaucgucug

SEQ ID NO: 3227820 - RNA, 21 nt, Mycobacterium leprae
gacuggguggcccgaggagag

SEQ ID NO: 3227821 - RNA, 14 nt, Mycobacterium leprae
gacuguagagacgu

SEQ ID NO: 3227822 - RNA, 21 nt, Mycobacterium leprae
gacuguagagacguaccacuc

SEQ ID NO: 3227823 - RNA, 17 nt, Mycobacterium leprae
gacugugcuaaccgggc

SEQ ID NO: 3227824 - RNA, 15 nt, Mycobacterium leprae
gacuguguacgaagc

SEQ ID NO: 3227825 - RNA, 15 nt, Mycobacterium leprae
gacuucugguugaca

SEQ ID NO: 3227826 - RNA, 15 nt, Mycobacterium leprae
gacuucuucugccug

SEQ ID NO: 3227827 - RNA, 13 nt, Mycobacterium leprae
gacuugaccagcc

SEQ ID NO: 3227828 - RNA, 22 nt, Mycobacterium leprae
gacuugcaucaggaaggagccg

SEQ ID NO: 3227829 - RNA, 19 nt, Mycobacterium leprae
gacuuguacuuugugugca

SEQ ID NO: 3227830 - RNA, 15 nt, Mycobacterium leprae
gacuuguugucgcgu

SEQ ID NO: 3227831 - RNA, 20 nt, Mycobacterium leprae
gagaacucaauaguguguuu

SEQ ID NO: 3227832 - RNA, 18 nt, Mycobacterium leprae
gagaaguagagaaaaaug

SEQ ID NO: 3227833 - RNA, 16 nt, Mycobacterium leprae
gagaauaaugguggug

SEQ ID NO: 3227834 - RNA, 15 nt, Mycobacterium leprae
gagaaucaggccgcc

SEQ ID NO: 3227835 - RNA, 13 nt, Mycobacterium leprae
gagaaucgguguu

SEQ ID NO: 3227836 - RNA, 21 nt, Mycobacterium leprae
gagaauguuguuagugcugcu

SEQ ID NO: 3227837 - RNA, 12 nt, Mycobacterium leprae
gagacaucgcca

SEQ ID NO: 3227838 - RNA, 17 nt, Mycobacterium leprae
gagacaucgccaccgac

SEQ ID NO: 3227839 - RNA, 11 nt, Mycobacterium leprae
gagacccccgu

SEQ ID NO: 3227840 - RNA, 13 nt, Mycobacterium leprae
gagacgaucgcaa

SEQ ID NO: 3227841 - RNA, 13 nt, Mycobacterium leprae
gagacgucgaugu

SEQ ID NO: 3227842 - RNA, 16 nt, Mycobacterium leprae
gagacuccacgugcgu

SEQ ID NO: 3227843 - RNA, 16 nt, Mycobacterium leprae
gagacucgugagcuua

SEQ ID NO: 3227844 - RNA, 23 nt, Mycobacterium leprae
gagagcaauccucagagugugug

SEQ ID NO: 3227845 - RNA, 13 nt, Mycobacterium leprae
gagagcauggacc

SEQ ID NO: 3227846 - RNA, 17 nt, Mycobacterium leprae
gagagucgggcuuggcc

SEQ ID NO: 3227847 - RNA, 19 nt, Mycobacterium leprae
gagagugcagagaguuguu

SEQ ID NO: 3227848 - RNA, 19 nt, Mycobacterium leprae
gagaguuagaugucgcagc

SEQ ID NO: 3227849 - RNA, 13 nt, Mycobacterium leprae
gagauacucugaa

SEQ ID NO: 3227850 - RNA, 21 nt, Mycobacterium leprae
gagaucaacguuuugccgagc

SEQ ID NO: 3227851 - RNA, 21 nt, Mycobacterium leprae
gagaucacaguccugcccgga

SEQ ID NO: 3227852 - RNA, 20 nt, Mycobacterium leprae
gagaucaccagcaagggugg

SEQ ID NO: 3227853 - RNA, 14 nt, Mycobacterium leprae
gagauccgagauca

SEQ ID NO: 3227854 - RNA, 13 nt, Mycobacterium leprae
gagaucgggcaug

SEQ ID NO: 3227855 - RNA, 18 nt, Mycobacterium leprae
gagaucguccucaugccc

SEQ ID NO: 3227856 - RNA, 18 nt, Mycobacterium leprae
gagaucuuaaucgagcca

SEQ ID NO: 3227857 - RNA, 19 nt, Mycobacterium leprae
gagaugccagccaacggcu

SEQ ID NO: 3227858 - RNA, 20 nt, Mycobacterium leprae
gagauugacgucgguguggu

SEQ ID NO: 3227859 - RNA, 14 nt, Mycobacterium leprae
gagauuucagccgg

SEQ ID NO: 3227860 - RNA, 21 nt, Mycobacterium leprae
gagcaaccaacuucacuggcu

SEQ ID NO: 3227861 - RNA, 11 nt, Mycobacterium leprae
gagcaagccgc

SEQ ID NO: 3227862 - RNA, 17 nt, Mycobacterium leprae
gagcaagcgcuaugcca

SEQ ID NO: 3227863 - RNA, 19 nt, Mycobacterium leprae
gagcaccacacggucgugu

SEQ ID NO: 3227864 - RNA, 16 nt, Mycobacterium leprae
gagcacggcacaaucg

SEQ ID NO: 3227865 - RNA, 17 nt, Mycobacterium leprae
gagcacggcucguccau

SEQ ID NO: 3227866 - RNA, 17 nt, Mycobacterium leprae
gagcacuagcuugugcu

SEQ ID NO: 3227867 - RNA, 18 nt, Mycobacterium leprae
gagcacuccuucaugcug

SEQ ID NO: 3227868 - RNA, 20 nt, Mycobacterium leprae
gagcacuucgguaacgcuga

SEQ ID NO: 3227869 - RNA, 16 nt, Mycobacterium leprae
gagcagauggaaggcg

SEQ ID NO: 3227870 - RNA, 20 nt, Mycobacterium leprae
gagcagauggugcacuugca

SEQ ID NO: 3227871 - RNA, 23 nt, Mycobacterium leprae
gagcagcuccagcucgcgguggg

SEQ ID NO: 3227872 - RNA, 23 nt, Mycobacterium leprae
gagcagucccuuagucugcgugu

SEQ ID NO: 3227873 - RNA, 14 nt, Mycobacterium leprae
gagcagugcugaca

SEQ ID NO: 3227874 - RNA, 21 nt, Mycobacterium leprae
gagcagugcugacaucaucgc

SEQ ID NO: 3227875 - RNA, 21 nt, Mycobacterium leprae
gagcaugaccgagcuggcgcc

SEQ ID NO: 3227876 - RNA, 12 nt, Mycobacterium leprae
gagcccagugug

SEQ ID NO: 3227877 - RNA, 19 nt, Mycobacterium leprae
gagccuguuguugugccuu

SEQ ID NO: 3227878 - RNA, 15 nt, Mycobacterium leprae
gagcgaagucgacgc

SEQ ID NO: 3227879 - RNA, 16 nt, Mycobacterium leprae
gagcgacagcucagcg

SEQ ID NO: 3227880 - RNA, 20 nt, Mycobacterium leprae
gagcgacaucgauacacuuu

SEQ ID NO: 3227881 - RNA, 15 nt, Mycobacterium leprae
gagcgauugugcgga

SEQ ID NO: 3227882 - RNA, 22 nt, Mycobacterium leprae
gagcgcccaagugaugucuuug

SEQ ID NO: 3227883 - RNA, 17 nt, Mycobacterium leprae
gagcgcggagcugguga

SEQ ID NO: 3227884 - RNA, 22 nt, Mycobacterium leprae
gagcgcguuaggcaugcgcuga

SEQ ID NO: 3227885 - RNA, 13 nt, Mycobacterium leprae
gagcgcucggcgu

SEQ ID NO: 3227886 - RNA, 18 nt, Mycobacterium leprae
gagcggccucagcagcag

SEQ ID NO: 3227887 - RNA, 20 nt, Mycobacterium leprae
gagcggugccgcacguugac

SEQ ID NO: 3227888 - RNA, 21 nt, Mycobacterium leprae
gagcgucgugaccgcggggcu

SEQ ID NO: 3227889 - RNA, 17 nt, Mycobacterium leprae
gagcguuuagucaccgc

SEQ ID NO: 3227890 - RNA, 12 nt, Mycobacterium leprae
gagcuacuuuuc

SEQ ID NO: 3227891 - RNA, 17 nt, Mycobacterium leprae
gagcucaaacgaccgga

SEQ ID NO: 3227892 - RNA, 17 nt, Mycobacterium leprae
gagcucaccggcggcga

SEQ ID NO: 3227893 - RNA, 20 nt, Mycobacterium leprae
gagcuccauugcguuugaug

SEQ ID NO: 3227894 - RNA, 17 nt, Mycobacterium leprae
gagcucgaagucaacga

SEQ ID NO: 3227895 - RNA, 23 nt, Mycobacterium leprae
gagcugacuaugauuucaucugc

SEQ ID NO: 3227896 - RNA, 18 nt, Mycobacterium leprae
gagcugauggccgccagg

SEQ ID NO: 3227897 - RNA, 22 nt, Mycobacterium leprae
gagcugcccgugcucagugaag

SEQ ID NO: 3227898 - RNA, 23 nt, Mycobacterium leprae
gagcugcugggccacagcaucuc

SEQ ID NO: 3227899 - RNA, 14 nt, Mycobacterium leprae
gagcuggccggggc

SEQ ID NO: 3227900 - RNA, 15 nt, Mycobacterium leprae
gagcuggcugugccc

SEQ ID NO: 3227901 - RNA, 16 nt, Mycobacterium leprae
gagcugggcgaaaaca

SEQ ID NO: 3227902 - RNA, 22 nt, Mycobacterium leprae
gagcuggucuucuuggcgcuga

SEQ ID NO: 3227903 - RNA, 23 nt, Mycobacterium leprae
gagcuguugcuuguugccgccgg

SEQ ID NO: 3227904 - RNA, 13 nt, Mycobacterium leprae
gagcuuuuccagc

SEQ ID NO: 3227905 - RNA, 22 nt, Mycobacterium leprae
gaggaacguuggcuugagugcu

SEQ ID NO: 3227906 - RNA, 20 nt, Mycobacterium leprae
gaggaagcucgguucgguga

SEQ ID NO: 3227907 - RNA, 18 nt, Mycobacterium leprae
gaggaaugccuggguggu

SEQ ID NO: 3227908 - RNA, 13 nt, Mycobacterium leprae
gaggaccgccaug

SEQ ID NO: 3227909 - RNA, 18 nt, Mycobacterium leprae
gaggagaggcagggcugg

SEQ ID NO: 3227910 - RNA, 21 nt, Mycobacterium leprae
gaggagcccgacgcaacugcu

SEQ ID NO: 3227911 - RNA, 21 nt, Mycobacterium leprae
gaggauaguuguuagcgccgc

SEQ ID NO: 3227912 - RNA, 22 nt, Mycobacterium leprae
gaggaucgucucgggcgguuga

SEQ ID NO: 3227913 - RNA, 19 nt, Mycobacterium leprae
gaggaucucuacggcgugu

SEQ ID NO: 3227914 - RNA, 23 nt, Mycobacterium leprae
gaggauuccagcaauuguucgac

SEQ ID NO: 3227915 - RNA, 18 nt, Mycobacterium leprae
gaggauuugcuggcugcc

SEQ ID NO: 3227916 - RNA, 21 nt, Mycobacterium leprae
gaggauuugcuggcugccgcc

SEQ ID NO: 3227917 - RNA, 21 nt, Mycobacterium leprae
gaggcacaacaucaccacgau

SEQ ID NO: 3227918 - RNA, 11 nt, Mycobacterium leprae
gaggcagcagc

SEQ ID NO: 3227919 - RNA, 16 nt, Mycobacterium leprae
gaggcagggcugggga

SEQ ID NO: 3227920 - RNA, 18 nt, Mycobacterium leprae
gaggcaugggugcguuga

SEQ ID NO: 3227921 - RNA, 21 nt, Mycobacterium leprae
gaggcugucuugcggcgugcu

SEQ ID NO: 3227922 - RNA, 16 nt, Mycobacterium leprae
gaggcuucgugugcuu

SEQ ID NO: 3227923 - RNA, 19 nt, Mycobacterium leprae
gaggguccggaccuggacc

SEQ ID NO: 3227924 - RNA, 12 nt, Mycobacterium leprae
gagggucgacga

SEQ ID NO: 3227925 - RNA, 20 nt, Mycobacterium leprae
gagggucgagcuacccgccu

SEQ ID NO: 3227926 - RNA, 15 nt, Mycobacterium leprae
gagguaaaucuggca

SEQ ID NO: 3227927 - RNA, 18 nt, Mycobacterium leprae
gaggugcaggagcguggg

SEQ ID NO: 3227928 - RNA, 19 nt, Mycobacterium leprae
gaggugcaggagcgugggu

SEQ ID NO: 3227929 - RNA, 23 nt, Mycobacterium leprae
gaggugcuggaugccgggaagcg

SEQ ID NO: 3227930 - RNA, 14 nt, Mycobacterium leprae
gagguggcagcugg

SEQ ID NO: 3227931 - RNA, 21 nt, Mycobacterium leprae
gagguguucgggauccuggcc

SEQ ID NO: 3227932 - RNA, 15 nt, Mycobacterium leprae
gagguuaccagcgcc

SEQ ID NO: 3227933 - RNA, 13 nt, Mycobacterium leprae
gaguaaagggugg

SEQ ID NO: 3227934 - RNA, 18 nt, Mycobacterium leprae
gaguaaccacuugcagua

SEQ ID NO: 3227935 - RNA, 19 nt, Mycobacterium leprae
gaguacacguugaugcauc

SEQ ID NO: 3227936 - RNA, 14 nt, Mycobacterium leprae
gaguacguccgcgc

SEQ ID NO: 3227937 - RNA, 21 nt, Mycobacterium leprae
gaguagaugcaacugagcgcg

SEQ ID NO: 3227938 - RNA, 15 nt, Mycobacterium leprae
gagucaugauccagc

SEQ ID NO: 3227939 - RNA, 18 nt, Mycobacterium leprae
gaguccagguuugcgguc

SEQ ID NO: 3227940 - RNA, 17 nt, Mycobacterium leprae
gagucccucagcggcau

SEQ ID NO: 3227941 - RNA, 18 nt, Mycobacterium leprae
gaguccgcuaaggcagcc

SEQ ID NO: 3227942 - RNA, 14 nt, Mycobacterium leprae
gaguccggcgugga

SEQ ID NO: 3227943 - RNA, 22 nt, Mycobacterium leprae
gagucgaccgccgaagcagcca

SEQ ID NO: 3227944 - RNA, 21 nt, Mycobacterium leprae
gagucggcaauccuugaugcu

SEQ ID NO: 3227945 - RNA, 15 nt, Mycobacterium leprae
gagucggcgugcgga

SEQ ID NO: 3227946 - RNA, 17 nt, Mycobacterium leprae
gagucugcgguucaggg

SEQ ID NO: 3227947 - RNA, 16 nt, Mycobacterium leprae
gagucuugaugccaac

SEQ ID NO: 3227948 - RNA, 14 nt, Mycobacterium leprae
gagugaucugcucg

SEQ ID NO: 3227949 - RNA, 15 nt, Mycobacterium leprae
gagugcuagcggcgc

SEQ ID NO: 3227950 - RNA, 20 nt, Mycobacterium leprae
gagugcuggucaacaguggc

SEQ ID NO: 3227951 - RNA, 24 nt, Mycobacterium leprae
gaguggcgaacgggugaguaacac

SEQ ID NO: 3227952 - RNA, 21 nt, Mycobacterium leprae
gaguguagcaggucgccgagg

SEQ ID NO: 3227953 - RNA, 20 nt, Mycobacterium leprae
gagugugaugccgaagcaga

SEQ ID NO: 3227954 - RNA, 11 nt, Mycobacterium leprae
gaguucaacaa

SEQ ID NO: 3227955 - RNA, 16 nt, Mycobacterium leprae
gaguucaacaaaacca

SEQ ID NO: 3227956 - RNA, 13 nt, Mycobacterium leprae
gaguucacugagg

SEQ ID NO: 3227957 - RNA, 22 nt, Mycobacterium leprae
gaguucuucacacgagccgcau

SEQ ID NO: 3227958 - RNA, 13 nt, Mycobacterium leprae
gaguuggccgcgg

SEQ ID NO: 3227959 - RNA, 16 nt, Mycobacterium leprae
gaguuggccgcggcaa

SEQ ID NO: 3227960 - RNA, 15 nt, Mycobacterium leprae
gaguugggccaugca

SEQ ID NO: 3227961 - RNA, 14 nt, Mycobacterium leprae
gaguuggugucugg

SEQ ID NO: 3227962 - RNA, 23 nt, Mycobacterium leprae
gaguuugguuauugcucugucua

SEQ ID NO: 3227963 - RNA, 21 nt, Mycobacterium leprae
gauaaauaguauuauugacau

SEQ ID NO: 3227964 - RNA, 17 nt, Mycobacterium leprae
gauaagauaaauaguau

SEQ ID NO: 3227965 - RNA, 22 nt, Mycobacterium leprae
gauaagcaaaaaauagcugcca

SEQ ID NO: 3227966 - RNA, 14 nt, Mycobacterium leprae
gauaagcagcagcg

SEQ ID NO: 3227967 - RNA, 17 nt, Mycobacterium leprae
gauaaggucaaggcugg

SEQ ID NO: 3227968 - RNA, 21 nt, Mycobacterium leprae
gauaaugccaccguauccugg

SEQ ID NO: 3227969 - RNA, 15 nt, Mycobacterium leprae
gauaauuuggcugau

SEQ ID NO: 3227970 - RNA, 13 nt, Mycobacterium leprae
gauacacuuuaau

SEQ ID NO: 3227971 - RNA, 23 nt, Mycobacterium leprae
gauacagccucucgacaaagaaa

SEQ ID NO: 3227972 - RNA, 13 nt, Mycobacterium leprae
gauaccagcggca

SEQ ID NO: 3227973 - RNA, 13 nt, Mycobacterium leprae
gauacgcgucugg

SEQ ID NO: 3227974 - RNA, 21 nt, Mycobacterium leprae
gauacucgaguggcgaacggg

SEQ ID NO: 3227975 - RNA, 18 nt, Mycobacterium leprae
gauagacacuccacgcac

SEQ ID NO: 3227976 - RNA, 17 nt, Mycobacterium leprae
gauagauggagccacca

SEQ ID NO: 3227977 - RNA, 13 nt, Mycobacterium leprae
gauagcgaccauc

SEQ ID NO: 3227978 - RNA, 11 nt, Mycobacterium leprae
gauagcgcaga

SEQ ID NO: 3227979 - RNA, 15 nt, Mycobacterium leprae
gauagcguuaggcgc

SEQ ID NO: 3227980 - RNA, 13 nt, Mycobacterium leprae
gauaucaauccau

SEQ ID NO: 3227981 - RNA, 14 nt, Mycobacterium leprae
gauauccgccggcc

SEQ ID NO: 3227982 - RNA, 18 nt, Mycobacterium leprae
gauauccgccggccgcac

SEQ ID NO: 3227983 - RNA, 23 nt, Mycobacterium leprae
gauauccuaggccacugggcuga

SEQ ID NO: 3227984 - RNA, 23 nt, Mycobacterium leprae
gauauggcagaguagagaaguca

SEQ ID NO: 3227985 - RNA, 21 nt, Mycobacterium leprae
gauauggccgaccaaauggga

SEQ ID NO: 3227986 - RNA, 23 nt, Mycobacterium leprae
gauauggcgaucaugagcaacac

SEQ ID NO: 3227987 - RNA, 14 nt, Mycobacterium leprae
gauauucggugacu

SEQ ID NO: 3227988 - RNA, 19 nt, Mycobacterium leprae
gaucaaagcgguuccuccc

SEQ ID NO: 3227989 - RNA, 15 nt, Mycobacterium leprae
gaucaacagcgcagu

SEQ ID NO: 3227990 - RNA, 16 nt, Mycobacterium leprae
gaucaacgccgcgaac

SEQ ID NO: 3227991 - RNA, 16 nt, Mycobacterium leprae
gaucaacgugacuuga

SEQ ID NO: 3227992 - RNA, 20 nt, Mycobacterium leprae
gaucaacguuuugccgagca

SEQ ID NO: 3227993 - RNA, 12 nt, Mycobacterium leprae
gaucaagauccg

SEQ ID NO: 3227994 - RNA, 15 nt, Mycobacterium leprae
gaucaauaccacaau

SEQ ID NO: 3227995 - RNA, 14 nt, Mycobacterium leprae
gaucaauggcagcc

SEQ ID NO: 3227996 - RNA, 14 nt, Mycobacterium leprae
gaucacaguccugc

SEQ ID NO: 3227997 - RNA, 20 nt, Mycobacterium leprae
gaucacguuggccggcaugc

SEQ ID NO: 3227998 - RNA, 19 nt, Mycobacterium leprae
gaucacucugcggcguagg

SEQ ID NO: 3227999 - RNA, 14 nt, Mycobacterium leprae
gaucagcaacacug

SEQ ID NO: 3228000 - RNA, 20 nt, Mycobacterium leprae
gaucagcaacacuggcgacc

SEQ ID NO: 3228001 - RNA, 22 nt, Mycobacterium leprae
gaucagcagaaauuuuucggac

SEQ ID NO: 3228002 - RNA, 23 nt, Mycobacterium leprae
gaucagggcgccccccaguggug

SEQ ID NO: 3228003 - RNA, 15 nt, Mycobacterium leprae
gaucaguucuucgau

SEQ ID NO: 3228004 - RNA, 17 nt, Mycobacterium leprae
gaucaguuugccgucgg

SEQ ID NO: 3228005 - RNA, 23 nt, Mycobacterium leprae
gaucauccgcaagcgcgccgagu

SEQ ID NO: 3228006 - RNA, 21 nt, Mycobacterium leprae
gaucaugcccgcgccgcagca

SEQ ID NO: 3228007 - RNA, 13 nt, Mycobacterium leprae
gauccagcuguca

SEQ ID NO: 3228008 - RNA, 15 nt, Mycobacterium leprae
gauccaggugcugca

SEQ ID NO: 3228009 - RNA, 22 nt, Mycobacterium leprae
gaucccagaauuuucggcggca

SEQ ID NO: 3228010 - RNA, 19 nt, Mycobacterium leprae
gaucccgaaagccaccaua

SEQ ID NO: 3228011 - RNA, 21 nt, Mycobacterium leprae
gaucccgaaagugccguuggc

SEQ ID NO: 3228012 - RNA, 19 nt, Mycobacterium leprae
gaucccgacagcaugucca

SEQ ID NO: 3228013 - RNA, 18 nt, Mycobacterium leprae
gauccggcacaucgaacc

SEQ ID NO: 3228014 - RNA, 23 nt, Mycobacterium leprae
gauccggcggccggcaagaagug

SEQ ID NO: 3228015 - RNA, 17 nt, Mycobacterium leprae
gauccggugccggccaa

SEQ ID NO: 3228016 - RNA, 16 nt, Mycobacterium leprae
gauccgguguggagug

SEQ ID NO: 3228017 - RNA, 16 nt, Mycobacterium leprae
gauccgucguaggcug

SEQ ID NO: 3228018 - RNA, 14 nt, Mycobacterium leprae
gauccgugcgccuu

SEQ ID NO: 3228019 - RNA, 17 nt, Mycobacterium leprae
gauccucgugacaucga

SEQ ID NO: 3228020 - RNA, 19 nt, Mycobacterium leprae
gauccugcucauucaggcc

SEQ ID NO: 3228021 - RNA, 17 nt, Mycobacterium leprae
gauccuuguugccgaaa

SEQ ID NO: 3228022 - RNA, 13 nt, Mycobacterium leprae
gaucgacaauguc

SEQ ID NO: 3228023 - RNA, 19 nt, Mycobacterium leprae
gaucgacaccucaccaucu

SEQ ID NO: 3228024 - RNA, 20 nt, Mycobacterium leprae
gaucgaccgcugaaguuauc

SEQ ID NO: 3228025 - RNA, 14 nt, Mycobacterium leprae
gaucgacggcagcg

SEQ ID NO: 3228026 - RNA, 14 nt, Mycobacterium leprae
gaucgacggcuggc

SEQ ID NO: 3228027 - RNA, 15 nt, Mycobacterium leprae
gaucgagcgauugug

SEQ ID NO: 3228028 - RNA, 17 nt, Mycobacterium leprae
gaucgagcggagcuggg

SEQ ID NO: 3228029 - RNA, 14 nt, Mycobacterium leprae
gaucgcaaauauaa

SEQ ID NO: 3228030 - RNA, 20 nt, Mycobacterium leprae
gaucgcaaauauaauccggc

SEQ ID NO: 3228031 - RNA, 22 nt, Mycobacterium leprae
gaucgcaaucgacggccgcaca

SEQ ID NO: 3228032 - RNA, 16 nt, Mycobacterium leprae
gaucgcacuaauaagc

SEQ ID NO: 3228033 - RNA, 21 nt, Mycobacterium leprae
gaucgcaggcaccacaaacaa

SEQ ID NO: 3228034 - RNA, 21 nt, Mycobacterium leprae
gaucgcaugccgaucagccgc

SEQ ID NO: 3228035 - RNA, 17 nt, Mycobacterium leprae
gaucgcccgcccaacua

SEQ ID NO: 3228036 - RNA, 15 nt, Mycobacterium leprae
gaucgcguucugucg

SEQ ID NO: 3228037 - RNA, 14 nt, Mycobacterium leprae
gaucggaacaucac

SEQ ID NO: 3228038 - RNA, 12 nt, Mycobacterium leprae
gaucggccagcc

SEQ ID NO: 3228039 - RNA, 21 nt, Mycobacterium leprae
gaucggcgugcacggcgagga

SEQ ID NO: 3228040 - RNA, 14 nt, Mycobacterium leprae
gaucgggaugccga

SEQ ID NO: 3228041 - RNA, 24 nt, Mycobacterium leprae
gaucggggauucaaucagacacgg

SEQ ID NO: 3228042 - RNA, 23 nt, Mycobacterium leprae
gaucggguugacgcugcuugcuc

SEQ ID NO: 3228043 - RNA, 18 nt, Mycobacterium leprae
gaucggugacuuggcugg

SEQ ID NO: 3228044 - RNA, 23 nt, Mycobacterium leprae
gaucggugauaucgacuguuguu

SEQ ID NO: 3228045 - RNA, 15 nt, Mycobacterium leprae
gaucggugcaugcac

SEQ ID NO: 3228046 - RNA, 17 nt, Mycobacterium leprae
gaucguaggucgcccgg

SEQ ID NO: 3228047 - RNA, 14 nt, Mycobacterium leprae
gaucgucgcagguu

SEQ ID NO: 3228048 - RNA, 20 nt, Mycobacterium leprae
gaucgugccccucgaagucg

SEQ ID NO: 3228049 - RNA, 22 nt, Mycobacterium leprae
gaucuaugguuuuggccgcggu

SEQ ID NO: 3228050 - RNA, 13 nt, Mycobacterium leprae
gaucucgacgcga

SEQ ID NO: 3228051 - RNA, 22 nt, Mycobacterium leprae
gaucugcacaacaccuugcgcc

SEQ ID NO: 3228052 - RNA, 21 nt, Mycobacterium leprae
gaucugcucggcgaagucaag

SEQ ID NO: 3228053 - RNA, 17 nt, Mycobacterium leprae
gaucugguuuuugccau

SEQ ID NO: 3228054 - RNA, 21 nt, Mycobacterium leprae
gaucuugaguguagcaggucg

SEQ ID NO: 3228055 - RNA, 16 nt, Mycobacterium leprae
gaugaauuugccgcga

SEQ ID NO: 3228056 - RNA, 14 nt, Mycobacterium leprae
gaugacaagaguga

SEQ ID NO: 3228057 - RNA, 14 nt, Mycobacterium leprae
gaugacaccgaaca

SEQ ID NO: 3228058 - RNA, 21 nt, Mycobacterium leprae
gaugaccauaaugcagcggca

SEQ ID NO: 3228059 - RNA, 20 nt, Mycobacterium leprae
gaugacgaaauucggcggcc

SEQ ID NO: 3228060 - RNA, 16 nt, Mycobacterium leprae
gaugacucggcgugcc

SEQ ID NO: 3228061 - RNA, 15 nt, Mycobacterium leprae
gaugagauucgagcg

SEQ ID NO: 3228062 - RNA, 14 nt, Mycobacterium leprae
gaugaggcucgugc

SEQ ID NO: 3228063 - RNA, 14 nt, Mycobacterium leprae
gaugagucagacac

SEQ ID NO: 3228064 - RNA, 20 nt, Mycobacterium leprae
gaugauacguucgaucacgu

SEQ ID NO: 3228065 - RNA, 18 nt, Mycobacterium leprae
gaugauccacucgccgcg

SEQ ID NO: 3228066 - RNA, 23 nt, Mycobacterium leprae
gaugauccggccgucggcggcac

SEQ ID NO: 3228067 - RNA, 17 nt, Mycobacterium leprae
gaugauggugccgaugu

SEQ ID NO: 3228068 - RNA, 15 nt, Mycobacterium leprae
gaugauguuugcccg

SEQ ID NO: 3228069 - RNA, 16 nt, Mycobacterium leprae
gaugauuacaucaucc

SEQ ID NO: 3228070 - RNA, 12 nt, Mycobacterium leprae
gaugauuggcca

SEQ ID NO: 3228071 - RNA, 20 nt, Mycobacterium leprae
gaugccguuuucaccaaacu

SEQ ID NO: 3228072 - RNA, 13 nt, Mycobacterium leprae
gaugccuuacaau

SEQ ID NO: 3228073 - RNA, 21 nt, Mycobacterium leprae
gaugcgcaccucgcugcagca

SEQ ID NO: 3228074 - RNA, 20 nt, Mycobacterium leprae
gaugcgcuguuguuggucgg

SEQ ID NO: 3228075 - RNA, 13 nt, Mycobacterium leprae
gaugcggugguga

SEQ ID NO: 3228076 - RNA, 17 nt, Mycobacterium leprae
gaugcgugccccggccg

SEQ ID NO: 3228077 - RNA, 15 nt, Mycobacterium leprae
gaugcucgcccucgg

SEQ ID NO: 3228078 - RNA, 20 nt, Mycobacterium leprae
gaugcugugucgguugcauc

SEQ ID NO: 3228079 - RNA, 20 nt, Mycobacterium leprae
gaugcuguguggcuguuucu

SEQ ID NO: 3228080 - RNA, 20 nt, Mycobacterium leprae
gauggcauccaacacgccga

SEQ ID NO: 3228081 - RNA, 23 nt, Mycobacterium leprae
gauggcauccaacacgccgaucg

SEQ ID NO: 3228082 - RNA, 22 nt, Mycobacterium leprae
gauggccaagccgcccggccug

SEQ ID NO: 3228083 - RNA, 16 nt, Mycobacterium leprae
gauggccagccguccc

SEQ ID NO: 3228084 - RNA, 14 nt, Mycobacterium leprae
gauggccgaggagu

SEQ ID NO: 3228085 - RNA, 15 nt, Mycobacterium leprae
gauggccgccagcac

SEQ ID NO: 3228086 - RNA, 19 nt, Mycobacterium leprae
gauggccgccuucacgaau

SEQ ID NO: 3228087 - RNA, 21 nt, Mycobacterium leprae
gauggccuauaucgcggcgcg

SEQ ID NO: 3228088 - RNA, 15 nt, Mycobacterium leprae
gauggccucuccagc

SEQ ID NO: 3228089 - RNA, 17 nt, Mycobacterium leprae
gauggccucuccagcca

SEQ ID NO: 3228090 - RNA, 15 nt, Mycobacterium leprae
gauggcgcgugaauu

SEQ ID NO: 3228091 - RNA, 20 nt, Mycobacterium leprae
gauggcgucaccgugcagcg

SEQ ID NO: 3228092 - RNA, 19 nt, Mycobacterium leprae
gauggcgucuugaucgacc

SEQ ID NO: 3228093 - RNA, 12 nt, Mycobacterium leprae
gauggcuccccg

SEQ ID NO: 3228094 - RNA, 22 nt, Mycobacterium leprae
gaugggacuagucgucgugcug

SEQ ID NO: 3228095 - RNA, 15 nt, Mycobacterium leprae
gaugggacuggcggu

SEQ ID NO: 3228096 - RNA, 14 nt, Mycobacterium leprae
gaugggaucucugu

SEQ ID NO: 3228097 - RNA, 17 nt, Mycobacterium leprae
gauggucauuugguggu

SEQ ID NO: 3228098 - RNA, 17 nt, Mycobacterium leprae
gauggucggcagcuggu

SEQ ID NO: 3228099 - RNA, 18 nt, Mycobacterium leprae
gauggucggcagcugguu

SEQ ID NO: 3228100 - RNA, 15 nt, Mycobacterium leprae
gauggugcacuugca

SEQ ID NO: 3228101 - RNA, 21 nt, Mycobacterium leprae
gauggugcacuugcacuaugu

SEQ ID NO: 3228102 - RNA, 22 nt, Mycobacterium leprae
gaugguguagcugagccacgcu

SEQ ID NO: 3228103 - RNA, 14 nt, Mycobacterium leprae
gauggugugcagua

SEQ ID NO: 3228104 - RNA, 14 nt, Mycobacterium leprae
gaugguuuggcugc

SEQ ID NO: 3228105 - RNA, 18 nt, Mycobacterium leprae
gauguaaucguaccaaca

SEQ ID NO: 3228106 - RNA, 19 nt, Mycobacterium leprae
gauguaaucguaccaacac

SEQ ID NO: 3228107 - RNA, 18 nt, Mycobacterium leprae
gauguagccaacagccaa

SEQ ID NO: 3228108 - RNA, 20 nt, Mycobacterium leprae
gaugucagcgucguggcugu

SEQ ID NO: 3228109 - RNA, 16 nt, Mycobacterium leprae
gauguccaaggggcua

SEQ ID NO: 3228110 - RNA, 13 nt, Mycobacterium leprae
gauguccauggcu

SEQ ID NO: 3228111 - RNA, 14 nt, Mycobacterium leprae
gaugucuuggcuga

SEQ ID NO: 3228112 - RNA, 20 nt, Mycobacterium leprae
gaugugcucggucaguccga

SEQ ID NO: 3228113 - RNA, 14 nt, Mycobacterium leprae
gauguggccgugga

SEQ ID NO: 3228114 - RNA, 18 nt, Mycobacterium leprae
gaugugggucuguuaucg

SEQ ID NO: 3228115 - RNA, 14 nt, Mycobacterium leprae
gauguuggcgccug

SEQ ID NO: 3228116 - RNA, 14 nt, Mycobacterium leprae
gauuaccacugccg

SEQ ID NO: 3228117 - RNA, 21 nt, Mycobacterium leprae
gauuaucugcaacucaucggc

SEQ ID NO: 3228118 - RNA, 16 nt, Mycobacterium leprae
gauucaaaggucgaca

SEQ ID NO: 3228119 - RNA, 17 nt, Mycobacterium leprae
gauucacacuugcgaua

SEQ ID NO: 3228120 - RNA, 17 nt, Mycobacterium leprae
gauucauggcuugcugc

SEQ ID NO: 3228121 - RNA, 12 nt, Mycobacterium leprae
gauuccacugcc

SEQ ID NO: 3228122 - RNA, 19 nt, Mycobacterium leprae
gauucgaaggcggugauca

SEQ ID NO: 3228123 - RNA, 21 nt, Mycobacterium leprae
gauucgggccguuauccacag

SEQ ID NO: 3228124 - RNA, 23 nt, Mycobacterium leprae
gauucguugacuauggcucucgg

SEQ ID NO: 3228125 - RNA, 20 nt, Mycobacterium leprae
gauucugcggaaaugugcgg

SEQ ID NO: 3228126 - RNA, 19 nt, Mycobacterium leprae
gauugacaaaagugcagug

SEQ ID NO: 3228127 - RNA, 12 nt, Mycobacterium leprae
gauugacgucgg

SEQ ID NO: 3228128 - RNA, 18 nt, Mycobacterium leprae
gauugcagauguugcagc

SEQ ID NO: 3228129 - RNA, 21 nt, Mycobacterium leprae
gauuggaaggcauaugagcau

SEQ ID NO: 3228130 - RNA, 17 nt, Mycobacterium leprae
gauuggacauguucaca

SEQ ID NO: 3228131 - RNA, 21 nt, Mycobacterium leprae
gauuggccauuguugugcugg

SEQ ID NO: 3228132 - RNA, 12 nt, Mycobacterium leprae
gauuugcucagu

SEQ ID NO: 3228133 - RNA, 15 nt, Mycobacterium leprae
gauuuggauggucgg

SEQ ID NO: 3228134 - RNA, 14 nt, Mycobacterium leprae
gauuuggugcugcc

SEQ ID NO: 3228135 - RNA, 19 nt, Mycobacterium leprae
gauuuugcuaccgaagguc

SEQ ID NO: 3228136 - RNA, 16 nt, Mycobacterium leprae
gauuuuuguucugucc

SEQ ID NO: 3228137 - RNA, 23 nt, Mycobacterium leprae
gcaaaacaacguaccuaagccaa

SEQ ID NO: 3228138 - RNA, 20 nt, Mycobacterium leprae
gcaaaacgucgaucucgacg

SEQ ID NO: 3228139 - RNA, 18 nt, Mycobacterium leprae
gcaaaauccuucaugucc

SEQ ID NO: 3228140 - RNA, 16 nt, Mycobacterium leprae
gcaaaaugcuccccca

SEQ ID NO: 3228141 - RNA, 14 nt, Mycobacterium leprae
gcaaacaacuggag

SEQ ID NO: 3228142 - RNA, 14 nt, Mycobacterium leprae
gcaaagcggcauua

SEQ ID NO: 3228143 - RNA, 13 nt, Mycobacterium leprae
gcaaaggucagcg

SEQ ID NO: 3228144 - RNA, 16 nt, Mycobacterium leprae
gcaaauugccgagcug

SEQ ID NO: 3228145 - RNA, 18 nt, Mycobacterium leprae
gcaacaaauucgccgcgg

SEQ ID NO: 3228146 - RNA, 15 nt, Mycobacterium leprae
gcaaccaaggcuccc

SEQ ID NO: 3228147 - RNA, 18 nt, Mycobacterium leprae
gcaaccaaggcucccaag

SEQ ID NO: 3228148 - RNA, 19 nt, Mycobacterium leprae
gcaacgaccaccgaucgaa

SEQ ID NO: 3228149 - RNA, 16 nt, Mycobacterium leprae
gcaacgacuguggcac

SEQ ID NO: 3228150 - RNA, 20 nt, Mycobacterium leprae
gcaacgcaccggcguuccgg

SEQ ID NO: 3228151 - RNA, 13 nt, Mycobacterium leprae
gcaacgcugcaag

SEQ ID NO: 3228152 - RNA, 17 nt, Mycobacterium leprae
gcaacgcugcccaccag

SEQ ID NO: 3228153 - RNA, 15 nt, Mycobacterium leprae
gcaacgcuguugacc

SEQ ID NO: 3228154 - RNA, 17 nt, Mycobacterium leprae
gcaacggcaccaaaccc

SEQ ID NO: 3228155 - RNA, 18 nt, Mycobacterium leprae
gcaacggcaccaaacccg

SEQ ID NO: 3228156 - RNA, 21 nt, Mycobacterium leprae
gcaacggcaccaaacccgccg

SEQ ID NO: 3228157 - RNA, 17 nt, Mycobacterium leprae
gcaacgguuacugccac

SEQ ID NO: 3228158 - RNA, 13 nt, Mycobacterium leprae
gcaacgugcaguc

SEQ ID NO: 3228159 - RNA, 18 nt, Mycobacterium leprae
gcaacguguaaggccagc

SEQ ID NO: 3228160 - RNA, 19 nt, Mycobacterium leprae
gcaacguguaaggccagcg

SEQ ID NO: 3228161 - RNA, 16 nt, Mycobacterium leprae
gcaacuaugcggcggg

SEQ ID NO: 3228162 - RNA, 14 nt, Mycobacterium leprae
gcaacucgaccuau

SEQ ID NO: 3228163 - RNA, 15 nt, Mycobacterium leprae
gcaacucgaccuauu

SEQ ID NO: 3228164 - RNA, 15 nt, Mycobacterium leprae
gcaacucucaagugg

SEQ ID NO: 3228165 - RNA, 21 nt, Mycobacterium leprae
gcaacugaagauuuggcgagu

SEQ ID NO: 3228166 - RNA, 13 nt, Mycobacterium leprae
gcaacugcuggag

SEQ ID NO: 3228167 - RNA, 16 nt, Mycobacterium leprae
gcaagauuacccgcgg

SEQ ID NO: 3228168 - RNA, 20 nt, Mycobacterium leprae
gcaagcagauucgagcucau

SEQ ID NO: 3228169 - RNA, 14 nt, Mycobacterium leprae
gcaagccaaaacau

SEQ ID NO: 3228170 - RNA, 22 nt, Mycobacterium leprae
gcaagcccgguuaguccgaccg

SEQ ID NO: 3228171 - RNA, 19 nt, Mycobacterium leprae
gcaagcgugcaggcugcau

SEQ ID NO: 3228172 - RNA, 14 nt, Mycobacterium leprae
gcaaggcuuggcca

SEQ ID NO: 3228173 - RNA, 22 nt, Mycobacterium leprae
gcaaggcuuggccagcaaguga

SEQ ID NO: 3228174 - RNA, 14 nt, Mycobacterium leprae
gcaaggguggggcc

SEQ ID NO: 3228175 - RNA, 17 nt, Mycobacterium leprae
gcaaggucacgagacca

SEQ ID NO: 3228176 - RNA, 20 nt, Mycobacterium leprae
gcaaggugagcguugugggc

SEQ ID NO: 3228177 - RNA, 20 nt, Mycobacterium leprae
gcaagguuguuuguucagug

SEQ ID NO: 3228178 - RNA, 17 nt, Mycobacterium leprae
gcaaguaaaacugacac

SEQ ID NO: 3228179 - RNA, 17 nt, Mycobacterium leprae
gcaagucgccuacacca

SEQ ID NO: 3228180 - RNA, 14 nt, Mycobacterium leprae
gcaagugcggcgcc

SEQ ID NO: 3228181 - RNA, 18 nt, Mycobacterium leprae
gcaaguuuagcaacaaau

SEQ ID NO: 3228182 - RNA, 14 nt, Mycobacterium leprae
gcaaguuugagaac

SEQ ID NO: 3228183 - RNA, 14 nt, Mycobacterium leprae
gcaauacggugcac

SEQ ID NO: 3228184 - RNA, 18 nt, Mycobacterium leprae
gcaauccgccgaucccga

SEQ ID NO: 3228185 - RNA, 14 nt, Mycobacterium leprae
gcaaucgauccggc

SEQ ID NO: 3228186 - RNA, 18 nt, Mycobacterium leprae
gcaaugcucugcugauca

SEQ ID NO: 3228187 - RNA, 14 nt, Mycobacterium leprae
gcaaugucgccggg

SEQ ID NO: 3228188 - RNA, 19 nt, Mycobacterium leprae
gcaauucgccaauucaaac

SEQ ID NO: 3228189 - RNA, 13 nt, Mycobacterium leprae
gcaauuuuucggu

SEQ ID NO: 3228190 - RNA, 15 nt, Mycobacterium leprae
gcacaacaagagaag

SEQ ID NO: 3228191 - RNA, 18 nt, Mycobacterium leprae
gcacaacaagagaagagc

SEQ ID NO: 3228192 - RNA, 19 nt, Mycobacterium leprae
gcacaacaagagaagagcu

SEQ ID NO: 3228193 - RNA, 21 nt, Mycobacterium leprae
gcacaacaagagaagagcugg

SEQ ID NO: 3228194 - RNA, 19 nt, Mycobacterium leprae
gcacaaucaaccaggcaac

SEQ ID NO: 3228195 - RNA, 13 nt, Mycobacterium leprae
gcacaaugggugu

SEQ ID NO: 3228196 - RNA, 15 nt, Mycobacterium leprae
gcacacgacagccgc

SEQ ID NO: 3228197 - RNA, 17 nt, Mycobacterium leprae
gcacacgacagccgcaa

SEQ ID NO: 3228198 - RNA, 16 nt, Mycobacterium leprae
gcacacgagaccauga

SEQ ID NO: 3228199 - RNA, 15 nt, Mycobacterium leprae
gcacacugcggcugc

SEQ ID NO: 3228200 - RNA, 21 nt, Mycobacterium leprae
gcacacugucacgucggccug

SEQ ID NO: 3228201 - RNA, 16 nt, Mycobacterium leprae
gcacagagcccagcac

SEQ ID NO: 3228202 - RNA, 19 nt, Mycobacterium leprae
gcacagagcccagcacgcg

SEQ ID NO: 3228203 - RNA, 15 nt, Mycobacterium leprae
gcacagcaccaugga

SEQ ID NO: 3228204 - RNA, 17 nt, Mycobacterium leprae
gcacagcaggucgccga

SEQ ID NO: 3228205 - RNA, 21 nt, Mycobacterium leprae
gcacagcccaguaggcaccac

SEQ ID NO: 3228206 - RNA, 16 nt, Mycobacterium leprae
gcacagcucuccggcu

SEQ ID NO: 3228207 - RNA, 14 nt, Mycobacterium leprae
gcacagugccugac

SEQ ID NO: 3228208 - RNA, 15 nt, Mycobacterium leprae
gcacagugccugacc

SEQ ID NO: 3228209 - RNA, 18 nt, Mycobacterium leprae
gcacagugccugaccauc

SEQ ID NO: 3228210 - RNA, 15 nt, Mycobacterium leprae
gcacaucgucgggug

SEQ ID NO: 3228211 - RNA, 15 nt, Mycobacterium leprae
gcacauucaaccagc

SEQ ID NO: 3228212 - RNA, 12 nt, Mycobacterium leprae
gcaccaaacccg

SEQ ID NO: 3228213 - RNA, 19 nt, Mycobacterium leprae
gcaccaacucgaugacacg

SEQ ID NO: 3228214 - RNA, 13 nt, Mycobacterium leprae
gcaccacgcacac

SEQ ID NO: 3228215 - RNA, 21 nt, Mycobacterium leprae
gcaccagcaguggucggcgaa

SEQ ID NO: 3228216 - RNA, 21 nt, Mycobacterium leprae
gcaccagcucacccgcagcac

SEQ ID NO: 3228217 - RNA, 14 nt, Mycobacterium leprae
gcaccagucgcgca

SEQ ID NO: 3228218 - RNA, 14 nt, Mycobacterium leprae
gcaccauccggcgg

SEQ ID NO: 3228219 - RNA, 18 nt, Mycobacterium leprae
gcacccacgcugcgcggc

SEQ ID NO: 3228220 - RNA, 14 nt, Mycobacterium leprae
gcacccgcaaaaau

SEQ ID NO: 3228221 - RNA, 13 nt, Mycobacterium leprae
gcacccgccaggg

SEQ ID NO: 3228222 - RNA, 17 nt, Mycobacterium leprae
gcacccgcuugucuuug

SEQ ID NO: 3228223 - RNA, 18 nt, Mycobacterium leprae
gcacccggcggcaugccu

SEQ ID NO: 3228224 - RNA, 12 nt, Mycobacterium leprae
gcacccucaccc

SEQ ID NO: 3228225 - RNA, 17 nt, Mycobacterium leprae
gcacccugccgccacag

SEQ ID NO: 3228226 - RNA, 16 nt, Mycobacterium leprae
gcaccgauccggcggc

SEQ ID NO: 3228227 - RNA, 20 nt, Mycobacterium leprae
gcaccgaucgcccgcccaac

SEQ ID NO: 3228228 - RNA, 16 nt, Mycobacterium leprae
gcaccgaucugcccag

SEQ ID NO: 3228229 - RNA, 19 nt, Mycobacterium leprae
gcaccgauugccugaugcc

SEQ ID NO: 3228230 - RNA, 15 nt, Mycobacterium leprae
gcaccgcgaagcuga

SEQ ID NO: 3228231 - RNA, 13 nt, Mycobacterium leprae
gcaccgcggcggg

SEQ ID NO: 3228232 - RNA, 16 nt, Mycobacterium leprae
gcaccgcggcggguag

SEQ ID NO: 3228233 - RNA, 17 nt, Mycobacterium leprae
gcaccggcauggccgcu

SEQ ID NO: 3228234 - RNA, 16 nt, Mycobacterium leprae
gcaccguacaugcugg

SEQ ID NO: 3228235 - RNA, 23 nt, Mycobacterium leprae
gcaccuacaacuucaaccaagcc

SEQ ID NO: 3228236 - RNA, 23 nt, Mycobacterium leprae
gcaccuguacuugauagcucgcg

SEQ ID NO: 3228237 - RNA, 21 nt, Mycobacterium leprae
gcaccuuacgauuacgcacgc

SEQ ID NO: 3228238 - RNA, 16 nt, Mycobacterium leprae
gcaccuugggcgccuc

SEQ ID NO: 3228239 - RNA, 14 nt, Mycobacterium leprae
gcacgagcgggugu

SEQ ID NO: 3228240 - RNA, 14 nt, Mycobacterium leprae
gcacgauaggcagu

SEQ ID NO: 3228241 - RNA, 16 nt, Mycobacterium leprae
gcacgauggccgguga

SEQ ID NO: 3228242 - RNA, 15 nt, Mycobacterium leprae
gcacgcaaccgccgg

SEQ ID NO: 3228243 - RNA, 21 nt, Mycobacterium leprae
gcacgcaaccgccggcaagcc

SEQ ID NO: 3228244 - RNA, 13 nt, Mycobacterium leprae
gcacgccagcugg

SEQ ID NO: 3228245 - RNA, 19 nt, Mycobacterium leprae
gcacgccgaacagccgcgc

SEQ ID NO: 3228246 - RNA, 18 nt, Mycobacterium leprae
gcacggauucgguuuccu

SEQ ID NO: 3228247 - RNA, 21 nt, Mycobacterium leprae
gcacggcacaaucgucgccuu

SEQ ID NO: 3228248 - RNA, 22 nt, Mycobacterium leprae
gcacggcguaugaccgcggucg

SEQ ID NO: 3228249 - RNA, 24 nt, Mycobacterium leprae
gcacggcguaugaccgcggucggc

SEQ ID NO: 3228250 - RNA, 18 nt, Mycobacterium leprae
gcacgggaggcguugcac

SEQ ID NO: 3228251 - RNA, 16 nt, Mycobacterium leprae
gcacgggguguuggcg

SEQ ID NO: 3228252 - RNA, 18 nt, Mycobacterium leprae
gcacguccucggcccaug

SEQ ID NO: 3228253 - RNA, 21 nt, Mycobacterium leprae
gcacgugcaaacugcugcgca

SEQ ID NO: 3228254 - RNA, 21 nt, Mycobacterium leprae
gcacgugcggcggccuuggca

SEQ ID NO: 3228255 - RNA, 16 nt, Mycobacterium leprae
gcacuaaagucuucaa

SEQ ID NO: 3228256 - RNA, 16 nt, Mycobacterium leprae
gcacuagcaucuguuc

SEQ ID NO: 3228257 - RNA, 16 nt, Mycobacterium leprae
gcacuagcuugugcuc

SEQ ID NO: 3228258 - RNA, 18 nt, Mycobacterium leprae
gcacuauaaggcagcucg

SEQ ID NO: 3228259 - RNA, 19 nt, Mycobacterium leprae
gcacucacccgcgaggccu

SEQ ID NO: 3228260 - RNA, 22 nt, Mycobacterium leprae
gcacuccuacgguguauggcgu

SEQ ID NO: 3228261 - RNA, 17 nt, Mycobacterium leprae
gcacuccuucaugcugg

SEQ ID NO: 3228262 - RNA, 16 nt, Mycobacterium leprae
gcacugagcaguugcg

SEQ ID NO: 3228263 - RNA, 15 nt, Mycobacterium leprae
gcacugauucgacac

SEQ ID NO: 3228264 - RNA, 15 nt, Mycobacterium leprae
gcacugcacggcgug

SEQ ID NO: 3228265 - RNA, 14 nt, Mycobacterium leprae
gcacugcguuguag

SEQ ID NO: 3228266 - RNA, 18 nt, Mycobacterium leprae
gcacugcuucggccagcg

SEQ ID NO: 3228267 - RNA, 16 nt, Mycobacterium leprae
gcacuguaucucgugc

SEQ ID NO: 3228268 - RNA, 21 nt, Mycobacterium leprae
gcacugugucaccugaaagag

SEQ ID NO: 3228269 - RNA, 21 nt, Mycobacterium leprae
gcacuguuacuaccguacagg

SEQ ID NO: 3228270 - RNA, 16 nt, Mycobacterium leprae
gcacuuaaguggcugg

SEQ ID NO: 3228271 - RNA, 13 nt, Mycobacterium leprae
gcacuucgacggu

SEQ ID NO: 3228272 - RNA, 19 nt, Mycobacterium leprae
gcacuucgcugagcgaagu

SEQ ID NO: 3228273 - RNA, 15 nt, Mycobacterium leprae
gcagaagaccgugcu

SEQ ID NO: 3228274 - RNA, 22 nt, Mycobacterium leprae
gcagaaguuguucgucgggugc

SEQ ID NO: 3228275 - RNA, 16 nt, Mycobacterium leprae
gcagaauuggagugaa

SEQ ID NO: 3228276 - RNA, 16 nt, Mycobacterium leprae
gcagacacgccgcggc

SEQ ID NO: 3228277 - RNA, 20 nt, Mycobacterium leprae
gcagacacgccgcggcuggg

SEQ ID NO: 3228278 - RNA, 24 nt, Mycobacterium leprae
gcagaccuuuuagcugcgcgcgcc

SEQ ID NO: 3228279 - RNA, 16 nt, Mycobacterium leprae
gcagacucgagucccg

SEQ ID NO: 3228280 - RNA, 14 nt, Mycobacterium leprae
gcagagcucacugg

SEQ ID NO: 3228281 - RNA, 13 nt, Mycobacterium leprae
gcagaggcaccug

SEQ ID NO: 3228282 - RNA, 15 nt, Mycobacterium leprae
gcagaucgacagcgg

SEQ ID NO: 3228283 - RNA, 15 nt, Mycobacterium leprae
gcagaucgaucucga

SEQ ID NO: 3228284 - RNA, 17 nt, Mycobacterium leprae
gcagaucgaucucgacg

SEQ ID NO: 3228285 - RNA, 18 nt, Mycobacterium leprae
gcagaugcaagauuauua

SEQ ID NO: 3228286 - RNA, 14 nt, Mycobacterium leprae
gcagauguccuuca

SEQ ID NO: 3228287 - RNA, 18 nt, Mycobacterium leprae
gcagauuauuaagauaaa

SEQ ID NO: 3228288 - RNA, 23 nt, Mycobacterium leprae
gcagcaacauucaccccccagga

SEQ ID NO: 3228289 - RNA, 22 nt, Mycobacterium leprae
gcagcaauugacgccgaccgcg

SEQ ID NO: 3228290 - RNA, 17 nt, Mycobacterium leprae
gcagcacccgcuugucu

SEQ ID NO: 3228291 - RNA, 22 nt, Mycobacterium leprae
gcagcacgggguguuggcgcuc

SEQ ID NO: 3228292 - RNA, 19 nt, Mycobacterium leprae
gcagcagcggagcgaacgg

SEQ ID NO: 3228293 - RNA, 17 nt, Mycobacterium leprae
gcagcaguuuucugcgc

SEQ ID NO: 3228294 - RNA, 15 nt, Mycobacterium leprae
gcagcauagucggug

SEQ ID NO: 3228295 - RNA, 13 nt, Mycobacterium leprae
gcagcauauggaa

SEQ ID NO: 3228296 - RNA, 14 nt, Mycobacterium leprae
gcagcauccaccac

SEQ ID NO: 3228297 - RNA, 22 nt, Mycobacterium leprae
gcagcauccgccgacgaugcgu

SEQ ID NO: 3228298 - RNA, 19 nt, Mycobacterium leprae
gcagcaucgcgucuuccaa

SEQ ID NO: 3228299 - RNA, 17 nt, Mycobacterium leprae
gcagcauuggcuccugg

SEQ ID NO: 3228300 - RNA, 14 nt, Mycobacterium leprae
gcagccaccgacga

SEQ ID NO: 3228301 - RNA, 23 nt, Mycobacterium leprae
gcagcccagauugcaguccacca

SEQ ID NO: 3228302 - RNA, 18 nt, Mycobacterium leprae
gcagccgagguucccggc

SEQ ID NO: 3228303 - RNA, 20 nt, Mycobacterium leprae
gcagccgagguucccggcgg

SEQ ID NO: 3228304 - RNA, 17 nt, Mycobacterium leprae
gcagccgaucggcugcc

SEQ ID NO: 3228305 - RNA, 12 nt, Mycobacterium leprae
gcagccgcggua

SEQ ID NO: 3228306 - RNA, 21 nt, Mycobacterium leprae
gcagccgcgguaacggcggug

SEQ ID NO: 3228307 - RNA, 21 nt, Mycobacterium leprae
gcagccugguguggacagcgu

SEQ ID NO: 3228308 - RNA, 15 nt, Mycobacterium leprae
gcagcgacuggaucc

SEQ ID NO: 3228309 - RNA, 22 nt, Mycobacterium leprae
gcagcgauaccagcgucgcuca

SEQ ID NO: 3228310 - RNA, 16 nt, Mycobacterium leprae
gcagcgccacgccgga

SEQ ID NO: 3228311 - RNA, 21 nt, Mycobacterium leprae
gcagcgccugccccgcuggug

SEQ ID NO: 3228312 - RNA, 17 nt, Mycobacterium leprae
gcagcggaccgcggacc

SEQ ID NO: 3228313 - RNA, 19 nt, Mycobacterium leprae
gcagcggcaguccgcguca

SEQ ID NO: 3228314 - RNA, 21 nt, Mycobacterium leprae
gcagcggcggccgugauuuuc

SEQ ID NO: 3228315 - RNA, 12 nt, Mycobacterium leprae
gcagcgucacca

SEQ ID NO: 3228316 - RNA, 15 nt, Mycobacterium leprae
gcagcguggucaccg

SEQ ID NO: 3228317 - RNA, 21 nt, Mycobacterium leprae
gcagcgugucguuguacagac

SEQ ID NO: 3228318 - RNA, 20 nt, Mycobacterium leprae
gcagcuaauuuuccacaggc

SEQ ID NO: 3228319 - RNA, 16 nt, Mycobacterium leprae
gcagcuccagcucgcg

SEQ ID NO: 3228320 - RNA, 15 nt, Mycobacterium leprae
gcagcucgacgggcg

SEQ ID NO: 3228321 - RNA, 13 nt, Mycobacterium leprae
gcagcucuggauc

SEQ ID NO: 3228322 - RNA, 22 nt, Mycobacterium leprae
gcagcugacgauuaucugcaac

SEQ ID NO: 3228323 - RNA, 14 nt, Mycobacterium leprae
gcagcugcagucga

SEQ ID NO: 3228324 - RNA, 19 nt, Mycobacterium leprae
gcagcuggaaagucgggau

SEQ ID NO: 3228325 - RNA, 12 nt, Mycobacterium leprae
gcagcuggccaa

SEQ ID NO: 3228326 - RNA, 18 nt, Mycobacterium leprae
gcagcuucaaaccggcca

SEQ ID NO: 3228327 - RNA, 18 nt, Mycobacterium leprae
gcagcuugaacgccgcga

SEQ ID NO: 3228328 - RNA, 20 nt, Mycobacterium leprae
gcagcuugaacgccgcgagc

SEQ ID NO: 3228329 - RNA, 17 nt, Mycobacterium leprae
gcaggaaucccagcagc

SEQ ID NO: 3228330 - RNA, 17 nt, Mycobacterium leprae
gcaggacugauggccgu

SEQ ID NO: 3228331 - RNA, 23 nt, Mycobacterium leprae
gcaggagaaacaaaggugcccac

SEQ ID NO: 3228332 - RNA, 15 nt, Mycobacterium leprae
gcaggaucggguagc

SEQ ID NO: 3228333 - RNA, 19 nt, Mycobacterium leprae
gcaggaucggguagcugca

SEQ ID NO: 3228334 - RNA, 22 nt, Mycobacterium leprae
gcaggauugcguugaccgccgc

SEQ ID NO: 3228335 - RNA, 19 nt, Mycobacterium leprae
gcaggcaugccgccgggug

SEQ ID NO: 3228336 - RNA, 13 nt, Mycobacterium leprae
gcaggccggccug

SEQ ID NO: 3228337 - RNA, 22 nt, Mycobacterium leprae
gcaggcgaguggcgaguccagg

SEQ ID NO: 3228338 - RNA, 13 nt, Mycobacterium leprae
gcaggcugcaucc

SEQ ID NO: 3228339 - RNA, 13 nt, Mycobacterium leprae
gcagggaugccaa

SEQ ID NO: 3228340 - RNA, 14 nt, Mycobacterium leprae
gcagggccagcccg

SEQ ID NO: 3228341 - RNA, 19 nt, Mycobacterium leprae
gcagggcgagcugcgccga

SEQ ID NO: 3228342 - RNA, 18 nt, Mycobacterium leprae
gcagggcguugccguccc

SEQ ID NO: 3228343 - RNA, 23 nt, Mycobacterium leprae
gcagggcguugccguccccuccc

SEQ ID NO: 3228344 - RNA, 23 nt, Mycobacterium leprae
gcagggcuguuuggccuccaagu

SEQ ID NO: 3228345 - RNA, 22 nt, Mycobacterium leprae
gcagguacuagcacgcugucuu

SEQ ID NO: 3228346 - RNA, 21 nt, Mycobacterium leprae
gcaggucgccgacgucuucaa

SEQ ID NO: 3228347 - RNA, 11 nt, Mycobacterium leprae
gcaggugcuuu

SEQ ID NO: 3228348 - RNA, 16 nt, Mycobacterium leprae
gcagguguccuauaaa

SEQ ID NO: 3228349 - RNA, 21 nt, Mycobacterium leprae
gcagguugaggaggugcugga

SEQ ID NO: 3228350 - RNA, 18 nt, Mycobacterium leprae
gcagguugcugucguguu

SEQ ID NO: 3228351 - RNA, 14 nt, Mycobacterium leprae
gcagguuguugacg

SEQ ID NO: 3228352 - RNA, 19 nt, Mycobacterium leprae
gcaguaucuaccuauccga

SEQ ID NO: 3228353 - RNA, 21 nt, Mycobacterium leprae
gcaguaucuaccuauccgagu

SEQ ID NO: 3228354 - RNA, 17 nt, Mycobacterium leprae
gcagucaguuuggcgcu

SEQ ID NO: 3228355 - RNA, 18 nt, Mycobacterium leprae
gcagucaguuuggcgcug

SEQ ID NO: 3228356 - RNA, 20 nt, Mycobacterium leprae
gcagucaguuuggcgcugcu

SEQ ID NO: 3228357 - RNA, 13 nt, Mycobacterium leprae
gcaguccaccaga

SEQ ID NO: 3228358 - RNA, 13 nt, Mycobacterium leprae
gcaguccgcguca

SEQ ID NO: 3228359 - RNA, 21 nt, Mycobacterium leprae
gcaguccuuuccagccacggc

SEQ ID NO: 3228360 - RNA, 16 nt, Mycobacterium leprae
gcagucgauuagccgg

SEQ ID NO: 3228361 - RNA, 21 nt, Mycobacterium leprae
gcagucguucgcugacagcaa

SEQ ID NO: 3228362 - RNA, 15 nt, Mycobacterium leprae
gcagucucgcuggcg

SEQ ID NO: 3228363 - RNA, 14 nt, Mycobacterium leprae
gcagugaacacgcu

SEQ ID NO: 3228364 - RNA, 21 nt, Mycobacterium leprae
gcagugaacacgcugaucgcu

SEQ ID NO: 3228365 - RNA, 17 nt, Mycobacterium leprae
gcagugagcagugggcc

SEQ ID NO: 3228366 - RNA, 20 nt, Mycobacterium leprae
gcagugcacgagcggguguu

SEQ ID NO: 3228367 - RNA, 17 nt, Mycobacterium leprae
gcagugcaguucaccac

SEQ ID NO: 3228368 - RNA, 17 nt, Mycobacterium leprae
gcagugccgccgaucgg

SEQ ID NO: 3228369 - RNA, 21 nt, Mycobacterium leprae
gcagugccuggcgucaucgac

SEQ ID NO: 3228370 - RNA, 17 nt, Mycobacterium leprae
gcagugcggugaucgcu

SEQ ID NO: 3228371 - RNA, 23 nt, Mycobacterium leprae
gcaguggacacgauuagcgcggc

SEQ ID NO: 3228372 - RNA, 19 nt, Mycobacterium leprae
gcagugucugggccgggcu

SEQ ID NO: 3228373 - RNA, 14 nt, Mycobacterium leprae
gcagugugcuuucg

SEQ ID NO: 3228374 - RNA, 20 nt, Mycobacterium leprae
gcaguguucaggccaucaga

SEQ ID NO: 3228375 - RNA, 19 nt, Mycobacterium leprae
gcaguuagcaugagcugcu

SEQ ID NO: 3228376 - RNA, 18 nt, Mycobacterium leprae
gcaguugauccgucgcgu

SEQ ID NO: 3228377 - RNA, 15 nt, Mycobacterium leprae
gcaguuuccaacaaa

SEQ ID NO: 3228378 - RNA, 15 nt, Mycobacterium leprae
gcauaaucagcgucg

SEQ ID NO: 3228379 - RNA, 15 nt, Mycobacterium leprae
gcauacagugcaccg

SEQ ID NO: 3228380 - RNA, 17 nt, Mycobacterium leprae
gcauagcgcuaaaugga

SEQ ID NO: 3228381 - RNA, 15 nt, Mycobacterium leprae
gcauagcggccgcca

SEQ ID NO: 3228382 - RNA, 18 nt, Mycobacterium leprae
gcauauaaucgcuucggc

SEQ ID NO: 3228383 - RNA, 12 nt, Mycobacterium leprae
gcauaugagcau

SEQ ID NO: 3228384 - RNA, 19 nt, Mycobacterium leprae
gcaucaagucggucgccga

SEQ ID NO: 3228385 - RNA, 18 nt, Mycobacterium leprae
gcaucaccggaaagcuga

SEQ ID NO: 3228386 - RNA, 14 nt, Mycobacterium leprae
gcaucacuucagcg

SEQ ID NO: 3228387 - RNA, 11 nt, Mycobacterium leprae
gcaucaucgcc

SEQ ID NO: 3228388 - RNA, 22 nt, Mycobacterium leprae
gcaucaucgcccaccgcaacgc

SEQ ID NO: 3228389 - RNA, 14 nt, Mycobacterium leprae
gcauccagucguug

SEQ ID NO: 3228390 - RNA, 13 nt, Mycobacterium leprae
gcauccugcagca

SEQ ID NO: 3228391 - RNA, 15 nt, Mycobacterium leprae
gcaucgaagcaacca

SEQ ID NO: 3228392 - RNA, 13 nt, Mycobacterium leprae
gcaucgacagcac

SEQ ID NO: 3228393 - RNA, 17 nt, Mycobacterium leprae
gcaucgauaagcagcag

SEQ ID NO: 3228394 - RNA, 23 nt, Mycobacterium leprae
gcaucgcggauugauccggucac

SEQ ID NO: 3228395 - RNA, 13 nt, Mycobacterium leprae
gcaucggcaacgc

SEQ ID NO: 3228396 - RNA, 15 nt, Mycobacterium leprae
gcaucggcagaugcc

SEQ ID NO: 3228397 - RNA, 15 nt, Mycobacterium leprae
gcaucggcaucccag

SEQ ID NO: 3228398 - RNA, 18 nt, Mycobacterium leprae
gcaucggcauugccgggg

SEQ ID NO: 3228399 - RNA, 16 nt, Mycobacterium leprae
gcaucggcggcggagc

SEQ ID NO: 3228400 - RNA, 14 nt, Mycobacterium leprae
gcaucggcuugaug

SEQ ID NO: 3228401 - RNA, 15 nt, Mycobacterium leprae
gcaucgucggcaaau

SEQ ID NO: 3228402 - RNA, 20 nt, Mycobacterium leprae
gcaucucaacuuucgcggcc

SEQ ID NO: 3228403 - RNA, 14 nt, Mycobacterium leprae
gcaucugccgugca

SEQ ID NO: 3228404 - RNA, 20 nt, Mycobacterium leprae
gcaucugccgugcagcgacc

SEQ ID NO: 3228405 - RNA, 15 nt, Mycobacterium leprae
gcaucugcuacgcug

SEQ ID NO: 3228406 - RNA, 19 nt, Mycobacterium leprae
gcaucugguagccguucgg

SEQ ID NO: 3228407 - RNA, 18 nt, Mycobacterium leprae
gcaugaaccucacccagu

SEQ ID NO: 3228408 - RNA, 13 nt, Mycobacterium leprae
gcaugaccgagcu

SEQ ID NO: 3228409 - RNA, 13 nt, Mycobacterium leprae
gcaugagcugcug

SEQ ID NO: 3228410 - RNA, 16 nt, Mycobacterium leprae
gcaugagugaucugcu

SEQ ID NO: 3228411 - RNA, 17 nt, Mycobacterium leprae
gcaugaugugcucgggc

SEQ ID NO: 3228412 - RNA, 17 nt, Mycobacterium leprae
gcaugcccugggccagc

SEQ ID NO: 3228413 - RNA, 21 nt, Mycobacterium leprae
gcaugcccugggccagcgauc

SEQ ID NO: 3228414 - RNA, 19 nt, Mycobacterium leprae
gcaugcgcugaggcagcag

SEQ ID NO: 3228415 - RNA, 21 nt, Mycobacterium leprae
gcaugcgcugaggcagcagcu

SEQ ID NO: 3228416 - RNA, 19 nt, Mycobacterium leprae
gcaugcuaacaucauucac

SEQ ID NO: 3228417 - RNA, 21 nt, Mycobacterium leprae
gcauggaauuguucugcgcug

SEQ ID NO: 3228418 - RNA, 12 nt, Mycobacterium leprae
gcauggcacugc

SEQ ID NO: 3228419 - RNA, 14 nt, Mycobacterium leprae
gcauggccgcuggg

SEQ ID NO: 3228420 - RNA, 16 nt, Mycobacterium leprae
gcauggccgcuggggc

SEQ ID NO: 3228421 - RNA, 23 nt, Mycobacterium leprae
gcauggcgaugcgcagccgcggu

SEQ ID NO: 3228422 - RNA, 15 nt, Mycobacterium leprae
gcaugugcauccagu

SEQ ID NO: 3228423 - RNA, 15 nt, Mycobacterium leprae
gcauguucgaccagg

SEQ ID NO: 3228424 - RNA, 21 nt, Mycobacterium leprae
gcauguucuguugugggggug

SEQ ID NO: 3228425 - RNA, 13 nt, Mycobacterium leprae
gcauuauuuuuua

SEQ ID NO: 3228426 - RNA, 14 nt, Mycobacterium leprae
gcauucagccgcga

SEQ ID NO: 3228427 - RNA, 19 nt, Mycobacterium leprae
gcauucccaaccgcgacgc

SEQ ID NO: 3228428 - RNA, 22 nt, Mycobacterium leprae
gcauucccaaccgcgacgccag

SEQ ID NO: 3228429 - RNA, 22 nt, Mycobacterium leprae
gcauugccggggcugcgcuggg

SEQ ID NO: 3228430 - RNA, 13 nt, Mycobacterium leprae
gcauuggaugaga

SEQ ID NO: 3228431 - RNA, 20 nt, Mycobacterium leprae
gcauuggucggggugcugca

SEQ ID NO: 3228432 - RNA, 17 nt, Mycobacterium leprae
gcauuuaccgagaucga

SEQ ID NO: 3228433 - RNA, 23 nt, Mycobacterium leprae
gcauuuaccgagaucgacgcugc

SEQ ID NO: 3228434 - RNA, 21 nt, Mycobacterium leprae
gcauuucgaaagucaccuguc

SEQ ID NO: 3228435 - RNA, 17 nt, Mycobacterium leprae
gccaaacuugcacugau

SEQ ID NO: 3228436 - RNA, 15 nt, Mycobacterium leprae
gccaacacgucacga

SEQ ID NO: 3228437 - RNA, 24 nt, Mycobacterium leprae
gccaacagccaaugucacaucgau

SEQ ID NO: 3228438 - RNA, 18 nt, Mycobacterium leprae
gccaaccacagcaauaga

SEQ ID NO: 3228439 - RNA, 19 nt, Mycobacterium leprae
gccaaccgguggagguacg

SEQ ID NO: 3228440 - RNA, 14 nt, Mycobacterium leprae
gccaacgcgcaccu

SEQ ID NO: 3228441 - RNA, 18 nt, Mycobacterium leprae
gccaacgcgcaccuggug

SEQ ID NO: 3228442 - RNA, 22 nt, Mycobacterium leprae
gccaacuguugcuugcccugcg

SEQ ID NO: 3228443 - RNA, 16 nt, Mycobacterium leprae
gccaagaccuaccugc

SEQ ID NO: 3228444 - RNA, 18 nt, Mycobacterium leprae
gccaagccgcccggccug

SEQ ID NO: 3228445 - RNA, 21 nt, Mycobacterium leprae
gccaagcucagcgcagugcca

SEQ ID NO: 3228446 - RNA, 19 nt, Mycobacterium leprae
gccaaguuguaagugcagu

SEQ ID NO: 3228447 - RNA, 12 nt, Mycobacterium leprae
gccaauaccgaa

SEQ ID NO: 3228448 - RNA, 22 nt, Mycobacterium leprae
gccaaucgccugugucgagcug

SEQ ID NO: 3228449 - RNA, 20 nt, Mycobacterium leprae
gccaaucuaauugcgaugca

SEQ ID NO: 3228450 - RNA, 16 nt, Mycobacterium leprae
gccaaucuaucaagcc

SEQ ID NO: 3228451 - RNA, 18 nt, Mycobacterium leprae
gccaauugaauccgcugc

SEQ ID NO: 3228452 - RNA, 17 nt, Mycobacterium leprae
gccacauugaccacgcc

SEQ ID NO: 3228453 - RNA, 14 nt, Mycobacterium leprae
gccacauugccggu

SEQ ID NO: 3228454 - RNA, 23 nt, Mycobacterium leprae
gccaccauauaagcgaaguccuu

SEQ ID NO: 3228455 - RNA, 16 nt, Mycobacterium leprae
gccacccgcaucguug

SEQ ID NO: 3228456 - RNA, 15 nt, Mycobacterium leprae
gccaccgacaaagcu

SEQ ID NO: 3228457 - RNA, 14 nt, Mycobacterium leprae
gccaccgccaccga

SEQ ID NO: 3228458 - RNA, 23 nt, Mycobacterium leprae
gccaccggcgcuuguaaggccag

SEQ ID NO: 3228459 - RNA, 19 nt, Mycobacterium leprae
gccaccggugauguggccg

SEQ ID NO: 3228460 - RNA, 16 nt, Mycobacterium leprae
gccaccuaggccugcu

SEQ ID NO: 3228461 - RNA, 17 nt, Mycobacterium leprae
gccacgaaaaucuggcg

SEQ ID NO: 3228462 - RNA, 15 nt, Mycobacterium leprae
gccacgagacccagc

SEQ ID NO: 3228463 - RNA, 17 nt, Mycobacterium leprae
gccacgcuggcacuccg

SEQ ID NO: 3228464 - RNA, 22 nt, Mycobacterium leprae
gccacuaauuagaggccaaaga

SEQ ID NO: 3228465 - RNA, 20 nt, Mycobacterium leprae
gccacuccgguugcggcgag

SEQ ID NO: 3228466 - RNA, 21 nt, Mycobacterium leprae
gccacuccgguugcggcgagc

SEQ ID NO: 3228467 - RNA, 22 nt, Mycobacterium leprae
gccacuccgguugcggcgagcu

SEQ ID NO: 3228468 - RNA, 20 nt, Mycobacterium leprae
gccacucggcagagcguucg

SEQ ID NO: 3228469 - RNA, 19 nt, Mycobacterium leprae
gccacugcacgaccacacu

SEQ ID NO: 3228470 - RNA, 19 nt, Mycobacterium leprae
gccagaauggaguuggugu

SEQ ID NO: 3228471 - RNA, 23 nt, Mycobacterium leprae
gccagacacugccaccgcuacgg

SEQ ID NO: 3228472 - RNA, 23 nt, Mycobacterium leprae
gccagacacuggcggauuuugac

SEQ ID NO: 3228473 - RNA, 13 nt, Mycobacterium leprae
gccagaccaacau

SEQ ID NO: 3228474 - RNA, 18 nt, Mycobacterium leprae
gccagacuggccggugga

SEQ ID NO: 3228475 - RNA, 17 nt, Mycobacterium leprae
gccagacuucagcgagc

SEQ ID NO: 3228476 - RNA, 21 nt, Mycobacterium leprae
gccagacuucagcgagcgugu

SEQ ID NO: 3228477 - RNA, 14 nt, Mycobacterium leprae
gccagcaagcaggc

SEQ ID NO: 3228478 - RNA, 20 nt, Mycobacterium leprae
gccagcacaucgucgggugc

SEQ ID NO: 3228479 - RNA, 22 nt, Mycobacterium leprae
gccagcaucaacgccagcaagc

SEQ ID NO: 3228480 - RNA, 13 nt, Mycobacterium leprae
gccagccaacggc

SEQ ID NO: 3228481 - RNA, 15 nt, Mycobacterium leprae
gccagccaggaugcg

SEQ ID NO: 3228482 - RNA, 15 nt, Mycobacterium leprae
gccagcccggcgugc

SEQ ID NO: 3228483 - RNA, 19 nt, Mycobacterium leprae
gccagcgacacagccggcc

SEQ ID NO: 3228484 - RNA, 20 nt, Mycobacterium leprae
gccagcgacacagccggccg

SEQ ID NO: 3228485 - RNA, 21 nt, Mycobacterium leprae
gccagcgcaucagccaacacc

SEQ ID NO: 3228486 - RNA, 21 nt, Mycobacterium leprae
gccagcucgucccaugucucu

SEQ ID NO: 3228487 - RNA, 23 nt, Mycobacterium leprae
gccaggaugcggcccagugcacu

SEQ ID NO: 3228488 - RNA, 16 nt, Mycobacterium leprae
gccaggcagcgccugc

SEQ ID NO: 3228489 - RNA, 20 nt, Mycobacterium leprae
gccaggcagcugugcacgug

SEQ ID NO: 3228490 - RNA, 11 nt, Mycobacterium leprae
gccaggcagga

SEQ ID NO: 3228491 - RNA, 23 nt, Mycobacterium leprae
gccaggcgaauugcuaccugguu

SEQ ID NO: 3228492 - RNA, 15 nt, Mycobacterium leprae
gccaggcgccgcagc

SEQ ID NO: 3228493 - RNA, 17 nt, Mycobacterium leprae
gccaggcgccgcagcau

SEQ ID NO: 3228494 - RNA, 18 nt, Mycobacterium leprae
gccaggcguccucauccc

SEQ ID NO: 3228495 - RNA, 15 nt, Mycobacterium leprae
gccaggcucuauguu

SEQ ID NO: 3228496 - RNA, 21 nt, Mycobacterium leprae
gccagggcggcauucccaacc

SEQ ID NO: 3228497 - RNA, 22 nt, Mycobacterium leprae
gccagggcggcauucccaaccg

SEQ ID NO: 3228498 - RNA, 16 nt, Mycobacterium leprae
gccagggguuccaaga

SEQ ID NO: 3228499 - RNA, 14 nt, Mycobacterium leprae
gccagguagugagu

SEQ ID NO: 3228500 - RNA, 15 nt, Mycobacterium leprae
gccagguagugagua

SEQ ID NO: 3228501 - RNA, 12 nt, Mycobacterium leprae
gccaggucggcu

SEQ ID NO: 3228502 - RNA, 21 nt, Mycobacterium leprae
gccaggucggcuagccgugca

SEQ ID NO: 3228503 - RNA, 20 nt, Mycobacterium leprae
gccaggugguaucugcaccu

SEQ ID NO: 3228504 - RNA, 13 nt, Mycobacterium leprae
gccagugaucgcc

SEQ ID NO: 3228505 - RNA, 21 nt, Mycobacterium leprae
gccauauccucgaccaccagg

SEQ ID NO: 3228506 - RNA, 16 nt, Mycobacterium leprae
gccaucacugauccca

SEQ ID NO: 3228507 - RNA, 20 nt, Mycobacterium leprae
gccauccaccgccgagcgca

SEQ ID NO: 3228508 - RNA, 18 nt, Mycobacterium leprae
gccauccgaaacccgaaa

SEQ ID NO: 3228509 - RNA, 18 nt, Mycobacterium leprae
gccauccgggccagaauc

SEQ ID NO: 3228510 - RNA, 17 nt, Mycobacterium leprae
gccaucgacgccgucuc

SEQ ID NO: 3228511 - RNA, 19 nt, Mycobacterium leprae
gccaucggcagaucgaucu

SEQ ID NO: 3228512 - RNA, 23 nt, Mycobacterium leprae
gccaucggcagaucgaucucgac

SEQ ID NO: 3228513 - RNA, 18 nt, Mycobacterium leprae
gccaucgggccagagcug

SEQ ID NO: 3228514 - RNA, 15 nt, Mycobacterium leprae
gccaugcacgccggc

SEQ ID NO: 3228515 - RNA, 18 nt, Mycobacterium leprae
gccaugucuaagacacuu

SEQ ID NO: 3228516 - RNA, 14 nt, Mycobacterium leprae
gccauguuaaacag

SEQ ID NO: 3228517 - RNA, 20 nt, Mycobacterium leprae
gccauucuagguucgagucc

SEQ ID NO: 3228518 - RNA, 19 nt, Mycobacterium leprae
gccauugcucugggcgcgg

SEQ ID NO: 3228519 - RNA, 17 nt, Mycobacterium leprae
gccauuguugugcuggg

SEQ ID NO: 3228520 - RNA, 15 nt, Mycobacterium leprae
gcccaacgucuggac

SEQ ID NO: 3228521 - RNA, 17 nt, Mycobacterium leprae
gcccaacuagucgcccg

SEQ ID NO: 3228522 - RNA, 22 nt, Mycobacterium leprae
gcccaaugcagcaacgugcagu

SEQ ID NO: 3228523 - RNA, 18 nt, Mycobacterium leprae
gcccaccauguuuccgau

SEQ ID NO: 3228524 - RNA, 12 nt, Mycobacterium leprae
gcccaccgcaac

SEQ ID NO: 3228525 - RNA, 19 nt, Mycobacterium leprae
gcccaccgccggacggcac

SEQ ID NO: 3228526 - RNA, 24 nt, Mycobacterium leprae
gcccacgaauaugcccagcagaug

SEQ ID NO: 3228527 - RNA, 13 nt, Mycobacterium leprae
gcccacguccacc

SEQ ID NO: 3228528 - RNA, 20 nt, Mycobacterium leprae
gcccagaccgaaaaccacaa

SEQ ID NO: 3228529 - RNA, 21 nt, Mycobacterium leprae
gcccagaccgaaaaccacaag

SEQ ID NO: 3228530 - RNA, 15 nt, Mycobacterium leprae
gcccagagaucgccg

SEQ ID NO: 3228531 - RNA, 18 nt, Mycobacterium leprae
gcccagagaucgccgcuc

SEQ ID NO: 3228532 - RNA, 15 nt, Mycobacterium leprae
gcccagcgcagcccg

SEQ ID NO: 3228533 - RNA, 23 nt, Mycobacterium leprae
gcccaggugcuggcugcgccggc

SEQ ID NO: 3228534 - RNA, 18 nt, Mycobacterium leprae
gcccaguaggcaccacgc

SEQ ID NO: 3228535 - RNA, 20 nt, Mycobacterium leprae
gcccaguuaucuagcccaga

SEQ ID NO: 3228536 - RNA, 18 nt, Mycobacterium leprae
gcccauaucgacuucggu

SEQ ID NO: 3228537 - RNA, 16 nt, Mycobacterium leprae
gcccauccgggccagu

SEQ ID NO: 3228538 - RNA, 21 nt, Mycobacterium leprae
gcccaugcuuaaggcagaacu

SEQ ID NO: 3228539 - RNA, 15 nt, Mycobacterium leprae
gccccagucgccaga

SEQ ID NO: 3228540 - RNA, 17 nt, Mycobacterium leprae
gccccagucgccagagc

SEQ ID NO: 3228541 - RNA, 19 nt, Mycobacterium leprae
gccccagucgccagagccg

SEQ ID NO: 3228542 - RNA, 14 nt, Mycobacterium leprae
gccccaucucaucu

SEQ ID NO: 3228543 - RNA, 19 nt, Mycobacterium leprae
gccccggacccgagccgca

SEQ ID NO: 3228544 - RNA, 12 nt, Mycobacterium leprae
gccccggccgcc

SEQ ID NO: 3228545 - RNA, 14 nt, Mycobacterium leprae
gccccggccgccgu

SEQ ID NO: 3228546 - RNA, 14 nt, Mycobacterium leprae
gccccgguggcugu

SEQ ID NO: 3228547 - RNA, 20 nt, Mycobacterium leprae
gccccuggcaucaucaacau

SEQ ID NO: 3228548 - RNA, 19 nt, Mycobacterium leprae
gccccuuccugacaaccgu

SEQ ID NO: 3228549 - RNA, 17 nt, Mycobacterium leprae
gcccgaaagaugcaggu

SEQ ID NO: 3228550 - RNA, 20 nt, Mycobacterium leprae
gcccgaagugcuugggcacg

SEQ ID NO: 3228551 - RNA, 22 nt, Mycobacterium leprae
gcccgaagugcuugggcacgcu

SEQ ID NO: 3228552 - RNA, 15 nt, Mycobacterium leprae
gcccgacagccacca

SEQ ID NO: 3228553 - RNA, 15 nt, Mycobacterium leprae
gcccgacggcgucgu

SEQ ID NO: 3228554 - RNA, 15 nt, Mycobacterium leprae
gcccgaggagaggca

SEQ ID NO: 3228555 - RNA, 23 nt, Mycobacterium leprae
gcccgagucucuggugcgccaac

SEQ ID NO: 3228556 - RNA, 20 nt, Mycobacterium leprae
gcccgcaaagagucgaccug

SEQ ID NO: 3228557 - RNA, 17 nt, Mycobacterium leprae
gcccgcacagcaccaug

SEQ ID NO: 3228558 - RNA, 14 nt, Mycobacterium leprae
gcccgcccaagaag

SEQ ID NO: 3228559 - RNA, 18 nt, Mycobacterium leprae
gcccgcgucgccuuagcc

SEQ ID NO: 3228560 - RNA, 21 nt, Mycobacterium leprae
gcccgcugccaggaucugcuc

SEQ ID NO: 3228561 - RNA, 23 nt, Mycobacterium leprae
gcccggaauccuguugacguguu

SEQ ID NO: 3228562 - RNA, 18 nt, Mycobacterium leprae
gcccggacggcccagcac

SEQ ID NO: 3228563 - RNA, 19 nt, Mycobacterium leprae
gcccggacggcccagcacc

SEQ ID NO: 3228564 - RNA, 18 nt, Mycobacterium leprae
gcccggauacagcacggc

SEQ ID NO: 3228565 - RNA, 21 nt, Mycobacterium leprae
gcccggauacagcacggcgcu

SEQ ID NO: 3228566 - RNA, 16 nt, Mycobacterium leprae
gcccggauugauggau

SEQ ID NO: 3228567 - RNA, 11 nt, Mycobacterium leprae
gcccggccagu

SEQ ID NO: 3228568 - RNA, 23 nt, Mycobacterium leprae
gcccggcgugcaggauucacccg

SEQ ID NO: 3228569 - RNA, 15 nt, Mycobacterium leprae
gcccgggaugacguu

SEQ ID NO: 3228570 - RNA, 13 nt, Mycobacterium leprae
gcccgguaccguc

SEQ ID NO: 3228571 - RNA, 22 nt, Mycobacterium leprae
gcccgguaccguccguccugcc

SEQ ID NO: 3228572 - RNA, 13 nt, Mycobacterium leprae
gcccgguugccgu

SEQ ID NO: 3228573 - RNA, 19 nt, Mycobacterium leprae
gcccgucacuacguuggcc

SEQ ID NO: 3228574 - RNA, 15 nt, Mycobacterium leprae
gcccgugcucaguga

SEQ ID NO: 3228575 - RNA, 15 nt, Mycobacterium leprae
gcccguuaucgaucu

SEQ ID NO: 3228576 - RNA, 18 nt, Mycobacterium leprae
gcccuagaacaaacgccg

SEQ ID NO: 3228577 - RNA, 20 nt, Mycobacterium leprae
gcccuccggaaauacggcag

SEQ ID NO: 3228578 - RNA, 15 nt, Mycobacterium leprae
gcccuccuggcgagu

SEQ ID NO: 3228579 - RNA, 18 nt, Mycobacterium leprae
gcccuccuuuucgccggc

SEQ ID NO: 3228580 - RNA, 12 nt, Mycobacterium leprae
gcccucgccggc

SEQ ID NO: 3228581 - RNA, 21 nt, Mycobacterium leprae
gcccucguugacgcccuccug

SEQ ID NO: 3228582 - RNA, 23 nt, Mycobacterium leprae
gcccucguugacgcccuccuggc

SEQ ID NO: 3228583 - RNA, 20 nt, Mycobacterium leprae
gcccugcacuugcacuucga

SEQ ID NO: 3228584 - RNA, 14 nt, Mycobacterium leprae
gcccugcgggaagu

SEQ ID NO: 3228585 - RNA, 14 nt, Mycobacterium leprae
gcccugggccagcg

SEQ ID NO: 3228586 - RNA, 16 nt, Mycobacterium leprae
gcccugggccagcgau

SEQ ID NO: 3228587 - RNA, 17 nt, Mycobacterium leprae
gcccugggugaccagga

SEQ ID NO: 3228588 - RNA, 18 nt, Mycobacterium leprae
gcccuuagagguuagcga

SEQ ID NO: 3228589 - RNA, 22 nt, Mycobacterium leprae
gccgaaaaccuacgcgguccug

SEQ ID NO: 3228590 - RNA, 20 nt, Mycobacterium leprae
gccgaaaucgguggcagccg

SEQ ID NO: 3228591 - RNA, 21 nt, Mycobacterium leprae
gccgaaaucgguggcagccgg

SEQ ID NO: 3228592 - RNA, 13 nt, Mycobacterium leprae
gccgaacagccgc

SEQ ID NO: 3228593 - RNA, 15 nt, Mycobacterium leprae
gccgaacagccgcgc

SEQ ID NO: 3228594 - RNA, 23 nt, Mycobacterium leprae
gccgaacagcugguucauggcug

SEQ ID NO: 3228595 - RNA, 22 nt, Mycobacterium leprae
gccgaacguaccaccgcgguga

SEQ ID NO: 3228596 - RNA, 15 nt, Mycobacterium leprae
gccgaagccgccagg

SEQ ID NO: 3228597 - RNA, 17 nt, Mycobacterium leprae
gccgaagccgccagguu

SEQ ID NO: 3228598 - RNA, 13 nt, Mycobacterium leprae
gccgaaucgguac

SEQ ID NO: 3228599 - RNA, 21 nt, Mycobacterium leprae
gccgaauuaccauuggcgaca

SEQ ID NO: 3228600 - RNA, 16 nt, Mycobacterium leprae
gccgaauucgaggacg

SEQ ID NO: 3228601 - RNA, 14 nt, Mycobacterium leprae
gccgacagugccac

SEQ ID NO: 3228602 - RNA, 18 nt, Mycobacterium leprae
gccgacagugccacggug

SEQ ID NO: 3228603 - RNA, 15 nt, Mycobacterium leprae
gccgaccaaccuaaa

SEQ ID NO: 3228604 - RNA, 12 nt, Mycobacterium leprae
gccgaccgcgac

SEQ ID NO: 3228605 - RNA, 20 nt, Mycobacterium leprae
gccgaccuaccgcauccggc

SEQ ID NO: 3228606 - RNA, 17 nt, Mycobacterium leprae
gccgacuaauuguggcu

SEQ ID NO: 3228607 - RNA, 15 nt, Mycobacterium leprae
gccgacuucggcaac

SEQ ID NO: 3228608 - RNA, 21 nt, Mycobacterium leprae
gccgagcaugaccgagcuggc

SEQ ID NO: 3228609 - RNA, 22 nt, Mycobacterium leprae
gccgagcaugaccgagcuggcg

SEQ ID NO: 3228610 - RNA, 13 nt, Mycobacterium leprae
gccgagcgcacca

SEQ ID NO: 3228611 - RNA, 20 nt, Mycobacterium leprae
gccgagcuguuccucuugac

SEQ ID NO: 3228612 - RNA, 22 nt, Mycobacterium leprae
gccgagcuugcugcuuugcggu

SEQ ID NO: 3228613 - RNA, 19 nt, Mycobacterium leprae
gccgaggcacaacaucacc

SEQ ID NO: 3228614 - RNA, 18 nt, Mycobacterium leprae
gccgaggcucugcucggc

SEQ ID NO: 3228615 - RNA, 18 nt, Mycobacterium leprae
gccgagguucccggcggc

SEQ ID NO: 3228616 - RNA, 24 nt, Mycobacterium leprae
gccgaguccgcuaaggcagcccgc

SEQ ID NO: 3228617 - RNA, 22 nt, Mycobacterium leprae
gccgagugcaggauugcguuga

SEQ ID NO: 3228618 - RNA, 19 nt, Mycobacterium leprae
gccgauacccaucacgucc

SEQ ID NO: 3228619 - RNA, 14 nt, Mycobacterium leprae
gccgauauaccugc

SEQ ID NO: 3228620 - RNA, 19 nt, Mycobacterium leprae
gccgauaucgaccagccaa

SEQ ID NO: 3228621 - RNA, 17 nt, Mycobacterium leprae
gccgauaucuccgugau

SEQ ID NO: 3228622 - RNA, 21 nt, Mycobacterium leprae
gccgauauguucgguagucgu

SEQ ID NO: 3228623 - RNA, 23 nt, Mycobacterium leprae
gccgaucauggcuggacagaagc

SEQ ID NO: 3228624 - RNA, 16 nt, Mycobacterium leprae
gccgaucccaucggcu

SEQ ID NO: 3228625 - RNA, 22 nt, Mycobacterium leprae
gccgaucccaucggcugcaccg

SEQ ID NO: 3228626 - RNA, 13 nt, Mycobacterium leprae
gccgaucccgaaa

SEQ ID NO: 3228627 - RNA, 14 nt, Mycobacterium leprae
gccgaucgguauug

SEQ ID NO: 3228628 - RNA, 19 nt, Mycobacterium leprae
gccgcaaguuuagcaacaa

SEQ ID NO: 3228629 - RNA, 16 nt, Mycobacterium leprae
gccgcacccggcagca

SEQ ID NO: 3228630 - RNA, 19 nt, Mycobacterium leprae
gccgcaccgcuucagagug

SEQ ID NO: 3228631 - RNA, 21 nt, Mycobacterium leprae
gccgcaccugaacaggcacgu

SEQ ID NO: 3228632 - RNA, 13 nt, Mycobacterium leprae
gccgcacguuaga

SEQ ID NO: 3228633 - RNA, 14 nt, Mycobacterium leprae
gccgcagcgcggcc

SEQ ID NO: 3228634 - RNA, 18 nt, Mycobacterium leprae
gccgccacgaccaaaccu

SEQ ID NO: 3228635 - RNA, 13 nt, Mycobacterium leprae
gccgccagaugcc

SEQ ID NO: 3228636 - RNA, 15 nt, Mycobacterium leprae
gccgccagguccacc

SEQ ID NO: 3228637 - RNA, 13 nt, Mycobacterium leprae
gccgccagugcgc

SEQ ID NO: 3228638 - RNA, 14 nt, Mycobacterium leprae
gccgccagugcgca

SEQ ID NO: 3228639 - RNA, 13 nt, Mycobacterium leprae
gccgccauugccc

SEQ ID NO: 3228640 - RNA, 17 nt, Mycobacterium leprae
gccgccauugcccccgc

SEQ ID NO: 3228641 - RNA, 13 nt, Mycobacterium leprae
gccgccgaacaag

SEQ ID NO: 3228642 - RNA, 21 nt, Mycobacterium leprae
gccgccgaacaguucgcacga

SEQ ID NO: 3228643 - RNA, 15 nt, Mycobacterium leprae
gccgccgacaccgau

SEQ ID NO: 3228644 - RNA, 17 nt, Mycobacterium leprae
gccgccgggacgcguca

SEQ ID NO: 3228645 - RNA, 20 nt, Mycobacterium leprae
gccgccgggugcagcaguau

SEQ ID NO: 3228646 - RNA, 17 nt, Mycobacterium leprae
gccgccguccacugcag

SEQ ID NO: 3228647 - RNA, 23 nt, Mycobacterium leprae
gccgccgugguggcugucgggca

SEQ ID NO: 3228648 - RNA, 14 nt, Mycobacterium leprae
gccgccucgaugcg

SEQ ID NO: 3228649 - RNA, 22 nt, Mycobacterium leprae
gccgccuuuacgaagccgccac

SEQ ID NO: 3228650 - RNA, 15 nt, Mycobacterium leprae
gccgcgaauggacag

SEQ ID NO: 3228651 - RNA, 15 nt, Mycobacterium leprae
gccgcgaccgccaga

SEQ ID NO: 3228652 - RNA, 20 nt, Mycobacterium leprae
gccgcgaguuggccgagcgu

SEQ ID NO: 3228653 - RNA, 21 nt, Mycobacterium leprae
gccgcgcaaacaacuggagua

SEQ ID NO: 3228654 - RNA, 19 nt, Mycobacterium leprae
gccgcgcacccgagcggca

SEQ ID NO: 3228655 - RNA, 21 nt, Mycobacterium leprae
gccgcgcgcaagucuggaguc

SEQ ID NO: 3228656 - RNA, 14 nt, Mycobacterium leprae
gccgcgcuggccuc

SEQ ID NO: 3228657 - RNA, 14 nt, Mycobacterium leprae
gccgcggacaagac

SEQ ID NO: 3228658 - RNA, 18 nt, Mycobacterium leprae
gccgcggcaacaacggau

SEQ ID NO: 3228659 - RNA, 17 nt, Mycobacterium leprae
gccgcggcugcgcucac

SEQ ID NO: 3228660 - RNA, 19 nt, Mycobacterium leprae
gccgcgggcgaugccaucg

SEQ ID NO: 3228661 - RNA, 22 nt, Mycobacterium leprae
gccgcggguaaccuugccggcc

SEQ ID NO: 3228662 - RNA, 23 nt, Mycobacterium leprae
gccgcggguaaccuugccggccu

SEQ ID NO: 3228663 - RNA, 24 nt, Mycobacterium leprae
gccgcggguaaccuugccggccuu

SEQ ID NO: 3228664 - RNA, 18 nt, Mycobacterium leprae
gccgcguauaccggcuga

SEQ ID NO: 3228665 - RNA, 13 nt, Mycobacterium leprae
gccgcguccagac

SEQ ID NO: 3228666 - RNA, 22 nt, Mycobacterium leprae
gccgcguccagacaccacugcc

SEQ ID NO: 3228667 - RNA, 21 nt, Mycobacterium leprae
gccgcuacacugcagcgguca

SEQ ID NO: 3228668 - RNA, 15 nt, Mycobacterium leprae
gccgcuccgcgcaca

SEQ ID NO: 3228669 - RNA, 21 nt, Mycobacterium leprae
gccgcuccgcgcacagugugg

SEQ ID NO: 3228670 - RNA, 13 nt, Mycobacterium leprae
gccgcugcauccg

SEQ ID NO: 3228671 - RNA, 14 nt, Mycobacterium leprae
gccgcugcauccgc

SEQ ID NO: 3228672 - RNA, 17 nt, Mycobacterium leprae
gccgcugguaucggugu

SEQ ID NO: 3228673 - RNA, 19 nt, Mycobacterium leprae
gccgcuuaaauuccccacu

SEQ ID NO: 3228674 - RNA, 22 nt, Mycobacterium leprae
gccggaaaccuucgauuccagc

SEQ ID NO: 3228675 - RNA, 20 nt, Mycobacterium leprae
gccggagauguaguccucag

SEQ ID NO: 3228676 - RNA, 20 nt, Mycobacterium leprae
gccggcaagaagugcgacga

SEQ ID NO: 3228677 - RNA, 14 nt, Mycobacterium leprae
gccggcacaucguc

SEQ ID NO: 3228678 - RNA, 19 nt, Mycobacterium leprae
gccggcagggaugccaaac

SEQ ID NO: 3228679 - RNA, 21 nt, Mycobacterium leprae
gccggccccgaaccauccagc

SEQ ID NO: 3228680 - RNA, 22 nt, Mycobacterium leprae
gccggccggcaagcugcccggc

SEQ ID NO: 3228681 - RNA, 13 nt, Mycobacterium leprae
gccggccuggcug

SEQ ID NO: 3228682 - RNA, 15 nt, Mycobacterium leprae
gccggcgccgcugcu

SEQ ID NO: 3228683 - RNA, 12 nt, Mycobacterium leprae
gccggcgccugg

SEQ ID NO: 3228684 - RNA, 21 nt, Mycobacterium leprae
gccggcggcagauguuggccc

SEQ ID NO: 3228685 - RNA, 15 nt, Mycobacterium leprae
gccggcggccaccgc

SEQ ID NO: 3228686 - RNA, 19 nt, Mycobacterium leprae
gccggcgguacugcacguc

SEQ ID NO: 3228687 - RNA, 14 nt, Mycobacterium leprae
gccggcgucaggcc

SEQ ID NO: 3228688 - RNA, 13 nt, Mycobacterium leprae
gccggcguguggg

SEQ ID NO: 3228689 - RNA, 16 nt, Mycobacterium leprae
gccggcucgcauccgc

SEQ ID NO: 3228690 - RNA, 17 nt, Mycobacterium leprae
gccggcucgcauccgca

SEQ ID NO: 3228691 - RNA, 20 nt, Mycobacterium leprae
gccggcucgcggggaugcug

SEQ ID NO: 3228692 - RNA, 20 nt, Mycobacterium leprae
gccggcuuuggcggacugcu

SEQ ID NO: 3228693 - RNA, 18 nt, Mycobacterium leprae
gccgggcuaaguccggcc

SEQ ID NO: 3228694 - RNA, 19 nt, Mycobacterium leprae
gccggggaaccuggaccga

SEQ ID NO: 3228695 - RNA, 17 nt, Mycobacterium leprae
gccggggcugcgcuggg

SEQ ID NO: 3228696 - RNA, 17 nt, Mycobacterium leprae
gccgguacucggaaugg

SEQ ID NO: 3228697 - RNA, 18 nt, Mycobacterium leprae
gccggucgaagugaccuc

SEQ ID NO: 3228698 - RNA, 15 nt, Mycobacterium leprae
gccggugcgguccca

SEQ ID NO: 3228699 - RNA, 22 nt, Mycobacterium leprae
gccgguggcuauacccccuguc

SEQ ID NO: 3228700 - RNA, 17 nt, Mycobacterium leprae
gccgguguacacgugcu

SEQ ID NO: 3228701 - RNA, 18 nt, Mycobacterium leprae
gccgguuucgccccaacu

SEQ ID NO: 3228702 - RNA, 22 nt, Mycobacterium leprae
gccguccacugcagggcgagcu

SEQ ID NO: 3228703 - RNA, 19 nt, Mycobacterium leprae
gccgucccuauagguggca

SEQ ID NO: 3228704 - RNA, 13 nt, Mycobacterium leprae
gccgugaccgaca

SEQ ID NO: 3228705 - RNA, 18 nt, Mycobacterium leprae
gccgugaccgacagcucg

SEQ ID NO: 3228706 - RNA, 21 nt, Mycobacterium leprae
gccgugcacacgucgagauug

SEQ ID NO: 3228707 - RNA, 14 nt, Mycobacterium leprae
gccgugcagcgacc

SEQ ID NO: 3228708 - RNA, 13 nt, Mycobacterium leprae
gccgugcccaagg

SEQ ID NO: 3228709 - RNA, 23 nt, Mycobacterium leprae
gccguggauaccacugacgggug

SEQ ID NO: 3228710 - RNA, 22 nt, Mycobacterium leprae
gccguggggcucggccaggugu

SEQ ID NO: 3228711 - RNA, 18 nt, Mycobacterium leprae
gccgugguagucagcaca

SEQ ID NO: 3228712 - RNA, 13 nt, Mycobacterium leprae
gccgugugcuucg

SEQ ID NO: 3228713 - RNA, 16 nt, Mycobacterium leprae
gccguuauccacagca

SEQ ID NO: 3228714 - RNA, 14 nt, Mycobacterium leprae
gccguuccauucca

SEQ ID NO: 3228715 - RNA, 14 nt, Mycobacterium leprae
gccguucggcuacu

SEQ ID NO: 3228716 - RNA, 20 nt, Mycobacterium leprae
gccguucuaggguguugugg

SEQ ID NO: 3228717 - RNA, 20 nt, Mycobacterium leprae
gccuaaagcggcaagcagau

SEQ ID NO: 3228718 - RNA, 12 nt, Mycobacterium leprae
gccuagacugac

SEQ ID NO: 3228719 - RNA, 15 nt, Mycobacterium leprae
gccuaggugaucgua

SEQ ID NO: 3228720 - RNA, 23 nt, Mycobacterium leprae
gccuauugguuggggaaaugaca

SEQ ID NO: 3228721 - RNA, 17 nt, Mycobacterium leprae
gccucaacuauccagcc

SEQ ID NO: 3228722 - RNA, 15 nt, Mycobacterium leprae
gccucacaguaggcc

SEQ ID NO: 3228723 - RNA, 18 nt, Mycobacterium leprae
gccucacaguaggccagc

SEQ ID NO: 3228724 - RNA, 23 nt, Mycobacterium leprae
gccucacaguaggccagcccggc

SEQ ID NO: 3228725 - RNA, 20 nt, Mycobacterium leprae
gccucaccugcgacagccgu

SEQ ID NO: 3228726 - RNA, 22 nt, Mycobacterium leprae
gccucaccugcgacagccgugc

SEQ ID NO: 3228727 - RNA, 14 nt, Mycobacterium leprae
gccucacguaccgg

SEQ ID NO: 3228728 - RNA, 18 nt, Mycobacterium leprae
gccucagcagcaggcuga

SEQ ID NO: 3228729 - RNA, 16 nt, Mycobacterium leprae
gccucaguuaucccac

SEQ ID NO: 3228730 - RNA, 14 nt, Mycobacterium leprae
gccucauugaccgc

SEQ ID NO: 3228731 - RNA, 13 nt, Mycobacterium leprae
gccuccacugcuc

SEQ ID NO: 3228732 - RNA, 14 nt, Mycobacterium leprae
gccuccacugcucc

SEQ ID NO: 3228733 - RNA, 22 nt, Mycobacterium leprae
gccuccaggugaagccggcgca

SEQ ID NO: 3228734 - RNA, 23 nt, Mycobacterium leprae
gccuccgaaaagcugagccgaca

SEQ ID NO: 3228735 - RNA, 21 nt, Mycobacterium leprae
gccuccgagcgcccgcacagc

SEQ ID NO: 3228736 - RNA, 14 nt, Mycobacterium leprae
gccuccuaggccac

SEQ ID NO: 3228737 - RNA, 14 nt, Mycobacterium leprae
gccucgaugugcuu

SEQ ID NO: 3228738 - RNA, 15 nt, Mycobacterium leprae
gccucggcuucccga

SEQ ID NO: 3228739 - RNA, 18 nt, Mycobacterium leprae
gccucgucgaugucgggg

SEQ ID NO: 3228740 - RNA, 16 nt, Mycobacterium leprae
gccucgucggccagca

SEQ ID NO: 3228741 - RNA, 20 nt, Mycobacterium leprae
gccucgucgucggccagguc

SEQ ID NO: 3228742 - RNA, 18 nt, Mycobacterium leprae
gccugagcgggccagcac

SEQ ID NO: 3228743 - RNA, 13 nt, Mycobacterium leprae
gccugcccgcagg

SEQ ID NO: 3228744 - RNA, 18 nt, Mycobacterium leprae
gccugcgacacuugccgc

SEQ ID NO: 3228745 - RNA, 14 nt, Mycobacterium leprae
gccugcgucaguaa

SEQ ID NO: 3228746 - RNA, 12 nt, Mycobacterium leprae
gccugcugcaug

SEQ ID NO: 3228747 - RNA, 16 nt, Mycobacterium leprae
gccugcuugcuggcug

SEQ ID NO: 3228748 - RNA, 15 nt, Mycobacterium leprae
gccuggaaacgggug

SEQ ID NO: 3228749 - RNA, 13 nt, Mycobacterium leprae
gccuggcgucauc

SEQ ID NO: 3228750 - RNA, 17 nt, Mycobacterium leprae
gccuggcgucaucgaca

SEQ ID NO: 3228751 - RNA, 21 nt, Mycobacterium leprae
gccuggguguucauggcgcgc

SEQ ID NO: 3228752 - RNA, 20 nt, Mycobacterium leprae
gccugucgauuaccacugcc

SEQ ID NO: 3228753 - RNA, 17 nt, Mycobacterium leprae
gccugugcuguugggga

SEQ ID NO: 3228754 - RNA, 21 nt, Mycobacterium leprae
gccuguucaggugcggccaca

SEQ ID NO: 3228755 - RNA, 18 nt, Mycobacterium leprae
gccuguugcggccaagcu

SEQ ID NO: 3228756 - RNA, 17 nt, Mycobacterium leprae
gccuguuguugugccuu

SEQ ID NO: 3228757 - RNA, 14 nt, Mycobacterium leprae
gccuuaucccacca

SEQ ID NO: 3228758 - RNA, 14 nt, Mycobacterium leprae
gccuucagcacagc

SEQ ID NO: 3228759 - RNA, 15 nt, Mycobacterium leprae
gccuucgucagcugg

SEQ ID NO: 3228760 - RNA, 19 nt, Mycobacterium leprae
gccuucgugauggccaaag

SEQ ID NO: 3228761 - RNA, 22 nt, Mycobacterium leprae
gccuugauugccgucggaugau

SEQ ID NO: 3228762 - RNA, 22 nt, Mycobacterium leprae
gccuuggugcuuaacgccgccu

SEQ ID NO: 3228763 - RNA, 18 nt, Mycobacterium leprae
gccuuuuguacuuguuga

SEQ ID NO: 3228764 - RNA, 18 nt, Mycobacterium leprae
gcgaaaacacuuacacca

SEQ ID NO: 3228765 - RNA, 14 nt, Mycobacterium leprae
gcgaaacggcgcuc

SEQ ID NO: 3228766 - RNA, 12 nt, Mycobacterium leprae
gcgaacaagaaa

SEQ ID NO: 3228767 - RNA, 17 nt, Mycobacterium leprae
gcgaaccuacaguggca

SEQ ID NO: 3228768 - RNA, 23 nt, Mycobacterium leprae
gcgacacagagcgcucggcgugc

SEQ ID NO: 3228769 - RNA, 15 nt, Mycobacterium leprae
gcgacacagccggcc

SEQ ID NO: 3228770 - RNA, 17 nt, Mycobacterium leprae
gcgacacagccggccgg

SEQ ID NO: 3228771 - RNA, 12 nt, Mycobacterium leprae
gcgacaccacca

SEQ ID NO: 3228772 - RNA, 20 nt, Mycobacterium leprae
gcgacacgcgcgacacguca

SEQ ID NO: 3228773 - RNA, 14 nt, Mycobacterium leprae
aacacguuucugca

SEQ ID NO: 3228774 - RNA, 15 nt, Mycobacterium leprae
aacacguuucugcau

SEQ ID NO: 3228775 - RNA, 17 nt, Mycobacterium leprae
aacacucauuggaccca

SEQ ID NO: 3228776 - RNA, 21 nt, Mycobacterium leprae
aacacugaguagaugcaacug

SEQ ID NO: 3228777 - RNA, 16 nt, Mycobacterium leprae
aacagaaccuauucaa

SEQ ID NO: 3228778 - RNA, 18 nt, Mycobacterium leprae
aacagagcaagccgcaca

SEQ ID NO: 3228779 - RNA, 22 nt, Mycobacterium leprae
aacagagcugauggccgccagg

SEQ ID NO: 3228780 - RNA, 17 nt, Mycobacterium leprae
aacagagucaaauucaa

SEQ ID NO: 3228781 - RNA, 13 nt, Mycobacterium leprae
aacagagugcacc

SEQ ID NO: 3228782 - RNA, 11 nt, Mycobacterium leprae
aacagauuauu

SEQ ID NO: 3228783 - RNA, 20 nt, Mycobacterium leprae
aacagcauccucggcacagu

SEQ ID NO: 3228784 - RNA, 21 nt, Mycobacterium leprae
aacagcauccucggcacagug

SEQ ID NO: 3228785 - RNA, 12 nt, Mycobacterium leprae
aacagcgcagug

SEQ ID NO: 3228786 - RNA, 20 nt, Mycobacterium leprae
aacagcggggauaggagccc

SEQ ID NO: 3228787 - RNA, 20 nt, Mycobacterium leprae
aacagcucgacagcagguag

SEQ ID NO: 3228788 - RNA, 16 nt, Mycobacterium leprae
aacagcuugacaucag

SEQ ID NO: 3228789 - RNA, 22 nt, Mycobacterium leprae
aacagugggggugcggcagcug

SEQ ID NO: 3228790 - RNA, 22 nt, Mycobacterium leprae
aacaguuaaagguaaagaauuc

SEQ ID NO: 3228791 - RNA, 23 nt, Mycobacterium leprae
aacaguuuaaguagaccagaagc

SEQ ID NO: 3228792 - RNA, 13 nt, Mycobacterium leprae
aacauagccagca

SEQ ID NO: 3228793 - RNA, 15 nt, Mycobacterium leprae
aacauagccagcauc

SEQ ID NO: 3228794 - RNA, 12 nt, Mycobacterium leprae
aacauagucaga

SEQ ID NO: 3228795 - RNA, 16 nt, Mycobacterium leprae
aacauagucagaucaa

SEQ ID NO: 3228796 - RNA, 14 nt, Mycobacterium leprae
aacauauccagugu

SEQ ID NO: 3228797 - RNA, 16 nt, Mycobacterium leprae
aacaugaacgucacug

SEQ ID NO: 3228798 - RNA, 21 nt, Mycobacterium leprae
aacaugaucaauaccacaauu

SEQ ID NO: 3228799 - RNA, 16 nt, Mycobacterium leprae
aacauggacaaccugg

SEQ ID NO: 3228800 - RNA, 17 nt, Mycobacterium leprae
aacauucaggaugcugu

SEQ ID NO: 3228801 - RNA, 18 nt, Mycobacterium leprae
aacauucaggaugcuguc

SEQ ID NO: 3228802 - RNA, 14 nt, Mycobacterium leprae
aaccaaacaacaac

SEQ ID NO: 3228803 - RNA, 23 nt, Mycobacterium leprae
aaccaaaugcuaugauaauuugg

SEQ ID NO: 3228804 - RNA, 12 nt, Mycobacterium leprae
aaccaacuaggc

SEQ ID NO: 3228805 - RNA, 17 nt, Mycobacterium leprae
aaccaacuaggcgccag

SEQ ID NO: 3228806 - RNA, 18 nt, Mycobacterium leprae
aaccaagauguaaagcag

SEQ ID NO: 3228807 - RNA, 21 nt, Mycobacterium leprae
aaccacacccuggcugggcug

SEQ ID NO: 3228808 - RNA, 21 nt, Mycobacterium leprae
aaccacuuagcgugagccugg

SEQ ID NO: 3228809 - RNA, 15 nt, Mycobacterium leprae
aaccaucaacggcua

SEQ ID NO: 3228810 - RNA, 19 nt, Mycobacterium leprae
aaccaucaacggcuacaac

SEQ ID NO: 3228811 - RNA, 17 nt, Mycobacterium leprae
aaccaucagaaaaccgu

SEQ ID NO: 3228812 - RNA, 14 nt, Mycobacterium leprae
aaccauccagccua

SEQ ID NO: 3228813 - RNA, 17 nt, Mycobacterium leprae
aaccauccggcaaaaau

SEQ ID NO: 3228814 - RNA, 17 nt, Mycobacterium leprae
aaccaucgucgacgagu

SEQ ID NO: 3228815 - RNA, 16 nt, Mycobacterium leprae
aaccaugccgcgcgcc

SEQ ID NO: 3228816 - RNA, 17 nt, Mycobacterium leprae
aaccccacgucgccggu

SEQ ID NO: 3228817 - RNA, 14 nt, Mycobacterium leprae
aaccccgcggaagc

SEQ ID NO: 3228818 - RNA, 14 nt, Mycobacterium leprae
aacccgaaaccaag

SEQ ID NO: 3228819 - RNA, 22 nt, Mycobacterium leprae
aacccggggguaguaguucacg

SEQ ID NO: 3228820 - RNA, 11 nt, Mycobacterium leprae
aacccguuguc

SEQ ID NO: 3228821 - RNA, 20 nt, Mycobacterium leprae
aaccgauuuucucggcagca

SEQ ID NO: 3228822 - RNA, 21 nt, Mycobacterium leprae
aaccgcacagagcccagcacg

SEQ ID NO: 3228823 - RNA, 20 nt, Mycobacterium leprae
aaccgcucgauggccagccg

SEQ ID NO: 3228824 - RNA, 22 nt, Mycobacterium leprae
aaccgcucgauggccagccguc

SEQ ID NO: 3228825 - RNA, 18 nt, Mycobacterium leprae
aaccggucaaucagguug

SEQ ID NO: 3228826 - RNA, 19 nt, Mycobacterium leprae
aaccggugauugccgcggu

SEQ ID NO: 3228827 - RNA, 18 nt, Mycobacterium leprae
aaccgguuugauccagcc

SEQ ID NO: 3228828 - RNA, 23 nt, Mycobacterium leprae
aaccgucggaaacacagcaagca

SEQ ID NO: 3228829 - RNA, 14 nt, Mycobacterium leprae
aaccgugucggccc

SEQ ID NO: 3228830 - RNA, 18 nt, Mycobacterium leprae
aaccguucgacuucuggu

SEQ ID NO: 3228831 - RNA, 16 nt, Mycobacterium leprae
aaccuaauuagucuag

SEQ ID NO: 3228832 - RNA, 21 nt, Mycobacterium leprae
aaccugcgcggcugccgcacc

SEQ ID NO: 3228833 - RNA, 17 nt, Mycobacterium leprae
aaccugcugaucgaauu

SEQ ID NO: 3228834 - RNA, 21 nt, Mycobacterium leprae
aaccugcugaucgaauugacc

SEQ ID NO: 3228835 - RNA, 12 nt, Mycobacterium leprae
aaccuuggucug

SEQ ID NO: 3228836 - RNA, 17 nt, Mycobacterium leprae
aacgaaaccaugccgcc

SEQ ID NO: 3228837 - RNA, 20 nt, Mycobacterium leprae
aacgacuugaccagccgcag

SEQ ID NO: 3228838 - RNA, 23 nt, Mycobacterium leprae
aacgagauccgagaucaguguga

SEQ ID NO: 3228839 - RNA, 19 nt, Mycobacterium leprae
aacgagauugccgacgccg

SEQ ID NO: 3228840 - RNA, 19 nt, Mycobacterium leprae
aacgauaugagcuccacug

SEQ ID NO: 3228841 - RNA, 19 nt, Mycobacterium leprae
aacgcacguaguuguacac

SEQ ID NO: 3228842 - RNA, 22 nt, Mycobacterium leprae
aacgcacuggagagcgccgcua

SEQ ID NO: 3228843 - RNA, 23 nt, Mycobacterium leprae
aacgcacugguuucggucgucau

SEQ ID NO: 3228844 - RNA, 18 nt, Mycobacterium leprae
aacgcagcgcgaacaaga

SEQ ID NO: 3228845 - RNA, 16 nt, Mycobacterium leprae
aacgcgcaccuggugg

SEQ ID NO: 3228846 - RNA, 15 nt, Mycobacterium leprae
aacgcgguguucguc

SEQ ID NO: 3228847 - RNA, 17 nt, Mycobacterium leprae
aacgcucaacuguucgg

SEQ ID NO: 3228848 - RNA, 13 nt, Mycobacterium leprae
aacgcugaccagc

SEQ ID NO: 3228849 - RNA, 14 nt, Mycobacterium leprae
aacgcugaccagca

SEQ ID NO: 3228850 - RNA, 17 nt, Mycobacterium leprae
aacgcugauugccaacu

SEQ ID NO: 3228851 - RNA, 20 nt, Mycobacterium leprae
aacgcugcacauucaaccag

SEQ ID NO: 3228852 - RNA, 13 nt, Mycobacterium leprae
aacgcugcccacc

SEQ ID NO: 3228853 - RNA, 13 nt, Mycobacterium leprae
aacgcuggcggcg

SEQ ID NO: 3228854 - RNA, 16 nt, Mycobacterium leprae
aacggaaaggucucua

SEQ ID NO: 3228855 - RNA, 15 nt, Mycobacterium leprae
aacggcaccaaaccc

SEQ ID NO: 3228856 - RNA, 16 nt, Mycobacterium leprae
aacggcaccaaacccg

SEQ ID NO: 3228857 - RNA, 22 nt, Mycobacterium leprae
aacggccuguucgggcgcccgg

SEQ ID NO: 3228858 - RNA, 12 nt, Mycobacterium leprae
aacggcggggcg

SEQ ID NO: 3228859 - RNA, 13 nt, Mycobacterium leprae
aacggcgguggca

SEQ ID NO: 3228860 - RNA, 13 nt, Mycobacterium leprae
aacgggacaaguc

SEQ ID NO: 3228861 - RNA, 20 nt, Mycobacterium leprae
aacggggucgucggccaggc

SEQ ID NO: 3228862 - RNA, 21 nt, Mycobacterium leprae
aacggggucgucggccaggcu

SEQ ID NO: 3228863 - RNA, 15 nt, Mycobacterium leprae
aacgguguugccauu

SEQ ID NO: 3228864 - RNA, 15 nt, Mycobacterium leprae
aacguccaguauguc

SEQ ID NO: 3228865 - RNA, 20 nt, Mycobacterium leprae
aacguccaguaugucgucaa

SEQ ID NO: 3228866 - RNA, 13 nt, Mycobacterium leprae
aacguggcaccaa

SEQ ID NO: 3228867 - RNA, 17 nt, Mycobacterium leprae
aacguguuuaggaaaca

SEQ ID NO: 3228868 - RNA, 17 nt, Mycobacterium leprae
aacguugacugggaaca

SEQ ID NO: 3228869 - RNA, 15 nt, Mycobacterium leprae
aacguugcugcuggu

SEQ ID NO: 3228870 - RNA, 14 nt, Mycobacterium leprae
aacguuucgccgca

SEQ ID NO: 3228871 - RNA, 21 nt, Mycobacterium leprae
aacguuugcugcaaugccgga

SEQ ID NO: 3228872 - RNA, 22 nt, Mycobacterium leprae
aacuaagccgaguugaagugcu

SEQ ID NO: 3228873 - RNA, 17 nt, Mycobacterium leprae
aacuacgugugcucgcu

SEQ ID NO: 3228874 - RNA, 14 nt, Mycobacterium leprae
aacuagcgggcucu

SEQ ID NO: 3228875 - RNA, 14 nt, Mycobacterium leprae
aacuauccucacac

SEQ ID NO: 3228876 - RNA, 17 nt, Mycobacterium leprae
aacuauugugccacaac

SEQ ID NO: 3228877 - RNA, 22 nt, Mycobacterium leprae
aacucauaguguucgcauuccg

SEQ ID NO: 3228878 - RNA, 15 nt, Mycobacterium leprae
aacucaucggcuccc

SEQ ID NO: 3228879 - RNA, 13 nt, Mycobacterium leprae
aacuccugaucgg

SEQ ID NO: 3228880 - RNA, 16 nt, Mycobacterium leprae
aacugaucgucgcagg

SEQ ID NO: 3228881 - RNA, 20 nt, Mycobacterium leprae
aacugcagcuaaucccaugg

SEQ ID NO: 3228882 - RNA, 15 nt, Mycobacterium leprae
aacugcggguagauc

SEQ ID NO: 3228883 - RNA, 14 nt, Mycobacterium leprae
aacuggguuucgcg

SEQ ID NO: 3228884 - RNA, 14 nt, Mycobacterium leprae
aacugguggcagcc

SEQ ID NO: 3228885 - RNA, 17 nt, Mycobacterium leprae
aacugucgguaaugcaa

SEQ ID NO: 3228886 - RNA, 17 nt, Mycobacterium leprae
aauaacguuugcugcaa

SEQ ID NO: 3228887 - RNA, 12 nt, Mycobacterium leprae
aauaacuauaau

SEQ ID NO: 3228888 - RNA, 22 nt, Mycobacterium leprae
aauaagaaagaauuuaccggcg

SEQ ID NO: 3228889 - RNA, 15 nt, Mycobacterium leprae
aauaauauccaaaga

SEQ ID NO: 3228890 - RNA, 21 nt, Mycobacterium leprae
aauaaucacagccuccgaaaa

SEQ ID NO: 3228891 - RNA, 20 nt, Mycobacterium leprae
aauacggcacgccgaacagc

SEQ ID NO: 3228892 - RNA, 15 nt, Mycobacterium leprae
aauacgggcucacgg

SEQ ID NO: 3228893 - RNA, 13 nt, Mycobacterium leprae
aauagaccagcgu

SEQ ID NO: 3228894 - RNA, 21 nt, Mycobacterium leprae
aauagaccgaguccccguguu

SEQ ID NO: 3228895 - RNA, 17 nt, Mycobacterium leprae
aauaguauuauugacau

SEQ ID NO: 3228896 - RNA, 15 nt, Mycobacterium leprae
aauaguggcugaugu

SEQ ID NO: 3228897 - RNA, 15 nt, Mycobacterium leprae
aauauacgaaucccg

SEQ ID NO: 3228898 - RNA, 15 nt, Mycobacterium leprae
aauaucgagcuaaac

SEQ ID NO: 3228899 - RNA, 21 nt, Mycobacterium leprae
aauaucgcuacccuugagcac

SEQ ID NO: 3228900 - RNA, 23 nt, Mycobacterium leprae
aauaucgcuacccuugagcaccc

SEQ ID NO: 3228901 - RNA, 19 nt, Mycobacterium leprae
aauaugcccagcagauggc

SEQ ID NO: 3228902 - RNA, 14 nt, Mycobacterium leprae
aaucaaccaggcaa

SEQ ID NO: 3228903 - RNA, 16 nt, Mycobacterium leprae
aaucacgcccagcgca

SEQ ID NO: 3228904 - RNA, 19 nt, Mycobacterium leprae
aaucacgcccagcgcagcc

SEQ ID NO: 3228905 - RNA, 16 nt, Mycobacterium leprae
aaucagaugaccggcu

SEQ ID NO: 3228906 - RNA, 22 nt, Mycobacterium leprae
aaucagcaucgacagcacccag

SEQ ID NO: 3228907 - RNA, 18 nt, Mycobacterium leprae
aaucagcccaacgcugcc

SEQ ID NO: 3228908 - RNA, 18 nt, Mycobacterium leprae
aaucagucgggccaggcc

SEQ ID NO: 3228909 - RNA, 20 nt, Mycobacterium leprae
aaucauagugaccaaaauuu

SEQ ID NO: 3228910 - RNA, 13 nt, Mycobacterium leprae
aauccagccgagg

SEQ ID NO: 3228911 - RNA, 18 nt, Mycobacterium leprae
aaucccagcguucuccac

SEQ ID NO: 3228912 - RNA, 19 nt, Mycobacterium leprae
aauccccgauccagacagc

SEQ ID NO: 3228913 - RNA, 22 nt, Mycobacterium leprae
aaucccgcuaugugcaaucgau

SEQ ID NO: 3228914 - RNA, 24 nt, Mycobacterium leprae
aauccgccucgguguucgacaugg

SEQ ID NO: 3228915 - RNA, 14 nt, Mycobacterium leprae
aauccguauugguu

SEQ ID NO: 3228916 - RNA, 19 nt, Mycobacterium leprae
aauccuagaaaauccaagu

SEQ ID NO: 3228917 - RNA, 21 nt, Mycobacterium leprae
aauccuagcguugguggcuac

SEQ ID NO: 3228918 - RNA, 17 nt, Mycobacterium leprae
aauccucacccgcgauc

SEQ ID NO: 3228919 - RNA, 14 nt, Mycobacterium leprae
aauccucagcgucc

SEQ ID NO: 3228920 - RNA, 18 nt, Mycobacterium leprae
aauccucagcgucccaac

SEQ ID NO: 3228921 - RNA, 22 nt, Mycobacterium leprae
aauccugcguagcaagguguug

SEQ ID NO: 3228922 - RNA, 21 nt, Mycobacterium leprae
aauccuucauguccuacacaa

SEQ ID NO: 3228923 - RNA, 22 nt, Mycobacterium leprae
aauccuucauguccuacacaaa

SEQ ID NO: 3228924 - RNA, 22 nt, Mycobacterium leprae
aauccuuugcugguggaaggcc

SEQ ID NO: 3228925 - RNA, 12 nt, Mycobacterium leprae
aaucgaaaaaug

SEQ ID NO: 3228926 - RNA, 17 nt, Mycobacterium leprae
aaucgaaaaaugccgga

SEQ ID NO: 3228927 - RNA, 17 nt, Mycobacterium leprae
aaucgacguuugcaggu

SEQ ID NO: 3228928 - RNA, 14 nt, Mycobacterium leprae
aaucgagaauuuac

SEQ ID NO: 3228929 - RNA, 18 nt, Mycobacterium leprae
aaucgagaauuuaccggc

SEQ ID NO: 3228930 - RNA, 12 nt, Mycobacterium leprae
aaucgaguucug

SEQ ID NO: 3228931 - RNA, 23 nt, Mycobacterium leprae
aaucgcccugcuuaugcgugcug

SEQ ID NO: 3228932 - RNA, 14 nt, Mycobacterium leprae
aaucgccggcguug

SEQ ID NO: 3228933 - RNA, 21 nt, Mycobacterium leprae
aaucgccuaaagcggcaagca

SEQ ID NO: 3228934 - RNA, 12 nt, Mycobacterium leprae
aaucgcggcaca

SEQ ID NO: 3228935 - RNA, 18 nt, Mycobacterium leprae
aaucgguggcagccggcu

SEQ ID NO: 3228936 - RNA, 15 nt, Mycobacterium leprae
aaucguccaggguga

SEQ ID NO: 3228937 - RNA, 12 nt, Mycobacterium leprae
aaucguccgcgu

SEQ ID NO: 3228938 - RNA, 23 nt, Mycobacterium leprae
aaucgucggcuaacucgaacauc

SEQ ID NO: 3228939 - RNA, 14 nt, Mycobacterium leprae
aaucugaugacgcg

SEQ ID NO: 3228940 - RNA, 14 nt, Mycobacterium leprae
aaucuucaauuuuc

SEQ ID NO: 3228941 - RNA, 15 nt, Mycobacterium leprae
aaugaauguguucaa

SEQ ID NO: 3228942 - RNA, 19 nt, Mycobacterium leprae
aaugcagcaacgugcaguc

SEQ ID NO: 3228943 - RNA, 13 nt, Mycobacterium leprae
aaugcaggugacc

SEQ ID NO: 3228944 - RNA, 15 nt, Mycobacterium leprae
aaugcauuggaugag

SEQ ID NO: 3228945 - RNA, 17 nt, Mycobacterium leprae
aaugccgacagugccac

SEQ ID NO: 3228946 - RNA, 12 nt, Mycobacterium leprae
aaugccggaacc

SEQ ID NO: 3228947 - RNA, 14 nt, Mycobacterium leprae
aaugccgguggcca

SEQ ID NO: 3228948 - RNA, 15 nt, Mycobacterium leprae
aaugcuaugauaauu

SEQ ID NO: 3228949 - RNA, 23 nt, Mycobacterium leprae
aaugcuaugauaauuuggcugau

SEQ ID NO: 3228950 - RNA, 17 nt, Mycobacterium leprae
aaugcucugcugaucag

SEQ ID NO: 3228951 - RNA, 14 nt, Mycobacterium leprae
aauggacagaacac

SEQ ID NO: 3228952 - RNA, 20 nt, Mycobacterium leprae
aauggcacugauacugaugu

SEQ ID NO: 3228953 - RNA, 14 nt, Mycobacterium leprae
aauggcagccacca

SEQ ID NO: 3228954 - RNA, 16 nt, Mycobacterium leprae
aauggccggcgccugg

SEQ ID NO: 3228955 - RNA, 13 nt, Mycobacterium leprae
aauggugcaaggg

SEQ ID NO: 3228956 - RNA, 17 nt, Mycobacterium leprae
aaugucaauaacguuug

SEQ ID NO: 3228957 - RNA, 17 nt, Mycobacterium leprae
aauguccaccagccgca

SEQ ID NO: 3228958 - RNA, 20 nt, Mycobacterium leprae
aaugucucggugucggacuu

SEQ ID NO: 3228959 - RNA, 15 nt, Mycobacterium leprae
aaugugccacgucga

SEQ ID NO: 3228960 - RNA, 22 nt, Mycobacterium leprae
aauguggccgcaccugaacagg

SEQ ID NO: 3228961 - RNA, 22 nt, Mycobacterium leprae
aaugugggcuuuccuucagugc

SEQ ID NO: 3228962 - RNA, 22 nt, Mycobacterium leprae
aauguugagugcgaccugaaca

SEQ ID NO: 3228963 - RNA, 17 nt, Mycobacterium leprae
aauguuguuagugcugc

SEQ ID NO: 3228964 - RNA, 14 nt, Mycobacterium leprae
aauuauaaaguuau

SEQ ID NO: 3228965 - RNA, 14 nt, Mycobacterium leprae
aauuauuccaaucc

SEQ ID NO: 3228966 - RNA, 20 nt, Mycobacterium leprae
aauuccauuccguugaacuu

SEQ ID NO: 3228967 - RNA, 12 nt, Mycobacterium leprae
aauucgccgacc

SEQ ID NO: 3228968 - RNA, 15 nt, Mycobacterium leprae
aauucgcucgccggg

SEQ ID NO: 3228969 - RNA, 21 nt, Mycobacterium leprae
aauucggcgauauccgccggc

SEQ ID NO: 3228970 - RNA, 15 nt, Mycobacterium leprae
aauucuucucuaaaa

SEQ ID NO: 3228971 - RNA, 17 nt, Mycobacterium leprae
aauucuucucuaaaaag

SEQ ID NO: 3228972 - RNA, 21 nt, Mycobacterium leprae
aauucuucucuaaaaagauau

SEQ ID NO: 3228973 - RNA, 20 nt, Mycobacterium leprae
aauugcgauaaugcacugcg

SEQ ID NO: 3228974 - RNA, 22 nt, Mycobacterium leprae
aauuggcuccccgaaugcaaug

SEQ ID NO: 3228975 - RNA, 17 nt, Mycobacterium leprae
aauuggguaaagugaac

SEQ ID NO: 3228976 - RNA, 18 nt, Mycobacterium leprae
aauugucguuaugcggug

SEQ ID NO: 3228977 - RNA, 22 nt, Mycobacterium leprae
aauuuagaggcugcaccggcuu

SEQ ID NO: 3228978 - RNA, 17 nt, Mycobacterium leprae
aauuuaguuaacgugcc

SEQ ID NO: 3228979 - RNA, 17 nt, Mycobacterium leprae
aauuuccguaccagaug

SEQ ID NO: 3228980 - RNA, 19 nt, Mycobacterium leprae
aauuucuucucguccaggc

SEQ ID NO: 3228981 - RNA, 12 nt, Mycobacterium leprae
aauuugaagcug

SEQ ID NO: 3228982 - RNA, 20 nt, Mycobacterium leprae
aauuugccaucaaaugggga

SEQ ID NO: 3228983 - RNA, 20 nt, Mycobacterium leprae
aauuuuguguacuggacccg

SEQ ID NO: 3228984 - RNA, 19 nt, Mycobacterium leprae
acaaaaccgcggagcuuga

SEQ ID NO: 3228985 - RNA, 12 nt, Mycobacterium leprae
acaaaauuugca

SEQ ID NO: 3228986 - RNA, 22 nt, Mycobacterium leprae
acaaaauuugcacgauuggcuu

SEQ ID NO: 3228987 - RNA, 12 nt, Mycobacterium leprae
acaaagaagaau

SEQ ID NO: 3228988 - RNA, 15 nt, Mycobacterium leprae
acaaagcccacgccu

SEQ ID NO: 3228989 - RNA, 10 nt, Mycobacterium leprae
acaaagcuca

SEQ ID NO: 3228990 - RNA, 16 nt, Mycobacterium leprae
acaaaggugcccacca

SEQ ID NO: 3228991 - RNA, 19 nt, Mycobacterium leprae
acaaaucauagugaccaaa

SEQ ID NO: 3228992 - RNA, 22 nt, Mycobacterium leprae
acaaaucauagugaccaaaauu

SEQ ID NO: 3228993 - RNA, 13 nt, Mycobacterium leprae
acaacaagagaag

SEQ ID NO: 3228994 - RNA, 18 nt, Mycobacterium leprae
acaacaagagaagagcug

SEQ ID NO: 3228995 - RNA, 19 nt, Mycobacterium leprae
acaacaagagaagagcugg

SEQ ID NO: 3228996 - RNA, 12 nt, Mycobacterium leprae
acaacaccacuu

SEQ ID NO: 3228997 - RNA, 13 nt, Mycobacterium leprae
acaacaccacuuc

SEQ ID NO: 3228998 - RNA, 17 nt, Mycobacterium leprae
acaaccgcgauguuuug

SEQ ID NO: 3228999 - RNA, 21 nt, Mycobacterium leprae
acccuggaauccgcgcagggc

SEQ ID NO: 3229000 - RNA, 18 nt, Mycobacterium leprae
acccuggcugggcugcug

SEQ ID NO: 3229001 - RNA, 23 nt, Mycobacterium leprae
acccuggcugggcugcugccgaa

SEQ ID NO: 3229002 - RNA, 18 nt, Mycobacterium leprae
accgaaaaccacaagcag

SEQ ID NO: 3229003 - RNA, 13 nt, Mycobacterium leprae
accgaaagccgca

SEQ ID NO: 3229004 - RNA, 14 nt, Mycobacterium leprae
accgaaagccgcac

SEQ ID NO: 3229005 - RNA, 16 nt, Mycobacterium leprae
accgaacaacgaacag

SEQ ID NO: 3229006 - RNA, 22 nt, Mycobacterium leprae
accgaagaucaccgccaccacg

SEQ ID NO: 3229007 - RNA, 19 nt, Mycobacterium leprae
accgaaucguuccacccga

SEQ ID NO: 3229008 - RNA, 17 nt, Mycobacterium leprae
accgacacacccaucaa

SEQ ID NO: 3229009 - RNA, 22 nt, Mycobacterium leprae
accgacagguugaaaaagaaag

SEQ ID NO: 3229010 - RNA, 14 nt, Mycobacterium leprae
accgaccuucgcga

SEQ ID NO: 3229011 - RNA, 14 nt, Mycobacterium leprae
accgacgagcaacc

SEQ ID NO: 3229012 - RNA, 21 nt, Mycobacterium leprae
accgacgcaaucuacuggaug

SEQ ID NO: 3229013 - RNA, 15 nt, Mycobacterium leprae
accgacggaugccca

SEQ ID NO: 3229014 - RNA, 15 nt, Mycobacterium leprae
accgacggcgccgca

SEQ ID NO: 3229015 - RNA, 21 nt, Mycobacterium leprae
accgacguauccaaggugaug

SEQ ID NO: 3229016 - RNA, 12 nt, Mycobacterium leprae
accgagccgguc

SEQ ID NO: 3229017 - RNA, 20 nt, Mycobacterium leprae
accgagccggucgaucgcag

SEQ ID NO: 3229018 - RNA, 22 nt, Mycobacterium leprae
accgaggaaugccuggguggug

SEQ ID NO: 3229019 - RNA, 23 nt, Mycobacterium leprae
accgaguuuggcugacacuucuu

SEQ ID NO: 3229020 - RNA, 16 nt, Mycobacterium leprae
accgauaccagcggca

SEQ ID NO: 3229021 - RNA, 15 nt, Mycobacterium leprae
accgauacgccaguc

SEQ ID NO: 3229022 - RNA, 22 nt, Mycobacterium leprae
accgauauggcgaucaugagca

SEQ ID NO: 3229023 - RNA, 20 nt, Mycobacterium leprae
accgauccgguguggaguga

SEQ ID NO: 3229024 - RNA, 19 nt, Mycobacterium leprae
accgauugccugaugccau

SEQ ID NO: 3229025 - RNA, 23 nt, Mycobacterium leprae
accgcaaucgaaaaaugccggaa

SEQ ID NO: 3229026 - RNA, 20 nt, Mycobacterium leprae
accgcacaguuccagugccu

SEQ ID NO: 3229027 - RNA, 21 nt, Mycobacterium leprae
accgcaccgaucugcccagca

SEQ ID NO: 3229028 - RNA, 13 nt, Mycobacterium leprae
accgcaggcgagc

SEQ ID NO: 3229029 - RNA, 21 nt, Mycobacterium leprae
accgcauacuggcacgccagc

SEQ ID NO: 3229030 - RNA, 13 nt, Mycobacterium leprae
accgcaucaccga

SEQ ID NO: 3229031 - RNA, 14 nt, Mycobacterium leprae
accgcaucaccgau

SEQ ID NO: 3229032 - RNA, 16 nt, Mycobacterium leprae
accgcauccggcgcca

SEQ ID NO: 3229033 - RNA, 20 nt, Mycobacterium leprae
accgccccgcuguaucgucc

SEQ ID NO: 3229034 - RNA, 17 nt, Mycobacterium leprae
accgcccgguagcacca

SEQ ID NO: 3229035 - RNA, 19 nt, Mycobacterium leprae
accgccggcaagcccgguu

SEQ ID NO: 3229036 - RNA, 18 nt, Mycobacterium leprae
accgccgguuucgcccca

SEQ ID NO: 3229037 - RNA, 17 nt, Mycobacterium leprae
accgcgaacgccucggc

SEQ ID NO: 3229038 - RNA, 12 nt, Mycobacterium leprae
accgcgacgcca

SEQ ID NO: 3229039 - RNA, 20 nt, Mycobacterium leprae
accgcggggcuaugccgcgc

SEQ ID NO: 3229040 - RNA, 22 nt, Mycobacterium leprae
accgcgguaauagcaauaacca

SEQ ID NO: 3229041 - RNA, 20 nt, Mycobacterium leprae
accgcgguaggccagguuag

SEQ ID NO: 3229042 - RNA, 17 nt, Mycobacterium leprae
accgcggugcagugccg

SEQ ID NO: 3229043 - RNA, 17 nt, Mycobacterium leprae
accgcucgauggccagc

SEQ ID NO: 3229044 - RNA, 13 nt, Mycobacterium leprae
accgcuguggcag

SEQ ID NO: 3229045 - RNA, 16 nt, Mycobacterium leprae
accgcuucagagugca

SEQ ID NO: 3229046 - RNA, 14 nt, Mycobacterium leprae
accggaauuccgac

SEQ ID NO: 3229047 - RNA, 18 nt, Mycobacterium leprae
accggaccaucgucaguc

SEQ ID NO: 3229048 - RNA, 23 nt, Mycobacterium leprae
accggagcacuccuucaugcugg

SEQ ID NO: 3229049 - RNA, 13 nt, Mycobacterium leprae
accggauggcugc

SEQ ID NO: 3229050 - RNA, 20 nt, Mycobacterium leprae
accggccaaaagccuugcgu

SEQ ID NO: 3229051 - RNA, 15 nt, Mycobacterium leprae
accggccaaaauggc

SEQ ID NO: 3229052 - RNA, 15 nt, Mycobacterium leprae
accggccaaccacag

SEQ ID NO: 3229053 - RNA, 13 nt, Mycobacterium leprae
accggccaccacg

SEQ ID NO: 3229054 - RNA, 14 nt, Mycobacterium leprae
accggcggcgagca

SEQ ID NO: 3229055 - RNA, 10 nt, Mycobacterium leprae
accggcgucu

SEQ ID NO: 3229056 - RNA, 18 nt, Mycobacterium leprae
accggcguuuccaaaacc

SEQ ID NO: 3229057 - RNA, 19 nt, Mycobacterium leprae
accggcugcacccgucgcu

SEQ ID NO: 3229058 - RNA, 13 nt, Mycobacterium leprae
accggcugcaccu

SEQ ID NO: 3229059 - RNA, 21 nt, Mycobacterium leprae
accggcuuagcccgcugcugc

SEQ ID NO: 3229060 - RNA, 16 nt, Mycobacterium leprae
accgggaugugugcgc

SEQ ID NO: 3229061 - RNA, 23 nt, Mycobacterium leprae
accgggggucguagggucgagau

SEQ ID NO: 3229062 - RNA, 19 nt, Mycobacterium leprae
accgggguacaauaaacug

SEQ ID NO: 3229063 - RNA, 13 nt, Mycobacterium leprae
accgguccggaua

SEQ ID NO: 3229064 - RNA, 15 nt, Mycobacterium leprae
accggugauguggcc

SEQ ID NO: 3229065 - RNA, 17 nt, Mycobacterium leprae
accggugauguggccgu

SEQ ID NO: 3229066 - RNA, 14 nt, Mycobacterium leprae
accggugcugcagc

SEQ ID NO: 3229067 - RNA, 17 nt, Mycobacterium leprae
accggugcugcagccac

SEQ ID NO: 3229068 - RNA, 21 nt, Mycobacterium leprae
accgguggguuugacgcauga

SEQ ID NO: 3229069 - RNA, 22 nt, Mycobacterium leprae
accgguugccgaaccucgccac

SEQ ID NO: 3229070 - RNA, 16 nt, Mycobacterium leprae
accgguuugauccagc

SEQ ID NO: 3229071 - RNA, 19 nt, Mycobacterium leprae
accguagucacuauauaua

SEQ ID NO: 3229072 - RNA, 20 nt, Mycobacterium leprae
accguauccuggucaucugu

SEQ ID NO: 3229073 - RNA, 14 nt, Mycobacterium leprae
accgucaugcugcu

SEQ ID NO: 3229074 - RNA, 23 nt, Mycobacterium leprae
accguccguccugccggugcggu

SEQ ID NO: 3229075 - RNA, 16 nt, Mycobacterium leprae
accguccucggcggca

SEQ ID NO: 3229076 - RNA, 22 nt, Mycobacterium leprae
accguccucggcggcaccuccc

SEQ ID NO: 3229077 - RNA, 15 nt, Mycobacterium leprae
accgucuuugcuaac

SEQ ID NO: 3229078 - RNA, 22 nt, Mycobacterium leprae
accgugcacggggacgugccug

SEQ ID NO: 3229079 - RNA, 13 nt, Mycobacterium leprae
accgugcagcugc

SEQ ID NO: 3229080 - RNA, 14 nt, Mycobacterium leprae
accgugcagcugcc

SEQ ID NO: 3229081 - RNA, 20 nt, Mycobacterium leprae
accgugcagcugccaaccgg

SEQ ID NO: 3229082 - RNA, 24 nt, Mycobacterium leprae
accguggccggcccccguaugauc

SEQ ID NO: 3229083 - RNA, 18 nt, Mycobacterium leprae
accgugguguugucgccg

SEQ ID NO: 3229084 - RNA, 19 nt, Mycobacterium leprae
accgugguguugucgccga

SEQ ID NO: 3229085 - RNA, 20 nt, Mycobacterium leprae
accgugguguugucgccgaa

SEQ ID NO: 3229086 - RNA, 12 nt, Mycobacterium leprae
accguuaauaua

SEQ ID NO: 3229087 - RNA, 20 nt, Mycobacterium leprae
accuaagccaagcucagcgc

SEQ ID NO: 3229088 - RNA, 21 nt, Mycobacterium leprae
accuacaacuucaaccaagcc

SEQ ID NO: 3229089 - RNA, 16 nt, Mycobacterium leprae
accuagucgaggcuca

SEQ ID NO: 3229090 - RNA, 15 nt, Mycobacterium leprae
accuaucgacauccu

SEQ ID NO: 3229091 - RNA, 22 nt, Mycobacterium leprae
accuauucaaccgguuuccuca

SEQ ID NO: 3229092 - RNA, 21 nt, Mycobacterium leprae
accucaaggccaugacaugca

SEQ ID NO: 3229093 - RNA, 15 nt, Mycobacterium leprae
accucacccaguccu

SEQ ID NO: 3229094 - RNA, 22 nt, Mycobacterium leprae
accucacgauuucggcucagca

SEQ ID NO: 3229095 - RNA, 14 nt, Mycobacterium leprae
accucaucccacag

SEQ ID NO: 3229096 - RNA, 18 nt, Mycobacterium leprae
accuccgcagcaucggca

SEQ ID NO: 3229097 - RNA, 16 nt, Mycobacterium leprae
accuccuugaccacca

SEQ ID NO: 3229098 - RNA, 19 nt, Mycobacterium leprae
accucggcgcuggggcgcu

SEQ ID NO: 3229099 - RNA, 15 nt, Mycobacterium leprae
accucguauggcgcc

SEQ ID NO: 3229100 - RNA, 14 nt, Mycobacterium leprae
accugcauggacga

SEQ ID NO: 3229101 - RNA, 13 nt, Mycobacterium leprae
accugccgcagcg

SEQ ID NO: 3229102 - RNA, 16 nt, Mycobacterium leprae
accugccuagcaacgu

SEQ ID NO: 3229103 - RNA, 22 nt, Mycobacterium leprae
accugcgacagccgugccucgc

SEQ ID NO: 3229104 - RNA, 17 nt, Mycobacterium leprae
accugcgagaucggguu

SEQ ID NO: 3229105 - RNA, 17 nt, Mycobacterium leprae
accugcugaucgaauug

SEQ ID NO: 3229106 - RNA, 16 nt, Mycobacterium leprae
accuggucaccaaccg

SEQ ID NO: 3229107 - RNA, 22 nt, Mycobacterium leprae
accuggucaccaaccggccggc

SEQ ID NO: 3229108 - RNA, 19 nt, Mycobacterium leprae
accugguucuuuugauugg

SEQ ID NO: 3229109 - RNA, 18 nt, Mycobacterium leprae
accugugcguaaggaaga

SEQ ID NO: 3229110 - RNA, 23 nt, Mycobacterium leprae
accuguuggugagauuucagccg

SEQ ID NO: 3229111 - RNA, 16 nt, Mycobacterium leprae
acggcuggcugcugca

SEQ ID NO: 3229112 - RNA, 20 nt, Mycobacterium leprae
acggcuuaaguaggcgguca

SEQ ID NO: 3229113 - RNA, 15 nt, Mycobacterium leprae
acggcuuugcaaagc

SEQ ID NO: 3229114 - RNA, 16 nt, Mycobacterium leprae
acgggaagugguggca

SEQ ID NO: 3229115 - RNA, 21 nt, Mycobacterium leprae
acgggaagugguggcacuuuu

SEQ ID NO: 3229116 - RNA, 17 nt, Mycobacterium leprae
acgggaggaacuccgug

SEQ ID NO: 3229117 - RNA, 16 nt, Mycobacterium leprae
acgggaucgacaaaau

SEQ ID NO: 3229118 - RNA, 22 nt, Mycobacterium leprae
acgggcaccagauggcuccccg

SEQ ID NO: 3229119 - RNA, 22 nt, Mycobacterium leprae
acgggcaugcaguacguguggu

SEQ ID NO: 3229120 - RNA, 14 nt, Mycobacterium leprae
acgggcggccaggc

SEQ ID NO: 3229121 - RNA, 17 nt, Mycobacterium leprae
acgggcucacggggcug

SEQ ID NO: 3229122 - RNA, 19 nt, Mycobacterium leprae
acgggcucacggggcuggg

SEQ ID NO: 3229123 - RNA, 13 nt, Mycobacterium leprae
acggggagaucga

SEQ ID NO: 3229124 - RNA, 13 nt, Mycobacterium leprae
acggggcuggguc

SEQ ID NO: 3229125 - RNA, 21 nt, Mycobacterium leprae
acgggugguuagaaucgccug

SEQ ID NO: 3229126 - RNA, 19 nt, Mycobacterium leprae
acgguaacugaccaagaag

SEQ ID NO: 3229127 - RNA, 22 nt, Mycobacterium leprae
acgguaauaaggcgucaagcag

SEQ ID NO: 3229128 - RNA, 13 nt, Mycobacterium leprae
acgguauauuaac

SEQ ID NO: 3229129 - RNA, 23 nt, Mycobacterium leprae
acgguauuugcugucguggcugc

SEQ ID NO: 3229130 - RNA, 17 nt, Mycobacterium leprae
acggucaaaggcaucca

SEQ ID NO: 3229131 - RNA, 13 nt, Mycobacterium leprae
acggucaacggcc

SEQ ID NO: 3229132 - RNA, 16 nt, Mycobacterium leprae
acgguccugguggcaa

SEQ ID NO: 3229133 - RNA, 15 nt, Mycobacterium leprae
acggucgcacgaccu

SEQ ID NO: 3229134 - RNA, 22 nt, Mycobacterium leprae
acggucgcucggacugggcuca

SEQ ID NO: 3229135 - RNA, 15 nt, Mycobacterium leprae
acggucgcugcuacc

SEQ ID NO: 3229136 - RNA, 23 nt, Mycobacterium leprae
acggucuuucgcagaagaccgug

SEQ ID NO: 3229137 - RNA, 12 nt, Mycobacterium leprae
acggugcaggug

SEQ ID NO: 3229138 - RNA, 19 nt, Mycobacterium leprae
acggugcaggugccaguga

SEQ ID NO: 3229139 - RNA, 20 nt, Mycobacterium leprae
acggugcugauggccggccu

SEQ ID NO: 3229140 - RNA, 22 nt, Mycobacterium leprae
acgguguauucauagcgguuuc

SEQ ID NO: 3229141 - RNA, 22 nt, Mycobacterium leprae
acgguuugccaugcacgccggc

SEQ ID NO: 3229142 - RNA, 13 nt, Mycobacterium leprae
acguaaucgccuu

SEQ ID NO: 3229143 - RNA, 12 nt, Mycobacterium leprae
acguaccggauc

SEQ ID NO: 3229144 - RNA, 15 nt, Mycobacterium leprae
acguaccggaucgac

SEQ ID NO: 3229145 - RNA, 16 nt, Mycobacterium leprae
acguagaacaagugca

SEQ ID NO: 3229146 - RNA, 20 nt, Mycobacterium leprae
acguaguccaugaauuacua

SEQ ID NO: 3229147 - RNA, 15 nt, Mycobacterium leprae
acguauagcgaaaau

SEQ ID NO: 3229148 - RNA, 12 nt, Mycobacterium leprae
acgucacgcugc

SEQ ID NO: 3229149 - RNA, 20 nt, Mycobacterium leprae
acgucacgucgacggcggcc

SEQ ID NO: 3229150 - RNA, 16 nt, Mycobacterium leprae
acgucagaagcuggug

SEQ ID NO: 3229151 - RNA, 13 nt, Mycobacterium leprae
acguccgcggcag

SEQ ID NO: 3229152 - RNA, 15 nt, Mycobacterium leprae
acguccucggcccau

SEQ ID NO: 3229153 - RNA, 23 nt, Mycobacterium leprae
acgucgaucagcggccccgcauc

SEQ ID NO: 3229154 - RNA, 16 nt, Mycobacterium leprae
acgucgaucucgacgc

SEQ ID NO: 3229155 - RNA, 23 nt, Mycobacterium leprae
acgucgaugucagcgucguggcu

SEQ ID NO: 3229156 - RNA, 21 nt, Mycobacterium leprae
acgucgccgguagcagcggua

SEQ ID NO: 3229157 - RNA, 22 nt, Mycobacterium leprae
acgucgggcagcaaccgcacag

SEQ ID NO: 3229158 - RNA, 23 nt, Mycobacterium leprae
acgucucgcggugauuggcugag

SEQ ID NO: 3229159 - RNA, 15 nt, Mycobacterium leprae
acgucugucacccgu

SEQ ID NO: 3229160 - RNA, 20 nt, Mycobacterium leprae
acgugacuugaacgguguug

SEQ ID NO: 3229161 - RNA, 17 nt, Mycobacterium leprae
acgugaucgacgaggug

SEQ ID NO: 3229162 - RNA, 14 nt, Mycobacterium leprae
acgugaugcagcau

SEQ ID NO: 3229163 - RNA, 21 nt, Mycobacterium leprae
acgugaugcagcaugugugaa

SEQ ID NO: 3229164 - RNA, 14 nt, Mycobacterium leprae
acgugaugcuaucg

SEQ ID NO: 3229165 - RNA, 16 nt, Mycobacterium leprae
acgugcacugguggug

SEQ ID NO: 3229166 - RNA, 21 nt, Mycobacterium leprae
acgugccggccucgugcugcg

SEQ ID NO: 3229167 - RNA, 14 nt, Mycobacterium leprae
acgugccuguucag

SEQ ID NO: 3229168 - RNA, 18 nt, Mycobacterium leprae
acgugccuguucaggugc

SEQ ID NO: 3229169 - RNA, 15 nt, Mycobacterium leprae
acgugcguaaggugg

SEQ ID NO: 3229170 - RNA, 17 nt, Mycobacterium leprae
acgugcugaggguggcg

SEQ ID NO: 3229171 - RNA, 21 nt, Mycobacterium leprae
acguggcaccaaaaaagucga

SEQ ID NO: 3229172 - RNA, 12 nt, Mycobacterium leprae
acguggcggugu

SEQ ID NO: 3229173 - RNA, 13 nt, Mycobacterium leprae
acgugguggcugc

SEQ ID NO: 3229174 - RNA, 14 nt, Mycobacterium leprae
acgugguggcugca

SEQ ID NO: 3229175 - RNA, 15 nt, Mycobacterium leprae
acguggugguagcca

SEQ ID NO: 3229176 - RNA, 16 nt, Mycobacterium leprae
acguguaaggccagcg

SEQ ID NO: 3229177 - RNA, 18 nt, Mycobacterium leprae
acgugugugacggcuggu

SEQ ID NO: 3229178 - RNA, 18 nt, Mycobacterium leprae
acguguuuugcuguguug

SEQ ID NO: 3229179 - RNA, 17 nt, Mycobacterium leprae
acguuagucuggcuggc

SEQ ID NO: 3229180 - RNA, 17 nt, Mycobacterium leprae
acguucgaucggcagcc

SEQ ID NO: 3229181 - RNA, 20 nt, Mycobacterium leprae
acguucggugacgaacaugc

SEQ ID NO: 3229182 - RNA, 22 nt, Mycobacterium leprae
acguugaugcaucaagcuguga

SEQ ID NO: 3229183 - RNA, 17 nt, Mycobacterium leprae
acguugcgcacugcccg

SEQ ID NO: 3229184 - RNA, 18 nt, Mycobacterium leprae
acguugcgcacugcccgg

SEQ ID NO: 3229185 - RNA, 19 nt, Mycobacterium leprae
acguugcugggacauccgc

SEQ ID NO: 3229186 - RNA, 23 nt, Mycobacterium leprae
acguugcugggacauccgcugau

SEQ ID NO: 3229187 - RNA, 15 nt, Mycobacterium leprae
acguuggacgaccac

SEQ ID NO: 3229188 - RNA, 16 nt, Mycobacterium leprae
acguuggacgaccacg

SEQ ID NO: 3229189 - RNA, 19 nt, Mycobacterium leprae
acguuggacgaccacguca

SEQ ID NO: 3229190 - RNA, 18 nt, Mycobacterium leprae
acguuggccggcaugcga

SEQ ID NO: 3229191 - RNA, 14 nt, Mycobacterium leprae
acguuggcgcucug

SEQ ID NO: 3229192 - RNA, 22 nt, Mycobacterium leprae
acguuguccgcguggaugccca

SEQ ID NO: 3229193 - RNA, 17 nt, Mycobacterium leprae
acguugugacaguucag

SEQ ID NO: 3229194 - RNA, 15 nt, Mycobacterium leprae
acguuugcaggugcu

SEQ ID NO: 3229195 - RNA, 16 nt, Mycobacterium leprae
acuaacguucggugac

SEQ ID NO: 3229196 - RNA, 20 nt, Mycobacterium leprae
acuaacguucggugacgaac

SEQ ID NO: 3229197 - RNA, 23 nt, Mycobacterium leprae
acuaagccccgucgcgagcugaa

SEQ ID NO: 3229198 - RNA, 23 nt, Mycobacterium leprae
acuaagccgaguugaagugcugc

SEQ ID NO: 3229199 - RNA, 13 nt, Mycobacterium leprae
acuaauaagcucg

SEQ ID NO: 3229200 - RNA, 17 nt, Mycobacterium leprae
acuaauccagacaucgg

SEQ ID NO: 3229201 - RNA, 15 nt, Mycobacterium leprae
acuaccccgagauca

SEQ ID NO: 3229202 - RNA, 23 nt, Mycobacterium leprae
acuacggcgacguuuugucuucu

SEQ ID NO: 3229203 - RNA, 17 nt, Mycobacterium leprae
acuacguuggccagcac

SEQ ID NO: 3229204 - RNA, 15 nt, Mycobacterium leprae
acuacuggauuaaua

SEQ ID NO: 3229205 - RNA, 19 nt, Mycobacterium leprae
acuacuggauuaauauuua

SEQ ID NO: 3229206 - RNA, 21 nt, Mycobacterium leprae
acuaggccccagauagcccga

SEQ ID NO: 3229207 - RNA, 15 nt, Mycobacterium leprae
acuaguaaucgcauu

SEQ ID NO: 3229208 - RNA, 19 nt, Mycobacterium leprae
acuauauauauauuaauuc

SEQ ID NO: 3229209 - RNA, 17 nt, Mycobacterium leprae
acuaucgugugcugauc

SEQ ID NO: 3229210 - RNA, 20 nt, Mycobacterium leprae
acuaucugcgugccgagccu

SEQ ID NO: 3229211 - RNA, 23 nt, Mycobacterium leprae
acuaugcuggcuaagacgcucaa

SEQ ID NO: 3229212 - RNA, 17 nt, Mycobacterium leprae
acuauuucccacuggau

SEQ ID NO: 3229213 - RNA, 15 nt, Mycobacterium leprae
acucaauggccugcu

SEQ ID NO: 3229214 - RNA, 19 nt, Mycobacterium leprae
acucaccgguacacaccgc

SEQ ID NO: 3229215 - RNA, 22 nt, Mycobacterium leprae
acucaccgguacacaccgcaca

SEQ ID NO: 3229216 - RNA, 20 nt, Mycobacterium leprae
acucacgcgcagugcaagug

SEQ ID NO: 3229217 - RNA, 18 nt, Mycobacterium leprae
acucagaaaucguucgac

SEQ ID NO: 3229218 - RNA, 15 nt, Mycobacterium leprae
acucagcaaugcucu

SEQ ID NO: 3229219 - RNA, 20 nt, Mycobacterium leprae
acucagugguggggccgcca

SEQ ID NO: 3229220 - RNA, 15 nt, Mycobacterium leprae
acucauguucucaag

SEQ ID NO: 3229221 - RNA, 16 nt, Mycobacterium leprae
acuccacccaaggauu

SEQ ID NO: 3229222 - RNA, 12 nt, Mycobacterium leprae
acuccagcagcg

SEQ ID NO: 3229223 - RNA, 21 nt, Mycobacterium leprae
acuccagcagcguggucaccg

SEQ ID NO: 3229224 - RNA, 20 nt, Mycobacterium leprae
agaacagcaucguauagcac

SEQ ID NO: 3229225 - RNA, 18 nt, Mycobacterium leprae
agaaccaguucuugguaa

SEQ ID NO: 3229226 - RNA, 23 nt, Mycobacterium leprae
agaacuucaagcucauccugggc

SEQ ID NO: 3229227 - RNA, 17 nt, Mycobacterium leprae
agaagcgcugcagcgau

SEQ ID NO: 3229228 - RNA, 18 nt, Mycobacterium leprae
agaaggaugauucgucug

SEQ ID NO: 3229229 - RNA, 15 nt, Mycobacterium leprae
agaagggagugcagu

SEQ ID NO: 3229230 - RNA, 16 nt, Mycobacterium leprae
agaaguaaagcccugu

SEQ ID NO: 3229231 - RNA, 22 nt, Mycobacterium leprae
agaagugguuuuggcaguacca

SEQ ID NO: 3229232 - RNA, 21 nt, Mycobacterium leprae
agaauaaaugccggugcagcu

SEQ ID NO: 3229233 - RNA, 21 nt, Mycobacterium leprae
agaaucgguguuguccgucag

SEQ ID NO: 3229234 - RNA, 16 nt, Mycobacterium leprae
agaaugaaaacuauac

SEQ ID NO: 3229235 - RNA, 21 nt, Mycobacterium leprae
agaauguuguuagugcugcug

SEQ ID NO: 3229236 - RNA, 14 nt, Mycobacterium leprae
agaauuaauauaua

SEQ ID NO: 3229237 - RNA, 20 nt, Mycobacterium leprae
agaauucgccauugcucugg

SEQ ID NO: 3229238 - RNA, 14 nt, Mycobacterium leprae
agaauuuaccggcg

SEQ ID NO: 3229239 - RNA, 17 nt, Mycobacterium leprae
agaauuuaccggcguuc

SEQ ID NO: 3229240 - RNA, 18 nt, Mycobacterium leprae
agacacaguuguuggccu

SEQ ID NO: 3229241 - RNA, 12 nt, Mycobacterium leprae
agacaucgccac

SEQ ID NO: 3229242 - RNA, 16 nt, Mycobacterium leprae
agacaugauugcagau

SEQ ID NO: 3229243 - RNA, 19 nt, Mycobacterium leprae
agacaugauugcagauguu

SEQ ID NO: 3229244 - RNA, 14 nt, Mycobacterium leprae
agacauuucauuau

SEQ ID NO: 3229245 - RNA, 13 nt, Mycobacterium leprae
agaccaagcagca

SEQ ID NO: 3229246 - RNA, 20 nt, Mycobacterium leprae
agaccaccguaagucagaug

SEQ ID NO: 3229247 - RNA, 14 nt, Mycobacterium leprae
agaccacggcagcg

SEQ ID NO: 3229248 - RNA, 20 nt, Mycobacterium leprae
agaccagagauuucgcaggc

SEQ ID NO: 3229249 - RNA, 23 nt, Mycobacterium leprae
agaccaguugcacaucagcaaag

SEQ ID NO: 3229250 - RNA, 10 nt, Mycobacterium leprae
agaccaucac

SEQ ID NO: 3229251 - RNA, 13 nt, Mycobacterium leprae
agaccaugagcac

SEQ ID NO: 3229252 - RNA, 14 nt, Mycobacterium leprae
agaccaugagcaca

SEQ ID NO: 3229253 - RNA, 19 nt, Mycobacterium leprae
agaccaugagcacacgcug

SEQ ID NO: 3229254 - RNA, 18 nt, Mycobacterium leprae
agaccgaaaaccacaagc

SEQ ID NO: 3229255 - RNA, 13 nt, Mycobacterium leprae
agaccgaaaucaa

SEQ ID NO: 3229256 - RNA, 16 nt, Mycobacterium leprae
agaccgaguccccgug

SEQ ID NO: 3229257 - RNA, 14 nt, Mycobacterium leprae
agaccgcccgggga

SEQ ID NO: 3229258 - RNA, 14 nt, Mycobacterium leprae
agaccucccugacg

SEQ ID NO: 3229259 - RNA, 18 nt, Mycobacterium leprae
agaccucccugacgcaca

SEQ ID NO: 3229260 - RNA, 13 nt, Mycobacterium leprae
agaccugccggug

SEQ ID NO: 3229261 - RNA, 15 nt, Mycobacterium leprae
agacgagaucagugc

SEQ ID NO: 3229262 - RNA, 21 nt, Mycobacterium leprae
agacgcauaacgaucuaucug

SEQ ID NO: 3229263 - RNA, 14 nt, Mycobacterium leprae
agacgcgaccgcca

SEQ ID NO: 3229264 - RNA, 17 nt, Mycobacterium leprae
agacgcgaccgccacca

SEQ ID NO: 3229265 - RNA, 20 nt, Mycobacterium leprae
agacgcgaccgccaccagau

SEQ ID NO: 3229266 - RNA, 16 nt, Mycobacterium leprae
agacggccugcucugu

SEQ ID NO: 3229267 - RNA, 18 nt, Mycobacterium leprae
agacgugcacaagauugc

SEQ ID NO: 3229268 - RNA, 23 nt, Mycobacterium leprae
agacuaccggagguucucggcgu

SEQ ID NO: 3229269 - RNA, 17 nt, Mycobacterium leprae
agacucaccaagauugc

SEQ ID NO: 3229270 - RNA, 20 nt, Mycobacterium leprae
agacucaccaagauugcgga

SEQ ID NO: 3229271 - RNA, 20 nt, Mycobacterium leprae
agacucgugagcuuacggac

SEQ ID NO: 3229272 - RNA, 14 nt, Mycobacterium leprae
agacugaaugcgau

SEQ ID NO: 3229273 - RNA, 20 nt, Mycobacterium leprae
agacugaaugcgaugcuggc

SEQ ID NO: 3229274 - RNA, 22 nt, Mycobacterium leprae
agacugcguguucaucaucuaa

SEQ ID NO: 3229275 - RNA, 21 nt, Mycobacterium leprae
agacuggguggcccgaggaga

SEQ ID NO: 3229276 - RNA, 13 nt, Mycobacterium leprae
agacuucagcgag

SEQ ID NO: 3229277 - RNA, 14 nt, Mycobacterium leprae
agacuuuggagcag

SEQ ID NO: 3229278 - RNA, 21 nt, Mycobacterium leprae
agagaaguagagaaaaaugcu

SEQ ID NO: 3229279 - RNA, 18 nt, Mycobacterium leprae
agagagguuuuccacugc

SEQ ID NO: 3229280 - RNA, 18 nt, Mycobacterium leprae
agagcaagccgcacaugg

SEQ ID NO: 3229281 - RNA, 15 nt, Mycobacterium leprae
agagcagugcugaca

SEQ ID NO: 3229282 - RNA, 14 nt, Mycobacterium leprae
agagcugcaccuga

SEQ ID NO: 3229283 - RNA, 13 nt, Mycobacterium leprae
agagcugcagcua

SEQ ID NO: 3229284 - RNA, 15 nt, Mycobacterium leprae
agagcugcaggucag

SEQ ID NO: 3229285 - RNA, 23 nt, Mycobacterium leprae
agaggcaaagugcgguuuucggc

SEQ ID NO: 3229286 - RNA, 12 nt, Mycobacterium leprae
agaggcaccugg

SEQ ID NO: 3229287 - RNA, 13 nt, Mycobacterium leprae
agaggcugcaccg

SEQ ID NO: 3229288 - RNA, 17 nt, Mycobacterium leprae
agaggcugcaccggcuu

SEQ ID NO: 3229289 - RNA, 14 nt, Mycobacterium leprae
agaggcugcaguca

SEQ ID NO: 3229290 - RNA, 15 nt, Mycobacterium leprae
agagguccugcaguc

SEQ ID NO: 3229291 - RNA, 20 nt, Mycobacterium leprae
agagguuuuccacugcauug

SEQ ID NO: 3229292 - RNA, 21 nt, Mycobacterium leprae
agagucguuucgaggucuugg

SEQ ID NO: 3229293 - RNA, 21 nt, Mycobacterium leprae
agagugaaaguaggcacagcc

SEQ ID NO: 3229294 - RNA, 22 nt, Mycobacterium leprae
agagugcagaucaccaacaguc

SEQ ID NO: 3229295 - RNA, 13 nt, Mycobacterium leprae
agauaccgggcuc

SEQ ID NO: 3229296 - RNA, 13 nt, Mycobacterium leprae
agauacuggauuc

SEQ ID NO: 3229297 - RNA, 16 nt, Mycobacterium leprae
agauaguauaaggugc

SEQ ID NO: 3229298 - RNA, 17 nt, Mycobacterium leprae
agauaucuacugggccg

SEQ ID NO: 3229299 - RNA, 13 nt, Mycobacterium leprae
agauauuaaguuu

SEQ ID NO: 3229300 - RNA, 14 nt, Mycobacterium leprae
agaucaacagcgca

SEQ ID NO: 3229301 - RNA, 17 nt, Mycobacterium leprae
agauccggccguugaga

SEQ ID NO: 3229302 - RNA, 18 nt, Mycobacterium leprae
agaucgacgcugcgccgu

SEQ ID NO: 3229303 - RNA, 16 nt, Mycobacterium leprae
agaucgcccaccgcaa

SEQ ID NO: 3229304 - RNA, 22 nt, Mycobacterium leprae
agaucgcccaccgcaaucgaaa

SEQ ID NO: 3229305 - RNA, 23 nt, Mycobacterium leprae
agaucgcgucgcaucgguggcac

SEQ ID NO: 3229306 - RNA, 22 nt, Mycobacterium leprae
agaucguccucaugcccaugcc

SEQ ID NO: 3229307 - RNA, 20 nt, Mycobacterium leprae
agaucuggguaucaguaugu

SEQ ID NO: 3229308 - RNA, 13 nt, Mycobacterium leprae
agaucuuucuggu

SEQ ID NO: 3229309 - RNA, 19 nt, Mycobacterium leprae
agaucuuuucggcugcacu

SEQ ID NO: 3229310 - RNA, 13 nt, Mycobacterium leprae
agaugacagcgcg

SEQ ID NO: 3229311 - RNA, 13 nt, Mycobacterium leprae
agaugaccggcuu

SEQ ID NO: 3229312 - RNA, 15 nt, Mycobacterium leprae
agaugacggcaaaaa

SEQ ID NO: 3229313 - RNA, 19 nt, Mycobacterium leprae
agaugacucggcgugccac

SEQ ID NO: 3229314 - RNA, 19 nt, Mycobacterium leprae
agaugccagccaacggcua

SEQ ID NO: 3229315 - RNA, 20 nt, Mycobacterium leprae
agaugcugcguucagcgaag

SEQ ID NO: 3229316 - RNA, 13 nt, Mycobacterium leprae
agauggaaggcgg

SEQ ID NO: 3229317 - RNA, 22 nt, Mycobacterium leprae
agauggcgucaccgugcagcgu

SEQ ID NO: 3229318 - RNA, 22 nt, Mycobacterium leprae
agauggcuccccgagccgcuuu

SEQ ID NO: 3229319 - RNA, 23 nt, Mycobacterium leprae
agauggugcacuugcacuauguc

SEQ ID NO: 3229320 - RNA, 16 nt, Mycobacterium leprae
agauguucaagcgaac

SEQ ID NO: 3229321 - RNA, 14 nt, Mycobacterium leprae
agauuaucgcauca

SEQ ID NO: 3229322 - RNA, 22 nt, Mycobacterium leprae
agauugacaaaagugcagugau

SEQ ID NO: 3229323 - RNA, 21 nt, Mycobacterium leprae
agauugcagcccugagcacca

SEQ ID NO: 3229324 - RNA, 17 nt, Mycobacterium leprae
agcaaacuuugucagcg

SEQ ID NO: 3229325 - RNA, 14 nt, Mycobacterium leprae
agcaaauuugugcc

SEQ ID NO: 3229326 - RNA, 21 nt, Mycobacterium leprae
agcaacacuggcgaccgcacg

SEQ ID NO: 3229327 - RNA, 18 nt, Mycobacterium leprae
agcaacguguaaggccag

SEQ ID NO: 3229328 - RNA, 15 nt, Mycobacterium leprae
agcaagcaggcaugc

SEQ ID NO: 3229329 - RNA, 17 nt, Mycobacterium leprae
agcaagcgcuaugccau

SEQ ID NO: 3229330 - RNA, 21 nt, Mycobacterium leprae
agcaaggcgcgguaucucaau

SEQ ID NO: 3229331 - RNA, 20 nt, Mycobacterium leprae
agcaaggcuuggccagcaag

SEQ ID NO: 3229332 - RNA, 14 nt, Mycobacterium leprae
agcaaggguggggc

SEQ ID NO: 3229333 - RNA, 19 nt, Mycobacterium leprae
agcaaggguugguagcugg

SEQ ID NO: 3229334 - RNA, 14 nt, Mycobacterium leprae
agcaagucgcugau

SEQ ID NO: 3229335 - RNA, 14 nt, Mycobacterium leprae
agcaaugcucugcu

SEQ ID NO: 3229336 - RNA, 15 nt, Mycobacterium leprae
agcaauuuuucggua

SEQ ID NO: 3229337 - RNA, 18 nt, Mycobacterium leprae
agccggaggguugccgac

SEQ ID NO: 3229338 - RNA, 18 nt, Mycobacterium leprae
agccggcucgcggggaug

SEQ ID NO: 3229339 - RNA, 22 nt, Mycobacterium leprae
agccggcucgcggggaugcuga

SEQ ID NO: 3229340 - RNA, 15 nt, Mycobacterium leprae
agccgggcgagcugg

SEQ ID NO: 3229341 - RNA, 19 nt, Mycobacterium leprae
agccggucgggaccuaccg

SEQ ID NO: 3229342 - RNA, 15 nt, Mycobacterium leprae
agccgguggccaccg

SEQ ID NO: 3229343 - RNA, 17 nt, Mycobacterium leprae
agccgguggccaccgcc

SEQ ID NO: 3229344 - RNA, 19 nt, Mycobacterium leprae
agccgguggccaccgccac

SEQ ID NO: 3229345 - RNA, 21 nt, Mycobacterium leprae
agccgucacugugugcagcuu

SEQ ID NO: 3229346 - RNA, 13 nt, Mycobacterium leprae
agccgugcagccu

SEQ ID NO: 3229347 - RNA, 22 nt, Mycobacterium leprae
agccgugcccaaggucacgaug

SEQ ID NO: 3229348 - RNA, 13 nt, Mycobacterium leprae
agccguucggcua

SEQ ID NO: 3229349 - RNA, 14 nt, Mycobacterium leprae
agccguugcugcug

SEQ ID NO: 3229350 - RNA, 18 nt, Mycobacterium leprae
agccguugggcugcccuc

SEQ ID NO: 3229351 - RNA, 19 nt, Mycobacterium leprae
agccguugggcugcccucc

SEQ ID NO: 3229352 - RNA, 22 nt, Mycobacterium leprae
agccuaaauccggauuuuccug

SEQ ID NO: 3229353 - RNA, 23 nt, Mycobacterium leprae
agccuaaccucacgccuaaucua

SEQ ID NO: 3229354 - RNA, 13 nt, Mycobacterium leprae
agccuacucccgg

SEQ ID NO: 3229355 - RNA, 14 nt, Mycobacterium leprae
agccuacucccgga

SEQ ID NO: 3229356 - RNA, 14 nt, Mycobacterium leprae
agccuaugauggcg

SEQ ID NO: 3229357 - RNA, 18 nt, Mycobacterium leprae
agccucaucgaaagcagg

SEQ ID NO: 3229358 - RNA, 16 nt, Mycobacterium leprae
agccuccagaaucaca

SEQ ID NO: 3229359 - RNA, 21 nt, Mycobacterium leprae
agccuccgaaaagcugagccg

SEQ ID NO: 3229360 - RNA, 14 nt, Mycobacterium leprae
agccucgaaccgau

SEQ ID NO: 3229361 - RNA, 14 nt, Mycobacterium leprae
agccuggucgcgua

SEQ ID NO: 3229362 - RNA, 20 nt, Mycobacterium leprae
agccuguuguugugccuucu

SEQ ID NO: 3229363 - RNA, 18 nt, Mycobacterium leprae
agcgaaccuacaguggca

SEQ ID NO: 3229364 - RNA, 16 nt, Mycobacterium leprae
agcgaaguccuugcug

SEQ ID NO: 3229365 - RNA, 13 nt, Mycobacterium leprae
agcgacagcucag

SEQ ID NO: 3229366 - RNA, 14 nt, Mycobacterium leprae
agcgaccggccagu

SEQ ID NO: 3229367 - RNA, 21 nt, Mycobacterium leprae
agcgaccggccagugcaaccu

SEQ ID NO: 3229368 - RNA, 16 nt, Mycobacterium leprae
agcgacgguaagcucg

SEQ ID NO: 3229369 - RNA, 17 nt, Mycobacterium leprae
agcgacgguaagcucgc

SEQ ID NO: 3229370 - RNA, 18 nt, Mycobacterium leprae
agcgacgguaagcucgcc

SEQ ID NO: 3229371 - RNA, 21 nt, Mycobacterium leprae
agcgacgguaagcucgcccua

SEQ ID NO: 3229372 - RNA, 12 nt, Mycobacterium leprae
agcgacuggcug

SEQ ID NO: 3229373 - RNA, 20 nt, Mycobacterium leprae
agcgagaagccccauggcac

SEQ ID NO: 3229374 - RNA, 21 nt, Mycobacterium leprae
agcgagaagccccauggcacg

SEQ ID NO: 3229375 - RNA, 15 nt, Mycobacterium leprae
agcgagaaucccagu

SEQ ID NO: 3229376 - RNA, 13 nt, Mycobacterium leprae
agcgagcguguca

SEQ ID NO: 3229377 - RNA, 14 nt, Mycobacterium leprae
agcgauaucaagcu

SEQ ID NO: 3229378 - RNA, 16 nt, Mycobacterium leprae
agcgaucggaacauca

SEQ ID NO: 3229379 - RNA, 12 nt, Mycobacterium leprae
agcgaucuaccu

SEQ ID NO: 3229380 - RNA, 23 nt, Mycobacterium leprae
agcgaugacauggaagccgccgu

SEQ ID NO: 3229381 - RNA, 22 nt, Mycobacterium leprae
agcgauugugcggaacaucgcg

SEQ ID NO: 3229382 - RNA, 18 nt, Mycobacterium leprae
agcgcacaucgauaacga

SEQ ID NO: 3229383 - RNA, 12 nt, Mycobacterium leprae
agcgcaccgcgg

SEQ ID NO: 3229384 - RNA, 20 nt, Mycobacterium leprae
agcgcagcaagcggccgccc

SEQ ID NO: 3229385 - RNA, 13 nt, Mycobacterium leprae
agcgcagccacca

SEQ ID NO: 3229386 - RNA, 14 nt, Mycobacterium leprae
agcgcagccaccac

SEQ ID NO: 3229387 - RNA, 15 nt, Mycobacterium leprae
agcgcaucagccaac

SEQ ID NO: 3229388 - RNA, 16 nt, Mycobacterium leprae
agcgcaucagccaaca

SEQ ID NO: 3229389 - RNA, 21 nt, Mycobacterium leprae
agcgcccaguaguucgagcac

SEQ ID NO: 3229390 - RNA, 15 nt, Mycobacterium leprae
agcgcccgcacagca

SEQ ID NO: 3229391 - RNA, 18 nt, Mycobacterium leprae
agcgccgagcacuagcuu

SEQ ID NO: 3229392 - RNA, 11 nt, Mycobacterium leprae
agcgccgcggg

SEQ ID NO: 3229393 - RNA, 23 nt, Mycobacterium leprae
agcgccucaccaaaucgacuaca

SEQ ID NO: 3229394 - RNA, 20 nt, Mycobacterium leprae
agcgccugagcgggccagca

SEQ ID NO: 3229395 - RNA, 14 nt, Mycobacterium leprae
agcgcuaaauggac

SEQ ID NO: 3229396 - RNA, 21 nt, Mycobacterium leprae
agcgcucgcuaucgccacacu

SEQ ID NO: 3229397 - RNA, 14 nt, Mycobacterium leprae
agcggagacccccg

SEQ ID NO: 3229398 - RNA, 14 nt, Mycobacterium leprae
agcggagcugggcg

SEQ ID NO: 3229399 - RNA, 13 nt, Mycobacterium leprae
agcggcccaaccc

SEQ ID NO: 3229400 - RNA, 12 nt, Mycobacterium leprae
agcggccgccag

SEQ ID NO: 3229401 - RNA, 21 nt, Mycobacterium leprae
agcggccuaggacgccgcccu

SEQ ID NO: 3229402 - RNA, 19 nt, Mycobacterium leprae
agcggcggccgugauuuuc

SEQ ID NO: 3229403 - RNA, 14 nt, Mycobacterium leprae
agcggcggcggcca

SEQ ID NO: 3229404 - RNA, 16 nt, Mycobacterium leprae
agcggcggcggccagc

SEQ ID NO: 3229405 - RNA, 18 nt, Mycobacterium leprae
agcgguauuuguggaugu

SEQ ID NO: 3229406 - RNA, 13 nt, Mycobacterium leprae
agcgguccgguuu

SEQ ID NO: 3229407 - RNA, 14 nt, Mycobacterium leprae
agcggucggcgcac

SEQ ID NO: 3229408 - RNA, 17 nt, Mycobacterium leprae
agcggucuggcgcucca

SEQ ID NO: 3229409 - RNA, 20 nt, Mycobacterium leprae
agcgguucaucgacaggaaa

SEQ ID NO: 3229410 - RNA, 14 nt, Mycobacterium leprae
agcgguuccuccca

SEQ ID NO: 3229411 - RNA, 20 nt, Mycobacterium leprae
agcgucucgcgcauacacgg

SEQ ID NO: 3229412 - RNA, 19 nt, Mycobacterium leprae
agcgucugcuggaucgucu

SEQ ID NO: 3229413 - RNA, 14 nt, Mycobacterium leprae
agcgugaauuacuc

SEQ ID NO: 3229414 - RNA, 23 nt, Mycobacterium leprae
agcgugcuuuggauuuuccaguu

SEQ ID NO: 3229415 - RNA, 16 nt, Mycobacterium leprae
agcguucguagagcug

SEQ ID NO: 3229416 - RNA, 18 nt, Mycobacterium leprae
agcguugugggcagcugc

SEQ ID NO: 3229417 - RNA, 19 nt, Mycobacterium leprae
agcguuuaaguaacaugcu

SEQ ID NO: 3229418 - RNA, 15 nt, Mycobacterium leprae
agcuaaagugcugcu

SEQ ID NO: 3229419 - RNA, 16 nt, Mycobacterium leprae
agcuaaagugcugcug

SEQ ID NO: 3229420 - RNA, 18 nt, Mycobacterium leprae
agcuaaagugcugcugug

SEQ ID NO: 3229421 - RNA, 21 nt, Mycobacterium leprae
agcuaaagugcugcugugguu

SEQ ID NO: 3229422 - RNA, 20 nt, Mycobacterium leprae
agcuacuuuucgugcugccg

SEQ ID NO: 3229423 - RNA, 23 nt, Mycobacterium leprae
agcuaguuuaccgugguugcuga

SEQ ID NO: 3229424 - RNA, 13 nt, Mycobacterium leprae
agcuaugcaguga

SEQ ID NO: 3229425 - RNA, 19 nt, Mycobacterium leprae
agcucaauuggcagagcau

SEQ ID NO: 3229426 - RNA, 20 nt, Mycobacterium leprae
agcucacaauugacaacacg

SEQ ID NO: 3229427 - RNA, 18 nt, Mycobacterium leprae
agcucacccgcagcaccu

SEQ ID NO: 3229428 - RNA, 17 nt, Mycobacterium leprae
agcucagcaacuuuccu

SEQ ID NO: 3229429 - RNA, 21 nt, Mycobacterium leprae
agcucaggauagcgacuguug

SEQ ID NO: 3229430 - RNA, 21 nt, Mycobacterium leprae
agcucaucggcgacugggaua

SEQ ID NO: 3229431 - RNA, 19 nt, Mycobacterium leprae
agcucaugacuuauaguca

SEQ ID NO: 3229432 - RNA, 14 nt, Mycobacterium leprae
agcuccaguucgau

SEQ ID NO: 3229433 - RNA, 15 nt, Mycobacterium leprae
agcuccgaagcacca

SEQ ID NO: 3229434 - RNA, 16 nt, Mycobacterium leprae
agcuccgaagcagcca

SEQ ID NO: 3229435 - RNA, 14 nt, Mycobacterium leprae
agcucgauggugcc

SEQ ID NO: 3229436 - RNA, 14 nt, Mycobacterium leprae
agcucgccaagguc

SEQ ID NO: 3229437 - RNA, 14 nt, Mycobacterium leprae
agcucggacaagau

SEQ ID NO: 3229438 - RNA, 15 nt, Mycobacterium leprae
agcugaaaugcucua

SEQ ID NO: 3229439 - RNA, 20 nt, Mycobacterium leprae
agcugaaaugcucuaauuuu

SEQ ID NO: 3229440 - RNA, 15 nt, Mycobacterium leprae
agcugaccacucgcg

SEQ ID NO: 3229441 - RNA, 21 nt, Mycobacterium leprae
agcugaccacucgcgacgaua

SEQ ID NO: 3229442 - RNA, 13 nt, Mycobacterium leprae
agcugaccggcga

SEQ ID NO: 3229443 - RNA, 11 nt, Mycobacterium leprae
agcugaugaca

SEQ ID NO: 3229444 - RNA, 18 nt, Mycobacterium leprae
agcugauuuggccgccau

SEQ ID NO: 3229445 - RNA, 17 nt, Mycobacterium leprae
agcugcaccugaucuag

SEQ ID NO: 3229446 - RNA, 14 nt, Mycobacterium leprae
agcugcaucggcag

SEQ ID NO: 3229447 - RNA, 18 nt, Mycobacterium leprae
agcugccagcuucgcaga

SEQ ID NO: 3229448 - RNA, 20 nt, Mycobacterium leprae
agcugccauuggccgcuggu

SEQ ID NO: 3229449 - RNA, 15 nt, Mycobacterium leprae
agcugcguauagugg

SEQ ID NO: 3229450 - RNA, 14 nt, Mycobacterium leprae
agcugcugaacauc

SEQ ID NO: 3229451 - RNA, 19 nt, Mycobacterium leprae
aggguacgagugguugagu

SEQ ID NO: 3229452 - RNA, 21 nt, Mycobacterium leprae
aggguacgccagguagugagu

SEQ ID NO: 3229453 - RNA, 23 nt, Mycobacterium leprae
aggguacgccagguagugaguac

SEQ ID NO: 3229454 - RNA, 22 nt, Mycobacterium leprae
agggucgagaucgccacucggu

SEQ ID NO: 3229455 - RNA, 18 nt, Mycobacterium leprae
agggugacgguggcgcac

SEQ ID NO: 3229456 - RNA, 23 nt, Mycobacterium leprae
aggguggcgguguguugcagugu

SEQ ID NO: 3229457 - RNA, 16 nt, Mycobacterium leprae
aggguguugugggugu

SEQ ID NO: 3229458 - RNA, 15 nt, Mycobacterium leprae
agguaagcuugcagu

SEQ ID NO: 3229459 - RNA, 13 nt, Mycobacterium leprae
agguacgcgucga

SEQ ID NO: 3229460 - RNA, 14 nt, Mycobacterium leprae
aggucaacguuugu

SEQ ID NO: 3229461 - RNA, 22 nt, Mycobacterium leprae
aggucacgagaccacggcagcg

SEQ ID NO: 3229462 - RNA, 22 nt, Mycobacterium leprae
aggucagcggucacauuguaac

SEQ ID NO: 3229463 - RNA, 18 nt, Mycobacterium leprae
aggucaguacgcuagagu

SEQ ID NO: 3229464 - RNA, 22 nt, Mycobacterium leprae
aggucaguucucgccgaggaug

SEQ ID NO: 3229465 - RNA, 13 nt, Mycobacterium leprae
aggucaugccagg

SEQ ID NO: 3229466 - RNA, 14 nt, Mycobacterium leprae
aggucauucucgac

SEQ ID NO: 3229467 - RNA, 15 nt, Mycobacterium leprae
agguccaaccgacga

SEQ ID NO: 3229468 - RNA, 15 nt, Mycobacterium leprae
agguccaauucacga

SEQ ID NO: 3229469 - RNA, 22 nt, Mycobacterium leprae
agguccaauucacgaacaacag

SEQ ID NO: 3229470 - RNA, 19 nt, Mycobacterium leprae
agguccuggaugccgaccg

SEQ ID NO: 3229471 - RNA, 19 nt, Mycobacterium leprae
aggucgagcgauggcugcc

SEQ ID NO: 3229472 - RNA, 24 nt, Mycobacterium leprae
aggucgagugcgagccacuccggu

SEQ ID NO: 3229473 - RNA, 14 nt, Mycobacterium leprae
aggucgcaaagguc

SEQ ID NO: 3229474 - RNA, 21 nt, Mycobacterium leprae
aggucgcacagcaggucgccg

SEQ ID NO: 3229475 - RNA, 15 nt, Mycobacterium leprae
aggucgccgccgaac

SEQ ID NO: 3229476 - RNA, 16 nt, Mycobacterium leprae
aggucgcgcugccgga

SEQ ID NO: 3229477 - RNA, 22 nt, Mycobacterium leprae
aggucgguaaaugccucgcuau

SEQ ID NO: 3229478 - RNA, 15 nt, Mycobacterium leprae
aggucguguugccac

SEQ ID NO: 3229479 - RNA, 20 nt, Mycobacterium leprae
aggucguguugccaccgaca

SEQ ID NO: 3229480 - RNA, 18 nt, Mycobacterium leprae
aggucuccuggucuccuc

SEQ ID NO: 3229481 - RNA, 14 nt, Mycobacterium leprae
aggucucuaaaaaa

SEQ ID NO: 3229482 - RNA, 18 nt, Mycobacterium leprae
aggucuuuuagguguggu

SEQ ID NO: 3229483 - RNA, 16 nt, Mycobacterium leprae
aggugaagccggcgca

SEQ ID NO: 3229484 - RNA, 14 nt, Mycobacterium leprae
aggugaccggagca

SEQ ID NO: 3229485 - RNA, 22 nt, Mycobacterium leprae
aggugacgccaguguagagggc

SEQ ID NO: 3229486 - RNA, 18 nt, Mycobacterium leprae
aggugagcguugugggca

SEQ ID NO: 3229487 - RNA, 13 nt, Mycobacterium leprae
aggugcccaccau

SEQ ID NO: 3229488 - RNA, 15 nt, Mycobacterium leprae
aggugcccagccccu

SEQ ID NO: 3229489 - RNA, 18 nt, Mycobacterium leprae
aggugcguugugcgguga

SEQ ID NO: 3229490 - RNA, 18 nt, Mycobacterium leprae
aggugcuggaugccggga

SEQ ID NO: 3229491 - RNA, 17 nt, Mycobacterium leprae
aggugcuuaucgaguac

SEQ ID NO: 3229492 - RNA, 16 nt, Mycobacterium leprae
agguggccuagucggg

SEQ ID NO: 3229493 - RNA, 20 nt, Mycobacterium leprae
agguggcggcgacacggcug

SEQ ID NO: 3229494 - RNA, 20 nt, Mycobacterium leprae
agguggcuagcuguaaggac

SEQ ID NO: 3229495 - RNA, 18 nt, Mycobacterium leprae
aggugucggcguggucaa

SEQ ID NO: 3229496 - RNA, 15 nt, Mycobacterium leprae
aggugucugcgaaca

SEQ ID NO: 3229497 - RNA, 15 nt, Mycobacterium leprae
aggugugcugcagca

SEQ ID NO: 3229498 - RNA, 14 nt, Mycobacterium leprae
agguguugcgguga

SEQ ID NO: 3229499 - RNA, 22 nt, Mycobacterium leprae
agguugaggaggugcuggaugc

SEQ ID NO: 3229500 - RNA, 14 nt, Mycobacterium leprae
agguuguggcacca

SEQ ID NO: 3229501 - RNA, 11 nt, Mycobacterium leprae
aguaaagggug

SEQ ID NO: 3229502 - RNA, 14 nt, Mycobacterium leprae
aguaaugcagguga

SEQ ID NO: 3229503 - RNA, 18 nt, Mycobacterium leprae
aguaaugcaggugaccgg

SEQ ID NO: 3229504 - RNA, 16 nt, Mycobacterium leprae
aguacaauauugacca

SEQ ID NO: 3229505 - RNA, 14 nt, Mycobacterium leprae
aguacaaugucuuc

SEQ ID NO: 3229506 - RNA, 21 nt, Mycobacterium leprae
aguaccgaaaacacgggcacc

SEQ ID NO: 3229507 - RNA, 18 nt, Mycobacterium leprae
aguaccgcgaacccuggu

SEQ ID NO: 3229508 - RNA, 14 nt, Mycobacterium leprae
aguaccggcucaca

SEQ ID NO: 3229509 - RNA, 17 nt, Mycobacterium leprae
aguacgaaaugaacguc

SEQ ID NO: 3229510 - RNA, 20 nt, Mycobacterium leprae
aguacgcuagagucaucccg

SEQ ID NO: 3229511 - RNA, 19 nt, Mycobacterium leprae
aguacggagccaguggcgu

SEQ ID NO: 3229512 - RNA, 18 nt, Mycobacterium leprae
aguacggcggcgauccuc

SEQ ID NO: 3229513 - RNA, 14 nt, Mycobacterium leprae
aguacguguggugu

SEQ ID NO: 3229514 - RNA, 12 nt, Mycobacterium leprae
aguagagaaguc

SEQ ID NO: 3229515 - RNA, 15 nt, Mycobacterium leprae
aguagaugcaacuga

SEQ ID NO: 3229516 - RNA, 15 nt, Mycobacterium leprae
aguagcaagccgcca

SEQ ID NO: 3229517 - RNA, 17 nt, Mycobacterium leprae
aguagcaagccgccagu

SEQ ID NO: 3229518 - RNA, 23 nt, Mycobacterium leprae
aguagcaagccgccagugcgcaa

SEQ ID NO: 3229519 - RNA, 15 nt, Mycobacterium leprae
aguagcgacaucggg

SEQ ID NO: 3229520 - RNA, 14 nt, Mycobacterium leprae
aguagucccgagcg

SEQ ID NO: 3229521 - RNA, 17 nt, Mycobacterium leprae
aguaguucacggucacc

SEQ ID NO: 3229522 - RNA, 13 nt, Mycobacterium leprae
aguaucgaccagc

SEQ ID NO: 3229523 - RNA, 18 nt, Mycobacterium leprae
aguaugccucgagcaaac

SEQ ID NO: 3229524 - RNA, 22 nt, Mycobacterium leprae
aguauguuuggauugucauggc

SEQ ID NO: 3229525 - RNA, 20 nt, Mycobacterium leprae
agucaccugucauucugaca

SEQ ID NO: 3229526 - RNA, 13 nt, Mycobacterium leprae
agucacuccgacg

SEQ ID NO: 3229527 - RNA, 17 nt, Mycobacterium leprae
agucagaucaaccaaau

SEQ ID NO: 3229528 - RNA, 11 nt, Mycobacterium leprae
agucagcacaa

SEQ ID NO: 3229529 - RNA, 14 nt, Mycobacterium leprae
agucagcaucagac

SEQ ID NO: 3229530 - RNA, 19 nt, Mycobacterium leprae
agucaguuuggcgcugcug

SEQ ID NO: 3229531 - RNA, 20 nt, Mycobacterium leprae
agucaguuuggcgcugcugc

SEQ ID NO: 3229532 - RNA, 21 nt, Mycobacterium leprae
agucaguuuggcgcugcugcg

SEQ ID NO: 3229533 - RNA, 15 nt, Mycobacterium leprae
agucauccacugcga

SEQ ID NO: 3229534 - RNA, 22 nt, Mycobacterium leprae
agucauccccaucgcuugagac

SEQ ID NO: 3229535 - RNA, 19 nt, Mycobacterium leprae
agucaugcagaugcaagau

SEQ ID NO: 3229536 - RNA, 15 nt, Mycobacterium leprae
agucauugccuaguu

SEQ ID NO: 3229537 - RNA, 19 nt, Mycobacterium leprae
aguccaagcacgaugacau

SEQ ID NO: 3229538 - RNA, 21 nt, Mycobacterium leprae
aguccagucgcgcaccgcgaa

SEQ ID NO: 3229539 - RNA, 15 nt, Mycobacterium leprae
aguccaugaauuacu

SEQ ID NO: 3229540 - RNA, 19 nt, Mycobacterium leprae
aguccccguguuugucaaa

SEQ ID NO: 3229541 - RNA, 12 nt, Mycobacterium leprae
aguccggcgcca

SEQ ID NO: 3229542 - RNA, 15 nt, Mycobacterium leprae
aguccuuuccagcca

SEQ ID NO: 3229543 - RNA, 11 nt, Mycobacterium leprae
agucgaccgga

SEQ ID NO: 3229544 - RNA, 19 nt, Mycobacterium leprae
agucgaccggaccaucguc

SEQ ID NO: 3229545 - RNA, 18 nt, Mycobacterium leprae
agucgacgcagaccgggc

SEQ ID NO: 3229546 - RNA, 17 nt, Mycobacterium leprae
agucgacgccgcggcug

SEQ ID NO: 3229547 - RNA, 16 nt, Mycobacterium leprae
agucgagggcucagug

SEQ ID NO: 3229548 - RNA, 23 nt, Mycobacterium leprae
agucgauaucgggccgagcuggu

SEQ ID NO: 3229549 - RNA, 23 nt, Mycobacterium leprae
agucgcaaaacgauucugcggaa

SEQ ID NO: 3229550 - RNA, 21 nt, Mycobacterium leprae
agucgcgucuuugcuggucag

SEQ ID NO: 3229551 - RNA, 22 nt, Mycobacterium leprae
agucgcgucuuugcuggucagc

SEQ ID NO: 3229552 - RNA, 22 nt, Mycobacterium leprae
agucggcaaugcucucacccuc

SEQ ID NO: 3229553 - RNA, 15 nt, Mycobacterium leprae
agucggcgugcggau

SEQ ID NO: 3229554 - RNA, 18 nt, Mycobacterium leprae
agucggcuuugcgguuga

SEQ ID NO: 3229555 - RNA, 18 nt, Mycobacterium leprae
agucgguuacaucgucaa

SEQ ID NO: 3229556 - RNA, 15 nt, Mycobacterium leprae
agucguggagcaccu

SEQ ID NO: 3229557 - RNA, 17 nt, Mycobacterium leprae
agucguggagcaccuca

SEQ ID NO: 3229558 - RNA, 19 nt, Mycobacterium leprae
agucguggguacguggugg

SEQ ID NO: 3229559 - RNA, 20 nt, Mycobacterium leprae
agucguggguacgugguggc

SEQ ID NO: 3229560 - RNA, 23 nt, Mycobacterium leprae
agucguggguacgugguggcugc

SEQ ID NO: 3229561 - RNA, 19 nt, Mycobacterium leprae
agucugaaggcaaaauccu

SEQ ID NO: 3229562 - RNA, 17 nt, Mycobacterium leprae
agucuucggaucugguu

SEQ ID NO: 3229563 - RNA, 18 nt, Mycobacterium leprae
agucuucggaucugguuu

SEQ ID NO: 3229564 - RNA, 18 nt, Mycobacterium leprae
auagcugugcaggagagc

SEQ ID NO: 3229565 - RNA, 17 nt, Mycobacterium leprae
auagggagaaugccaca

SEQ ID NO: 3229566 - RNA, 11 nt, Mycobacterium leprae
auagguggcau

SEQ ID NO: 3229567 - RNA, 18 nt, Mycobacterium leprae
auagguguagcagcugca

SEQ ID NO: 3229568 - RNA, 14 nt, Mycobacterium leprae
auaguacagaccga

SEQ ID NO: 3229569 - RNA, 16 nt, Mycobacterium leprae
auagucagaucaacca

SEQ ID NO: 3229570 - RNA, 22 nt, Mycobacterium leprae
auagugcgcuauacuugcugca

SEQ ID NO: 3229571 - RNA, 15 nt, Mycobacterium leprae
auaguggcugauguc

SEQ ID NO: 3229572 - RNA, 17 nt, Mycobacterium leprae
auaguguguuugguuuu

SEQ ID NO: 3229573 - RNA, 17 nt, Mycobacterium leprae
auaguuguuagcgccgc

SEQ ID NO: 3229574 - RNA, 19 nt, Mycobacterium leprae
auaguuguuagcgccgcgg

SEQ ID NO: 3229575 - RNA, 15 nt, Mycobacterium leprae
auauaacggcuucau

SEQ ID NO: 3229576 - RNA, 15 nt, Mycobacterium leprae
auauagacuaugaag

SEQ ID NO: 3229577 - RNA, 14 nt, Mycobacterium leprae
auauauuccagguc

SEQ ID NO: 3229578 - RNA, 20 nt, Mycobacterium leprae
auauccaccauacagcuaac

SEQ ID NO: 3229579 - RNA, 14 nt, Mycobacterium leprae
auauccguugccau

SEQ ID NO: 3229580 - RNA, 15 nt, Mycobacterium leprae
auaucgaugcaggcg

SEQ ID NO: 3229581 - RNA, 18 nt, Mycobacterium leprae
auaucgcacacagcggcc

SEQ ID NO: 3229582 - RNA, 22 nt, Mycobacterium leprae
auaucgcuacccuugagcaccc

SEQ ID NO: 3229583 - RNA, 16 nt, Mycobacterium leprae
auaucguaaucaggac

SEQ ID NO: 3229584 - RNA, 20 nt, Mycobacterium leprae
auaucguaaucaggacucgg

SEQ ID NO: 3229585 - RNA, 18 nt, Mycobacterium leprae
auaucuuuuuagagaaga

SEQ ID NO: 3229586 - RNA, 19 nt, Mycobacterium leprae
auauggaaagucagcauca

SEQ ID NO: 3229587 - RNA, 21 nt, Mycobacterium leprae
auauuaaguuuucucuaaaag

SEQ ID NO: 3229588 - RNA, 17 nt, Mycobacterium leprae
auauugcgacauccaaa

SEQ ID NO: 3229589 - RNA, 13 nt, Mycobacterium leprae
auauuucggcgaa

SEQ ID NO: 3229590 - RNA, 19 nt, Mycobacterium leprae
auauuuucaagacugcacc

SEQ ID NO: 3229591 - RNA, 14 nt, Mycobacterium leprae
auauuuuuaagguc

SEQ ID NO: 3229592 - RNA, 13 nt, Mycobacterium leprae
aucaaccaaaugc

SEQ ID NO: 3229593 - RNA, 15 nt, Mycobacterium leprae
aucaaccaggcaacc

SEQ ID NO: 3229594 - RNA, 18 nt, Mycobacterium leprae
aucaaccggugauugccg

SEQ ID NO: 3229595 - RNA, 18 nt, Mycobacterium leprae
aucaaccgugucggcccc

SEQ ID NO: 3229596 - RNA, 14 nt, Mycobacterium leprae
aucaacgccagcaa

SEQ ID NO: 3229597 - RNA, 18 nt, Mycobacterium leprae
aucaacggcugcgugucg

SEQ ID NO: 3229598 - RNA, 17 nt, Mycobacterium leprae
aucaagaucggccagcc

SEQ ID NO: 3229599 - RNA, 13 nt, Mycobacterium leprae
aucaauaccuacu

SEQ ID NO: 3229600 - RNA, 16 nt, Mycobacterium leprae
aucaauggcagccacc

SEQ ID NO: 3229601 - RNA, 16 nt, Mycobacterium leprae
aucacaaggagccaac

SEQ ID NO: 3229602 - RNA, 12 nt, Mycobacterium leprae
aucacaaucaca

SEQ ID NO: 3229603 - RNA, 14 nt, Mycobacterium leprae
aucacacggcgcga

SEQ ID NO: 3229604 - RNA, 22 nt, Mycobacterium leprae
aucacagccuccgaaaagcuga

SEQ ID NO: 3229605 - RNA, 21 nt, Mycobacterium leprae
aucacaguccugcccggacaa

SEQ ID NO: 3229606 - RNA, 14 nt, Mycobacterium leprae
aucacaucagugcu

SEQ ID NO: 3229607 - RNA, 18 nt, Mycobacterium leprae
aucacauccgauuugucg

SEQ ID NO: 3229608 - RNA, 19 nt, Mycobacterium leprae
aucaccacgaucaccgcgg

SEQ ID NO: 3229609 - RNA, 15 nt, Mycobacterium leprae
aucaccacuuuggca

SEQ ID NO: 3229610 - RNA, 16 nt, Mycobacterium leprae
aucaccggaaagcuga

SEQ ID NO: 3229611 - RNA, 13 nt, Mycobacterium leprae
aucaccggccagc

SEQ ID NO: 3229612 - RNA, 22 nt, Mycobacterium leprae
aucaccggcggugucggcuacc

SEQ ID NO: 3229613 - RNA, 14 nt, Mycobacterium leprae
aucaccggugcacc

SEQ ID NO: 3229614 - RNA, 19 nt, Mycobacterium leprae
aucaccuagaacagcaucg

SEQ ID NO: 3229615 - RNA, 22 nt, Mycobacterium leprae
aucacgguugcuuccaacccgu

SEQ ID NO: 3229616 - RNA, 15 nt, Mycobacterium leprae
aucacguuggccggc

SEQ ID NO: 3229617 - RNA, 19 nt, Mycobacterium leprae
aucacugagugaaccuauu

SEQ ID NO: 3229618 - RNA, 18 nt, Mycobacterium leprae
aucacuugcugaccgacu

SEQ ID NO: 3229619 - RNA, 22 nt, Mycobacterium leprae
aucagaaauguccuugagcuaa

SEQ ID NO: 3229620 - RNA, 17 nt, Mycobacterium leprae
aucagacagagccggca

SEQ ID NO: 3229621 - RNA, 11 nt, Mycobacterium leprae
aucagauaucc

SEQ ID NO: 3229622 - RNA, 23 nt, Mycobacterium leprae
aucagaucgcgucgcaucggugg

SEQ ID NO: 3229623 - RNA, 13 nt, Mycobacterium leprae
aucagauguaauc

SEQ ID NO: 3229624 - RNA, 19 nt, Mycobacterium leprae
aucagcaacacuggcgacc

SEQ ID NO: 3229625 - RNA, 14 nt, Mycobacterium leprae
aucagcaagaaauu

SEQ ID NO: 3229626 - RNA, 15 nt, Mycobacterium leprae
aucagcaaggaacaa

SEQ ID NO: 3229627 - RNA, 14 nt, Mycobacterium leprae
aucagcaccgcgcc

SEQ ID NO: 3229628 - RNA, 15 nt, Mycobacterium leprae
aucaggaaggagccg

SEQ ID NO: 3229629 - RNA, 15 nt, Mycobacterium leprae
aucaggcuggggaag

SEQ ID NO: 3229630 - RNA, 15 nt, Mycobacterium leprae
aucagggcgcccccc

SEQ ID NO: 3229631 - RNA, 19 nt, Mycobacterium leprae
aucaguggacgcucgguga

SEQ ID NO: 3229632 - RNA, 13 nt, Mycobacterium leprae
aucaucgcccacc

SEQ ID NO: 3229633 - RNA, 23 nt, Mycobacterium leprae
aucaucgcccaccgcaacgccuc

SEQ ID NO: 3229634 - RNA, 16 nt, Mycobacterium leprae
aucaugcauccuccua

SEQ ID NO: 3229635 - RNA, 19 nt, Mycobacterium leprae
aucauggccgcagugauca

SEQ ID NO: 3229636 - RNA, 15 nt, Mycobacterium leprae
aucaugguuaacgaa

SEQ ID NO: 3229637 - RNA, 13 nt, Mycobacterium leprae
auccaaugacuac

SEQ ID NO: 3229638 - RNA, 14 nt, Mycobacterium leprae
auccacagcaucaa

SEQ ID NO: 3229639 - RNA, 17 nt, Mycobacterium leprae
auccaccauacagcuaa

SEQ ID NO: 3229640 - RNA, 13 nt, Mycobacterium leprae
auccacccaggac

SEQ ID NO: 3229641 - RNA, 23 nt, Mycobacterium leprae
auccacugcgaacuaguguucgg

SEQ ID NO: 3229642 - RNA, 22 nt, Mycobacterium leprae
auccacuugacggucgagcugg

SEQ ID NO: 3229643 - RNA, 12 nt, Mycobacterium leprae
auccagccaaca

SEQ ID NO: 3229644 - RNA, 16 nt, Mycobacterium leprae
auccagcccguugauc

SEQ ID NO: 3229645 - RNA, 18 nt, Mycobacterium leprae
auccagcccguugaucga

SEQ ID NO: 3229646 - RNA, 17 nt, Mycobacterium leprae
auccagcgaagguagcc

SEQ ID NO: 3229647 - RNA, 19 nt, Mycobacterium leprae
auccaggugcugcaguugg

SEQ ID NO: 3229648 - RNA, 14 nt, Mycobacterium leprae
auccaguagugcgg

SEQ ID NO: 3229649 - RNA, 22 nt, Mycobacterium leprae
auccaguaguuaccguauauua

SEQ ID NO: 3229650 - RNA, 18 nt, Mycobacterium leprae
auccaucgcaucugccau

SEQ ID NO: 3229651 - RNA, 16 nt, Mycobacterium leprae
auccauugaccucuuc

SEQ ID NO: 3229652 - RNA, 16 nt, Mycobacterium leprae
aucccaaaaccacaaa

SEQ ID NO: 3229653 - RNA, 15 nt, Mycobacterium leprae
aucccaaguggaaua

SEQ ID NO: 3229654 - RNA, 12 nt, Mycobacterium leprae
aucccacucuug

SEQ ID NO: 3229655 - RNA, 18 nt, Mycobacterium leprae
aucccacugacgccgauu

SEQ ID NO: 3229656 - RNA, 12 nt, Mycobacterium leprae
aucccagugugc

SEQ ID NO: 3229657 - RNA, 17 nt, Mycobacterium leprae
aucccagugugcugcau

SEQ ID NO: 3229658 - RNA, 15 nt, Mycobacterium leprae
aucccaucggcugca

SEQ ID NO: 3229659 - RNA, 17 nt, Mycobacterium leprae
aucccaucggcugcacc

SEQ ID NO: 3229660 - RNA, 18 nt, Mycobacterium leprae
aucccaucggcugcaccg

SEQ ID NO: 3229661 - RNA, 22 nt, Mycobacterium leprae
aucccaugagucuucacucacc

SEQ ID NO: 3229662 - RNA, 20 nt, Mycobacterium leprae
aucccccaggucaacagcau

SEQ ID NO: 3229663 - RNA, 16 nt, Mycobacterium leprae
auccccgauccagaca

SEQ ID NO: 3229664 - RNA, 18 nt, Mycobacterium leprae
aucccgaaaaccccacac

SEQ ID NO: 3229665 - RNA, 19 nt, Mycobacterium leprae
aucccgaaaaccccacacu

SEQ ID NO: 3229666 - RNA, 16 nt, Mycobacterium leprae
auccgaaacccgaaac

SEQ ID NO: 3229667 - RNA, 19 nt, Mycobacterium leprae
auccgaaacccgaaaccaa

SEQ ID NO: 3229668 - RNA, 16 nt, Mycobacterium leprae
auccgacaaagcagca

SEQ ID NO: 3229669 - RNA, 21 nt, Mycobacterium leprae
auccgagaaaacucgaucgag

SEQ ID NO: 3229670 - RNA, 21 nt, Mycobacterium leprae
auccgaguggguaaaaccggu

SEQ ID NO: 3229671 - RNA, 20 nt, Mycobacterium leprae
auccgaucaauggcagccac

SEQ ID NO: 3229672 - RNA, 15 nt, Mycobacterium leprae
auccgccggccgcac

SEQ ID NO: 3229673 - RNA, 22 nt, Mycobacterium leprae
auccgccggccgcacccggcag

SEQ ID NO: 3229674 - RNA, 13 nt, Mycobacterium leprae
auccgcgcaucgu

SEQ ID NO: 3229675 - RNA, 16 nt, Mycobacterium leprae
auccgcgguguguccc

SEQ ID NO: 3229676 - RNA, 18 nt, Mycobacterium leprae
auccgcgugaugauggcc

SEQ ID NO: 3229677 - RNA, 21 nt, Mycobacterium leprae
auccggaaaucgagaauuuac

SEQ ID NO: 3229678 - RNA, 16 nt, Mycobacterium leprae
aucugauucagauuac

SEQ ID NO: 3229679 - RNA, 11 nt, Mycobacterium leprae
aucugcacaac

SEQ ID NO: 3229680 - RNA, 20 nt, Mycobacterium leprae
aucugcgugccgagccugga

SEQ ID NO: 3229681 - RNA, 15 nt, Mycobacterium leprae
aucugcuacgcuggc

SEQ ID NO: 3229682 - RNA, 14 nt, Mycobacterium leprae
aucugcucggcgaa

SEQ ID NO: 3229683 - RNA, 15 nt, Mycobacterium leprae
aucugcuuguggcgg

SEQ ID NO: 3229684 - RNA, 16 nt, Mycobacterium leprae
aucugcuuguggcgga

SEQ ID NO: 3229685 - RNA, 13 nt, Mycobacterium leprae
aucuggacaaagu

SEQ ID NO: 3229686 - RNA, 17 nt, Mycobacterium leprae
aucuggauggccgccag

SEQ ID NO: 3229687 - RNA, 15 nt, Mycobacterium leprae
aucugguagccguuc

SEQ ID NO: 3229688 - RNA, 15 nt, Mycobacterium leprae
aucuggugaaacugc

SEQ ID NO: 3229689 - RNA, 20 nt, Mycobacterium leprae
aucuguacgcguugauggcc

SEQ ID NO: 3229690 - RNA, 13 nt, Mycobacterium leprae
aucugugccuggu

SEQ ID NO: 3229691 - RNA, 18 nt, Mycobacterium leprae
aucuguuccgcgugugcc

SEQ ID NO: 3229692 - RNA, 17 nt, Mycobacterium leprae
aucuucgcccagcacgc

SEQ ID NO: 3229693 - RNA, 22 nt, Mycobacterium leprae
aucuucucuuguaguagcaggu

SEQ ID NO: 3229694 - RNA, 18 nt, Mycobacterium leprae
aucuucugaaccaucacu

SEQ ID NO: 3229695 - RNA, 16 nt, Mycobacterium leprae
aucuugaguguagcag

SEQ ID NO: 3229696 - RNA, 17 nt, Mycobacterium leprae
aucuugaguguagcagg

SEQ ID NO: 3229697 - RNA, 20 nt, Mycobacterium leprae
aucuugcggauuugcagagc

SEQ ID NO: 3229698 - RNA, 21 nt, Mycobacterium leprae
aucuuggagaagguuucccgc

SEQ ID NO: 3229699 - RNA, 23 nt, Mycobacterium leprae
aucuugggcaucggcuugauguc

SEQ ID NO: 3229700 - RNA, 16 nt, Mycobacterium leprae
aucuuggugaugucga

SEQ ID NO: 3229701 - RNA, 16 nt, Mycobacterium leprae
aucuuugccuucguga

SEQ ID NO: 3229702 - RNA, 16 nt, Mycobacterium leprae
aucuuuucggcugcac

SEQ ID NO: 3229703 - RNA, 13 nt, Mycobacterium leprae
aucuuuugaccag

SEQ ID NO: 3229704 - RNA, 13 nt, Mycobacterium leprae
aucuuuuuuagag

SEQ ID NO: 3229705 - RNA, 23 nt, Mycobacterium leprae
augaaaucccgcuaugugcaauc

SEQ ID NO: 3229706 - RNA, 19 nt, Mycobacterium leprae
augaacugacuucagucag

SEQ ID NO: 3229707 - RNA, 23 nt, Mycobacterium leprae
augaauucuugauccgagaaaac

SEQ ID NO: 3229708 - RNA, 17 nt, Mycobacterium leprae
augacacugcggcugcg

SEQ ID NO: 3229709 - RNA, 21 nt, Mycobacterium leprae
augacagcgaugacauggaag

SEQ ID NO: 3229710 - RNA, 17 nt, Mycobacterium leprae
augacaugcacacuaaa

SEQ ID NO: 3229711 - RNA, 13 nt, Mycobacterium leprae
augaccgagcugg

SEQ ID NO: 3229712 - RNA, 16 nt, Mycobacterium leprae
augaccgcaccgaucu

SEQ ID NO: 3229713 - RNA, 22 nt, Mycobacterium leprae
augaccgcggucggcaucugcu

SEQ ID NO: 3229714 - RNA, 22 nt, Mycobacterium leprae
augacgacuugacacaaagaag

SEQ ID NO: 3229715 - RNA, 21 nt, Mycobacterium leprae
augacgccugggaacccauug

SEQ ID NO: 3229716 - RNA, 20 nt, Mycobacterium leprae
augacggcgcaguugaccgg

SEQ ID NO: 3229717 - RNA, 21 nt, Mycobacterium leprae
augacguugcucgacaggggc

SEQ ID NO: 3229718 - RNA, 16 nt, Mycobacterium leprae
augacuguggcuauga

SEQ ID NO: 3229719 - RNA, 13 nt, Mycobacterium leprae
augagcaacacgu

SEQ ID NO: 3229720 - RNA, 16 nt, Mycobacterium leprae
augagcacacgcugcg

SEQ ID NO: 3229721 - RNA, 17 nt, Mycobacterium leprae
augagcaguagaccaag

SEQ ID NO: 3229722 - RNA, 13 nt, Mycobacterium leprae
augagccgacuga

SEQ ID NO: 3229723 - RNA, 15 nt, Mycobacterium leprae
augagucuucacuca

SEQ ID NO: 3229724 - RNA, 17 nt, Mycobacterium leprae
augaguugugcagcuga

SEQ ID NO: 3229725 - RNA, 19 nt, Mycobacterium leprae
augauccagcugucagugu

SEQ ID NO: 3229726 - RNA, 16 nt, Mycobacterium leprae
augaucgucauaggcu

SEQ ID NO: 3229727 - RNA, 12 nt, Mycobacterium leprae
augaucuucuga

SEQ ID NO: 3229728 - RNA, 19 nt, Mycobacterium leprae
augaucuuggcccggcucc

SEQ ID NO: 3229729 - RNA, 21 nt, Mycobacterium leprae
augaugguuuggcugccagaa

SEQ ID NO: 3229730 - RNA, 22 nt, Mycobacterium leprae
augauugcagauguugcagcag

SEQ ID NO: 3229731 - RNA, 19 nt, Mycobacterium leprae
augauuuauguguaagaua

SEQ ID NO: 3229732 - RNA, 15 nt, Mycobacterium leprae
augcaacuaugcggc

SEQ ID NO: 3229733 - RNA, 13 nt, Mycobacterium leprae
augcaagauuauu

SEQ ID NO: 3229734 - RNA, 19 nt, Mycobacterium leprae
augcacgccggcgucgcac

SEQ ID NO: 3229735 - RNA, 18 nt, Mycobacterium leprae
augcacgugauggcgcgu

SEQ ID NO: 3229736 - RNA, 21 nt, Mycobacterium leprae
augcacgugcauaaguugcgu

SEQ ID NO: 3229737 - RNA, 15 nt, Mycobacterium leprae
augcagaugcaagau

SEQ ID NO: 3229738 - RNA, 23 nt, Mycobacterium leprae
augcagcagccagucagccgucg

SEQ ID NO: 3229739 - RNA, 18 nt, Mycobacterium leprae
augcagcuggugguccug

SEQ ID NO: 3229740 - RNA, 14 nt, Mycobacterium leprae
augcagggccagcc

SEQ ID NO: 3229741 - RNA, 13 nt, Mycobacterium leprae
augcaguacgugu

SEQ ID NO: 3229742 - RNA, 22 nt, Mycobacterium leprae
augcagucgcucaggcuaccga

SEQ ID NO: 3229743 - RNA, 13 nt, Mycobacterium leprae
augcaguggguga

SEQ ID NO: 3229744 - RNA, 19 nt, Mycobacterium leprae
augccaaccugugcaugca

SEQ ID NO: 3229745 - RNA, 16 nt, Mycobacterium leprae
augccacgagcucgaa

SEQ ID NO: 3229746 - RNA, 19 nt, Mycobacterium leprae
augccacuaaacauuuuag

SEQ ID NO: 3229747 - RNA, 18 nt, Mycobacterium leprae
augccaguuuuggugucu

SEQ ID NO: 3229748 - RNA, 19 nt, Mycobacterium leprae
augccaguuuuggugucuu

SEQ ID NO: 3229749 - RNA, 17 nt, Mycobacterium leprae
augccaucagaagacca

SEQ ID NO: 3229750 - RNA, 20 nt, Mycobacterium leprae
augcccaggggguaguucuu

SEQ ID NO: 3229751 - RNA, 14 nt, Mycobacterium leprae
augcccaugccagc

SEQ ID NO: 3229752 - RNA, 13 nt, Mycobacterium leprae
augccgacagugc

SEQ ID NO: 3229753 - RNA, 19 nt, Mycobacterium leprae
augccgagguggcagcugg

SEQ ID NO: 3229754 - RNA, 18 nt, Mycobacterium leprae
augccgcagcaucagggc

SEQ ID NO: 3229755 - RNA, 10 nt, Mycobacterium leprae
augccgccgg

SEQ ID NO: 3229756 - RNA, 19 nt, Mycobacterium leprae
augccggauuccgaacgac

SEQ ID NO: 3229757 - RNA, 17 nt, Mycobacterium leprae
augccgggcugcaccga

SEQ ID NO: 3229758 - RNA, 18 nt, Mycobacterium leprae
augccgguggccagcgca

SEQ ID NO: 3229759 - RNA, 23 nt, Mycobacterium leprae
augccuacccuagagucgaccgc

SEQ ID NO: 3229760 - RNA, 17 nt, Mycobacterium leprae
augccugcuugcuggcu

SEQ ID NO: 3229761 - RNA, 19 nt, Mycobacterium leprae
augccugcuugcuggcuga

SEQ ID NO: 3229762 - RNA, 18 nt, Mycobacterium leprae
augccuugaccuucucga

SEQ ID NO: 3229763 - RNA, 15 nt, Mycobacterium leprae
augcgaacgaaucgc

SEQ ID NO: 3229764 - RNA, 23 nt, Mycobacterium leprae
augcgaucgcagucaucaccccg

SEQ ID NO: 3229765 - RNA, 23 nt, Mycobacterium leprae
augcgccugaagguuaucgacac

SEQ ID NO: 3229766 - RNA, 22 nt, Mycobacterium leprae
augcgcuaagguggagcgaccg

SEQ ID NO: 3229767 - RNA, 20 nt, Mycobacterium leprae
augcgcuguuguuggucggc

SEQ ID NO: 3229768 - RNA, 18 nt, Mycobacterium leprae
augcggcggacgaucgag

SEQ ID NO: 3229769 - RNA, 13 nt, Mycobacterium leprae
augcggcgggauc

SEQ ID NO: 3229770 - RNA, 18 nt, Mycobacterium leprae
augcggcgggaucgccga

SEQ ID NO: 3229771 - RNA, 21 nt, Mycobacterium leprae
augcggggggagagacgucga

SEQ ID NO: 3229772 - RNA, 20 nt, Mycobacterium leprae
augcgguagucuaucccggc

SEQ ID NO: 3229773 - RNA, 14 nt, Mycobacterium leprae
augcguccaccgag

SEQ ID NO: 3229774 - RNA, 19 nt, Mycobacterium leprae
augcguugucgucggccgc

SEQ ID NO: 3229775 - RNA, 21 nt, Mycobacterium leprae
augcguugucgucggccgcgg

SEQ ID NO: 3229776 - RNA, 20 nt, Mycobacterium leprae
augcuagggcugcuguucau

SEQ ID NO: 3229777 - RNA, 15 nt, Mycobacterium leprae
augcuccgacacugg

SEQ ID NO: 3229778 - RNA, 13 nt, Mycobacterium leprae
augcucgaccagg

SEQ ID NO: 3229779 - RNA, 14 nt, Mycobacterium leprae
augcugccugcguc

SEQ ID NO: 3229780 - RNA, 13 nt, Mycobacterium leprae
augcugcguucag

SEQ ID NO: 3229781 - RNA, 19 nt, Mycobacterium leprae
augcuggagcgaugucgag

SEQ ID NO: 3229782 - RNA, 15 nt, Mycobacterium leprae
augcugugaugcugu

SEQ ID NO: 3229783 - RNA, 19 nt, Mycobacterium leprae
augcuguguggcuguuucu

SEQ ID NO: 3229784 - RNA, 14 nt, Mycobacterium leprae
augcuguucgguga

SEQ ID NO: 3229785 - RNA, 21 nt, Mycobacterium leprae
augcuugggucgaucgcuggu

SEQ ID NO: 3229786 - RNA, 17 nt, Mycobacterium leprae
auggaacagcguucgac

SEQ ID NO: 3229787 - RNA, 22 nt, Mycobacterium leprae
auggacaaccugggcggcauga

SEQ ID NO: 3229788 - RNA, 15 nt, Mycobacterium leprae
auggacagaacaccc

SEQ ID NO: 3229789 - RNA, 20 nt, Mycobacterium leprae
auggacgaccugcggcauuc

SEQ ID NO: 3229790 - RNA, 20 nt, Mycobacterium leprae
auggaguuacuuucgacagc

SEQ ID NO: 3229791 - RNA, 20 nt, Mycobacterium leprae
auucuagguucgaguccugg

SEQ ID NO: 3229792 - RNA, 20 nt, Mycobacterium leprae
auucucgagcgagcccagug

SEQ ID NO: 3229793 - RNA, 22 nt, Mycobacterium leprae
auucucgagcggcgcaugccaa

SEQ ID NO: 3229794 - RNA, 14 nt, Mycobacterium leprae
auucucuguugcug

SEQ ID NO: 3229795 - RNA, 18 nt, Mycobacterium leprae
auucugcacgcccaacac

SEQ ID NO: 3229796 - RNA, 18 nt, Mycobacterium leprae
auucugcgguaucaucaa

SEQ ID NO: 3229797 - RNA, 13 nt, Mycobacterium leprae
auucuguugcagg

SEQ ID NO: 3229798 - RNA, 14 nt, Mycobacterium leprae
auucuucucuaaaa

SEQ ID NO: 3229799 - RNA, 16 nt, Mycobacterium leprae
auucuuuuagagaaaa

SEQ ID NO: 3229800 - RNA, 13 nt, Mycobacterium leprae
auugacaacacga

SEQ ID NO: 3229801 - RNA, 21 nt, Mycobacterium leprae
auugaccgcaucaccgaucac

SEQ ID NO: 3229802 - RNA, 18 nt, Mycobacterium leprae
auugacgaaacggcgucg

SEQ ID NO: 3229803 - RNA, 20 nt, Mycobacterium leprae
auugacguaagaauacacua

SEQ ID NO: 3229804 - RNA, 21 nt, Mycobacterium leprae
auugacgucgguguggugcuc

SEQ ID NO: 3229805 - RNA, 14 nt, Mycobacterium leprae
auugacgugguggu

SEQ ID NO: 3229806 - RNA, 19 nt, Mycobacterium leprae
auugaguacaucugauuga

SEQ ID NO: 3229807 - RNA, 20 nt, Mycobacterium leprae
auugaucguccgcaaccgau

SEQ ID NO: 3229808 - RNA, 19 nt, Mycobacterium leprae
auugaugcacgcgcgccug

SEQ ID NO: 3229809 - RNA, 16 nt, Mycobacterium leprae
auugauggaugcacac

SEQ ID NO: 3229810 - RNA, 17 nt, Mycobacterium leprae
auugcagcccugagcac

SEQ ID NO: 3229811 - RNA, 18 nt, Mycobacterium leprae
auugcagcccugagcacc

SEQ ID NO: 3229812 - RNA, 14 nt, Mycobacterium leprae
auugcagcgcgaac

SEQ ID NO: 3229813 - RNA, 16 nt, Mycobacterium leprae
auugcaugcaccgacg

SEQ ID NO: 3229814 - RNA, 15 nt, Mycobacterium leprae
auugcauuggcugau

SEQ ID NO: 3229815 - RNA, 18 nt, Mycobacterium leprae
auugcauuggcugaucaa

SEQ ID NO: 3229816 - RNA, 21 nt, Mycobacterium leprae
auugccaacucaccgcaggcg

SEQ ID NO: 3229817 - RNA, 23 nt, Mycobacterium leprae
auugccucggcuucccgauccca

SEQ ID NO: 3229818 - RNA, 16 nt, Mycobacterium leprae
auugccugaugccauc

SEQ ID NO: 3229819 - RNA, 15 nt, Mycobacterium leprae
auugcgacauccaaa

SEQ ID NO: 3229820 - RNA, 17 nt, Mycobacterium leprae
auugcggccgaauucga

SEQ ID NO: 3229821 - RNA, 21 nt, Mycobacterium leprae
auugcguugaccgccgccauc

SEQ ID NO: 3229822 - RNA, 19 nt, Mycobacterium leprae
auugcucagugagccgucu

SEQ ID NO: 3229823 - RNA, 22 nt, Mycobacterium leprae
auugcucgguauuugcggugga

SEQ ID NO: 3229824 - RNA, 12 nt, Mycobacterium leprae
auugcugcaucu

SEQ ID NO: 3229825 - RNA, 22 nt, Mycobacterium leprae
auugcuggugccccagucgcca

SEQ ID NO: 3229826 - RNA, 21 nt, Mycobacterium leprae
auugcuuuuguccugacagau

SEQ ID NO: 3229827 - RNA, 16 nt, Mycobacterium leprae
auuggacccgaucgac

SEQ ID NO: 3229828 - RNA, 19 nt, Mycobacterium leprae
auuggacccgaucgacggc

SEQ ID NO: 3229829 - RNA, 22 nt, Mycobacterium leprae
auuggauguaaucguaccaaca

SEQ ID NO: 3229830 - RNA, 21 nt, Mycobacterium leprae
auuggccauuguugugcuggg

SEQ ID NO: 3229831 - RNA, 13 nt, Mycobacterium leprae
auuggcugaucaa

SEQ ID NO: 3229832 - RNA, 14 nt, Mycobacterium leprae
auuggcugaucaaa

SEQ ID NO: 3229833 - RNA, 15 nt, Mycobacterium leprae
auuggcugaucaaaa

SEQ ID NO: 3229834 - RNA, 20 nt, Mycobacterium leprae
auugggcagcuaagaagcug

SEQ ID NO: 3229835 - RNA, 15 nt, Mycobacterium leprae
auuggguaaagugaa

SEQ ID NO: 3229836 - RNA, 18 nt, Mycobacterium leprae
auugguugccgagcuguu

SEQ ID NO: 3229837 - RNA, 13 nt, Mycobacterium leprae
auuguacugacug

SEQ ID NO: 3229838 - RNA, 19 nt, Mycobacterium leprae
auuguacuuugugugcaug

SEQ ID NO: 3229839 - RNA, 15 nt, Mycobacterium leprae
auugucauggccgcu

SEQ ID NO: 3229840 - RNA, 22 nt, Mycobacterium leprae
auuguccgagcuuuuccagcgg

SEQ ID NO: 3229841 - RNA, 21 nt, Mycobacterium leprae
auugucgguguugaucgaccg

SEQ ID NO: 3229842 - RNA, 20 nt, Mycobacterium leprae
auugucgugggucagucgga

SEQ ID NO: 3229843 - RNA, 19 nt, Mycobacterium leprae
auuuaaauuucaagacaga

SEQ ID NO: 3229844 - RNA, 21 nt, Mycobacterium leprae
auuuaccgagaucgacgcugc

SEQ ID NO: 3229845 - RNA, 22 nt, Mycobacterium leprae
auuuaccggcguucaauaagaa

SEQ ID NO: 3229846 - RNA, 22 nt, Mycobacterium leprae
auuuaccggcguucgauaagaa

SEQ ID NO: 3229847 - RNA, 16 nt, Mycobacterium leprae
auuuagaggcugcacc

SEQ ID NO: 3229848 - RNA, 19 nt, Mycobacterium leprae
auuuagcgaccggccagug

SEQ ID NO: 3229849 - RNA, 17 nt, Mycobacterium leprae
auuuauauucaauuuuc

SEQ ID NO: 3229850 - RNA, 18 nt, Mycobacterium leprae
auuuauuugucgcuggau

SEQ ID NO: 3229851 - RNA, 16 nt, Mycobacterium leprae
auuuccggaacaacag

SEQ ID NO: 3229852 - RNA, 22 nt, Mycobacterium leprae
auuuccggaacaacagacacau

SEQ ID NO: 3229853 - RNA, 14 nt, Mycobacterium leprae
auuucgacaggcug

SEQ ID NO: 3229854 - RNA, 16 nt, Mycobacterium leprae
auuucgacaggcuguc

SEQ ID NO: 3229855 - RNA, 19 nt, Mycobacterium leprae
auuucgacggcaacggcac

SEQ ID NO: 3229856 - RNA, 14 nt, Mycobacterium leprae
auuucggacgugga

SEQ ID NO: 3229857 - RNA, 22 nt, Mycobacterium leprae
auuucggcgucgugaucggcau

SEQ ID NO: 3229858 - RNA, 18 nt, Mycobacterium leprae
auuucucgugguggcugg

SEQ ID NO: 3229859 - RNA, 22 nt, Mycobacterium leprae
auuucucgugguggcuggcuac

SEQ ID NO: 3229860 - RNA, 15 nt, Mycobacterium leprae
auuugcacaacaucc

SEQ ID NO: 3229861 - RNA, 16 nt, Mycobacterium leprae
auuugccccagccgac

SEQ ID NO: 3229862 - RNA, 22 nt, Mycobacterium leprae
auuugcucagugacguguuggu

SEQ ID NO: 3229863 - RNA, 11 nt, Mycobacterium leprae
auuugcuggcu

SEQ ID NO: 3229864 - RNA, 16 nt, Mycobacterium leprae
auuugcuggcugccgc

SEQ ID NO: 3229865 - RNA, 13 nt, Mycobacterium leprae
auuuggcugauaa

SEQ ID NO: 3229866 - RNA, 13 nt, Mycobacterium leprae
auuuggugaucac

SEQ ID NO: 3229867 - RNA, 12 nt, Mycobacterium leprae
auuuguguuggc

SEQ ID NO: 3229868 - RNA, 17 nt, Mycobacterium leprae
auuuguuuuccugugca

SEQ ID NO: 3229869 - RNA, 15 nt, Mycobacterium leprae
auuuucaagacugca

SEQ ID NO: 3229870 - RNA, 17 nt, Mycobacterium leprae
auuuucaagacugcacc

SEQ ID NO: 3229871 - RNA, 13 nt, Mycobacterium leprae
auuuuccaguuga

SEQ ID NO: 3229872 - RNA, 14 nt, Mycobacterium leprae
auuuucggcggcac

SEQ ID NO: 3229873 - RNA, 19 nt, Mycobacterium leprae
auuuucguugugccgcugc

SEQ ID NO: 3229874 - RNA, 19 nt, Mycobacterium leprae
auuuucucggugucaucua

SEQ ID NO: 3229875 - RNA, 16 nt, Mycobacterium leprae
auuuucuugccgucga

SEQ ID NO: 3229876 - RNA, 15 nt, Mycobacterium leprae
auuuucuugugaguu

SEQ ID NO: 3229877 - RNA, 15 nt, Mycobacterium leprae
auuuugggugaucaa

SEQ ID NO: 3229878 - RNA, 17 nt, Mycobacterium leprae
auuuuucuugaaaaaua

SEQ ID NO: 3229879 - RNA, 16 nt, Mycobacterium leprae
auuuuuggcauacucu

SEQ ID NO: 3229880 - RNA, 11 nt, Mycobacterium leprae
caaaaaaaggg

SEQ ID NO: 3229881 - RNA, 12 nt, Mycobacterium leprae
caaaaaaaggga

SEQ ID NO: 3229882 - RNA, 18 nt, Mycobacterium leprae
caaaaacucauguucuca

SEQ ID NO: 3229883 - RNA, 19 nt, Mycobacterium leprae
caaaacaugaacacgcuua

SEQ ID NO: 3229884 - RNA, 15 nt, Mycobacterium leprae
caaaaccaucgucga

SEQ ID NO: 3229885 - RNA, 21 nt, Mycobacterium leprae
caaaaccguagaacaacuaac

SEQ ID NO: 3229886 - RNA, 18 nt, Mycobacterium leprae
caaaaccuaucccgaccg

SEQ ID NO: 3229887 - RNA, 19 nt, Mycobacterium leprae
caaaacgucgaucucgacg

SEQ ID NO: 3229888 - RNA, 20 nt, Mycobacterium leprae
caaaacgucgaucuggggaa

SEQ ID NO: 3229889 - RNA, 16 nt, Mycobacterium leprae
caaaacuuacuucugu

SEQ ID NO: 3229890 - RNA, 11 nt, Mycobacterium leprae
caaaaggcagg

SEQ ID NO: 3229891 - RNA, 22 nt, Mycobacterium leprae
caaaaugcucccccaaugcagc

SEQ ID NO: 3229892 - RNA, 20 nt, Mycobacterium leprae
caaacaccggcgggccgaug

SEQ ID NO: 3229893 - RNA, 14 nt, Mycobacterium leprae
caaaccaaacaaca

SEQ ID NO: 3229894 - RNA, 15 nt, Mycobacterium leprae
caaaccaaacaacaa

SEQ ID NO: 3229895 - RNA, 21 nt, Mycobacterium leprae
caaaccaggcgacacgcgcga

SEQ ID NO: 3229896 - RNA, 21 nt, Mycobacterium leprae
caaaccaguaccuuggucacg

SEQ ID NO: 3229897 - RNA, 21 nt, Mycobacterium leprae
caaaccgcaguacuggugcug

SEQ ID NO: 3229898 - RNA, 16 nt, Mycobacterium leprae
caaaccggccaccacg

SEQ ID NO: 3229899 - RNA, 13 nt, Mycobacterium leprae
caaacgaccggau

SEQ ID NO: 3229900 - RNA, 16 nt, Mycobacterium leprae
caaacgcugcgcgcag

SEQ ID NO: 3229901 - RNA, 23 nt, Mycobacterium leprae
caaacggaauaaucacagccucc

SEQ ID NO: 3229902 - RNA, 22 nt, Mycobacterium leprae
caaacgucguccgguggucgcg

SEQ ID NO: 3229903 - RNA, 13 nt, Mycobacterium leprae
caaacguuucgcc

SEQ ID NO: 3229904 - RNA, 19 nt, Mycobacterium leprae
caagcagucccaaggggag

SEQ ID NO: 3229905 - RNA, 22 nt, Mycobacterium leprae
caagcagugucugggccgggcu

SEQ ID NO: 3229906 - RNA, 14 nt, Mycobacterium leprae
caagccaguguucc

SEQ ID NO: 3229907 - RNA, 18 nt, Mycobacterium leprae
caagccaugcaaccacac

SEQ ID NO: 3229908 - RNA, 20 nt, Mycobacterium leprae
caagccaugcaaccacaccc

SEQ ID NO: 3229909 - RNA, 18 nt, Mycobacterium leprae
caagcccccucggcgauc

SEQ ID NO: 3229910 - RNA, 13 nt, Mycobacterium leprae
caagccggucggg

SEQ ID NO: 3229911 - RNA, 18 nt, Mycobacterium leprae
caagccggugccaggcag

SEQ ID NO: 3229912 - RNA, 15 nt, Mycobacterium leprae
caagcgaucggaaca

SEQ ID NO: 3229913 - RNA, 17 nt, Mycobacterium leprae
caagcgaucggaacauc

SEQ ID NO: 3229914 - RNA, 18 nt, Mycobacterium leprae
caagcgaucggaacauca

SEQ ID NO: 3229915 - RNA, 14 nt, Mycobacterium leprae
caagcgcgccgagu

SEQ ID NO: 3229916 - RNA, 22 nt, Mycobacterium leprae
caagcgcuuuuccuuggaacca

SEQ ID NO: 3229917 - RNA, 14 nt, Mycobacterium leprae
caagcggccgccca

SEQ ID NO: 3229918 - RNA, 19 nt, Mycobacterium leprae
caagcuagaucaacagcgc

SEQ ID NO: 3229919 - RNA, 21 nt, Mycobacterium leprae
caagcuagcucuccuacaacg

SEQ ID NO: 3229920 - RNA, 20 nt, Mycobacterium leprae
caagcucaaccaacaugugc

SEQ ID NO: 3229921 - RNA, 18 nt, Mycobacterium leprae
caagcucccggagagagu

SEQ ID NO: 3229922 - RNA, 13 nt, Mycobacterium leprae
caagcugcccggc

SEQ ID NO: 3229923 - RNA, 22 nt, Mycobacterium leprae
caagcuuacuuggucaagguga

SEQ ID NO: 3229924 - RNA, 15 nt, Mycobacterium leprae
caaggaacaaaaucu

SEQ ID NO: 3229925 - RNA, 19 nt, Mycobacterium leprae
caaggaccggugcugcagc

SEQ ID NO: 3229926 - RNA, 18 nt, Mycobacterium leprae
caaggcuuggccagcaag

SEQ ID NO: 3229927 - RNA, 15 nt, Mycobacterium leprae
caagggauuccacug

SEQ ID NO: 3229928 - RNA, 20 nt, Mycobacterium leprae
caagggauuccacugccaga

SEQ ID NO: 3229929 - RNA, 22 nt, Mycobacterium leprae
caaggucgagugcgagccacuc

SEQ ID NO: 3229930 - RNA, 15 nt, Mycobacterium leprae
caaggucggugggca

SEQ ID NO: 3229931 - RNA, 18 nt, Mycobacterium leprae
caaggucggugggcaauu

SEQ ID NO: 3229932 - RNA, 20 nt, Mycobacterium leprae
caaggucguuagcgccgaga

SEQ ID NO: 3229933 - RNA, 16 nt, Mycobacterium leprae
caagguguugcgguga

SEQ ID NO: 3229934 - RNA, 17 nt, Mycobacterium leprae
caaguagcaguguggca

SEQ ID NO: 3229935 - RNA, 15 nt, Mycobacterium leprae
caaguaggguggguu

SEQ ID NO: 3229936 - RNA, 16 nt, Mycobacterium leprae
caagucaaaaccagcc

SEQ ID NO: 3229937 - RNA, 17 nt, Mycobacterium leprae
caagucacaccacuacc

SEQ ID NO: 3229938 - RNA, 22 nt, Mycobacterium leprae
caagucggucgccgagcugauc

SEQ ID NO: 3229939 - RNA, 16 nt, Mycobacterium leprae
caagucuuucagauac

SEQ ID NO: 3229940 - RNA, 19 nt, Mycobacterium leprae
caagugccgcgggugcagu

SEQ ID NO: 3229941 - RNA, 23 nt, Mycobacterium leprae
caagugccgcgggugcaguugua

SEQ ID NO: 3229942 - RNA, 19 nt, Mycobacterium leprae
caagugcggcgcccagcac

SEQ ID NO: 3229943 - RNA, 21 nt, Mycobacterium leprae
caaguggcugcuaugguuggu

SEQ ID NO: 3229944 - RNA, 13 nt, Mycobacterium leprae
caaguggucccgc

SEQ ID NO: 3229945 - RNA, 18 nt, Mycobacterium leprae
caaguguguucuacccag

SEQ ID NO: 3229946 - RNA, 16 nt, Mycobacterium leprae
caaguguuuccacacc

SEQ ID NO: 3229947 - RNA, 15 nt, Mycobacterium leprae
caaguuuagcaacaa

SEQ ID NO: 3229948 - RNA, 18 nt, Mycobacterium leprae
caaguuuagcaacaaauu

SEQ ID NO: 3229949 - RNA, 21 nt, Mycobacterium leprae
caauaccgaccgaaagccgca

SEQ ID NO: 3229950 - RNA, 17 nt, Mycobacterium leprae
caauaccuaucgacauc

SEQ ID NO: 3229951 - RNA, 16 nt, Mycobacterium leprae
caauacggugcaccag

SEQ ID NO: 3229952 - RNA, 14 nt, Mycobacterium leprae
caaucaacgagauc

SEQ ID NO: 3229953 - RNA, 20 nt, Mycobacterium leprae
caaucagacacggaagcccu

SEQ ID NO: 3229954 - RNA, 13 nt, Mycobacterium leprae
caauccaccgugc

SEQ ID NO: 3229955 - RNA, 17 nt, Mycobacterium leprae
caauccagccaacauag

SEQ ID NO: 3229956 - RNA, 20 nt, Mycobacterium leprae
caauccguacugguucgcga

SEQ ID NO: 3229957 - RNA, 22 nt, Mycobacterium leprae
caauccugcguagcaagguguu

SEQ ID NO: 3229958 - RNA, 21 nt, Mycobacterium leprae
caaucgaauuaggaguugaca

SEQ ID NO: 3229959 - RNA, 15 nt, Mycobacterium leprae
caaucgccugugucg

SEQ ID NO: 3229960 - RNA, 15 nt, Mycobacterium leprae
caaucgcggcacaug

SEQ ID NO: 3229961 - RNA, 17 nt, Mycobacterium leprae
caaucuaauugcgaugc

SEQ ID NO: 3229962 - RNA, 15 nt, Mycobacterium leprae
caaucucacguccga

SEQ ID NO: 3229963 - RNA, 20 nt, Mycobacterium leprae
caaucuccgguggauacaua

SEQ ID NO: 3229964 - RNA, 14 nt, Mycobacterium leprae
caaugacuacgaca

SEQ ID NO: 3229965 - RNA, 18 nt, Mycobacterium leprae
caaugcaguagaauuuau

SEQ ID NO: 3229966 - RNA, 15 nt, Mycobacterium leprae
caaugccggacuggc

SEQ ID NO: 3229967 - RNA, 17 nt, Mycobacterium leprae
caaugcucugcugauca

SEQ ID NO: 3229968 - RNA, 19 nt, Mycobacterium leprae
caaugcugagcgaagaauu

SEQ ID NO: 3229969 - RNA, 17 nt, Mycobacterium leprae
caaugggugugacacca

SEQ ID NO: 3229970 - RNA, 17 nt, Mycobacterium leprae
caaugugcgcugcuccg

SEQ ID NO: 3229971 - RNA, 23 nt, Mycobacterium leprae
caauguggccgcaccugaacagg

SEQ ID NO: 3229972 - RNA, 21 nt, Mycobacterium leprae
caauguugagugcgaccugaa

SEQ ID NO: 3229973 - RNA, 15 nt, Mycobacterium leprae
caauucaacgaauac

SEQ ID NO: 3229974 - RNA, 13 nt, Mycobacterium leprae
caauucacgaaca

SEQ ID NO: 3229975 - RNA, 12 nt, Mycobacterium leprae
caauucgacugc

SEQ ID NO: 3229976 - RNA, 20 nt, Mycobacterium leprae
caauucgccgacucgcgauc

SEQ ID NO: 3229977 - RNA, 18 nt, Mycobacterium leprae
caauucggagagacgugu

SEQ ID NO: 3229978 - RNA, 20 nt, Mycobacterium leprae
caauucggcgagcacuugca

SEQ ID NO: 3229979 - RNA, 17 nt, Mycobacterium leprae
caauucuucgcucagca

SEQ ID NO: 3229980 - RNA, 13 nt, Mycobacterium leprae
caauugacgccga

SEQ ID NO: 3229981 - RNA, 19 nt, Mycobacterium leprae
caauugcggccgaauucga

SEQ ID NO: 3229982 - RNA, 22 nt, Mycobacterium leprae
caauuguucgacaagcccccgc

SEQ ID NO: 3229983 - RNA, 11 nt, Mycobacterium leprae
cacaaacucca

SEQ ID NO: 3229984 - RNA, 20 nt, Mycobacterium leprae
cacaaacuccagagccgcgc

SEQ ID NO: 3229985 - RNA, 21 nt, Mycobacterium leprae
cacaacaagagaagagcuggu

SEQ ID NO: 3229986 - RNA, 15 nt, Mycobacterium leprae
cacaaccagcuuggg

SEQ ID NO: 3229987 - RNA, 13 nt, Mycobacterium leprae
cacaaccaucgcu

SEQ ID NO: 3229988 - RNA, 19 nt, Mycobacterium leprae
cacaagauugcagcccuga

SEQ ID NO: 3229989 - RNA, 15 nt, Mycobacterium leprae
cacaagcaacugcag

SEQ ID NO: 3229990 - RNA, 14 nt, Mycobacterium leprae
cacaaggaauugcu

SEQ ID NO: 3229991 - RNA, 19 nt, Mycobacterium leprae
cacaauucuucgcucagca

SEQ ID NO: 3229992 - RNA, 22 nt, Mycobacterium leprae
cacacagcaaugugcgcugcuc

SEQ ID NO: 3229993 - RNA, 22 nt, Mycobacterium leprae
cacacaggucauccuugcgcug

SEQ ID NO: 3229994 - RNA, 20 nt, Mycobacterium leprae
cacaccuggugugcgcgccg

SEQ ID NO: 3229995 - RNA, 22 nt, Mycobacterium leprae
cacacgacagccgcaaucgccg

SEQ ID NO: 3229996 - RNA, 14 nt, Mycobacterium leprae
cacacgagaccaug

SEQ ID NO: 3229997 - RNA, 13 nt, Mycobacterium leprae
cacacggcgcgau

SEQ ID NO: 3229998 - RNA, 16 nt, Mycobacterium leprae
cacacuaaacugcgug

SEQ ID NO: 3229999 - RNA, 15 nt, Mycobacterium leprae
cacacucacgccugc

SEQ ID NO: 3230000 - RNA, 14 nt, Mycobacterium leprae
cacacugacuugca

SEQ ID NO: 3230001 - RNA, 23 nt, Mycobacterium leprae
cacacugguggugacaacgccgc

SEQ ID NO: 3230002 - RNA, 22 nt, Mycobacterium leprae
cacacugucacgucggccuggg

SEQ ID NO: 3230003 - RNA, 14 nt, Mycobacterium leprae
cacacugugccugc

SEQ ID NO: 3230004 - RNA, 16 nt, Mycobacterium leprae
cacagaccgaaaucaa

SEQ ID NO: 3230005 - RNA, 17 nt, Mycobacterium leprae
cacagagcgcucggcgu

SEQ ID NO: 3230006 - RNA, 22 nt, Mycobacterium leprae
cacagcaagauuacccgcggug

SEQ ID NO: 3230007 - RNA, 16 nt, Mycobacterium leprae
cacagcaagcagaucg

SEQ ID NO: 3230008 - RNA, 21 nt, Mycobacterium leprae
cacagcaagcagaucgacagc

SEQ ID NO: 3230009 - RNA, 14 nt, Mycobacterium leprae
cacagcaccaugga

SEQ ID NO: 3230010 - RNA, 10 nt, Mycobacterium leprae
cacagcagag

SEQ ID NO: 3230011 - RNA, 14 nt, Mycobacterium leprae
cacagcaggcgagu

SEQ ID NO: 3230012 - RNA, 15 nt, Mycobacterium leprae
cacagcaucaacgcg

SEQ ID NO: 3230013 - RNA, 16 nt, Mycobacterium leprae
cacagcaucaacgcgu

SEQ ID NO: 3230014 - RNA, 15 nt, Mycobacterium leprae
cacagcccaggugcc

SEQ ID NO: 3230015 - RNA, 14 nt, Mycobacterium leprae
cacagccgucaggg

SEQ ID NO: 3230016 - RNA, 19 nt, Mycobacterium leprae
cacagccguugcugcugcc

SEQ ID NO: 3230017 - RNA, 20 nt, Mycobacterium leprae
caccucgcugcagcauaacc

SEQ ID NO: 3230018 - RNA, 20 nt, Mycobacterium leprae
caccucuguugugauccuca

SEQ ID NO: 3230019 - RNA, 12 nt, Mycobacterium leprae
caccugaacagg

SEQ ID NO: 3230020 - RNA, 14 nt, Mycobacterium leprae
caccugaacaggca

SEQ ID NO: 3230021 - RNA, 17 nt, Mycobacterium leprae
caccugaucggucagcu

SEQ ID NO: 3230022 - RNA, 20 nt, Mycobacterium leprae
caccugaucggucagcucga

SEQ ID NO: 3230023 - RNA, 15 nt, Mycobacterium leprae
caccugcgacagccg

SEQ ID NO: 3230024 - RNA, 21 nt, Mycobacterium leprae
caccuggugugcgcgccgccc

SEQ ID NO: 3230025 - RNA, 12 nt, Mycobacterium leprae
caccuguugcaa

SEQ ID NO: 3230026 - RNA, 16 nt, Mycobacterium leprae
caccuguuucagcgug

SEQ ID NO: 3230027 - RNA, 15 nt, Mycobacterium leprae
caccuugcgccccgc

SEQ ID NO: 3230028 - RNA, 17 nt, Mycobacterium leprae
caccuuggugcgggcac

SEQ ID NO: 3230029 - RNA, 21 nt, Mycobacterium leprae
cacgaauaucgcuacccuuga

SEQ ID NO: 3230030 - RNA, 17 nt, Mycobacterium leprae
cacgaccgucuggaaca

SEQ ID NO: 3230031 - RNA, 22 nt, Mycobacterium leprae
cacgaccgucuggaacacgauc

SEQ ID NO: 3230032 - RNA, 22 nt, Mycobacterium leprae
cacgacggugcggcuggcucca

SEQ ID NO: 3230033 - RNA, 17 nt, Mycobacterium leprae
cacgacucaaagacgac

SEQ ID NO: 3230034 - RNA, 15 nt, Mycobacterium leprae
cacgagaaugucgca

SEQ ID NO: 3230035 - RNA, 14 nt, Mycobacterium leprae
cacgagaccaugac

SEQ ID NO: 3230036 - RNA, 16 nt, Mycobacterium leprae
cacgagacccagccgu

SEQ ID NO: 3230037 - RNA, 12 nt, Mycobacterium leprae
cacgagccgcau

SEQ ID NO: 3230038 - RNA, 18 nt, Mycobacterium leprae
cacgauacugcugcaccc

SEQ ID NO: 3230039 - RNA, 13 nt, Mycobacterium leprae
cacgaugacaaga

SEQ ID NO: 3230040 - RNA, 19 nt, Mycobacterium leprae
cacgaugacaagagugaaa

SEQ ID NO: 3230041 - RNA, 22 nt, Mycobacterium leprae
cacgcaaacgaauaacugccaa

SEQ ID NO: 3230042 - RNA, 14 nt, Mycobacterium leprae
cacgcaaugucgcc

SEQ ID NO: 3230043 - RNA, 17 nt, Mycobacterium leprae
cacgcacacgacagccg

SEQ ID NO: 3230044 - RNA, 23 nt, Mycobacterium leprae
cacgcacacgacagccgcaaucg

SEQ ID NO: 3230045 - RNA, 21 nt, Mycobacterium leprae
cacgcaccugaucggucagcu

SEQ ID NO: 3230046 - RNA, 14 nt, Mycobacterium leprae
cacgcaguuauugu

SEQ ID NO: 3230047 - RNA, 20 nt, Mycobacterium leprae
cacgccgaacagccgcgcca

SEQ ID NO: 3230048 - RNA, 13 nt, Mycobacterium leprae
cacgccgacaccu

SEQ ID NO: 3230049 - RNA, 16 nt, Mycobacterium leprae
cacgccgauaucgacc

SEQ ID NO: 3230050 - RNA, 17 nt, Mycobacterium leprae
cacgccgauaucgacca

SEQ ID NO: 3230051 - RNA, 21 nt, Mycobacterium leprae
cacgccgauaucgaccagcca

SEQ ID NO: 3230052 - RNA, 22 nt, Mycobacterium leprae
cacgccgauaucgaccagccaa

SEQ ID NO: 3230053 - RNA, 22 nt, Mycobacterium leprae
cacgccgugcuuccauucgcga

SEQ ID NO: 3230054 - RNA, 19 nt, Mycobacterium leprae
cacgcgaccaacgccgagc

SEQ ID NO: 3230055 - RNA, 11 nt, Mycobacterium leprae
cacgcgcgccu

SEQ ID NO: 3230056 - RNA, 14 nt, Mycobacterium leprae
cacgcgcgccuggg

SEQ ID NO: 3230057 - RNA, 19 nt, Mycobacterium leprae
cacgcgugcggcgcccacc

SEQ ID NO: 3230058 - RNA, 22 nt, Mycobacterium leprae
cacgcugauggcacuacccgac

SEQ ID NO: 3230059 - RNA, 17 nt, Mycobacterium leprae
cacgcuggcacuccgac

SEQ ID NO: 3230060 - RNA, 18 nt, Mycobacterium leprae
cacgcuggcacuccgacc

SEQ ID NO: 3230061 - RNA, 21 nt, Mycobacterium leprae
cacgcuguuccauaacguugc

SEQ ID NO: 3230062 - RNA, 13 nt, Mycobacterium leprae
cacggaagcccuc

SEQ ID NO: 3230063 - RNA, 18 nt, Mycobacterium leprae
cacggacaagcagugucu

SEQ ID NO: 3230064 - RNA, 18 nt, Mycobacterium leprae
cacggagaucggcgugca

SEQ ID NO: 3230065 - RNA, 12 nt, Mycobacterium leprae
cacggcacaauc

SEQ ID NO: 3230066 - RNA, 18 nt, Mycobacterium leprae
cacggcacaaucgucgcc

SEQ ID NO: 3230067 - RNA, 20 nt, Mycobacterium leprae
cacggcagcgucaccaagcg

SEQ ID NO: 3230068 - RNA, 20 nt, Mycobacterium leprae
cacggccgucgcgggugggu

SEQ ID NO: 3230069 - RNA, 20 nt, Mycobacterium leprae
cacggcgggugaugaucacc

SEQ ID NO: 3230070 - RNA, 21 nt, Mycobacterium leprae
cacggcuuaaguaggcgguca

SEQ ID NO: 3230071 - RNA, 13 nt, Mycobacterium leprae
cacgggauggcca

SEQ ID NO: 3230072 - RNA, 19 nt, Mycobacterium leprae
cacgggauggccaagccgc

SEQ ID NO: 3230073 - RNA, 22 nt, Mycobacterium leprae
cacgggauggccaagccgcccg

SEQ ID NO: 3230074 - RNA, 12 nt, Mycobacterium leprae
cacggguggugc

SEQ ID NO: 3230075 - RNA, 20 nt, Mycobacterium leprae
cacggucccgggucacgcuc

SEQ ID NO: 3230076 - RNA, 21 nt, Mycobacterium leprae
cacggucgacuucgcagccac

SEQ ID NO: 3230077 - RNA, 13 nt, Mycobacterium leprae
cacggugcaguca

SEQ ID NO: 3230078 - RNA, 14 nt, Mycobacterium leprae
cacggugcgugcca

SEQ ID NO: 3230079 - RNA, 21 nt, Mycobacterium leprae
cacgguguugacccacuggug

SEQ ID NO: 3230080 - RNA, 18 nt, Mycobacterium leprae
cacgucccagguuuccgu

SEQ ID NO: 3230081 - RNA, 20 nt, Mycobacterium leprae
cacgucgacggcggccgcca

SEQ ID NO: 3230082 - RNA, 14 nt, Mycobacterium leprae
cacgucgaucagcg

SEQ ID NO: 3230083 - RNA, 22 nt, Mycobacterium leprae
cacgucgauucgcucgccgccc

SEQ ID NO: 3230084 - RNA, 20 nt, Mycobacterium leprae
cacgucgccgguagcagcgg

SEQ ID NO: 3230085 - RNA, 15 nt, Mycobacterium leprae
cacgugcaaacugcu

SEQ ID NO: 3230086 - RNA, 18 nt, Mycobacterium leprae
cacgugcaaacugcugcg

SEQ ID NO: 3230087 - RNA, 17 nt, Mycobacterium leprae
cacgugcacaucagcgc

SEQ ID NO: 3230088 - RNA, 22 nt, Mycobacterium leprae
cacgugcaucgagaacugcacu

SEQ ID NO: 3230089 - RNA, 11 nt, Mycobacterium leprae
cacguguggcc

SEQ ID NO: 3230090 - RNA, 15 nt, Mycobacterium leprae
cacguuacuuaugca

SEQ ID NO: 3230091 - RNA, 19 nt, Mycobacterium leprae
cacguucgaucggcagcca

SEQ ID NO: 3230092 - RNA, 18 nt, Mycobacterium leprae
cacguucggaucauugcu

SEQ ID NO: 3230093 - RNA, 19 nt, Mycobacterium leprae
cacuaaaacuaacacuaac

SEQ ID NO: 3230094 - RNA, 16 nt, Mycobacterium leprae
cacuaacaccgugccg

SEQ ID NO: 3230095 - RNA, 23 nt, Mycobacterium leprae
cacuacguuggccagcacggcgu

SEQ ID NO: 3230096 - RNA, 18 nt, Mycobacterium leprae
cacuacuguugucagugg

SEQ ID NO: 3230097 - RNA, 17 nt, Mycobacterium leprae
cacuagggaggucacca

SEQ ID NO: 3230098 - RNA, 22 nt, Mycobacterium leprae
cacuaugucgaucggcaguggu

SEQ ID NO: 3230099 - RNA, 15 nt, Mycobacterium leprae
cacucauuggaccca

SEQ ID NO: 3230100 - RNA, 16 nt, Mycobacterium leprae
cacuccacgcacccug

SEQ ID NO: 3230101 - RNA, 21 nt, Mycobacterium leprae
cacuccgucacugucucacca

SEQ ID NO: 3230102 - RNA, 16 nt, Mycobacterium leprae
cacucgucacauuccu

SEQ ID NO: 3230103 - RNA, 15 nt, Mycobacterium leprae
cacucuggcuagccg

SEQ ID NO: 3230104 - RNA, 21 nt, Mycobacterium leprae
cacugacaugccgagguggca

SEQ ID NO: 3230105 - RNA, 14 nt, Mycobacterium leprae
cacugaucgaucug

SEQ ID NO: 3230106 - RNA, 16 nt, Mycobacterium leprae
cacugcacgaccacac

SEQ ID NO: 3230107 - RNA, 22 nt, Mycobacterium leprae
cacugcacgaccacacugugcc

SEQ ID NO: 3230108 - RNA, 16 nt, Mycobacterium leprae
cacugcacggcgugca

SEQ ID NO: 3230109 - RNA, 14 nt, Mycobacterium leprae
cacugcagcgguca

SEQ ID NO: 3230110 - RNA, 15 nt, Mycobacterium leprae
cacugcagggcgagc

SEQ ID NO: 3230111 - RNA, 11 nt, Mycobacterium leprae
cacugccagag

SEQ ID NO: 3230112 - RNA, 23 nt, Mycobacterium leprae
cacugcccgggugaacgccaggc

SEQ ID NO: 3230113 - RNA, 16 nt, Mycobacterium leprae
cacugcgucaaagcua

SEQ ID NO: 3230114 - RNA, 16 nt, Mycobacterium leprae
cacugcucaggucgac

SEQ ID NO: 3230115 - RNA, 19 nt, Mycobacterium leprae
cacuggcaaguucgucggc

SEQ ID NO: 3230116 - RNA, 13 nt, Mycobacterium leprae
cacuggguggcac

SEQ ID NO: 3230117 - RNA, 15 nt, Mycobacterium leprae
cacugucacgucggc

SEQ ID NO: 3230118 - RNA, 16 nt, Mycobacterium leprae
cacugucacgucggcc

SEQ ID NO: 3230119 - RNA, 14 nt, Mycobacterium leprae
cacuguccacucgg

SEQ ID NO: 3230120 - RNA, 16 nt, Mycobacterium leprae
cacugugucaccugaa

SEQ ID NO: 3230121 - RNA, 21 nt, Mycobacterium leprae
cacuguuacuaccguacaggc

SEQ ID NO: 3230122 - RNA, 17 nt, Mycobacterium leprae
cacuguuuuaagcgaaa

SEQ ID NO: 3230123 - RNA, 17 nt, Mycobacterium leprae
cacuuaaguggcuggcu

SEQ ID NO: 3230124 - RNA, 19 nt, Mycobacterium leprae
cacuuacaccaacauaguc

SEQ ID NO: 3230125 - RNA, 11 nt, Mycobacterium leprae
cacuucaacau

SEQ ID NO: 3230126 - RNA, 23 nt, Mycobacterium leprae
cacuucagcgacaggcagcugca

SEQ ID NO: 3230127 - RNA, 15 nt, Mycobacterium leprae
cacuugacggucgag

SEQ ID NO: 3230128 - RNA, 14 nt, Mycobacterium leprae
cagaaaucguucga

SEQ ID NO: 3230129 - RNA, 21 nt, Mycobacterium leprae
cagaaauuuuucggacgggca

SEQ ID NO: 3230130 - RNA, 13 nt, Mycobacterium leprae
cagccaaugcugc

SEQ ID NO: 3230131 - RNA, 19 nt, Mycobacterium leprae
cagccaccacucucaucgc

SEQ ID NO: 3230132 - RNA, 20 nt, Mycobacterium leprae
cagccaccacucucaucgcg

SEQ ID NO: 3230133 - RNA, 21 nt, Mycobacterium leprae
cagccaccagggaagaucuca

SEQ ID NO: 3230134 - RNA, 20 nt, Mycobacterium leprae
cagccacugagauuaucccg

SEQ ID NO: 3230135 - RNA, 16 nt, Mycobacterium leprae
cagccagcaagcaggc

SEQ ID NO: 3230136 - RNA, 19 nt, Mycobacterium leprae
cagccagcaagcaggcaug

SEQ ID NO: 3230137 - RNA, 17 nt, Mycobacterium leprae
cagccaggagaagcgcu

SEQ ID NO: 3230138 - RNA, 12 nt, Mycobacterium leprae
cagccaucacug

SEQ ID NO: 3230139 - RNA, 18 nt, Mycobacterium leprae
cagcccaggugcccagcc

SEQ ID NO: 3230140 - RNA, 14 nt, Mycobacterium leprae
cagccccuggcauc

SEQ ID NO: 3230141 - RNA, 22 nt, Mycobacterium leprae
cagcccgaggcuaaccucgcua

SEQ ID NO: 3230142 - RNA, 18 nt, Mycobacterium leprae
cagcccgcuagcaucgac

SEQ ID NO: 3230143 - RNA, 20 nt, Mycobacterium leprae
cagcccgcuagcaucgacca

SEQ ID NO: 3230144 - RNA, 13 nt, Mycobacterium leprae
cagccgaccgccc

SEQ ID NO: 3230145 - RNA, 20 nt, Mycobacterium leprae
cagccgaggggccgucggca

SEQ ID NO: 3230146 - RNA, 13 nt, Mycobacterium leprae
cagccgagguucc

SEQ ID NO: 3230147 - RNA, 19 nt, Mycobacterium leprae
cagccgagguucccggcgg

SEQ ID NO: 3230148 - RNA, 13 nt, Mycobacterium leprae
cagccgaugucca

SEQ ID NO: 3230149 - RNA, 18 nt, Mycobacterium leprae
cagccgauguccaugcag

SEQ ID NO: 3230150 - RNA, 14 nt, Mycobacterium leprae
cagccgcaacaacg

SEQ ID NO: 3230151 - RNA, 14 nt, Mycobacterium leprae
cagccgcaaucgcc

SEQ ID NO: 3230152 - RNA, 14 nt, Mycobacterium leprae
cagccgcgaaugga

SEQ ID NO: 3230153 - RNA, 21 nt, Mycobacterium leprae
cagccgcgaauggacagaaca

SEQ ID NO: 3230154 - RNA, 17 nt, Mycobacterium leprae
cagccgcgcuagcgaug

SEQ ID NO: 3230155 - RNA, 21 nt, Mycobacterium leprae
cagccgcgggcgaugccaucg

SEQ ID NO: 3230156 - RNA, 14 nt, Mycobacterium leprae
cagccgcgguaacg

SEQ ID NO: 3230157 - RNA, 22 nt, Mycobacterium leprae
cagccgcguccagacaccacug

SEQ ID NO: 3230158 - RNA, 22 nt, Mycobacterium leprae
cagccggaggguugccgacggc

SEQ ID NO: 3230159 - RNA, 23 nt, Mycobacterium leprae
cagccggaggguugccgacggcc

SEQ ID NO: 3230160 - RNA, 17 nt, Mycobacterium leprae
cagccgucagggcagca

SEQ ID NO: 3230161 - RNA, 18 nt, Mycobacterium leprae
cagccgucgaagcccugc

SEQ ID NO: 3230162 - RNA, 19 nt, Mycobacterium leprae
cagccguucggguugcggu

SEQ ID NO: 3230163 - RNA, 17 nt, Mycobacterium leprae
cagccguugcugcugcc

SEQ ID NO: 3230164 - RNA, 14 nt, Mycobacterium leprae
cagccuagacugac

SEQ ID NO: 3230165 - RNA, 19 nt, Mycobacterium leprae
cagccuagcagcaucgcgu

SEQ ID NO: 3230166 - RNA, 13 nt, Mycobacterium leprae
cagccuaggugau

SEQ ID NO: 3230167 - RNA, 22 nt, Mycobacterium leprae
cagccuccgaaaagcugagccg

SEQ ID NO: 3230168 - RNA, 20 nt, Mycobacterium leprae
cagccuuucacgccaggcga

SEQ ID NO: 3230169 - RNA, 18 nt, Mycobacterium leprae
cagccuuucaggugugcu

SEQ ID NO: 3230170 - RNA, 19 nt, Mycobacterium leprae
cagccuuucaggugugcug

SEQ ID NO: 3230171 - RNA, 19 nt, Mycobacterium leprae
cagcgaagaguuucugcug

SEQ ID NO: 3230172 - RNA, 18 nt, Mycobacterium leprae
cagcgacaggcagcugca

SEQ ID NO: 3230173 - RNA, 15 nt, Mycobacterium leprae
cagcgacggcaagcu

SEQ ID NO: 3230174 - RNA, 20 nt, Mycobacterium leprae
cagcgacggcaagcugauca

SEQ ID NO: 3230175 - RNA, 21 nt, Mycobacterium leprae
cagcgacggcaagcugaucac

SEQ ID NO: 3230176 - RNA, 21 nt, Mycobacterium leprae
cagcgacuccacuccacccaa

SEQ ID NO: 3230177 - RNA, 12 nt, Mycobacterium leprae
cagcgacuggcu

SEQ ID NO: 3230178 - RNA, 18 nt, Mycobacterium leprae
cagcgagaagccccaugg

SEQ ID NO: 3230179 - RNA, 19 nt, Mycobacterium leprae
cagcgagaagccccauggc

SEQ ID NO: 3230180 - RNA, 19 nt, Mycobacterium leprae
cagcgauaccagcgucgcu

SEQ ID NO: 3230181 - RNA, 21 nt, Mycobacterium leprae
cagcgauaccagcgucgcuca

SEQ ID NO: 3230182 - RNA, 18 nt, Mycobacterium leprae
cagcgaucuaccucgcca

SEQ ID NO: 3230183 - RNA, 16 nt, Mycobacterium leprae
cagcgcacccauccga

SEQ ID NO: 3230184 - RNA, 14 nt, Mycobacterium leprae
cagcgcagcccgcu

SEQ ID NO: 3230185 - RNA, 15 nt, Mycobacterium leprae
cagcgcagcccgcua

SEQ ID NO: 3230186 - RNA, 14 nt, Mycobacterium leprae
cagcgcagugugcu

SEQ ID NO: 3230187 - RNA, 13 nt, Mycobacterium leprae
cagcgcaucagcc

SEQ ID NO: 3230188 - RNA, 14 nt, Mycobacterium leprae
cagcgcaucagcca

SEQ ID NO: 3230189 - RNA, 16 nt, Mycobacterium leprae
cagcgccacgccggac

SEQ ID NO: 3230190 - RNA, 17 nt, Mycobacterium leprae
cagcgccucaccaaauc

SEQ ID NO: 3230191 - RNA, 15 nt, Mycobacterium leprae
cagcgccugccccgc

SEQ ID NO: 3230192 - RNA, 16 nt, Mycobacterium leprae
cagcgccugccccgcu

SEQ ID NO: 3230193 - RNA, 16 nt, Mycobacterium leprae
cagcgcgcacagcucu

SEQ ID NO: 3230194 - RNA, 18 nt, Mycobacterium leprae
cagcgcggacucucccca

SEQ ID NO: 3230195 - RNA, 18 nt, Mycobacterium leprae
cagcggacguacaguggu

SEQ ID NO: 3230196 - RNA, 20 nt, Mycobacterium leprae
cagcggacugcuagccggcu

SEQ ID NO: 3230197 - RNA, 18 nt, Mycobacterium leprae
cagcggcccaacccggcc

SEQ ID NO: 3230198 - RNA, 19 nt, Mycobacterium leprae
cagcgguacccgccaggau

SEQ ID NO: 3230199 - RNA, 23 nt, Mycobacterium leprae
cagcgguaccugugggucaccac

SEQ ID NO: 3230200 - RNA, 14 nt, Mycobacterium leprae
cagcggucacauug

SEQ ID NO: 3230201 - RNA, 16 nt, Mycobacterium leprae
cagcgucccaaccaau

SEQ ID NO: 3230202 - RNA, 22 nt, Mycobacterium leprae
cagcgucgcucacggccaccau

SEQ ID NO: 3230203 - RNA, 15 nt, Mycobacterium leprae
cagcgugaauuacuc

SEQ ID NO: 3230204 - RNA, 21 nt, Mycobacterium leprae
cagcgugaauuacucgucggu

SEQ ID NO: 3230205 - RNA, 15 nt, Mycobacterium leprae
cagcgugacgacuug

SEQ ID NO: 3230206 - RNA, 16 nt, Mycobacterium leprae
cagcuaagaagcugcc

SEQ ID NO: 3230207 - RNA, 20 nt, Mycobacterium leprae
cagcuaaucccaugggaguu

SEQ ID NO: 3230208 - RNA, 16 nt, Mycobacterium leprae
cagcuagacccgaacc

SEQ ID NO: 3230209 - RNA, 18 nt, Mycobacterium leprae
cagcucacccgcagcacc

SEQ ID NO: 3230210 - RNA, 14 nt, Mycobacterium leprae
cagcucgacagcag

SEQ ID NO: 3230211 - RNA, 20 nt, Mycobacterium leprae
cagcucgacgggcggcaccu

SEQ ID NO: 3230212 - RNA, 22 nt, Mycobacterium leprae
cagcucgccaaggucgaucuag

SEQ ID NO: 3230213 - RNA, 14 nt, Mycobacterium leprae
cagcucggacaaga

SEQ ID NO: 3230214 - RNA, 16 nt, Mycobacterium leprae
cagcucguccaucgcg

SEQ ID NO: 3230215 - RNA, 16 nt, Mycobacterium leprae
cagcucuuuucgucug

SEQ ID NO: 3230216 - RNA, 21 nt, Mycobacterium leprae
cagcugcagucgauuagccgg

SEQ ID NO: 3230217 - RNA, 15 nt, Mycobacterium leprae
cagcugccauuggcc

SEQ ID NO: 3230218 - RNA, 16 nt, Mycobacterium leprae
cagcugcguacggaga

SEQ ID NO: 3230219 - RNA, 11 nt, Mycobacterium leprae
cagcuggaaag

SEQ ID NO: 3230220 - RNA, 17 nt, Mycobacterium leprae
cagcuggccgggaucgg

SEQ ID NO: 3230221 - RNA, 18 nt, Mycobacterium leprae
cagcuggcggaugcgggc

SEQ ID NO: 3230222 - RNA, 23 nt, Mycobacterium leprae
cagcuggguaccgaugugcugga

SEQ ID NO: 3230223 - RNA, 16 nt, Mycobacterium leprae
cagcuggugaccugac

SEQ ID NO: 3230224 - RNA, 16 nt, Mycobacterium leprae
cagcugguuguccacg

SEQ ID NO: 3230225 - RNA, 18 nt, Mycobacterium leprae
cagcuguauaacaaauca

SEQ ID NO: 3230226 - RNA, 23 nt, Mycobacterium leprae
cagcuguauaacaaaucauagug

SEQ ID NO: 3230227 - RNA, 20 nt, Mycobacterium leprae
cagcuguugacugcgaaaaa

SEQ ID NO: 3230228 - RNA, 16 nt, Mycobacterium leprae
cagcuucaaaccggcc

SEQ ID NO: 3230229 - RNA, 17 nt, Mycobacterium leprae
cagcuucaaaccggcca

SEQ ID NO: 3230230 - RNA, 15 nt, Mycobacterium leprae
caggaagugcucaau

SEQ ID NO: 3230231 - RNA, 22 nt, Mycobacterium leprae
caggaauuccgcuacaguaaug

SEQ ID NO: 3230232 - RNA, 23 nt, Mycobacterium leprae
caggaauugguggucgcgggcua

SEQ ID NO: 3230233 - RNA, 20 nt, Mycobacterium leprae
caggaauuuagaggcugcac

SEQ ID NO: 3230234 - RNA, 22 nt, Mycobacterium leprae
caggaauuuagaggcugcaccg

SEQ ID NO: 3230235 - RNA, 19 nt, Mycobacterium leprae
caggacgcacccugcaaug

SEQ ID NO: 3230236 - RNA, 13 nt, Mycobacterium leprae
caggauagccgau

SEQ ID NO: 3230237 - RNA, 16 nt, Mycobacterium leprae
caggaucccugauccu

SEQ ID NO: 3230238 - RNA, 13 nt, Mycobacterium leprae
caggaugcgugcc

SEQ ID NO: 3230239 - RNA, 21 nt, Mycobacterium leprae
caggauucggucacgggucgg

SEQ ID NO: 3230240 - RNA, 21 nt, Mycobacterium leprae
caggauugcguugaccgccgc

SEQ ID NO: 3230241 - RNA, 21 nt, Mycobacterium leprae
caggcaaccgcccgcaguagc

SEQ ID NO: 3230242 - RNA, 21 nt, Mycobacterium leprae
caggcacccguugaagccguu

SEQ ID NO: 3230243 - RNA, 18 nt, Mycobacterium leprae
caguuagcaugagcugcu

SEQ ID NO: 3230244 - RNA, 18 nt, Mycobacterium leprae
caguuaucuagcccagaa

SEQ ID NO: 3230245 - RNA, 24 nt, Mycobacterium leprae
caguuauuguuuccgauguagcac

SEQ ID NO: 3230246 - RNA, 20 nt, Mycobacterium leprae
caguucaauggugccgagcg

SEQ ID NO: 3230247 - RNA, 14 nt, Mycobacterium leprae
caguucaccacauc

SEQ ID NO: 3230248 - RNA, 15 nt, Mycobacterium leprae
caguucacgcuggcc

SEQ ID NO: 3230249 - RNA, 13 nt, Mycobacterium leprae
caguuccagugcc

SEQ ID NO: 3230250 - RNA, 21 nt, Mycobacterium leprae
caguuccagugccuugggcac

SEQ ID NO: 3230251 - RNA, 12 nt, Mycobacterium leprae
caguucgacugg

SEQ ID NO: 3230252 - RNA, 14 nt, Mycobacterium leprae
caguucgauugcga

SEQ ID NO: 3230253 - RNA, 14 nt, Mycobacterium leprae
caguucgugauggu

SEQ ID NO: 3230254 - RNA, 18 nt, Mycobacterium leprae
caguugcgggacagaagc

SEQ ID NO: 3230255 - RNA, 18 nt, Mycobacterium leprae
caguugcuugucuucugu

SEQ ID NO: 3230256 - RNA, 21 nt, Mycobacterium leprae
caguuuaccgugccuugcggc

SEQ ID NO: 3230257 - RNA, 20 nt, Mycobacterium leprae
caguuuugugggcaggucag

SEQ ID NO: 3230258 - RNA, 20 nt, Mycobacterium leprae
caguuuuucucacaccugcg

SEQ ID NO: 3230259 - RNA, 19 nt, Mycobacterium leprae
cauaaccacauugugugac

SEQ ID NO: 3230260 - RNA, 18 nt, Mycobacterium leprae
cauaaccgcauaaacuca

SEQ ID NO: 3230261 - RNA, 16 nt, Mycobacterium leprae
cauaagcgggugccgc

SEQ ID NO: 3230262 - RNA, 16 nt, Mycobacterium leprae
cauaaugccugcauug

SEQ ID NO: 3230263 - RNA, 14 nt, Mycobacterium leprae
cauacagugcaccg

SEQ ID NO: 3230264 - RNA, 24 nt, Mycobacterium leprae
cauacgguuauugacgugaucgca

SEQ ID NO: 3230265 - RNA, 15 nt, Mycobacterium leprae
cauagccgugguagg

SEQ ID NO: 3230266 - RNA, 14 nt, Mycobacterium leprae
cauagcggccgcca

SEQ ID NO: 3230267 - RNA, 20 nt, Mycobacterium leprae
cauagucagaucaaccaaau

SEQ ID NO: 3230268 - RNA, 23 nt, Mycobacterium leprae
cauaguccagucgcgcaccgcga

SEQ ID NO: 3230269 - RNA, 17 nt, Mycobacterium leprae
cauaguggaucuccuaa

SEQ ID NO: 3230270 - RNA, 18 nt, Mycobacterium leprae
cauauacaaaccccagac

SEQ ID NO: 3230271 - RNA, 17 nt, Mycobacterium leprae
cauaugagcaucgagga

SEQ ID NO: 3230272 - RNA, 14 nt, Mycobacterium leprae
cauaugccgccaug

SEQ ID NO: 3230273 - RNA, 18 nt, Mycobacterium leprae
cauauggaaagucagcau

SEQ ID NO: 3230274 - RNA, 18 nt, Mycobacterium leprae
cauaugugcuauagcaca

SEQ ID NO: 3230275 - RNA, 20 nt, Mycobacterium leprae
cauaugugcuauagcacacc

SEQ ID NO: 3230276 - RNA, 21 nt, Mycobacterium leprae
caucaaccggugauugccgcg

SEQ ID NO: 3230277 - RNA, 17 nt, Mycobacterium leprae
caucaacggcuacaaca

SEQ ID NO: 3230278 - RNA, 14 nt, Mycobacterium leprae
caucaacgugcgca

SEQ ID NO: 3230279 - RNA, 12 nt, Mycobacterium leprae
caucaagccucc

SEQ ID NO: 3230280 - RNA, 17 nt, Mycobacterium leprae
caucaagccuccagaau

SEQ ID NO: 3230281 - RNA, 14 nt, Mycobacterium leprae
caucacacggcgcg

SEQ ID NO: 3230282 - RNA, 19 nt, Mycobacterium leprae
caucaccacgaucaccgcg

SEQ ID NO: 3230283 - RNA, 19 nt, Mycobacterium leprae
caucaccguggccggcccc

SEQ ID NO: 3230284 - RNA, 16 nt, Mycobacterium leprae
caucagaaauguccuu

SEQ ID NO: 3230285 - RNA, 19 nt, Mycobacterium leprae
caucagauauccuaggcca

SEQ ID NO: 3230286 - RNA, 13 nt, Mycobacterium leprae
caucagcaccgcg

SEQ ID NO: 3230287 - RNA, 14 nt, Mycobacterium leprae
caucagcaccgcgc

SEQ ID NO: 3230288 - RNA, 17 nt, Mycobacterium leprae
caucagccaacaccacc

SEQ ID NO: 3230289 - RNA, 19 nt, Mycobacterium leprae
caucagccaacaccaccag

SEQ ID NO: 3230290 - RNA, 23 nt, Mycobacterium leprae
caucaggagauacucugaaaaua

SEQ ID NO: 3230291 - RNA, 17 nt, Mycobacterium leprae
caucaguaucagugcca

SEQ ID NO: 3230292 - RNA, 13 nt, Mycobacterium leprae
caucagucagcau

SEQ ID NO: 3230293 - RNA, 20 nt, Mycobacterium leprae
caucaucaacauguagacca

SEQ ID NO: 3230294 - RNA, 14 nt, Mycobacterium leprae
caucaucaccguug

SEQ ID NO: 3230295 - RNA, 22 nt, Mycobacterium leprae
caucaucgcccaccgcaacgcc

SEQ ID NO: 3230296 - RNA, 20 nt, Mycobacterium leprae
caucaucgcuaagacucacc

SEQ ID NO: 3230297 - RNA, 14 nt, Mycobacterium leprae
caucauugcgacga

SEQ ID NO: 3230298 - RNA, 16 nt, Mycobacterium leprae
caucauuuucaacgcc

SEQ ID NO: 3230299 - RNA, 19 nt, Mycobacterium leprae
cauccagaaaguacugacc

SEQ ID NO: 3230300 - RNA, 22 nt, Mycobacterium leprae
cauccauguacaacaccagauc

SEQ ID NO: 3230301 - RNA, 18 nt, Mycobacterium leprae
caucccagaaucgucggc

SEQ ID NO: 3230302 - RNA, 18 nt, Mycobacterium leprae
caucccgaagugaucggc

SEQ ID NO: 3230303 - RNA, 22 nt, Mycobacterium leprae
caucccgauaagcaaaaaauag

SEQ ID NO: 3230304 - RNA, 17 nt, Mycobacterium leprae
cauccgaaucaccgcug

SEQ ID NO: 3230305 - RNA, 18 nt, Mycobacterium leprae
cauccgacaaagcagcau

SEQ ID NO: 3230306 - RNA, 20 nt, Mycobacterium leprae
cauccgacggcuucaucagu

SEQ ID NO: 3230307 - RNA, 23 nt, Mycobacterium leprae
cauccgccacucgucacauuccu

SEQ ID NO: 3230308 - RNA, 13 nt, Mycobacterium leprae
cauccgggccaga

SEQ ID NO: 3230309 - RNA, 22 nt, Mycobacterium leprae
cauccguggcgagacacccggc

SEQ ID NO: 3230310 - RNA, 19 nt, Mycobacterium leprae
cauccucacgaccguugca

SEQ ID NO: 3230311 - RNA, 16 nt, Mycobacterium leprae
cauccucgaugguguc

SEQ ID NO: 3230312 - RNA, 18 nt, Mycobacterium leprae
cauccucggacugccccg

SEQ ID NO: 3230313 - RNA, 22 nt, Mycobacterium leprae
cauccucgguaucgucaaauuu

SEQ ID NO: 3230314 - RNA, 13 nt, Mycobacterium leprae
cauccugcagcau

SEQ ID NO: 3230315 - RNA, 15 nt, Mycobacterium leprae
caucgaacaagucga

SEQ ID NO: 3230316 - RNA, 17 nt, Mycobacterium leprae
caucgaacaagucgaac

SEQ ID NO: 3230317 - RNA, 15 nt, Mycobacterium leprae
caucgaagcaaccag

SEQ ID NO: 3230318 - RNA, 13 nt, Mycobacterium leprae
caucgaauaccuu

SEQ ID NO: 3230319 - RNA, 19 nt, Mycobacterium leprae
caucgacagcacccagcuc

SEQ ID NO: 3230320 - RNA, 22 nt, Mycobacterium leprae
caucgacaucccagcaacgcua

SEQ ID NO: 3230321 - RNA, 16 nt, Mycobacterium leprae
caucgacgaggucgcc

SEQ ID NO: 3230322 - RNA, 12 nt, Mycobacterium leprae
caucgacgccgc

SEQ ID NO: 3230323 - RNA, 15 nt, Mycobacterium leprae
caucgacgccgccgu

SEQ ID NO: 3230324 - RNA, 14 nt, Mycobacterium leprae
caucgacuugcugc

SEQ ID NO: 3230325 - RNA, 13 nt, Mycobacterium leprae
caucgauacacuu

SEQ ID NO: 3230326 - RNA, 15 nt, Mycobacterium leprae
caucgaucagacccu

SEQ ID NO: 3230327 - RNA, 21 nt, Mycobacterium leprae
caucgaugcacuguucacuaa

SEQ ID NO: 3230328 - RNA, 15 nt, Mycobacterium leprae
caucgcccaccgcaa

SEQ ID NO: 3230329 - RNA, 16 nt, Mycobacterium leprae
caucgcccaccgcaac

SEQ ID NO: 3230330 - RNA, 19 nt, Mycobacterium leprae
caucgcccaccgcaacgcc

SEQ ID NO: 3230331 - RNA, 14 nt, Mycobacterium leprae
caucgcggcugcca

SEQ ID NO: 3230332 - RNA, 16 nt, Mycobacterium leprae
caucgcggcugccacu

SEQ ID NO: 3230333 - RNA, 18 nt, Mycobacterium leprae
caucgcggcugccacugu

SEQ ID NO: 3230334 - RNA, 19 nt, Mycobacterium leprae
caucgcggcugccacugug

SEQ ID NO: 3230335 - RNA, 20 nt, Mycobacterium leprae
caucgcugccaucgacgccg

SEQ ID NO: 3230336 - RNA, 21 nt, Mycobacterium leprae
caucgcugccaucgacgccgu

SEQ ID NO: 3230337 - RNA, 17 nt, Mycobacterium leprae
caucggcagaucgaucu

SEQ ID NO: 3230338 - RNA, 18 nt, Mycobacterium leprae
caucggcagaucgaucuc

SEQ ID NO: 3230339 - RNA, 20 nt, Mycobacterium leprae
caucggcaucccagugugcu

SEQ ID NO: 3230340 - RNA, 19 nt, Mycobacterium leprae
caucggcgacugggauaga

SEQ ID NO: 3230341 - RNA, 22 nt, Mycobacterium leprae
caucggcggccagcucagcaac

SEQ ID NO: 3230342 - RNA, 17 nt, Mycobacterium leprae
caucggcgucgguggca

SEQ ID NO: 3230343 - RNA, 16 nt, Mycobacterium leprae
caucggcgugccuggc

SEQ ID NO: 3230344 - RNA, 15 nt, Mycobacterium leprae
caucggcuacggcaa

SEQ ID NO: 3230345 - RNA, 18 nt, Mycobacterium leprae
caucggcucccaucggcg

SEQ ID NO: 3230346 - RNA, 20 nt, Mycobacterium leprae
caucggcucccaucggcggc

SEQ ID NO: 3230347 - RNA, 21 nt, Mycobacterium leprae
caucggcucccaucggcggcc

SEQ ID NO: 3230348 - RNA, 23 nt, Mycobacterium leprae
caucggcucccaucggcggccag

SEQ ID NO: 3230349 - RNA, 23 nt, Mycobacterium leprae
caucggcugugguuggggcgcca

SEQ ID NO: 3230350 - RNA, 14 nt, Mycobacterium leprae
caucgggccagagc

SEQ ID NO: 3230351 - RNA, 17 nt, Mycobacterium leprae
caucgguaguggccggc

SEQ ID NO: 3230352 - RNA, 22 nt, Mycobacterium leprae
caucgucagucggccuuaauaa

SEQ ID NO: 3230353 - RNA, 16 nt, Mycobacterium leprae
caucgucggcaaauuu

SEQ ID NO: 3230354 - RNA, 19 nt, Mycobacterium leprae
caucgugaaucagaugacc

SEQ ID NO: 3230355 - RNA, 15 nt, Mycobacterium leprae
caucguugccgcugu

SEQ ID NO: 3230356 - RNA, 23 nt, Mycobacterium leprae
cauuucugccgcugguaucggug

SEQ ID NO: 3230357 - RNA, 18 nt, Mycobacterium leprae
cauuugauguccauggcu

SEQ ID NO: 3230358 - RNA, 21 nt, Mycobacterium leprae
cauuugcggaugacgauuuga

SEQ ID NO: 3230359 - RNA, 16 nt, Mycobacterium leprae
cauuugucaucggcgu

SEQ ID NO: 3230360 - RNA, 13 nt, Mycobacterium leprae
cauuuguggcgau

SEQ ID NO: 3230361 - RNA, 14 nt, Mycobacterium leprae
cauuuuaucacugu

SEQ ID NO: 3230362 - RNA, 18 nt, Mycobacterium leprae
cauuuugaugguaacgaa

SEQ ID NO: 3230363 - RNA, 19 nt, Mycobacterium leprae
cauuuugaugguaacgaag

SEQ ID NO: 3230364 - RNA, 20 nt, Mycobacterium leprae
cauuuugaugguaacgaagu

SEQ ID NO: 3230365 - RNA, 14 nt, Mycobacterium leprae
ccaaaauggcacga

SEQ ID NO: 3230366 - RNA, 16 nt, Mycobacterium leprae
ccaaacacggccagcg

SEQ ID NO: 3230367 - RNA, 18 nt, Mycobacterium leprae
ccaaacuugguuaauauc

SEQ ID NO: 3230368 - RNA, 15 nt, Mycobacterium leprae
ccaaaucagcaccau

SEQ ID NO: 3230369 - RNA, 14 nt, Mycobacterium leprae
ccaacaacggccug

SEQ ID NO: 3230370 - RNA, 13 nt, Mycobacterium leprae
ccaacaccgcggc

SEQ ID NO: 3230371 - RNA, 12 nt, Mycobacterium leprae
ccaacacgccga

SEQ ID NO: 3230372 - RNA, 15 nt, Mycobacterium leprae
ccaacagccaauguc

SEQ ID NO: 3230373 - RNA, 14 nt, Mycobacterium leprae
ccaacagcuugaca

SEQ ID NO: 3230374 - RNA, 19 nt, Mycobacterium leprae
ccaacauagucagaucaac

SEQ ID NO: 3230375 - RNA, 18 nt, Mycobacterium leprae
ccaacauagucauugccu

SEQ ID NO: 3230376 - RNA, 15 nt, Mycobacterium leprae
ccaaccacagcaaua

SEQ ID NO: 3230377 - RNA, 17 nt, Mycobacterium leprae
ccaacccgggucauaca

SEQ ID NO: 3230378 - RNA, 22 nt, Mycobacterium leprae
ccaaccguaguguuuuaccagc

SEQ ID NO: 3230379 - RNA, 12 nt, Mycobacterium leprae
ccaacgcgcacc

SEQ ID NO: 3230380 - RNA, 13 nt, Mycobacterium leprae
ccaacguccagug

SEQ ID NO: 3230381 - RNA, 18 nt, Mycobacterium leprae
ccaacgugaccagcuccg

SEQ ID NO: 3230382 - RNA, 22 nt, Mycobacterium leprae
ccaacuccuaggaucagaaccg

SEQ ID NO: 3230383 - RNA, 14 nt, Mycobacterium leprae
ccaacucggccgcc

SEQ ID NO: 3230384 - RNA, 12 nt, Mycobacterium leprae
ccaacuguugcu

SEQ ID NO: 3230385 - RNA, 17 nt, Mycobacterium leprae
ccaacuguugcuugccc

SEQ ID NO: 3230386 - RNA, 14 nt, Mycobacterium leprae
ccaagaaguacagu

SEQ ID NO: 3230387 - RNA, 22 nt, Mycobacterium leprae
ccaagaaguuaccgagccgguc

SEQ ID NO: 3230388 - RNA, 17 nt, Mycobacterium leprae
ccaagaccaccugucug

SEQ ID NO: 3230389 - RNA, 18 nt, Mycobacterium leprae
ccaagccgccagucgcag

SEQ ID NO: 3230390 - RNA, 18 nt, Mycobacterium leprae
ccaagccgcccggccugc

SEQ ID NO: 3230391 - RNA, 21 nt, Mycobacterium leprae
ccaagcguuacagccgagggu

SEQ ID NO: 3230392 - RNA, 23 nt, Mycobacterium leprae
ccaagcugacggaaagugccgcg

SEQ ID NO: 3230393 - RNA, 18 nt, Mycobacterium leprae
ccaaggaaugguuguagc

SEQ ID NO: 3230394 - RNA, 20 nt, Mycobacterium leprae
ccaaggucacgaugcuugau

SEQ ID NO: 3230395 - RNA, 18 nt, Mycobacterium leprae
ccaaguauacuagacuuu

SEQ ID NO: 3230396 - RNA, 15 nt, Mycobacterium leprae
ccaagucuucgaugc

SEQ ID NO: 3230397 - RNA, 23 nt, Mycobacterium leprae
ccaaguuggugucaacagucgcc

SEQ ID NO: 3230398 - RNA, 22 nt, Mycobacterium leprae
ccaauccaccgugcuggucuug

SEQ ID NO: 3230399 - RNA, 16 nt, Mycobacterium leprae
ccaauccagccgaggg

SEQ ID NO: 3230400 - RNA, 23 nt, Mycobacterium leprae
ccaaucuaucaagccacacgguu

SEQ ID NO: 3230401 - RNA, 17 nt, Mycobacterium leprae
ccaaugcagcaacgugc

SEQ ID NO: 3230402 - RNA, 12 nt, Mycobacterium leprae
ccaaugcagcgu

SEQ ID NO: 3230403 - RNA, 21 nt, Mycobacterium leprae
ccaauguugagugcgaccuga

SEQ ID NO: 3230404 - RNA, 18 nt, Mycobacterium leprae
ccaauucgccgaccacau

SEQ ID NO: 3230405 - RNA, 22 nt, Mycobacterium leprae
ccaauucguaauuccugcagcc

SEQ ID NO: 3230406 - RNA, 21 nt, Mycobacterium leprae
ccaauucucagcggaagcgcu

SEQ ID NO: 3230407 - RNA, 13 nt, Mycobacterium leprae
ccaauugccaucc

SEQ ID NO: 3230408 - RNA, 17 nt, Mycobacterium leprae
ccaauugccauccucga

SEQ ID NO: 3230409 - RNA, 13 nt, Mycobacterium leprae
ccaauugccuggc

SEQ ID NO: 3230410 - RNA, 15 nt, Mycobacterium leprae
ccacaacgccaaacu

SEQ ID NO: 3230411 - RNA, 19 nt, Mycobacterium leprae
ccacaagcaacugcagcua

SEQ ID NO: 3230412 - RNA, 16 nt, Mycobacterium leprae
ccacacccuggcuggg

SEQ ID NO: 3230413 - RNA, 19 nt, Mycobacterium leprae
ccacagaaccuucaucgga

SEQ ID NO: 3230414 - RNA, 17 nt, Mycobacterium leprae
ccacagauucguaccgc

SEQ ID NO: 3230415 - RNA, 17 nt, Mycobacterium leprae
ccacagcgacggaucug

SEQ ID NO: 3230416 - RNA, 20 nt, Mycobacterium leprae
ccacaggcagagccaaacau

SEQ ID NO: 3230417 - RNA, 15 nt, Mycobacterium leprae
ccacaucaucgauca

SEQ ID NO: 3230418 - RNA, 20 nt, Mycobacterium leprae
ccacaucgauugggucaguc

SEQ ID NO: 3230419 - RNA, 15 nt, Mycobacterium leprae
ccacauguuuccggc

SEQ ID NO: 3230420 - RNA, 22 nt, Mycobacterium leprae
ccacauugaccacgccgacacc

SEQ ID NO: 3230421 - RNA, 13 nt, Mycobacterium leprae
ccaccaccgccac

SEQ ID NO: 3230422 - RNA, 21 nt, Mycobacterium leprae
ccaccagggaagaucucagcc

SEQ ID NO: 3230423 - RNA, 15 nt, Mycobacterium leprae
ccaccaugcggcgga

SEQ ID NO: 3230424 - RNA, 16 nt, Mycobacterium leprae
ccacccacggcuguca

SEQ ID NO: 3230425 - RNA, 14 nt, Mycobacterium leprae
ccacccgucccgca

SEQ ID NO: 3230426 - RNA, 23 nt, Mycobacterium leprae
ccaccgaaccgggcagcgccacg

SEQ ID NO: 3230427 - RNA, 13 nt, Mycobacterium leprae
ccaccgacaugcu

SEQ ID NO: 3230428 - RNA, 16 nt, Mycobacterium leprae
ccaccgacaugcuuac

SEQ ID NO: 3230429 - RNA, 12 nt, Mycobacterium leprae
ccaccgccaccg

SEQ ID NO: 3230430 - RNA, 16 nt, Mycobacterium leprae
ccaccgccaccuaggc

SEQ ID NO: 3230431 - RNA, 22 nt, Mycobacterium leprae
ccaccggcgcuuguaaggccag

SEQ ID NO: 3230432 - RNA, 12 nt, Mycobacterium leprae
ccaccggcggcu

SEQ ID NO: 3230433 - RNA, 15 nt, Mycobacterium leprae
ccaccggcggcuggu

SEQ ID NO: 3230434 - RNA, 21 nt, Mycobacterium leprae
ccaccguauccuggucaucug

SEQ ID NO: 3230435 - RNA, 20 nt, Mycobacterium leprae
ccaccgugguguugucgccg

SEQ ID NO: 3230436 - RNA, 19 nt, Mycobacterium leprae
ccaccguuacggccauguc

SEQ ID NO: 3230437 - RNA, 19 nt, Mycobacterium leprae
ccaccguuggacaccaccg

SEQ ID NO: 3230438 - RNA, 19 nt, Mycobacterium leprae
ccaccguuguggaucgacc

SEQ ID NO: 3230439 - RNA, 23 nt, Mycobacterium leprae
ccaccugcauggacgauaucgcu

SEQ ID NO: 3230440 - RNA, 14 nt, Mycobacterium leprae
ccaccuggucacca

SEQ ID NO: 3230441 - RNA, 16 nt, Mycobacterium leprae
ccaccuggucaccaac

SEQ ID NO: 3230442 - RNA, 17 nt, Mycobacterium leprae
ccaccuggucaccaacc

SEQ ID NO: 3230443 - RNA, 14 nt, Mycobacterium leprae
ccacgacaucguug

SEQ ID NO: 3230444 - RNA, 19 nt, Mycobacterium leprae
ccacgagacccagccgugg

SEQ ID NO: 3230445 - RNA, 19 nt, Mycobacterium leprae
ccacgauucugcuggagau

SEQ ID NO: 3230446 - RNA, 23 nt, Mycobacterium leprae
ccacgcaaacgaauaacugccaa

SEQ ID NO: 3230447 - RNA, 17 nt, Mycobacterium leprae
ccacgcaaugucgccgg

SEQ ID NO: 3230448 - RNA, 10 nt, Mycobacterium leprae
ccacgccgga

SEQ ID NO: 3230449 - RNA, 23 nt, Mycobacterium leprae
ccacgcuggcacuccgaccgagc

SEQ ID NO: 3230450 - RNA, 17 nt, Mycobacterium leprae
ccacggcagcgucacca

SEQ ID NO: 3230451 - RNA, 12 nt, Mycobacterium leprae
ccacggcagcua

SEQ ID NO: 3230452 - RNA, 18 nt, Mycobacterium leprae
ccacggcgucggcguacu

SEQ ID NO: 3230453 - RNA, 13 nt, Mycobacterium leprae
ccacgguggccuu

SEQ ID NO: 3230454 - RNA, 11 nt, Mycobacterium leprae
ccacgucgauc

SEQ ID NO: 3230455 - RNA, 11 nt, Mycobacterium leprae
ccacuaacaca

SEQ ID NO: 3230456 - RNA, 18 nt, Mycobacterium leprae
ccacuccgguugcggcga

SEQ ID NO: 3230457 - RNA, 19 nt, Mycobacterium leprae
ccacugaacguggcaccaa

SEQ ID NO: 3230458 - RNA, 14 nt, Mycobacterium leprae
ccacugcacgacca

SEQ ID NO: 3230459 - RNA, 19 nt, Mycobacterium leprae
ccacugcaggagguagcaa

SEQ ID NO: 3230460 - RNA, 13 nt, Mycobacterium leprae
ccacugccagaga

SEQ ID NO: 3230461 - RNA, 16 nt, Mycobacterium leprae
ccacugcggcaaagca

SEQ ID NO: 3230462 - RNA, 23 nt, Mycobacterium leprae
ccacugcuccugagacaucgcca

SEQ ID NO: 3230463 - RNA, 19 nt, Mycobacterium leprae
ccacugggcugagccgccg

SEQ ID NO: 3230464 - RNA, 22 nt, Mycobacterium leprae
ccacuucagaucgacuccgcaa

SEQ ID NO: 3230465 - RNA, 17 nt, Mycobacterium leprae
ccacuucggcacagugc

SEQ ID NO: 3230466 - RNA, 19 nt, Mycobacterium leprae
ccacuucuugugcaccguu

SEQ ID NO: 3230467 - RNA, 19 nt, Mycobacterium leprae
ccacuugacggucgagcug

SEQ ID NO: 3230468 - RNA, 21 nt, Mycobacterium leprae
ccacuugacuauauaguccga

SEQ ID NO: 3230469 - RNA, 14 nt, Mycobacterium leprae
ccauuggccgcugg

SEQ ID NO: 3230470 - RNA, 17 nt, Mycobacterium leprae
ccauuuauuccagagca

SEQ ID NO: 3230471 - RNA, 20 nt, Mycobacterium leprae
ccauuugucaucggcgugcc

SEQ ID NO: 3230472 - RNA, 17 nt, Mycobacterium leprae
cccaaaucagcaccauc

SEQ ID NO: 3230473 - RNA, 16 nt, Mycobacterium leprae
cccaaccgcgacgcca

SEQ ID NO: 3230474 - RNA, 16 nt, Mycobacterium leprae
cccaagcaucccccgu

SEQ ID NO: 3230475 - RNA, 13 nt, Mycobacterium leprae
cccaaggggagca

SEQ ID NO: 3230476 - RNA, 23 nt, Mycobacterium leprae
cccaauagagcagugcugacauc

SEQ ID NO: 3230477 - RNA, 16 nt, Mycobacterium leprae
cccaauugccuggcga

SEQ ID NO: 3230478 - RNA, 12 nt, Mycobacterium leprae
cccacaacgcca

SEQ ID NO: 3230479 - RNA, 12 nt, Mycobacterium leprae
cccacaagucca

SEQ ID NO: 3230480 - RNA, 17 nt, Mycobacterium leprae
cccacaaguuguccgcc

SEQ ID NO: 3230481 - RNA, 20 nt, Mycobacterium leprae
cccacaaguuguccgccccg

SEQ ID NO: 3230482 - RNA, 14 nt, Mycobacterium leprae
cccacagcugcgca

SEQ ID NO: 3230483 - RNA, 18 nt, Mycobacterium leprae
cccaccgcaacgccucca

SEQ ID NO: 3230484 - RNA, 14 nt, Mycobacterium leprae
cccaccgcaaucga

SEQ ID NO: 3230485 - RNA, 13 nt, Mycobacterium leprae
cccacucggcggu

SEQ ID NO: 3230486 - RNA, 19 nt, Mycobacterium leprae
cccacugggcaagcagugc

SEQ ID NO: 3230487 - RNA, 23 nt, Mycobacterium leprae
cccacuuaugagcaaaaauccgc

SEQ ID NO: 3230488 - RNA, 16 nt, Mycobacterium leprae
cccacuugggcaacac

SEQ ID NO: 3230489 - RNA, 21 nt, Mycobacterium leprae
cccacuugggcaacaccucaa

SEQ ID NO: 3230490 - RNA, 16 nt, Mycobacterium leprae
cccagacgcgaccgcc

SEQ ID NO: 3230491 - RNA, 17 nt, Mycobacterium leprae
cccagcaccacugcggu

SEQ ID NO: 3230492 - RNA, 22 nt, Mycobacterium leprae
cccagcaccacugcggugugug

SEQ ID NO: 3230493 - RNA, 14 nt, Mycobacterium leprae
cccagcagauggcc

SEQ ID NO: 3230494 - RNA, 20 nt, Mycobacterium leprae
cccagcgauaucaagcugcg

SEQ ID NO: 3230495 - RNA, 14 nt, Mycobacterium leprae
cccagcguucucca

SEQ ID NO: 3230496 - RNA, 24 nt, Mycobacterium leprae
cccagcuccagaacggucuggcgc

SEQ ID NO: 3230497 - RNA, 19 nt, Mycobacterium leprae
cccaggccuguugcggcca

SEQ ID NO: 3230498 - RNA, 22 nt, Mycobacterium leprae
cccaggccuguugcggccaagc

SEQ ID NO: 3230499 - RNA, 23 nt, Mycobacterium leprae
cccaggggggcgcggucgccgau

SEQ ID NO: 3230500 - RNA, 16 nt, Mycobacterium leprae
cccaguaggcaccacg

SEQ ID NO: 3230501 - RNA, 14 nt, Mycobacterium leprae
cccagucgccagag

SEQ ID NO: 3230502 - RNA, 23 nt, Mycobacterium leprae
cccagugugcugcauccgacaaa

SEQ ID NO: 3230503 - RNA, 17 nt, Mycobacterium leprae
cccaguucgugaugguc

SEQ ID NO: 3230504 - RNA, 20 nt, Mycobacterium leprae
cccaguucgugauggucgaa

SEQ ID NO: 3230505 - RNA, 21 nt, Mycobacterium leprae
cccaucaccggugcaccgucu

SEQ ID NO: 3230506 - RNA, 17 nt, Mycobacterium leprae
cccauccgaaucaccgc

SEQ ID NO: 3230507 - RNA, 13 nt, Mycobacterium leprae
cccauccgggcca

SEQ ID NO: 3230508 - RNA, 15 nt, Mycobacterium leprae
cccauccgggccagu

SEQ ID NO: 3230509 - RNA, 15 nt, Mycobacterium leprae
cccauccguccaccc

SEQ ID NO: 3230510 - RNA, 13 nt, Mycobacterium leprae
cccaucgcugacc

SEQ ID NO: 3230511 - RNA, 14 nt, Mycobacterium leprae
cccaucggcggcca

SEQ ID NO: 3230512 - RNA, 16 nt, Mycobacterium leprae
cccaucucaucuugac

SEQ ID NO: 3230513 - RNA, 18 nt, Mycobacterium leprae
cccaugcuuaaggcagaa

SEQ ID NO: 3230514 - RNA, 15 nt, Mycobacterium leprae
cccaugggaguuuau

SEQ ID NO: 3230515 - RNA, 22 nt, Mycobacterium leprae
cccaugggaguuuaucggugga

SEQ ID NO: 3230516 - RNA, 12 nt, Mycobacterium leprae
ccccaacugguu

SEQ ID NO: 3230517 - RNA, 14 nt, Mycobacterium leprae
ccccaauggcggag

SEQ ID NO: 3230518 - RNA, 13 nt, Mycobacterium leprae
ccccacguugcgg

SEQ ID NO: 3230519 - RNA, 12 nt, Mycobacterium leprae
ccccagacguca

SEQ ID NO: 3230520 - RNA, 18 nt, Mycobacterium leprae
ccccagucgccagagccg

SEQ ID NO: 3230521 - RNA, 21 nt, Mycobacterium leprae
ccccauucagcggcgauuucg

SEQ ID NO: 3230522 - RNA, 22 nt, Mycobacterium leprae
cccccagaaccaucccaaaacc

SEQ ID NO: 3230523 - RNA, 23 nt, Mycobacterium leprae
cccccggacaguccaccgccagg

SEQ ID NO: 3230524 - RNA, 13 nt, Mycobacterium leprae
cccccucggcgau

SEQ ID NO: 3230525 - RNA, 15 nt, Mycobacterium leprae
ccccgaaugcaaugc

SEQ ID NO: 3230526 - RNA, 21 nt, Mycobacterium leprae
ccccgaaugcaaugcgccauu

SEQ ID NO: 3230527 - RNA, 17 nt, Mycobacterium leprae
ccccgaguucucagucg

SEQ ID NO: 3230528 - RNA, 14 nt, Mycobacterium leprae
ccccggaacgggca

SEQ ID NO: 3230529 - RNA, 20 nt, Mycobacterium leprae
ccccggacaguccaccgcca

SEQ ID NO: 3230530 - RNA, 12 nt, Mycobacterium leprae
ccccggccgccg

SEQ ID NO: 3230531 - RNA, 19 nt, Mycobacterium leprae
cccgaaaaccccacacuga

SEQ ID NO: 3230532 - RNA, 21 nt, Mycobacterium leprae
cccgaccggcccgaaagaugc

SEQ ID NO: 3230533 - RNA, 15 nt, Mycobacterium leprae
cccgacggcacaccg

SEQ ID NO: 3230534 - RNA, 20 nt, Mycobacterium leprae
cccgacggcacaccgugucc

SEQ ID NO: 3230535 - RNA, 10 nt, Mycobacterium leprae
cccgacggcg

SEQ ID NO: 3230536 - RNA, 20 nt, Mycobacterium leprae
cccgaggcgcuaggacaaca

SEQ ID NO: 3230537 - RNA, 19 nt, Mycobacterium leprae
cccgauagggguucgccgc

SEQ ID NO: 3230538 - RNA, 22 nt, Mycobacterium leprae
cccgaugauccacucgccgcgg

SEQ ID NO: 3230539 - RNA, 15 nt, Mycobacterium leprae
cccgauuuucgaucc

SEQ ID NO: 3230540 - RNA, 15 nt, Mycobacterium leprae
cccgcagcaccuugg

SEQ ID NO: 3230541 - RNA, 18 nt, Mycobacterium leprae
cccgcaucguugucggcu

SEQ ID NO: 3230542 - RNA, 18 nt, Mycobacterium leprae
cccgcaugcccugggcca

SEQ ID NO: 3230543 - RNA, 11 nt, Mycobacterium leprae
cccgcgacggc

SEQ ID NO: 3230544 - RNA, 12 nt, Mycobacterium leprae
cccgcgccgccg

SEQ ID NO: 3230545 - RNA, 17 nt, Mycobacterium leprae
cccgcgccgccugcugc

SEQ ID NO: 3230546 - RNA, 17 nt, Mycobacterium leprae
cccgcguuagucgucgu

SEQ ID NO: 3230547 - RNA, 21 nt, Mycobacterium leprae
cccgcguuagucgucgugaau

SEQ ID NO: 3230548 - RNA, 22 nt, Mycobacterium leprae
cccgcuuaaccaucagaaaacc

SEQ ID NO: 3230549 - RNA, 23 nt, Mycobacterium leprae
cccgcuugucuuugauccgcugg

SEQ ID NO: 3230550 - RNA, 15 nt, Mycobacterium leprae
cccggacaagucagc

SEQ ID NO: 3230551 - RNA, 23 nt, Mycobacterium leprae
cccggacaagucagccuagcagc

SEQ ID NO: 3230552 - RNA, 18 nt, Mycobacterium leprae
cccggauugauggaugca

SEQ ID NO: 3230553 - RNA, 24 nt, Mycobacterium leprae
cccggcaccgacguauccaaggug

SEQ ID NO: 3230554 - RNA, 18 nt, Mycobacterium leprae
cccggcagcauccgccga

SEQ ID NO: 3230555 - RNA, 11 nt, Mycobacterium leprae
cccggccaggu

SEQ ID NO: 3230556 - RNA, 13 nt, Mycobacterium leprae
cccggccgccguc

SEQ ID NO: 3230557 - RNA, 18 nt, Mycobacterium leprae
cccggcgauugccaccac

SEQ ID NO: 3230558 - RNA, 17 nt, Mycobacterium leprae
cccggcggcaugccugc

SEQ ID NO: 3230559 - RNA, 21 nt, Mycobacterium leprae
cccggcggcaugccugcuugc

SEQ ID NO: 3230560 - RNA, 21 nt, Mycobacterium leprae
cccggcggccaauucgccgac

SEQ ID NO: 3230561 - RNA, 15 nt, Mycobacterium leprae
cccgggucgagcagc

SEQ ID NO: 3230562 - RNA, 13 nt, Mycobacterium leprae
cccgguaucccaa

SEQ ID NO: 3230563 - RNA, 20 nt, Mycobacterium leprae
cccggugacaucaccggaug

SEQ ID NO: 3230564 - RNA, 14 nt, Mycobacterium leprae
cccggugucacccg

SEQ ID NO: 3230565 - RNA, 15 nt, Mycobacterium leprae
cccggugucacccgg

SEQ ID NO: 3230566 - RNA, 18 nt, Mycobacterium leprae
cccgguuggccaacuguc

SEQ ID NO: 3230567 - RNA, 22 nt, Mycobacterium leprae
cccguaugaucuaauagccgaa

SEQ ID NO: 3230568 - RNA, 20 nt, Mycobacterium leprae
cccucaaugcacgugauggc

SEQ ID NO: 3230569 - RNA, 15 nt, Mycobacterium leprae
cccucacccgaccgg

SEQ ID NO: 3230570 - RNA, 19 nt, Mycobacterium leprae
cccuccuuuucgccggcgu

SEQ ID NO: 3230571 - RNA, 14 nt, Mycobacterium leprae
cccucgccggcggu

SEQ ID NO: 3230572 - RNA, 16 nt, Mycobacterium leprae
cccucggccaucucga

SEQ ID NO: 3230573 - RNA, 19 nt, Mycobacterium leprae
cccucguugacgcccuccu

SEQ ID NO: 3230574 - RNA, 12 nt, Mycobacterium leprae
cccugagcacca

SEQ ID NO: 3230575 - RNA, 15 nt, Mycobacterium leprae
cccugagcaccaucu

SEQ ID NO: 3230576 - RNA, 20 nt, Mycobacterium leprae
cccugcaauggguagucagc

SEQ ID NO: 3230577 - RNA, 16 nt, Mycobacterium leprae
cccugccgccacagca

SEQ ID NO: 3230578 - RNA, 15 nt, Mycobacterium leprae
cccugcgaacugcgc

SEQ ID NO: 3230579 - RNA, 16 nt, Mycobacterium leprae
cccugcgaacugcgca

SEQ ID NO: 3230580 - RNA, 20 nt, Mycobacterium leprae
cccuggaauccgcgcagggc

SEQ ID NO: 3230581 - RNA, 16 nt, Mycobacterium leprae
cccuggaccgcagcac

SEQ ID NO: 3230582 - RNA, 18 nt, Mycobacterium leprae
ccgcaucgauaagcagca

SEQ ID NO: 3230583 - RNA, 21 nt, Mycobacterium leprae
ccgcaucgauaagcagcagcg

SEQ ID NO: 3230584 - RNA, 13 nt, Mycobacterium leprae
ccgcaucggcccg

SEQ ID NO: 3230585 - RNA, 17 nt, Mycobacterium leprae
ccgcaugagccggucgg

SEQ ID NO: 3230586 - RNA, 19 nt, Mycobacterium leprae
ccgcaugcccugggccagc

SEQ ID NO: 3230587 - RNA, 14 nt, Mycobacterium leprae
ccgccacagcaagu

SEQ ID NO: 3230588 - RNA, 21 nt, Mycobacterium leprae
ccgccacaugugcgccagggg

SEQ ID NO: 3230589 - RNA, 15 nt, Mycobacterium leprae
ccgccacgccgugcu

SEQ ID NO: 3230590 - RNA, 16 nt, Mycobacterium leprae
ccgccacucgucacau

SEQ ID NO: 3230591 - RNA, 19 nt, Mycobacterium leprae
ccgccagaccggcgaucuu

SEQ ID NO: 3230592 - RNA, 17 nt, Mycobacterium leprae
ccgccagcgacaccacc

SEQ ID NO: 3230593 - RNA, 16 nt, Mycobacterium leprae
ccgccaggucagcgau

SEQ ID NO: 3230594 - RNA, 15 nt, Mycobacterium leprae
ccgccaucggcuggu

SEQ ID NO: 3230595 - RNA, 16 nt, Mycobacterium leprae
ccgccauugcccccgc

SEQ ID NO: 3230596 - RNA, 13 nt, Mycobacterium leprae
ccgcccaagcgaa

SEQ ID NO: 3230597 - RNA, 22 nt, Mycobacterium leprae
ccgcccaggugucuuccagugg

SEQ ID NO: 3230598 - RNA, 14 nt, Mycobacterium leprae
ccgcccgcuggauc

SEQ ID NO: 3230599 - RNA, 13 nt, Mycobacterium leprae
ccgcccggccugc

SEQ ID NO: 3230600 - RNA, 20 nt, Mycobacterium leprae
ccgcccuggaccgcagcacg

SEQ ID NO: 3230601 - RNA, 16 nt, Mycobacterium leprae
ccgccgaagccgcgca

SEQ ID NO: 3230602 - RNA, 14 nt, Mycobacterium leprae
ccgccgacaccgau

SEQ ID NO: 3230603 - RNA, 13 nt, Mycobacterium leprae
ccgccggcaagcc

SEQ ID NO: 3230604 - RNA, 11 nt, Mycobacterium leprae
ccgccggcguc

SEQ ID NO: 3230605 - RNA, 21 nt, Mycobacterium leprae
ccgccguccacugcagggcga

SEQ ID NO: 3230606 - RNA, 19 nt, Mycobacterium leprae
ccgccgugguggcugucgg

SEQ ID NO: 3230607 - RNA, 21 nt, Mycobacterium leprae
ccgccguucucccgccacucg

SEQ ID NO: 3230608 - RNA, 18 nt, Mycobacterium leprae
ccgccguucucgcgcagg

SEQ ID NO: 3230609 - RNA, 16 nt, Mycobacterium leprae
ccgccucgaucagcua

SEQ ID NO: 3230610 - RNA, 16 nt, Mycobacterium leprae
ccgcgacgccaggcgg

SEQ ID NO: 3230611 - RNA, 21 nt, Mycobacterium leprae
ccgcgaucucgucgacaaggc

SEQ ID NO: 3230612 - RNA, 19 nt, Mycobacterium leprae
ccgcgcacccgagcggcac

SEQ ID NO: 3230613 - RNA, 18 nt, Mycobacterium leprae
ccgcgcaucaucgcccac

SEQ ID NO: 3230614 - RNA, 22 nt, Mycobacterium leprae
ccgcgcuagacgucugucaccc

SEQ ID NO: 3230615 - RNA, 15 nt, Mycobacterium leprae
ccgcgcucuggcauc

SEQ ID NO: 3230616 - RNA, 20 nt, Mycobacterium leprae
ccgcgcugugcgcaugcacg

SEQ ID NO: 3230617 - RNA, 14 nt, Mycobacterium leprae
ccgcggaguuggcc

SEQ ID NO: 3230618 - RNA, 14 nt, Mycobacterium leprae
ccgcggcaacaacg

SEQ ID NO: 3230619 - RNA, 15 nt, Mycobacterium leprae
ccgcggcgaugaccg

SEQ ID NO: 3230620 - RNA, 13 nt, Mycobacterium leprae
ccgcggcgcuaac

SEQ ID NO: 3230621 - RNA, 21 nt, Mycobacterium leprae
ccgcggcguuauccacgccga

SEQ ID NO: 3230622 - RNA, 16 nt, Mycobacterium leprae
ccgcggcuaucgccgc

SEQ ID NO: 3230623 - RNA, 18 nt, Mycobacterium leprae
ccgcggucgugcugcugg

SEQ ID NO: 3230624 - RNA, 13 nt, Mycobacterium leprae
ccgcggugacgcu

SEQ ID NO: 3230625 - RNA, 16 nt, Mycobacterium leprae
ccgcgguuuccgcggc

SEQ ID NO: 3230626 - RNA, 22 nt, Mycobacterium leprae
ccgcguaaccaacuaggcgcca

SEQ ID NO: 3230627 - RNA, 20 nt, Mycobacterium leprae
ccgcguaaccgcucgauggc

SEQ ID NO: 3230628 - RNA, 16 nt, Mycobacterium leprae
ccgcguccagacacca

SEQ ID NO: 3230629 - RNA, 12 nt, Mycobacterium leprae
ccgcgucggcgu

SEQ ID NO: 3230630 - RNA, 17 nt, Mycobacterium leprae
ccgcguucguugcugac

SEQ ID NO: 3230631 - RNA, 17 nt, Mycobacterium leprae
ccgcuaaggcagcccgc

SEQ ID NO: 3230632 - RNA, 21 nt, Mycobacterium leprae
ccgcuacauugcuccgcagca

SEQ ID NO: 3230633 - RNA, 22 nt, Mycobacterium leprae
ccgcuacauugcuccgcagcac

SEQ ID NO: 3230634 - RNA, 19 nt, Mycobacterium leprae
ccgcuaugcggacggacac

SEQ ID NO: 3230635 - RNA, 16 nt, Mycobacterium leprae
ccgcucgaccauguga

SEQ ID NO: 3230636 - RNA, 22 nt, Mycobacterium leprae
ccgcucgauggccagccguccc

SEQ ID NO: 3230637 - RNA, 20 nt, Mycobacterium leprae
ccgcugagcaauuucuucuc

SEQ ID NO: 3230638 - RNA, 22 nt, Mycobacterium leprae
ccgcuggaagucggucugcggg

SEQ ID NO: 3230639 - RNA, 16 nt, Mycobacterium leprae
ccgcugguaucggugu

SEQ ID NO: 3230640 - RNA, 14 nt, Mycobacterium leprae
ccgcuggucaagcu

SEQ ID NO: 3230641 - RNA, 23 nt, Mycobacterium leprae
ccgcugucgauggacaagguguu

SEQ ID NO: 3230642 - RNA, 11 nt, Mycobacterium leprae
ccgcugugaca

SEQ ID NO: 3230643 - RNA, 23 nt, Mycobacterium leprae
ccgcugugacagcgugccgaagu

SEQ ID NO: 3230644 - RNA, 22 nt, Mycobacterium leprae
ccggaaaagucguggagcaccu

SEQ ID NO: 3230645 - RNA, 20 nt, Mycobacterium leprae
ccggaaagaucgcccaccgc

SEQ ID NO: 3230646 - RNA, 17 nt, Mycobacterium leprae
ccggaaauaguggcuga

SEQ ID NO: 3230647 - RNA, 13 nt, Mycobacterium leprae
ccggaauuccgac

SEQ ID NO: 3230648 - RNA, 20 nt, Mycobacterium leprae
ccggaauuuuugaggugcag

SEQ ID NO: 3230649 - RNA, 15 nt, Mycobacterium leprae
ccggacacaaccagc

SEQ ID NO: 3230650 - RNA, 11 nt, Mycobacterium leprae
ccggacagcac

SEQ ID NO: 3230651 - RNA, 16 nt, Mycobacterium leprae
ccggacagcacccccg

SEQ ID NO: 3230652 - RNA, 19 nt, Mycobacterium leprae
ccggacagcggcccaaccc

SEQ ID NO: 3230653 - RNA, 16 nt, Mycobacterium leprae
ccggacaguccaccgc

SEQ ID NO: 3230654 - RNA, 17 nt, Mycobacterium leprae
ccggacaguccaccgcc

SEQ ID NO: 3230655 - RNA, 19 nt, Mycobacterium leprae
ccggacaguccaccgccag

SEQ ID NO: 3230656 - RNA, 12 nt, Mycobacterium leprae
ccggacccgagc

SEQ ID NO: 3230657 - RNA, 21 nt, Mycobacterium leprae
ccggacggccauuggcaccgu

SEQ ID NO: 3230658 - RNA, 20 nt, Mycobacterium leprae
ccggacggcccagcaccacu

SEQ ID NO: 3230659 - RNA, 16 nt, Mycobacterium leprae
ccggacgugcacaucg

SEQ ID NO: 3230660 - RNA, 13 nt, Mycobacterium leprae
ccggaguuuucaa

SEQ ID NO: 3230661 - RNA, 19 nt, Mycobacterium leprae
ccggaucgacggcagcgcu

SEQ ID NO: 3230662 - RNA, 19 nt, Mycobacterium leprae
ccggauguguugguuuggu

SEQ ID NO: 3230663 - RNA, 18 nt, Mycobacterium leprae
ccggauuccgaacgaccu

SEQ ID NO: 3230664 - RNA, 13 nt, Mycobacterium leprae
ccggcaagcccgg

SEQ ID NO: 3230665 - RNA, 17 nt, Mycobacterium leprae
ccggcaagcugcccggc

SEQ ID NO: 3230666 - RNA, 16 nt, Mycobacterium leprae
ccggcacaucgucggc

SEQ ID NO: 3230667 - RNA, 18 nt, Mycobacterium leprae
ccggcaucggacaggauc

SEQ ID NO: 3230668 - RNA, 17 nt, Mycobacterium leprae
ccggcaugggccggugu

SEQ ID NO: 3230669 - RNA, 21 nt, Mycobacterium leprae
ccggccgaucgugugcacugc

SEQ ID NO: 3230670 - RNA, 15 nt, Mycobacterium leprae
ccggccgucgcggga

SEQ ID NO: 3230671 - RNA, 16 nt, Mycobacterium leprae
ccggccuccggugccc

SEQ ID NO: 3230672 - RNA, 15 nt, Mycobacterium leprae
ccggcgaaucggucu

SEQ ID NO: 3230673 - RNA, 17 nt, Mycobacterium leprae
ccggcgaccagcgagca

SEQ ID NO: 3230674 - RNA, 19 nt, Mycobacterium leprae
ccggcgauugccaccacca

SEQ ID NO: 3230675 - RNA, 14 nt, Mycobacterium leprae
ccggcgcuguccac

SEQ ID NO: 3230676 - RNA, 20 nt, Mycobacterium leprae
ccggcgcuuguaaggccagc

SEQ ID NO: 3230677 - RNA, 13 nt, Mycobacterium leprae
ccggcggccaauu

SEQ ID NO: 3230678 - RNA, 19 nt, Mycobacterium leprae
ccggcggccaauucgccga

SEQ ID NO: 3230679 - RNA, 20 nt, Mycobacterium leprae
ccggcggccaauucgccgac

SEQ ID NO: 3230680 - RNA, 15 nt, Mycobacterium leprae
ccggcggccaccgcg

SEQ ID NO: 3230681 - RNA, 17 nt, Mycobacterium leprae
ccggcggcgagcaagcg

SEQ ID NO: 3230682 - RNA, 21 nt, Mycobacterium leprae
ccggcgguauugacguggugg

SEQ ID NO: 3230683 - RNA, 14 nt, Mycobacterium leprae
ccggcgucaggcca

SEQ ID NO: 3230684 - RNA, 19 nt, Mycobacterium leprae
ccggcgucuggcuggccuc

SEQ ID NO: 3230685 - RNA, 21 nt, Mycobacterium leprae
ccggcguguggggguccgcgc

SEQ ID NO: 3230686 - RNA, 16 nt, Mycobacterium leprae
ccggcuaccggcccga

SEQ ID NO: 3230687 - RNA, 20 nt, Mycobacterium leprae
ccggcuguagugggacacuc

SEQ ID NO: 3230688 - RNA, 22 nt, Mycobacterium leprae
ccggcuguagugggacacucga

SEQ ID NO: 3230689 - RNA, 14 nt, Mycobacterium leprae
ccggcuugggguau

SEQ ID NO: 3230690 - RNA, 17 nt, Mycobacterium leprae
ccgggaaacuagcgggc

SEQ ID NO: 3230691 - RNA, 20 nt, Mycobacterium leprae
ccgggaaauacggcacgccg

SEQ ID NO: 3230692 - RNA, 18 nt, Mycobacterium leprae
ccgggaugacguugcugg

SEQ ID NO: 3230693 - RNA, 23 nt, Mycobacterium leprae
ccgggaugacguugcuggacauc

SEQ ID NO: 3230694 - RNA, 15 nt, Mycobacterium leprae
ccgggauggcugggc

SEQ ID NO: 3230695 - RNA, 13 nt, Mycobacterium leprae
ccucgagcuugcc

SEQ ID NO: 3230696 - RNA, 21 nt, Mycobacterium leprae
ccucgaggugcaggagcgugg

SEQ ID NO: 3230697 - RNA, 17 nt, Mycobacterium leprae
ccucgccaccuggucac

SEQ ID NO: 3230698 - RNA, 23 nt, Mycobacterium leprae
ccucgcugcagcauaacccgauc

SEQ ID NO: 3230699 - RNA, 14 nt, Mycobacterium leprae
ccucggccaucucg

SEQ ID NO: 3230700 - RNA, 19 nt, Mycobacterium leprae
ccucggcggcaccuccccg

SEQ ID NO: 3230701 - RNA, 16 nt, Mycobacterium leprae
ccucgucggccagcac

SEQ ID NO: 3230702 - RNA, 17 nt, Mycobacterium leprae
ccucgucggccagcacu

SEQ ID NO: 3230703 - RNA, 20 nt, Mycobacterium leprae
ccucguggguacgugccaac

SEQ ID NO: 3230704 - RNA, 22 nt, Mycobacterium leprae
ccucgugugcuacguuguuguc

SEQ ID NO: 3230705 - RNA, 23 nt, Mycobacterium leprae
ccucguugacgcccuccuggcga

SEQ ID NO: 3230706 - RNA, 19 nt, Mycobacterium leprae
ccucuccagccaucacuga

SEQ ID NO: 3230707 - RNA, 19 nt, Mycobacterium leprae
ccucugacguuguuuuugu

SEQ ID NO: 3230708 - RNA, 18 nt, Mycobacterium leprae
ccucugccagggguucca

SEQ ID NO: 3230709 - RNA, 14 nt, Mycobacterium leprae
ccucuguugugauc

SEQ ID NO: 3230710 - RNA, 14 nt, Mycobacterium leprae
ccucuuccgccgcu

SEQ ID NO: 3230711 - RNA, 15 nt, Mycobacterium leprae
ccucuucgacaccga

SEQ ID NO: 3230712 - RNA, 13 nt, Mycobacterium leprae
ccucuugacggga

SEQ ID NO: 3230713 - RNA, 14 nt, Mycobacterium leprae
ccugaaaacuacuc

SEQ ID NO: 3230714 - RNA, 14 nt, Mycobacterium leprae
ccugaacugguggc

SEQ ID NO: 3230715 - RNA, 21 nt, Mycobacterium leprae
ccugagacaucgccaccgacc

SEQ ID NO: 3230716 - RNA, 18 nt, Mycobacterium leprae
ccugagaccauaacacua

SEQ ID NO: 3230717 - RNA, 20 nt, Mycobacterium leprae
ccugagcaaauuugugcccg

SEQ ID NO: 3230718 - RNA, 16 nt, Mycobacterium leprae
ccugagcaccaucucg

SEQ ID NO: 3230719 - RNA, 20 nt, Mycobacterium leprae
ccugaggguguuggucuguu

SEQ ID NO: 3230720 - RNA, 15 nt, Mycobacterium leprae
ccugauccuucuuuu

SEQ ID NO: 3230721 - RNA, 21 nt, Mycobacterium leprae
ccugcacuucagggauaagcu

SEQ ID NO: 3230722 - RNA, 13 nt, Mycobacterium leprae
ccugcagucuuug

SEQ ID NO: 3230723 - RNA, 15 nt, Mycobacterium leprae
ccugccccgguggcu

SEQ ID NO: 3230724 - RNA, 22 nt, Mycobacterium leprae
ccugccgacaguuuaccgugcc

SEQ ID NO: 3230725 - RNA, 14 nt, Mycobacterium leprae
ccugccgccacagc

SEQ ID NO: 3230726 - RNA, 18 nt, Mycobacterium leprae
ccugccgccacagcaagu

SEQ ID NO: 3230727 - RNA, 19 nt, Mycobacterium leprae
ccugccggugcggucccau

SEQ ID NO: 3230728 - RNA, 14 nt, Mycobacterium leprae
ccugcgacagccgu

SEQ ID NO: 3230729 - RNA, 20 nt, Mycobacterium leprae
ccugcgacaucucggucagg

SEQ ID NO: 3230730 - RNA, 22 nt, Mycobacterium leprae
ccugcgagaucggguugacgcu

SEQ ID NO: 3230731 - RNA, 24 nt, Mycobacterium leprae
ccugcgagaucggguugacgcugc

SEQ ID NO: 3230732 - RNA, 21 nt, Mycobacterium leprae
ccugcguccacgucgcccaac

SEQ ID NO: 3230733 - RNA, 18 nt, Mycobacterium leprae
ccugcucauggcaccggc

SEQ ID NO: 3230734 - RNA, 22 nt, Mycobacterium leprae
ccugcuguaauauauguuccua

SEQ ID NO: 3230735 - RNA, 20 nt, Mycobacterium leprae
ccugcuuguuaucgaagcuu

SEQ ID NO: 3230736 - RNA, 14 nt, Mycobacterium leprae
ccuggaauccgcgc

SEQ ID NO: 3230737 - RNA, 16 nt, Mycobacterium leprae
ccuggacccaccuuga

SEQ ID NO: 3230738 - RNA, 13 nt, Mycobacterium leprae
ccuggaccgcagc

SEQ ID NO: 3230739 - RNA, 22 nt, Mycobacterium leprae
ccuggaugugugcacucgcauc

SEQ ID NO: 3230740 - RNA, 22 nt, Mycobacterium leprae
ccuggccaguuuuuaggcacgc

SEQ ID NO: 3230741 - RNA, 22 nt, Mycobacterium leprae
ccuggcgauuuucuugccgucg

SEQ ID NO: 3230742 - RNA, 20 nt, Mycobacterium leprae
ccuggcucaggacgaacgcu

SEQ ID NO: 3230743 - RNA, 15 nt, Mycobacterium leprae
ccuggcugggcugcu

SEQ ID NO: 3230744 - RNA, 20 nt, Mycobacterium leprae
ccugggccagcgaucuaccu

SEQ ID NO: 3230745 - RNA, 20 nt, Mycobacterium leprae
ccugggugaaucgccuaaag

SEQ ID NO: 3230746 - RNA, 21 nt, Mycobacterium leprae
ccuggguguucauggcgcgcu

SEQ ID NO: 3230747 - RNA, 23 nt, Mycobacterium leprae
ccugguagcaucccgaagugauc

SEQ ID NO: 3230748 - RNA, 13 nt, Mycobacterium leprae
ccugguagguguc

SEQ ID NO: 3230749 - RNA, 15 nt, Mycobacterium leprae
ccuggucauggcuuc

SEQ ID NO: 3230750 - RNA, 17 nt, Mycobacterium leprae
ccuggucgagcagcucc

SEQ ID NO: 3230751 - RNA, 15 nt, Mycobacterium leprae
ccuggucuccucgcu

SEQ ID NO: 3230752 - RNA, 13 nt, Mycobacterium leprae
ccuggugacgucg

SEQ ID NO: 3230753 - RNA, 19 nt, Mycobacterium leprae
ccuggugcccgacagccac

SEQ ID NO: 3230754 - RNA, 19 nt, Mycobacterium leprae
ccuggugugcgcgccgccc

SEQ ID NO: 3230755 - RNA, 14 nt, Mycobacterium leprae
ccugucuaucacau

SEQ ID NO: 3230756 - RNA, 23 nt, Mycobacterium leprae
ccugucuaucacauccgauuugu

SEQ ID NO: 3230757 - RNA, 24 nt, Mycobacterium leprae
ccugugcaggucgagcgauggcug

SEQ ID NO: 3230758 - RNA, 17 nt, Mycobacterium leprae
ccugugcguaaggaaga

SEQ ID NO: 3230759 - RNA, 19 nt, Mycobacterium leprae
ccugugcuguuggggauau

SEQ ID NO: 3230760 - RNA, 17 nt, Mycobacterium leprae
ccugugggucaccacug

SEQ ID NO: 3230761 - RNA, 17 nt, Mycobacterium leprae
ccuguuauauagugcgc

SEQ ID NO: 3230762 - RNA, 18 nt, Mycobacterium leprae
ccuguuauauagugcgcu

SEQ ID NO: 3230763 - RNA, 13 nt, Mycobacterium leprae
ccuguugauuuuu

SEQ ID NO: 3230764 - RNA, 13 nt, Mycobacterium leprae
ccuguugcggcca

SEQ ID NO: 3230765 - RNA, 10 nt, Mycobacterium leprae
ccuguuggac

SEQ ID NO: 3230766 - RNA, 21 nt, Mycobacterium leprae
ccuguuuuuggaccccaacca

SEQ ID NO: 3230767 - RNA, 21 nt, Mycobacterium leprae
ccuuacaaugugucaaaaggc

SEQ ID NO: 3230768 - RNA, 22 nt, Mycobacterium leprae
ccuucaaaaagguguucaacga

SEQ ID NO: 3230769 - RNA, 22 nt, Mycobacterium leprae
ccuucaugcuggccuccaguuu

SEQ ID NO: 3230770 - RNA, 15 nt, Mycobacterium leprae
ccuuccggcggucac

SEQ ID NO: 3230771 - RNA, 13 nt, Mycobacterium leprae
ccuucgucagcug

SEQ ID NO: 3230772 - RNA, 19 nt, Mycobacterium leprae
ccuucuaugacaacgguga

SEQ ID NO: 3230773 - RNA, 17 nt, Mycobacterium leprae
ccuugaccucaucccac

SEQ ID NO: 3230774 - RNA, 16 nt, Mycobacterium leprae
ccuugaggugucggcg

SEQ ID NO: 3230775 - RNA, 18 nt, Mycobacterium leprae
ccuugaugagaucacuga

SEQ ID NO: 3230776 - RNA, 23 nt, Mycobacterium leprae
ccuugcaaaacgucgaucucgac

SEQ ID NO: 3230777 - RNA, 14 nt, Mycobacterium leprae
ccuugccgcuccgc

SEQ ID NO: 3230778 - RNA, 18 nt, Mycobacterium leprae
ccuugcggcgccccucug

SEQ ID NO: 3230779 - RNA, 19 nt, Mycobacterium leprae
ccuuggaaccaucaacggc

SEQ ID NO: 3230780 - RNA, 11 nt, Mycobacterium leprae
ccuuggguggu

SEQ ID NO: 3230781 - RNA, 18 nt, Mycobacterium leprae
ccuuggugcgggcacaca

SEQ ID NO: 3230782 - RNA, 21 nt, Mycobacterium leprae
ccuuggugcuuaacgccgccu

SEQ ID NO: 3230783 - RNA, 14 nt, Mycobacterium leprae
ccuugguguugcug

SEQ ID NO: 3230784 - RNA, 16 nt, Mycobacterium leprae
ccuuucacgccaggcg

SEQ ID NO: 3230785 - RNA, 14 nt, Mycobacterium leprae
ccuuuuccauugga

SEQ ID NO: 3230786 - RNA, 13 nt, Mycobacterium leprae
cgaaaaaugaguu

SEQ ID NO: 3230787 - RNA, 18 nt, Mycobacterium leprae
cgaaaacauucaggaugc

SEQ ID NO: 3230788 - RNA, 13 nt, Mycobacterium leprae
cgaaaaccucacg

SEQ ID NO: 3230789 - RNA, 13 nt, Mycobacterium leprae
cgaaaccaagcca

SEQ ID NO: 3230790 - RNA, 23 nt, Mycobacterium leprae
cgaaaccacauaugccgccaugu

SEQ ID NO: 3230791 - RNA, 16 nt, Mycobacterium leprae
cgaaaccauggucuua

SEQ ID NO: 3230792 - RNA, 15 nt, Mycobacterium leprae
cgaaacgucaucgac

SEQ ID NO: 3230793 - RNA, 16 nt, Mycobacterium leprae
cgaaacgucaucgaca

SEQ ID NO: 3230794 - RNA, 14 nt, Mycobacterium leprae
cgaaacuaaauccg

SEQ ID NO: 3230795 - RNA, 19 nt, Mycobacterium leprae
cgaaagccgcaccaggucg

SEQ ID NO: 3230796 - RNA, 15 nt, Mycobacterium leprae
cgaaaggguagccgu

SEQ ID NO: 3230797 - RNA, 14 nt, Mycobacterium leprae
cgaaaugaacguca

SEQ ID NO: 3230798 - RNA, 12 nt, Mycobacterium leprae
cgaaauggcgcc

SEQ ID NO: 3230799 - RNA, 21 nt, Mycobacterium leprae
cgaacaggccguuguuggagc

SEQ ID NO: 3230800 - RNA, 21 nt, Mycobacterium leprae
cgaacaucccugggccggcac

SEQ ID NO: 3230801 - RNA, 23 nt, Mycobacterium leprae
cgaacaugacggucgcacgaccu

SEQ ID NO: 3230802 - RNA, 19 nt, Mycobacterium leprae
cgaacccagacgcgaccgc

SEQ ID NO: 3230803 - RNA, 22 nt, Mycobacterium leprae
cgaacccagacgcgaccgccac

SEQ ID NO: 3230804 - RNA, 11 nt, Mycobacterium leprae
cgaacccucac

SEQ ID NO: 3230805 - RNA, 15 nt, Mycobacterium leprae
cgaaccgauccagca

SEQ ID NO: 3230806 - RNA, 17 nt, Mycobacterium leprae
cgaaccgauccagcauu

SEQ ID NO: 3230807 - RNA, 16 nt, Mycobacterium leprae
cgaaccuccaccacuc

SEQ ID NO: 3230808 - RNA, 16 nt, Mycobacterium leprae
cgagacuccacgugcg

SEQ ID NO: 3230809 - RNA, 17 nt, Mycobacterium leprae
cgagaucaacguuuugc

SEQ ID NO: 3230810 - RNA, 23 nt, Mycobacterium leprae
cgagaucaacguuuugccgagca

SEQ ID NO: 3230811 - RNA, 14 nt, Mycobacterium leprae
cgagaucauccgca

SEQ ID NO: 3230812 - RNA, 15 nt, Mycobacterium leprae
cgagaucgccacucg

SEQ ID NO: 3230813 - RNA, 22 nt, Mycobacterium leprae
cgagaucucaacggggucgucg

SEQ ID NO: 3230814 - RNA, 20 nt, Mycobacterium leprae
cgagauugacgucggugugg

SEQ ID NO: 3230815 - RNA, 20 nt, Mycobacterium leprae
cgagcaaauugccgagcugg

SEQ ID NO: 3230816 - RNA, 18 nt, Mycobacterium leprae
cgagcaaccuuggucugc

SEQ ID NO: 3230817 - RNA, 22 nt, Mycobacterium leprae
cgagcacuagcuugugcuccug

SEQ ID NO: 3230818 - RNA, 12 nt, Mycobacterium leprae
cgagcagcucca

SEQ ID NO: 3230819 - RNA, 14 nt, Mycobacterium leprae
cgagcaucuggccg

SEQ ID NO: 3230820 - RNA, 20 nt, Mycobacterium leprae
cgagcccagugugucggcgu

SEQ ID NO: 3230821 - RNA, 14 nt, Mycobacterium leprae
cgagccgcaggucu

SEQ ID NO: 3230822 - RNA, 16 nt, Mycobacterium leprae
cgagcgauugugcgga

SEQ ID NO: 3230823 - RNA, 19 nt, Mycobacterium leprae
cgagcgcaucggcggcgga

SEQ ID NO: 3230824 - RNA, 13 nt, Mycobacterium leprae
cgagcgccccguu

SEQ ID NO: 3230825 - RNA, 15 nt, Mycobacterium leprae
cgagcgcccgcacag

SEQ ID NO: 3230826 - RNA, 16 nt, Mycobacterium leprae
cgagcggaccauggcg

SEQ ID NO: 3230827 - RNA, 19 nt, Mycobacterium leprae
cgagcggccucagcagcag

SEQ ID NO: 3230828 - RNA, 18 nt, Mycobacterium leprae
cgagcguacuggugauaa

SEQ ID NO: 3230829 - RNA, 15 nt, Mycobacterium leprae
cgagcuaaacagcaa

SEQ ID NO: 3230830 - RNA, 13 nt, Mycobacterium leprae
cgagcucggccua

SEQ ID NO: 3230831 - RNA, 23 nt, Mycobacterium leprae
cgagcucugagagugcagagagu

SEQ ID NO: 3230832 - RNA, 15 nt, Mycobacterium leprae
cgagcucuggucugg

SEQ ID NO: 3230833 - RNA, 16 nt, Mycobacterium leprae
cgagcugaacaggcgc

SEQ ID NO: 3230834 - RNA, 22 nt, Mycobacterium leprae
cgaggaagcgcagcucgccaag

SEQ ID NO: 3230835 - RNA, 22 nt, Mycobacterium leprae
cgaggaagcucgguucggugac

SEQ ID NO: 3230836 - RNA, 16 nt, Mycobacterium leprae
cgaggaaugccugggu

SEQ ID NO: 3230837 - RNA, 12 nt, Mycobacterium leprae
cgaggaccgcca

SEQ ID NO: 3230838 - RNA, 15 nt, Mycobacterium leprae
cgaggaccgccaugc

SEQ ID NO: 3230839 - RNA, 18 nt, Mycobacterium leprae
cgaggagaggcagggcug

SEQ ID NO: 3230840 - RNA, 16 nt, Mycobacterium leprae
cgaggauuaucgccgg

SEQ ID NO: 3230841 - RNA, 18 nt, Mycobacterium leprae
cgaggccuuggguggugg

SEQ ID NO: 3230842 - RNA, 20 nt, Mycobacterium leprae
cgaggcgcuaggacaacaga

SEQ ID NO: 3230843 - RNA, 23 nt, Mycobacterium leprae
cgaggcgcuaggacaacagagca

SEQ ID NO: 3230844 - RNA, 13 nt, Mycobacterium leprae
cgaggcucugcuc

SEQ ID NO: 3230845 - RNA, 17 nt, Mycobacterium leprae
cgaggcucugcucggcu

SEQ ID NO: 3230846 - RNA, 16 nt, Mycobacterium leprae
cgagguaaccaaaacc

SEQ ID NO: 3230847 - RNA, 12 nt, Mycobacterium leprae
cgaggucuuggu

SEQ ID NO: 3230848 - RNA, 17 nt, Mycobacterium leprae
cgagguggcagcugggu

SEQ ID NO: 3230849 - RNA, 19 nt, Mycobacterium leprae
cgaggugucggcgauaacg

SEQ ID NO: 3230850 - RNA, 17 nt, Mycobacterium leprae
cgagguucccggcggcc

SEQ ID NO: 3230851 - RNA, 15 nt, Mycobacterium leprae
cgaguaaugcaggug

SEQ ID NO: 3230852 - RNA, 17 nt, Mycobacterium leprae
cgaguaaugcaggugac

SEQ ID NO: 3230853 - RNA, 20 nt, Mycobacterium leprae
cgaguacguccgcgccggcg

SEQ ID NO: 3230854 - RNA, 15 nt, Mycobacterium leprae
cgaguacugccgacg

SEQ ID NO: 3230855 - RNA, 20 nt, Mycobacterium leprae
cgaguccgcuaaggcagccc

SEQ ID NO: 3230856 - RNA, 18 nt, Mycobacterium leprae
cgagugguacaacaguug

SEQ ID NO: 3230857 - RNA, 13 nt, Mycobacterium leprae
cgaguuggccucc

SEQ ID NO: 3230858 - RNA, 22 nt, Mycobacterium leprae
cgaguuguggcggccgaccaac

SEQ ID NO: 3230859 - RNA, 23 nt, Mycobacterium leprae
cgauaacucauaguguucgcauu

SEQ ID NO: 3230860 - RNA, 18 nt, Mycobacterium leprae
cgauaauuaugaguggua

SEQ ID NO: 3230861 - RNA, 13 nt, Mycobacterium leprae
cgauacgcaaauc

SEQ ID NO: 3230862 - RNA, 15 nt, Mycobacterium leprae
cgauacugcugcacc

SEQ ID NO: 3230863 - RNA, 16 nt, Mycobacterium leprae
cgauagaaaucacgga

SEQ ID NO: 3230864 - RNA, 18 nt, Mycobacterium leprae
cgauagaccgcuacaacc

SEQ ID NO: 3230865 - RNA, 14 nt, Mycobacterium leprae
cgauagcugccagc

SEQ ID NO: 3230866 - RNA, 23 nt, Mycobacterium leprae
cgauagguauacuacacccgauc

SEQ ID NO: 3230867 - RNA, 19 nt, Mycobacterium leprae
cgauaucgaccagccaagc

SEQ ID NO: 3230868 - RNA, 16 nt, Mycobacterium leprae
cgauaucgaugcaggc

SEQ ID NO: 3230869 - RNA, 17 nt, Mycobacterium leprae
cgauaucgaugcaggcg

SEQ ID NO: 3230870 - RNA, 23 nt, Mycobacterium leprae
cgauaucgcuaaggcugcugacu

SEQ ID NO: 3230871 - RNA, 17 nt, Mycobacterium leprae
cgauaugagcuccacug

SEQ ID NO: 3230872 - RNA, 17 nt, Mycobacterium leprae
cgauauucgccggacac

SEQ ID NO: 3230873 - RNA, 17 nt, Mycobacterium leprae
cgaucaacuggucgagu

SEQ ID NO: 3230874 - RNA, 14 nt, Mycobacterium leprae
cgaucagacccuug

SEQ ID NO: 3230875 - RNA, 17 nt, Mycobacterium leprae
cgaucagcaacacuggc

SEQ ID NO: 3230876 - RNA, 20 nt, Mycobacterium leprae
cgaucagcaggaaucccagc

SEQ ID NO: 3230877 - RNA, 15 nt, Mycobacterium leprae
cgaucauggcuggac

SEQ ID NO: 3230878 - RNA, 18 nt, Mycobacterium leprae
cgaucauggugguguuca

SEQ ID NO: 3230879 - RNA, 14 nt, Mycobacterium leprae
cgauccacuugacg

SEQ ID NO: 3230880 - RNA, 13 nt, Mycobacterium leprae
cgauccagcauuc

SEQ ID NO: 3230881 - RNA, 19 nt, Mycobacterium leprae
cgauccagugccggaaccc

SEQ ID NO: 3230882 - RNA, 17 nt, Mycobacterium leprae
cgaucccaggaucccug

SEQ ID NO: 3230883 - RNA, 17 nt, Mycobacterium leprae
cgaucccaucggcugca

SEQ ID NO: 3230884 - RNA, 21 nt, Mycobacterium leprae
cgaucccgguuacguccgcgg

SEQ ID NO: 3230885 - RNA, 21 nt, Mycobacterium leprae
cgauccgcgugaugauggccu

SEQ ID NO: 3230886 - RNA, 16 nt, Mycobacterium leprae
cgauccggcggccggc

SEQ ID NO: 3230887 - RNA, 13 nt, Mycobacterium leprae
cgauccgucguag

SEQ ID NO: 3230888 - RNA, 15 nt, Mycobacterium leprae
cgauccgugaauaca

SEQ ID NO: 3230889 - RNA, 22 nt, Mycobacterium leprae
cgauccuuguugccgaaaucgu

SEQ ID NO: 3230890 - RNA, 20 nt, Mycobacterium leprae
cgaucgagguuuaacgaucc

SEQ ID NO: 3230891 - RNA, 16 nt, Mycobacterium leprae
cgaucgcaaauauaau

SEQ ID NO: 3230892 - RNA, 21 nt, Mycobacterium leprae
cgaucgcaaauauaauccggc

SEQ ID NO: 3230893 - RNA, 17 nt, Mycobacterium leprae
cgaucgcaccggcugca

SEQ ID NO: 3230894 - RNA, 14 nt, Mycobacterium leprae
cgaucgcacucacc

SEQ ID NO: 3230895 - RNA, 14 nt, Mycobacterium leprae
cgaucgcagcccag

SEQ ID NO: 3230896 - RNA, 18 nt, Mycobacterium leprae
cgaucgcagccgcaaggu

SEQ ID NO: 3230897 - RNA, 15 nt, Mycobacterium leprae
cgaucgcagucauca

SEQ ID NO: 3230898 - RNA, 15 nt, Mycobacterium leprae
cgaucggcagccacg

SEQ ID NO: 3230899 - RNA, 23 nt, Mycobacterium leprae
cgaucguucuuacccgagcugac

SEQ ID NO: 3230900 - RNA, 14 nt, Mycobacterium leprae
cgaucucgacggca

SEQ ID NO: 3230901 - RNA, 20 nt, Mycobacterium leprae
cgaucucggcgcgcucucug

SEQ ID NO: 3230902 - RNA, 12 nt, Mycobacterium leprae
cgaucugcccag

SEQ ID NO: 3230903 - RNA, 20 nt, Mycobacterium leprae
cgaucugcccagcauuaucc

SEQ ID NO: 3230904 - RNA, 14 nt, Mycobacterium leprae
cgaucuggauggcc

SEQ ID NO: 3230905 - RNA, 19 nt, Mycobacterium leprae
cgaucuggauggccgccag

SEQ ID NO: 3230906 - RNA, 20 nt, Mycobacterium leprae
cgaucuggauggccgccagc

SEQ ID NO: 3230907 - RNA, 19 nt, Mycobacterium leprae
cgaucuggggaaugucgau

SEQ ID NO: 3230908 - RNA, 15 nt, Mycobacterium leprae
cgaucuuccaccauu

SEQ ID NO: 3230909 - RNA, 14 nt, Mycobacterium leprae
cgaugaaauccgca

SEQ ID NO: 3230910 - RNA, 22 nt, Mycobacterium leprae
cgaugacauggaagccgccgug

SEQ ID NO: 3230911 - RNA, 18 nt, Mycobacterium leprae
cgaugaggcuucgugugc

SEQ ID NO: 3230912 - RNA, 21 nt, Mycobacterium leprae
cgaugauccggccgucggcgg

SEQ ID NO: 3230913 - RNA, 20 nt, Mycobacterium leprae
cgaugaucuaaccgacgaaa

SEQ ID NO: 3230914 - RNA, 23 nt, Mycobacterium leprae
cgaugauggccgaccuaccgcau

SEQ ID NO: 3230915 - RNA, 22 nt, Mycobacterium leprae
cgaugcacuguucacuaacacg

SEQ ID NO: 3230916 - RNA, 18 nt, Mycobacterium leprae
cgaugccaucgggccaga

SEQ ID NO: 3230917 - RNA, 20 nt, Mycobacterium leprae
cgaugccccaucucaucuug

SEQ ID NO: 3230918 - RNA, 14 nt, Mycobacterium leprae
cgaugccgugguga

SEQ ID NO: 3230919 - RNA, 19 nt, Mycobacterium leprae
cgaugcgagugugaaaaag

SEQ ID NO: 3230920 - RNA, 21 nt, Mycobacterium leprae
cgaugcgcaccucgcugcagc

SEQ ID NO: 3230921 - RNA, 15 nt, Mycobacterium leprae
cgccacucgucacau

SEQ ID NO: 3230922 - RNA, 13 nt, Mycobacterium leprae
cgccagaccggcg

SEQ ID NO: 3230923 - RNA, 18 nt, Mycobacterium leprae
cgccagacuggccggugg

SEQ ID NO: 3230924 - RNA, 20 nt, Mycobacterium leprae
cgccagacuggccgguggau

SEQ ID NO: 3230925 - RNA, 19 nt, Mycobacterium leprae
cgccagccuuucacgccag

SEQ ID NO: 3230926 - RNA, 22 nt, Mycobacterium leprae
cgccaggcgguaggaaucaccg

SEQ ID NO: 3230927 - RNA, 16 nt, Mycobacterium leprae
cgccaggggaaccauc

SEQ ID NO: 3230928 - RNA, 13 nt, Mycobacterium leprae
cgccaggucagcg

SEQ ID NO: 3230929 - RNA, 16 nt, Mycobacterium leprae
cgccaggucagcgauu

SEQ ID NO: 3230930 - RNA, 14 nt, Mycobacterium leprae
cgccagguuccccg

SEQ ID NO: 3230931 - RNA, 13 nt, Mycobacterium leprae
cgccauagccgau

SEQ ID NO: 3230932 - RNA, 17 nt, Mycobacterium leprae
cgccauagccgaucucc

SEQ ID NO: 3230933 - RNA, 22 nt, Mycobacterium leprae
cgccauauacaaaccccagacc

SEQ ID NO: 3230934 - RNA, 15 nt, Mycobacterium leprae
cgccauauccucgac

SEQ ID NO: 3230935 - RNA, 16 nt, Mycobacterium leprae
cgccaucgaauccucg

SEQ ID NO: 3230936 - RNA, 13 nt, Mycobacterium leprae
cgccauugccccc

SEQ ID NO: 3230937 - RNA, 13 nt, Mycobacterium leprae
cgcccaacacaag

SEQ ID NO: 3230938 - RNA, 15 nt, Mycobacterium leprae
cgcccaagcgaagcc

SEQ ID NO: 3230939 - RNA, 18 nt, Mycobacterium leprae
cgcccaagugaugucuuu

SEQ ID NO: 3230940 - RNA, 19 nt, Mycobacterium leprae
cgcccaauggugcggcgau

SEQ ID NO: 3230941 - RNA, 18 nt, Mycobacterium leprae
cgcccaccgcaacgccuc

SEQ ID NO: 3230942 - RNA, 19 nt, Mycobacterium leprae
cgccccuaccccgcggcgc

SEQ ID NO: 3230943 - RNA, 19 nt, Mycobacterium leprae
cgcccgcuggaucggugcu

SEQ ID NO: 3230944 - RNA, 12 nt, Mycobacterium leprae
cgcccggccugc

SEQ ID NO: 3230945 - RNA, 16 nt, Mycobacterium leprae
cgcccgggaaggacgc

SEQ ID NO: 3230946 - RNA, 21 nt, Mycobacterium leprae
cgcccgggaaggacgcaucca

SEQ ID NO: 3230947 - RNA, 14 nt, Mycobacterium leprae
cgcccggucugcgu

SEQ ID NO: 3230948 - RNA, 14 nt, Mycobacterium leprae
cgcccuagacggga

SEQ ID NO: 3230949 - RNA, 21 nt, Mycobacterium leprae
cgcccuccuggcgaguggcua

SEQ ID NO: 3230950 - RNA, 23 nt, Mycobacterium leprae
cgcccuguguucggucugcggug

SEQ ID NO: 3230951 - RNA, 15 nt, Mycobacterium leprae
cgccgaaaucgacgu

SEQ ID NO: 3230952 - RNA, 18 nt, Mycobacterium leprae
cgccgacauuugggauuc

SEQ ID NO: 3230953 - RNA, 16 nt, Mycobacterium leprae
cgccgaccucggcgcu

SEQ ID NO: 3230954 - RNA, 18 nt, Mycobacterium leprae
cgccgaccucggcgcugg

SEQ ID NO: 3230955 - RNA, 21 nt, Mycobacterium leprae
cgccgaccucggcgcuggggc

SEQ ID NO: 3230956 - RNA, 17 nt, Mycobacterium leprae
cgccgacgaugcgugcc

SEQ ID NO: 3230957 - RNA, 19 nt, Mycobacterium leprae
cgccgagaggaugucgaga

SEQ ID NO: 3230958 - RNA, 21 nt, Mycobacterium leprae
cgccgaguucacugaggaucc

SEQ ID NO: 3230959 - RNA, 14 nt, Mycobacterium leprae
cgccgauaucgacc

SEQ ID NO: 3230960 - RNA, 16 nt, Mycobacterium leprae
cgccgauaucgaccag

SEQ ID NO: 3230961 - RNA, 18 nt, Mycobacterium leprae
cgccgauaucgaccagcc

SEQ ID NO: 3230962 - RNA, 19 nt, Mycobacterium leprae
cgccgaucccaucggcugc

SEQ ID NO: 3230963 - RNA, 12 nt, Mycobacterium leprae
cgccgaucggua

SEQ ID NO: 3230964 - RNA, 17 nt, Mycobacterium leprae
cgccgcccucucacggc

SEQ ID NO: 3230965 - RNA, 14 nt, Mycobacterium leprae
cgccgccguugcca

SEQ ID NO: 3230966 - RNA, 22 nt, Mycobacterium leprae
cgccgccuuuacgaagccgcca

SEQ ID NO: 3230967 - RNA, 15 nt, Mycobacterium leprae
cgccgcgaacacggc

SEQ ID NO: 3230968 - RNA, 19 nt, Mycobacterium leprae
cgccgcgaacacggcaacg

SEQ ID NO: 3230969 - RNA, 17 nt, Mycobacterium leprae
cgccgcgcaucaucgcc

SEQ ID NO: 3230970 - RNA, 12 nt, Mycobacterium leprae
cgccgcgcuaau

SEQ ID NO: 3230971 - RNA, 12 nt, Mycobacterium leprae
cgccgcggcggg

SEQ ID NO: 3230972 - RNA, 17 nt, Mycobacterium leprae
cgccgcugcuuccucga

SEQ ID NO: 3230973 - RNA, 21 nt, Mycobacterium leprae
cgccggagcgaagcacccgga

SEQ ID NO: 3230974 - RNA, 14 nt, Mycobacterium leprae
cgccggcaagcccg

SEQ ID NO: 3230975 - RNA, 18 nt, Mycobacterium leprae
cgccggcgcgcaggcugc

SEQ ID NO: 3230976 - RNA, 15 nt, Mycobacterium leprae
cgccgggacgcguca

SEQ ID NO: 3230977 - RNA, 17 nt, Mycobacterium leprae
cgccgggguguggcacg

SEQ ID NO: 3230978 - RNA, 12 nt, Mycobacterium leprae
cgccgguggcaa

SEQ ID NO: 3230979 - RNA, 14 nt, Mycobacterium leprae
cgccguccacugca

SEQ ID NO: 3230980 - RNA, 20 nt, Mycobacterium leprae
cgccguccacugcagggcga

SEQ ID NO: 3230981 - RNA, 21 nt, Mycobacterium leprae
cgccguccacugcagggcgag

SEQ ID NO: 3230982 - RNA, 14 nt, Mycobacterium leprae
cgccgucuccgccg

SEQ ID NO: 3230983 - RNA, 19 nt, Mycobacterium leprae
cgccguuaguuucgggccu

SEQ ID NO: 3230984 - RNA, 13 nt, Mycobacterium leprae
cgccguucgucga

SEQ ID NO: 3230985 - RNA, 16 nt, Mycobacterium leprae
cgccguucucccgcca

SEQ ID NO: 3230986 - RNA, 17 nt, Mycobacterium leprae
cgccuaaucuagccucg

SEQ ID NO: 3230987 - RNA, 17 nt, Mycobacterium leprae
cgccuagagagugcggu

SEQ ID NO: 3230988 - RNA, 19 nt, Mycobacterium leprae
cgccucgaucagcaacacu

SEQ ID NO: 3230989 - RNA, 14 nt, Mycobacterium leprae
cgccucgucggcca

SEQ ID NO: 3230990 - RNA, 20 nt, Mycobacterium leprae
cgccucugccagggguucca

SEQ ID NO: 3230991 - RNA, 23 nt, Mycobacterium leprae
cgccugaacuggaucggucagcc

SEQ ID NO: 3230992 - RNA, 22 nt, Mycobacterium leprae
cgccugcuugaggucgcacagc

SEQ ID NO: 3230993 - RNA, 13 nt, Mycobacterium leprae
cgccuuagccgaa

SEQ ID NO: 3230994 - RNA, 14 nt, Mycobacterium leprae
cgccuugcagcuuc

SEQ ID NO: 3230995 - RNA, 17 nt, Mycobacterium leprae
cgccuugcugccggcga

SEQ ID NO: 3230996 - RNA, 18 nt, Mycobacterium leprae
cgcgaaauaacggaacgg

SEQ ID NO: 3230997 - RNA, 16 nt, Mycobacterium leprae
cgcgacaguaucgacc

SEQ ID NO: 3230998 - RNA, 18 nt, Mycobacterium leprae
cgcgacaguaucgaccag

SEQ ID NO: 3230999 - RNA, 19 nt, Mycobacterium leprae
cgcgacaguaucgaccagc

SEQ ID NO: 3231000 - RNA, 23 nt, Mycobacterium leprae
cgcgacaguaucgaccagccacg

SEQ ID NO: 3231001 - RNA, 21 nt, Mycobacterium leprae
cgcgacauacaaucgcggcac

SEQ ID NO: 3231002 - RNA, 16 nt, Mycobacterium leprae
cgcgacauauucgcua

SEQ ID NO: 3231003 - RNA, 17 nt, Mycobacterium leprae
cgcgaccaacccggcga

SEQ ID NO: 3231004 - RNA, 14 nt, Mycobacterium leprae
cgcgaccgccacca

SEQ ID NO: 3231005 - RNA, 16 nt, Mycobacterium leprae
cgcgaccgccaccaga

SEQ ID NO: 3231006 - RNA, 16 nt, Mycobacterium leprae
cgcgaccuugcggcgc

SEQ ID NO: 3231007 - RNA, 15 nt, Mycobacterium leprae
cgcgacgccaggcgg

SEQ ID NO: 3231008 - RNA, 13 nt, Mycobacterium leprae
cgcgacggccggc

SEQ ID NO: 3231009 - RNA, 23 nt, Mycobacterium leprae
cgcgagcaaauugccgagcuggu

SEQ ID NO: 3231010 - RNA, 17 nt, Mycobacterium leprae
cgcgagcacugacaugc

SEQ ID NO: 3231011 - RNA, 15 nt, Mycobacterium leprae
cgcgagcugaacagg

SEQ ID NO: 3231012 - RNA, 19 nt, Mycobacterium leprae
cgcgauagcuugcaguuau

SEQ ID NO: 3231013 - RNA, 14 nt, Mycobacterium leprae
cgcgauccaucagc

SEQ ID NO: 3231014 - RNA, 17 nt, Mycobacterium leprae
cgcgaucuacgccaucg

SEQ ID NO: 3231015 - RNA, 20 nt, Mycobacterium leprae
cgcgaucuggauggccgcca

SEQ ID NO: 3231016 - RNA, 18 nt, Mycobacterium leprae
cgcgauggcauugcuggu

SEQ ID NO: 3231017 - RNA, 19 nt, Mycobacterium leprae
cgcgauucguauaaugucg

SEQ ID NO: 3231018 - RNA, 21 nt, Mycobacterium leprae
cgcgauucguauaaugucgaa

SEQ ID NO: 3231019 - RNA, 20 nt, Mycobacterium leprae
cgcgauugaaauauacgacg

SEQ ID NO: 3231020 - RNA, 19 nt, Mycobacterium leprae
cgcgcaggcugcgacauuc

SEQ ID NO: 3231021 - RNA, 19 nt, Mycobacterium leprae
cgcgcaucaucgcccaccg

SEQ ID NO: 3231022 - RNA, 19 nt, Mycobacterium leprae
cgcgccaaacacggccagc

SEQ ID NO: 3231023 - RNA, 15 nt, Mycobacterium leprae
cgcgccgcccagcag

SEQ ID NO: 3231024 - RNA, 16 nt, Mycobacterium leprae
cgcgccgccugcugca

SEQ ID NO: 3231025 - RNA, 14 nt, Mycobacterium leprae
cgcgccggcuacug

SEQ ID NO: 3231026 - RNA, 15 nt, Mycobacterium leprae
cgcgccggucgugca

SEQ ID NO: 3231027 - RNA, 22 nt, Mycobacterium leprae
cgcgcgcuaguucgacaccggc

SEQ ID NO: 3231028 - RNA, 22 nt, Mycobacterium leprae
cgcgcgguucuugccaaggucg

SEQ ID NO: 3231029 - RNA, 14 nt, Mycobacterium leprae
cgcgcgucguagcu

SEQ ID NO: 3231030 - RNA, 14 nt, Mycobacterium leprae
cgcgcgugccacca

SEQ ID NO: 3231031 - RNA, 14 nt, Mycobacterium leprae
cgcgcuacggcggu

SEQ ID NO: 3231032 - RNA, 15 nt, Mycobacterium leprae
cgcgcugaaugguca

SEQ ID NO: 3231033 - RNA, 15 nt, Mycobacterium leprae
cgcggaagcccgccc

SEQ ID NO: 3231034 - RNA, 12 nt, Mycobacterium leprae
cgcggacaagac

SEQ ID NO: 3231035 - RNA, 22 nt, Mycobacterium leprae
cggaacccauauucgucaaaaa

SEQ ID NO: 3231036 - RNA, 21 nt, Mycobacterium leprae
cggaacccucugacguuguuu

SEQ ID NO: 3231037 - RNA, 12 nt, Mycobacterium leprae
cggaacgcgcaa

SEQ ID NO: 3231038 - RNA, 19 nt, Mycobacterium leprae
cggaacugcaagguccccc

SEQ ID NO: 3231039 - RNA, 16 nt, Mycobacterium leprae
cggaagcccucccagc

SEQ ID NO: 3231040 - RNA, 19 nt, Mycobacterium leprae
cggaaguaacgucgaaccc

SEQ ID NO: 3231041 - RNA, 21 nt, Mycobacterium leprae
cggaaucgccgcgacgaaccc

SEQ ID NO: 3231042 - RNA, 15 nt, Mycobacterium leprae
cggaauugcauugca

SEQ ID NO: 3231043 - RNA, 21 nt, Mycobacterium leprae
cggacaagaucgaggccagcc

SEQ ID NO: 3231044 - RNA, 14 nt, Mycobacterium leprae
cggaccccauagcg

SEQ ID NO: 3231045 - RNA, 14 nt, Mycobacterium leprae
cggacccguugagc

SEQ ID NO: 3231046 - RNA, 21 nt, Mycobacterium leprae
cggacccguugagcugcaugu

SEQ ID NO: 3231047 - RNA, 13 nt, Mycobacterium leprae
cggaccgugguga

SEQ ID NO: 3231048 - RNA, 12 nt, Mycobacterium leprae
cggaccuggacc

SEQ ID NO: 3231049 - RNA, 19 nt, Mycobacterium leprae
cggacgacgcugagaggcg

SEQ ID NO: 3231050 - RNA, 19 nt, Mycobacterium leprae
cggacgcugaaacgguaaa

SEQ ID NO: 3231051 - RNA, 13 nt, Mycobacterium leprae
cggacggcaccua

SEQ ID NO: 3231052 - RNA, 17 nt, Mycobacterium leprae
cggacggcccagcacca

SEQ ID NO: 3231053 - RNA, 16 nt, Mycobacterium leprae
cggacgucgacaucau

SEQ ID NO: 3231054 - RNA, 18 nt, Mycobacterium leprae
cggacucuccccacugca

SEQ ID NO: 3231055 - RNA, 15 nt, Mycobacterium leprae
cggacugcuagccgg

SEQ ID NO: 3231056 - RNA, 14 nt, Mycobacterium leprae
cggagacggcagcg

SEQ ID NO: 3231057 - RNA, 16 nt, Mycobacterium leprae
cggagaucggcgugca

SEQ ID NO: 3231058 - RNA, 20 nt, Mycobacterium leprae
cggagccaguggcguggccg

SEQ ID NO: 3231059 - RNA, 16 nt, Mycobacterium leprae
cggaggccaaucgcaa

SEQ ID NO: 3231060 - RNA, 18 nt, Mycobacterium leprae
cggaggcugggcaccacc

SEQ ID NO: 3231061 - RNA, 20 nt, Mycobacterium leprae
cggagucaugauccagcugu

SEQ ID NO: 3231062 - RNA, 23 nt, Mycobacterium leprae
cggagucaugauccagcugucag

SEQ ID NO: 3231063 - RNA, 14 nt, Mycobacterium leprae
cggaucggugcaug

SEQ ID NO: 3231064 - RNA, 17 nt, Mycobacterium leprae
cggaucuaugguuuugg

SEQ ID NO: 3231065 - RNA, 12 nt, Mycobacterium leprae
cggaugcccagc

SEQ ID NO: 3231066 - RNA, 14 nt, Mycobacterium leprae
cggauguguugguu

SEQ ID NO: 3231067 - RNA, 19 nt, Mycobacterium leprae
cggauugauggaugcacac

SEQ ID NO: 3231068 - RNA, 21 nt, Mycobacterium leprae
cggauuuaauuacaucggccc

SEQ ID NO: 3231069 - RNA, 23 nt, Mycobacterium leprae
cggauuuaauuacaucggcccac

SEQ ID NO: 3231070 - RNA, 17 nt, Mycobacterium leprae
cggauuuacccccagaa

SEQ ID NO: 3231071 - RNA, 21 nt, Mycobacterium leprae
cggauuucucgugguggcugg

SEQ ID NO: 3231072 - RNA, 20 nt, Mycobacterium leprae
cggauuuugacuccguuugc

SEQ ID NO: 3231073 - RNA, 17 nt, Mycobacterium leprae
cggcaaaaacggaggcc

SEQ ID NO: 3231074 - RNA, 21 nt, Mycobacterium leprae
cggcaaaauuuucuugugagu

SEQ ID NO: 3231075 - RNA, 16 nt, Mycobacterium leprae
cggcaacggcgucuuc

SEQ ID NO: 3231076 - RNA, 18 nt, Mycobacterium leprae
cggcaagcagauucgagc

SEQ ID NO: 3231077 - RNA, 20 nt, Mycobacterium leprae
cggcaagccaguguucccag

SEQ ID NO: 3231078 - RNA, 21 nt, Mycobacterium leprae
cggcaagcgguuguccggcgc

SEQ ID NO: 3231079 - RNA, 22 nt, Mycobacterium leprae
cggcaagcgguuguccggcgcg

SEQ ID NO: 3231080 - RNA, 15 nt, Mycobacterium leprae
cggcaagcugaucac

SEQ ID NO: 3231081 - RNA, 18 nt, Mycobacterium leprae
cggcaauccuugaugcug

SEQ ID NO: 3231082 - RNA, 16 nt, Mycobacterium leprae
cggcaaugucaaagcc

SEQ ID NO: 3231083 - RNA, 21 nt, Mycobacterium leprae
cggcacacccaauugccuggc

SEQ ID NO: 3231084 - RNA, 22 nt, Mycobacterium leprae
cggcacacccaauugccuggcg

SEQ ID NO: 3231085 - RNA, 12 nt, Mycobacterium leprae
cggcacaccgug

SEQ ID NO: 3231086 - RNA, 20 nt, Mycobacterium leprae
cggcacaccguguccgaacg

SEQ ID NO: 3231087 - RNA, 20 nt, Mycobacterium leprae
cggcaccaauguugcccgca

SEQ ID NO: 3231088 - RNA, 21 nt, Mycobacterium leprae
cggcaccgacguauccaaggu

SEQ ID NO: 3231089 - RNA, 14 nt, Mycobacterium leprae
cggcaccgcgaagc

SEQ ID NO: 3231090 - RNA, 16 nt, Mycobacterium leprae
cggcaccuccccgccc

SEQ ID NO: 3231091 - RNA, 20 nt, Mycobacterium leprae
cggcaccuuaccguccaccg

SEQ ID NO: 3231092 - RNA, 19 nt, Mycobacterium leprae
cggcacgccgaacagccgc

SEQ ID NO: 3231093 - RNA, 20 nt, Mycobacterium leprae
cggcacguucgaucggcagc

SEQ ID NO: 3231094 - RNA, 18 nt, Mycobacterium leprae
cggcacuucgcugagcga

SEQ ID NO: 3231095 - RNA, 21 nt, Mycobacterium leprae
cggcacuucgcugagcgaagu

SEQ ID NO: 3231096 - RNA, 23 nt, Mycobacterium leprae
cggcacuucgcugagcgaagucg

SEQ ID NO: 3231097 - RNA, 20 nt, Mycobacterium leprae
cggcagaaauaacagggaug

SEQ ID NO: 3231098 - RNA, 17 nt, Mycobacterium leprae
cggcagaggcaccugga

SEQ ID NO: 3231099 - RNA, 18 nt, Mycobacterium leprae
cggcagaggcaccuggaa

SEQ ID NO: 3231100 - RNA, 15 nt, Mycobacterium leprae
cggcagaucgaucuc

SEQ ID NO: 3231101 - RNA, 18 nt, Mycobacterium leprae
cggcagcauccgccgacg

SEQ ID NO: 3231102 - RNA, 13 nt, Mycobacterium leprae
cggcagcgcuguc

SEQ ID NO: 3231103 - RNA, 14 nt, Mycobacterium leprae
cggcaggccggccu

SEQ ID NO: 3231104 - RNA, 14 nt, Mycobacterium leprae
cggcaggcuguaca

SEQ ID NO: 3231105 - RNA, 20 nt, Mycobacterium leprae
cggcaggcuuagccaacacc

SEQ ID NO: 3231106 - RNA, 20 nt, Mycobacterium leprae
cggcagggcguugccguccc

SEQ ID NO: 3231107 - RNA, 20 nt, Mycobacterium leprae
cggcagguggaucgucggcc

SEQ ID NO: 3231108 - RNA, 20 nt, Mycobacterium leprae
cggcagugagcucaccggcg

SEQ ID NO: 3231109 - RNA, 18 nt, Mycobacterium leprae
cggcauaaucagcgucgg

SEQ ID NO: 3231110 - RNA, 20 nt, Mycobacterium leprae
cggcauccauguacaacacc

SEQ ID NO: 3231111 - RNA, 22 nt, Mycobacterium leprae
cggcauccauguacaacaccag

SEQ ID NO: 3231112 - RNA, 17 nt, Mycobacterium leprae
cggcaucccagugugcu

SEQ ID NO: 3231113 - RNA, 18 nt, Mycobacterium leprae
cggcaugaucgcgaucag

SEQ ID NO: 3231114 - RNA, 22 nt, Mycobacterium leprae
cggcauggccgcuggggcaagu

SEQ ID NO: 3231115 - RNA, 16 nt, Mycobacterium leprae
cggcaugguagugcac

SEQ ID NO: 3231116 - RNA, 16 nt, Mycobacterium leprae
cggcauugccggggcu

SEQ ID NO: 3231117 - RNA, 17 nt, Mycobacterium leprae
cggccacaacgcggccu

SEQ ID NO: 3231118 - RNA, 15 nt, Mycobacterium leprae
cggccacauugacca

SEQ ID NO: 3231119 - RNA, 21 nt, Mycobacterium leprae
cggccacauugaccacgccga

SEQ ID NO: 3231120 - RNA, 17 nt, Mycobacterium leprae
cggccaccauagcaccc

SEQ ID NO: 3231121 - RNA, 13 nt, Mycobacterium leprae
cggccaccggccg

SEQ ID NO: 3231122 - RNA, 14 nt, Mycobacterium leprae
cggccaccggcgcu

SEQ ID NO: 3231123 - RNA, 15 nt, Mycobacterium leprae
cggccaccggcgcuu

SEQ ID NO: 3231124 - RNA, 15 nt, Mycobacterium leprae
cggccacgucgccgu

SEQ ID NO: 3231125 - RNA, 19 nt, Mycobacterium leprae
cggccacuacgacguuguu

SEQ ID NO: 3231126 - RNA, 21 nt, Mycobacterium leprae
cggccacucguagggaccgcu

SEQ ID NO: 3231127 - RNA, 17 nt, Mycobacterium leprae
cggccagauccagcauc

SEQ ID NO: 3231128 - RNA, 16 nt, Mycobacterium leprae
cggccagccguggcuc

SEQ ID NO: 3231129 - RNA, 22 nt, Mycobacterium leprae
cggccagccguggcuccgcgcu

SEQ ID NO: 3231130 - RNA, 14 nt, Mycobacterium leprae
cggccagcgcauca

SEQ ID NO: 3231131 - RNA, 18 nt, Mycobacterium leprae
cggccaggugugccugga

SEQ ID NO: 3231132 - RNA, 18 nt, Mycobacterium leprae
cggcccaacccggccgau

SEQ ID NO: 3231133 - RNA, 13 nt, Mycobacterium leprae
cggcccagcacca

SEQ ID NO: 3231134 - RNA, 22 nt, Mycobacterium leprae
cggccccgcaucuucgcccagc

SEQ ID NO: 3231135 - RNA, 13 nt, Mycobacterium leprae
cggccccggaugc

SEQ ID NO: 3231136 - RNA, 13 nt, Mycobacterium leprae
cggcccgaauuca

SEQ ID NO: 3231137 - RNA, 23 nt, Mycobacterium leprae
cggcccgaauucaucgaauaccu

SEQ ID NO: 3231138 - RNA, 20 nt, Mycobacterium leprae
cggccgaugauggugccgau

SEQ ID NO: 3231139 - RNA, 17 nt, Mycobacterium leprae
cggccgcacagccagca

SEQ ID NO: 3231140 - RNA, 15 nt, Mycobacterium leprae
cggccgccaggucca

SEQ ID NO: 3231141 - RNA, 21 nt, Mycobacterium leprae
cggccgcggcgaccuggucga

SEQ ID NO: 3231142 - RNA, 14 nt, Mycobacterium leprae
cggccgcgguggcg

SEQ ID NO: 3231143 - RNA, 21 nt, Mycobacterium leprae
cggccggagauguaguccuca

SEQ ID NO: 3231144 - RNA, 14 nt, Mycobacterium leprae
cggccggcacugag

SEQ ID NO: 3231145 - RNA, 19 nt, Mycobacterium leprae
cggccggcgucgcgucauc

SEQ ID NO: 3231146 - RNA, 19 nt, Mycobacterium leprae
cggccggcucgcauccgca

SEQ ID NO: 3231147 - RNA, 13 nt, Mycobacterium leprae
cgggcuuggccgg

SEQ ID NO: 3231148 - RNA, 21 nt, Mycobacterium leprae
cgggcuuggccggaacagcau

SEQ ID NO: 3231149 - RNA, 18 nt, Mycobacterium leprae
cggggauaggagcccacu

SEQ ID NO: 3231150 - RNA, 20 nt, Mycobacterium leprae
cggggaucaugugucaccug

SEQ ID NO: 3231151 - RNA, 18 nt, Mycobacterium leprae
cggggaugguuuccaggg

SEQ ID NO: 3231152 - RNA, 21 nt, Mycobacterium leprae
cggggaugguuuccagggcga

SEQ ID NO: 3231153 - RNA, 18 nt, Mycobacterium leprae
cggggauguuggcgccug

SEQ ID NO: 3231154 - RNA, 19 nt, Mycobacterium leprae
cggggauguuggcgccugc

SEQ ID NO: 3231155 - RNA, 21 nt, Mycobacterium leprae
cggggcaggccugaucuccaa

SEQ ID NO: 3231156 - RNA, 14 nt, Mycobacterium leprae
cggggcggcaccuu

SEQ ID NO: 3231157 - RNA, 16 nt, Mycobacterium leprae
cggggcgguggcagcg

SEQ ID NO: 3231158 - RNA, 20 nt, Mycobacterium leprae
cgggguacaauaaacuggcg

SEQ ID NO: 3231159 - RNA, 17 nt, Mycobacterium leprae
cggggugggcagccugg

SEQ ID NO: 3231160 - RNA, 22 nt, Mycobacterium leprae
cggggugucaacagcggacgua

SEQ ID NO: 3231161 - RNA, 14 nt, Mycobacterium leprae
cgggguguggcacg

SEQ ID NO: 3231162 - RNA, 19 nt, Mycobacterium leprae
cggguaaguucuaccgacu

SEQ ID NO: 3231163 - RNA, 22 nt, Mycobacterium leprae
cggguaccccauucagcggcga

SEQ ID NO: 3231164 - RNA, 20 nt, Mycobacterium leprae
cgggucagaguuucaugcua

SEQ ID NO: 3231165 - RNA, 18 nt, Mycobacterium leprae
cgggucgagcagccaccc

SEQ ID NO: 3231166 - RNA, 21 nt, Mycobacterium leprae
cgggucgagcagccacccgca

SEQ ID NO: 3231167 - RNA, 21 nt, Mycobacterium leprae
cgggucuggauaacggggcua

SEQ ID NO: 3231168 - RNA, 21 nt, Mycobacterium leprae
cgggucuuucguuguuuguca

SEQ ID NO: 3231169 - RNA, 20 nt, Mycobacterium leprae
cgggugaugaucacccgcgg

SEQ ID NO: 3231170 - RNA, 16 nt, Mycobacterium leprae
cgggugcgcagcaauu

SEQ ID NO: 3231171 - RNA, 17 nt, Mycobacterium leprae
cgggugcgcugcugacg

SEQ ID NO: 3231172 - RNA, 19 nt, Mycobacterium leprae
cggguggacgaaccggaca

SEQ ID NO: 3231173 - RNA, 22 nt, Mycobacterium leprae
cggguggacgaaccggacagca

SEQ ID NO: 3231174 - RNA, 12 nt, Mycobacterium leprae
cgggugguccgg

SEQ ID NO: 3231175 - RNA, 15 nt, Mycobacterium leprae
cggguugcuuugggg

SEQ ID NO: 3231176 - RNA, 17 nt, Mycobacterium leprae
cggguugggaaccggcg

SEQ ID NO: 3231177 - RNA, 22 nt, Mycobacterium leprae
cgguaacggcgguggcagccgc

SEQ ID NO: 3231178 - RNA, 18 nt, Mycobacterium leprae
cgguaauaguugccuauc

SEQ ID NO: 3231179 - RNA, 20 nt, Mycobacterium leprae
cgguacaaggcuucgccgag

SEQ ID NO: 3231180 - RNA, 20 nt, Mycobacterium leprae
cgguacauuugcggaugacg

SEQ ID NO: 3231181 - RNA, 17 nt, Mycobacterium leprae
cgguacccgccaggauc

SEQ ID NO: 3231182 - RNA, 14 nt, Mycobacterium leprae
cgguacccgugguc

SEQ ID NO: 3231183 - RNA, 17 nt, Mycobacterium leprae
cgguaccguugacaacg

SEQ ID NO: 3231184 - RNA, 15 nt, Mycobacterium leprae
cgguacgcugcauga

SEQ ID NO: 3231185 - RNA, 16 nt, Mycobacterium leprae
cgguacgcugcaugau

SEQ ID NO: 3231186 - RNA, 21 nt, Mycobacterium leprae
cgguagauaucuacugggccg

SEQ ID NO: 3231187 - RNA, 16 nt, Mycobacterium leprae
cgguagccucggcgcu

SEQ ID NO: 3231188 - RNA, 19 nt, Mycobacterium leprae
cgguagcggaccugcgaga

SEQ ID NO: 3231189 - RNA, 18 nt, Mycobacterium leprae
cgguagcguggaccguac

SEQ ID NO: 3231190 - RNA, 19 nt, Mycobacterium leprae
cgguaguuccgcgcugaau

SEQ ID NO: 3231191 - RNA, 16 nt, Mycobacterium leprae
cgguaguuggcuaagg

SEQ ID NO: 3231192 - RNA, 22 nt, Mycobacterium leprae
cgguaucgaugccguggugaug

SEQ ID NO: 3231193 - RNA, 16 nt, Mycobacterium leprae
cgguaucgucaaauuu

SEQ ID NO: 3231194 - RNA, 19 nt, Mycobacterium leprae
cgguaucucaauccguugu

SEQ ID NO: 3231195 - RNA, 16 nt, Mycobacterium leprae
cgguauugacguggug

SEQ ID NO: 3231196 - RNA, 18 nt, Mycobacterium leprae
cgguauugcgucggcuga

SEQ ID NO: 3231197 - RNA, 14 nt, Mycobacterium leprae
cggucaaaggcauc

SEQ ID NO: 3231198 - RNA, 23 nt, Mycobacterium leprae
cggucaaaggcuguccuugccgg

SEQ ID NO: 3231199 - RNA, 12 nt, Mycobacterium leprae
cggucaacaagc

SEQ ID NO: 3231200 - RNA, 18 nt, Mycobacterium leprae
cggucaacaagccgccga

SEQ ID NO: 3231201 - RNA, 20 nt, Mycobacterium leprae
cggucaacaagccgccgaca

SEQ ID NO: 3231202 - RNA, 15 nt, Mycobacterium leprae
cggucaacggccuca

SEQ ID NO: 3231203 - RNA, 20 nt, Mycobacterium leprae
cggucacgggucggcggggu

SEQ ID NO: 3231204 - RNA, 12 nt, Mycobacterium leprae
cggucacuccac

SEQ ID NO: 3231205 - RNA, 17 nt, Mycobacterium leprae
cggucagcucgaaggug

SEQ ID NO: 3231206 - RNA, 15 nt, Mycobacterium leprae
cggucagguauucag

SEQ ID NO: 3231207 - RNA, 15 nt, Mycobacterium leprae
cgguccaggccaccg

SEQ ID NO: 3231208 - RNA, 13 nt, Mycobacterium leprae
cggucccaucgcu

SEQ ID NO: 3231209 - RNA, 14 nt, Mycobacterium leprae
cggucccaucgcug

SEQ ID NO: 3231210 - RNA, 17 nt, Mycobacterium leprae
cggucccaucgcugacc

SEQ ID NO: 3231211 - RNA, 17 nt, Mycobacterium leprae
cgguccugguggcaacg

SEQ ID NO: 3231212 - RNA, 15 nt, Mycobacterium leprae
cgguccuguccaggu

SEQ ID NO: 3231213 - RNA, 17 nt, Mycobacterium leprae
cgguccuguccaggugc

SEQ ID NO: 3231214 - RNA, 16 nt, Mycobacterium leprae
cggucgaucgcagccg

SEQ ID NO: 3231215 - RNA, 14 nt, Mycobacterium leprae
cggucgccgaugcg

SEQ ID NO: 3231216 - RNA, 18 nt, Mycobacterium leprae
cggucgcucggacugggc

SEQ ID NO: 3231217 - RNA, 14 nt, Mycobacterium leprae
cggucggaguucuu

SEQ ID NO: 3231218 - RNA, 19 nt, Mycobacterium leprae
cggucggggaaggccaagc

SEQ ID NO: 3231219 - RNA, 11 nt, Mycobacterium leprae
cggucgguaaa

SEQ ID NO: 3231220 - RNA, 15 nt, Mycobacterium leprae
cggucguagaccucu

SEQ ID NO: 3231221 - RNA, 14 nt, Mycobacterium leprae
cggucguccggugc

SEQ ID NO: 3231222 - RNA, 18 nt, Mycobacterium leprae
cggucuagcaaguagacg

SEQ ID NO: 3231223 - RNA, 20 nt, Mycobacterium leprae
cggucucuuucggcagcgag

SEQ ID NO: 3231224 - RNA, 23 nt, Mycobacterium leprae
cggucugauaguguaagccauca

SEQ ID NO: 3231225 - RNA, 23 nt, Mycobacterium leprae
cggucugccuugauugccgucgg

SEQ ID NO: 3231226 - RNA, 14 nt, Mycobacterium leprae
cggucugcggugcu

SEQ ID NO: 3231227 - RNA, 17 nt, Mycobacterium leprae
cggucugcgucgacuga

SEQ ID NO: 3231228 - RNA, 15 nt, Mycobacterium leprae
cggucugcucggcga

SEQ ID NO: 3231229 - RNA, 12 nt, Mycobacterium leprae
cggucuuagcaa

SEQ ID NO: 3231230 - RNA, 17 nt, Mycobacterium leprae
cggugaaucagucugcg

SEQ ID NO: 3231231 - RNA, 18 nt, Mycobacterium leprae
cggugacgaacaugcagu

SEQ ID NO: 3231232 - RNA, 19 nt, Mycobacterium leprae
cggugacgcuaccgaggaa

SEQ ID NO: 3231233 - RNA, 18 nt, Mycobacterium leprae
cggugacuaguccggaaa

SEQ ID NO: 3231234 - RNA, 20 nt, Mycobacterium leprae
cggugacuucggccggaguu

SEQ ID NO: 3231235 - RNA, 22 nt, Mycobacterium leprae
cggugagguguucgggauccug

SEQ ID NO: 3231236 - RNA, 14 nt, Mycobacterium leprae
cggugaucguggug

SEQ ID NO: 3231237 - RNA, 14 nt, Mycobacterium leprae
cggugaugacgaaa

SEQ ID NO: 3231238 - RNA, 16 nt, Mycobacterium leprae
cggugauuggcugaga

SEQ ID NO: 3231239 - RNA, 22 nt, Mycobacterium leprae
cggugcaccagcucacccgcag

SEQ ID NO: 3231240 - RNA, 12 nt, Mycobacterium leprae
cggugcauggau

SEQ ID NO: 3231241 - RNA, 19 nt, Mycobacterium leprae
cggugccgaauucgcccga

SEQ ID NO: 3231242 - RNA, 12 nt, Mycobacterium leprae
cggugccgccau

SEQ ID NO: 3231243 - RNA, 16 nt, Mycobacterium leprae
cggugccgccauugcc

SEQ ID NO: 3231244 - RNA, 13 nt, Mycobacterium leprae
cggugcgucaggu

SEQ ID NO: 3231245 - RNA, 13 nt, Mycobacterium leprae
cggugcgugccac

SEQ ID NO: 3231246 - RNA, 15 nt, Mycobacterium leprae
cggugcugcagccac

SEQ ID NO: 3231247 - RNA, 18 nt, Mycobacterium leprae
cggugcugucuuuaccac

SEQ ID NO: 3231248 - RNA, 12 nt, Mycobacterium leprae
cgguggauucca

SEQ ID NO: 3231249 - RNA, 15 nt, Mycobacterium leprae
cgguggcagccggcu

SEQ ID NO: 3231250 - RNA, 15 nt, Mycobacterium leprae
cgguggccaccgcca

SEQ ID NO: 3231251 - RNA, 12 nt, Mycobacterium leprae
cgguggcugugu

SEQ ID NO: 3231252 - RNA, 18 nt, Mycobacterium leprae
cggugguacaaucccacc

SEQ ID NO: 3231253 - RNA, 21 nt, Mycobacterium leprae
cggugguacaaucccaccacc

SEQ ID NO: 3231254 - RNA, 12 nt, Mycobacterium leprae
cggugucacccg

SEQ ID NO: 3231255 - RNA, 21 nt, Mycobacterium leprae
cggugucccauuacuacgcua

SEQ ID NO: 3231256 - RNA, 14 nt, Mycobacterium leprae
cggugucggcggcu

SEQ ID NO: 3231257 - RNA, 13 nt, Mycobacterium leprae
cgguguggugcuc

SEQ ID NO: 3231258 - RNA, 22 nt, Mycobacterium leprae
cgguguguugcaguguugugag

SEQ ID NO: 3231259 - RNA, 21 nt, Mycobacterium leprae
cgguguuagcaugcuugucau

SEQ ID NO: 3231260 - RNA, 15 nt, Mycobacterium leprae
cgucuggaucaacuu

SEQ ID NO: 3231261 - RNA, 15 nt, Mycobacterium leprae
cgucuggauggcuga

SEQ ID NO: 3231262 - RNA, 16 nt, Mycobacterium leprae
cgucugguugcacggc

SEQ ID NO: 3231263 - RNA, 13 nt, Mycobacterium leprae
cgucugucacccg

SEQ ID NO: 3231264 - RNA, 13 nt, Mycobacterium leprae
cgucuucccaaug

SEQ ID NO: 3231265 - RNA, 15 nt, Mycobacterium leprae
cgucuuccggaaaac

SEQ ID NO: 3231266 - RNA, 16 nt, Mycobacterium leprae
cgucuuuauuagcaug

SEQ ID NO: 3231267 - RNA, 16 nt, Mycobacterium leprae
cgucuuuauucuuuua

SEQ ID NO: 3231268 - RNA, 17 nt, Mycobacterium leprae
cgugaaucaugccgcag

SEQ ID NO: 3231269 - RNA, 16 nt, Mycobacterium leprae
cgugaauccgcugcaa

SEQ ID NO: 3231270 - RNA, 15 nt, Mycobacterium leprae
cgugacgcgggcgcc

SEQ ID NO: 3231271 - RNA, 12 nt, Mycobacterium leprae
cgugacucaaca

SEQ ID NO: 3231272 - RNA, 15 nt, Mycobacterium leprae
cgugagccggucggc

SEQ ID NO: 3231273 - RNA, 18 nt, Mycobacterium leprae
cgugaggucgaagcugcc

SEQ ID NO: 3231274 - RNA, 22 nt, Mycobacterium leprae
cgugaucgacaucguguggugu

SEQ ID NO: 3231275 - RNA, 13 nt, Mycobacterium leprae
cgugaugcagcau

SEQ ID NO: 3231276 - RNA, 14 nt, Mycobacterium leprae
cgugauggacgacc

SEQ ID NO: 3231277 - RNA, 19 nt, Mycobacterium leprae
cgugauuuucauuggcauu

SEQ ID NO: 3231278 - RNA, 14 nt, Mycobacterium leprae
cgugcaauguuaca

SEQ ID NO: 3231279 - RNA, 20 nt, Mycobacterium leprae
cgugcacaucgguaguggcc

SEQ ID NO: 3231280 - RNA, 21 nt, Mycobacterium leprae
cgugcacaucgguaguggccg

SEQ ID NO: 3231281 - RNA, 15 nt, Mycobacterium leprae
cgugcacggcgagga

SEQ ID NO: 3231282 - RNA, 22 nt, Mycobacterium leprae
cgugcagcgaccucaugcccgg

SEQ ID NO: 3231283 - RNA, 17 nt, Mycobacterium leprae
cgugcaggauucacccg

SEQ ID NO: 3231284 - RNA, 20 nt, Mycobacterium leprae
cgugcaucggguuauggucc

SEQ ID NO: 3231285 - RNA, 18 nt, Mycobacterium leprae
cgugccaacacuuaucac

SEQ ID NO: 3231286 - RNA, 23 nt, Mycobacterium leprae
cgugccgaaguguaaucggccga

SEQ ID NO: 3231287 - RNA, 15 nt, Mycobacterium leprae
cgugccugguugggc

SEQ ID NO: 3231288 - RNA, 16 nt, Mycobacterium leprae
cgugcggcgcccaccu

SEQ ID NO: 3231289 - RNA, 18 nt, Mycobacterium leprae
cgugcuaugaccucgccg

SEQ ID NO: 3231290 - RNA, 15 nt, Mycobacterium leprae
cgugcugaggguggc

SEQ ID NO: 3231291 - RNA, 18 nt, Mycobacterium leprae
cgugcugaguccgaugau

SEQ ID NO: 3231292 - RNA, 16 nt, Mycobacterium leprae
cgugcugaucaccggc

SEQ ID NO: 3231293 - RNA, 19 nt, Mycobacterium leprae
cgugcuguugucagcagac

SEQ ID NO: 3231294 - RNA, 21 nt, Mycobacterium leprae
cgugcuuaacacaugcaaguc

SEQ ID NO: 3231295 - RNA, 16 nt, Mycobacterium leprae
cguggacuucugcgcg

SEQ ID NO: 3231296 - RNA, 17 nt, Mycobacterium leprae
cguggcccaaaccguug

SEQ ID NO: 3231297 - RNA, 12 nt, Mycobacterium leprae
cguggcgagugc

SEQ ID NO: 3231298 - RNA, 17 nt, Mycobacterium leprae
cguggcgagugcugacg

SEQ ID NO: 3231299 - RNA, 18 nt, Mycobacterium leprae
cguggcgagugcugacgc

SEQ ID NO: 3231300 - RNA, 18 nt, Mycobacterium leprae
cguggcuaggccaguguc

SEQ ID NO: 3231301 - RNA, 18 nt, Mycobacterium leprae
cguggcuccgcgcugacg

SEQ ID NO: 3231302 - RNA, 19 nt, Mycobacterium leprae
cguggcugcacaagcuugu

SEQ ID NO: 3231303 - RNA, 18 nt, Mycobacterium leprae
cguggggggcagcccgga

SEQ ID NO: 3231304 - RNA, 15 nt, Mycobacterium leprae
cguggguacguggug

SEQ ID NO: 3231305 - RNA, 21 nt, Mycobacterium leprae
cgugggucgagugguccccug

SEQ ID NO: 3231306 - RNA, 14 nt, Mycobacterium leprae
cgugggugugagga

SEQ ID NO: 3231307 - RNA, 21 nt, Mycobacterium leprae
cguggucaccgcuguggcaga

SEQ ID NO: 3231308 - RNA, 14 nt, Mycobacterium leprae
cgugguggcugcaa

SEQ ID NO: 3231309 - RNA, 15 nt, Mycobacterium leprae
cguguaaacuggcga

SEQ ID NO: 3231310 - RNA, 20 nt, Mycobacterium leprae
cguguaaacuggcgagugga

SEQ ID NO: 3231311 - RNA, 19 nt, Mycobacterium leprae
cguguacagugggaggcgc

SEQ ID NO: 3231312 - RNA, 15 nt, Mycobacterium leprae
cgugucggccccccg

SEQ ID NO: 3231313 - RNA, 13 nt, Mycobacterium leprae
cgugugccgcuga

SEQ ID NO: 3231314 - RNA, 17 nt, Mycobacterium leprae
cgugugcuuugccgcag

SEQ ID NO: 3231315 - RNA, 22 nt, Mycobacterium leprae
cguguucacgcagucauccacu

SEQ ID NO: 3231316 - RNA, 12 nt, Mycobacterium leprae
cguguucaucau

SEQ ID NO: 3231317 - RNA, 15 nt, Mycobacterium leprae
cguguucguuguucu

SEQ ID NO: 3231318 - RNA, 14 nt, Mycobacterium leprae
cguguugccaccga

SEQ ID NO: 3231319 - RNA, 17 nt, Mycobacterium leprae
cguguugcuugcuguga

SEQ ID NO: 3231320 - RNA, 17 nt, Mycobacterium leprae
cguguuuucaguucacg

SEQ ID NO: 3231321 - RNA, 20 nt, Mycobacterium leprae
cguuaacuguagucgguuac

SEQ ID NO: 3231322 - RNA, 20 nt, Mycobacterium leprae
cguuaccgacaccgccgacg

SEQ ID NO: 3231323 - RNA, 15 nt, Mycobacterium leprae
cguuauccacgccga

SEQ ID NO: 3231324 - RNA, 17 nt, Mycobacterium leprae
cguuaucgaucuaccug

SEQ ID NO: 3231325 - RNA, 12 nt, Mycobacterium leprae
cguuauugcugu

SEQ ID NO: 3231326 - RNA, 14 nt, Mycobacterium leprae
cguucaguggccaa

SEQ ID NO: 3231327 - RNA, 18 nt, Mycobacterium leprae
cguucauccucgggcagu

SEQ ID NO: 3231328 - RNA, 18 nt, Mycobacterium leprae
cguucaucgucgggugcu

SEQ ID NO: 3231329 - RNA, 18 nt, Mycobacterium leprae
cguuccagcuuucgggaa

SEQ ID NO: 3231330 - RNA, 12 nt, Mycobacterium leprae
cguuccugagug

SEQ ID NO: 3231331 - RNA, 22 nt, Mycobacterium leprae
cguuccugagugugaugccgaa

SEQ ID NO: 3231332 - RNA, 14 nt, Mycobacterium leprae
cguuccuggcuggc

SEQ ID NO: 3231333 - RNA, 20 nt, Mycobacterium leprae
cguucgacuucugguugaca

SEQ ID NO: 3231334 - RNA, 15 nt, Mycobacterium leprae
cguucucgcgcaggu

SEQ ID NO: 3231335 - RNA, 22 nt, Mycobacterium leprae
cguugaccgcccuggaccgcag

SEQ ID NO: 3231336 - RNA, 14 nt, Mycobacterium leprae
cguugacuauggcu

SEQ ID NO: 3231337 - RNA, 23 nt, Mycobacterium leprae
cguugacuauggcucucgggugc

SEQ ID NO: 3231338 - RNA, 22 nt, Mycobacterium leprae
cguugagcgcagccaccacucu

SEQ ID NO: 3231339 - RNA, 21 nt, Mycobacterium leprae
cguugaucuggaucagcgcgc

SEQ ID NO: 3231340 - RNA, 17 nt, Mycobacterium leprae
cguugauugaggagugu

SEQ ID NO: 3231341 - RNA, 20 nt, Mycobacterium leprae
cguugcauucgacggagcgc

SEQ ID NO: 3231342 - RNA, 16 nt, Mycobacterium leprae
cguugcuaaaaccacc

SEQ ID NO: 3231343 - RNA, 14 nt, Mycobacterium leprae
cguuggcaucggac

SEQ ID NO: 3231344 - RNA, 14 nt, Mycobacterium leprae
cguuggccagcacg

SEQ ID NO: 3231345 - RNA, 17 nt, Mycobacterium leprae
cguuggccagcacggcg

SEQ ID NO: 3231346 - RNA, 13 nt, Mycobacterium leprae
cguuggccggcau

SEQ ID NO: 3231347 - RNA, 19 nt, Mycobacterium leprae
cguuguaguagaccuugac

SEQ ID NO: 3231348 - RNA, 22 nt, Mycobacterium leprae
cguugucggcuccuccagcauc

SEQ ID NO: 3231349 - RNA, 23 nt, Mycobacterium leprae
cguugucggcuccuccagcaucg

SEQ ID NO: 3231350 - RNA, 16 nt, Mycobacterium leprae
cguugucgucggccgc

SEQ ID NO: 3231351 - RNA, 13 nt, Mycobacterium leprae
cguugucuugugg

SEQ ID NO: 3231352 - RNA, 16 nt, Mycobacterium leprae
cguugugccauuggcu

SEQ ID NO: 3231353 - RNA, 13 nt, Mycobacterium leprae
cguugugcgguga

SEQ ID NO: 3231354 - RNA, 23 nt, Mycobacterium leprae
cguugugcggugagagcuuccaa

SEQ ID NO: 3231355 - RNA, 23 nt, Mycobacterium leprae
cguuguucggcaggccggccugg

SEQ ID NO: 3231356 - RNA, 19 nt, Mycobacterium leprae
cguuuagucaccgccgaag

SEQ ID NO: 3231357 - RNA, 14 nt, Mycobacterium leprae
cguuucaugacgag

SEQ ID NO: 3231358 - RNA, 15 nt, Mycobacterium leprae
cguuuugucuucuag

SEQ ID NO: 3231359 - RNA, 20 nt, Mycobacterium leprae
cuaaaacgccccuaccccgc

SEQ ID NO: 3231360 - RNA, 21 nt, Mycobacterium leprae
cuaaacugacgcugcgcugag

SEQ ID NO: 3231361 - RNA, 14 nt, Mycobacterium leprae
cuaaagugcugcug

SEQ ID NO: 3231362 - RNA, 16 nt, Mycobacterium leprae
cuaaagugcugcugug

SEQ ID NO: 3231363 - RNA, 16 nt, Mycobacterium leprae
cuaaaucuggccaacg

SEQ ID NO: 3231364 - RNA, 21 nt, Mycobacterium leprae
cuaacacaggaauuuagaggc

SEQ ID NO: 3231365 - RNA, 22 nt, Mycobacterium leprae
cuaacccgcaaaccaaacaaca

SEQ ID NO: 3231366 - RNA, 23 nt, Mycobacterium leprae
cuaacccgcaaaccaaacaacaa

SEQ ID NO: 3231367 - RNA, 19 nt, Mycobacterium leprae
cuaaccgauccggugugga

SEQ ID NO: 3231368 - RNA, 13 nt, Mycobacterium leprae
cuaagaagcugcc

SEQ ID NO: 3231369 - RNA, 14 nt, Mycobacterium leprae
cuaagccaagcuca

SEQ ID NO: 3231370 - RNA, 17 nt, Mycobacterium leprae
cuaaguccggccugccc

SEQ ID NO: 3231371 - RNA, 13 nt, Mycobacterium leprae
cuaauagccgaac

SEQ ID NO: 3231372 - RNA, 21 nt, Mycobacterium leprae
cuaauauagacuaugaagacc

SEQ ID NO: 3231373 - RNA, 20 nt, Mycobacterium leprae
cucagcaacuucuugugggg

SEQ ID NO: 3231374 - RNA, 16 nt, Mycobacterium leprae
cucagcaacuuuccug

SEQ ID NO: 3231375 - RNA, 21 nt, Mycobacterium leprae
cucagccagcaagcaggcaug

SEQ ID NO: 3231376 - RNA, 17 nt, Mycobacterium leprae
cucagcggccagacacc

SEQ ID NO: 3231377 - RNA, 16 nt, Mycobacterium leprae
cucagugaagaccauc

SEQ ID NO: 3231378 - RNA, 20 nt, Mycobacterium leprae
cucagugaagugcucgggug

SEQ ID NO: 3231379 - RNA, 14 nt, Mycobacterium leprae
cucagugaucaggu

SEQ ID NO: 3231380 - RNA, 23 nt, Mycobacterium leprae
cucaguggcgggcuugaccugga

SEQ ID NO: 3231381 - RNA, 14 nt, Mycobacterium leprae
cucagugucagcag

SEQ ID NO: 3231382 - RNA, 15 nt, Mycobacterium leprae
cucaguuaucccacg

SEQ ID NO: 3231383 - RNA, 22 nt, Mycobacterium leprae
cucaguuaucccacgcugacgu

SEQ ID NO: 3231384 - RNA, 15 nt, Mycobacterium leprae
cucauaccuuuucca

SEQ ID NO: 3231385 - RNA, 20 nt, Mycobacterium leprae
cucauauuuagcgaccggcc

SEQ ID NO: 3231386 - RNA, 18 nt, Mycobacterium leprae
cucaucgcggcugccacu

SEQ ID NO: 3231387 - RNA, 21 nt, Mycobacterium leprae
cucaucgcggcugccacugug

SEQ ID NO: 3231388 - RNA, 14 nt, Mycobacterium leprae
cucaucggcuccca

SEQ ID NO: 3231389 - RNA, 18 nt, Mycobacterium leprae
cucaucuugaccagugug

SEQ ID NO: 3231390 - RNA, 22 nt, Mycobacterium leprae
cucaugcccgggauggcugggc

SEQ ID NO: 3231391 - RNA, 15 nt, Mycobacterium leprae
cucauugagccacgu

SEQ ID NO: 3231392 - RNA, 14 nt, Mycobacterium leprae
cucauuguggcugg

SEQ ID NO: 3231393 - RNA, 14 nt, Mycobacterium leprae
cuccaaguggcugc

SEQ ID NO: 3231394 - RNA, 16 nt, Mycobacterium leprae
cuccacgauucugcug

SEQ ID NO: 3231395 - RNA, 19 nt, Mycobacterium leprae
cuccacggucauggucgaa

SEQ ID NO: 3231396 - RNA, 19 nt, Mycobacterium leprae
cuccagccgcgggcgaugc

SEQ ID NO: 3231397 - RNA, 23 nt, Mycobacterium leprae
cuccagcucgcggugggcuucca

SEQ ID NO: 3231398 - RNA, 22 nt, Mycobacterium leprae
cuccaguuuugugggcagguca

SEQ ID NO: 3231399 - RNA, 23 nt, Mycobacterium leprae
cuccaguuuugugggcaggucag

SEQ ID NO: 3231400 - RNA, 13 nt, Mycobacterium leprae
cuccauuaaaccu

SEQ ID NO: 3231401 - RNA, 17 nt, Mycobacterium leprae
cuccauugcguuugaug

SEQ ID NO: 3231402 - RNA, 17 nt, Mycobacterium leprae
cucccaaggaccggugc

SEQ ID NO: 3231403 - RNA, 21 nt, Mycobacterium leprae
cucccaaggaccggugcugca

SEQ ID NO: 3231404 - RNA, 19 nt, Mycobacterium leprae
cucccaucggcggccagcu

SEQ ID NO: 3231405 - RNA, 15 nt, Mycobacterium leprae
cuccccgcccaaggc

SEQ ID NO: 3231406 - RNA, 17 nt, Mycobacterium leprae
cucccgaaucgcuagcg

SEQ ID NO: 3231407 - RNA, 13 nt, Mycobacterium leprae
cucccuucgccgg

SEQ ID NO: 3231408 - RNA, 18 nt, Mycobacterium leprae
cuccgaagcagccaaugc

SEQ ID NO: 3231409 - RNA, 14 nt, Mycobacterium leprae
cuccgaucacuugg

SEQ ID NO: 3231410 - RNA, 19 nt, Mycobacterium leprae
cuccgcagcaccugccgca

SEQ ID NO: 3231411 - RNA, 19 nt, Mycobacterium leprae
cuccgcgcacaguguggcc

SEQ ID NO: 3231412 - RNA, 17 nt, Mycobacterium leprae
cuccgcuauaagugugg

SEQ ID NO: 3231413 - RNA, 19 nt, Mycobacterium leprae
cuccgugaugaacuucgga

SEQ ID NO: 3231414 - RNA, 23 nt, Mycobacterium leprae
cuccguucacagugccgaaagcc

SEQ ID NO: 3231415 - RNA, 19 nt, Mycobacterium leprae
cuccucaacucuucugcug

SEQ ID NO: 3231416 - RNA, 14 nt, Mycobacterium leprae
cuccuccagcaucg

SEQ ID NO: 3231417 - RNA, 17 nt, Mycobacterium leprae
cuccugagacaucgcca

SEQ ID NO: 3231418 - RNA, 17 nt, Mycobacterium leprae
cuccuuuagcuugguug

SEQ ID NO: 3231419 - RNA, 16 nt, Mycobacterium leprae
cuccuuuucgccggcg

SEQ ID NO: 3231420 - RNA, 17 nt, Mycobacterium leprae
cucgaaacgcgaagcac

SEQ ID NO: 3231421 - RNA, 15 nt, Mycobacterium leprae
cucgaaccgauccag

SEQ ID NO: 3231422 - RNA, 22 nt, Mycobacterium leprae
cucgaaccgauccagcauucag

SEQ ID NO: 3231423 - RNA, 13 nt, Mycobacterium leprae
cucgacauagaac

SEQ ID NO: 3231424 - RNA, 14 nt, Mycobacterium leprae
cucgacauagaaca

SEQ ID NO: 3231425 - RNA, 21 nt, Mycobacterium leprae
cucgacgacguuaucuugaug

SEQ ID NO: 3231426 - RNA, 19 nt, Mycobacterium leprae
cucgacgggucacagguaa

SEQ ID NO: 3231427 - RNA, 13 nt, Mycobacterium leprae
cucgagcaaugcu

SEQ ID NO: 3231428 - RNA, 15 nt, Mycobacterium leprae
cucgagcgagcccag

SEQ ID NO: 3231429 - RNA, 13 nt, Mycobacterium leprae
cucgagcggcgca

SEQ ID NO: 3231430 - RNA, 13 nt, Mycobacterium leprae
cucgagcuugccc

SEQ ID NO: 3231431 - RNA, 23 nt, Mycobacterium leprae
cucgaguugguuaaucaccucau

SEQ ID NO: 3231432 - RNA, 12 nt, Mycobacterium leprae
cucgaugacacg

SEQ ID NO: 3231433 - RNA, 13 nt, Mycobacterium leprae
cucgaugugcuua

SEQ ID NO: 3231434 - RNA, 20 nt, Mycobacterium leprae
cucgccgcgcaucaucgccc

SEQ ID NO: 3231435 - RNA, 22 nt, Mycobacterium leprae
cucgcgccguuuccagcgcucg

SEQ ID NO: 3231436 - RNA, 16 nt, Mycobacterium leprae
cucgcgggcggcguga

SEQ ID NO: 3231437 - RNA, 19 nt, Mycobacterium leprae
cucgcggggaugcugaggu

SEQ ID NO: 3231438 - RNA, 17 nt, Mycobacterium leprae
cucgcuccaacaacggc

SEQ ID NO: 3231439 - RNA, 14 nt, Mycobacterium leprae
cucgcugccgugug

SEQ ID NO: 3231440 - RNA, 13 nt, Mycobacterium leprae
cucgcuggaauuu

SEQ ID NO: 3231441 - RNA, 13 nt, Mycobacterium leprae
cucgcuggucagc

SEQ ID NO: 3231442 - RNA, 16 nt, Mycobacterium leprae
cucgcuugguugcggg

SEQ ID NO: 3231443 - RNA, 14 nt, Mycobacterium leprae
cucggacaccggga

SEQ ID NO: 3231444 - RNA, 21 nt, Mycobacterium leprae
cucggacgugguccgaucgca

SEQ ID NO: 3231445 - RNA, 19 nt, Mycobacterium leprae
cucggauaggugcaauccc

SEQ ID NO: 3231446 - RNA, 14 nt, Mycobacterium leprae
cucggccaggugug

SEQ ID NO: 3231447 - RNA, 14 nt, Mycobacterium leprae
cucggcgccaucga

SEQ ID NO: 3231448 - RNA, 21 nt, Mycobacterium leprae
cucggcgccaucgaauccucg

SEQ ID NO: 3231449 - RNA, 17 nt, Mycobacterium leprae
cucggcgcgcucucugg

SEQ ID NO: 3231450 - RNA, 19 nt, Mycobacterium leprae
cucggcggcaccuccccgc

SEQ ID NO: 3231451 - RNA, 17 nt, Mycobacterium leprae
cucggcgguaccgucua

SEQ ID NO: 3231452 - RNA, 22 nt, Mycobacterium leprae
cucgguaucgucaaauuuuccg

SEQ ID NO: 3231453 - RNA, 22 nt, Mycobacterium leprae
cucggucaccccgagcucggcc

SEQ ID NO: 3231454 - RNA, 14 nt, Mycobacterium leprae
cucggucaggugcg

SEQ ID NO: 3231455 - RNA, 12 nt, Mycobacterium leprae
cucggugagaua

SEQ ID NO: 3231456 - RNA, 21 nt, Mycobacterium leprae
cucggugagauagcggcggua

SEQ ID NO: 3231457 - RNA, 19 nt, Mycobacterium leprae
cucgguguucgcuccgccc

SEQ ID NO: 3231458 - RNA, 19 nt, Mycobacterium leprae
cucguagcggcggcggcca

SEQ ID NO: 3231459 - RNA, 16 nt, Mycobacterium leprae
cucgucaagaucgacu

SEQ ID NO: 3231460 - RNA, 14 nt, Mycobacterium leprae
cucguccaggccug

SEQ ID NO: 3231461 - RNA, 14 nt, Mycobacterium leprae
cucgucgcacaaau

SEQ ID NO: 3231462 - RNA, 13 nt, Mycobacterium leprae
cucgucggccagc

SEQ ID NO: 3231463 - RNA, 15 nt, Mycobacterium leprae
cucgucggccagcac

SEQ ID NO: 3231464 - RNA, 21 nt, Mycobacterium leprae
cucgucggugagguguucggg

SEQ ID NO: 3231465 - RNA, 20 nt, Mycobacterium leprae
cucgugcgucgucucagcgg

SEQ ID NO: 3231466 - RNA, 14 nt, Mycobacterium leprae
cucguggcagucuc

SEQ ID NO: 3231467 - RNA, 22 nt, Mycobacterium leprae
cucguggguuaaagucaugccc

SEQ ID NO: 3231468 - RNA, 20 nt, Mycobacterium leprae
cucuagcuggucccacagcc

SEQ ID NO: 3231469 - RNA, 14 nt, Mycobacterium leprae
cucuauaaaauuua

SEQ ID NO: 3231470 - RNA, 22 nt, Mycobacterium leprae
cucuaucgaacuuuuccaugcu

SEQ ID NO: 3231471 - RNA, 11 nt, Mycobacterium leprae
cucucaggccg

SEQ ID NO: 3231472 - RNA, 14 nt, Mycobacterium leprae
cucucaucgcggcu

SEQ ID NO: 3231473 - RNA, 23 nt, Mycobacterium leprae
cucuccauaagcgggugccgcgu

SEQ ID NO: 3231474 - RNA, 19 nt, Mycobacterium leprae
cucucgaggauuaucgccg

SEQ ID NO: 3231475 - RNA, 14 nt, Mycobacterium leprae
cucucgaguugccg

SEQ ID NO: 3231476 - RNA, 14 nt, Mycobacterium leprae
cucugccgccucga

SEQ ID NO: 3231477 - RNA, 20 nt, Mycobacterium leprae
cucugcgguaucgccgauca

SEQ ID NO: 3231478 - RNA, 19 nt, Mycobacterium leprae
cucugcguaggccaggucu

SEQ ID NO: 3231479 - RNA, 15 nt, Mycobacterium leprae
cucugcuggaucugu

SEQ ID NO: 3231480 - RNA, 21 nt, Mycobacterium leprae
cucuggcuggucguguugcuu

SEQ ID NO: 3231481 - RNA, 21 nt, Mycobacterium leprae
cucugggugguguggcccgac

SEQ ID NO: 3231482 - RNA, 16 nt, Mycobacterium leprae
cucugucgacgggaag

SEQ ID NO: 3231483 - RNA, 22 nt, Mycobacterium leprae
cucugucgacgggaaguggugg

SEQ ID NO: 3231484 - RNA, 13 nt, Mycobacterium leprae
cucuguucaggcc

SEQ ID NO: 3231485 - RNA, 17 nt, Mycobacterium leprae
cucuguucaucacccag

SEQ ID NO: 3231486 - RNA, 13 nt, Mycobacterium leprae
cugcgacguccca

SEQ ID NO: 3231487 - RNA, 15 nt, Mycobacterium leprae
cugcgauccggcaca

SEQ ID NO: 3231488 - RNA, 24 nt, Mycobacterium leprae
cugcgauccggcacaucgaaccga

SEQ ID NO: 3231489 - RNA, 23 nt, Mycobacterium leprae
cugcgcaauacggugcaccagcu

SEQ ID NO: 3231490 - RNA, 18 nt, Mycobacterium leprae
cugcgccguuugggccac

SEQ ID NO: 3231491 - RNA, 14 nt, Mycobacterium leprae
cugcgcgcagugca

SEQ ID NO: 3231492 - RNA, 20 nt, Mycobacterium leprae
cugcgcugagagugccaccg

SEQ ID NO: 3231493 - RNA, 20 nt, Mycobacterium leprae
cugcgcuucuggcugggaca

SEQ ID NO: 3231494 - RNA, 21 nt, Mycobacterium leprae
cugcgcuucuggcugggacac

SEQ ID NO: 3231495 - RNA, 20 nt, Mycobacterium leprae
cugcgguaucaucaagcacc

SEQ ID NO: 3231496 - RNA, 15 nt, Mycobacterium leprae
cugcgguaucgccga

SEQ ID NO: 3231497 - RNA, 15 nt, Mycobacterium leprae
cugcggugguggccg

SEQ ID NO: 3231498 - RNA, 18 nt, Mycobacterium leprae
cugcggugugugggucgc

SEQ ID NO: 3231499 - RNA, 22 nt, Mycobacterium leprae
cugcguaacaccgucgaaauug

SEQ ID NO: 3231500 - RNA, 20 nt, Mycobacterium leprae
cugcguacggaccccgccac

SEQ ID NO: 3231501 - RNA, 22 nt, Mycobacterium leprae
cugcguacggaccccgccacuc

SEQ ID NO: 3231502 - RNA, 23 nt, Mycobacterium leprae
cugcguacggaccccgccacuca

SEQ ID NO: 3231503 - RNA, 21 nt, Mycobacterium leprae
cugcguagcaagguguugcgg

SEQ ID NO: 3231504 - RNA, 17 nt, Mycobacterium leprae
cugcgucaucgacucga

SEQ ID NO: 3231505 - RNA, 22 nt, Mycobacterium leprae
cugcgugauccgucgcacgugg

SEQ ID NO: 3231506 - RNA, 17 nt, Mycobacterium leprae
cugcgugccgagccugg

SEQ ID NO: 3231507 - RNA, 21 nt, Mycobacterium leprae
cugcguggccuccgagcgccc

SEQ ID NO: 3231508 - RNA, 17 nt, Mycobacterium leprae
cugcgugucgugucgga

SEQ ID NO: 3231509 - RNA, 14 nt, Mycobacterium leprae
cugcguucgguagc

SEQ ID NO: 3231510 - RNA, 19 nt, Mycobacterium leprae
cugcuaugguuggucggcc

SEQ ID NO: 3231511 - RNA, 13 nt, Mycobacterium leprae
cugcucauggcac

SEQ ID NO: 3231512 - RNA, 16 nt, Mycobacterium leprae
cugcuccugagacauc

SEQ ID NO: 3231513 - RNA, 22 nt, Mycobacterium leprae
cugcuccugagacaucgccacc

SEQ ID NO: 3231514 - RNA, 13 nt, Mycobacterium leprae
cugcucucagcac

SEQ ID NO: 3231515 - RNA, 22 nt, Mycobacterium leprae
cugcugagcguggcugcucaac

SEQ ID NO: 3231516 - RNA, 20 nt, Mycobacterium leprae
cugcugauauagcgcucaac

SEQ ID NO: 3231517 - RNA, 17 nt, Mycobacterium leprae
cugcugcaagcccccuc

SEQ ID NO: 3231518 - RNA, 14 nt, Mycobacterium leprae
cugcugcacccggc

SEQ ID NO: 3231519 - RNA, 15 nt, Mycobacterium leprae
cugcugcacccggcg

SEQ ID NO: 3231520 - RNA, 14 nt, Mycobacterium leprae
cugcugcagaccgg

SEQ ID NO: 3231521 - RNA, 14 nt, Mycobacterium leprae
cugcugcauguugu

SEQ ID NO: 3231522 - RNA, 17 nt, Mycobacterium leprae
cugcugcgcaagguugu

SEQ ID NO: 3231523 - RNA, 13 nt, Mycobacterium leprae
cugcugcggcgcc

SEQ ID NO: 3231524 - RNA, 13 nt, Mycobacterium leprae
cugcugcuggccu

SEQ ID NO: 3231525 - RNA, 18 nt, Mycobacterium leprae
cugcuggaauccggcaac

SEQ ID NO: 3231526 - RNA, 11 nt, Mycobacterium leprae
cugcuggagau

SEQ ID NO: 3231527 - RNA, 15 nt, Mycobacterium leprae
cugcuggcccuguuc

SEQ ID NO: 3231528 - RNA, 20 nt, Mycobacterium leprae
cugcuggccuggauugucga

SEQ ID NO: 3231529 - RNA, 19 nt, Mycobacterium leprae
cugcugguggaguacuggg

SEQ ID NO: 3231530 - RNA, 13 nt, Mycobacterium leprae
cugcugguucuug

SEQ ID NO: 3231531 - RNA, 17 nt, Mycobacterium leprae
cugcugguucuuggcuu

SEQ ID NO: 3231532 - RNA, 15 nt, Mycobacterium leprae
cugcuuacucgcgcc

SEQ ID NO: 3231533 - RNA, 16 nt, Mycobacterium leprae
cugcuugcucugggug

SEQ ID NO: 3231534 - RNA, 14 nt, Mycobacterium leprae
cugcuuguggcgga

SEQ ID NO: 3231535 - RNA, 17 nt, Mycobacterium leprae
cugcuuuaccuucaggu

SEQ ID NO: 3231536 - RNA, 14 nt, Mycobacterium leprae
cuggaacacgaucg

SEQ ID NO: 3231537 - RNA, 22 nt, Mycobacterium leprae
cuggaagaugacucggcgugcc

SEQ ID NO: 3231538 - RNA, 13 nt, Mycobacterium leprae
cuggaagcgcuga

SEQ ID NO: 3231539 - RNA, 22 nt, Mycobacterium leprae
cuggaagucggucugcggggag

SEQ ID NO: 3231540 - RNA, 17 nt, Mycobacterium leprae
cuggaauccgcgcaggg

SEQ ID NO: 3231541 - RNA, 21 nt, Mycobacterium leprae
cuggaauccgcgcagggccug

SEQ ID NO: 3231542 - RNA, 17 nt, Mycobacterium leprae
cuggaauccggcaacug

SEQ ID NO: 3231543 - RNA, 22 nt, Mycobacterium leprae
cuggaauuuauuguccacgucg

SEQ ID NO: 3231544 - RNA, 13 nt, Mycobacterium leprae
cuggacaaagucu

SEQ ID NO: 3231545 - RNA, 23 nt, Mycobacterium leprae
cuggacccguggaauccgcugca

SEQ ID NO: 3231546 - RNA, 15 nt, Mycobacterium leprae
cuggaccgcagcacg

SEQ ID NO: 3231547 - RNA, 22 nt, Mycobacterium leprae
cuggacucggucugcuggacag

SEQ ID NO: 3231548 - RNA, 23 nt, Mycobacterium leprae
cuggagaauguuguuagugcugc

SEQ ID NO: 3231549 - RNA, 13 nt, Mycobacterium leprae
cuggaggccaacc

SEQ ID NO: 3231550 - RNA, 16 nt, Mycobacterium leprae
cuggaucagcgcgcca

SEQ ID NO: 3231551 - RNA, 20 nt, Mycobacterium leprae
cuggaucagcgcgccaaaca

SEQ ID NO: 3231552 - RNA, 15 nt, Mycobacterium leprae
cuggaucuguauuaa

SEQ ID NO: 3231553 - RNA, 22 nt, Mycobacterium leprae
cuggaugaccauaaugcagcgg

SEQ ID NO: 3231554 - RNA, 18 nt, Mycobacterium leprae
cuggaugccgggaagcga

SEQ ID NO: 3231555 - RNA, 13 nt, Mycobacterium leprae
cuggauuaauauu

SEQ ID NO: 3231556 - RNA, 17 nt, Mycobacterium leprae
cuggauuagcgggaggc

SEQ ID NO: 3231557 - RNA, 21 nt, Mycobacterium leprae
cuggauugucgacaagcuggu

SEQ ID NO: 3231558 - RNA, 10 nt, Mycobacterium leprae
cuggauuuac

SEQ ID NO: 3231559 - RNA, 23 nt, Mycobacterium leprae
cuggauuucagggcacacagcaa

SEQ ID NO: 3231560 - RNA, 15 nt, Mycobacterium leprae
cuggcaagugccgcg

SEQ ID NO: 3231561 - RNA, 15 nt, Mycobacterium leprae
cuggcacccacgcug

SEQ ID NO: 3231562 - RNA, 19 nt, Mycobacterium leprae
cuggcacccacgcugcgcg

SEQ ID NO: 3231563 - RNA, 22 nt, Mycobacterium leprae
cuggcaccgcgguaggccaggu

SEQ ID NO: 3231564 - RNA, 13 nt, Mycobacterium leprae
cuggcacgccagc

SEQ ID NO: 3231565 - RNA, 15 nt, Mycobacterium leprae
cuggcacuccgaccg

SEQ ID NO: 3231566 - RNA, 22 nt, Mycobacterium leprae
cuggcaguuagcaugagcugcu

SEQ ID NO: 3231567 - RNA, 19 nt, Mycobacterium leprae
cuggcccuguuccucgcgg

SEQ ID NO: 3231568 - RNA, 14 nt, Mycobacterium leprae
cuggccgccgggcg

SEQ ID NO: 3231569 - RNA, 16 nt, Mycobacterium leprae
cuggccggcagggaug

SEQ ID NO: 3231570 - RNA, 17 nt, Mycobacterium leprae
cuggccuaccgggcgcu

SEQ ID NO: 3231571 - RNA, 22 nt, Mycobacterium leprae
cuggccuccuaggccacccgcc

SEQ ID NO: 3231572 - RNA, 13 nt, Mycobacterium leprae
cuggcgaacaaca

SEQ ID NO: 3231573 - RNA, 15 nt, Mycobacterium leprae
cuggcgaacaacaaa

SEQ ID NO: 3231574 - RNA, 13 nt, Mycobacterium leprae
cuggcgcaacagu

SEQ ID NO: 3231575 - RNA, 19 nt, Mycobacterium leprae
cuggcgcaauuuggugauc

SEQ ID NO: 3231576 - RNA, 20 nt, Mycobacterium leprae
cuggcgcuuaauguagcaug

SEQ ID NO: 3231577 - RNA, 15 nt, Mycobacterium leprae
cuggcggaguugagc

SEQ ID NO: 3231578 - RNA, 15 nt, Mycobacterium leprae
cuggcggaugcgggc

SEQ ID NO: 3231579 - RNA, 15 nt, Mycobacterium leprae
cuggcggauuuugac

SEQ ID NO: 3231580 - RNA, 21 nt, Mycobacterium leprae
cuggcuacgacaggagcuuca

SEQ ID NO: 3231581 - RNA, 16 nt, Mycobacterium leprae
cuggcugagggccggu

SEQ ID NO: 3231582 - RNA, 19 nt, Mycobacterium leprae
cuggcugagggccggucaa

SEQ ID NO: 3231583 - RNA, 13 nt, Mycobacterium leprae
cuggcugccgcca

SEQ ID NO: 3231584 - RNA, 14 nt, Mycobacterium leprae
cuggcugcugcaga

SEQ ID NO: 3231585 - RNA, 21 nt, Mycobacterium leprae
cuggcuguauucuauagcguc

SEQ ID NO: 3231586 - RNA, 13 nt, Mycobacterium leprae
cuggcuuccucuc

SEQ ID NO: 3231587 - RNA, 15 nt, Mycobacterium leprae
cuggcuucucuaucu

SEQ ID NO: 3231588 - RNA, 19 nt, Mycobacterium leprae
cuggcuucucuaucuugag

SEQ ID NO: 3231589 - RNA, 22 nt, Mycobacterium leprae
cugggacauccgcugauuggca

SEQ ID NO: 3231590 - RNA, 15 nt, Mycobacterium leprae
cugggauagaccgcc

SEQ ID NO: 3231591 - RNA, 22 nt, Mycobacterium leprae
cugggauagcugugcaggagag

SEQ ID NO: 3231592 - RNA, 22 nt, Mycobacterium leprae
cugggauugggcauccugcugu

SEQ ID NO: 3231593 - RNA, 21 nt, Mycobacterium leprae
cugggcaccugggcugugcug

SEQ ID NO: 3231594 - RNA, 22 nt, Mycobacterium leprae
cugggcagccgagguucccggc

SEQ ID NO: 3231595 - RNA, 12 nt, Mycobacterium leprae
cugggccagcga

SEQ ID NO: 3231596 - RNA, 15 nt, Mycobacterium leprae
cugggccgggcugcu

SEQ ID NO: 3231597 - RNA, 19 nt, Mycobacterium leprae
cugggcggaugugucagca

SEQ ID NO: 3231598 - RNA, 21 nt, Mycobacterium leprae
cugggcggcuagucggccggc

SEQ ID NO: 3231599 - RNA, 15 nt, Mycobacterium leprae
cuuccaguggcugca

SEQ ID NO: 3231600 - RNA, 20 nt, Mycobacterium leprae
cuuccgauuguccaugccac

SEQ ID NO: 3231601 - RNA, 16 nt, Mycobacterium leprae
cuuccgcuuugccgcu

SEQ ID NO: 3231602 - RNA, 19 nt, Mycobacterium leprae
cuuccgcuuugccgcugug

SEQ ID NO: 3231603 - RNA, 21 nt, Mycobacterium leprae
cuuccggaaaacugccgguag

SEQ ID NO: 3231604 - RNA, 15 nt, Mycobacterium leprae
cuuccguacgccgcu

SEQ ID NO: 3231605 - RNA, 13 nt, Mycobacterium leprae
cuuccugaacaac

SEQ ID NO: 3231606 - RNA, 17 nt, Mycobacterium leprae
cuuccugcuggcccugu

SEQ ID NO: 3231607 - RNA, 12 nt, Mycobacterium leprae
cuucgacggugu

SEQ ID NO: 3231608 - RNA, 21 nt, Mycobacterium leprae
cuucgcagacacagccgucag

SEQ ID NO: 3231609 - RNA, 13 nt, Mycobacterium leprae
cuucgcucagcau

SEQ ID NO: 3231610 - RNA, 15 nt, Mycobacterium leprae
cuucgcugagcgaag

SEQ ID NO: 3231611 - RNA, 18 nt, Mycobacterium leprae
cuucggcacagugccuga

SEQ ID NO: 3231612 - RNA, 18 nt, Mycobacterium leprae
cuucgggcaagugguugg

SEQ ID NO: 3231613 - RNA, 19 nt, Mycobacterium leprae
cuucggucaggucaugcca

SEQ ID NO: 3231614 - RNA, 23 nt, Mycobacterium leprae
cuucggucaugagcgucgcuccu

SEQ ID NO: 3231615 - RNA, 18 nt, Mycobacterium leprae
cuucuaaccggucaauca

SEQ ID NO: 3231616 - RNA, 14 nt, Mycobacterium leprae
cuucuauacuuuaa

SEQ ID NO: 3231617 - RNA, 16 nt, Mycobacterium leprae
cuucuccgggcuggga

SEQ ID NO: 3231618 - RNA, 20 nt, Mycobacterium leprae
cuucuccguucacagugccg

SEQ ID NO: 3231619 - RNA, 21 nt, Mycobacterium leprae
cuucugcgcgcacccaagcca

SEQ ID NO: 3231620 - RNA, 23 nt, Mycobacterium leprae
cuucuggauuuugggugaucaac

SEQ ID NO: 3231621 - RNA, 14 nt, Mycobacterium leprae
cuucuuacacgugc

SEQ ID NO: 3231622 - RNA, 15 nt, Mycobacterium leprae
cuucuucgauuacgu

SEQ ID NO: 3231623 - RNA, 19 nt, Mycobacterium leprae
cuucuuuuaucaagggauu

SEQ ID NO: 3231624 - RNA, 20 nt, Mycobacterium leprae
cuugaagccgccaaaauuuu

SEQ ID NO: 3231625 - RNA, 13 nt, Mycobacterium leprae
cuugaaguguugu

SEQ ID NO: 3231626 - RNA, 18 nt, Mycobacterium leprae
cuugaccaccaccgccac

SEQ ID NO: 3231627 - RNA, 18 nt, Mycobacterium leprae
cuugaccagccgcagcac

SEQ ID NO: 3231628 - RNA, 22 nt, Mycobacterium leprae
cuugaccagugugccugucaca

SEQ ID NO: 3231629 - RNA, 13 nt, Mycobacterium leprae
cuugaccugccgu

SEQ ID NO: 3231630 - RNA, 12 nt, Mycobacterium leprae
cuugaccuggau

SEQ ID NO: 3231631 - RNA, 13 nt, Mycobacterium leprae
cuugaggucgcac

SEQ ID NO: 3231632 - RNA, 20 nt, Mycobacterium leprae
cuugagugcugccagggcuc

SEQ ID NO: 3231633 - RNA, 20 nt, Mycobacterium leprae
cuugauccgagaaaacucga

SEQ ID NO: 3231634 - RNA, 22 nt, Mycobacterium leprae
cuugaugccaaccugcgcggcu

SEQ ID NO: 3231635 - RNA, 20 nt, Mycobacterium leprae
cuugcaccauuucugccgcu

SEQ ID NO: 3231636 - RNA, 19 nt, Mycobacterium leprae
cuugcacugaucgaucugg

SEQ ID NO: 3231637 - RNA, 21 nt, Mycobacterium leprae
cuugcagcgaggccguggccg

SEQ ID NO: 3231638 - RNA, 13 nt, Mycobacterium leprae
cuugcagcuggcg

SEQ ID NO: 3231639 - RNA, 18 nt, Mycobacterium leprae
cuugccaaggucguuagc

SEQ ID NO: 3231640 - RNA, 22 nt, Mycobacterium leprae
cuugccaaggucguuagcgccg

SEQ ID NO: 3231641 - RNA, 17 nt, Mycobacterium leprae
cuugccccguugugguc

SEQ ID NO: 3231642 - RNA, 20 nt, Mycobacterium leprae
cuugcccucguugacgcccu

SEQ ID NO: 3231643 - RNA, 18 nt, Mycobacterium leprae
cuugccgaagccgggacc

SEQ ID NO: 3231644 - RNA, 17 nt, Mycobacterium leprae
cuugccgauauucgcga

SEQ ID NO: 3231645 - RNA, 22 nt, Mycobacterium leprae
cuugccggccuuaaugcaggag

SEQ ID NO: 3231646 - RNA, 16 nt, Mycobacterium leprae
cuugcgcucacccaag

SEQ ID NO: 3231647 - RNA, 14 nt, Mycobacterium leprae
cuugcguagaauua

SEQ ID NO: 3231648 - RNA, 23 nt, Mycobacterium leprae
cuuggaaccaucaacggcuacaa

SEQ ID NO: 3231649 - RNA, 17 nt, Mycobacterium leprae
cuuggccuuguccgcag

SEQ ID NO: 3231650 - RNA, 15 nt, Mycobacterium leprae
cuuggcgcauugguc

SEQ ID NO: 3231651 - RNA, 18 nt, Mycobacterium leprae
cuuggcgcugagcagucc

SEQ ID NO: 3231652 - RNA, 20 nt, Mycobacterium leprae
cuuggcgucgaucagggcgc

SEQ ID NO: 3231653 - RNA, 13 nt, Mycobacterium leprae
cuuggcugacggc

SEQ ID NO: 3231654 - RNA, 18 nt, Mycobacterium leprae
cuuggcugguuaacuuaa

SEQ ID NO: 3231655 - RNA, 13 nt, Mycobacterium leprae
cuuggcuugcugu

SEQ ID NO: 3231656 - RNA, 22 nt, Mycobacterium leprae
cuugggagaccagagauuucgc

SEQ ID NO: 3231657 - RNA, 17 nt, Mycobacterium leprae
cuuggguaacaauccug

SEQ ID NO: 3231658 - RNA, 13 nt, Mycobacterium leprae
cuugggugguggu

SEQ ID NO: 3231659 - RNA, 14 nt, Mycobacterium leprae
cuugggugguggug

SEQ ID NO: 3231660 - RNA, 22 nt, Mycobacterium leprae
cuugguccgacggcuggcugcu

SEQ ID NO: 3231661 - RNA, 16 nt, Mycobacterium leprae
cuuggugcgggcacac

SEQ ID NO: 3231662 - RNA, 23 nt, Mycobacterium leprae
cuuggugcgggcacacagauccu

SEQ ID NO: 3231663 - RNA, 18 nt, Mycobacterium leprae
cuugguugacagcagaau

SEQ ID NO: 3231664 - RNA, 15 nt, Mycobacterium leprae
cuugguuuguaggcc

SEQ ID NO: 3231665 - RNA, 22 nt, Mycobacterium leprae
cuuguacagugaugcggacgac

SEQ ID NO: 3231666 - RNA, 20 nt, Mycobacterium leprae
cuuguaccuucuguauggcu

SEQ ID NO: 3231667 - RNA, 22 nt, Mycobacterium leprae
cuuguagcguucguagagcugc

SEQ ID NO: 3231668 - RNA, 15 nt, Mycobacterium leprae
cuugucaccagauug

SEQ ID NO: 3231669 - RNA, 13 nt, Mycobacterium leprae
cuugucacgccgg

SEQ ID NO: 3231670 - RNA, 11 nt, Mycobacterium leprae
cuugucgggca

SEQ ID NO: 3231671 - RNA, 16 nt, Mycobacterium leprae
cuugucgggcauugcc

SEQ ID NO: 3231672 - RNA, 13 nt, Mycobacterium leprae
cuuguuagccguu

SEQ ID NO: 3231673 - RNA, 16 nt, Mycobacterium leprae
cuuguuaucgaagcuu

SEQ ID NO: 3231674 - RNA, 16 nt, Mycobacterium leprae
cuuguucuuguuggcu

SEQ ID NO: 3231675 - RNA, 12 nt, Mycobacterium leprae
cuuguuggccau

SEQ ID NO: 3231676 - RNA, 22 nt, Mycobacterium leprae
cuuuagcuugguugacagcaga

SEQ ID NO: 3231677 - RNA, 14 nt, Mycobacterium leprae
cuuuauauacuuug

SEQ ID NO: 3231678 - RNA, 15 nt, Mycobacterium leprae
cuuuauucuuuuaga

SEQ ID NO: 3231679 - RNA, 15 nt, Mycobacterium leprae
cuuucacgccaggcg

SEQ ID NO: 3231680 - RNA, 15 nt, Mycobacterium leprae
cuuucacgucggcgu

SEQ ID NO: 3231681 - RNA, 19 nt, Mycobacterium leprae
cuuucacugcgucaaagcu

SEQ ID NO: 3231682 - RNA, 17 nt, Mycobacterium leprae
cuuucagcucgauggug

SEQ ID NO: 3231683 - RNA, 20 nt, Mycobacterium leprae
cuuucgcagaagaccgugcu

SEQ ID NO: 3231684 - RNA, 17 nt, Mycobacterium leprae
cuuucgcggccgcagcg

SEQ ID NO: 3231685 - RNA, 13 nt, Mycobacterium leprae
cuuucggcagcga

SEQ ID NO: 3231686 - RNA, 20 nt, Mycobacterium leprae
cuuucuaguugauaugcguu

SEQ ID NO: 3231687 - RNA, 23 nt, Mycobacterium leprae
cuuucucauuguggcuggcuucc

SEQ ID NO: 3231688 - RNA, 23 nt, Mycobacterium leprae
cuuucuccgggucgcgggacaac

SEQ ID NO: 3231689 - RNA, 17 nt, Mycobacterium leprae
cuuugacgaaaauguuu

SEQ ID NO: 3231690 - RNA, 15 nt, Mycobacterium leprae
cuuugaucagcaagg

SEQ ID NO: 3231691 - RNA, 14 nt, Mycobacterium leprae
cuuugcuggucagc

SEQ ID NO: 3231692 - RNA, 22 nt, Mycobacterium leprae
cuuugcuucacuuagccauguc

SEQ ID NO: 3231693 - RNA, 21 nt, Mycobacterium leprae
cuuuggagcaggagcuguugg

SEQ ID NO: 3231694 - RNA, 23 nt, Mycobacterium leprae
cuuuguacgcguacuccagcagc

SEQ ID NO: 3231695 - RNA, 17 nt, Mycobacterium leprae
cuuugugaacgaucggg

SEQ ID NO: 3231696 - RNA, 15 nt, Mycobacterium leprae
cuuuuaggugugguc

SEQ ID NO: 3231697 - RNA, 14 nt, Mycobacterium leprae
cuuuucgagggcag

SEQ ID NO: 3231698 - RNA, 18 nt, Mycobacterium leprae
cuuuucucaagcgggcaa

SEQ ID NO: 3231699 - RNA, 22 nt, Mycobacterium leprae
cuuuuguccugacagauacuca

SEQ ID NO: 3231700 - RNA, 17 nt, Mycobacterium leprae
gaaaaauccgcgcaaca

SEQ ID NO: 3231701 - RNA, 18 nt, Mycobacterium leprae
gaaaaaugaguugcaaca

SEQ ID NO: 3231702 - RNA, 13 nt, Mycobacterium leprae
gaaaaaugccuau

SEQ ID NO: 3231703 - RNA, 21 nt, Mycobacterium leprae
gaaaacacuuacaccaacaua

SEQ ID NO: 3231704 - RNA, 18 nt, Mycobacterium leprae
gaaaacagcgccucacca

SEQ ID NO: 3231705 - RNA, 23 nt, Mycobacterium leprae
gaaaacccgcgcgugcacaagga

SEQ ID NO: 3231706 - RNA, 14 nt, Mycobacterium leprae
gaaaaccgucgcgg

SEQ ID NO: 3231707 - RNA, 16 nt, Mycobacterium leprae
gaaaaccguguagugc

SEQ ID NO: 3231708 - RNA, 14 nt, Mycobacterium leprae
gaaaacuuaauauc

SEQ ID NO: 3231709 - RNA, 22 nt, Mycobacterium leprae
gaaaauccaagucuuucagaua

SEQ ID NO: 3231710 - RNA, 21 nt, Mycobacterium leprae
gaaaccaugccgccgaagccg

SEQ ID NO: 3231711 - RNA, 17 nt, Mycobacterium leprae
gaaacccgaaaccaagc

SEQ ID NO: 3231712 - RNA, 16 nt, Mycobacterium leprae
gaaucguuccacccga

SEQ ID NO: 3231713 - RNA, 23 nt, Mycobacterium leprae
gaaucguugacguggacuucugc

SEQ ID NO: 3231714 - RNA, 15 nt, Mycobacterium leprae
gaaucugugccuggu

SEQ ID NO: 3231715 - RNA, 20 nt, Mycobacterium leprae
gaaugcgaugcuggccgugu

SEQ ID NO: 3231716 - RNA, 18 nt, Mycobacterium leprae
gaauggucauuggaaagg

SEQ ID NO: 3231717 - RNA, 18 nt, Mycobacterium leprae
gaauggucauuggaagcu

SEQ ID NO: 3231718 - RNA, 14 nt, Mycobacterium leprae
gaauguccaccagc

SEQ ID NO: 3231719 - RNA, 23 nt, Mycobacterium leprae
gaauguccaccagccgcaggcac

SEQ ID NO: 3231720 - RNA, 18 nt, Mycobacterium leprae
gaauguuguuagugcugc

SEQ ID NO: 3231721 - RNA, 17 nt, Mycobacterium leprae
gaauucagagcugcagg

SEQ ID NO: 3231722 - RNA, 19 nt, Mycobacterium leprae
gaauucagccgugcccaag

SEQ ID NO: 3231723 - RNA, 19 nt, Mycobacterium leprae
gaauucguggugguggcca

SEQ ID NO: 3231724 - RNA, 20 nt, Mycobacterium leprae
gaauucguggugguggccac

SEQ ID NO: 3231725 - RNA, 15 nt, Mycobacterium leprae
gaauucuauaucuau

SEQ ID NO: 3231726 - RNA, 19 nt, Mycobacterium leprae
gaauugaccgacggcgccg

SEQ ID NO: 3231727 - RNA, 18 nt, Mycobacterium leprae
gaauuuagaggcugcacc

SEQ ID NO: 3231728 - RNA, 14 nt, Mycobacterium leprae
gacaaaaacaggcc

SEQ ID NO: 3231729 - RNA, 19 nt, Mycobacterium leprae
gacaaaauuuucaggcugu

SEQ ID NO: 3231730 - RNA, 18 nt, Mycobacterium leprae
gacaaaccaggcgacacg

SEQ ID NO: 3231731 - RNA, 14 nt, Mycobacterium leprae
gacaaagaaaaaga

SEQ ID NO: 3231732 - RNA, 21 nt, Mycobacterium leprae
gacaaagaaaaagagcccggc

SEQ ID NO: 3231733 - RNA, 18 nt, Mycobacterium leprae
gacaaagagaacuucuuc

SEQ ID NO: 3231734 - RNA, 21 nt, Mycobacterium leprae
gacaaagcagcauauggaaag

SEQ ID NO: 3231735 - RNA, 14 nt, Mycobacterium leprae
gacaaaggacuuga

SEQ ID NO: 3231736 - RNA, 21 nt, Mycobacterium leprae
gacaacacguuucugcaugca

SEQ ID NO: 3231737 - RNA, 16 nt, Mycobacterium leprae
gacaacccgacggcac

SEQ ID NO: 3231738 - RNA, 14 nt, Mycobacterium leprae
gacaaccguucgag

SEQ ID NO: 3231739 - RNA, 20 nt, Mycobacterium leprae
gacaaccucguuacgaucca

SEQ ID NO: 3231740 - RNA, 15 nt, Mycobacterium leprae
gacaacgauccggaa

SEQ ID NO: 3231741 - RNA, 16 nt, Mycobacterium leprae
gacaacggugccgggu

SEQ ID NO: 3231742 - RNA, 12 nt, Mycobacterium leprae
gacaagagugaa

SEQ ID NO: 3231743 - RNA, 14 nt, Mycobacterium leprae
gacaagagugaaag

SEQ ID NO: 3231744 - RNA, 18 nt, Mycobacterium leprae
gacaagagugaaaguagg

SEQ ID NO: 3231745 - RNA, 17 nt, Mycobacterium leprae
gacaagaucgaggccag

SEQ ID NO: 3231746 - RNA, 18 nt, Mycobacterium leprae
gacaagcagugucugggc

SEQ ID NO: 3231747 - RNA, 15 nt, Mycobacterium leprae
gacaagucaaaacca

SEQ ID NO: 3231748 - RNA, 13 nt, Mycobacterium leprae
gacaaguucgucu

SEQ ID NO: 3231749 - RNA, 16 nt, Mycobacterium leprae
gacaauucaacgaaua

SEQ ID NO: 3231750 - RNA, 12 nt, Mycobacterium leprae
gacacaaagaag

SEQ ID NO: 3231751 - RNA, 22 nt, Mycobacterium leprae
gacacaaccagcuugggagcau

SEQ ID NO: 3231752 - RNA, 20 nt, Mycobacterium leprae
gacacagaacgguucaacgg

SEQ ID NO: 3231753 - RNA, 13 nt, Mycobacterium leprae
gacacagccggcc

SEQ ID NO: 3231754 - RNA, 22 nt, Mycobacterium leprae
gacacagccgucagggcagcag

SEQ ID NO: 3231755 - RNA, 23 nt, Mycobacterium leprae
gacacagccgucagggcagcagg

SEQ ID NO: 3231756 - RNA, 12 nt, Mycobacterium leprae
gacaccacugcc

SEQ ID NO: 3231757 - RNA, 23 nt, Mycobacterium leprae
gacaccagcgacgaaauccucac

SEQ ID NO: 3231758 - RNA, 12 nt, Mycobacterium leprae
gacaccgaacag

SEQ ID NO: 3231759 - RNA, 14 nt, Mycobacterium leprae
gacaccgcagggcu

SEQ ID NO: 3231760 - RNA, 12 nt, Mycobacterium leprae
gacaccgcccgg

SEQ ID NO: 3231761 - RNA, 16 nt, Mycobacterium leprae
gacaccgcccgguauc

SEQ ID NO: 3231762 - RNA, 21 nt, Mycobacterium leprae
gacaccgcccgguaucccaau

SEQ ID NO: 3231763 - RNA, 12 nt, Mycobacterium leprae
gacacgacagcc

SEQ ID NO: 3231764 - RNA, 13 nt, Mycobacterium leprae
gacacgagcggcc

SEQ ID NO: 3231765 - RNA, 17 nt, Mycobacterium leprae
gacacgauuagcgcggc

SEQ ID NO: 3231766 - RNA, 18 nt, Mycobacterium leprae
gacacggcguggauggcu

SEQ ID NO: 3231767 - RNA, 16 nt, Mycobacterium leprae
gacacuacuguuguca

SEQ ID NO: 3231768 - RNA, 20 nt, Mycobacterium leprae
gacacuagcuccuuaaugaa

SEQ ID NO: 3231769 - RNA, 15 nt, Mycobacterium leprae
gacagaagcaagucc

SEQ ID NO: 3231770 - RNA, 19 nt, Mycobacterium leprae
gacagaauaguuuccggac

SEQ ID NO: 3231771 - RNA, 23 nt, Mycobacterium leprae
gacagaugcgaucgcagucauca

SEQ ID NO: 3231772 - RNA, 16 nt, Mycobacterium leprae
gacagcaagacggggg

SEQ ID NO: 3231773 - RNA, 14 nt, Mycobacterium leprae
gacagcagguagac

SEQ ID NO: 3231774 - RNA, 17 nt, Mycobacterium leprae
gacagcgaugacaugga

SEQ ID NO: 3231775 - RNA, 20 nt, Mycobacterium leprae
gacagcggccaccagggcgu

SEQ ID NO: 3231776 - RNA, 18 nt, Mycobacterium leprae
gacagcuaagccugcacu

SEQ ID NO: 3231777 - RNA, 17 nt, Mycobacterium leprae
gacaggcaaccgcccgc

SEQ ID NO: 3231778 - RNA, 22 nt, Mycobacterium leprae
gacaggcgcggucgucaagugc

SEQ ID NO: 3231779 - RNA, 18 nt, Mycobacterium leprae
gacagguugaaaaagaaa

SEQ ID NO: 3231780 - RNA, 16 nt, Mycobacterium leprae
gacaguaucgaccagc

SEQ ID NO: 3231781 - RNA, 16 nt, Mycobacterium leprae
gacauacaggacgauc

SEQ ID NO: 3231782 - RNA, 23 nt, Mycobacterium leprae
gacauauuugggagccagggcag

SEQ ID NO: 3231783 - RNA, 18 nt, Mycobacterium leprae
gacaucacuugcugaccg

SEQ ID NO: 3231784 - RNA, 18 nt, Mycobacterium leprae
gacaucagucagcaucgg

SEQ ID NO: 3231785 - RNA, 16 nt, Mycobacterium leprae
gacauccccgaaagga

SEQ ID NO: 3231786 - RNA, 14 nt, Mycobacterium leprae
gacaucgccaccga

SEQ ID NO: 3231787 - RNA, 18 nt, Mycobacterium leprae
gacaucgccaccgaccgc

SEQ ID NO: 3231788 - RNA, 22 nt, Mycobacterium leprae
gacaucggcuacggcaaccgca

SEQ ID NO: 3231789 - RNA, 21 nt, Mycobacterium leprae
gacaugacgcucgaggaagcg

SEQ ID NO: 3231790 - RNA, 14 nt, Mycobacterium leprae
gacauguucacagg

SEQ ID NO: 3231791 - RNA, 13 nt, Mycobacterium leprae
gaccaacccggcg

SEQ ID NO: 3231792 - RNA, 23 nt, Mycobacterium leprae
gaccaacccggcgauugccacca

SEQ ID NO: 3231793 - RNA, 16 nt, Mycobacterium leprae
gaccaagcagcaucca

SEQ ID NO: 3231794 - RNA, 18 nt, Mycobacterium leprae
gaccaagcagcauccacc

SEQ ID NO: 3231795 - RNA, 15 nt, Mycobacterium leprae
gaccacacugugccu

SEQ ID NO: 3231796 - RNA, 12 nt, Mycobacterium leprae
gaccaccaccgc

SEQ ID NO: 3231797 - RNA, 14 nt, Mycobacterium leprae
gaccaccaccgcca

SEQ ID NO: 3231798 - RNA, 14 nt, Mycobacterium leprae
gaccacccacaacg

SEQ ID NO: 3231799 - RNA, 19 nt, Mycobacterium leprae
gaccacccacaacgccaaa

SEQ ID NO: 3231800 - RNA, 22 nt, Mycobacterium leprae
gaccaccgaaccgggcagcgcc

SEQ ID NO: 3231801 - RNA, 18 nt, Mycobacterium leprae
gaccacgccgacaccuca

SEQ ID NO: 3231802 - RNA, 19 nt, Mycobacterium leprae
gaccacggcagcgucacca

SEQ ID NO: 3231803 - RNA, 21 nt, Mycobacterium leprae
gaccacggcagcgucaccaag

SEQ ID NO: 3231804 - RNA, 18 nt, Mycobacterium leprae
gaccacuauuucaaagcg

SEQ ID NO: 3231805 - RNA, 22 nt, Mycobacterium leprae
gaccagagauuucgcaggcugu

SEQ ID NO: 3231806 - RNA, 16 nt, Mycobacterium leprae
gaccagaugaacagcc

SEQ ID NO: 3231807 - RNA, 15 nt, Mycobacterium leprae
gaccagccaagccgc

SEQ ID NO: 3231808 - RNA, 14 nt, Mycobacterium leprae
gaccagccacgcaa

SEQ ID NO: 3231809 - RNA, 13 nt, Mycobacterium leprae
gaccagccgcagc

SEQ ID NO: 3231810 - RNA, 21 nt, Mycobacterium leprae
gaccagcgcauguuaaaauaa

SEQ ID NO: 3231811 - RNA, 20 nt, Mycobacterium leprae
gaccaggcaaugugugccgu

SEQ ID NO: 3231812 - RNA, 16 nt, Mycobacterium leprae
gaccagggguguugca

SEQ ID NO: 3231813 - RNA, 15 nt, Mycobacterium leprae
gaccaguucgacugg

SEQ ID NO: 3231814 - RNA, 16 nt, Mycobacterium leprae
gaccaucuggcgacuc

SEQ ID NO: 3231815 - RNA, 18 nt, Mycobacterium leprae
gaccaugugaccgcggug

SEQ ID NO: 3231816 - RNA, 15 nt, Mycobacterium leprae
gaccauucagugcgu

SEQ ID NO: 3231817 - RNA, 18 nt, Mycobacterium leprae
gacccacugggcaagcag

SEQ ID NO: 3231818 - RNA, 13 nt, Mycobacterium leprae
gacccagccgucg

SEQ ID NO: 3231819 - RNA, 21 nt, Mycobacterium leprae
gacccagcgauaucaagcugc

SEQ ID NO: 3231820 - RNA, 14 nt, Mycobacterium leprae
gaccccaaccagac

SEQ ID NO: 3231821 - RNA, 18 nt, Mycobacterium leprae
gaccccaaccagacccac

SEQ ID NO: 3231822 - RNA, 11 nt, Mycobacterium leprae
gacccccggau

SEQ ID NO: 3231823 - RNA, 16 nt, Mycobacterium leprae
gacccgcgguagcgga

SEQ ID NO: 3231824 - RNA, 21 nt, Mycobacterium leprae
gacccgugcuuaccucagugu

SEQ ID NO: 3231825 - RNA, 20 nt, Mycobacterium leprae
gacuugccgaagccgggacc

SEQ ID NO: 3231826 - RNA, 12 nt, Mycobacterium leprae
gacuugcgggua

SEQ ID NO: 3231827 - RNA, 23 nt, Mycobacterium leprae
gacuuuagcaacgacgccacagc

SEQ ID NO: 3231828 - RNA, 18 nt, Mycobacterium leprae
gagaaagucacuuacgac

SEQ ID NO: 3231829 - RNA, 14 nt, Mycobacterium leprae
gagaaauuaucguu

SEQ ID NO: 3231830 - RNA, 15 nt, Mycobacterium leprae
gagaagaauuaauau

SEQ ID NO: 3231831 - RNA, 20 nt, Mycobacterium leprae
gagaagcgcugcagcgauac

SEQ ID NO: 3231832 - RNA, 21 nt, Mycobacterium leprae
gagaagggagugcagugcccg

SEQ ID NO: 3231833 - RNA, 14 nt, Mycobacterium leprae
gagaauaauggugg

SEQ ID NO: 3231834 - RNA, 12 nt, Mycobacterium leprae
gagaauuuaccg

SEQ ID NO: 3231835 - RNA, 16 nt, Mycobacterium leprae
gagacaccguccucgg

SEQ ID NO: 3231836 - RNA, 13 nt, Mycobacterium leprae
gagacaucgccac

SEQ ID NO: 3231837 - RNA, 17 nt, Mycobacterium leprae
gagacgaaugcugacca

SEQ ID NO: 3231838 - RNA, 14 nt, Mycobacterium leprae
gagacgggugcucg

SEQ ID NO: 3231839 - RNA, 19 nt, Mycobacterium leprae
gagacgguguugcugagug

SEQ ID NO: 3231840 - RNA, 20 nt, Mycobacterium leprae
gagacgguguugcugagugu

SEQ ID NO: 3231841 - RNA, 15 nt, Mycobacterium leprae
gagacguaccacuca

SEQ ID NO: 3231842 - RNA, 20 nt, Mycobacterium leprae
gagacgugucucuucgcugu

SEQ ID NO: 3231843 - RNA, 15 nt, Mycobacterium leprae
gagacguugcuggga

SEQ ID NO: 3231844 - RNA, 21 nt, Mycobacterium leprae
gagagacgucgaugucagcgu

SEQ ID NO: 3231845 - RNA, 11 nt, Mycobacterium leprae
gagagcaaucc

SEQ ID NO: 3231846 - RNA, 17 nt, Mycobacterium leprae
gagagcagauggaaggc

SEQ ID NO: 3231847 - RNA, 19 nt, Mycobacterium leprae
gagagcauggacccacugg

SEQ ID NO: 3231848 - RNA, 15 nt, Mycobacterium leprae
gagagccacuucaga

SEQ ID NO: 3231849 - RNA, 12 nt, Mycobacterium leprae
gagagccgagcg

SEQ ID NO: 3231850 - RNA, 12 nt, Mycobacterium leprae
gagagcgccgcu

SEQ ID NO: 3231851 - RNA, 18 nt, Mycobacterium leprae
gagagguuuuccacugca

SEQ ID NO: 3231852 - RNA, 16 nt, Mycobacterium leprae
gagagugccaccgcug

SEQ ID NO: 3231853 - RNA, 13 nt, Mycobacterium leprae
gagagugcggugc

SEQ ID NO: 3231854 - RNA, 18 nt, Mycobacterium leprae
gagauaaccuuugcccug

SEQ ID NO: 3231855 - RNA, 19 nt, Mycobacterium leprae
gagauagacaugugugcug

SEQ ID NO: 3231856 - RNA, 20 nt, Mycobacterium leprae
gagauagacaugugugcugg

SEQ ID NO: 3231857 - RNA, 21 nt, Mycobacterium leprae
gagauagcggcgguaaacaga

SEQ ID NO: 3231858 - RNA, 18 nt, Mycobacterium leprae
gagaucacaguccugccc

SEQ ID NO: 3231859 - RNA, 17 nt, Mycobacterium leprae
gagaucguccucaugcc

SEQ ID NO: 3231860 - RNA, 21 nt, Mycobacterium leprae
gagaucguccucaugcccaug

SEQ ID NO: 3231861 - RNA, 17 nt, Mycobacterium leprae
gagauggucacauucca

SEQ ID NO: 3231862 - RNA, 15 nt, Mycobacterium leprae
gagaugucuucgacg

SEQ ID NO: 3231863 - RNA, 18 nt, Mycobacterium leprae
gagcaacguacugcaaug

SEQ ID NO: 3231864 - RNA, 23 nt, Mycobacterium leprae
gagcaagcaacgaagggaaugcg

SEQ ID NO: 3231865 - RNA, 14 nt, Mycobacterium leprae
gagcaaggugguga

SEQ ID NO: 3231866 - RNA, 16 nt, Mycobacterium leprae
gagcaauccucagagu

SEQ ID NO: 3231867 - RNA, 22 nt, Mycobacterium leprae
gagcaauccucagagugugugu

SEQ ID NO: 3231868 - RNA, 14 nt, Mycobacterium leprae
gagcaccucagcaa

SEQ ID NO: 3231869 - RNA, 22 nt, Mycobacterium leprae
gagcacuugcagcacucauugc

SEQ ID NO: 3231870 - RNA, 20 nt, Mycobacterium leprae
gagcagccacccgcaucguu

SEQ ID NO: 3231871 - RNA, 17 nt, Mycobacterium leprae
gagcaugaccgagcugg

SEQ ID NO: 3231872 - RNA, 20 nt, Mycobacterium leprae
gagcauggacccacugggca

SEQ ID NO: 3231873 - RNA, 18 nt, Mycobacterium leprae
gagccaacgauacugaug

SEQ ID NO: 3231874 - RNA, 20 nt, Mycobacterium leprae
gagccacauuugacgccaau

SEQ ID NO: 3231875 - RNA, 23 nt, Mycobacterium leprae
gagccacgcuggcacuccgaccg

SEQ ID NO: 3231876 - RNA, 21 nt, Mycobacterium leprae
gagcccgacgcaacugcugga

SEQ ID NO: 3231877 - RNA, 20 nt, Mycobacterium leprae
gagcccggaaauaguggcug

SEQ ID NO: 3231878 - RNA, 21 nt, Mycobacterium leprae
gagccgacaaucgagcacggc

SEQ ID NO: 3231879 - RNA, 19 nt, Mycobacterium leprae
gagccgauuaccaucugcc

SEQ ID NO: 3231880 - RNA, 22 nt, Mycobacterium leprae
gagccgcauagcgcuaaaugga

SEQ ID NO: 3231881 - RNA, 15 nt, Mycobacterium leprae
gagccgccagacugg

SEQ ID NO: 3231882 - RNA, 21 nt, Mycobacterium leprae
gagccggucgaucgcagccgc

SEQ ID NO: 3231883 - RNA, 17 nt, Mycobacterium leprae
gagccggucggcggcgc

SEQ ID NO: 3231884 - RNA, 23 nt, Mycobacterium leprae
gagcgauacacagccguugcugc

SEQ ID NO: 3231885 - RNA, 15 nt, Mycobacterium leprae
gagcgcagccaccac

SEQ ID NO: 3231886 - RNA, 18 nt, Mycobacterium leprae
gagcgcaucggcggcgga

SEQ ID NO: 3231887 - RNA, 21 nt, Mycobacterium leprae
gagcgcccaagugaugucuuu

SEQ ID NO: 3231888 - RNA, 13 nt, Mycobacterium leprae
gagcgcccgcaca

SEQ ID NO: 3231889 - RNA, 17 nt, Mycobacterium leprae
gagcgcccgcacagcac

SEQ ID NO: 3231890 - RNA, 19 nt, Mycobacterium leprae
gagcgcccgcacagcacca

SEQ ID NO: 3231891 - RNA, 15 nt, Mycobacterium leprae
gagcgcuauuaaguc

SEQ ID NO: 3231892 - RNA, 16 nt, Mycobacterium leprae
gagcggagcugggcga

SEQ ID NO: 3231893 - RNA, 14 nt, Mycobacterium leprae
gagcgggcggcagc

SEQ ID NO: 3231894 - RNA, 22 nt, Mycobacterium leprae
gagcggugguacaaucccacca

SEQ ID NO: 3231895 - RNA, 15 nt, Mycobacterium leprae
gagcgguucaucgac

SEQ ID NO: 3231896 - RNA, 16 nt, Mycobacterium leprae
gagcgucgugaccgcg

SEQ ID NO: 3231897 - RNA, 20 nt, Mycobacterium leprae
gagcgucgugaccgcggggc

SEQ ID NO: 3231898 - RNA, 19 nt, Mycobacterium leprae
gagcgugacgacaugacgc

SEQ ID NO: 3231899 - RNA, 24 nt, Mycobacterium leprae
gagcguucgauaacaguggucugg

SEQ ID NO: 3231900 - RNA, 23 nt, Mycobacterium leprae
gagcuccauuuuucuugaaaaau

SEQ ID NO: 3231901 - RNA, 18 nt, Mycobacterium leprae
gagcugaacaggcgccug

SEQ ID NO: 3231902 - RNA, 17 nt, Mycobacterium leprae
gagcugcaggucaggau

SEQ ID NO: 3231903 - RNA, 14 nt, Mycobacterium leprae
gagcuggggcggcc

SEQ ID NO: 3231904 - RNA, 20 nt, Mycobacterium leprae
gaggaacgacuugaccagcc

SEQ ID NO: 3231905 - RNA, 17 nt, Mycobacterium leprae
gaggaccaccugguaga

SEQ ID NO: 3231906 - RNA, 14 nt, Mycobacterium leprae
gaggacgggcggcc

SEQ ID NO: 3231907 - RNA, 15 nt, Mycobacterium leprae
gaggcaaagugcggu

SEQ ID NO: 3231908 - RNA, 21 nt, Mycobacterium leprae
gaggcagcagcucgacgggcg

SEQ ID NO: 3231909 - RNA, 15 nt, Mycobacterium leprae
gaggcagggcugggg

SEQ ID NO: 3231910 - RNA, 16 nt, Mycobacterium leprae
gaggcaugggugcguu

SEQ ID NO: 3231911 - RNA, 14 nt, Mycobacterium leprae
gaggccaaucgcaa

SEQ ID NO: 3231912 - RNA, 14 nt, Mycobacterium leprae
gaggccuugggugg

SEQ ID NO: 3231913 - RNA, 20 nt, Mycobacterium leprae
gaggccuugggugguggugu

SEQ ID NO: 3231914 - RNA, 13 nt, Mycobacterium leprae
gaggcggugaccg

SEQ ID NO: 3231915 - RNA, 14 nt, Mycobacterium leprae
gaggcggugaccga

SEQ ID NO: 3231916 - RNA, 14 nt, Mycobacterium leprae
gaggcucugcucgg

SEQ ID NO: 3231917 - RNA, 18 nt, Mycobacterium leprae
gagggacgcaaaggccaa

SEQ ID NO: 3231918 - RNA, 15 nt, Mycobacterium leprae
gaggggaccgcgucg

SEQ ID NO: 3231919 - RNA, 21 nt, Mycobacterium leprae
gaggggucuggucuggcgggu

SEQ ID NO: 3231920 - RNA, 16 nt, Mycobacterium leprae
gaggguacgagugguu

SEQ ID NO: 3231921 - RNA, 22 nt, Mycobacterium leprae
gaggguccggaccuggacccac

SEQ ID NO: 3231922 - RNA, 17 nt, Mycobacterium leprae
gaggucgaagcugcccu

SEQ ID NO: 3231923 - RNA, 13 nt, Mycobacterium leprae
gaggucgcacagc

SEQ ID NO: 3231924 - RNA, 17 nt, Mycobacterium leprae
gaggucgcacagcaggu

SEQ ID NO: 3231925 - RNA, 22 nt, Mycobacterium leprae
gaggugcagacuuugagcuguu

SEQ ID NO: 3231926 - RNA, 21 nt, Mycobacterium leprae
gaggugcaggagcgugggucg

SEQ ID NO: 3231927 - RNA, 19 nt, Mycobacterium leprae
gagguggccuagucgggca

SEQ ID NO: 3231928 - RNA, 16 nt, Mycobacterium leprae
gaggugucggcguggu

SEQ ID NO: 3231929 - RNA, 21 nt, Mycobacterium leprae
gagguguugggagcgaagaca

SEQ ID NO: 3231930 - RNA, 16 nt, Mycobacterium leprae
gaguaaugcaggugac

SEQ ID NO: 3231931 - RNA, 20 nt, Mycobacterium leprae
gaguacaccaagaacuucaa

SEQ ID NO: 3231932 - RNA, 18 nt, Mycobacterium leprae
gaguacguccgcgccggc

SEQ ID NO: 3231933 - RNA, 22 nt, Mycobacterium leprae
gaguagaugcaacugagcgcgu

SEQ ID NO: 3231934 - RNA, 23 nt, Mycobacterium leprae
gaguaucgaaucggugaucaacg

SEQ ID NO: 3231935 - RNA, 15 nt, Mycobacterium leprae
gaguaucugugggca

SEQ ID NO: 3231936 - RNA, 20 nt, Mycobacterium leprae
gaguccgcuaaggcagcccg

SEQ ID NO: 3231937 - RNA, 19 nt, Mycobacterium leprae
gaguccggcgccaacugga

SEQ ID NO: 3231938 - RNA, 15 nt, Mycobacterium leprae
gaugacaguaaguag

SEQ ID NO: 3231939 - RNA, 18 nt, Mycobacterium leprae
gaugaccauaaugcagcg

SEQ ID NO: 3231940 - RNA, 22 nt, Mycobacterium leprae
gaugaccauguacgcgacagcu

SEQ ID NO: 3231941 - RNA, 14 nt, Mycobacterium leprae
gaugacucggcgug

SEQ ID NO: 3231942 - RNA, 15 nt, Mycobacterium leprae
gaugacucggcgugc

SEQ ID NO: 3231943 - RNA, 17 nt, Mycobacterium leprae
gaugagauucgagcggg

SEQ ID NO: 3231944 - RNA, 19 nt, Mycobacterium leprae
gaugagauucgagcgggca

SEQ ID NO: 3231945 - RNA, 20 nt, Mycobacterium leprae
gaugaguaucugugggcagu

SEQ ID NO: 3231946 - RNA, 17 nt, Mycobacterium leprae
gaugauccacucgccgc

SEQ ID NO: 3231947 - RNA, 18 nt, Mycobacterium leprae
gaugaucggcaaaauuuu

SEQ ID NO: 3231948 - RNA, 16 nt, Mycobacterium leprae
gaugaucuuggcccgg

SEQ ID NO: 3231949 - RNA, 14 nt, Mycobacterium leprae
gaugaugaaaaaug

SEQ ID NO: 3231950 - RNA, 17 nt, Mycobacterium leprae
gaugaugccaggggcug

SEQ ID NO: 3231951 - RNA, 13 nt, Mycobacterium leprae
gaugaugcgaacg

SEQ ID NO: 3231952 - RNA, 20 nt, Mycobacterium leprae
gaugauuacaucauccgccc

SEQ ID NO: 3231953 - RNA, 22 nt, Mycobacterium leprae
gaugauuggccauuguugugcu

SEQ ID NO: 3231954 - RNA, 16 nt, Mycobacterium leprae
gaugauuucgccguaa

SEQ ID NO: 3231955 - RNA, 17 nt, Mycobacterium leprae
gaugcacgcgcgccugg

SEQ ID NO: 3231956 - RNA, 19 nt, Mycobacterium leprae
gaugcagcuggugguccug

SEQ ID NO: 3231957 - RNA, 16 nt, Mycobacterium leprae
gaugcaggcgugggug

SEQ ID NO: 3231958 - RNA, 17 nt, Mycobacterium leprae
gaugcaggcgugggugu

SEQ ID NO: 3231959 - RNA, 22 nt, Mycobacterium leprae
gaugccaaccugcgcggcugcc

SEQ ID NO: 3231960 - RNA, 13 nt, Mycobacterium leprae
gaugcccaucaug

SEQ ID NO: 3231961 - RNA, 17 nt, Mycobacterium leprae
gaugccccaucucaucu

SEQ ID NO: 3231962 - RNA, 19 nt, Mycobacterium leprae
gaugccgggaagcgaccgg

SEQ ID NO: 3231963 - RNA, 14 nt, Mycobacterium leprae
gaugccuuacaaug

SEQ ID NO: 3231964 - RNA, 21 nt, Mycobacterium leprae
gaugcgaugagauucgagcgg

SEQ ID NO: 3231965 - RNA, 19 nt, Mycobacterium leprae
gaugcggucaugcgucugu

SEQ ID NO: 3231966 - RNA, 15 nt, Mycobacterium leprae
gaugcuaucgccggu

SEQ ID NO: 3231967 - RNA, 19 nt, Mycobacterium leprae
gaugcuaucgccgguggcu

SEQ ID NO: 3231968 - RNA, 15 nt, Mycobacterium leprae
gaugcugcguucagc

SEQ ID NO: 3231969 - RNA, 20 nt, Mycobacterium leprae
gaugcuggccguguugcugc

SEQ ID NO: 3231970 - RNA, 21 nt, Mycobacterium leprae
gaugcuggccguguugcugcu

SEQ ID NO: 3231971 - RNA, 15 nt, Mycobacterium leprae
gaugcugggucagca

SEQ ID NO: 3231972 - RNA, 23 nt, Mycobacterium leprae
gaugcuguggugugcguugccug

SEQ ID NO: 3231973 - RNA, 17 nt, Mycobacterium leprae
gaugcugugucgguugc

SEQ ID NO: 3231974 - RNA, 22 nt, Mycobacterium leprae
gaugcuguguggcuguuucugc

SEQ ID NO: 3231975 - RNA, 16 nt, Mycobacterium leprae
gauggaguuuuuguuu

SEQ ID NO: 3231976 - RNA, 20 nt, Mycobacterium leprae
gauggccuaaacuccgggcc

SEQ ID NO: 3231977 - RNA, 19 nt, Mycobacterium leprae
gauggccuauaucgcggcg

SEQ ID NO: 3231978 - RNA, 15 nt, Mycobacterium leprae
gauggccugcuggcc

SEQ ID NO: 3231979 - RNA, 16 nt, Mycobacterium leprae
gauggccugcuggccg

SEQ ID NO: 3231980 - RNA, 19 nt, Mycobacterium leprae
gauggcgucaccgugcagc

SEQ ID NO: 3231981 - RNA, 20 nt, Mycobacterium leprae
gauggcgucuugaucgaccu

SEQ ID NO: 3231982 - RNA, 16 nt, Mycobacterium leprae
gauggcugggagggcu

SEQ ID NO: 3231983 - RNA, 17 nt, Mycobacterium leprae
gaugggguuguggaccg

SEQ ID NO: 3231984 - RNA, 22 nt, Mycobacterium leprae
gauggugucgaugaugcgcugu

SEQ ID NO: 3231985 - RNA, 16 nt, Mycobacterium leprae
gaugguuuccagggcg

SEQ ID NO: 3231986 - RNA, 12 nt, Mycobacterium leprae
gauguaaagcag

SEQ ID NO: 3231987 - RNA, 21 nt, Mycobacterium leprae
gauguaaucgcgugccagcgc

SEQ ID NO: 3231988 - RNA, 23 nt, Mycobacterium leprae
gauguaaucgcgugccagcgcug

SEQ ID NO: 3231989 - RNA, 17 nt, Mycobacterium leprae
gauguagccaacagcca

SEQ ID NO: 3231990 - RNA, 14 nt, Mycobacterium leprae
gaugucgagaucau

SEQ ID NO: 3231991 - RNA, 14 nt, Mycobacterium leprae
gaugugcagcagcu

SEQ ID NO: 3231992 - RNA, 22 nt, Mycobacterium leprae
gauguggccgcacgggauggcc

SEQ ID NO: 3231993 - RNA, 17 nt, Mycobacterium leprae
gaugugucagcaccggc

SEQ ID NO: 3231994 - RNA, 15 nt, Mycobacterium leprae
gauguuauguagcug

SEQ ID NO: 3231995 - RNA, 14 nt, Mycobacterium leprae
gauguuuuggaccg

SEQ ID NO: 3231996 - RNA, 23 nt, Mycobacterium leprae
gauuaccggcugcgccguucguc

SEQ ID NO: 3231997 - RNA, 19 nt, Mycobacterium leprae
gauuagcuugaaggcagcg

SEQ ID NO: 3231998 - RNA, 19 nt, Mycobacterium leprae
gauucaaaggucgacacuc

SEQ ID NO: 3231999 - RNA, 16 nt, Mycobacterium leprae
gauuccaaugucccac

SEQ ID NO: 3232000 - RNA, 16 nt, Mycobacterium leprae
gauuccacugccagag

SEQ ID NO: 3232001 - RNA, 17 nt, Mycobacterium leprae
gauuccagcaauuguuc

SEQ ID NO: 3232002 - RNA, 18 nt, Mycobacterium leprae
gauuccagcuuggcacgc

SEQ ID NO: 3232003 - RNA, 17 nt, Mycobacterium leprae
gauuccgccgucgaucu

SEQ ID NO: 3232004 - RNA, 15 nt, Mycobacterium leprae
gauucgagcgggcaa

SEQ ID NO: 3232005 - RNA, 18 nt, Mycobacterium leprae
gauucgguggcgaucggc

SEQ ID NO: 3232006 - RNA, 20 nt, Mycobacterium leprae
gauucuaggcggugacugaa

SEQ ID NO: 3232007 - RNA, 14 nt, Mycobacterium leprae
gauucucgagcggc

SEQ ID NO: 3232008 - RNA, 14 nt, Mycobacterium leprae
gauugaucggugac

SEQ ID NO: 3232009 - RNA, 22 nt, Mycobacterium leprae
gauugcagauguugcagcaguu

SEQ ID NO: 3232010 - RNA, 22 nt, Mycobacterium leprae
gauuggaaaagauuuucucggu

SEQ ID NO: 3232011 - RNA, 17 nt, Mycobacterium leprae
gauugggcauccugcug

SEQ ID NO: 3232012 - RNA, 23 nt, Mycobacterium leprae
gauugggucagucagcgugccug

SEQ ID NO: 3232013 - RNA, 14 nt, Mycobacterium leprae
gauuuaagcaggcu

SEQ ID NO: 3232014 - RNA, 19 nt, Mycobacterium leprae
gauuuaauuacaucggccc

SEQ ID NO: 3232015 - RNA, 21 nt, Mycobacterium leprae
gauuuaccacucgucuuuccg

SEQ ID NO: 3232016 - RNA, 18 nt, Mycobacterium leprae
gauuucaucugccaggcg

SEQ ID NO: 3232017 - RNA, 15 nt, Mycobacterium leprae
gauuucgcaggcugu

SEQ ID NO: 3232018 - RNA, 17 nt, Mycobacterium leprae
gauuugaacugggacca

SEQ ID NO: 3232019 - RNA, 15 nt, Mycobacterium leprae
gauuugaacuuggca

SEQ ID NO: 3232020 - RNA, 17 nt, Mycobacterium leprae
gauuuucuugccgucga

SEQ ID NO: 3232021 - RNA, 13 nt, Mycobacterium leprae
gauuuugggugau

SEQ ID NO: 3232022 - RNA, 20 nt, Mycobacterium leprae
gcaaaaaauagcugccaagc

SEQ ID NO: 3232023 - RNA, 19 nt, Mycobacterium leprae
gcaaaacgucgaucucgac

SEQ ID NO: 3232024 - RNA, 16 nt, Mycobacterium leprae
gcaaaccaaacaacaa

SEQ ID NO: 3232025 - RNA, 19 nt, Mycobacterium leprae
gcaaacugcugcgcaaggu

SEQ ID NO: 3232026 - RNA, 20 nt, Mycobacterium leprae
gcaaacuuugucagcggaca

SEQ ID NO: 3232027 - RNA, 16 nt, Mycobacterium leprae
gcaaagagucgaccug

SEQ ID NO: 3232028 - RNA, 19 nt, Mycobacterium leprae
gcaaaguccucgaaucgga

SEQ ID NO: 3232029 - RNA, 16 nt, Mycobacterium leprae
gcaaaguuaugcaacg

SEQ ID NO: 3232030 - RNA, 19 nt, Mycobacterium leprae
gcaacaaauucgccgcggc

SEQ ID NO: 3232031 - RNA, 13 nt, Mycobacterium leprae
gcaacaccuccuc

SEQ ID NO: 3232032 - RNA, 18 nt, Mycobacterium leprae
gcaacacgcgccuuagau

SEQ ID NO: 3232033 - RNA, 17 nt, Mycobacterium leprae
gcaacacggggagaucg

SEQ ID NO: 3232034 - RNA, 17 nt, Mycobacterium leprae
gcaacacguaguaccgc

SEQ ID NO: 3232035 - RNA, 15 nt, Mycobacterium leprae
gcaacagccacaccc

SEQ ID NO: 3232036 - RNA, 19 nt, Mycobacterium leprae
gcaaccaacuucacuggcu

SEQ ID NO: 3232037 - RNA, 19 nt, Mycobacterium leprae
gcaaccgccggcaagcccg

SEQ ID NO: 3232038 - RNA, 21 nt, Mycobacterium leprae
gcaacgaaaccaugccgccga

SEQ ID NO: 3232039 - RNA, 16 nt, Mycobacterium leprae
gcaacgacgccacagc

SEQ ID NO: 3232040 - RNA, 14 nt, Mycobacterium leprae
gcaacgccuccacu

SEQ ID NO: 3232041 - RNA, 17 nt, Mycobacterium leprae
gcaacgccuccacugcu

SEQ ID NO: 3232042 - RNA, 14 nt, Mycobacterium leprae
gcaacgcuucgugc

SEQ ID NO: 3232043 - RNA, 16 nt, Mycobacterium leprae
gcaacgggacaaguca

SEQ ID NO: 3232044 - RNA, 12 nt, Mycobacterium leprae
gcaacguacugc

SEQ ID NO: 3232045 - RNA, 19 nt, Mycobacterium leprae
gcaacgugggcgauucggg

SEQ ID NO: 3232046 - RNA, 17 nt, Mycobacterium leprae
gcaacguguaaggccag

SEQ ID NO: 3232047 - RNA, 16 nt, Mycobacterium leprae
gcaacucaucggcucc

SEQ ID NO: 3232048 - RNA, 21 nt, Mycobacterium leprae
gcaacucaucggcucccaucg

SEQ ID NO: 3232049 - RNA, 15 nt, Mycobacterium leprae
gcaacugagaagguc

SEQ ID NO: 3232050 - RNA, 16 nt, Mycobacterium leprae
gcaagaccgaguuggg

SEQ ID NO: 3232051 - RNA, 18 nt, Mycobacterium leprae
gcagaauuggagugaagu

SEQ ID NO: 3232052 - RNA, 22 nt, Mycobacterium leprae
gcagacacagccgucagggcag

SEQ ID NO: 3232053 - RNA, 18 nt, Mycobacterium leprae
gcagaccucuuccgccgc

SEQ ID NO: 3232054 - RNA, 19 nt, Mycobacterium leprae
gcagacucgagucccgaaa

SEQ ID NO: 3232055 - RNA, 19 nt, Mycobacterium leprae
gcagacuuuggagcaggag

SEQ ID NO: 3232056 - RNA, 17 nt, Mycobacterium leprae
gcagagcucacugggcu

SEQ ID NO: 3232057 - RNA, 19 nt, Mycobacterium leprae
gcagagcucacugggcuuc

SEQ ID NO: 3232058 - RNA, 17 nt, Mycobacterium leprae
gcagaggacgggcggcc

SEQ ID NO: 3232059 - RNA, 15 nt, Mycobacterium leprae
gcagaggcaccugga

SEQ ID NO: 3232060 - RNA, 15 nt, Mycobacterium leprae
gcagagguaaaucug

SEQ ID NO: 3232061 - RNA, 15 nt, Mycobacterium leprae
gcagaguaaccacuu

SEQ ID NO: 3232062 - RNA, 16 nt, Mycobacterium leprae
gcagaucgaucucgac

SEQ ID NO: 3232063 - RNA, 19 nt, Mycobacterium leprae
gcagaucgaucucgacggc

SEQ ID NO: 3232064 - RNA, 14 nt, Mycobacterium leprae
gcagauucgagcuc

SEQ ID NO: 3232065 - RNA, 19 nt, Mycobacterium leprae
gcagcaacagccacacccg

SEQ ID NO: 3232066 - RNA, 16 nt, Mycobacterium leprae
gcagcaacgugcaguc

SEQ ID NO: 3232067 - RNA, 14 nt, Mycobacterium leprae
gcagcaagcggccg

SEQ ID NO: 3232068 - RNA, 12 nt, Mycobacterium leprae
gcagcaaucaau

SEQ ID NO: 3232069 - RNA, 17 nt, Mycobacterium leprae
gcagcaauugacgccga

SEQ ID NO: 3232070 - RNA, 23 nt, Mycobacterium leprae
gcagcaauugacgccgaccgcga

SEQ ID NO: 3232071 - RNA, 14 nt, Mycobacterium leprae
gcagcacaaaauuc

SEQ ID NO: 3232072 - RNA, 14 nt, Mycobacterium leprae
gcagcaccacagcg

SEQ ID NO: 3232073 - RNA, 15 nt, Mycobacterium leprae
gcagcaccugccgca

SEQ ID NO: 3232074 - RNA, 13 nt, Mycobacterium leprae
gcagcaguucauc

SEQ ID NO: 3232075 - RNA, 22 nt, Mycobacterium leprae
gcagcauauggaaagucagcau

SEQ ID NO: 3232076 - RNA, 12 nt, Mycobacterium leprae
gcagcaucuguc

SEQ ID NO: 3232077 - RNA, 14 nt, Mycobacterium leprae
gcagcaugguggcc

SEQ ID NO: 3232078 - RNA, 14 nt, Mycobacterium leprae
gcagccagucagcc

SEQ ID NO: 3232079 - RNA, 17 nt, Mycobacterium leprae
gcagcccgcgccgccgu

SEQ ID NO: 3232080 - RNA, 14 nt, Mycobacterium leprae
gcagcccugagcac

SEQ ID NO: 3232081 - RNA, 16 nt, Mycobacterium leprae
gcagcccuugcagcaa

SEQ ID NO: 3232082 - RNA, 21 nt, Mycobacterium leprae
gcagccucauugaccgcauca

SEQ ID NO: 3232083 - RNA, 16 nt, Mycobacterium leprae
gcagcgaggccguggc

SEQ ID NO: 3232084 - RNA, 16 nt, Mycobacterium leprae
gcagcgaguguccgca

SEQ ID NO: 3232085 - RNA, 22 nt, Mycobacterium leprae
gcagcgccugccccgcuggugu

SEQ ID NO: 3232086 - RNA, 13 nt, Mycobacterium leprae
gcagcgcgaacag

SEQ ID NO: 3232087 - RNA, 15 nt, Mycobacterium leprae
gcagcgcggacucuc

SEQ ID NO: 3232088 - RNA, 18 nt, Mycobacterium leprae
gcagcggcggugucccga

SEQ ID NO: 3232089 - RNA, 19 nt, Mycobacterium leprae
gcagcgguacccgccagga

SEQ ID NO: 3232090 - RNA, 17 nt, Mycobacterium leprae
gcagcguggucaccgcu

SEQ ID NO: 3232091 - RNA, 20 nt, Mycobacterium leprae
gcagcguggucaccgcugug

SEQ ID NO: 3232092 - RNA, 21 nt, Mycobacterium leprae
gcagcuaaucccaugggaguu

SEQ ID NO: 3232093 - RNA, 19 nt, Mycobacterium leprae
gcagcuaauuuuccacagg

SEQ ID NO: 3232094 - RNA, 15 nt, Mycobacterium leprae
gcagcuacagcgggc

SEQ ID NO: 3232095 - RNA, 14 nt, Mycobacterium leprae
gcagcuccagcucg

SEQ ID NO: 3232096 - RNA, 19 nt, Mycobacterium leprae
gcagcucgggcucgcacac

SEQ ID NO: 3232097 - RNA, 22 nt, Mycobacterium leprae
gcagcugcaacaccuccucugg

SEQ ID NO: 3232098 - RNA, 15 nt, Mycobacterium leprae
gcagcugccaggcau

SEQ ID NO: 3232099 - RNA, 21 nt, Mycobacterium leprae
gcagcugccauuggccgcugg

SEQ ID NO: 3232100 - RNA, 22 nt, Mycobacterium leprae
gcagcugccauuggccgcuggu

SEQ ID NO: 3232101 - RNA, 17 nt, Mycobacterium leprae
gcagcuggccaagcgga

SEQ ID NO: 3232102 - RNA, 15 nt, Mycobacterium leprae
gcagcugggauagcu

SEQ ID NO: 3232103 - RNA, 23 nt, Mycobacterium leprae
gcagcugguuguccacggcagcu

SEQ ID NO: 3232104 - RNA, 17 nt, Mycobacterium leprae
gcagcuuccugcggugg

SEQ ID NO: 3232105 - RNA, 18 nt, Mycobacterium leprae
gcagcuuccugcgguggu

SEQ ID NO: 3232106 - RNA, 18 nt, Mycobacterium leprae
gcaggagagcgccgcugu

SEQ ID NO: 3232107 - RNA, 16 nt, Mycobacterium leprae
gcaggaucacgugugg

SEQ ID NO: 3232108 - RNA, 21 nt, Mycobacterium leprae
gcaggcaccauugauggaacu

SEQ ID NO: 3232109 - RNA, 18 nt, Mycobacterium leprae
gcaggcaugccgccgggu

SEQ ID NO: 3232110 - RNA, 17 nt, Mycobacterium leprae
gcaggcugacuccgggu

SEQ ID NO: 3232111 - RNA, 20 nt, Mycobacterium leprae
gcaggcugcauccugcagca

SEQ ID NO: 3232112 - RNA, 19 nt, Mycobacterium leprae
gcagggcuguuuggccucc

SEQ ID NO: 3232113 - RNA, 16 nt, Mycobacterium leprae
gcagguacggaucgaa

SEQ ID NO: 3232114 - RNA, 16 nt, Mycobacterium leprae
gcaggucacccuccuc

SEQ ID NO: 3232115 - RNA, 17 nt, Mycobacterium leprae
gcagguccaauucacga

SEQ ID NO: 3232116 - RNA, 21 nt, Mycobacterium leprae
gcagguccaucgagcucugag

SEQ ID NO: 3232117 - RNA, 15 nt, Mycobacterium leprae
gcaggucgaggacca

SEQ ID NO: 3232118 - RNA, 16 nt, Mycobacterium leprae
gcaggucgccgaggcg

SEQ ID NO: 3232119 - RNA, 16 nt, Mycobacterium leprae
gcaggugaccggccaa

SEQ ID NO: 3232120 - RNA, 21 nt, Mycobacterium leprae
gcaggugacgguguugguguc

SEQ ID NO: 3232121 - RNA, 14 nt, Mycobacterium leprae
gcagguggaucguc

SEQ ID NO: 3232122 - RNA, 18 nt, Mycobacterium leprae
gcagguggaucgucggcc

SEQ ID NO: 3232123 - RNA, 22 nt, Mycobacterium leprae
gcagguugaggaggugcuggau

SEQ ID NO: 3232124 - RNA, 15 nt, Mycobacterium leprae
gcagguugcugucgu

SEQ ID NO: 3232125 - RNA, 21 nt, Mycobacterium leprae
gcaguaaccgauauggcgauc

SEQ ID NO: 3232126 - RNA, 22 nt, Mycobacterium leprae
gcaguaaccgauauggcgauca

SEQ ID NO: 3232127 - RNA, 19 nt, Mycobacterium leprae
gcaguacuggugcuguguu

SEQ ID NO: 3232128 - RNA, 23 nt, Mycobacterium leprae
gcaguaucguguuagugaacagu

SEQ ID NO: 3232129 - RNA, 19 nt, Mycobacterium leprae
gcagucaguuuggcgcugc

SEQ ID NO: 3232130 - RNA, 13 nt, Mycobacterium leprae
gcagucaucaccc

SEQ ID NO: 3232131 - RNA, 13 nt, Mycobacterium leprae
gcaguccgcucag

SEQ ID NO: 3232132 - RNA, 18 nt, Mycobacterium leprae
gcagucucgcuggcgcuu

SEQ ID NO: 3232133 - RNA, 20 nt, Mycobacterium leprae
gcagucuuggcucacaucuc

SEQ ID NO: 3232134 - RNA, 21 nt, Mycobacterium leprae
gcagugaucacaucagugcug

SEQ ID NO: 3232135 - RNA, 22 nt, Mycobacterium leprae
gcagugaucacaucagugcugu

SEQ ID NO: 3232136 - RNA, 15 nt, Mycobacterium leprae
gcagugcaagugggc

SEQ ID NO: 3232137 - RNA, 12 nt, Mycobacterium leprae
gcagugcgguga

SEQ ID NO: 3232138 - RNA, 11 nt, Mycobacterium leprae
gcaguggacac

SEQ ID NO: 3232139 - RNA, 17 nt, Mycobacterium leprae
gcagugggccaguggcu

SEQ ID NO: 3232140 - RNA, 21 nt, Mycobacterium leprae
gcagugucaucgcguagugau

SEQ ID NO: 3232141 - RNA, 17 nt, Mycobacterium leprae
gcaguguggcauccgcc

SEQ ID NO: 3232142 - RNA, 16 nt, Mycobacterium leprae
gcaguuauaaccacga

SEQ ID NO: 3232143 - RNA, 20 nt, Mycobacterium leprae
gcaguucaggauauggcaga

SEQ ID NO: 3232144 - RNA, 23 nt, Mycobacterium leprae
gcaguugaccggagcgacaucga

SEQ ID NO: 3232145 - RNA, 17 nt, Mycobacterium leprae
gcaguuggauucggugu

SEQ ID NO: 3232146 - RNA, 21 nt, Mycobacterium leprae
gcaguuuccaacaaacuacug

SEQ ID NO: 3232147 - RNA, 15 nt, Mycobacterium leprae
gcauaacccgaucac

SEQ ID NO: 3232148 - RNA, 19 nt, Mycobacterium leprae
gcauacagugcaccggugg

SEQ ID NO: 3232149 - RNA, 19 nt, Mycobacterium leprae
gcauacugcgaacaucgaa

SEQ ID NO: 3232150 - RNA, 17 nt, Mycobacterium leprae
gcauagaucuucucgac

SEQ ID NO: 3232151 - RNA, 20 nt, Mycobacterium leprae
gcauagaucuucucgacgac

SEQ ID NO: 3232152 - RNA, 13 nt, Mycobacterium leprae
gcauaucaaacca

SEQ ID NO: 3232153 - RNA, 13 nt, Mycobacterium leprae
gcauauccgcccc

SEQ ID NO: 3232154 - RNA, 16 nt, Mycobacterium leprae
gcaucaacgccagcaa

SEQ ID NO: 3232155 - RNA, 15 nt, Mycobacterium leprae
gcaucaacgccgaga

SEQ ID NO: 3232156 - RNA, 16 nt, Mycobacterium leprae
gcaucaagcugugagu

SEQ ID NO: 3232157 - RNA, 21 nt, Mycobacterium leprae
gcaucaagcugugagugugca

SEQ ID NO: 3232158 - RNA, 14 nt, Mycobacterium leprae
gcaucagacagagc

SEQ ID NO: 3232159 - RNA, 21 nt, Mycobacterium leprae
gcaucagauauccuaggccac

SEQ ID NO: 3232160 - RNA, 18 nt, Mycobacterium leprae
gcaucaggaaggagccga

SEQ ID NO: 3232161 - RNA, 16 nt, Mycobacterium leprae
gcaucaucaacaugua

SEQ ID NO: 3232162 - RNA, 14 nt, Mycobacterium leprae
gcaucaucgcccac

SEQ ID NO: 3232163 - RNA, 23 nt, Mycobacterium leprae
gcauccagaaaguacugaccggc

SEQ ID NO: 3232164 - RNA, 19 nt, Mycobacterium leprae
gccaggaugcggcccagug

SEQ ID NO: 3232165 - RNA, 19 nt, Mycobacterium leprae
gccaggcgaauugcuaccu

SEQ ID NO: 3232166 - RNA, 19 nt, Mycobacterium leprae
gccaggggaaccaucgcac

SEQ ID NO: 3232167 - RNA, 15 nt, Mycobacterium leprae
gccaggggcugggca

SEQ ID NO: 3232168 - RNA, 19 nt, Mycobacterium leprae
gccaggggcugggcaccug

SEQ ID NO: 3232169 - RNA, 14 nt, Mycobacterium leprae
gccagggggcguca

SEQ ID NO: 3232170 - RNA, 20 nt, Mycobacterium leprae
gccagggggcgucaagucca

SEQ ID NO: 3232171 - RNA, 23 nt, Mycobacterium leprae
gccagggguuccaagauggcguc

SEQ ID NO: 3232172 - RNA, 12 nt, Mycobacterium leprae
gccagguccacc

SEQ ID NO: 3232173 - RNA, 14 nt, Mycobacterium leprae
gccaguaccuccag

SEQ ID NO: 3232174 - RNA, 13 nt, Mycobacterium leprae
gccagucagccgu

SEQ ID NO: 3232175 - RNA, 22 nt, Mycobacterium leprae
gccagucggucugcucggcgaa

SEQ ID NO: 3232176 - RNA, 16 nt, Mycobacterium leprae
gccagugcaaccuccg

SEQ ID NO: 3232177 - RNA, 23 nt, Mycobacterium leprae
gccauaaaucaucgcugccaucg

SEQ ID NO: 3232178 - RNA, 20 nt, Mycobacterium leprae
gccauauacaaaccccagac

SEQ ID NO: 3232179 - RNA, 13 nt, Mycobacterium leprae
gccauaucguucc

SEQ ID NO: 3232180 - RNA, 15 nt, Mycobacterium leprae
gccaucaccguggcc

SEQ ID NO: 3232181 - RNA, 20 nt, Mycobacterium leprae
gccaucagaagaccagguga

SEQ ID NO: 3232182 - RNA, 18 nt, Mycobacterium leprae
gccauccaccgccgagcg

SEQ ID NO: 3232183 - RNA, 20 nt, Mycobacterium leprae
gccauccauuuguggcgaua

SEQ ID NO: 3232184 - RNA, 23 nt, Mycobacterium leprae
gccaucgaacggcggggcgucgc

SEQ ID NO: 3232185 - RNA, 12 nt, Mycobacterium leprae
gccaucgacgcc

SEQ ID NO: 3232186 - RNA, 17 nt, Mycobacterium leprae
gccaucgacgccgccgu

SEQ ID NO: 3232187 - RNA, 20 nt, Mycobacterium leprae
gccaucgacgccgccguugc

SEQ ID NO: 3232188 - RNA, 22 nt, Mycobacterium leprae
gccaucgacgccgccguugcca

SEQ ID NO: 3232189 - RNA, 13 nt, Mycobacterium leprae
gccaucgcaccga

SEQ ID NO: 3232190 - RNA, 19 nt, Mycobacterium leprae
gccaucgguaaccccgcgg

SEQ ID NO: 3232191 - RNA, 12 nt, Mycobacterium leprae
gccaucgguugu

SEQ ID NO: 3232192 - RNA, 17 nt, Mycobacterium leprae
gccaugacaugcacacu

SEQ ID NO: 3232193 - RNA, 13 nt, Mycobacterium leprae
gccaugaccgacc

SEQ ID NO: 3232194 - RNA, 18 nt, Mycobacterium leprae
gccaugaccgaccugggg

SEQ ID NO: 3232195 - RNA, 20 nt, Mycobacterium leprae
gccaugcacgccggcgucgc

SEQ ID NO: 3232196 - RNA, 21 nt, Mycobacterium leprae
gccaugggacuaccgguaagc

SEQ ID NO: 3232197 - RNA, 13 nt, Mycobacterium leprae
gccauucuagguu

SEQ ID NO: 3232198 - RNA, 13 nt, Mycobacterium leprae
gccauuggcaccg

SEQ ID NO: 3232199 - RNA, 13 nt, Mycobacterium leprae
gccauuugcggcu

SEQ ID NO: 3232200 - RNA, 14 nt, Mycobacterium leprae
gccauuuggcaccc

SEQ ID NO: 3232201 - RNA, 14 nt, Mycobacterium leprae
gcccaacgcugccc

SEQ ID NO: 3232202 - RNA, 23 nt, Mycobacterium leprae
gcccaacguaucggcgauagcgc

SEQ ID NO: 3232203 - RNA, 22 nt, Mycobacterium leprae
gcccaacgucuggaccacgcaa

SEQ ID NO: 3232204 - RNA, 14 nt, Mycobacterium leprae
gcccaagacucagu

SEQ ID NO: 3232205 - RNA, 17 nt, Mycobacterium leprae
gcccaagcgaagccugg

SEQ ID NO: 3232206 - RNA, 13 nt, Mycobacterium leprae
gcccaaggcucca

SEQ ID NO: 3232207 - RNA, 15 nt, Mycobacterium leprae
gcccaagugaugucu

SEQ ID NO: 3232208 - RNA, 16 nt, Mycobacterium leprae
gcccaaucccccaggu

SEQ ID NO: 3232209 - RNA, 23 nt, Mycobacterium leprae
gcccaaugcagcaacgugcaguc

SEQ ID NO: 3232210 - RNA, 18 nt, Mycobacterium leprae
gcccaauggugcggcgau

SEQ ID NO: 3232211 - RNA, 20 nt, Mycobacterium leprae
gcccaauggugcggcgauca

SEQ ID NO: 3232212 - RNA, 19 nt, Mycobacterium leprae
gcccaccgcaacgccucca

SEQ ID NO: 3232213 - RNA, 21 nt, Mycobacterium leprae
gcccaccgcaaucgaaaaaug

SEQ ID NO: 3232214 - RNA, 13 nt, Mycobacterium leprae
gcccaccgccgga

SEQ ID NO: 3232215 - RNA, 23 nt, Mycobacterium leprae
gcccacucccacucuagauaacu

SEQ ID NO: 3232216 - RNA, 19 nt, Mycobacterium leprae
gcccagaagcucacugaca

SEQ ID NO: 3232217 - RNA, 20 nt, Mycobacterium leprae
gcccagaugaauucgcugau

SEQ ID NO: 3232218 - RNA, 20 nt, Mycobacterium leprae
gcccagauugcaguccacca

SEQ ID NO: 3232219 - RNA, 15 nt, Mycobacterium leprae
gcccagcacgcgcga

SEQ ID NO: 3232220 - RNA, 14 nt, Mycobacterium leprae
gcccagcagauggc

SEQ ID NO: 3232221 - RNA, 14 nt, Mycobacterium leprae
gcccagcagguuga

SEQ ID NO: 3232222 - RNA, 17 nt, Mycobacterium leprae
gcccagcaguuacuggu

SEQ ID NO: 3232223 - RNA, 20 nt, Mycobacterium leprae
gcccagcaguuacugguggc

SEQ ID NO: 3232224 - RNA, 20 nt, Mycobacterium leprae
gcccaggugcccagccccug

SEQ ID NO: 3232225 - RNA, 17 nt, Mycobacterium leprae
gcccaggugucuuccag

SEQ ID NO: 3232226 - RNA, 16 nt, Mycobacterium leprae
gcccagugacgucgga

SEQ ID NO: 3232227 - RNA, 20 nt, Mycobacterium leprae
gccccagauagcccgauuug

SEQ ID NO: 3232228 - RNA, 22 nt, Mycobacterium leprae
gccccccggacaguccaccgcc

SEQ ID NO: 3232229 - RNA, 20 nt, Mycobacterium leprae
gccccgcaucuucgcccagc

SEQ ID NO: 3232230 - RNA, 15 nt, Mycobacterium leprae
gccccggaacgggca

SEQ ID NO: 3232231 - RNA, 17 nt, Mycobacterium leprae
gccccggacccgagccg

SEQ ID NO: 3232232 - RNA, 17 nt, Mycobacterium leprae
gccccuaccccgcggcg

SEQ ID NO: 3232233 - RNA, 18 nt, Mycobacterium leprae
gccccuaccccgcggcgc

SEQ ID NO: 3232234 - RNA, 22 nt, Mycobacterium leprae
gccccucgaagucggagugucu

SEQ ID NO: 3232235 - RNA, 19 nt, Mycobacterium leprae
gccccucgauuugcucagu

SEQ ID NO: 3232236 - RNA, 20 nt, Mycobacterium leprae
gccccucucgaguugccgau

SEQ ID NO: 3232237 - RNA, 18 nt, Mycobacterium leprae
gccccuggcaucaucaac

SEQ ID NO: 3232238 - RNA, 23 nt, Mycobacterium leprae
gcccgaaaaguucggccauggca

SEQ ID NO: 3232239 - RNA, 12 nt, Mycobacterium leprae
gcccgacggcgu

SEQ ID NO: 3232240 - RNA, 21 nt, Mycobacterium leprae
gcccgcaacaccguacugaac

SEQ ID NO: 3232241 - RNA, 12 nt, Mycobacterium leprae
gcccgcacagca

SEQ ID NO: 3232242 - RNA, 15 nt, Mycobacterium leprae
gcccgcacagcacca

SEQ ID NO: 3232243 - RNA, 16 nt, Mycobacterium leprae
gcccgcacagcaccau

SEQ ID NO: 3232244 - RNA, 13 nt, Mycobacterium leprae
gcccgcgccgccg

SEQ ID NO: 3232245 - RNA, 14 nt, Mycobacterium leprae
gcccgcgccgccgu

SEQ ID NO: 3232246 - RNA, 20 nt, Mycobacterium leprae
gcccgcgucgccuuagccga

SEQ ID NO: 3232247 - RNA, 14 nt, Mycobacterium leprae
gcccgcguucaugg

SEQ ID NO: 3232248 - RNA, 20 nt, Mycobacterium leprae
gcccgcugccaggaucugcu

SEQ ID NO: 3232249 - RNA, 22 nt, Mycobacterium leprae
gcccgcugcugcgaccgaccaa

SEQ ID NO: 3232250 - RNA, 22 nt, Mycobacterium leprae
gcccgcugggugagcugugccg

SEQ ID NO: 3232251 - RNA, 20 nt, Mycobacterium leprae
gcccggaaauaguggcugau

SEQ ID NO: 3232252 - RNA, 16 nt, Mycobacterium leprae
gcccggacggcccagc

SEQ ID NO: 3232253 - RNA, 20 nt, Mycobacterium leprae
gcccggacggcccagcacca

SEQ ID NO: 3232254 - RNA, 21 nt, Mycobacterium leprae
gcccggucaagacguugugac

SEQ ID NO: 3232255 - RNA, 20 nt, Mycobacterium leprae
gcccgguuuuagcgugcugu

SEQ ID NO: 3232256 - RNA, 21 nt, Mycobacterium leprae
gcccgguuuuagcgugcugug

SEQ ID NO: 3232257 - RNA, 16 nt, Mycobacterium leprae
gcccgucguggugugc

SEQ ID NO: 3232258 - RNA, 20 nt, Mycobacterium leprae
gcccguuaucgaucuaccug

SEQ ID NO: 3232259 - RNA, 19 nt, Mycobacterium leprae
gcccuagacgggaggaaga

SEQ ID NO: 3232260 - RNA, 21 nt, Mycobacterium leprae
gcccuccggaaauacggcagu

SEQ ID NO: 3232261 - RNA, 22 nt, Mycobacterium leprae
gcccucguugacgcccuccugg

SEQ ID NO: 3232262 - RNA, 15 nt, Mycobacterium leprae
gcccugaagcugagu

SEQ ID NO: 3232263 - RNA, 13 nt, Mycobacterium leprae
gcccugcacuuca

SEQ ID NO: 3232264 - RNA, 15 nt, Mycobacterium leprae
gcccuggaccgcagc

SEQ ID NO: 3232265 - RNA, 16 nt, Mycobacterium leprae
gcccuggaccgcagca

SEQ ID NO: 3232266 - RNA, 14 nt, Mycobacterium leprae
gcccuucuccacca

SEQ ID NO: 3232267 - RNA, 17 nt, Mycobacterium leprae
gcccuugcccacgucca

SEQ ID NO: 3232268 - RNA, 17 nt, Mycobacterium leprae
gccgaacuauccaagac

SEQ ID NO: 3232269 - RNA, 16 nt, Mycobacterium leprae
gccgaagagcugcagc

SEQ ID NO: 3232270 - RNA, 14 nt, Mycobacterium leprae
gccgaagcagccgg

SEQ ID NO: 3232271 - RNA, 16 nt, Mycobacterium leprae
gccgaauuaccauugg

SEQ ID NO: 3232272 - RNA, 17 nt, Mycobacterium leprae
gccgaauuaccauuggc

SEQ ID NO: 3232273 - RNA, 22 nt, Mycobacterium leprae
gccgaauuucuuuaucucccua

SEQ ID NO: 3232274 - RNA, 13 nt, Mycobacterium leprae
gccgacaaucuca

SEQ ID NO: 3232275 - RNA, 18 nt, Mycobacterium leprae
gccgacaaucucacgucc

SEQ ID NO: 3232276 - RNA, 21 nt, Mycobacterium leprae
gccgacaccgauaccagcggc

SEQ ID NO: 3232277 - RNA, 14 nt, Mycobacterium leprae
gccguuguuggagc

SEQ ID NO: 3232278 - RNA, 16 nt, Mycobacterium leprae
gccguuuccgcuacca

SEQ ID NO: 3232279 - RNA, 13 nt, Mycobacterium leprae
gccguuugggcca

SEQ ID NO: 3232280 - RNA, 17 nt, Mycobacterium leprae
gccuaagcucucgagga

SEQ ID NO: 3232281 - RNA, 17 nt, Mycobacterium leprae
gccuacaccagcucggc

SEQ ID NO: 3232282 - RNA, 20 nt, Mycobacterium leprae
gccuagcaacgucacgucga

SEQ ID NO: 3232283 - RNA, 16 nt, Mycobacterium leprae
gccuagcuggcagucg

SEQ ID NO: 3232284 - RNA, 14 nt, Mycobacterium leprae
gccuauaucgcggc

SEQ ID NO: 3232285 - RNA, 16 nt, Mycobacterium leprae
gccuaugcggccagcc

SEQ ID NO: 3232286 - RNA, 18 nt, Mycobacterium leprae
gccuaugcggccagccag

SEQ ID NO: 3232287 - RNA, 18 nt, Mycobacterium leprae
gccuaugcggguucggug

SEQ ID NO: 3232288 - RNA, 20 nt, Mycobacterium leprae
gccuaugcggguucgguggu

SEQ ID NO: 3232289 - RNA, 21 nt, Mycobacterium leprae
gccucaaugcagacacgccgc

SEQ ID NO: 3232290 - RNA, 19 nt, Mycobacterium leprae
gccucacaguaggccagcc

SEQ ID NO: 3232291 - RNA, 15 nt, Mycobacterium leprae
gccucagcagcaggc

SEQ ID NO: 3232292 - RNA, 15 nt, Mycobacterium leprae
gccuccacugcuccu

SEQ ID NO: 3232293 - RNA, 16 nt, Mycobacterium leprae
gccuccagaaucacag

SEQ ID NO: 3232294 - RNA, 21 nt, Mycobacterium leprae
gccuccgaaaagcugagccga

SEQ ID NO: 3232295 - RNA, 13 nt, Mycobacterium leprae
gccuccuaggcca

SEQ ID NO: 3232296 - RNA, 23 nt, Mycobacterium leprae
gccucgaucagcaacacuggcga

SEQ ID NO: 3232297 - RNA, 16 nt, Mycobacterium leprae
gccucgguguucgaca

SEQ ID NO: 3232298 - RNA, 15 nt, Mycobacterium leprae
gccucgucggccagc

SEQ ID NO: 3232299 - RNA, 17 nt, Mycobacterium leprae
gccucgucggccagcac

SEQ ID NO: 3232300 - RNA, 18 nt, Mycobacterium leprae
gccucgucggccagcacu

SEQ ID NO: 3232301 - RNA, 20 nt, Mycobacterium leprae
gccucgucggccagcacuug

SEQ ID NO: 3232302 - RNA, 14 nt, Mycobacterium leprae
gccucgugcgguca

SEQ ID NO: 3232303 - RNA, 19 nt, Mycobacterium leprae
gccucguugcguaccggaa

SEQ ID NO: 3232304 - RNA, 16 nt, Mycobacterium leprae
gccucuccagccauca

SEQ ID NO: 3232305 - RNA, 14 nt, Mycobacterium leprae
gccugaugccauca

SEQ ID NO: 3232306 - RNA, 17 nt, Mycobacterium leprae
gccugcaucgcagcgau

SEQ ID NO: 3232307 - RNA, 15 nt, Mycobacterium leprae
gccugcccgcaggga

SEQ ID NO: 3232308 - RNA, 13 nt, Mycobacterium leprae
gccugcguccacg

SEQ ID NO: 3232309 - RNA, 14 nt, Mycobacterium leprae
gccugcucauggca

SEQ ID NO: 3232310 - RNA, 12 nt, Mycobacterium leprae
gccugcuggccg

SEQ ID NO: 3232311 - RNA, 19 nt, Mycobacterium leprae
gccugcuggccggcaggga

SEQ ID NO: 3232312 - RNA, 18 nt, Mycobacterium leprae
gccugcuuccaauagcag

SEQ ID NO: 3232313 - RNA, 23 nt, Mycobacterium leprae
gccugcuugcuggcugagggccg

SEQ ID NO: 3232314 - RNA, 14 nt, Mycobacterium leprae
gccuggacgguuuc

SEQ ID NO: 3232315 - RNA, 18 nt, Mycobacterium leprae
gccuggcccauccgggcc

SEQ ID NO: 3232316 - RNA, 24 nt, Mycobacterium leprae
gccuggcgucaucgacaucccagc

SEQ ID NO: 3232317 - RNA, 16 nt, Mycobacterium leprae
gccuggucauggcuuc

SEQ ID NO: 3232318 - RNA, 19 nt, Mycobacterium leprae
gccugugucgagcuggcug

SEQ ID NO: 3232319 - RNA, 15 nt, Mycobacterium leprae
gccuguucaggugcg

SEQ ID NO: 3232320 - RNA, 21 nt, Mycobacterium leprae
gccuguuguugugccuucugc

SEQ ID NO: 3232321 - RNA, 14 nt, Mycobacterium leprae
gccuuaagcugcau

SEQ ID NO: 3232322 - RNA, 13 nt, Mycobacterium leprae
gccuucgucagcu

SEQ ID NO: 3232323 - RNA, 18 nt, Mycobacterium leprae
gccuucuccguucacagu

SEQ ID NO: 3232324 - RNA, 13 nt, Mycobacterium leprae
gccuucugcaccc

SEQ ID NO: 3232325 - RNA, 19 nt, Mycobacterium leprae
gccuucugcacccgccagg

SEQ ID NO: 3232326 - RNA, 14 nt, Mycobacterium leprae
gccuugcagcuuca

SEQ ID NO: 3232327 - RNA, 11 nt, Mycobacterium leprae
gccuugccgcu

SEQ ID NO: 3232328 - RNA, 20 nt, Mycobacterium leprae
gccuugcggacuggcugucc

SEQ ID NO: 3232329 - RNA, 15 nt, Mycobacterium leprae
gccuugggugguggu

SEQ ID NO: 3232330 - RNA, 21 nt, Mycobacterium leprae
gccuuggugcuuaacgccgcc

SEQ ID NO: 3232331 - RNA, 19 nt, Mycobacterium leprae
gccuuguguucggcaagcc

SEQ ID NO: 3232332 - RNA, 22 nt, Mycobacterium leprae
gcgaaaacacuuacaccaacau

SEQ ID NO: 3232333 - RNA, 22 nt, Mycobacterium leprae
gcgaaacagggguccugaccgc

SEQ ID NO: 3232334 - RNA, 13 nt, Mycobacterium leprae
gcgaacaacaaaa

SEQ ID NO: 3232335 - RNA, 14 nt, Mycobacterium leprae
gcgaacaacaaaaa

SEQ ID NO: 3232336 - RNA, 21 nt, Mycobacterium leprae
gcgaacacacaggucauccuu

SEQ ID NO: 3232337 - RNA, 14 nt, Mycobacterium leprae
gcgaacagaggcgc

SEQ ID NO: 3232338 - RNA, 15 nt, Mycobacterium leprae
gcgaacagccgagcu

SEQ ID NO: 3232339 - RNA, 17 nt, Mycobacterium leprae
gcgaacuaguguucggc

SEQ ID NO: 3232340 - RNA, 20 nt, Mycobacterium leprae
gcgaagaguuucugcugccg

SEQ ID NO: 3232341 - RNA, 18 nt, Mycobacterium leprae
gcgaaggagcggugguac

SEQ ID NO: 3232342 - RNA, 17 nt, Mycobacterium leprae
gcgaaguccuugcuggu

SEQ ID NO: 3232343 - RNA, 20 nt, Mycobacterium leprae
gcgaagucgacgccgcggcu

SEQ ID NO: 3232344 - RNA, 12 nt, Mycobacterium leprae
gcgaagugagac

SEQ ID NO: 3232345 - RNA, 13 nt, Mycobacterium leprae
gcgaauggugcuc

SEQ ID NO: 3232346 - RNA, 22 nt, Mycobacterium leprae
gcgacaaagagaacuucuucag

SEQ ID NO: 3232347 - RNA, 13 nt, Mycobacterium leprae
gcgacacagccgg

SEQ ID NO: 3232348 - RNA, 19 nt, Mycobacterium leprae
gcgacacagccggccggca

SEQ ID NO: 3232349 - RNA, 20 nt, Mycobacterium leprae
gcgacaccaccacgguggca

SEQ ID NO: 3232350 - RNA, 22 nt, Mycobacterium leprae
gcgacaccaccacgguggcacc

SEQ ID NO: 3232351 - RNA, 14 nt, Mycobacterium leprae
gcgacacgcgcgac

SEQ ID NO: 3232352 - RNA, 16 nt, Mycobacterium leprae
gcgacacggcugucac

SEQ ID NO: 3232353 - RNA, 15 nt, Mycobacterium leprae
gcgacacuugccgcg

SEQ ID NO: 3232354 - RNA, 17 nt, Mycobacterium leprae
gcgacaggcagcugcag

SEQ ID NO: 3232355 - RNA, 19 nt, Mycobacterium leprae
gcgacauacaaucgcggca

SEQ ID NO: 3232356 - RNA, 13 nt, Mycobacterium leprae
gcgaccagcgagc

SEQ ID NO: 3232357 - RNA, 18 nt, Mycobacterium leprae
gcgaccgcacggcaagcc

SEQ ID NO: 3232358 - RNA, 13 nt, Mycobacterium leprae
gcgaccggccagu

SEQ ID NO: 3232359 - RNA, 18 nt, Mycobacterium leprae
gcgaccuggucgagcagc

SEQ ID NO: 3232360 - RNA, 15 nt, Mycobacterium leprae
gcgaccuugcggcgc

SEQ ID NO: 3232361 - RNA, 17 nt, Mycobacterium leprae
gcgaccuugcggcgccc

SEQ ID NO: 3232362 - RNA, 20 nt, Mycobacterium leprae
gcgacgaacccgucgaugau

SEQ ID NO: 3232363 - RNA, 21 nt, Mycobacterium leprae
gcgacgaacccgucgaugauc

SEQ ID NO: 3232364 - RNA, 18 nt, Mycobacterium leprae
gcgacgaucugugacacu

SEQ ID NO: 3232365 - RNA, 18 nt, Mycobacterium leprae
gcgacggacaggccguag

SEQ ID NO: 3232366 - RNA, 14 nt, Mycobacterium leprae
gcgacggcaaguaa

SEQ ID NO: 3232367 - RNA, 17 nt, Mycobacterium leprae
gcgacguuucacgguca

SEQ ID NO: 3232368 - RNA, 18 nt, Mycobacterium leprae
gcgacuaucgugugcuga

SEQ ID NO: 3232369 - RNA, 15 nt, Mycobacterium leprae
gcgacucaucgccaa

SEQ ID NO: 3232370 - RNA, 15 nt, Mycobacterium leprae
gcgacugauaccgga

SEQ ID NO: 3232371 - RNA, 22 nt, Mycobacterium leprae
gcgacugugcuaaccgggccaa

SEQ ID NO: 3232372 - RNA, 17 nt, Mycobacterium leprae
gcgacuguuguggucaa

SEQ ID NO: 3232373 - RNA, 13 nt, Mycobacterium leprae
gcgagacaugauu

SEQ ID NO: 3232374 - RNA, 24 nt, Mycobacterium leprae
gcgagcaaauugccgagcugguag

SEQ ID NO: 3232375 - RNA, 17 nt, Mycobacterium leprae
gcgagcaagcggugugc

SEQ ID NO: 3232376 - RNA, 16 nt, Mycobacterium leprae
gcgagcuuacgcgcgu

SEQ ID NO: 3232377 - RNA, 17 nt, Mycobacterium leprae
gcgaggaccaccuggua

SEQ ID NO: 3232378 - RNA, 13 nt, Mycobacterium leprae
gcgaggccguggc

SEQ ID NO: 3232379 - RNA, 16 nt, Mycobacterium leprae
gcgaggccuugggugg

SEQ ID NO: 3232380 - RNA, 17 nt, Mycobacterium leprae
gcgagggucgagcuacc

SEQ ID NO: 3232381 - RNA, 19 nt, Mycobacterium leprae
gcgaguacguccgcgccgg

SEQ ID NO: 3232382 - RNA, 20 nt, Mycobacterium leprae
gcgaguacguccgcgccggc

SEQ ID NO: 3232383 - RNA, 21 nt, Mycobacterium leprae
gcgaguacguccgcgccggcg

SEQ ID NO: 3232384 - RNA, 20 nt, Mycobacterium leprae
gcgaguaucgaaucggugau

SEQ ID NO: 3232385 - RNA, 14 nt, Mycobacterium leprae
gcgagugcugacgc

SEQ ID NO: 3232386 - RNA, 19 nt, Mycobacterium leprae
gcgagugcugacgccgggc

SEQ ID NO: 3232387 - RNA, 21 nt, Mycobacterium leprae
gcgaguucguuccuggcuggc

SEQ ID NO: 3232388 - RNA, 24 nt, Mycobacterium leprae
gcgaguucuccuaucgaaauacga

SEQ ID NO: 3232389 - RNA, 15 nt, Mycobacterium leprae
gcgaguuugcgccga

SEQ ID NO: 3232390 - RNA, 20 nt, Mycobacterium leprae
gcggcacguucgaucggcag

SEQ ID NO: 3232391 - RNA, 16 nt, Mycobacterium leprae
gcggcagaaauggugc

SEQ ID NO: 3232392 - RNA, 13 nt, Mycobacterium leprae
gcggcagcggcgg

SEQ ID NO: 3232393 - RNA, 16 nt, Mycobacterium leprae
gcggcagcugcugagc

SEQ ID NO: 3232394 - RNA, 14 nt, Mycobacterium leprae
gcggcagcuggaaa

SEQ ID NO: 3232395 - RNA, 17 nt, Mycobacterium leprae
gcggcaguccgcgucac

SEQ ID NO: 3232396 - RNA, 15 nt, Mycobacterium leprae
gcggcaucgucggca

SEQ ID NO: 3232397 - RNA, 15 nt, Mycobacterium leprae
gcggcauucccaacc

SEQ ID NO: 3232398 - RNA, 19 nt, Mycobacterium leprae
gcggcauucccaaccgcga

SEQ ID NO: 3232399 - RNA, 20 nt, Mycobacterium leprae
gcggcauugcggcguucgug

SEQ ID NO: 3232400 - RNA, 15 nt, Mycobacterium leprae
gcggccaagcuagau

SEQ ID NO: 3232401 - RNA, 13 nt, Mycobacterium leprae
gcggccaccgcga

SEQ ID NO: 3232402 - RNA, 11 nt, Mycobacterium leprae
gcggccgcagc

SEQ ID NO: 3232403 - RNA, 13 nt, Mycobacterium leprae
gcggccgccagca

SEQ ID NO: 3232404 - RNA, 21 nt, Mycobacterium leprae
gcggccgugauuuucauuggc

SEQ ID NO: 3232405 - RNA, 14 nt, Mycobacterium leprae
gcggcgacugugcu

SEQ ID NO: 3232406 - RNA, 19 nt, Mycobacterium leprae
gcggcgagcuuacgcgcgu

SEQ ID NO: 3232407 - RNA, 15 nt, Mycobacterium leprae
gcggcgaugaccgga

SEQ ID NO: 3232408 - RNA, 13 nt, Mycobacterium leprae
gcggcgcccagca

SEQ ID NO: 3232409 - RNA, 15 nt, Mycobacterium leprae
gcggcggacgaucga

SEQ ID NO: 3232410 - RNA, 13 nt, Mycobacterium leprae
gcggcggccccuu

SEQ ID NO: 3232411 - RNA, 15 nt, Mycobacterium leprae
gcggcggccuuggca

SEQ ID NO: 3232412 - RNA, 15 nt, Mycobacterium leprae
gcggcguguaaguag

SEQ ID NO: 3232413 - RNA, 19 nt, Mycobacterium leprae
gcggcguuauccacgccga

SEQ ID NO: 3232414 - RNA, 18 nt, Mycobacterium leprae
gcggcuagucggccggcu

SEQ ID NO: 3232415 - RNA, 12 nt, Mycobacterium leprae
gcggcucaccga

SEQ ID NO: 3232416 - RNA, 14 nt, Mycobacterium leprae
gcggcucguggcag

SEQ ID NO: 3232417 - RNA, 14 nt, Mycobacterium leprae
gcggcucuuucggc

SEQ ID NO: 3232418 - RNA, 14 nt, Mycobacterium leprae
gcggcugccacugu

SEQ ID NO: 3232419 - RNA, 20 nt, Mycobacterium leprae
gcggcuggcuaauggcgggc

SEQ ID NO: 3232420 - RNA, 16 nt, Mycobacterium leprae
gcggcuggugcggcgg

SEQ ID NO: 3232421 - RNA, 16 nt, Mycobacterium leprae
gcggcuucgucaagcu

SEQ ID NO: 3232422 - RNA, 14 nt, Mycobacterium leprae
gcggcuuguugacc

SEQ ID NO: 3232423 - RNA, 17 nt, Mycobacterium leprae
gcggcuuguugaccggc

SEQ ID NO: 3232424 - RNA, 15 nt, Mycobacterium leprae
gcggcuuguuuguug

SEQ ID NO: 3232425 - RNA, 19 nt, Mycobacterium leprae
gcgggacaacaccacuucu

SEQ ID NO: 3232426 - RNA, 15 nt, Mycobacterium leprae
gcgggacagaagcau

SEQ ID NO: 3232427 - RNA, 18 nt, Mycobacterium leprae
gcgggacgugcacuggug

SEQ ID NO: 3232428 - RNA, 20 nt, Mycobacterium leprae
gcgggacgugcacugguggu

SEQ ID NO: 3232429 - RNA, 11 nt, Mycobacterium leprae
gcgggagaucu

SEQ ID NO: 3232430 - RNA, 19 nt, Mycobacterium leprae
gcgggaggccuuaagcugc

SEQ ID NO: 3232431 - RNA, 20 nt, Mycobacterium leprae
gcgggaugaugauugccgcc

SEQ ID NO: 3232432 - RNA, 15 nt, Mycobacterium leprae
gcgggcaacaggcgg

SEQ ID NO: 3232433 - RNA, 16 nt, Mycobacterium leprae
gcgggcaagcccugcc

SEQ ID NO: 3232434 - RNA, 22 nt, Mycobacterium leprae
gcgggcacgccaucguugcgac

SEQ ID NO: 3232435 - RNA, 23 nt, Mycobacterium leprae
gcgggccaacuaggauagaucca

SEQ ID NO: 3232436 - RNA, 17 nt, Mycobacterium leprae
gcgggcccgucguggug

SEQ ID NO: 3232437 - RNA, 21 nt, Mycobacterium leprae
gcgggcccgucguggugugca

SEQ ID NO: 3232438 - RNA, 22 nt, Mycobacterium leprae
gcgggcgaugccaucgggccag

SEQ ID NO: 3232439 - RNA, 13 nt, Mycobacterium leprae
gcgggcggcagcc

SEQ ID NO: 3232440 - RNA, 20 nt, Mycobacterium leprae
gcgggcuagguacucaacgu

SEQ ID NO: 3232441 - RNA, 17 nt, Mycobacterium leprae
gcggggauagacacucc

SEQ ID NO: 3232442 - RNA, 13 nt, Mycobacterium leprae
gcggggcgguggc

SEQ ID NO: 3232443 - RNA, 18 nt, Mycobacterium leprae
gcggggcuaugccgcgcg

SEQ ID NO: 3232444 - RNA, 14 nt, Mycobacterium leprae
gcgggggaccuugc

SEQ ID NO: 3232445 - RNA, 18 nt, Mycobacterium leprae
gcgggguaauucuugaca

SEQ ID NO: 3232446 - RNA, 22 nt, Mycobacterium leprae
gcgggguucuggaugcgguggu

SEQ ID NO: 3232447 - RNA, 12 nt, Mycobacterium leprae
gcgggguuggcc

SEQ ID NO: 3232448 - RNA, 19 nt, Mycobacterium leprae
gcgggguuuuuguuggugg

SEQ ID NO: 3232449 - RNA, 20 nt, Mycobacterium leprae
gcgggguuuuuguugguggg

SEQ ID NO: 3232450 - RNA, 22 nt, Mycobacterium leprae
gcgggguuuuuguuggugggug

SEQ ID NO: 3232451 - RNA, 15 nt, Mycobacterium leprae
gcggguacgacgccu

SEQ ID NO: 3232452 - RNA, 14 nt, Mycobacterium leprae
gcgggugcaguugu

SEQ ID NO: 3232453 - RNA, 17 nt, Mycobacterium leprae
gcggguucggugguauc

SEQ ID NO: 3232454 - RNA, 22 nt, Mycobacterium leprae
gcggguugacuuuaacgacauc

SEQ ID NO: 3232455 - RNA, 19 nt, Mycobacterium leprae
gcggguugcuuuggggguu

SEQ ID NO: 3232456 - RNA, 15 nt, Mycobacterium leprae
gcggguuucccagag

SEQ ID NO: 3232457 - RNA, 17 nt, Mycobacterium leprae
gcggguuucccagagcu

SEQ ID NO: 3232458 - RNA, 17 nt, Mycobacterium leprae
gcggguuucccgccaaa

SEQ ID NO: 3232459 - RNA, 19 nt, Mycobacterium leprae
gcgguaacggcgguggcag

SEQ ID NO: 3232460 - RNA, 19 nt, Mycobacterium leprae
gcgguaccgucuaguggcg

SEQ ID NO: 3232461 - RNA, 15 nt, Mycobacterium leprae
gcgguaccugugggu

SEQ ID NO: 3232462 - RNA, 23 nt, Mycobacterium leprae
gcgguagcggaccugcgagaucg

SEQ ID NO: 3232463 - RNA, 17 nt, Mycobacterium leprae
gcgguaggaaucaccgg

SEQ ID NO: 3232464 - RNA, 18 nt, Mycobacterium leprae
gcgguaguuuccugagca

SEQ ID NO: 3232465 - RNA, 14 nt, Mycobacterium leprae
gcgguauccauccg

SEQ ID NO: 3232466 - RNA, 18 nt, Mycobacterium leprae
gcggucaaaaaacuaggu

SEQ ID NO: 3232467 - RNA, 19 nt, Mycobacterium leprae
gcgguccuguccaggugcg

SEQ ID NO: 3232468 - RNA, 14 nt, Mycobacterium leprae
gcggucgccgaugc

SEQ ID NO: 3232469 - RNA, 22 nt, Mycobacterium leprae
gcggucgucaagugcgcaccgg

SEQ ID NO: 3232470 - RNA, 15 nt, Mycobacterium leprae
gcggucgugcugcug

SEQ ID NO: 3232471 - RNA, 21 nt, Mycobacterium leprae
gcggucuuggugagagcucca

SEQ ID NO: 3232472 - RNA, 20 nt, Mycobacterium leprae
gcggugaccgaacuguggau

SEQ ID NO: 3232473 - RNA, 22 nt, Mycobacterium leprae
gcggugaucgcugccggcggca

SEQ ID NO: 3232474 - RNA, 12 nt, Mycobacterium leprae
gcggugcagugc

SEQ ID NO: 3232475 - RNA, 18 nt, Mycobacterium leprae
gcggugcagugccgccga

SEQ ID NO: 3232476 - RNA, 16 nt, Mycobacterium leprae
gcggugcugagucggc

SEQ ID NO: 3232477 - RNA, 18 nt, Mycobacterium leprae
gcggugcugagucggcgc

SEQ ID NO: 3232478 - RNA, 18 nt, Mycobacterium leprae
gcgguggcagccgccagc

SEQ ID NO: 3232479 - RNA, 14 nt, Mycobacterium leprae
gcggugggugcaca

SEQ ID NO: 3232480 - RNA, 21 nt, Mycobacterium leprae
gcgguggugacgguaauaagg

SEQ ID NO: 3232481 - RNA, 17 nt, Mycobacterium leprae
gcggugugcgucggaug

SEQ ID NO: 3232482 - RNA, 22 nt, Mycobacterium leprae
gcggugugugcagauugcguga

SEQ ID NO: 3232483 - RNA, 22 nt, Mycobacterium leprae
gcgguugcguaauggccggcgc

SEQ ID NO: 3232484 - RNA, 15 nt, Mycobacterium leprae
gcgguuuccgcggca

SEQ ID NO: 3232485 - RNA, 21 nt, Mycobacterium leprae
gcguaaggaagaugacaccga

SEQ ID NO: 3232486 - RNA, 16 nt, Mycobacterium leprae
gcguagaaccaguucu

SEQ ID NO: 3232487 - RNA, 14 nt, Mycobacterium leprae
gcguaggcgcacgc

SEQ ID NO: 3232488 - RNA, 23 nt, Mycobacterium leprae
gcguaggcgcacgcugauggcac

SEQ ID NO: 3232489 - RNA, 15 nt, Mycobacterium leprae
gcguagucgaccgga

SEQ ID NO: 3232490 - RNA, 15 nt, Mycobacterium leprae
gcguaguuccaccgu

SEQ ID NO: 3232491 - RNA, 18 nt, Mycobacterium leprae
gcguaugaccgcggucgg

SEQ ID NO: 3232492 - RNA, 16 nt, Mycobacterium leprae
gcgucaaagucgcggg

SEQ ID NO: 3232493 - RNA, 18 nt, Mycobacterium leprae
gcgucaagcagcaccaca

SEQ ID NO: 3232494 - RNA, 12 nt, Mycobacterium leprae
gcgucacggucg

SEQ ID NO: 3232495 - RNA, 14 nt, Mycobacterium leprae
gcgucaggccaggc

SEQ ID NO: 3232496 - RNA, 17 nt, Mycobacterium leprae
gcgucaggccaggcagc

SEQ ID NO: 3232497 - RNA, 23 nt, Mycobacterium leprae
gcgucaguaucgcgacggcaagu

SEQ ID NO: 3232498 - RNA, 17 nt, Mycobacterium leprae
gcgucaguuuacuggca

SEQ ID NO: 3232499 - RNA, 13 nt, Mycobacterium leprae
gcgucauggcacu

SEQ ID NO: 3232500 - RNA, 20 nt, Mycobacterium leprae
gcguccagacaccacugcca

SEQ ID NO: 3232501 - RNA, 19 nt, Mycobacterium leprae
gcguccgagguuaccagcg

SEQ ID NO: 3232502 - RNA, 16 nt, Mycobacterium leprae
gcguccgcggcggccc

SEQ ID NO: 3232503 - RNA, 15 nt, Mycobacterium leprae
gcguccucaucccau

SEQ ID NO: 3232504 - RNA, 23 nt, Mycobacterium leprae
gcucgacauuguagaaacggccu

SEQ ID NO: 3232505 - RNA, 16 nt, Mycobacterium leprae
gcucgacgcggagugu

SEQ ID NO: 3232506 - RNA, 18 nt, Mycobacterium leprae
gcucgacgguuaccggaa

SEQ ID NO: 3232507 - RNA, 13 nt, Mycobacterium leprae
gcucgagcagccg

SEQ ID NO: 3232508 - RNA, 20 nt, Mycobacterium leprae
gcucgaugggguuguggacc

SEQ ID NO: 3232509 - RNA, 20 nt, Mycobacterium leprae
gcucgauucucgagcggcgc

SEQ ID NO: 3232510 - RNA, 15 nt, Mycobacterium leprae
gcucgcaauaugauc

SEQ ID NO: 3232511 - RNA, 19 nt, Mycobacterium leprae
gcucgcauccgcaacgaaa

SEQ ID NO: 3232512 - RNA, 23 nt, Mycobacterium leprae
gcucgccaaggucgaucuagcgu

SEQ ID NO: 3232513 - RNA, 14 nt, Mycobacterium leprae
gcucgccgcccgcu

SEQ ID NO: 3232514 - RNA, 24 nt, Mycobacterium leprae
gcucgccgcgcaucaucgcccacc

SEQ ID NO: 3232515 - RNA, 14 nt, Mycobacterium leprae
gcucgccggggugu

SEQ ID NO: 3232516 - RNA, 13 nt, Mycobacterium leprae
gcucgcggugggc

SEQ ID NO: 3232517 - RNA, 14 nt, Mycobacterium leprae
gcucgcggugggcu

SEQ ID NO: 3232518 - RNA, 17 nt, Mycobacterium leprae
gcucgcuuuccgcgccc

SEQ ID NO: 3232519 - RNA, 23 nt, Mycobacterium leprae
gcucgcuuuccgcgccccuuccu

SEQ ID NO: 3232520 - RNA, 12 nt, Mycobacterium leprae
gcucggcgaagu

SEQ ID NO: 3232521 - RNA, 16 nt, Mycobacterium leprae
gcucggcgaagucaag

SEQ ID NO: 3232522 - RNA, 18 nt, Mycobacterium leprae
gcucggcgaagucaagau

SEQ ID NO: 3232523 - RNA, 15 nt, Mycobacterium leprae
gcucgggugguccgg

SEQ ID NO: 3232524 - RNA, 20 nt, Mycobacterium leprae
gcucgguaagcuggcucggu

SEQ ID NO: 3232525 - RNA, 20 nt, Mycobacterium leprae
gcucgguaaguugcuuaacg

SEQ ID NO: 3232526 - RNA, 18 nt, Mycobacterium leprae
gcucgguauuugcggugg

SEQ ID NO: 3232527 - RNA, 15 nt, Mycobacterium leprae
gcucguagcggcggc

SEQ ID NO: 3232528 - RNA, 16 nt, Mycobacterium leprae
gcucgucacucgcgga

SEQ ID NO: 3232529 - RNA, 16 nt, Mycobacterium leprae
gcucguggcagucucg

SEQ ID NO: 3232530 - RNA, 16 nt, Mycobacterium leprae
gcucgugggcggcggc

SEQ ID NO: 3232531 - RNA, 20 nt, Mycobacterium leprae
gcucucgaggauuaucgccg

SEQ ID NO: 3232532 - RNA, 18 nt, Mycobacterium leprae
gcucucucgggguugaau

SEQ ID NO: 3232533 - RNA, 23 nt, Mycobacterium leprae
gcucucugguaacggaccuggca

SEQ ID NO: 3232534 - RNA, 20 nt, Mycobacterium leprae
gcucugaggucaccggccac

SEQ ID NO: 3232535 - RNA, 21 nt, Mycobacterium leprae
gcucugcugaucagacggcga

SEQ ID NO: 3232536 - RNA, 14 nt, Mycobacterium leprae
gcucugguggccac

SEQ ID NO: 3232537 - RNA, 16 nt, Mycobacterium leprae
gcucugguggccaccg

SEQ ID NO: 3232538 - RNA, 23 nt, Mycobacterium leprae
gcucuguucugguggggauacag

SEQ ID NO: 3232539 - RNA, 12 nt, Mycobacterium leprae
gcucuuucuugu

SEQ ID NO: 3232540 - RNA, 13 nt, Mycobacterium leprae
gcugaaccgcugu

SEQ ID NO: 3232541 - RNA, 23 nt, Mycobacterium leprae
gcugaaccgcugugacagcgugc

SEQ ID NO: 3232542 - RNA, 17 nt, Mycobacterium leprae
gcugaacucagcgguaa

SEQ ID NO: 3232543 - RNA, 18 nt, Mycobacterium leprae
gcugaaguuaucugcuga

SEQ ID NO: 3232544 - RNA, 13 nt, Mycobacterium leprae
gcugacacuguca

SEQ ID NO: 3232545 - RNA, 19 nt, Mycobacterium leprae
gcugacagacauggcugua

SEQ ID NO: 3232546 - RNA, 13 nt, Mycobacterium leprae
gcugaccagcaga

SEQ ID NO: 3232547 - RNA, 21 nt, Mycobacterium leprae
gcugaccgacuucaacggucg

SEQ ID NO: 3232548 - RNA, 23 nt, Mycobacterium leprae
gcugaccggcgaccaguuuacau

SEQ ID NO: 3232549 - RNA, 17 nt, Mycobacterium leprae
gcugaccgggguucaau

SEQ ID NO: 3232550 - RNA, 23 nt, Mycobacterium leprae
gcugacggcuaggguuggauggu

SEQ ID NO: 3232551 - RNA, 14 nt, Mycobacterium leprae
gcugacgguugcuc

SEQ ID NO: 3232552 - RNA, 18 nt, Mycobacterium leprae
gcugacuccguacucacg

SEQ ID NO: 3232553 - RNA, 19 nt, Mycobacterium leprae
gcugacuccguacucacgu

SEQ ID NO: 3232554 - RNA, 23 nt, Mycobacterium leprae
gcugagaggcggucggcggcuug

SEQ ID NO: 3232555 - RNA, 16 nt, Mycobacterium leprae
gcugagagugccaccg

SEQ ID NO: 3232556 - RNA, 22 nt, Mycobacterium leprae
gcugagcagucccuuagucugc

SEQ ID NO: 3232557 - RNA, 17 nt, Mycobacterium leprae
gcugagccacgcuggca

SEQ ID NO: 3232558 - RNA, 20 nt, Mycobacterium leprae
gcugagccauuuggcaccca

SEQ ID NO: 3232559 - RNA, 16 nt, Mycobacterium leprae
gcugagcgaagucgac

SEQ ID NO: 3232560 - RNA, 13 nt, Mycobacterium leprae
gcugaggcagcag

SEQ ID NO: 3232561 - RNA, 17 nt, Mycobacterium leprae
gcugaggcagcagcucg

SEQ ID NO: 3232562 - RNA, 18 nt, Mycobacterium leprae
gcugaggguggcgccggc

SEQ ID NO: 3232563 - RNA, 21 nt, Mycobacterium leprae
gcugaggguggcgccggcgug

SEQ ID NO: 3232564 - RNA, 21 nt, Mycobacterium leprae
gcugaggugcgagauccgugc

SEQ ID NO: 3232565 - RNA, 21 nt, Mycobacterium leprae
gcugagucuucgaucacgcgu

SEQ ID NO: 3232566 - RNA, 13 nt, Mycobacterium leprae
gcugaucgcugau

SEQ ID NO: 3232567 - RNA, 12 nt, Mycobacterium leprae
gcugaugcugcc

SEQ ID NO: 3232568 - RNA, 18 nt, Mycobacterium leprae
gcugcacccgucgcugau

SEQ ID NO: 3232569 - RNA, 16 nt, Mycobacterium leprae
gcugcaccggcucguc

SEQ ID NO: 3232570 - RNA, 22 nt, Mycobacterium leprae
gcugcacggcugcguuggcauc

SEQ ID NO: 3232571 - RNA, 16 nt, Mycobacterium leprae
gcugcagaccggauac

SEQ ID NO: 3232572 - RNA, 21 nt, Mycobacterium leprae
gcugcagucaguuuggcgcug

SEQ ID NO: 3232573 - RNA, 15 nt, Mycobacterium leprae
gcugcagugcuacga

SEQ ID NO: 3232574 - RNA, 23 nt, Mycobacterium leprae
gcugcagugcuacgaaggggucg

SEQ ID NO: 3232575 - RNA, 19 nt, Mycobacterium leprae
gcugcauccgacaaagcag

SEQ ID NO: 3232576 - RNA, 22 nt, Mycobacterium leprae
gcugcauccgacaaagcagcau

SEQ ID NO: 3232577 - RNA, 15 nt, Mycobacterium leprae
gcugcauccgcagca

SEQ ID NO: 3232578 - RNA, 20 nt, Mycobacterium leprae
gcugcauccgcagcacuaaa

SEQ ID NO: 3232579 - RNA, 15 nt, Mycobacterium leprae
gcugcauccugcagc

SEQ ID NO: 3232580 - RNA, 13 nt, Mycobacterium leprae
gcugcaucggcag

SEQ ID NO: 3232581 - RNA, 18 nt, Mycobacterium leprae
gcugcauuacgacgacuc

SEQ ID NO: 3232582 - RNA, 13 nt, Mycobacterium leprae
gcugccaaccggu

SEQ ID NO: 3232583 - RNA, 13 nt, Mycobacterium leprae
gcugccagggcuc

SEQ ID NO: 3232584 - RNA, 18 nt, Mycobacterium leprae
gcugccagggcucgacca

SEQ ID NO: 3232585 - RNA, 12 nt, Mycobacterium leprae
gcugcccaccag

SEQ ID NO: 3232586 - RNA, 20 nt, Mycobacterium leprae
gcugcccgacgaggcgguga

SEQ ID NO: 3232587 - RNA, 22 nt, Mycobacterium leprae
gcugcccgucacuacguuggcc

SEQ ID NO: 3232588 - RNA, 22 nt, Mycobacterium leprae
gcugccgaaccuccaccacucg

SEQ ID NO: 3232589 - RNA, 13 nt, Mycobacterium leprae
gcugccgcaguaa

SEQ ID NO: 3232590 - RNA, 24 nt, Mycobacterium leprae
gcugccggugaccgggccggccgc

SEQ ID NO: 3232591 - RNA, 11 nt, Mycobacterium leprae
gcugccgucga

SEQ ID NO: 3232592 - RNA, 14 nt, Mycobacterium leprae
gcugccgugugcuu

SEQ ID NO: 3232593 - RNA, 16 nt, Mycobacterium leprae
gcugcgacaacaccuu

SEQ ID NO: 3232594 - RNA, 18 nt, Mycobacterium leprae
gcugcgacggacaggccg

SEQ ID NO: 3232595 - RNA, 17 nt, Mycobacterium leprae
gcugcgagucucaccca

SEQ ID NO: 3232596 - RNA, 17 nt, Mycobacterium leprae
gcugcgcuucuggcugg

SEQ ID NO: 3232597 - RNA, 23 nt, Mycobacterium leprae
gcugcgguguccguaagcgucuc

SEQ ID NO: 3232598 - RNA, 14 nt, Mycobacterium leprae
gcugcgugccuggu

SEQ ID NO: 3232599 - RNA, 16 nt, Mycobacterium leprae
gcugcgugccugguug

SEQ ID NO: 3232600 - RNA, 17 nt, Mycobacterium leprae
gcugcuacccacuggug

SEQ ID NO: 3232601 - RNA, 15 nt, Mycobacterium leprae
gcugcucaaccaugc

SEQ ID NO: 3232602 - RNA, 16 nt, Mycobacterium leprae
gcugcucgagcagccg

SEQ ID NO: 3232603 - RNA, 14 nt, Mycobacterium leprae
gcugcucggccaga

SEQ ID NO: 3232604 - RNA, 16 nt, Mycobacterium leprae
gcugcucggccagagc

SEQ ID NO: 3232605 - RNA, 15 nt, Mycobacterium leprae
gcugcugaacaucag

SEQ ID NO: 3232606 - RNA, 18 nt, Mycobacterium leprae
gcugcugagcguggcugc

SEQ ID NO: 3232607 - RNA, 21 nt, Mycobacterium leprae
gcugcugcagaccggauacag

SEQ ID NO: 3232608 - RNA, 15 nt, Mycobacterium leprae
gcugcugcgaccgac

SEQ ID NO: 3232609 - RNA, 18 nt, Mycobacterium leprae
gcugcugcggaucggugc

SEQ ID NO: 3232610 - RNA, 20 nt, Mycobacterium leprae
gcugcugcggaucggugcau

SEQ ID NO: 3232611 - RNA, 16 nt, Mycobacterium leprae
gcugcugcggcgccug

SEQ ID NO: 3232612 - RNA, 13 nt, Mycobacterium leprae
gcugcugcuggug

SEQ ID NO: 3232613 - RNA, 15 nt, Mycobacterium leprae
gcugcugcuggugga

SEQ ID NO: 3232614 - RNA, 19 nt, Mycobacterium leprae
gcugcugguggaguacugg

SEQ ID NO: 3232615 - RNA, 12 nt, Mycobacterium leprae
gcugcuugcucu

SEQ ID NO: 3232616 - RNA, 14 nt, Mycobacterium leprae
gcugcuugcucugg

SEQ ID NO: 3232617 - RNA, 17 nt, Mycobacterium leprae
ggacacgagcggccuca

SEQ ID NO: 3232618 - RNA, 17 nt, Mycobacterium leprae
ggacacgauuagcgcgg

SEQ ID NO: 3232619 - RNA, 21 nt, Mycobacterium leprae
ggacacgauuagcgcggcgca

SEQ ID NO: 3232620 - RNA, 15 nt, Mycobacterium leprae
ggacacuacagcgug

SEQ ID NO: 3232621 - RNA, 16 nt, Mycobacterium leprae
ggacagaacaccccgc

SEQ ID NO: 3232622 - RNA, 16 nt, Mycobacterium leprae
ggacagauucccgcug

SEQ ID NO: 3232623 - RNA, 19 nt, Mycobacterium leprae
ggacagauucccgcugagc

SEQ ID NO: 3232624 - RNA, 21 nt, Mycobacterium leprae
ggacagcacccccggccaggu

SEQ ID NO: 3232625 - RNA, 17 nt, Mycobacterium leprae
ggacagcggcccaaccc

SEQ ID NO: 3232626 - RNA, 14 nt, Mycobacterium leprae
ggacagcguaucuc

SEQ ID NO: 3232627 - RNA, 17 nt, Mycobacterium leprae
ggacagcguaucucagc

SEQ ID NO: 3232628 - RNA, 18 nt, Mycobacterium leprae
ggacauccgcugauuggc

SEQ ID NO: 3232629 - RNA, 10 nt, Mycobacterium leprae
ggaccaccgu

SEQ ID NO: 3232630 - RNA, 13 nt, Mycobacterium leprae
ggaccaccugaga

SEQ ID NO: 3232631 - RNA, 19 nt, Mycobacterium leprae
ggacccguugagcugcaug

SEQ ID NO: 3232632 - RNA, 15 nt, Mycobacterium leprae
ggaccgaacagguca

SEQ ID NO: 3232633 - RNA, 20 nt, Mycobacterium leprae
ggaccgggcguuucccuauc

SEQ ID NO: 3232634 - RNA, 17 nt, Mycobacterium leprae
ggaccggugcugcagcc

SEQ ID NO: 3232635 - RNA, 17 nt, Mycobacterium leprae
ggaccgucgcgcgugcc

SEQ ID NO: 3232636 - RNA, 22 nt, Mycobacterium leprae
ggaccgucgcgcgugccaccag

SEQ ID NO: 3232637 - RNA, 16 nt, Mycobacterium leprae
ggaccuuucccgcaga

SEQ ID NO: 3232638 - RNA, 17 nt, Mycobacterium leprae
ggacgauuugcgaucaa

SEQ ID NO: 3232639 - RNA, 13 nt, Mycobacterium leprae
ggacgccggcggc

SEQ ID NO: 3232640 - RNA, 13 nt, Mycobacterium leprae
ggacggacacugu

SEQ ID NO: 3232641 - RNA, 20 nt, Mycobacterium leprae
ggacggcaccuacaacuuca

SEQ ID NO: 3232642 - RNA, 20 nt, Mycobacterium leprae
ggacggcccagcaccacugc

SEQ ID NO: 3232643 - RNA, 17 nt, Mycobacterium leprae
ggacuaccgagauggcg

SEQ ID NO: 3232644 - RNA, 14 nt, Mycobacterium leprae
ggacugauccccag

SEQ ID NO: 3232645 - RNA, 13 nt, Mycobacterium leprae
ggacuggcgguau

SEQ ID NO: 3232646 - RNA, 10 nt, Mycobacterium leprae
ggacuucugc

SEQ ID NO: 3232647 - RNA, 14 nt, Mycobacterium leprae
ggagaaguuuugcg

SEQ ID NO: 3232648 - RNA, 20 nt, Mycobacterium leprae
ggagaauguuguuagugcug

SEQ ID NO: 3232649 - RNA, 22 nt, Mycobacterium leprae
ggagaauguuguuagugcugcu

SEQ ID NO: 3232650 - RNA, 14 nt, Mycobacterium leprae
ggagagcagaugga

SEQ ID NO: 3232651 - RNA, 15 nt, Mycobacterium leprae
ggagagcagauggaa

SEQ ID NO: 3232652 - RNA, 19 nt, Mycobacterium leprae
ggagagcagauggaaggcg

SEQ ID NO: 3232653 - RNA, 21 nt, Mycobacterium leprae
ggagagucgggcuuggccgga

SEQ ID NO: 3232654 - RNA, 15 nt, Mycobacterium leprae
ggagaguuugauccu

SEQ ID NO: 3232655 - RNA, 19 nt, Mycobacterium leprae
ggagauagacaugugugcu

SEQ ID NO: 3232656 - RNA, 14 nt, Mycobacterium leprae
ggagaucggcgugc

SEQ ID NO: 3232657 - RNA, 14 nt, Mycobacterium leprae
ggagcaccucagca

SEQ ID NO: 3232658 - RNA, 16 nt, Mycobacterium leprae
ggagccagggcagccu

SEQ ID NO: 3232659 - RNA, 20 nt, Mycobacterium leprae
ggagcgaugucgagcggacc

SEQ ID NO: 3232660 - RNA, 21 nt, Mycobacterium leprae
ggagcgaugucgagcggacca

SEQ ID NO: 3232661 - RNA, 13 nt, Mycobacterium leprae
ggagcgugggucg

SEQ ID NO: 3232662 - RNA, 15 nt, Mycobacterium leprae
ggaggcguugcacug

SEQ ID NO: 3232663 - RNA, 21 nt, Mycobacterium leprae
ggagggcaucaacuggaucac

SEQ ID NO: 3232664 - RNA, 15 nt, Mycobacterium leprae
ggaggugcuggaugc

SEQ ID NO: 3232665 - RNA, 14 nt, Mycobacterium leprae
ggaguaaagggugg

SEQ ID NO: 3232666 - RNA, 15 nt, Mycobacterium leprae
ggaguaauaacugug

SEQ ID NO: 3232667 - RNA, 12 nt, Mycobacterium leprae
ggaguacuggcg

SEQ ID NO: 3232668 - RNA, 14 nt, Mycobacterium leprae
ggagugaagugagu

SEQ ID NO: 3232669 - RNA, 13 nt, Mycobacterium leprae
ggagugcgaucaa

SEQ ID NO: 3232670 - RNA, 19 nt, Mycobacterium leprae
ggagugguuagacagugau

SEQ ID NO: 3232671 - RNA, 15 nt, Mycobacterium leprae
ggaguugaccaggca

SEQ ID NO: 3232672 - RNA, 17 nt, Mycobacterium leprae
ggauaccgaacaguggg

SEQ ID NO: 3232673 - RNA, 14 nt, Mycobacterium leprae
ggauaccggggguc

SEQ ID NO: 3232674 - RNA, 15 nt, Mycobacterium leprae
ggauacucaauugca

SEQ ID NO: 3232675 - RNA, 13 nt, Mycobacterium leprae
ggauagcgacugu

SEQ ID NO: 3232676 - RNA, 16 nt, Mycobacterium leprae
ggaucaucgaugcacu

SEQ ID NO: 3232677 - RNA, 17 nt, Mycobacterium leprae
ggaucccaccggcggcu

SEQ ID NO: 3232678 - RNA, 22 nt, Mycobacterium leprae
ggaucccaccggcggcuggugc

SEQ ID NO: 3232679 - RNA, 18 nt, Mycobacterium leprae
ggaucgacggcagcgcug

SEQ ID NO: 3232680 - RNA, 19 nt, Mycobacterium leprae
ggaucgcuguauucugcac

SEQ ID NO: 3232681 - RNA, 12 nt, Mycobacterium leprae
ggaucggggcga

SEQ ID NO: 3232682 - RNA, 21 nt, Mycobacterium leprae
ggaucgguaccagcggcagcg

SEQ ID NO: 3232683 - RNA, 12 nt, Mycobacterium leprae
ggaucggugcau

SEQ ID NO: 3232684 - RNA, 21 nt, Mycobacterium leprae
ggaucucuucgucgugcaauu

SEQ ID NO: 3232685 - RNA, 14 nt, Mycobacterium leprae
ggaucuuuugacca

SEQ ID NO: 3232686 - RNA, 21 nt, Mycobacterium leprae
ggaugcugcuuggucuacaug

SEQ ID NO: 3232687 - RNA, 16 nt, Mycobacterium leprae
ggauggcugagcggca

SEQ ID NO: 3232688 - RNA, 23 nt, Mycobacterium leprae
ggauggcugcaacgacuggauga

SEQ ID NO: 3232689 - RNA, 22 nt, Mycobacterium leprae
ggauggggccacgucgugcugu

SEQ ID NO: 3232690 - RNA, 17 nt, Mycobacterium leprae
ggauggucggcagcugg

SEQ ID NO: 3232691 - RNA, 23 nt, Mycobacterium leprae
ggaugguuagcaugagcacgcca

SEQ ID NO: 3232692 - RNA, 20 nt, Mycobacterium leprae
ggauguaaucguaccaacac

SEQ ID NO: 3232693 - RNA, 15 nt, Mycobacterium leprae
ggaugucgcagaggu

SEQ ID NO: 3232694 - RNA, 21 nt, Mycobacterium leprae
ggaugugucagcaccggcaug

SEQ ID NO: 3232695 - RNA, 11 nt, Mycobacterium leprae
ggaugugugca

SEQ ID NO: 3232696 - RNA, 17 nt, Mycobacterium leprae
ggauguuauucgggagc

SEQ ID NO: 3232697 - RNA, 13 nt, Mycobacterium leprae
ggauuccacugcc

SEQ ID NO: 3232698 - RNA, 22 nt, Mycobacterium leprae
ggauugauccggucaccgcuug

SEQ ID NO: 3232699 - RNA, 16 nt, Mycobacterium leprae
ggauugcaugcaccga

SEQ ID NO: 3232700 - RNA, 11 nt, Mycobacterium leprae
ggauugggcau

SEQ ID NO: 3232701 - RNA, 19 nt, Mycobacterium leprae
ggauuucucgugguggcug

SEQ ID NO: 3232702 - RNA, 15 nt, Mycobacterium leprae
ggcaacacagcugau

SEQ ID NO: 3232703 - RNA, 23 nt, Mycobacterium leprae
ggcaacaccagcgacuggcugua

SEQ ID NO: 3232704 - RNA, 15 nt, Mycobacterium leprae
ggcaacacggggaga

SEQ ID NO: 3232705 - RNA, 14 nt, Mycobacterium leprae
ggcaacacgugcug

SEQ ID NO: 3232706 - RNA, 20 nt, Mycobacterium leprae
ggcaaccuucuagcgcagau

SEQ ID NO: 3232707 - RNA, 11 nt, Mycobacterium leprae
ggcaacgcugc

SEQ ID NO: 3232708 - RNA, 22 nt, Mycobacterium leprae
ggcaacugacauauuugggagc

SEQ ID NO: 3232709 - RNA, 17 nt, Mycobacterium leprae
ggcaagaagugcgacga

SEQ ID NO: 3232710 - RNA, 14 nt, Mycobacterium leprae
ggcaagcagauucg

SEQ ID NO: 3232711 - RNA, 21 nt, Mycobacterium leprae
ggcaagcagauucgagcucau

SEQ ID NO: 3232712 - RNA, 23 nt, Mycobacterium leprae
ggcaagcccggauacagcacggc

SEQ ID NO: 3232713 - RNA, 21 nt, Mycobacterium leprae
ggcaagcgguuguccggcgcg

SEQ ID NO: 3232714 - RNA, 21 nt, Mycobacterium leprae
ggcaaguaaaacugacacuau

SEQ ID NO: 3232715 - RNA, 22 nt, Mycobacterium leprae
ggcaauccuugaugcugcgagu

SEQ ID NO: 3232716 - RNA, 15 nt, Mycobacterium leprae
ggcaaugcucucacc

SEQ ID NO: 3232717 - RNA, 20 nt, Mycobacterium leprae
ggcaauguggacgcuagugu

SEQ ID NO: 3232718 - RNA, 14 nt, Mycobacterium leprae
ggcacacagcaaug

SEQ ID NO: 3232719 - RNA, 13 nt, Mycobacterium leprae
ggcacaccguguc

SEQ ID NO: 3232720 - RNA, 17 nt, Mycobacterium leprae
ggcacaucgaaccgacg

SEQ ID NO: 3232721 - RNA, 23 nt, Mycobacterium leprae
ggcacaugcaacuaugcggcggg

SEQ ID NO: 3232722 - RNA, 22 nt, Mycobacterium leprae
ggcaccacgcacacgacagccg

SEQ ID NO: 3232723 - RNA, 17 nt, Mycobacterium leprae
ggcaccagauggcuccc

SEQ ID NO: 3232724 - RNA, 19 nt, Mycobacterium leprae
ggcacccauaacgugcugu

SEQ ID NO: 3232725 - RNA, 22 nt, Mycobacterium leprae
ggcaccgacguauccaagguga

SEQ ID NO: 3232726 - RNA, 13 nt, Mycobacterium leprae
ggcaccggccgua

SEQ ID NO: 3232727 - RNA, 23 nt, Mycobacterium leprae
ggcaccugggcugugcugaaggc

SEQ ID NO: 3232728 - RNA, 16 nt, Mycobacterium leprae
ggcaccuuaccgucca

SEQ ID NO: 3232729 - RNA, 13 nt, Mycobacterium leprae
ggcacgaagugcg

SEQ ID NO: 3232730 - RNA, 15 nt, Mycobacterium leprae
ggcacgaauaucgcu

SEQ ID NO: 3232731 - RNA, 19 nt, Mycobacterium leprae
ggcgcaacagucagccgcg

SEQ ID NO: 3232732 - RNA, 16 nt, Mycobacterium leprae
ggcgcaagcgugcagg

SEQ ID NO: 3232733 - RNA, 14 nt, Mycobacterium leprae
ggcgcacguaagca

SEQ ID NO: 3232734 - RNA, 22 nt, Mycobacterium leprae
ggcgcagaccucuuccgccgcu

SEQ ID NO: 3232735 - RNA, 14 nt, Mycobacterium leprae
ggcgccaggcgucc

SEQ ID NO: 3232736 - RNA, 13 nt, Mycobacterium leprae
ggcgccccucugc

SEQ ID NO: 3232737 - RNA, 12 nt, Mycobacterium leprae
ggcgccgcagca

SEQ ID NO: 3232738 - RNA, 14 nt, Mycobacterium leprae
ggcgccgcugcuuc

SEQ ID NO: 3232739 - RNA, 22 nt, Mycobacterium leprae
ggcgccguggaggugcggcugg

SEQ ID NO: 3232740 - RNA, 20 nt, Mycobacterium leprae
ggcgccucgucggccagcac

SEQ ID NO: 3232741 - RNA, 12 nt, Mycobacterium leprae
ggcgccugcauc

SEQ ID NO: 3232742 - RNA, 19 nt, Mycobacterium leprae
ggcgccuuuuuaugaagag

SEQ ID NO: 3232743 - RNA, 15 nt, Mycobacterium leprae
ggcgcgacaaagaga

SEQ ID NO: 3232744 - RNA, 18 nt, Mycobacterium leprae
ggcgcgaucuuccaccau

SEQ ID NO: 3232745 - RNA, 14 nt, Mycobacterium leprae
ggcgcgcaggcugc

SEQ ID NO: 3232746 - RNA, 13 nt, Mycobacterium leprae
ggcgcgcgaggcg

SEQ ID NO: 3232747 - RNA, 13 nt, Mycobacterium leprae
ggcgcggucgccg

SEQ ID NO: 3232748 - RNA, 13 nt, Mycobacterium leprae
ggcgcguaggccu

SEQ ID NO: 3232749 - RNA, 17 nt, Mycobacterium leprae
ggcgcguggucucccaa

SEQ ID NO: 3232750 - RNA, 19 nt, Mycobacterium leprae
ggcgcguuaggucuccugg

SEQ ID NO: 3232751 - RNA, 11 nt, Mycobacterium leprae
ggcgcuaacaa

SEQ ID NO: 3232752 - RNA, 15 nt, Mycobacterium leprae
ggcgcucagugauca

SEQ ID NO: 3232753 - RNA, 14 nt, Mycobacterium leprae
ggcgcugcugcgga

SEQ ID NO: 3232754 - RNA, 13 nt, Mycobacterium leprae
ggcgcuuaaugua

SEQ ID NO: 3232755 - RNA, 14 nt, Mycobacterium leprae
ggcgcuucaccgac

SEQ ID NO: 3232756 - RNA, 18 nt, Mycobacterium leprae
ggcgcuuguaaggccagc

SEQ ID NO: 3232757 - RNA, 17 nt, Mycobacterium leprae
ggcggagcgcggagcug

SEQ ID NO: 3232758 - RNA, 18 nt, Mycobacterium leprae
ggcggaugcgggcuuccu

SEQ ID NO: 3232759 - RNA, 21 nt, Mycobacterium leprae
ggcggcacauacggcaaccuu

SEQ ID NO: 3232760 - RNA, 14 nt, Mycobacterium leprae
ggcggcaccucccc

SEQ ID NO: 3232761 - RNA, 16 nt, Mycobacterium leprae
ggcggcaccuccccgc

SEQ ID NO: 3232762 - RNA, 19 nt, Mycobacterium leprae
ggcggcauucccaaccgcg

SEQ ID NO: 3232763 - RNA, 21 nt, Mycobacterium leprae
ggcggccacgugcacaucagc

SEQ ID NO: 3232764 - RNA, 14 nt, Mycobacterium leprae
ggcggccgccggcu

SEQ ID NO: 3232765 - RNA, 18 nt, Mycobacterium leprae
ggcggcgacacggcuguc

SEQ ID NO: 3232766 - RNA, 18 nt, Mycobacterium leprae
ggcggcgauccucaacca

SEQ ID NO: 3232767 - RNA, 15 nt, Mycobacterium leprae
ggcggcgccgauccc

SEQ ID NO: 3232768 - RNA, 12 nt, Mycobacterium leprae
ggcgggcgugcu

SEQ ID NO: 3232769 - RNA, 13 nt, Mycobacterium leprae
ggcgggcuugacc

SEQ ID NO: 3232770 - RNA, 17 nt, Mycobacterium leprae
ggcggguagucggcgcg

SEQ ID NO: 3232771 - RNA, 12 nt, Mycobacterium leprae
ggcggucggcgc

SEQ ID NO: 3232772 - RNA, 13 nt, Mycobacterium leprae
ggcggucggcgcu

SEQ ID NO: 3232773 - RNA, 23 nt, Mycobacterium leprae
ggcggucguugauuuccgcggcg

SEQ ID NO: 3232774 - RNA, 18 nt, Mycobacterium leprae
ggcggugaccgaacugug

SEQ ID NO: 3232775 - RNA, 14 nt, Mycobacterium leprae
ggcgguggcagcgu

SEQ ID NO: 3232776 - RNA, 19 nt, Mycobacterium leprae
ggcgguuacgcgcucgccg

SEQ ID NO: 3232777 - RNA, 15 nt, Mycobacterium leprae
ggcgguugacccgcg

SEQ ID NO: 3232778 - RNA, 13 nt, Mycobacterium leprae
ggcguaccugggu

SEQ ID NO: 3232779 - RNA, 14 nt, Mycobacterium leprae
ggcgucaaguccag

SEQ ID NO: 3232780 - RNA, 13 nt, Mycobacterium leprae
ggcgucacccagu

SEQ ID NO: 3232781 - RNA, 11 nt, Mycobacterium leprae
ggcgucaccgu

SEQ ID NO: 3232782 - RNA, 18 nt, Mycobacterium leprae
ggcgucaggccaggcagc

SEQ ID NO: 3232783 - RNA, 23 nt, Mycobacterium leprae
ggcgucaucgacaucccagcaac

SEQ ID NO: 3232784 - RNA, 17 nt, Mycobacterium leprae
ggcgucgcugugucgau

SEQ ID NO: 3232785 - RNA, 15 nt, Mycobacterium leprae
ggcgucgguggcggu

SEQ ID NO: 3232786 - RNA, 13 nt, Mycobacterium leprae
ggcgucguuuugg

SEQ ID NO: 3232787 - RNA, 15 nt, Mycobacterium leprae
ggcgucguuuuggcg

SEQ ID NO: 3232788 - RNA, 23 nt, Mycobacterium leprae
ggcgucuggauggcugagcggca

SEQ ID NO: 3232789 - RNA, 13 nt, Mycobacterium leprae
ggcguggguguga

SEQ ID NO: 3232790 - RNA, 22 nt, Mycobacterium leprae
ggcguggucaauguggccgcac

SEQ ID NO: 3232791 - RNA, 17 nt, Mycobacterium leprae
ggcuaagguggcuagcu

SEQ ID NO: 3232792 - RNA, 15 nt, Mycobacterium leprae
ggcuaauggcgggcu

SEQ ID NO: 3232793 - RNA, 14 nt, Mycobacterium leprae
ggcuacccgagagu

SEQ ID NO: 3232794 - RNA, 20 nt, Mycobacterium leprae
ggcuacggggugggcagccu

SEQ ID NO: 3232795 - RNA, 13 nt, Mycobacterium leprae
ggcuauccucggg

SEQ ID NO: 3232796 - RNA, 21 nt, Mycobacterium leprae
ggcuauggguaggccgacuuc

SEQ ID NO: 3232797 - RNA, 14 nt, Mycobacterium leprae
ggcucaaucgcccg

SEQ ID NO: 3232798 - RNA, 17 nt, Mycobacterium leprae
ggcucacacugagacca

SEQ ID NO: 3232799 - RNA, 21 nt, Mycobacterium leprae
ggcucacacugagaccauggu

SEQ ID NO: 3232800 - RNA, 15 nt, Mycobacterium leprae
ggcuccaaguggcug

SEQ ID NO: 3232801 - RNA, 18 nt, Mycobacterium leprae
ggcuccauccugccucac

SEQ ID NO: 3232802 - RNA, 17 nt, Mycobacterium leprae
ggcucccaucggcggcc

SEQ ID NO: 3232803 - RNA, 21 nt, Mycobacterium leprae
ggcucccaucggcggccagcu

SEQ ID NO: 3232804 - RNA, 21 nt, Mycobacterium leprae
ggcucccgggucgagcagcca

SEQ ID NO: 3232805 - RNA, 12 nt, Mycobacterium leprae
ggcucgacauug

SEQ ID NO: 3232806 - RNA, 22 nt, Mycobacterium leprae
ggcucgaguugguuaaucaccu

SEQ ID NO: 3232807 - RNA, 20 nt, Mycobacterium leprae
ggcucgauuccagcuuggca

SEQ ID NO: 3232808 - RNA, 13 nt, Mycobacterium leprae
ggcucggccaggu

SEQ ID NO: 3232809 - RNA, 15 nt, Mycobacterium leprae
ggcucuuaggugccu

SEQ ID NO: 3232810 - RNA, 16 nt, Mycobacterium leprae
ggcugacugccugcuu

SEQ ID NO: 3232811 - RNA, 15 nt, Mycobacterium leprae
ggcugagaaguggcu

SEQ ID NO: 3232812 - RNA, 13 nt, Mycobacterium leprae
ggcugagaccggu

SEQ ID NO: 3232813 - RNA, 22 nt, Mycobacterium leprae
ggcugagaccgguccaccugcc

SEQ ID NO: 3232814 - RNA, 15 nt, Mycobacterium leprae
ggcugcaccgagcga

SEQ ID NO: 3232815 - RNA, 19 nt, Mycobacterium leprae
ggcugcaccggcucgucga

SEQ ID NO: 3232816 - RNA, 13 nt, Mycobacterium leprae
ggcugcacugugg

SEQ ID NO: 3232817 - RNA, 22 nt, Mycobacterium leprae
ggcugcacuguggcgaucgcca

SEQ ID NO: 3232818 - RNA, 17 nt, Mycobacterium leprae
ggcugcauccugcagca

SEQ ID NO: 3232819 - RNA, 12 nt, Mycobacterium leprae
ggcugccacugu

SEQ ID NO: 3232820 - RNA, 15 nt, Mycobacterium leprae
ggcugcccguaugca

SEQ ID NO: 3232821 - RNA, 12 nt, Mycobacterium leprae
ggcugcgccggc

SEQ ID NO: 3232822 - RNA, 18 nt, Mycobacterium leprae
ggcugcgccguucgucga

SEQ ID NO: 3232823 - RNA, 23 nt, Mycobacterium leprae
ggcugcgcugggacaugaagccg

SEQ ID NO: 3232824 - RNA, 17 nt, Mycobacterium leprae
ggcugcggaagccgcuc

SEQ ID NO: 3232825 - RNA, 13 nt, Mycobacterium leprae
ggcugcguuggca

SEQ ID NO: 3232826 - RNA, 20 nt, Mycobacterium leprae
ggcugcuguucaugccaggu

SEQ ID NO: 3232827 - RNA, 20 nt, Mycobacterium leprae
ggcuggccaucgcaccgauc

SEQ ID NO: 3232828 - RNA, 17 nt, Mycobacterium leprae
ggcuggcuacgcagcuc

SEQ ID NO: 3232829 - RNA, 20 nt, Mycobacterium leprae
ggcuggcuacgcagcucugg

SEQ ID NO: 3232830 - RNA, 11 nt, Mycobacterium leprae
ggcuggcugua

SEQ ID NO: 3232831 - RNA, 14 nt, Mycobacterium leprae
ggcugggcaccacc

SEQ ID NO: 3232832 - RNA, 13 nt, Mycobacterium leprae
ggcugggcaccug

SEQ ID NO: 3232833 - RNA, 23 nt, Mycobacterium leprae
ggcugggcaccugggcugugcug

SEQ ID NO: 3232834 - RNA, 16 nt, Mycobacterium leprae
ggcugggcagccgagg

SEQ ID NO: 3232835 - RNA, 18 nt, Mycobacterium leprae
ggcuggugcggcgguggg

SEQ ID NO: 3232836 - RNA, 21 nt, Mycobacterium leprae
ggcuggugcggcggugggagu

SEQ ID NO: 3232837 - RNA, 15 nt, Mycobacterium leprae
ggcugguggccgagg

SEQ ID NO: 3232838 - RNA, 21 nt, Mycobacterium leprae
ggcuggugggguguggguggu

SEQ ID NO: 3232839 - RNA, 19 nt, Mycobacterium leprae
ggcuuauccaaucgguccu

SEQ ID NO: 3232840 - RNA, 20 nt, Mycobacterium leprae
ggcuucccccagcuagggau

SEQ ID NO: 3232841 - RNA, 18 nt, Mycobacterium leprae
ggcuuccucuccuagggu

SEQ ID NO: 3232842 - RNA, 21 nt, Mycobacterium leprae
ggcuugauacagacccagcua

SEQ ID NO: 3232843 - RNA, 19 nt, Mycobacterium leprae
ggcuugccgauauucgcga

SEQ ID NO: 3232844 - RNA, 14 nt, Mycobacterium leprae
ggcuuggccagcaa

SEQ ID NO: 3232845 - RNA, 14 nt, Mycobacterium leprae
gguacacucucaga

SEQ ID NO: 3232846 - RNA, 15 nt, Mycobacterium leprae
gguaccagcggcagc

SEQ ID NO: 3232847 - RNA, 16 nt, Mycobacterium leprae
gguaccccagucgagc

SEQ ID NO: 3232848 - RNA, 17 nt, Mycobacterium leprae
gguaccgucuaguggcg

SEQ ID NO: 3232849 - RNA, 17 nt, Mycobacterium leprae
gguacgagugguugagu

SEQ ID NO: 3232850 - RNA, 14 nt, Mycobacterium leprae
gguacgcugcauga

SEQ ID NO: 3232851 - RNA, 19 nt, Mycobacterium leprae
gguacucggaauggcggca

SEQ ID NO: 3232852 - RNA, 22 nt, Mycobacterium leprae
gguacuguugguaaccagccac

SEQ ID NO: 3232853 - RNA, 15 nt, Mycobacterium leprae
gguagacgugcacaa

SEQ ID NO: 3232854 - RNA, 14 nt, Mycobacterium leprae
gguagacugggugg

SEQ ID NO: 3232855 - RNA, 21 nt, Mycobacterium leprae
gguagccguggggcucggcca

SEQ ID NO: 3232856 - RNA, 22 nt, Mycobacterium leprae
gguagcgcauuuagucuggcua

SEQ ID NO: 3232857 - RNA, 13 nt, Mycobacterium leprae
gguagcggcuaca

SEQ ID NO: 3232858 - RNA, 21 nt, Mycobacterium leprae
gguagcuacguggucugaagu

SEQ ID NO: 3232859 - RNA, 20 nt, Mycobacterium leprae
gguagcugcaucggcaggcu

SEQ ID NO: 3232860 - RNA, 20 nt, Mycobacterium leprae
gguagucguggggggcagcc

SEQ ID NO: 3232861 - RNA, 16 nt, Mycobacterium leprae
gguagugaguacacca

SEQ ID NO: 3232862 - RNA, 22 nt, Mycobacterium leprae
gguaucaaagcgauuuggaccc

SEQ ID NO: 3232863 - RNA, 19 nt, Mycobacterium leprae
gguauccauccguggcgag

SEQ ID NO: 3232864 - RNA, 19 nt, Mycobacterium leprae
gguaucggugucggcggcu

SEQ ID NO: 3232865 - RNA, 11 nt, Mycobacterium leprae
gguaucucaau

SEQ ID NO: 3232866 - RNA, 14 nt, Mycobacterium leprae
gguauuggacccga

SEQ ID NO: 3232867 - RNA, 18 nt, Mycobacterium leprae
ggucaacguuugucgugu

SEQ ID NO: 3232868 - RNA, 18 nt, Mycobacterium leprae
ggucacagguaaacaaaa

SEQ ID NO: 3232869 - RNA, 16 nt, Mycobacterium leprae
ggucaccaaccggccg

SEQ ID NO: 3232870 - RNA, 14 nt, Mycobacterium leprae
ggucaccccgagcu

SEQ ID NO: 3232871 - RNA, 22 nt, Mycobacterium leprae
ggucagguccaacgcggcggcg

SEQ ID NO: 3232872 - RNA, 17 nt, Mycobacterium leprae
ggucaguacgcuagagu

SEQ ID NO: 3232873 - RNA, 20 nt, Mycobacterium leprae
ggucaucggcgucgguggca

SEQ ID NO: 3232874 - RNA, 21 nt, Mycobacterium leprae
ggucaucuaaacugacgcugc

SEQ ID NO: 3232875 - RNA, 12 nt, Mycobacterium leprae
ggucauggcgag

SEQ ID NO: 3232876 - RNA, 16 nt, Mycobacterium leprae
ggucauuacucacgau

SEQ ID NO: 3232877 - RNA, 13 nt, Mycobacterium leprae
ggucauuggaaag

SEQ ID NO: 3232878 - RNA, 15 nt, Mycobacterium leprae
gguccaaccgacgau

SEQ ID NO: 3232879 - RNA, 22 nt, Mycobacterium leprae
gguccaauucacgaacaacaga

SEQ ID NO: 3232880 - RNA, 12 nt, Mycobacterium leprae
gguccacccgcg

SEQ ID NO: 3232881 - RNA, 20 nt, Mycobacterium leprae
gguccacuugacuggcuuga

SEQ ID NO: 3232882 - RNA, 16 nt, Mycobacterium leprae
gguccagccaacggga

SEQ ID NO: 3232883 - RNA, 22 nt, Mycobacterium leprae
gguccagccaacgggaacagcg

SEQ ID NO: 3232884 - RNA, 14 nt, Mycobacterium leprae
ggucccgcagccgc

SEQ ID NO: 3232885 - RNA, 16 nt, Mycobacterium leprae
gguccggaccuggacc

SEQ ID NO: 3232886 - RNA, 12 nt, Mycobacterium leprae
gguccggcugca

SEQ ID NO: 3232887 - RNA, 19 nt, Mycobacterium leprae
gguccugaccgccugugcu

SEQ ID NO: 3232888 - RNA, 14 nt, Mycobacterium leprae
gguccugguggcaa

SEQ ID NO: 3232889 - RNA, 16 nt, Mycobacterium leprae
gguccuuaugcgguca

SEQ ID NO: 3232890 - RNA, 15 nt, Mycobacterium leprae
gguccuuccggccuc

SEQ ID NO: 3232891 - RNA, 16 nt, Mycobacterium leprae
gguccuugcaccgauc

SEQ ID NO: 3232892 - RNA, 19 nt, Mycobacterium leprae
ggucgacgacugccgaccg

SEQ ID NO: 3232893 - RNA, 16 nt, Mycobacterium leprae
ggucgacuucgcagcc

SEQ ID NO: 3232894 - RNA, 13 nt, Mycobacterium leprae
ggucgagcagcuc

SEQ ID NO: 3232895 - RNA, 13 nt, Mycobacterium leprae
ggucgagcuggac

SEQ ID NO: 3232896 - RNA, 21 nt, Mycobacterium leprae
ggucgcacagcaggucgccga

SEQ ID NO: 3232897 - RNA, 11 nt, Mycobacterium leprae
ggucgccgaug

SEQ ID NO: 3232898 - RNA, 17 nt, Mycobacterium leprae
ggucgccgcgccacugu

SEQ ID NO: 3232899 - RNA, 18 nt, Mycobacterium leprae
ggucgcugcuacccacug

SEQ ID NO: 3232900 - RNA, 16 nt, Mycobacterium leprae
ggucggcaucugcuac

SEQ ID NO: 3232901 - RNA, 15 nt, Mycobacterium leprae
ggucggcgggguguc

SEQ ID NO: 3232902 - RNA, 14 nt, Mycobacterium leprae
ggucggcguuauug

SEQ ID NO: 3232903 - RNA, 22 nt, Mycobacterium leprae
ggucguguugcuugcugugacc

SEQ ID NO: 3232904 - RNA, 15 nt, Mycobacterium leprae
ggucguuagcgccga

SEQ ID NO: 3232905 - RNA, 14 nt, Mycobacterium leprae
ggucguugagcggc

SEQ ID NO: 3232906 - RNA, 13 nt, Mycobacterium leprae
ggucuacucgccu

SEQ ID NO: 3232907 - RNA, 22 nt, Mycobacterium leprae
ggucucaaugaccgcaccgauc

SEQ ID NO: 3232908 - RNA, 18 nt, Mycobacterium leprae
ggucucacgcugggguug

SEQ ID NO: 3232909 - RNA, 20 nt, Mycobacterium leprae
ggucucuuucggcagcgaga

SEQ ID NO: 3232910 - RNA, 16 nt, Mycobacterium leprae
ggucugaaguggggua

SEQ ID NO: 3232911 - RNA, 17 nt, Mycobacterium leprae
ggucuggcggguggugu

SEQ ID NO: 3232912 - RNA, 20 nt, Mycobacterium leprae
ggugaacgccaggcgccgca

SEQ ID NO: 3232913 - RNA, 15 nt, Mycobacterium leprae
ggugaagccggcgca

SEQ ID NO: 3232914 - RNA, 20 nt, Mycobacterium leprae
ggugaagccggcgcaaaucc

SEQ ID NO: 3232915 - RNA, 17 nt, Mycobacterium leprae
ggugaccacccacaacg

SEQ ID NO: 3232916 - RNA, 16 nt, Mycobacterium leprae
ggugacgguguuggug

SEQ ID NO: 3232917 - RNA, 15 nt, Mycobacterium leprae
ggugacuuggcuggu

SEQ ID NO: 3232918 - RNA, 19 nt, Mycobacterium leprae
ggugagucgcccagcaggu

SEQ ID NO: 3232919 - RNA, 15 nt, Mycobacterium leprae
ggugaugaucacccg

SEQ ID NO: 3232920 - RNA, 16 nt, Mycobacterium leprae
ggugaugcccaucaug

SEQ ID NO: 3232921 - RNA, 14 nt, Mycobacterium leprae
ggugcaccagcuca

SEQ ID NO: 3232922 - RNA, 16 nt, Mycobacterium leprae
ggugcaggagcguggg

SEQ ID NO: 3232923 - RNA, 21 nt, Mycobacterium leprae
ggugccauuggugggaugagu

SEQ ID NO: 3232924 - RNA, 20 nt, Mycobacterium leprae
ggugcccgacagccaccacg

SEQ ID NO: 3232925 - RNA, 22 nt, Mycobacterium leprae
ggugcccgggaaacuagcgggc

SEQ ID NO: 3232926 - RNA, 23 nt, Mycobacterium leprae
ggugcccgguuuuagcgugcugu

SEQ ID NO: 3232927 - RNA, 15 nt, Mycobacterium leprae
ggugcccuagaacaa

SEQ ID NO: 3232928 - RNA, 22 nt, Mycobacterium leprae
ggugccgagcgcaucggcggcg

SEQ ID NO: 3232929 - RNA, 16 nt, Mycobacterium leprae
ggugccgaggcucugc

SEQ ID NO: 3232930 - RNA, 12 nt, Mycobacterium leprae
ggugccgcgucc

SEQ ID NO: 3232931 - RNA, 22 nt, Mycobacterium leprae
ggugccguaagacacuuccugg

SEQ ID NO: 3232932 - RNA, 22 nt, Mycobacterium leprae
ggugcgccaacacuagcggcua

SEQ ID NO: 3232933 - RNA, 15 nt, Mycobacterium leprae
ggugcggcgccgccc

SEQ ID NO: 3232934 - RNA, 14 nt, Mycobacterium leprae
ggugcgugaggugu

SEQ ID NO: 3232935 - RNA, 20 nt, Mycobacterium leprae
ggugcgugagguguugccga

SEQ ID NO: 3232936 - RNA, 23 nt, Mycobacterium leprae
ggugcguugugcggugagagcuu

SEQ ID NO: 3232937 - RNA, 20 nt, Mycobacterium leprae
ggugcugcuuggucuacaug

SEQ ID NO: 3232938 - RNA, 11 nt, Mycobacterium leprae
ggugcuggaug

SEQ ID NO: 3232939 - RNA, 22 nt, Mycobacterium leprae
ggugcuggcugcgccggcuauc

SEQ ID NO: 3232940 - RNA, 19 nt, Mycobacterium leprae
ggugcuguguugugggugu

SEQ ID NO: 3232941 - RNA, 21 nt, Mycobacterium leprae
gguggaguaaaggguggcggu

SEQ ID NO: 3232942 - RNA, 15 nt, Mycobacterium leprae
gguggcgaucggcuc

SEQ ID NO: 3232943 - RNA, 15 nt, Mycobacterium leprae
ggugggcgcagacgu

SEQ ID NO: 3232944 - RNA, 17 nt, Mycobacterium leprae
gguggggccgccagaug

SEQ ID NO: 3232945 - RNA, 16 nt, Mycobacterium leprae
gguggggguggggauc

SEQ ID NO: 3232946 - RNA, 14 nt, Mycobacterium leprae
gguggucgaccgcg

SEQ ID NO: 3232947 - RNA, 20 nt, Mycobacterium leprae
gguggugaaaucguccaggg

SEQ ID NO: 3232948 - RNA, 12 nt, Mycobacterium leprae
ggugguggguga

SEQ ID NO: 3232949 - RNA, 15 nt, Mycobacterium leprae
gguggugggugcugc

SEQ ID NO: 3232950 - RNA, 15 nt, Mycobacterium leprae
ggugguguuccccgu

SEQ ID NO: 3232951 - RNA, 16 nt, Mycobacterium leprae
gguguacacgugcugc

SEQ ID NO: 3232952 - RNA, 15 nt, Mycobacterium leprae
gguguccgggccgca

SEQ ID NO: 3232953 - RNA, 23 nt, Mycobacterium leprae
ggugucgagcuucgguuuuggcg

SEQ ID NO: 3232954 - RNA, 13 nt, Mycobacterium leprae
ggugucggcggcu

SEQ ID NO: 3232955 - RNA, 16 nt, Mycobacterium leprae
ggugucugcgaacagc

SEQ ID NO: 3232956 - RNA, 22 nt, Mycobacterium leprae
gguguggacagcguaucucagc

SEQ ID NO: 3232957 - RNA, 15 nt, Mycobacterium leprae
gguguggagccugcc

SEQ ID NO: 3232958 - RNA, 14 nt, Mycobacterium leprae
gguguggcccgacg

SEQ ID NO: 3232959 - RNA, 21 nt, Mycobacterium leprae
gucaaccuugguugccgcggu

SEQ ID NO: 3232960 - RNA, 22 nt, Mycobacterium leprae
gucaaccuugguugccgcgguu

SEQ ID NO: 3232961 - RNA, 17 nt, Mycobacterium leprae
gucaaccuuugucgcca

SEQ ID NO: 3232962 - RNA, 18 nt, Mycobacterium leprae
gucaacgcgaaaggguag

SEQ ID NO: 3232963 - RNA, 22 nt, Mycobacterium leprae
gucaacggccucacaguaggcc

SEQ ID NO: 3232964 - RNA, 15 nt, Mycobacterium leprae
gucaacucgucggca

SEQ ID NO: 3232965 - RNA, 22 nt, Mycobacterium leprae
gucaagugucggguggucagca

SEQ ID NO: 3232966 - RNA, 14 nt, Mycobacterium leprae
gucaaugcaggugg

SEQ ID NO: 3232967 - RNA, 15 nt, Mycobacterium leprae
gucacagguaaacaa

SEQ ID NO: 3232968 - RNA, 13 nt, Mycobacterium leprae
gucacauuccagu

SEQ ID NO: 3232969 - RNA, 20 nt, Mycobacterium leprae
gucaccaagcgcagaugauc

SEQ ID NO: 3232970 - RNA, 11 nt, Mycobacterium leprae
gucaccacuga

SEQ ID NO: 3232971 - RNA, 23 nt, Mycobacterium leprae
gucaccacugaaccugccaucca

SEQ ID NO: 3232972 - RNA, 21 nt, Mycobacterium leprae
gucacccggggugagacaguc

SEQ ID NO: 3232973 - RNA, 14 nt, Mycobacterium leprae
gucacccuccucgc

SEQ ID NO: 3232974 - RNA, 20 nt, Mycobacterium leprae
gucacccuccucgcggcggu

SEQ ID NO: 3232975 - RNA, 12 nt, Mycobacterium leprae
gucaccgcagcc

SEQ ID NO: 3232976 - RNA, 17 nt, Mycobacterium leprae
gucaccgugcagcguga

SEQ ID NO: 3232977 - RNA, 14 nt, Mycobacterium leprae
gucacgguugcccg

SEQ ID NO: 3232978 - RNA, 15 nt, Mycobacterium leprae
gucacuccacgauuc

SEQ ID NO: 3232979 - RNA, 21 nt, Mycobacterium leprae
gucacuccacgauucugcugg

SEQ ID NO: 3232980 - RNA, 14 nt, Mycobacterium leprae
gucacuccgacggu

SEQ ID NO: 3232981 - RNA, 13 nt, Mycobacterium leprae
gucagaagcuggu

SEQ ID NO: 3232982 - RNA, 18 nt, Mycobacterium leprae
gucagacgaaauuugucg

SEQ ID NO: 3232983 - RNA, 12 nt, Mycobacterium leprae
gucagagugcag

SEQ ID NO: 3232984 - RNA, 10 nt, Mycobacterium leprae
gucagauaac

SEQ ID NO: 3232985 - RNA, 15 nt, Mycobacterium leprae
gucagauaacgggug

SEQ ID NO: 3232986 - RNA, 18 nt, Mycobacterium leprae
gucagauccggccguuga

SEQ ID NO: 3232987 - RNA, 23 nt, Mycobacterium leprae
gucagauggaacaagcgaucgga

SEQ ID NO: 3232988 - RNA, 16 nt, Mycobacterium leprae
gucagcaucggguaaa

SEQ ID NO: 3232989 - RNA, 12 nt, Mycobacterium leprae
gucagccgcggg

SEQ ID NO: 3232990 - RNA, 15 nt, Mycobacterium leprae
gucagccuagcagca

SEQ ID NO: 3232991 - RNA, 15 nt, Mycobacterium leprae
gucagcggacugcua

SEQ ID NO: 3232992 - RNA, 20 nt, Mycobacterium leprae
gucagcgugcuccaggguga

SEQ ID NO: 3232993 - RNA, 21 nt, Mycobacterium leprae
gucagcuggaaucccccauuc

SEQ ID NO: 3232994 - RNA, 21 nt, Mycobacterium leprae
gucagcuggugaccugacauc

SEQ ID NO: 3232995 - RNA, 14 nt, Mycobacterium leprae
gucaguacgcuaga

SEQ ID NO: 3232996 - RNA, 21 nt, Mycobacterium leprae
gucaguaguuuuuggauccug

SEQ ID NO: 3232997 - RNA, 17 nt, Mycobacterium leprae
gucagucagcgugccug

SEQ ID NO: 3232998 - RNA, 13 nt, Mycobacterium leprae
gucaguggcgacg

SEQ ID NO: 3232999 - RNA, 19 nt, Mycobacterium leprae
gucaguuuggcgcugcugc

SEQ ID NO: 3233000 - RNA, 13 nt, Mycobacterium leprae
gucauccacugcg

SEQ ID NO: 3233001 - RNA, 21 nt, Mycobacterium leprae
gucaucccagaacugguccgc

SEQ ID NO: 3233002 - RNA, 19 nt, Mycobacterium leprae
gucaucgacagaugcgauc

SEQ ID NO: 3233003 - RNA, 20 nt, Mycobacterium leprae
gucaucgacgaugccauaga

SEQ ID NO: 3233004 - RNA, 15 nt, Mycobacterium leprae
gucaugauccagcug

SEQ ID NO: 3233005 - RNA, 16 nt, Mycobacterium leprae
gucaugauccagcugu

SEQ ID NO: 3233006 - RNA, 19 nt, Mycobacterium leprae
gucauguucaucacgggug

SEQ ID NO: 3233007 - RNA, 16 nt, Mycobacterium leprae
gucauguucccugacu

SEQ ID NO: 3233008 - RNA, 19 nt, Mycobacterium leprae
gucauuaucgagauuggcg

SEQ ID NO: 3233009 - RNA, 23 nt, Mycobacterium leprae
gucauuaucgagauuggcgaaaa

SEQ ID NO: 3233010 - RNA, 20 nt, Mycobacterium leprae
gucauuggaaaggggccaac

SEQ ID NO: 3233011 - RNA, 15 nt, Mycobacterium leprae
guccaaaugcggugg

SEQ ID NO: 3233012 - RNA, 23 nt, Mycobacterium leprae
guccaaccgacgauuccuggaaa

SEQ ID NO: 3233013 - RNA, 15 nt, Mycobacterium leprae
guccaacgcggcggc

SEQ ID NO: 3233014 - RNA, 14 nt, Mycobacterium leprae
guccaacgugguug

SEQ ID NO: 3233015 - RNA, 18 nt, Mycobacterium leprae
guccaccagccgcaggca

SEQ ID NO: 3233016 - RNA, 12 nt, Mycobacterium leprae
guccacccgcgc

SEQ ID NO: 3233017 - RNA, 13 nt, Mycobacterium leprae
guccacggcagcu

SEQ ID NO: 3233018 - RNA, 21 nt, Mycobacterium leprae
guccacgucggucauuguuag

SEQ ID NO: 3233019 - RNA, 22 nt, Mycobacterium leprae
guccagaaggggcugcggcuac

SEQ ID NO: 3233020 - RNA, 24 nt, Mycobacterium leprae
guccagccaacgggaacagcggcg

SEQ ID NO: 3233021 - RNA, 17 nt, Mycobacterium leprae
guccagguuugcgguca

SEQ ID NO: 3233022 - RNA, 23 nt, Mycobacterium leprae
guccaucuuguuggccggugcua

SEQ ID NO: 3233023 - RNA, 22 nt, Mycobacterium leprae
guccauucgccguccacuggcu

SEQ ID NO: 3233024 - RNA, 18 nt, Mycobacterium leprae
guccauuuucguggcgag

SEQ ID NO: 3233025 - RNA, 18 nt, Mycobacterium leprae
gucccaaggggagcaggu

SEQ ID NO: 3233026 - RNA, 14 nt, Mycobacterium leprae
gucccacggcggca

SEQ ID NO: 3233027 - RNA, 23 nt, Mycobacterium leprae
gucccaggacauauuaagacgcu

SEQ ID NO: 3233028 - RNA, 18 nt, Mycobacterium leprae
gucccaucgcugaccggu

SEQ ID NO: 3233029 - RNA, 14 nt, Mycobacterium leprae
guccccgugcacgg

SEQ ID NO: 3233030 - RNA, 11 nt, Mycobacterium leprae
gucccgagcgg

SEQ ID NO: 3233031 - RNA, 12 nt, Mycobacterium leprae
gucccgcagccg

SEQ ID NO: 3233032 - RNA, 12 nt, Mycobacterium leprae
gucccgcccggc

SEQ ID NO: 3233033 - RNA, 12 nt, Mycobacterium leprae
gucccggugcug

SEQ ID NO: 3233034 - RNA, 17 nt, Mycobacterium leprae
gucccggugcugccugc

SEQ ID NO: 3233035 - RNA, 14 nt, Mycobacterium leprae
gucccugacgcgca

SEQ ID NO: 3233036 - RNA, 16 nt, Mycobacterium leprae
gucccuggggcugcau

SEQ ID NO: 3233037 - RNA, 13 nt, Mycobacterium leprae
guccgagaaucag

SEQ ID NO: 3233038 - RNA, 18 nt, Mycobacterium leprae
guccgagaaucaggccgc

SEQ ID NO: 3233039 - RNA, 20 nt, Mycobacterium leprae
guccgcaaaaugcuccccca

SEQ ID NO: 3233040 - RNA, 13 nt, Mycobacterium leprae
guccgcaaccgau

SEQ ID NO: 3233041 - RNA, 19 nt, Mycobacterium leprae
guccgcgcucgcuuuccgc

SEQ ID NO: 3233042 - RNA, 13 nt, Mycobacterium leprae
guccgcggcggcc

SEQ ID NO: 3233043 - RNA, 18 nt, Mycobacterium leprae
guccgcggcuaucgccgc

SEQ ID NO: 3233044 - RNA, 20 nt, Mycobacterium leprae
guccgcguaaccaacuaggc

SEQ ID NO: 3233045 - RNA, 15 nt, Mycobacterium leprae
guccgcguggaugcc

SEQ ID NO: 3233046 - RNA, 23 nt, Mycobacterium leprae
guccgcuacauugcuccgcagca

SEQ ID NO: 3233047 - RNA, 19 nt, Mycobacterium leprae
guccgguugcguggcugcu

SEQ ID NO: 3233048 - RNA, 23 nt, Mycobacterium leprae
guccgugaucggcaucugguagc

SEQ ID NO: 3233049 - RNA, 20 nt, Mycobacterium leprae
guccuccaguuguaugcgcu

SEQ ID NO: 3233050 - RNA, 22 nt, Mycobacterium leprae
guccuccaguuguaugcgcuaa

SEQ ID NO: 3233051 - RNA, 19 nt, Mycobacterium leprae
guccugacagauacucagc

SEQ ID NO: 3233052 - RNA, 13 nt, Mycobacterium leprae
guccugccggugc

SEQ ID NO: 3233053 - RNA, 19 nt, Mycobacterium leprae
guccugguaccccagcaaa

SEQ ID NO: 3233054 - RNA, 16 nt, Mycobacterium leprae
guccugguggcaacgc

SEQ ID NO: 3233055 - RNA, 15 nt, Mycobacterium leprae
guccuguugauuuuu

SEQ ID NO: 3233056 - RNA, 17 nt, Mycobacterium leprae
guccuuaacugacuggu

SEQ ID NO: 3233057 - RNA, 22 nt, Mycobacterium leprae
guccuugagcuaacagauacca

SEQ ID NO: 3233058 - RNA, 13 nt, Mycobacterium leprae
gucgaaaccaugg

SEQ ID NO: 3233059 - RNA, 19 nt, Mycobacterium leprae
gucgaaacgucaucgacag

SEQ ID NO: 3233060 - RNA, 20 nt, Mycobacterium leprae
gucgaacccucacucaugau

SEQ ID NO: 3233061 - RNA, 14 nt, Mycobacterium leprae
gucgaacgcacugg

SEQ ID NO: 3233062 - RNA, 17 nt, Mycobacterium leprae
gucgaacgcacuggaga

SEQ ID NO: 3233063 - RNA, 23 nt, Mycobacterium leprae
gucgaagggcugguggccgaggu

SEQ ID NO: 3233064 - RNA, 15 nt, Mycobacterium leprae
gucgaaggugagucg

SEQ ID NO: 3233065 - RNA, 20 nt, Mycobacterium leprae
gucgaccgccgaagcagcca

SEQ ID NO: 3233066 - RNA, 20 nt, Mycobacterium leprae
gucgacgaugugcagcagcu

SEQ ID NO: 3233067 - RNA, 20 nt, Mycobacterium leprae
gucgacggcggccgccacgc

SEQ ID NO: 3233068 - RNA, 18 nt, Mycobacterium leprae
gucgacgguaaguuuuca

SEQ ID NO: 3233069 - RNA, 16 nt, Mycobacterium leprae
gucgacguguucacgc

SEQ ID NO: 3233070 - RNA, 17 nt, Mycobacterium leprae
gucgacuucgcagccac

SEQ ID NO: 3233071 - RNA, 21 nt, Mycobacterium leprae
gucgagacacagaucgagcga

SEQ ID NO: 3233072 - RNA, 22 nt, Mycobacterium leprae
gugaccgcggugcagugccgcc

SEQ ID NO: 3233073 - RNA, 13 nt, Mycobacterium leprae
gugaccgugcagc

SEQ ID NO: 3233074 - RNA, 17 nt, Mycobacterium leprae
gugaccgugcagcugcc

SEQ ID NO: 3233075 - RNA, 18 nt, Mycobacterium leprae
gugaccgugcagcugcca

SEQ ID NO: 3233076 - RNA, 17 nt, Mycobacterium leprae
gugacgacauacucgac

SEQ ID NO: 3233077 - RNA, 15 nt, Mycobacterium leprae
gugacgcgggcgccg

SEQ ID NO: 3233078 - RNA, 19 nt, Mycobacterium leprae
gugacgcgggcgccgcagu

SEQ ID NO: 3233079 - RNA, 13 nt, Mycobacterium leprae
gugacggcuggua

SEQ ID NO: 3233080 - RNA, 13 nt, Mycobacterium leprae
gugacggucgugc

SEQ ID NO: 3233081 - RNA, 19 nt, Mycobacterium leprae
gugacuaguccggaaagau

SEQ ID NO: 3233082 - RNA, 16 nt, Mycobacterium leprae
gugacucaacauaaca

SEQ ID NO: 3233083 - RNA, 23 nt, Mycobacterium leprae
gugacucgauuggacauguucac

SEQ ID NO: 3233084 - RNA, 14 nt, Mycobacterium leprae
gugacugcggcuca

SEQ ID NO: 3233085 - RNA, 15 nt, Mycobacterium leprae
gugacugcguuucau

SEQ ID NO: 3233086 - RNA, 13 nt, Mycobacterium leprae
gugacuuggcugg

SEQ ID NO: 3233087 - RNA, 14 nt, Mycobacterium leprae
gugagacauuucau

SEQ ID NO: 3233088 - RNA, 18 nt, Mycobacterium leprae
gugagccggucggcggcg

SEQ ID NO: 3233089 - RNA, 23 nt, Mycobacterium leprae
gugagccuaugcggccagccagg

SEQ ID NO: 3233090 - RNA, 13 nt, Mycobacterium leprae
gugaggguaguug

SEQ ID NO: 3233091 - RNA, 16 nt, Mycobacterium leprae
gugaggguaguuguua

SEQ ID NO: 3233092 - RNA, 16 nt, Mycobacterium leprae
gugaggucgaagcugc

SEQ ID NO: 3233093 - RNA, 22 nt, Mycobacterium leprae
gugaggugugaccgugcagcug

SEQ ID NO: 3233094 - RNA, 19 nt, Mycobacterium leprae
gugagugaaagaggccgac

SEQ ID NO: 3233095 - RNA, 21 nt, Mycobacterium leprae
gugagugauacuaggucgccu

SEQ ID NO: 3233096 - RNA, 17 nt, Mycobacterium leprae
gugaucacccgcuggug

SEQ ID NO: 3233097 - RNA, 15 nt, Mycobacterium leprae
gugauccgucgcacg

SEQ ID NO: 3233098 - RNA, 17 nt, Mycobacterium leprae
gugaucgacggcuggca

SEQ ID NO: 3233099 - RNA, 17 nt, Mycobacterium leprae
gugaucgcuaguuuacu

SEQ ID NO: 3233100 - RNA, 16 nt, Mycobacterium leprae
gugaucgcugccggcg

SEQ ID NO: 3233101 - RNA, 23 nt, Mycobacterium leprae
gugaucguaggucgcccggugac

SEQ ID NO: 3233102 - RNA, 14 nt, Mycobacterium leprae
gugaucgugguggg

SEQ ID NO: 3233103 - RNA, 16 nt, Mycobacterium leprae
gugaugaucacccgcg

SEQ ID NO: 3233104 - RNA, 14 nt, Mycobacterium leprae
gugaugaucggcaa

SEQ ID NO: 3233105 - RNA, 13 nt, Mycobacterium leprae
gugauucgggaca

SEQ ID NO: 3233106 - RNA, 14 nt, Mycobacterium leprae
gugauuggcugcug

SEQ ID NO: 3233107 - RNA, 16 nt, Mycobacterium leprae
gugcaccaucugcucu

SEQ ID NO: 3233108 - RNA, 21 nt, Mycobacterium leprae
gugcacugcuucggccagcgc

SEQ ID NO: 3233109 - RNA, 14 nt, Mycobacterium leprae
gugcacuugcacua

SEQ ID NO: 3233110 - RNA, 12 nt, Mycobacterium leprae
gugcagccucau

SEQ ID NO: 3233111 - RNA, 12 nt, Mycobacterium leprae
gugcaggcaguc

SEQ ID NO: 3233112 - RNA, 15 nt, Mycobacterium leprae
gugcagucaaacuuu

SEQ ID NO: 3233113 - RNA, 15 nt, Mycobacterium leprae
gugcaguccucugga

SEQ ID NO: 3233114 - RNA, 22 nt, Mycobacterium leprae
gugcauccagucguugacgaua

SEQ ID NO: 3233115 - RNA, 17 nt, Mycobacterium leprae
gugcauguucuguugug

SEQ ID NO: 3233116 - RNA, 22 nt, Mycobacterium leprae
gugcauguucuguugugggggu

SEQ ID NO: 3233117 - RNA, 23 nt, Mycobacterium leprae
gugcauguucuguugugggggug

SEQ ID NO: 3233118 - RNA, 17 nt, Mycobacterium leprae
gugcauuaacggcuucc

SEQ ID NO: 3233119 - RNA, 23 nt, Mycobacterium leprae
gugccaacgcgcaccugguggug

SEQ ID NO: 3233120 - RNA, 13 nt, Mycobacterium leprae
gugccagcucguc

SEQ ID NO: 3233121 - RNA, 16 nt, Mycobacterium leprae
gugccaguucccuaca

SEQ ID NO: 3233122 - RNA, 21 nt, Mycobacterium leprae
gugccaguucccuacacucau

SEQ ID NO: 3233123 - RNA, 17 nt, Mycobacterium leprae
gugcccaggugaaucgg

SEQ ID NO: 3233124 - RNA, 22 nt, Mycobacterium leprae
gugcccucgcugccgugugcuu

SEQ ID NO: 3233125 - RNA, 19 nt, Mycobacterium leprae
gugccgagcuggccggggc

SEQ ID NO: 3233126 - RNA, 13 nt, Mycobacterium leprae
gugccgcaggcac

SEQ ID NO: 3233127 - RNA, 20 nt, Mycobacterium leprae
gugccgcaggcacccguuga

SEQ ID NO: 3233128 - RNA, 15 nt, Mycobacterium leprae
gugccgcgaccgcca

SEQ ID NO: 3233129 - RNA, 13 nt, Mycobacterium leprae
gugccgcugacca

SEQ ID NO: 3233130 - RNA, 15 nt, Mycobacterium leprae
gugccggccucgugc

SEQ ID NO: 3233131 - RNA, 22 nt, Mycobacterium leprae
gugccggccucgugcugcgugc

SEQ ID NO: 3233132 - RNA, 19 nt, Mycobacterium leprae
gugccguaagacacuuccu

SEQ ID NO: 3233133 - RNA, 16 nt, Mycobacterium leprae
gugccguaaugugcag

SEQ ID NO: 3233134 - RNA, 16 nt, Mycobacterium leprae
gugccguugcauucga

SEQ ID NO: 3233135 - RNA, 19 nt, Mycobacterium leprae
gugccguuggcccaccgcc

SEQ ID NO: 3233136 - RNA, 17 nt, Mycobacterium leprae
gugccuauuucacuggc

SEQ ID NO: 3233137 - RNA, 20 nt, Mycobacterium leprae
gugccuauuucacuggcccg

SEQ ID NO: 3233138 - RNA, 19 nt, Mycobacterium leprae
gugccuccggcguuuacug

SEQ ID NO: 3233139 - RNA, 18 nt, Mycobacterium leprae
gugccuguucaggugcgg

SEQ ID NO: 3233140 - RNA, 15 nt, Mycobacterium leprae
gugccuugacuucuu

SEQ ID NO: 3233141 - RNA, 23 nt, Mycobacterium leprae
gugccuugcggcagggcguugcc

SEQ ID NO: 3233142 - RNA, 14 nt, Mycobacterium leprae
gugcgaaaacacuu

SEQ ID NO: 3233143 - RNA, 17 nt, Mycobacterium leprae
gugcgaccugaacauua

SEQ ID NO: 3233144 - RNA, 17 nt, Mycobacterium leprae
gugcgcacuggguggau

SEQ ID NO: 3233145 - RNA, 13 nt, Mycobacterium leprae
gugcgccaacacu

SEQ ID NO: 3233146 - RNA, 19 nt, Mycobacterium leprae
gugcgcguauuucgagcgu

SEQ ID NO: 3233147 - RNA, 19 nt, Mycobacterium leprae
gugcgcuauacuugcugca

SEQ ID NO: 3233148 - RNA, 15 nt, Mycobacterium leprae
gugcggcagcugcca

SEQ ID NO: 3233149 - RNA, 22 nt, Mycobacterium leprae
gugcggucccaucgcugaccgg

SEQ ID NO: 3233150 - RNA, 19 nt, Mycobacterium leprae
gugcguaaggaagaugaca

SEQ ID NO: 3233151 - RNA, 17 nt, Mycobacterium leprae
gugcguauucggcguca

SEQ ID NO: 3233152 - RNA, 23 nt, Mycobacterium leprae
gugcgucauggcacugggcugcu

SEQ ID NO: 3233153 - RNA, 14 nt, Mycobacterium leprae
gugcgugccacauu

SEQ ID NO: 3233154 - RNA, 17 nt, Mycobacterium leprae
gugcguugacgaccggc

SEQ ID NO: 3233155 - RNA, 23 nt, Mycobacterium leprae
gugcguugacgaccggcugcacc

SEQ ID NO: 3233156 - RNA, 13 nt, Mycobacterium leprae
gugcuaaccgauc

SEQ ID NO: 3233157 - RNA, 15 nt, Mycobacterium leprae
gugcuaaccgauccg

SEQ ID NO: 3233158 - RNA, 20 nt, Mycobacterium leprae
gugcuccugacucgccggug

SEQ ID NO: 3233159 - RNA, 12 nt, Mycobacterium leprae
gugcucggucag

SEQ ID NO: 3233160 - RNA, 17 nt, Mycobacterium leprae
gugcugagagcagaugg

SEQ ID NO: 3233161 - RNA, 16 nt, Mycobacterium leprae
gugcugaguccgauga

SEQ ID NO: 3233162 - RNA, 16 nt, Mycobacterium leprae
gugcugaucaccggcc

SEQ ID NO: 3233163 - RNA, 18 nt, Mycobacterium leprae
gugcugaucaccggccag

SEQ ID NO: 3233164 - RNA, 15 nt, Mycobacterium leprae
gugcugauggccggc

SEQ ID NO: 3233165 - RNA, 15 nt, Mycobacterium leprae
gugcugccagggcuc

SEQ ID NO: 3233166 - RNA, 22 nt, Mycobacterium leprae
gugcugcccgacgaggcgguga

SEQ ID NO: 3233167 - RNA, 22 nt, Mycobacterium leprae
gugcugcgcgguugguccuuac

SEQ ID NO: 3233168 - RNA, 17 nt, Mycobacterium leprae
gugcugcugcuggugga

SEQ ID NO: 3233169 - RNA, 12 nt, Mycobacterium leprae
gugcugucaucc

SEQ ID NO: 3233170 - RNA, 14 nt, Mycobacterium leprae
gugcuguugucagc

SEQ ID NO: 3233171 - RNA, 15 nt, Mycobacterium leprae
gugcuuaacgccgcc

SEQ ID NO: 3233172 - RNA, 17 nt, Mycobacterium leprae
gugcuuaacgccgccuu

SEQ ID NO: 3233173 - RNA, 19 nt, Mycobacterium leprae
gugcuuagcauagcggccg

SEQ ID NO: 3233174 - RNA, 17 nt, Mycobacterium leprae
gugcuuggcagcccuug

SEQ ID NO: 3233175 - RNA, 15 nt, Mycobacterium leprae
gugcuuugccgcagu

SEQ ID NO: 3233176 - RNA, 18 nt, Mycobacterium leprae
guggaauccgcugcacga

SEQ ID NO: 3233177 - RNA, 18 nt, Mycobacterium leprae
guggaaucggguuuuaga

SEQ ID NO: 3233178 - RNA, 22 nt, Mycobacterium leprae
guggacagcguaucucagcucc

SEQ ID NO: 3233179 - RNA, 15 nt, Mycobacterium leprae
guggaguaaagggug

SEQ ID NO: 3233180 - RNA, 16 nt, Mycobacterium leprae
guggaguaaagggugg

SEQ ID NO: 3233181 - RNA, 17 nt, Mycobacterium leprae
guggaguaaaggguggc

SEQ ID NO: 3233182 - RNA, 21 nt, Mycobacterium leprae
guggaguaaaggguggcggug

SEQ ID NO: 3233183 - RNA, 20 nt, Mycobacterium leprae
guggagucggaguuugcgcu

SEQ ID NO: 3233184 - RNA, 18 nt, Mycobacterium leprae
guggauaccacugacggg

SEQ ID NO: 3233185 - RNA, 14 nt, Mycobacterium leprae
guuagcgagggucg

SEQ ID NO: 3233186 - RNA, 21 nt, Mycobacterium leprae
guuagcgcagcaugguggcca

SEQ ID NO: 3233187 - RNA, 22 nt, Mycobacterium leprae
guuagguugguggugaaaucgu

SEQ ID NO: 3233188 - RNA, 17 nt, Mycobacterium leprae
guuagugaacagugcau

SEQ ID NO: 3233189 - RNA, 13 nt, Mycobacterium leprae
guuauaaguuaua

SEQ ID NO: 3233190 - RNA, 22 nt, Mycobacterium leprae
guuauauuguccgagcuuuucc

SEQ ID NO: 3233191 - RNA, 17 nt, Mycobacterium leprae
guuauccacagcaucaa

SEQ ID NO: 3233192 - RNA, 19 nt, Mycobacterium leprae
guuaucggaagcguuguaa

SEQ ID NO: 3233193 - RNA, 18 nt, Mycobacterium leprae
guuaucuaaaucauucaa

SEQ ID NO: 3233194 - RNA, 21 nt, Mycobacterium leprae
guuaugcgucguacucuggcu

SEQ ID NO: 3233195 - RNA, 22 nt, Mycobacterium leprae
guuauugcggucacagagcugu

SEQ ID NO: 3233196 - RNA, 23 nt, Mycobacterium leprae
guuauugcggucacagagcugug

SEQ ID NO: 3233197 - RNA, 23 nt, Mycobacterium leprae
guucagccgucgcugugccaagu

SEQ ID NO: 3233198 - RNA, 23 nt, Mycobacterium leprae
guucagcgaagaguuucugcugc

SEQ ID NO: 3233199 - RNA, 19 nt, Mycobacterium leprae
guucagugccguaaaucgu

SEQ ID NO: 3233200 - RNA, 16 nt, Mycobacterium leprae
guucagugcguugucg

SEQ ID NO: 3233201 - RNA, 17 nt, Mycobacterium leprae
guucaucacggguggug

SEQ ID NO: 3233202 - RNA, 18 nt, Mycobacterium leprae
guucaugccgcuugauuu

SEQ ID NO: 3233203 - RNA, 21 nt, Mycobacterium leprae
guucauggcaguccacaggac

SEQ ID NO: 3233204 - RNA, 16 nt, Mycobacterium leprae
guucauuaugggggug

SEQ ID NO: 3233205 - RNA, 21 nt, Mycobacterium leprae
guuccaagauggcgucaccgu

SEQ ID NO: 3233206 - RNA, 19 nt, Mycobacterium leprae
guuccaccguuacggccau

SEQ ID NO: 3233207 - RNA, 17 nt, Mycobacterium leprae
guuccacugucgcccga

SEQ ID NO: 3233208 - RNA, 12 nt, Mycobacterium leprae
guuccagugccu

SEQ ID NO: 3233209 - RNA, 18 nt, Mycobacterium leprae
guuccauuccagaugccg

SEQ ID NO: 3233210 - RNA, 18 nt, Mycobacterium leprae
guuccgcaauuucggcgu

SEQ ID NO: 3233211 - RNA, 21 nt, Mycobacterium leprae
guuccgcugauacgugccggc

SEQ ID NO: 3233212 - RNA, 16 nt, Mycobacterium leprae
guuccggcgaccagcg

SEQ ID NO: 3233213 - RNA, 18 nt, Mycobacterium leprae
guuccgucucucaggccg

SEQ ID NO: 3233214 - RNA, 14 nt, Mycobacterium leprae
guuccguugauggu

SEQ ID NO: 3233215 - RNA, 13 nt, Mycobacterium leprae
guuccuggcuggc

SEQ ID NO: 3233216 - RNA, 15 nt, Mycobacterium leprae
guuccuggcuggcca

SEQ ID NO: 3233217 - RNA, 15 nt, Mycobacterium leprae
guucgaccaggaugu

SEQ ID NO: 3233218 - RNA, 15 nt, Mycobacterium leprae
guucgacuucugguu

SEQ ID NO: 3233219 - RNA, 16 nt, Mycobacterium leprae
guucgaucggcagcca

SEQ ID NO: 3233220 - RNA, 21 nt, Mycobacterium leprae
guucgaugccccaucucaucu

SEQ ID NO: 3233221 - RNA, 13 nt, Mycobacterium leprae
guucgauucugcc

SEQ ID NO: 3233222 - RNA, 16 nt, Mycobacterium leprae
guucggccauggcagc

SEQ ID NO: 3233223 - RNA, 17 nt, Mycobacterium leprae
guucggcuacggcugau

SEQ ID NO: 3233224 - RNA, 15 nt, Mycobacterium leprae
guucggugacuucgg

SEQ ID NO: 3233225 - RNA, 18 nt, Mycobacterium leprae
guucuccagucgcauccu

SEQ ID NO: 3233226 - RNA, 13 nt, Mycobacterium leprae
guucugccaugcc

SEQ ID NO: 3233227 - RNA, 19 nt, Mycobacterium leprae
guucugcgcuggccacaaa

SEQ ID NO: 3233228 - RNA, 20 nt, Mycobacterium leprae
guucugcugauauagcgcuc

SEQ ID NO: 3233229 - RNA, 14 nt, Mycobacterium leprae
guucuguccgcaca

SEQ ID NO: 3233230 - RNA, 22 nt, Mycobacterium leprae
guucuugaccgucaugcugcuc

SEQ ID NO: 3233231 - RNA, 17 nt, Mycobacterium leprae
guucuuggcuugcuguc

SEQ ID NO: 3233232 - RNA, 22 nt, Mycobacterium leprae
guugaauuguacuuugugugca

SEQ ID NO: 3233233 - RNA, 23 nt, Mycobacterium leprae
guugacaaagcccacgccuagcu

SEQ ID NO: 3233234 - RNA, 14 nt, Mycobacterium leprae
guugacugggaaca

SEQ ID NO: 3233235 - RNA, 20 nt, Mycobacterium leprae
guugacuuuaacgacaucgc

SEQ ID NO: 3233236 - RNA, 19 nt, Mycobacterium leprae
guugagcgcagccaccacu

SEQ ID NO: 3233237 - RNA, 16 nt, Mycobacterium leprae
guugagcucgaggaga

SEQ ID NO: 3233238 - RNA, 19 nt, Mycobacterium leprae
guugcaaaucaccagcgac

SEQ ID NO: 3233239 - RNA, 20 nt, Mycobacterium leprae
guugcaaaucaccagcgacg

SEQ ID NO: 3233240 - RNA, 22 nt, Mycobacterium leprae
guugcacggcaauggcccgagc

SEQ ID NO: 3233241 - RNA, 20 nt, Mycobacterium leprae
guugccaucgacgccgccgu

SEQ ID NO: 3233242 - RNA, 16 nt, Mycobacterium leprae
guugccguaugugccg

SEQ ID NO: 3233243 - RNA, 14 nt, Mycobacterium leprae
guugccgugaggau

SEQ ID NO: 3233244 - RNA, 21 nt, Mycobacterium leprae
guugcgcuggaaggagcgcgc

SEQ ID NO: 3233245 - RNA, 16 nt, Mycobacterium leprae
guugcgggguuuuugu

SEQ ID NO: 3233246 - RNA, 16 nt, Mycobacterium leprae
guugcguaauggccgg

SEQ ID NO: 3233247 - RNA, 22 nt, Mycobacterium leprae
guugcguaauggccggcgccug

SEQ ID NO: 3233248 - RNA, 15 nt, Mycobacterium leprae
guugcucgucaucga

SEQ ID NO: 3233249 - RNA, 14 nt, Mycobacterium leprae
guugcugaguguug

SEQ ID NO: 3233250 - RNA, 17 nt, Mycobacterium leprae
guugcuuguugccgccg

SEQ ID NO: 3233251 - RNA, 19 nt, Mycobacterium leprae
guugcuuuggggguugcac

SEQ ID NO: 3233252 - RNA, 21 nt, Mycobacterium leprae
guuggacaacacguuucugca

SEQ ID NO: 3233253 - RNA, 18 nt, Mycobacterium leprae
guuggauuaccggcugcg

SEQ ID NO: 3233254 - RNA, 24 nt, Mycobacterium leprae
guuggauucgguguugcuggcggu

SEQ ID NO: 3233255 - RNA, 19 nt, Mycobacterium leprae
guuggcccaccgccggacg

SEQ ID NO: 3233256 - RNA, 16 nt, Mycobacterium leprae
guuggcgccugccacu

SEQ ID NO: 3233257 - RNA, 20 nt, Mycobacterium leprae
guuggcggauauuuacucaa

SEQ ID NO: 3233258 - RNA, 15 nt, Mycobacterium leprae
guuggcucgacguga

SEQ ID NO: 3233259 - RNA, 22 nt, Mycobacterium leprae
guugggagugcuagcggcgcca

SEQ ID NO: 3233260 - RNA, 14 nt, Mycobacterium leprae
guugggugggggug

SEQ ID NO: 3233261 - RNA, 14 nt, Mycobacterium leprae
guugguagcuggcu

SEQ ID NO: 3233262 - RNA, 17 nt, Mycobacterium leprae
guuggucggcgcuggcg

SEQ ID NO: 3233263 - RNA, 20 nt, Mycobacterium leprae
guuggucggcgcuggcggug

SEQ ID NO: 3233264 - RNA, 16 nt, Mycobacterium leprae
guugguggguggcuga

SEQ ID NO: 3233265 - RNA, 17 nt, Mycobacterium leprae
guugguuaaucaccuca

SEQ ID NO: 3233266 - RNA, 21 nt, Mycobacterium leprae
guugguuucauaggugguggg

SEQ ID NO: 3233267 - RNA, 16 nt, Mycobacterium leprae
guuguaguagaccuug

SEQ ID NO: 3233268 - RNA, 14 nt, Mycobacterium leprae
guugucccgcccgg

SEQ ID NO: 3233269 - RNA, 13 nt, Mycobacterium leprae
guugucgucggcc

SEQ ID NO: 3233270 - RNA, 21 nt, Mycobacterium leprae
guugugaaccacugcgcccug

SEQ ID NO: 3233271 - RNA, 15 nt, Mycobacterium leprae
guugugccgcugcau

SEQ ID NO: 3233272 - RNA, 21 nt, Mycobacterium leprae
guugugccgcugcauccgcag

SEQ ID NO: 3233273 - RNA, 17 nt, Mycobacterium leprae
guuguggguguuuuguc

SEQ ID NO: 3233274 - RNA, 15 nt, Mycobacterium leprae
guuguuagugcugcu

SEQ ID NO: 3233275 - RNA, 13 nt, Mycobacterium leprae
guuguugauggug

SEQ ID NO: 3233276 - RNA, 15 nt, Mycobacterium leprae
guuuacaacguugcu

SEQ ID NO: 3233277 - RNA, 17 nt, Mycobacterium leprae
guuuacaucggagggga

SEQ ID NO: 3233278 - RNA, 12 nt, Mycobacterium leprae
guuuaccgauuc

SEQ ID NO: 3233279 - RNA, 16 nt, Mycobacterium leprae
guuuaggaaacauugu

SEQ ID NO: 3233280 - RNA, 17 nt, Mycobacterium leprae
guuucacaaccaucgcu

SEQ ID NO: 3233281 - RNA, 15 nt, Mycobacterium leprae
guuucauagguggug

SEQ ID NO: 3233282 - RNA, 17 nt, Mycobacterium leprae
guuucauaggugguggg

SEQ ID NO: 3233283 - RNA, 20 nt, Mycobacterium leprae
guuucauaggugguggguga

SEQ ID NO: 3233284 - RNA, 12 nt, Mycobacterium leprae
guuucaucgacg

SEQ ID NO: 3233285 - RNA, 14 nt, Mycobacterium leprae
guuucccagagcuc

SEQ ID NO: 3233286 - RNA, 23 nt, Mycobacterium leprae
guuucggcgccucgucgcacaaa

SEQ ID NO: 3233287 - RNA, 17 nt, Mycobacterium leprae
guuucguggcaagcgcg

SEQ ID NO: 3233288 - RNA, 21 nt, Mycobacterium leprae
guuucuuggguaacaauccug

SEQ ID NO: 3233289 - RNA, 16 nt, Mycobacterium leprae
guuugagaacagccuu

SEQ ID NO: 3233290 - RNA, 20 nt, Mycobacterium leprae
guuugauccagccgaacaaa

SEQ ID NO: 3233291 - RNA, 21 nt, Mycobacterium leprae
guuuggaugcguugucgucgg

SEQ ID NO: 3233292 - RNA, 21 nt, Mycobacterium leprae
guuugggugguguuguggugg

SEQ ID NO: 3233293 - RNA, 17 nt, Mycobacterium leprae
guuugguuuggguggug

SEQ ID NO: 3233294 - RNA, 14 nt, Mycobacterium leprae
guuugguuuuguug

SEQ ID NO: 3233295 - RNA, 17 nt, Mycobacterium leprae
guuugugucuguggcgg

SEQ ID NO: 3233296 - RNA, 15 nt, Mycobacterium leprae
guuuguucagugccg

SEQ ID NO: 3233297 - RNA, 16 nt, Mycobacterium leprae
guuuucaaguucucaa

SEQ ID NO: 3233298 - RNA, 18 nt, Mycobacterium leprae
uaccgguacgcugcauga

SEQ ID NO: 3233299 - RNA, 22 nt, Mycobacterium leprae
uaccgucuaguggcgcggcacg

SEQ ID NO: 3233300 - RNA, 17 nt, Mycobacterium leprae
uaccugaccgaaccgau

SEQ ID NO: 3233301 - RNA, 13 nt, Mycobacterium leprae
uaccugagucggc

SEQ ID NO: 3233302 - RNA, 20 nt, Mycobacterium leprae
uaccugcgaccuggugucgc

SEQ ID NO: 3233303 - RNA, 18 nt, Mycobacterium leprae
uaccugcguggccuccga

SEQ ID NO: 3233304 - RNA, 13 nt, Mycobacterium leprae
uaccugggccagg

SEQ ID NO: 3233305 - RNA, 14 nt, Mycobacterium leprae
uaccugggccaggg

SEQ ID NO: 3233306 - RNA, 15 nt, Mycobacterium leprae
uacgaaagaugcugc

SEQ ID NO: 3233307 - RNA, 22 nt, Mycobacterium leprae
uacgaaggggucgaugaggcuc

SEQ ID NO: 3233308 - RNA, 22 nt, Mycobacterium leprae
uacgacaaaauuuucaggcugu

SEQ ID NO: 3233309 - RNA, 23 nt, Mycobacterium leprae
uacgcgacauacaaucgcggcac

SEQ ID NO: 3233310 - RNA, 17 nt, Mycobacterium leprae
uacgcgaucuaccccgg

SEQ ID NO: 3233311 - RNA, 23 nt, Mycobacterium leprae
uacgcuaaucgcgggcaagcccu

SEQ ID NO: 3233312 - RNA, 22 nt, Mycobacterium leprae
uacggagauagacaugugugcu

SEQ ID NO: 3233313 - RNA, 20 nt, Mycobacterium leprae
uacggagccaguggcguggc

SEQ ID NO: 3233314 - RNA, 22 nt, Mycobacterium leprae
uacggcaaccuucuagcgcaga

SEQ ID NO: 3233315 - RNA, 20 nt, Mycobacterium leprae
uacggcgacguuuugucuuc

SEQ ID NO: 3233316 - RNA, 17 nt, Mycobacterium leprae
uacggcgguguuucucg

SEQ ID NO: 3233317 - RNA, 14 nt, Mycobacterium leprae
uacgggugaagcau

SEQ ID NO: 3233318 - RNA, 14 nt, Mycobacterium leprae
uacgguuaauauac

SEQ ID NO: 3233319 - RNA, 16 nt, Mycobacterium leprae
uacguagcgucggcgg

SEQ ID NO: 3233320 - RNA, 18 nt, Mycobacterium leprae
uacguccacuagccagua

SEQ ID NO: 3233321 - RNA, 22 nt, Mycobacterium leprae
uacguccgcgccggcgucggcc

SEQ ID NO: 3233322 - RNA, 17 nt, Mycobacterium leprae
uacgugccaacucggcc

SEQ ID NO: 3233323 - RNA, 14 nt, Mycobacterium leprae
uacgugguggcugc

SEQ ID NO: 3233324 - RNA, 16 nt, Mycobacterium leprae
uacuaccaaugagcag

SEQ ID NO: 3233325 - RNA, 13 nt, Mycobacterium leprae
uacuaucacgaau

SEQ ID NO: 3233326 - RNA, 18 nt, Mycobacterium leprae
uacucagcgguaaauacu

SEQ ID NO: 3233327 - RNA, 13 nt, Mycobacterium leprae
uacucguuucuca

SEQ ID NO: 3233328 - RNA, 14 nt, Mycobacterium leprae
uacucguuucucau

SEQ ID NO: 3233329 - RNA, 15 nt, Mycobacterium leprae
uacucuggcuggucg

SEQ ID NO: 3233330 - RNA, 15 nt, Mycobacterium leprae
uacugagguacccgc

SEQ ID NO: 3233331 - RNA, 14 nt, Mycobacterium leprae
uacugaugggcagc

SEQ ID NO: 3233332 - RNA, 21 nt, Mycobacterium leprae
uacugcaauccguggagagca

SEQ ID NO: 3233333 - RNA, 21 nt, Mycobacterium leprae
uacugcgacagcagccacuga

SEQ ID NO: 3233334 - RNA, 21 nt, Mycobacterium leprae
uacugcgaucgcaaauauaau

SEQ ID NO: 3233335 - RNA, 17 nt, Mycobacterium leprae
uacugugaucgcaugcc

SEQ ID NO: 3233336 - RNA, 14 nt, Mycobacterium leprae
uacuguugucagug

SEQ ID NO: 3233337 - RNA, 18 nt, Mycobacterium leprae
uacuugcguugcggcuua

SEQ ID NO: 3233338 - RNA, 23 nt, Mycobacterium leprae
uacuugugauucagcgcugauau

SEQ ID NO: 3233339 - RNA, 18 nt, Mycobacterium leprae
uagaacacguucuugcca

SEQ ID NO: 3233340 - RNA, 19 nt, Mycobacterium leprae
uagaacgguuugccaugca

SEQ ID NO: 3233341 - RNA, 14 nt, Mycobacterium leprae
uagaccaagcagca

SEQ ID NO: 3233342 - RNA, 13 nt, Mycobacterium leprae
uagaccagaagcu

SEQ ID NO: 3233343 - RNA, 15 nt, Mycobacterium leprae
uagaccaugagcaca

SEQ ID NO: 3233344 - RNA, 20 nt, Mycobacterium leprae
uagacgagggugacgguggc

SEQ ID NO: 3233345 - RNA, 20 nt, Mycobacterium leprae
uagacgggaggaagauaucc

SEQ ID NO: 3233346 - RNA, 12 nt, Mycobacterium leprae
uagacgugcaca

SEQ ID NO: 3233347 - RNA, 16 nt, Mycobacterium leprae
uagacuaugaagacca

SEQ ID NO: 3233348 - RNA, 17 nt, Mycobacterium leprae
uagagaaaacuuaauau

SEQ ID NO: 3233349 - RNA, 17 nt, Mycobacterium leprae
uagagaagaauuaauau

SEQ ID NO: 3233350 - RNA, 17 nt, Mycobacterium leprae
uagagagguuuuccacu

SEQ ID NO: 3233351 - RNA, 19 nt, Mycobacterium leprae
uagaggaucugcacaacac

SEQ ID NO: 3233352 - RNA, 17 nt, Mycobacterium leprae
uagaggcugcaccggcu

SEQ ID NO: 3233353 - RNA, 11 nt, Mycobacterium leprae
uagagugcagc

SEQ ID NO: 3233354 - RNA, 12 nt, Mycobacterium leprae
uagagugcagca

SEQ ID NO: 3233355 - RNA, 19 nt, Mycobacterium leprae
uagagugcagcacaagacu

SEQ ID NO: 3233356 - RNA, 15 nt, Mycobacterium leprae
uagaucaacagcgca

SEQ ID NO: 3233357 - RNA, 19 nt, Mycobacterium leprae
uagaucuugcagcuggcgg

SEQ ID NO: 3233358 - RNA, 19 nt, Mycobacterium leprae
uagauugacaccgccggcg

SEQ ID NO: 3233359 - RNA, 19 nt, Mycobacterium leprae
uagcaacaaauucgccgcg

SEQ ID NO: 3233360 - RNA, 12 nt, Mycobacterium leprae
uagcaacgucac

SEQ ID NO: 3233361 - RNA, 14 nt, Mycobacterium leprae
uagcaagccgccag

SEQ ID NO: 3233362 - RNA, 16 nt, Mycobacterium leprae
uagcaaguuguuaaga

SEQ ID NO: 3233363 - RNA, 18 nt, Mycobacterium leprae
uagcaauaaccagggccg

SEQ ID NO: 3233364 - RNA, 22 nt, Mycobacterium leprae
uagcaaucuuugccuucgugau

SEQ ID NO: 3233365 - RNA, 23 nt, Mycobacterium leprae
uagcaggucgccgaggcgacuga

SEQ ID NO: 3233366 - RNA, 16 nt, Mycobacterium leprae
uagcaucgaccacguc

SEQ ID NO: 3233367 - RNA, 20 nt, Mycobacterium leprae
uagcaugacgucuucuauac

SEQ ID NO: 3233368 - RNA, 14 nt, Mycobacterium leprae
uagcaugagcugcu

SEQ ID NO: 3233369 - RNA, 20 nt, Mycobacterium leprae
uagcauguacuuaccugcgc

SEQ ID NO: 3233370 - RNA, 20 nt, Mycobacterium leprae
uagcauuccucgugugugua

SEQ ID NO: 3233371 - RNA, 16 nt, Mycobacterium leprae
uagccaacaccgcggc

SEQ ID NO: 3233372 - RNA, 18 nt, Mycobacterium leprae
uagcccgccgcggcgggc

SEQ ID NO: 3233373 - RNA, 22 nt, Mycobacterium leprae
uagcccuccggaaauacggcag

SEQ ID NO: 3233374 - RNA, 19 nt, Mycobacterium leprae
uagccgauuagacacacuu

SEQ ID NO: 3233375 - RNA, 17 nt, Mycobacterium leprae
uagccgcuugccucaac

SEQ ID NO: 3233376 - RNA, 20 nt, Mycobacterium leprae
uagccggcuuuggcggacug

SEQ ID NO: 3233377 - RNA, 16 nt, Mycobacterium leprae
uagcgauguagccaac

SEQ ID NO: 3233378 - RNA, 18 nt, Mycobacterium leprae
uagcgauucgggagagga

SEQ ID NO: 3233379 - RNA, 14 nt, Mycobacterium leprae
uagcgccgagcacu

SEQ ID NO: 3233380 - RNA, 17 nt, Mycobacterium leprae
uagcgcgcugaucgggc

SEQ ID NO: 3233381 - RNA, 15 nt, Mycobacterium leprae
uagcggccgccagca

SEQ ID NO: 3233382 - RNA, 20 nt, Mycobacterium leprae
uagcggccuaggacgccgcc

SEQ ID NO: 3233383 - RNA, 14 nt, Mycobacterium leprae
uagcggcggcggcc

SEQ ID NO: 3233384 - RNA, 19 nt, Mycobacterium leprae
uagcgggcucuuaggugcc

SEQ ID NO: 3233385 - RNA, 16 nt, Mycobacterium leprae
uagcgucccagcucca

SEQ ID NO: 3233386 - RNA, 21 nt, Mycobacterium leprae
uagcgucccagcuccagaacg

SEQ ID NO: 3233387 - RNA, 16 nt, Mycobacterium leprae
uagcguucguagagcu

SEQ ID NO: 3233388 - RNA, 19 nt, Mycobacterium leprae
uaggaaacauuguucugcc

SEQ ID NO: 3233389 - RNA, 12 nt, Mycobacterium leprae
uaggacaacaga

SEQ ID NO: 3233390 - RNA, 15 nt, Mycobacterium leprae
uaggacaacagagca

SEQ ID NO: 3233391 - RNA, 16 nt, Mycobacterium leprae
uaggacaacagagcac

SEQ ID NO: 3233392 - RNA, 21 nt, Mycobacterium leprae
uaggcacagcccaguaggcac

SEQ ID NO: 3233393 - RNA, 21 nt, Mycobacterium leprae
uaggcaccacgcacacgacag

SEQ ID NO: 3233394 - RNA, 22 nt, Mycobacterium leprae
uaggcaccacgcacacgacagc

SEQ ID NO: 3233395 - RNA, 15 nt, Mycobacterium leprae
uaggcggauggggca

SEQ ID NO: 3233396 - RNA, 22 nt, Mycobacterium leprae
uaggcugucugcggauuuugcc

SEQ ID NO: 3233397 - RNA, 13 nt, Mycobacterium leprae
uaggcuguuguca

SEQ ID NO: 3233398 - RNA, 16 nt, Mycobacterium leprae
uaggcuguugucaccc

SEQ ID NO: 3233399 - RNA, 19 nt, Mycobacterium leprae
uagggaccgcugcgguguc

SEQ ID NO: 3233400 - RNA, 14 nt, Mycobacterium leprae
uagggaggucacca

SEQ ID NO: 3233401 - RNA, 22 nt, Mycobacterium leprae
uaggggcguuuuagugugcaug

SEQ ID NO: 3233402 - RNA, 20 nt, Mycobacterium leprae
uagggugauagauggagcca

SEQ ID NO: 3233403 - RNA, 16 nt, Mycobacterium leprae
uaggguguugugggug

SEQ ID NO: 3233404 - RNA, 18 nt, Mycobacterium leprae
uagguccuggaugccgac

SEQ ID NO: 3233405 - RNA, 17 nt, Mycobacterium leprae
uagguguagcagcugca

SEQ ID NO: 3233406 - RNA, 17 nt, Mycobacterium leprae
uagguugauguauccag

SEQ ID NO: 3233407 - RNA, 16 nt, Mycobacterium leprae
uagucagcggacugcu

SEQ ID NO: 3233408 - RNA, 17 nt, Mycobacterium leprae
uaguccgaccgcaucga

SEQ ID NO: 3233409 - RNA, 18 nt, Mycobacterium leprae
uaguccgcagaaugugcu

SEQ ID NO: 3233410 - RNA, 20 nt, Mycobacterium leprae
uaguccgcagaaugugcucu

SEQ ID NO: 3233411 - RNA, 11 nt, Mycobacterium leprae
ucaccagcaag

SEQ ID NO: 3233412 - RNA, 10 nt, Mycobacterium leprae
ucaccccaga

SEQ ID NO: 3233413 - RNA, 13 nt, Mycobacterium leprae
ucaccccagacgu

SEQ ID NO: 3233414 - RNA, 16 nt, Mycobacterium leprae
ucaccccgggcacagc

SEQ ID NO: 3233415 - RNA, 13 nt, Mycobacterium leprae
ucacccuuucggg

SEQ ID NO: 3233416 - RNA, 14 nt, Mycobacterium leprae
ucaccgacugagac

SEQ ID NO: 3233417 - RNA, 13 nt, Mycobacterium leprae
ucaccgcagccgg

SEQ ID NO: 3233418 - RNA, 22 nt, Mycobacterium leprae
ucaccgcggcguuauccacgcc

SEQ ID NO: 3233419 - RNA, 17 nt, Mycobacterium leprae
ucaccggccaccggcgc

SEQ ID NO: 3233420 - RNA, 18 nt, Mycobacterium leprae
ucaccggccaccggcgcu

SEQ ID NO: 3233421 - RNA, 20 nt, Mycobacterium leprae
ucaccggccagccuagccac

SEQ ID NO: 3233422 - RNA, 15 nt, Mycobacterium leprae
ucaccguggccggcc

SEQ ID NO: 3233423 - RNA, 24 nt, Mycobacterium leprae
ucaccucauauuuagcgaccggcc

SEQ ID NO: 3233424 - RNA, 15 nt, Mycobacterium leprae
ucacgaacaacagag

SEQ ID NO: 3233425 - RNA, 12 nt, Mycobacterium leprae
ucacgccaggcg

SEQ ID NO: 3233426 - RNA, 17 nt, Mycobacterium leprae
ucacgccuaaucuagcc

SEQ ID NO: 3233427 - RNA, 23 nt, Mycobacterium leprae
ucacgggugguuagaaucgccug

SEQ ID NO: 3233428 - RNA, 18 nt, Mycobacterium leprae
ucacggucgacuucgcag

SEQ ID NO: 3233429 - RNA, 19 nt, Mycobacterium leprae
ucacgguugcuuccaaccc

SEQ ID NO: 3233430 - RNA, 20 nt, Mycobacterium leprae
ucacgucgacggcggccgcc

SEQ ID NO: 3233431 - RNA, 16 nt, Mycobacterium leprae
ucacgucgcugcgucc

SEQ ID NO: 3233432 - RNA, 14 nt, Mycobacterium leprae
ucacuacguccacu

SEQ ID NO: 3233433 - RNA, 21 nt, Mycobacterium leprae
ucacuacguccacuagccagu

SEQ ID NO: 3233434 - RNA, 12 nt, Mycobacterium leprae
ucacuacguugg

SEQ ID NO: 3233435 - RNA, 20 nt, Mycobacterium leprae
ucacuauauauauauuaauu

SEQ ID NO: 3233436 - RNA, 17 nt, Mycobacterium leprae
ucacugaucccagaauu

SEQ ID NO: 3233437 - RNA, 12 nt, Mycobacterium leprae
ucacuuagccau

SEQ ID NO: 3233438 - RNA, 19 nt, Mycobacterium leprae
ucacuucagcgacaggcag

SEQ ID NO: 3233439 - RNA, 18 nt, Mycobacterium leprae
ucacuuccggcuucucca

SEQ ID NO: 3233440 - RNA, 23 nt, Mycobacterium leprae
ucagaaaucguucgaccagauga

SEQ ID NO: 3233441 - RNA, 19 nt, Mycobacterium leprae
ucagaagcacgacacuagc

SEQ ID NO: 3233442 - RNA, 19 nt, Mycobacterium leprae
ucagacugcccagacucag

SEQ ID NO: 3233443 - RNA, 22 nt, Mycobacterium leprae
ucagagacaccguccucggcgg

SEQ ID NO: 3233444 - RNA, 22 nt, Mycobacterium leprae
ucagaguguguguggcaccggg

SEQ ID NO: 3233445 - RNA, 16 nt, Mycobacterium leprae
ucagaucaaccaaaug

SEQ ID NO: 3233446 - RNA, 17 nt, Mycobacterium leprae
ucagauccgguggcgac

SEQ ID NO: 3233447 - RNA, 23 nt, Mycobacterium leprae
ucagauccgguggcgacaguguu

SEQ ID NO: 3233448 - RNA, 18 nt, Mycobacterium leprae
ucagauuacgcgcgacau

SEQ ID NO: 3233449 - RNA, 14 nt, Mycobacterium leprae
ucagcaacuuuccu

SEQ ID NO: 3233450 - RNA, 17 nt, Mycobacterium leprae
ucagcaaugcucugcug

SEQ ID NO: 3233451 - RNA, 16 nt, Mycobacterium leprae
ucagcacaaucaacca

SEQ ID NO: 3233452 - RNA, 11 nt, Mycobacterium leprae
ucagcacagcc

SEQ ID NO: 3233453 - RNA, 14 nt, Mycobacterium leprae
ucagcaugcccaga

SEQ ID NO: 3233454 - RNA, 15 nt, Mycobacterium leprae
ucagcaugucggcca

SEQ ID NO: 3233455 - RNA, 21 nt, Mycobacterium leprae
ucagcaugucggccacugcac

SEQ ID NO: 3233456 - RNA, 14 nt, Mycobacterium leprae
ucagccaaaaugaa

SEQ ID NO: 3233457 - RNA, 13 nt, Mycobacterium leprae
ucagccacacucg

SEQ ID NO: 3233458 - RNA, 15 nt, Mycobacterium leprae
ucagccacauccucg

SEQ ID NO: 3233459 - RNA, 18 nt, Mycobacterium leprae
ucagccacauccucggua

SEQ ID NO: 3233460 - RNA, 19 nt, Mycobacterium leprae
ucagccgggcuaaggugcg

SEQ ID NO: 3233461 - RNA, 13 nt, Mycobacterium leprae
ucagccgugccca

SEQ ID NO: 3233462 - RNA, 17 nt, Mycobacterium leprae
ucagccuagcagcaucg

SEQ ID NO: 3233463 - RNA, 19 nt, Mycobacterium leprae
ucagcgaagaguuucugcu

SEQ ID NO: 3233464 - RNA, 23 nt, Mycobacterium leprae
ucagcgaagaguuucugcugccg

SEQ ID NO: 3233465 - RNA, 18 nt, Mycobacterium leprae
ucagcgcgcacagcucuc

SEQ ID NO: 3233466 - RNA, 20 nt, Mycobacterium leprae
ucagcgcugcuucaaucaac

SEQ ID NO: 3233467 - RNA, 18 nt, Mycobacterium leprae
ucagcgguaagcggaucc

SEQ ID NO: 3233468 - RNA, 18 nt, Mycobacterium leprae
ucagcgucggacgccgga

SEQ ID NO: 3233469 - RNA, 14 nt, Mycobacterium leprae
ucagcgugccugag

SEQ ID NO: 3233470 - RNA, 15 nt, Mycobacterium leprae
ucagcuccgaagcag

SEQ ID NO: 3233471 - RNA, 13 nt, Mycobacterium leprae
ucagcuggugcug

SEQ ID NO: 3233472 - RNA, 19 nt, Mycobacterium leprae
ucagcuggugcuggcgucg

SEQ ID NO: 3233473 - RNA, 19 nt, Mycobacterium leprae
ucaggaauucagagcugca

SEQ ID NO: 3233474 - RNA, 20 nt, Mycobacterium leprae
ucaggacgaacgcuggcggc

SEQ ID NO: 3233475 - RNA, 13 nt, Mycobacterium leprae
ucaggaucgcaaa

SEQ ID NO: 3233476 - RNA, 17 nt, Mycobacterium leprae
ucaggccaggcagcgcc

SEQ ID NO: 3233477 - RNA, 13 nt, Mycobacterium leprae
ucaggccgucguu

SEQ ID NO: 3233478 - RNA, 18 nt, Mycobacterium leprae
ucaggccuugauucucgu

SEQ ID NO: 3233479 - RNA, 16 nt, Mycobacterium leprae
ucaggcugucaucaga

SEQ ID NO: 3233480 - RNA, 22 nt, Mycobacterium leprae
ucagguauuuccuaaaauucau

SEQ ID NO: 3233481 - RNA, 23 nt, Mycobacterium leprae
ucagguccaacgcggcggcggcc

SEQ ID NO: 3233482 - RNA, 14 nt, Mycobacterium leprae
ucagguccuugcuc

SEQ ID NO: 3233483 - RNA, 12 nt, Mycobacterium leprae
ucaguaaguccc

SEQ ID NO: 3233484 - RNA, 13 nt, Mycobacterium leprae
ucaguaaucgacg

SEQ ID NO: 3233485 - RNA, 15 nt, Mycobacterium leprae
ucagucaagcuagcu

SEQ ID NO: 3233486 - RNA, 21 nt, Mycobacterium leprae
ucagucaggcacguugaugaa

SEQ ID NO: 3233487 - RNA, 14 nt, Mycobacterium leprae
ucagugaagaccau

SEQ ID NO: 3233488 - RNA, 18 nt, Mycobacterium leprae
ucagugagccgucuuggc

SEQ ID NO: 3233489 - RNA, 16 nt, Mycobacterium leprae
ucagugcguugucgaa

SEQ ID NO: 3233490 - RNA, 16 nt, Mycobacterium leprae
ucaguguauuggcggg

SEQ ID NO: 3233491 - RNA, 15 nt, Mycobacterium leprae
ucagugucagcagca

SEQ ID NO: 3233492 - RNA, 16 nt, Mycobacterium leprae
ucaguucacgcuggcc

SEQ ID NO: 3233493 - RNA, 17 nt, Mycobacterium leprae
ucaguucgugcgcgcau

SEQ ID NO: 3233494 - RNA, 14 nt, Mycobacterium leprae
ucaguuuacuggca

SEQ ID NO: 3233495 - RNA, 16 nt, Mycobacterium leprae
ucaguuuggcgcugcu

SEQ ID NO: 3233496 - RNA, 19 nt, Mycobacterium leprae
ucauagaaccugccuagca

SEQ ID NO: 3233497 - RNA, 12 nt, Mycobacterium leprae
ucauagcggcga

SEQ ID NO: 3233498 - RNA, 14 nt, Mycobacterium leprae
ucaucagcucugcc

SEQ ID NO: 3233499 - RNA, 16 nt, Mycobacterium leprae
ucaucaucuaaauccu

SEQ ID NO: 3233500 - RNA, 14 nt, Mycobacterium leprae
ucauccacugcgaa

SEQ ID NO: 3233501 - RNA, 21 nt, Mycobacterium leprae
ucauccgacggcuucaucagu

SEQ ID NO: 3233502 - RNA, 17 nt, Mycobacterium leprae
ucaucgacgaugccaua

SEQ ID NO: 3233503 - RNA, 15 nt, Mycobacterium leprae
ucaucgacucgaaac

SEQ ID NO: 3233504 - RNA, 15 nt, Mycobacterium leprae
ucaucgaucagaccc

SEQ ID NO: 3233505 - RNA, 18 nt, Mycobacterium leprae
ucaucgaugcacuguuca

SEQ ID NO: 3233506 - RNA, 23 nt, Mycobacterium leprae
ucaucgcggcugccacuguguca

SEQ ID NO: 3233507 - RNA, 18 nt, Mycobacterium leprae
ucaucgcuucgugguuag

SEQ ID NO: 3233508 - RNA, 17 nt, Mycobacterium leprae
ucaucggcgacugggau

SEQ ID NO: 3233509 - RNA, 17 nt, Mycobacterium leprae
ucaucggcgugccuggc

SEQ ID NO: 3233510 - RNA, 16 nt, Mycobacterium leprae
ucaucgggccugguuu

SEQ ID NO: 3233511 - RNA, 19 nt, Mycobacterium leprae
ucaucuugggcaucggcuu

SEQ ID NO: 3233512 - RNA, 22 nt, Mycobacterium leprae
ucaugacgggccgcguuugaga

SEQ ID NO: 3233513 - RNA, 15 nt, Mycobacterium leprae
ucaugcauccuccua

SEQ ID NO: 3233514 - RNA, 16 nt, Mycobacterium leprae
ucaugcccaugccagc

SEQ ID NO: 3233515 - RNA, 19 nt, Mycobacterium leprae
ucaugccgcagcaucaggg

SEQ ID NO: 3233516 - RNA, 22 nt, Mycobacterium leprae
ucaugccgcuugauuugcacaa

SEQ ID NO: 3233517 - RNA, 22 nt, Mycobacterium leprae
ucaugccuggugcgcauccucg

SEQ ID NO: 3233518 - RNA, 18 nt, Mycobacterium leprae
ucaugcuccgacacugga

SEQ ID NO: 3233519 - RNA, 15 nt, Mycobacterium leprae
ucauggcuugcugca

SEQ ID NO: 3233520 - RNA, 18 nt, Mycobacterium leprae
ucauguagcuacugucaa

SEQ ID NO: 3233521 - RNA, 19 nt, Mycobacterium leprae
ucauguauucguacaacgu

SEQ ID NO: 3233522 - RNA, 15 nt, Mycobacterium leprae
ucauguuccgcugau

SEQ ID NO: 3233523 - RNA, 21 nt, Mycobacterium leprae
ucauuauugucggucugccuu

SEQ ID NO: 3233524 - RNA, 17 nt, Mycobacterium leprae
uccaaacuuccucugcc

SEQ ID NO: 3233525 - RNA, 18 nt, Mycobacterium leprae
uccuccggggaccauugc

SEQ ID NO: 3233526 - RNA, 14 nt, Mycobacterium leprae
uccucgacagucaa

SEQ ID NO: 3233527 - RNA, 15 nt, Mycobacterium leprae
uccucgacccaccac

SEQ ID NO: 3233528 - RNA, 17 nt, Mycobacterium leprae
uccucgacuuccggccc

SEQ ID NO: 3233529 - RNA, 18 nt, Mycobacterium leprae
uccucggcggcaccuccc

SEQ ID NO: 3233530 - RNA, 21 nt, Mycobacterium leprae
uccucggcggcaccuccccgc

SEQ ID NO: 3233531 - RNA, 16 nt, Mycobacterium leprae
uccucgugacaucgac

SEQ ID NO: 3233532 - RNA, 16 nt, Mycobacterium leprae
uccucuuaacaacuug

SEQ ID NO: 3233533 - RNA, 15 nt, Mycobacterium leprae
uccugaauucagccg

SEQ ID NO: 3233534 - RNA, 15 nt, Mycobacterium leprae
uccugacucgccggu

SEQ ID NO: 3233535 - RNA, 18 nt, Mycobacterium leprae
uccugagacaucgccacc

SEQ ID NO: 3233536 - RNA, 21 nt, Mycobacterium leprae
uccugagugugaugccgaagc

SEQ ID NO: 3233537 - RNA, 21 nt, Mycobacterium leprae
uccugaucuauuuauaauguu

SEQ ID NO: 3233538 - RNA, 16 nt, Mycobacterium leprae
uccugcccggacaagu

SEQ ID NO: 3233539 - RNA, 17 nt, Mycobacterium leprae
uccuggcuggccaucgc

SEQ ID NO: 3233540 - RNA, 20 nt, Mycobacterium leprae
uccuguucuacauccaccca

SEQ ID NO: 3233541 - RNA, 19 nt, Mycobacterium leprae
uccuucaaaaagguguuca

SEQ ID NO: 3233542 - RNA, 18 nt, Mycobacterium leprae
uccuucaugcuggccucc

SEQ ID NO: 3233543 - RNA, 16 nt, Mycobacterium leprae
uccuucauguccuaca

SEQ ID NO: 3233544 - RNA, 12 nt, Mycobacterium leprae
uccuuccggccu

SEQ ID NO: 3233545 - RNA, 16 nt, Mycobacterium leprae
uccuugaccugauugc

SEQ ID NO: 3233546 - RNA, 16 nt, Mycobacterium leprae
uccuuuaucagcaaga

SEQ ID NO: 3233547 - RNA, 22 nt, Mycobacterium leprae
uccuuucagcucgauggugcca

SEQ ID NO: 3233548 - RNA, 15 nt, Mycobacterium leprae
uccuuuucgccggcg

SEQ ID NO: 3233549 - RNA, 13 nt, Mycobacterium leprae
ucgaaaaaucaga

SEQ ID NO: 3233550 - RNA, 12 nt, Mycobacterium leprae
ucgaaaaaugcc

SEQ ID NO: 3233551 - RNA, 15 nt, Mycobacterium leprae
ucgaaauguaacugu

SEQ ID NO: 3233552 - RNA, 14 nt, Mycobacterium leprae
ucgaagcaaccagc

SEQ ID NO: 3233553 - RNA, 13 nt, Mycobacterium leprae
ucgaagggcuggu

SEQ ID NO: 3233554 - RNA, 16 nt, Mycobacterium leprae
ucgaagggcugguggc

SEQ ID NO: 3233555 - RNA, 15 nt, Mycobacterium leprae
ucgaauauccaucua

SEQ ID NO: 3233556 - RNA, 18 nt, Mycobacterium leprae
ucgaauuaggcggauggg

SEQ ID NO: 3233557 - RNA, 17 nt, Mycobacterium leprae
ucgacaaccucuagcca

SEQ ID NO: 3233558 - RNA, 13 nt, Mycobacterium leprae
ucgacaagcaucu

SEQ ID NO: 3233559 - RNA, 20 nt, Mycobacterium leprae
ucgacaaugucggccaccgg

SEQ ID NO: 3233560 - RNA, 13 nt, Mycobacterium leprae
ucgacaccgagca

SEQ ID NO: 3233561 - RNA, 13 nt, Mycobacterium leprae
ucgacaccggcca

SEQ ID NO: 3233562 - RNA, 14 nt, Mycobacterium leprae
ucgacacgaggauc

SEQ ID NO: 3233563 - RNA, 14 nt, Mycobacterium leprae
ucgacagcagguag

SEQ ID NO: 3233564 - RNA, 13 nt, Mycobacterium leprae
ucgacaucaccgg

SEQ ID NO: 3233565 - RNA, 14 nt, Mycobacterium leprae
ucgacaucaccggc

SEQ ID NO: 3233566 - RNA, 16 nt, Mycobacterium leprae
ucgacaucccagcaac

SEQ ID NO: 3233567 - RNA, 13 nt, Mycobacterium leprae
ucgacauugcccg

SEQ ID NO: 3233568 - RNA, 12 nt, Mycobacterium leprae
ucgaccagauga

SEQ ID NO: 3233569 - RNA, 14 nt, Mycobacterium leprae
ucgacccuugcuug

SEQ ID NO: 3233570 - RNA, 17 nt, Mycobacterium leprae
ucgaccgccgaagcagc

SEQ ID NO: 3233571 - RNA, 20 nt, Mycobacterium leprae
ucgaccgcuggggucgcgga

SEQ ID NO: 3233572 - RNA, 22 nt, Mycobacterium leprae
ucgaccgcuggggucgcggacc

SEQ ID NO: 3233573 - RNA, 18 nt, Mycobacterium leprae
ucgaccuauuucggcaaa

SEQ ID NO: 3233574 - RNA, 22 nt, Mycobacterium leprae
ucgaccuauuucggcaaaauau

SEQ ID NO: 3233575 - RNA, 17 nt, Mycobacterium leprae
ucgaccucgaauccgcc

SEQ ID NO: 3233576 - RNA, 22 nt, Mycobacterium leprae
ucgacgagacacugacguuggc

SEQ ID NO: 3233577 - RNA, 17 nt, Mycobacterium leprae
ucgacgaggucgccgcc

SEQ ID NO: 3233578 - RNA, 18 nt, Mycobacterium leprae
ucgacgaggucgccgccg

SEQ ID NO: 3233579 - RNA, 22 nt, Mycobacterium leprae
ucgacgaguuagacaccccccg

SEQ ID NO: 3233580 - RNA, 19 nt, Mycobacterium leprae
ucgacgaugugcagcagcu

SEQ ID NO: 3233581 - RNA, 20 nt, Mycobacterium leprae
ucgacgcgugcgucauggca

SEQ ID NO: 3233582 - RNA, 18 nt, Mycobacterium leprae
ucgacgggaagugguggc

SEQ ID NO: 3233583 - RNA, 15 nt, Mycobacterium leprae
ucgacgguaaguuuu

SEQ ID NO: 3233584 - RNA, 17 nt, Mycobacterium leprae
ucgacgguaaguuuuca

SEQ ID NO: 3233585 - RNA, 22 nt, Mycobacterium leprae
ucgacgguguaaugcugcugcc

SEQ ID NO: 3233586 - RNA, 21 nt, Mycobacterium leprae
ucgacguugcgcacugcccgg

SEQ ID NO: 3233587 - RNA, 15 nt, Mycobacterium leprae
ucgacucaccgcggc

SEQ ID NO: 3233588 - RNA, 16 nt, Mycobacterium leprae
ucgacucgaaacgcga

SEQ ID NO: 3233589 - RNA, 20 nt, Mycobacterium leprae
ucgacuggcuugucaccaga

SEQ ID NO: 3233590 - RNA, 18 nt, Mycobacterium leprae
ucgacuguuguuguacau

SEQ ID NO: 3233591 - RNA, 20 nt, Mycobacterium leprae
ucgacuucgcagccaccgac

SEQ ID NO: 3233592 - RNA, 14 nt, Mycobacterium leprae
ucgacuugaccuau

SEQ ID NO: 3233593 - RNA, 22 nt, Mycobacterium leprae
ucgacuugaccuauacuggaua

SEQ ID NO: 3233594 - RNA, 16 nt, Mycobacterium leprae
ucgagaaaaauuggca

SEQ ID NO: 3233595 - RNA, 13 nt, Mycobacterium leprae
ucgagaauuuacc

SEQ ID NO: 3233596 - RNA, 17 nt, Mycobacterium leprae
ucgagcaaaccagguga

SEQ ID NO: 3233597 - RNA, 22 nt, Mycobacterium leprae
ucgagcaacguacugcaaugcu

SEQ ID NO: 3233598 - RNA, 22 nt, Mycobacterium leprae
ucgagcaaugcugagcgaagaa

SEQ ID NO: 3233599 - RNA, 18 nt, Mycobacterium leprae
ucgagcagccgaccgccc

SEQ ID NO: 3233600 - RNA, 22 nt, Mycobacterium leprae
ucgagcaguaguccucugcggu

SEQ ID NO: 3233601 - RNA, 14 nt, Mycobacterium leprae
ucgagccgcaccgg

SEQ ID NO: 3233602 - RNA, 19 nt, Mycobacterium leprae
ucgagcgaggagcacggcu

SEQ ID NO: 3233603 - RNA, 16 nt, Mycobacterium leprae
ucgagcgauugugcgg

SEQ ID NO: 3233604 - RNA, 23 nt, Mycobacterium leprae
ucgagcgcccaagugaugucuuu

SEQ ID NO: 3233605 - RNA, 16 nt, Mycobacterium leprae
ucgagcggcgcaugcc

SEQ ID NO: 3233606 - RNA, 15 nt, Mycobacterium leprae
ucgaggccagauggc

SEQ ID NO: 3233607 - RNA, 14 nt, Mycobacterium leprae
ucgagguaaccaaa

SEQ ID NO: 3233608 - RNA, 23 nt, Mycobacterium leprae
ucgaggucuuggucucacgcugg

SEQ ID NO: 3233609 - RNA, 12 nt, Mycobacterium leprae
ucgaggugagca

SEQ ID NO: 3233610 - RNA, 21 nt, Mycobacterium leprae
ucgagugcagcuaauuuucca

SEQ ID NO: 3233611 - RNA, 23 nt, Mycobacterium leprae
ucgauaagaaguuguagcugugg

SEQ ID NO: 3233612 - RNA, 17 nt, Mycobacterium leprae
ucgauacagucauuguc

SEQ ID NO: 3233613 - RNA, 18 nt, Mycobacterium leprae
ucgauccucgacggguca

SEQ ID NO: 3233614 - RNA, 15 nt, Mycobacterium leprae
ucgaucgcuggucag

SEQ ID NO: 3233615 - RNA, 16 nt, Mycobacterium leprae
ucgaucggcagccacg

SEQ ID NO: 3233616 - RNA, 23 nt, Mycobacterium leprae
ucgaucggcagugguaaucgaca

SEQ ID NO: 3233617 - RNA, 21 nt, Mycobacterium leprae
ucgaugcacuguucacuaaca

SEQ ID NO: 3233618 - RNA, 13 nt, Mycobacterium leprae
ucgaugcgaugcg

SEQ ID NO: 3233619 - RNA, 18 nt, Mycobacterium leprae
ucgaugucggggaugguu

SEQ ID NO: 3233620 - RNA, 17 nt, Mycobacterium leprae
ucgcacaaauguucaac

SEQ ID NO: 3233621 - RNA, 19 nt, Mycobacterium leprae
ucgcacagcaggucgccga

SEQ ID NO: 3233622 - RNA, 20 nt, Mycobacterium leprae
ucgcacccugccgccacagc

SEQ ID NO: 3233623 - RNA, 14 nt, Mycobacterium leprae
ucgcaccgauaucc

SEQ ID NO: 3233624 - RNA, 19 nt, Mycobacterium leprae
ucgcaccgauauccggccu

SEQ ID NO: 3233625 - RNA, 23 nt, Mycobacterium leprae
ucgcaccggcugcacccgucgcu

SEQ ID NO: 3233626 - RNA, 13 nt, Mycobacterium leprae
ucgcacguggcac

SEQ ID NO: 3233627 - RNA, 19 nt, Mycobacterium leprae
ucgcagagguaaaucuggc

SEQ ID NO: 3233628 - RNA, 21 nt, Mycobacterium leprae
ucgcagagguaaaucuggcaa

SEQ ID NO: 3233629 - RNA, 15 nt, Mycobacterium leprae
ucgcagccaccgacg

SEQ ID NO: 3233630 - RNA, 21 nt, Mycobacterium leprae
ucgcaggaucggguagcugca

SEQ ID NO: 3233631 - RNA, 16 nt, Mycobacterium leprae
ucgcagguucugcacc

SEQ ID NO: 3233632 - RNA, 21 nt, Mycobacterium leprae
ucgcagguucugcaccccagg

SEQ ID NO: 3233633 - RNA, 20 nt, Mycobacterium leprae
ucgcaugugauacugcauuc

SEQ ID NO: 3233634 - RNA, 15 nt, Mycobacterium leprae
ucgcauugccaacgu

SEQ ID NO: 3233635 - RNA, 18 nt, Mycobacterium leprae
ucgccaacgguaucuccc

SEQ ID NO: 3233636 - RNA, 17 nt, Mycobacterium leprae
ucgccaccuggucacca

SEQ ID NO: 3233637 - RNA, 12 nt, Mycobacterium leprae
ucgccaugaacu

SEQ ID NO: 3233638 - RNA, 16 nt, Mycobacterium leprae
ucggugauaucgacug

SEQ ID NO: 3233639 - RNA, 23 nt, Mycobacterium leprae
ucggugccguaaugugcagugcg

SEQ ID NO: 3233640 - RNA, 17 nt, Mycobacterium leprae
ucgguggcagccggcug

SEQ ID NO: 3233641 - RNA, 21 nt, Mycobacterium leprae
ucggugguggaugcugcuugg

SEQ ID NO: 3233642 - RNA, 16 nt, Mycobacterium leprae
ucgguguuguuuggca

SEQ ID NO: 3233643 - RNA, 22 nt, Mycobacterium leprae
ucgguguuguuuggcaacgcac

SEQ ID NO: 3233644 - RNA, 14 nt, Mycobacterium leprae
ucgguucuggcccc

SEQ ID NO: 3233645 - RNA, 14 nt, Mycobacterium leprae
ucgguuucacagca

SEQ ID NO: 3233646 - RNA, 21 nt, Mycobacterium leprae
ucguaacgcugauugccaacu

SEQ ID NO: 3233647 - RNA, 20 nt, Mycobacterium leprae
ucguacaacguguuuaggaa

SEQ ID NO: 3233648 - RNA, 15 nt, Mycobacterium leprae
ucguacccaauagag

SEQ ID NO: 3233649 - RNA, 21 nt, Mycobacterium leprae
ucguaccgcgcaaaaaguauu

SEQ ID NO: 3233650 - RNA, 22 nt, Mycobacterium leprae
ucguagaccucuucagacugga

SEQ ID NO: 3233651 - RNA, 13 nt, Mycobacterium leprae
ucguagcucucca

SEQ ID NO: 3233652 - RNA, 15 nt, Mycobacterium leprae
ucguagcucuccauu

SEQ ID NO: 3233653 - RNA, 16 nt, Mycobacterium leprae
ucguaggucgcccggu

SEQ ID NO: 3233654 - RNA, 23 nt, Mycobacterium leprae
ucguauaaugucgaagggcuggu

SEQ ID NO: 3233655 - RNA, 23 nt, Mycobacterium leprae
ucgucaagugcgcaccggcugag

SEQ ID NO: 3233656 - RNA, 18 nt, Mycobacterium leprae
ucgucaauucggcgauau

SEQ ID NO: 3233657 - RNA, 19 nt, Mycobacterium leprae
ucgucaauucggcgauauc

SEQ ID NO: 3233658 - RNA, 19 nt, Mycobacterium leprae
ucgucacgcuacugcgggc

SEQ ID NO: 3233659 - RNA, 18 nt, Mycobacterium leprae
ucgucagauccggccguu

SEQ ID NO: 3233660 - RNA, 13 nt, Mycobacterium leprae
ucgucagcugcug

SEQ ID NO: 3233661 - RNA, 20 nt, Mycobacterium leprae
ucguccagggugaauugcac

SEQ ID NO: 3233662 - RNA, 21 nt, Mycobacterium leprae
ucguccgcaaccgauacgcca

SEQ ID NO: 3233663 - RNA, 18 nt, Mycobacterium leprae
ucguccucaagacuucag

SEQ ID NO: 3233664 - RNA, 20 nt, Mycobacterium leprae
ucgucgauaaugccgguggc

SEQ ID NO: 3233665 - RNA, 20 nt, Mycobacterium leprae
ucgucgaugcgcagacccgg

SEQ ID NO: 3233666 - RNA, 12 nt, Mycobacterium leprae
ucgucggccgga

SEQ ID NO: 3233667 - RNA, 15 nt, Mycobacterium leprae
ucgucgucagcugcu

SEQ ID NO: 3233668 - RNA, 16 nt, Mycobacterium leprae
ucgucgugauggucau

SEQ ID NO: 3233669 - RNA, 15 nt, Mycobacterium leprae
ucgucgugcugauca

SEQ ID NO: 3233670 - RNA, 15 nt, Mycobacterium leprae
ucgucugaaccaggg

SEQ ID NO: 3233671 - RNA, 15 nt, Mycobacterium leprae
ucgucuucgcagccu

SEQ ID NO: 3233672 - RNA, 19 nt, Mycobacterium leprae
ucgugacgggucaauccgu

SEQ ID NO: 3233673 - RNA, 17 nt, Mycobacterium leprae
ucgugagaaucgguguu

SEQ ID NO: 3233674 - RNA, 20 nt, Mycobacterium leprae
ucgugcacuguaucucgugc

SEQ ID NO: 3233675 - RNA, 22 nt, Mycobacterium leprae
ucgugccgagcuggccggggcc

SEQ ID NO: 3233676 - RNA, 15 nt, Mycobacterium leprae
ucgugcgucgucuca

SEQ ID NO: 3233677 - RNA, 19 nt, Mycobacterium leprae
ucgugcgugagaucaccag

SEQ ID NO: 3233678 - RNA, 19 nt, Mycobacterium leprae
ucgugcugaucaccggcca

SEQ ID NO: 3233679 - RNA, 15 nt, Mycobacterium leprae
ucguggcagaggcug

SEQ ID NO: 3233680 - RNA, 22 nt, Mycobacterium leprae
ucguggcagcuguauaacaaau

SEQ ID NO: 3233681 - RNA, 17 nt, Mycobacterium leprae
ucgugggcaacaccagc

SEQ ID NO: 3233682 - RNA, 18 nt, Mycobacterium leprae
ucgugggcaacaccagcg

SEQ ID NO: 3233683 - RNA, 22 nt, Mycobacterium leprae
ucgugggcaacaccagcgacug

SEQ ID NO: 3233684 - RNA, 22 nt, Mycobacterium leprae
ucguggguuugaggcgcgcgag

SEQ ID NO: 3233685 - RNA, 17 nt, Mycobacterium leprae
ucgugguccacggcuga

SEQ ID NO: 3233686 - RNA, 14 nt, Mycobacterium leprae
ucgugugcuuugcc

SEQ ID NO: 3233687 - RNA, 18 nt, Mycobacterium leprae
ucgugugcuuugccgcag

SEQ ID NO: 3233688 - RNA, 13 nt, Mycobacterium leprae
ucguguggaucaa

SEQ ID NO: 3233689 - RNA, 18 nt, Mycobacterium leprae
ucguucaagauacuggau

SEQ ID NO: 3233690 - RNA, 14 nt, Mycobacterium leprae
ucguucaguuuggu

SEQ ID NO: 3233691 - RNA, 21 nt, Mycobacterium leprae
ucguucccacuugggcaacac

SEQ ID NO: 3233692 - RNA, 15 nt, Mycobacterium leprae
ucguugaaaacgguu

SEQ ID NO: 3233693 - RNA, 21 nt, Mycobacterium leprae
ucguugacguggacuucugcg

SEQ ID NO: 3233694 - RNA, 21 nt, Mycobacterium leprae
ucguugccguaguacccggcc

SEQ ID NO: 3233695 - RNA, 19 nt, Mycobacterium leprae
ucguugcggcgcguuugca

SEQ ID NO: 3233696 - RNA, 17 nt, Mycobacterium leprae
ucguugcugacugcgau

SEQ ID NO: 3233697 - RNA, 14 nt, Mycobacterium leprae
ucuacauccaccca

SEQ ID NO: 3233698 - RNA, 20 nt, Mycobacterium leprae
ucuaccacuuccuacuucug

SEQ ID NO: 3233699 - RNA, 17 nt, Mycobacterium leprae
ucuacccacgacaucuu

SEQ ID NO: 3233700 - RNA, 21 nt, Mycobacterium leprae
ucuaccccggcauuuacgugc

SEQ ID NO: 3233701 - RNA, 14 nt, Mycobacterium leprae
ucuacccuuuuugu

SEQ ID NO: 3233702 - RNA, 20 nt, Mycobacterium leprae
ucuacccuuuuugucacuga

SEQ ID NO: 3233703 - RNA, 22 nt, Mycobacterium leprae
ucuacccuuuuugucacugagu

SEQ ID NO: 3233704 - RNA, 13 nt, Mycobacterium leprae
ucuaccugggcac

SEQ ID NO: 3233705 - RNA, 14 nt, Mycobacterium leprae
ucuacgaaaaauga

SEQ ID NO: 3233706 - RNA, 16 nt, Mycobacterium leprae
ucuagagaaacaccuu

SEQ ID NO: 3233707 - RNA, 18 nt, Mycobacterium leprae
ucuagagcugugccgaca

SEQ ID NO: 3233708 - RNA, 18 nt, Mycobacterium leprae
ucuagcaaguagacggcu

SEQ ID NO: 3233709 - RNA, 14 nt, Mycobacterium leprae
ucuagccaagcucc

SEQ ID NO: 3233710 - RNA, 19 nt, Mycobacterium leprae
ucuagcccagaagcucacu

SEQ ID NO: 3233711 - RNA, 21 nt, Mycobacterium leprae
ucuagcuggucccacagccgc

SEQ ID NO: 3233712 - RNA, 14 nt, Mycobacterium leprae
ucuaggguguugug

SEQ ID NO: 3233713 - RNA, 22 nt, Mycobacterium leprae
ucuauaguugaucauucgaucc

SEQ ID NO: 3233714 - RNA, 15 nt, Mycobacterium leprae
ucuaucgcgucggca

SEQ ID NO: 3233715 - RNA, 19 nt, Mycobacterium leprae
ucuauugcggucuugguga

SEQ ID NO: 3233716 - RNA, 23 nt, Mycobacterium leprae
ucuauuugguacacuaagccccg

SEQ ID NO: 3233717 - RNA, 16 nt, Mycobacterium leprae
ucucacgcugggguug

SEQ ID NO: 3233718 - RNA, 15 nt, Mycobacterium leprae
ucucacguccgauaa

SEQ ID NO: 3233719 - RNA, 18 nt, Mycobacterium leprae
ucucaucgcggcugccac

SEQ ID NO: 3233720 - RNA, 14 nt, Mycobacterium leprae
ucucauuguggcug

SEQ ID NO: 3233721 - RNA, 23 nt, Mycobacterium leprae
ucucauuguggcuggcuuccucu

SEQ ID NO: 3233722 - RNA, 11 nt, Mycobacterium leprae
ucuccaagguu

SEQ ID NO: 3233723 - RNA, 16 nt, Mycobacterium leprae
ucuccaccaccgagau

SEQ ID NO: 3233724 - RNA, 19 nt, Mycobacterium leprae
ucuccacuauucggguaga

SEQ ID NO: 3233725 - RNA, 20 nt, Mycobacterium leprae
ucuccgugaugaacuucgga

SEQ ID NO: 3233726 - RNA, 22 nt, Mycobacterium leprae
ucucgacgacguuaucuugaug

SEQ ID NO: 3233727 - RNA, 13 nt, Mycobacterium leprae
ucucgagcggcgc

SEQ ID NO: 3233728 - RNA, 21 nt, Mycobacterium leprae
ucucgcgcaggucacccuccu

SEQ ID NO: 3233729 - RNA, 18 nt, Mycobacterium leprae
ucucgcgccaccgccggu

SEQ ID NO: 3233730 - RNA, 22 nt, Mycobacterium leprae
ucucgcuugguugcggguacga

SEQ ID NO: 3233731 - RNA, 15 nt, Mycobacterium leprae
ucucggauaggugca

SEQ ID NO: 3233732 - RNA, 13 nt, Mycobacterium leprae
ucucuaaaaagau

SEQ ID NO: 3233733 - RNA, 11 nt, Mycobacterium leprae
ucucucaggcc

SEQ ID NO: 3233734 - RNA, 21 nt, Mycobacterium leprae
ucucuguuuauauguagcccu

SEQ ID NO: 3233735 - RNA, 17 nt, Mycobacterium leprae
ucucuucgugcagcacu

SEQ ID NO: 3233736 - RNA, 20 nt, Mycobacterium leprae
ucugaacuggugagacauuu

SEQ ID NO: 3233737 - RNA, 17 nt, Mycobacterium leprae
ucugaaggcaaaauccu

SEQ ID NO: 3233738 - RNA, 20 nt, Mycobacterium leprae
ucugagagugcagagaguug

SEQ ID NO: 3233739 - RNA, 16 nt, Mycobacterium leprae
ucugaucuucuuucac

SEQ ID NO: 3233740 - RNA, 20 nt, Mycobacterium leprae
ucugaugacgcgacgccggc

SEQ ID NO: 3233741 - RNA, 18 nt, Mycobacterium leprae
ucugauugaauccccgau

SEQ ID NO: 3233742 - RNA, 22 nt, Mycobacterium leprae
ucugcaccucuucgacaccgag

SEQ ID NO: 3233743 - RNA, 14 nt, Mycobacterium leprae
ucugccagggguuc

SEQ ID NO: 3233744 - RNA, 16 nt, Mycobacterium leprae
ucugccagggguucca

SEQ ID NO: 3233745 - RNA, 15 nt, Mycobacterium leprae
ucugcccugcacuuc

SEQ ID NO: 3233746 - RNA, 17 nt, Mycobacterium leprae
ucugccucgucgauguc

SEQ ID NO: 3233747 - RNA, 17 nt, Mycobacterium leprae
ucugcgcgcacccaagc

SEQ ID NO: 3233748 - RNA, 19 nt, Mycobacterium leprae
ucugcgcuggccacaaaac

SEQ ID NO: 3233749 - RNA, 22 nt, Mycobacterium leprae
ucugcgguggucauguggccgc

SEQ ID NO: 3233750 - RNA, 17 nt, Mycobacterium leprae
ugacgcgggcgccgcag

SEQ ID NO: 3233751 - RNA, 12 nt, Mycobacterium leprae
ugacggcagaaa

SEQ ID NO: 3233752 - RNA, 16 nt, Mycobacterium leprae
ugacggcgcaguugac

SEQ ID NO: 3233753 - RNA, 13 nt, Mycobacterium leprae
ugacggcuggauc

SEQ ID NO: 3233754 - RNA, 17 nt, Mycobacterium leprae
ugacgguguugguguca

SEQ ID NO: 3233755 - RNA, 19 nt, Mycobacterium leprae
ugacgguguuggugucacu

SEQ ID NO: 3233756 - RNA, 16 nt, Mycobacterium leprae
ugacgucccggcaccg

SEQ ID NO: 3233757 - RNA, 16 nt, Mycobacterium leprae
ugacgucgguguggug

SEQ ID NO: 3233758 - RNA, 22 nt, Mycobacterium leprae
ugacgucguaaacuaccagaug

SEQ ID NO: 3233759 - RNA, 19 nt, Mycobacterium leprae
ugacguucgaugccccauc

SEQ ID NO: 3233760 - RNA, 22 nt, Mycobacterium leprae
ugacguuuacaacguugcugcu

SEQ ID NO: 3233761 - RNA, 13 nt, Mycobacterium leprae
ugacuaaagucau

SEQ ID NO: 3233762 - RNA, 16 nt, Mycobacterium leprae
ugacucggcgugccac

SEQ ID NO: 3233763 - RNA, 22 nt, Mycobacterium leprae
ugacugggaacauagccagcau

SEQ ID NO: 3233764 - RNA, 13 nt, Mycobacterium leprae
ugacuguuuccgc

SEQ ID NO: 3233765 - RNA, 20 nt, Mycobacterium leprae
ugacuucgucagacgaaauu

SEQ ID NO: 3233766 - RNA, 18 nt, Mycobacterium leprae
ugagacaucgccaccgac

SEQ ID NO: 3233767 - RNA, 20 nt, Mycobacterium leprae
ugagacaucgccaccgaccg

SEQ ID NO: 3233768 - RNA, 20 nt, Mycobacterium leprae
ugagacaucgucgcaagcuu

SEQ ID NO: 3233769 - RNA, 15 nt, Mycobacterium leprae
ugagacauuucauua

SEQ ID NO: 3233770 - RNA, 21 nt, Mycobacterium leprae
ugagaggcggucggcggcuug

SEQ ID NO: 3233771 - RNA, 18 nt, Mycobacterium leprae
ugagagugccaccgcuga

SEQ ID NO: 3233772 - RNA, 22 nt, Mycobacterium leprae
ugagaucaccagcaaggguggg

SEQ ID NO: 3233773 - RNA, 12 nt, Mycobacterium leprae
ugagaugccagc

SEQ ID NO: 3233774 - RNA, 15 nt, Mycobacterium leprae
ugagaugccagccaa

SEQ ID NO: 3233775 - RNA, 15 nt, Mycobacterium leprae
ugagaugucuucgac

SEQ ID NO: 3233776 - RNA, 13 nt, Mycobacterium leprae
ugagauuucagcc

SEQ ID NO: 3233777 - RNA, 22 nt, Mycobacterium leprae
ugagcacccgcccaagcgaagc

SEQ ID NO: 3233778 - RNA, 21 nt, Mycobacterium leprae
ugagcagcacgggguguuggc

SEQ ID NO: 3233779 - RNA, 16 nt, Mycobacterium leprae
ugagccauuuggcacc

SEQ ID NO: 3233780 - RNA, 15 nt, Mycobacterium leprae
ugagccgacugacaa

SEQ ID NO: 3233781 - RNA, 17 nt, Mycobacterium leprae
ugagccggucggaguuc

SEQ ID NO: 3233782 - RNA, 15 nt, Mycobacterium leprae
ugagcgacagcucag

SEQ ID NO: 3233783 - RNA, 16 nt, Mycobacterium leprae
ugagcgacagcucagc

SEQ ID NO: 3233784 - RNA, 17 nt, Mycobacterium leprae
ugagcgacagcucagcg

SEQ ID NO: 3233785 - RNA, 21 nt, Mycobacterium leprae
ugagcgacagcucagcggcua

SEQ ID NO: 3233786 - RNA, 17 nt, Mycobacterium leprae
ugagcgcagccaccacu

SEQ ID NO: 3233787 - RNA, 19 nt, Mycobacterium leprae
ugagcgcagccaccacucu

SEQ ID NO: 3233788 - RNA, 18 nt, Mycobacterium leprae
ugagcggcagagcccggc

SEQ ID NO: 3233789 - RNA, 19 nt, Mycobacterium leprae
ugagcggcagagcccggca

SEQ ID NO: 3233790 - RNA, 16 nt, Mycobacterium leprae
ugagcguggcugcuca

SEQ ID NO: 3233791 - RNA, 19 nt, Mycobacterium leprae
ugagcguugugggcagcug

SEQ ID NO: 3233792 - RNA, 19 nt, Mycobacterium leprae
ugagcuuacggacugacac

SEQ ID NO: 3233793 - RNA, 21 nt, Mycobacterium leprae
ugaggauccugaccuugagga

SEQ ID NO: 3233794 - RNA, 19 nt, Mycobacterium leprae
ugaggaucugcugauggua

SEQ ID NO: 3233795 - RNA, 15 nt, Mycobacterium leprae
ugaggcgggucagcg

SEQ ID NO: 3233796 - RNA, 16 nt, Mycobacterium leprae
ugagggccggucaaca

SEQ ID NO: 3233797 - RNA, 20 nt, Mycobacterium leprae
ugaggucaccggccaccggc

SEQ ID NO: 3233798 - RNA, 22 nt, Mycobacterium leprae
ugaggugucggcguggucaaug

SEQ ID NO: 3233799 - RNA, 21 nt, Mycobacterium leprae
ugaggugugaccgugcagcug

SEQ ID NO: 3233800 - RNA, 23 nt, Mycobacterium leprae
ugaggugugaccgugcagcugcc

SEQ ID NO: 3233801 - RNA, 18 nt, Mycobacterium leprae
ugaguaucugugggcagu

SEQ ID NO: 3233802 - RNA, 16 nt, Mycobacterium leprae
ugagucagacacuuga

SEQ ID NO: 3233803 - RNA, 20 nt, Mycobacterium leprae
ugaguccgaugaugguuggu

SEQ ID NO: 3233804 - RNA, 13 nt, Mycobacterium leprae
ugagucgugucga

SEQ ID NO: 3233805 - RNA, 16 nt, Mycobacterium leprae
ugagugaucugcucgg

SEQ ID NO: 3233806 - RNA, 19 nt, Mycobacterium leprae
ugagugcgaccugaacauu

SEQ ID NO: 3233807 - RNA, 14 nt, Mycobacterium leprae
ugagugcugccagg

SEQ ID NO: 3233808 - RNA, 20 nt, Mycobacterium leprae
ugagugcugccagggcucga

SEQ ID NO: 3233809 - RNA, 14 nt, Mycobacterium leprae
ugagugugaggaua

SEQ ID NO: 3233810 - RNA, 16 nt, Mycobacterium leprae
ugagugugaugccgaa

SEQ ID NO: 3233811 - RNA, 20 nt, Mycobacterium leprae
ugagugugaugccgaagcag

SEQ ID NO: 3233812 - RNA, 23 nt, Mycobacterium leprae
ugaguucgcaagcaaauuuuuug

SEQ ID NO: 3233813 - RNA, 14 nt, Mycobacterium leprae
ugaguuguucgguu

SEQ ID NO: 3233814 - RNA, 15 nt, Mycobacterium leprae
ugauagauggagcca

SEQ ID NO: 3233815 - RNA, 15 nt, Mycobacterium leprae
ugauagcgaccaucg

SEQ ID NO: 3233816 - RNA, 17 nt, Mycobacterium leprae
ugauagcgaccaucgaa

SEQ ID NO: 3233817 - RNA, 21 nt, Mycobacterium leprae
ugauagugguucgauucugcc

SEQ ID NO: 3233818 - RNA, 19 nt, Mycobacterium leprae
ugaucaacuugucgggcau

SEQ ID NO: 3233819 - RNA, 16 nt, Mycobacterium leprae
ugaucacaaauuguca

SEQ ID NO: 3233820 - RNA, 17 nt, Mycobacterium leprae
ugaucagcaaggaacaa

SEQ ID NO: 3233821 - RNA, 20 nt, Mycobacterium leprae
ugauccucucccgaaucgcu

SEQ ID NO: 3233822 - RNA, 21 nt, Mycobacterium leprae
ugaucgaccgcugaaguuauc

SEQ ID NO: 3233823 - RNA, 19 nt, Mycobacterium leprae
ugaucgacgcaacugagaa

SEQ ID NO: 3233824 - RNA, 17 nt, Mycobacterium leprae
ugaucgcucacccgcgc

SEQ ID NO: 3233825 - RNA, 13 nt, Mycobacterium leprae
ugaucggcuugcc

SEQ ID NO: 3233826 - RNA, 15 nt, Mycobacterium leprae
ugaucgggcccagca

SEQ ID NO: 3233827 - RNA, 20 nt, Mycobacterium leprae
ugaucggugacuuggcuggu

SEQ ID NO: 3233828 - RNA, 13 nt, Mycobacterium leprae
ugaugacgaaauu

SEQ ID NO: 3233829 - RNA, 20 nt, Mycobacterium leprae
ugaugaugccaggggcuggg

SEQ ID NO: 3233830 - RNA, 19 nt, Mycobacterium leprae
ugaugcagcaugugugaac

SEQ ID NO: 3233831 - RNA, 16 nt, Mycobacterium leprae
ugaugcuaucgccggu

SEQ ID NO: 3233832 - RNA, 15 nt, Mycobacterium leprae
ugaugcuguggugug

SEQ ID NO: 3233833 - RNA, 13 nt, Mycobacterium leprae
ugaugcugugucg

SEQ ID NO: 3233834 - RNA, 15 nt, Mycobacterium leprae
ugauggcauccaaca

SEQ ID NO: 3233835 - RNA, 22 nt, Mycobacterium leprae
ugauggcauccaacacgccgau

SEQ ID NO: 3233836 - RNA, 22 nt, Mycobacterium leprae
ugauggccaaagugcgaaguaa

SEQ ID NO: 3233837 - RNA, 22 nt, Mycobacterium leprae
ugauggccgaccuaccgcaucc

SEQ ID NO: 3233838 - RNA, 16 nt, Mycobacterium leprae
ugauggccgccagguc

SEQ ID NO: 3233839 - RNA, 17 nt, Mycobacterium leprae
ugauggccggccuggcu

SEQ ID NO: 3233840 - RNA, 22 nt, Mycobacterium leprae
ugaugguaaccgguuuccauga

SEQ ID NO: 3233841 - RNA, 20 nt, Mycobacterium leprae
ugaugguugguacgcuccca

SEQ ID NO: 3233842 - RNA, 15 nt, Mycobacterium leprae
ugaugguuuggcugc

SEQ ID NO: 3233843 - RNA, 14 nt, Mycobacterium leprae
ugauucgacaccaa

SEQ ID NO: 3233844 - RNA, 21 nt, Mycobacterium leprae
ugauucgggacagugucuuag

SEQ ID NO: 3233845 - RNA, 22 nt, Mycobacterium leprae
ugauucugguucagccauucua

SEQ ID NO: 3233846 - RNA, 22 nt, Mycobacterium leprae
ugauugaucggugacuuggcug

SEQ ID NO: 3233847 - RNA, 19 nt, Mycobacterium leprae
ugauuugcacaacauccaa

SEQ ID NO: 3233848 - RNA, 17 nt, Mycobacterium leprae
ugauuuucauuggcauu

SEQ ID NO: 3233849 - RNA, 20 nt, Mycobacterium leprae
ugcaaaacgucgaucucgac

SEQ ID NO: 3233850 - RNA, 15 nt, Mycobacterium leprae
ugcaaauggcacuga

SEQ ID NO: 3233851 - RNA, 13 nt, Mycobacterium leprae
ugcaaccacaccc

SEQ ID NO: 3233852 - RNA, 18 nt, Mycobacterium leprae
ugcaaccuccguuguccc

SEQ ID NO: 3233853 - RNA, 18 nt, Mycobacterium leprae
ugcaacgcuucgugcauc

SEQ ID NO: 3233854 - RNA, 15 nt, Mycobacterium leprae
ugcaaggucccccgc

SEQ ID NO: 3233855 - RNA, 16 nt, Mycobacterium leprae
ugcaagugcaccaucu

SEQ ID NO: 3233856 - RNA, 19 nt, Mycobacterium leprae
ugcaagugcaccaucugcu

SEQ ID NO: 3233857 - RNA, 20 nt, Mycobacterium leprae
ugcaauccgccgaucccgaa

SEQ ID NO: 3233858 - RNA, 21 nt, Mycobacterium leprae
ugcaauccgccgaucccgaaa

SEQ ID NO: 3233859 - RNA, 18 nt, Mycobacterium leprae
ugcacaacaccuugcgcc

SEQ ID NO: 3233860 - RNA, 21 nt, Mycobacterium leprae
ugcacaagauugcagcccuga

SEQ ID NO: 3233861 - RNA, 15 nt, Mycobacterium leprae
ugcacaagcuuguuu

SEQ ID NO: 3233862 - RNA, 16 nt, Mycobacterium leprae
ugccgaucccggcgcu

SEQ ID NO: 3233863 - RNA, 17 nt, Mycobacterium leprae
ugccgcaccgcuucaga

SEQ ID NO: 3233864 - RNA, 13 nt, Mycobacterium leprae
ugccgcaggcacc

SEQ ID NO: 3233865 - RNA, 16 nt, Mycobacterium leprae
ugccgcccagugcacu

SEQ ID NO: 3233866 - RNA, 11 nt, Mycobacterium leprae
ugccgccgaag

SEQ ID NO: 3233867 - RNA, 17 nt, Mycobacterium leprae
ugccgcgggugcaguug

SEQ ID NO: 3233868 - RNA, 20 nt, Mycobacterium leprae
ugccgcuccgcgcacagugu

SEQ ID NO: 3233869 - RNA, 15 nt, Mycobacterium leprae
ugccgcugaccaguc

SEQ ID NO: 3233870 - RNA, 14 nt, Mycobacterium leprae
ugccgcugucgaug

SEQ ID NO: 3233871 - RNA, 13 nt, Mycobacterium leprae
ugccggaaccauc

SEQ ID NO: 3233872 - RNA, 19 nt, Mycobacterium leprae
ugccggcaaccagccccuc

SEQ ID NO: 3233873 - RNA, 13 nt, Mycobacterium leprae
ugccgggucagag

SEQ ID NO: 3233874 - RNA, 15 nt, Mycobacterium leprae
ugccgguagccugga

SEQ ID NO: 3233875 - RNA, 21 nt, Mycobacterium leprae
ugccggugauuucggcggcuu

SEQ ID NO: 3233876 - RNA, 14 nt, Mycobacterium leprae
ugccgguggccagc

SEQ ID NO: 3233877 - RNA, 22 nt, Mycobacterium leprae
ugccgugguagucagcacaauc

SEQ ID NO: 3233878 - RNA, 21 nt, Mycobacterium leprae
ugccguuccugagugugaugc

SEQ ID NO: 3233879 - RNA, 22 nt, Mycobacterium leprae
ugccucgcugucgaaaaccuca

SEQ ID NO: 3233880 - RNA, 16 nt, Mycobacterium leprae
ugccucggcuucccga

SEQ ID NO: 3233881 - RNA, 12 nt, Mycobacterium leprae
ugccucgucgau

SEQ ID NO: 3233882 - RNA, 22 nt, Mycobacterium leprae
ugccucuagcaaggcgcgguau

SEQ ID NO: 3233883 - RNA, 17 nt, Mycobacterium leprae
ugccucuguucaggccg

SEQ ID NO: 3233884 - RNA, 12 nt, Mycobacterium leprae
ugccugaugcca

SEQ ID NO: 3233885 - RNA, 15 nt, Mycobacterium leprae
ugccugaugccauca

SEQ ID NO: 3233886 - RNA, 19 nt, Mycobacterium leprae
ugccugaugccaucagaag

SEQ ID NO: 3233887 - RNA, 13 nt, Mycobacterium leprae
ugccugcauugcu

SEQ ID NO: 3233888 - RNA, 17 nt, Mycobacterium leprae
ugccugguaggugucgc

SEQ ID NO: 3233889 - RNA, 18 nt, Mycobacterium leprae
ugccuucugcacccgcca

SEQ ID NO: 3233890 - RNA, 22 nt, Mycobacterium leprae
ugccuucugcacccgccagggc

SEQ ID NO: 3233891 - RNA, 13 nt, Mycobacterium leprae
ugccuugacuucu

SEQ ID NO: 3233892 - RNA, 17 nt, Mycobacterium leprae
ugccuugggcacggagc

SEQ ID NO: 3233893 - RNA, 22 nt, Mycobacterium leprae
ugccuuguguucggcaagccaa

SEQ ID NO: 3233894 - RNA, 15 nt, Mycobacterium leprae
ugcgacacuugccgc

SEQ ID NO: 3233895 - RNA, 16 nt, Mycobacterium leprae
ugcgacacuugccgcg

SEQ ID NO: 3233896 - RNA, 15 nt, Mycobacterium leprae
ugcgacccgguuguc

SEQ ID NO: 3233897 - RNA, 14 nt, Mycobacterium leprae
ugcgacgucccaag

SEQ ID NO: 3233898 - RNA, 21 nt, Mycobacterium leprae
ugcgacuaucgugugcugauc

SEQ ID NO: 3233899 - RNA, 15 nt, Mycobacterium leprae
ugcgagucucaccca

SEQ ID NO: 3233900 - RNA, 16 nt, Mycobacterium leprae
ugcgagugugaaaaag

SEQ ID NO: 3233901 - RNA, 11 nt, Mycobacterium leprae
ugcgauagcgg

SEQ ID NO: 3233902 - RNA, 14 nt, Mycobacterium leprae
ugcgauagcggugc

SEQ ID NO: 3233903 - RNA, 18 nt, Mycobacterium leprae
ugcgauauauaccuacga

SEQ ID NO: 3233904 - RNA, 14 nt, Mycobacterium leprae
ugcgcaccggcuga

SEQ ID NO: 3233905 - RNA, 20 nt, Mycobacterium leprae
ugcgcaccggcugaggcggc

SEQ ID NO: 3233906 - RNA, 13 nt, Mycobacterium leprae
ugcgcagacccgg

SEQ ID NO: 3233907 - RNA, 15 nt, Mycobacterium leprae
ugcgcagccgcggua

SEQ ID NO: 3233908 - RNA, 16 nt, Mycobacterium leprae
ugcgccaacacuagcg

SEQ ID NO: 3233909 - RNA, 15 nt, Mycobacterium leprae
ugcgccuccagcucg

SEQ ID NO: 3233910 - RNA, 19 nt, Mycobacterium leprae
ugcgccuugcaagccacau

SEQ ID NO: 3233911 - RNA, 16 nt, Mycobacterium leprae
ugcgcgcacccaagcc

SEQ ID NO: 3233912 - RNA, 16 nt, Mycobacterium leprae
ugcgcgccgaccucgg

SEQ ID NO: 3233913 - RNA, 12 nt, Mycobacterium leprae
ugcgcgccgccc

SEQ ID NO: 3233914 - RNA, 16 nt, Mycobacterium leprae
ugcgcgccgcccagca

SEQ ID NO: 3233915 - RNA, 14 nt, Mycobacterium leprae
ugcgcggcgccggu

SEQ ID NO: 3233916 - RNA, 17 nt, Mycobacterium leprae
ugcgcggcgccgguacu

SEQ ID NO: 3233917 - RNA, 14 nt, Mycobacterium leprae
ugcgcgggagcggc

SEQ ID NO: 3233918 - RNA, 15 nt, Mycobacterium leprae
ugcgcgggagcggcu

SEQ ID NO: 3233919 - RNA, 14 nt, Mycobacterium leprae
ugcgcucacccaag

SEQ ID NO: 3233920 - RNA, 17 nt, Mycobacterium leprae
ugcgcucacccaagggc

SEQ ID NO: 3233921 - RNA, 14 nt, Mycobacterium leprae
ugcgcugagcccgg

SEQ ID NO: 3233922 - RNA, 18 nt, Mycobacterium leprae
ugcgcugaggcagcagcu

SEQ ID NO: 3233923 - RNA, 23 nt, Mycobacterium leprae
ugcgcugcagcaacagccacacc

SEQ ID NO: 3233924 - RNA, 19 nt, Mycobacterium leprae
ugcgcuggaaggagcgcgc

SEQ ID NO: 3233925 - RNA, 15 nt, Mycobacterium leprae
ugcgcuucaucagcu

SEQ ID NO: 3233926 - RNA, 16 nt, Mycobacterium leprae
ugcgcuucuggcuggg

SEQ ID NO: 3233927 - RNA, 15 nt, Mycobacterium leprae
ugcggagcaugacag

SEQ ID NO: 3233928 - RNA, 18 nt, Mycobacterium leprae
ugcggaugguuggcagaa

SEQ ID NO: 3233929 - RNA, 18 nt, Mycobacterium leprae
ugcggauuugcagagcau

SEQ ID NO: 3233930 - RNA, 13 nt, Mycobacterium leprae
ugcggcagcugcc

SEQ ID NO: 3233931 - RNA, 20 nt, Mycobacterium leprae
ugcggccaagcuagaucaac

SEQ ID NO: 3233932 - RNA, 20 nt, Mycobacterium leprae
ugcggcgagcuuacgcgcgu

SEQ ID NO: 3233933 - RNA, 14 nt, Mycobacterium leprae
ugcggcgcccagca

SEQ ID NO: 3233934 - RNA, 24 nt, Mycobacterium leprae
ugcggcggccuuggcagccgcugc

SEQ ID NO: 3233935 - RNA, 19 nt, Mycobacterium leprae
ugcggcucguggcagucuc

SEQ ID NO: 3233936 - RNA, 17 nt, Mycobacterium leprae
ugcggcuggcuccaucc

SEQ ID NO: 3233937 - RNA, 20 nt, Mycobacterium leprae
ugcgguaaacacuucuugua

SEQ ID NO: 3233938 - RNA, 15 nt, Mycobacterium leprae
ugcgguauccauccg

SEQ ID NO: 3233939 - RNA, 18 nt, Mycobacterium leprae
ugcguaaccgccaucggu

SEQ ID NO: 3233940 - RNA, 17 nt, Mycobacterium leprae
ugcguaauggccggcgc

SEQ ID NO: 3233941 - RNA, 18 nt, Mycobacterium leprae
ugcgugagaucaccagca

SEQ ID NO: 3233942 - RNA, 18 nt, Mycobacterium leprae
ugcgugccccggccgccg

SEQ ID NO: 3233943 - RNA, 18 nt, Mycobacterium leprae
ugcguuaacgcgucgggg

SEQ ID NO: 3233944 - RNA, 20 nt, Mycobacterium leprae
ugcguuguagaccaugagca

SEQ ID NO: 3233945 - RNA, 16 nt, Mycobacterium leprae
ugcguuguugauggug

SEQ ID NO: 3233946 - RNA, 18 nt, Mycobacterium leprae
ugcuaccaguguccgucg

SEQ ID NO: 3233947 - RNA, 20 nt, Mycobacterium leprae
ugcuacccacuggugguggc

SEQ ID NO: 3233948 - RNA, 20 nt, Mycobacterium leprae
ugcuacgaaggggucgauga

SEQ ID NO: 3233949 - RNA, 17 nt, Mycobacterium leprae
ugcuagacagcucggau

SEQ ID NO: 3233950 - RNA, 14 nt, Mycobacterium leprae
ugcuauccgcggug

SEQ ID NO: 3233951 - RNA, 13 nt, Mycobacterium leprae
ugcuaugggguug

SEQ ID NO: 3233952 - RNA, 15 nt, Mycobacterium leprae
ugcucacaggcagca

SEQ ID NO: 3233953 - RNA, 14 nt, Mycobacterium leprae
ugcucaggucgacg

SEQ ID NO: 3233954 - RNA, 22 nt, Mycobacterium leprae
ugcucagugaagugcucgggug

SEQ ID NO: 3233955 - RNA, 15 nt, Mycobacterium leprae
ugcuccgcagcaccu

SEQ ID NO: 3233956 - RNA, 17 nt, Mycobacterium leprae
ugcucgaucagugcggu

SEQ ID NO: 3233957 - RNA, 16 nt, Mycobacterium leprae
ugcucgcugcugcugg

SEQ ID NO: 3233958 - RNA, 20 nt, Mycobacterium leprae
ugcucguauaguaccgcuga

SEQ ID NO: 3233959 - RNA, 19 nt, Mycobacterium leprae
ugcucuaucgaacuuuucc

SEQ ID NO: 3233960 - RNA, 21 nt, Mycobacterium leprae
ugcucugggugguguggcccg

SEQ ID NO: 3233961 - RNA, 20 nt, Mycobacterium leprae
ugcugaaggcgauaucgaug

SEQ ID NO: 3233962 - RNA, 20 nt, Mycobacterium leprae
ugcugacagacauggcugua

SEQ ID NO: 3233963 - RNA, 15 nt, Mycobacterium leprae
ugcugacaucggcua

SEQ ID NO: 3233964 - RNA, 14 nt, Mycobacterium leprae
ugcugacgccgggc

SEQ ID NO: 3233965 - RNA, 14 nt, Mycobacterium leprae
ugcugagucggcgc

SEQ ID NO: 3233966 - RNA, 19 nt, Mycobacterium leprae
ugcugaucaccggccagcc

SEQ ID NO: 3233967 - RNA, 13 nt, Mycobacterium leprae
ugcugcacugugc

SEQ ID NO: 3233968 - RNA, 12 nt, Mycobacterium leprae
ugcugcagcugg

SEQ ID NO: 3233969 - RNA, 20 nt, Mycobacterium leprae
ugcugcaguuaauccgccgu

SEQ ID NO: 3233970 - RNA, 23 nt, Mycobacterium leprae
ugcugcauccgacaaagcagcau

SEQ ID NO: 3233971 - RNA, 17 nt, Mycobacterium leprae
ugcugcaucgguaacca

SEQ ID NO: 3233972 - RNA, 20 nt, Mycobacterium leprae
ugcugcaucgguaaccauaa

SEQ ID NO: 3233973 - RNA, 20 nt, Mycobacterium leprae
ugcugccaauugucgugggu

SEQ ID NO: 3233974 - RNA, 13 nt, Mycobacterium leprae
ugcugccacaugu

SEQ ID NO: 3233975 - RNA, 21 nt, Mycobacterium leprae
ugcugccgcguucguugcuga

SEQ ID NO: 3233976 - RNA, 22 nt, Mycobacterium leprae
uggcgcuacgacgaguagugau

SEQ ID NO: 3233977 - RNA, 22 nt, Mycobacterium leprae
uggcggacugaaaacagcgccu

SEQ ID NO: 3233978 - RNA, 14 nt, Mycobacterium leprae
uggcggaguugagc

SEQ ID NO: 3233979 - RNA, 22 nt, Mycobacterium leprae
uggcggcagcgccaauuccucc

SEQ ID NO: 3233980 - RNA, 19 nt, Mycobacterium leprae
uggcggcgacacggcuguc

SEQ ID NO: 3233981 - RNA, 19 nt, Mycobacterium leprae
uggcgguggucuccaaggu

SEQ ID NO: 3233982 - RNA, 17 nt, Mycobacterium leprae
uggcuaagacgcucaau

SEQ ID NO: 3233983 - RNA, 15 nt, Mycobacterium leprae
uggcuacgcagcucu

SEQ ID NO: 3233984 - RNA, 20 nt, Mycobacterium leprae
uggcuccaaguggcugcuau

SEQ ID NO: 3233985 - RNA, 15 nt, Mycobacterium leprae
uggcuccccgagccg

SEQ ID NO: 3233986 - RNA, 15 nt, Mycobacterium leprae
uggcuccugggaagu

SEQ ID NO: 3233987 - RNA, 14 nt, Mycobacterium leprae
uggcucgacauugu

SEQ ID NO: 3233988 - RNA, 16 nt, Mycobacterium leprae
uggcucgauuccagcu

SEQ ID NO: 3233989 - RNA, 17 nt, Mycobacterium leprae
uggcugacucgacauag

SEQ ID NO: 3233990 - RNA, 21 nt, Mycobacterium leprae
uggcugccgggcgucacgaag

SEQ ID NO: 3233991 - RNA, 18 nt, Mycobacterium leprae
uggcugcgauggcauuga

SEQ ID NO: 3233992 - RNA, 20 nt, Mycobacterium leprae
uggcugcucaaccaugccgc

SEQ ID NO: 3233993 - RNA, 15 nt, Mycobacterium leprae
uggcugcugcagacc

SEQ ID NO: 3233994 - RNA, 20 nt, Mycobacterium leprae
uggcugucccgggggccagc

SEQ ID NO: 3233995 - RNA, 18 nt, Mycobacterium leprae
uggcugucgggcaccugg

SEQ ID NO: 3233996 - RNA, 23 nt, Mycobacterium leprae
uggcuuccgauuguccaugccac

SEQ ID NO: 3233997 - RNA, 18 nt, Mycobacterium leprae
uggcuugaguuuugaacu

SEQ ID NO: 3233998 - RNA, 15 nt, Mycobacterium leprae
uggcuugucccaacc

SEQ ID NO: 3233999 - RNA, 17 nt, Mycobacterium leprae
ugggaacauagccagca

SEQ ID NO: 3234000 - RNA, 16 nt, Mycobacterium leprae
ugggacauccgcugau

SEQ ID NO: 3234001 - RNA, 12 nt, Mycobacterium leprae
ugggacuggcgg

SEQ ID NO: 3234002 - RNA, 18 nt, Mycobacterium leprae
ugggacuggcgguauucg

SEQ ID NO: 3234003 - RNA, 22 nt, Mycobacterium leprae
ugggaucgacaccucaccaucu

SEQ ID NO: 3234004 - RNA, 15 nt, Mycobacterium leprae
ugggcaacaccagcg

SEQ ID NO: 3234005 - RNA, 18 nt, Mycobacterium leprae
ugggcacaauggguguga

SEQ ID NO: 3234006 - RNA, 21 nt, Mycobacterium leprae
ugggcacaaugggugugacac

SEQ ID NO: 3234007 - RNA, 19 nt, Mycobacterium leprae
ugggcaccugggcugugcu

SEQ ID NO: 3234008 - RNA, 15 nt, Mycobacterium leprae
ugggcacggagcggc

SEQ ID NO: 3234009 - RNA, 13 nt, Mycobacterium leprae
ugggcagccgagg

SEQ ID NO: 3234010 - RNA, 14 nt, Mycobacterium leprae
ugggcagccgaggu

SEQ ID NO: 3234011 - RNA, 14 nt, Mycobacterium leprae
ugggcagccuggac

SEQ ID NO: 3234012 - RNA, 22 nt, Mycobacterium leprae
ugggcagcuaagaagcugcccu

SEQ ID NO: 3234013 - RNA, 15 nt, Mycobacterium leprae
ugggcauccugcugu

SEQ ID NO: 3234014 - RNA, 22 nt, Mycobacterium leprae
ugggcauuggcgacaaagaaga

SEQ ID NO: 3234015 - RNA, 20 nt, Mycobacterium leprae
ugggccgguguacacgugcu

SEQ ID NO: 3234016 - RNA, 22 nt, Mycobacterium leprae
ugggcgacaaugugucaggcug

SEQ ID NO: 3234017 - RNA, 17 nt, Mycobacterium leprae
ugggcgcagacguuuug

SEQ ID NO: 3234018 - RNA, 16 nt, Mycobacterium leprae
ugggcggcggccgaac

SEQ ID NO: 3234019 - RNA, 13 nt, Mycobacterium leprae
ugggcggcuaguc

SEQ ID NO: 3234020 - RNA, 13 nt, Mycobacterium leprae
ugggcuuccagca

SEQ ID NO: 3234021 - RNA, 20 nt, Mycobacterium leprae
uggggaaaaguucaccggca

SEQ ID NO: 3234022 - RNA, 17 nt, Mycobacterium leprae
uggggaaugucgauggc

SEQ ID NO: 3234023 - RNA, 21 nt, Mycobacterium leprae
uggggacgccggcggccaccg

SEQ ID NO: 3234024 - RNA, 17 nt, Mycobacterium leprae
ugggggugggaaaagca

SEQ ID NO: 3234025 - RNA, 17 nt, Mycobacterium leprae
uggggguguuggcccaa

SEQ ID NO: 3234026 - RNA, 21 nt, Mycobacterium leprae
uggggucgcuuguggaucagc

SEQ ID NO: 3234027 - RNA, 20 nt, Mycobacterium leprae
ugggucgagugguccccugu

SEQ ID NO: 3234028 - RNA, 17 nt, Mycobacterium leprae
ugggugaccacccacaa

SEQ ID NO: 3234029 - RNA, 15 nt, Mycobacterium leprae
ugggugguguucccc

SEQ ID NO: 3234030 - RNA, 12 nt, Mycobacterium leprae
ugggugugagga

SEQ ID NO: 3234031 - RNA, 18 nt, Mycobacterium leprae
uggguuugcugucaaggc

SEQ ID NO: 3234032 - RNA, 14 nt, Mycobacterium leprae
uggguuuggguggu

SEQ ID NO: 3234033 - RNA, 19 nt, Mycobacterium leprae
ugguaaguauguuuggauu

SEQ ID NO: 3234034 - RNA, 17 nt, Mycobacterium leprae
ugguacuugugauucag

SEQ ID NO: 3234035 - RNA, 20 nt, Mycobacterium leprae
uggucaagugucgggugguc

SEQ ID NO: 3234036 - RNA, 21 nt, Mycobacterium leprae
uggucagcauggcgaugcgca

SEQ ID NO: 3234037 - RNA, 17 nt, Mycobacterium leprae
uggucauggcgagcauc

SEQ ID NO: 3234038 - RNA, 17 nt, Mycobacterium leprae
uggucauguggccgcuc

SEQ ID NO: 3234039 - RNA, 19 nt, Mycobacterium leprae
ugguccgcuacauugcucc

SEQ ID NO: 3234040 - RNA, 11 nt, Mycobacterium leprae
uggucgccgcg

SEQ ID NO: 3234041 - RNA, 17 nt, Mycobacterium leprae
uggucgcuggcccugcc

SEQ ID NO: 3234042 - RNA, 12 nt, Mycobacterium leprae
uggucggauggc

SEQ ID NO: 3234043 - RNA, 14 nt, Mycobacterium leprae
uggucggcgcuggc

SEQ ID NO: 3234044 - RNA, 14 nt, Mycobacterium leprae
uggucuacauguug

SEQ ID NO: 3234045 - RNA, 21 nt, Mycobacterium leprae
uggucuacauguugaugaugc

SEQ ID NO: 3234046 - RNA, 17 nt, Mycobacterium leprae
uggugaccugacaucaa

SEQ ID NO: 3234047 - RNA, 22 nt, Mycobacterium leprae
uggugacucuguggacucagca

SEQ ID NO: 3234048 - RNA, 20 nt, Mycobacterium leprae
uggugauaaauucuuuugca

SEQ ID NO: 3234049 - RNA, 20 nt, Mycobacterium leprae
uggugcccgacagccaccac

SEQ ID NO: 3234050 - RNA, 16 nt, Mycobacterium leprae
uggugccgagcgcauc

SEQ ID NO: 3234051 - RNA, 16 nt, Mycobacterium leprae
uggugcgccaacacua

SEQ ID NO: 3234052 - RNA, 11 nt, Mycobacterium leprae
uggugcugccc

SEQ ID NO: 3234053 - RNA, 14 nt, Mycobacterium leprae
uggugcuuggcagc

SEQ ID NO: 3234054 - RNA, 23 nt, Mycobacterium leprae
ugguggccauaccuagagaauaa

SEQ ID NO: 3234055 - RNA, 19 nt, Mycobacterium leprae
ugguggcuggcuacgcagc

SEQ ID NO: 3234056 - RNA, 12 nt, Mycobacterium leprae
uggugggcuggu

SEQ ID NO: 3234057 - RNA, 16 nt, Mycobacterium leprae
uggugugcaguaacau

SEQ ID NO: 3234058 - RNA, 22 nt, Mycobacterium leprae
uggugugugaggaucugcugau

SEQ ID NO: 3234059 - RNA, 17 nt, Mycobacterium leprae
ugguguugucgccgaaa

SEQ ID NO: 3234060 - RNA, 16 nt, Mycobacterium leprae
ugguuaaucaccucau

SEQ ID NO: 3234061 - RNA, 18 nt, Mycobacterium leprae
ugguuaucgauuucagcc

SEQ ID NO: 3234062 - RNA, 22 nt, Mycobacterium leprae
ugguucaccaaucagaucacgu

SEQ ID NO: 3234063 - RNA, 12 nt, Mycobacterium leprae
ugguucacuaag

SEQ ID NO: 3234064 - RNA, 16 nt, Mycobacterium leprae
ugguucgauucugccc

SEQ ID NO: 3234065 - RNA, 14 nt, Mycobacterium leprae
ugguugacagcaga

SEQ ID NO: 3234066 - RNA, 16 nt, Mycobacterium leprae
ugguugacagcagaau

SEQ ID NO: 3234067 - RNA, 23 nt, Mycobacterium leprae
ugguuggucggccacucguaggg

SEQ ID NO: 3234068 - RNA, 20 nt, Mycobacterium leprae
ugguugucuaauucguccug

SEQ ID NO: 3234069 - RNA, 23 nt, Mycobacterium leprae
ugguuuccagggcgaguacgucc

SEQ ID NO: 3234070 - RNA, 13 nt, Mycobacterium leprae
ugguuuggguggu

SEQ ID NO: 3234071 - RNA, 17 nt, Mycobacterium leprae
ugguuugggugguguug

SEQ ID NO: 3234072 - RNA, 22 nt, Mycobacterium leprae
uguaacggucaucccagaacug

SEQ ID NO: 3234073 - RNA, 13 nt, Mycobacterium leprae
uguaaggccagca

SEQ ID NO: 3234074 - RNA, 15 nt, Mycobacterium leprae
uguaaggccagcagu

SEQ ID NO: 3234075 - RNA, 16 nt, Mycobacterium leprae
uguaagugcaguuccu

SEQ ID NO: 3234076 - RNA, 13 nt, Mycobacterium leprae
uguaaugcugcug

SEQ ID NO: 3234077 - RNA, 16 nt, Mycobacterium leprae
uguaauuacuucgguc

SEQ ID NO: 3234078 - RNA, 14 nt, Mycobacterium leprae
uguacaacgccagu

SEQ ID NO: 3234079 - RNA, 15 nt, Mycobacterium leprae
uguacucgcgauggc

SEQ ID NO: 3234080 - RNA, 13 nt, Mycobacterium leprae
uguagaccaagca

SEQ ID NO: 3234081 - RNA, 18 nt, Mycobacterium leprae
uguagaccaagcagcauc

SEQ ID NO: 3234082 - RNA, 21 nt, Mycobacterium leprae
uguagaccaagcagcauccac

SEQ ID NO: 3234083 - RNA, 16 nt, Mycobacterium leprae
uguagcaggucgccga

SEQ ID NO: 3234084 - RNA, 13 nt, Mycobacterium leprae
uguaguuuauuau

SEQ ID NO: 3234085 - RNA, 15 nt, Mycobacterium leprae
uguauaacaaaucau

SEQ ID NO: 3234086 - RNA, 21 nt, Mycobacterium leprae
uguauccaggauugaugccuu

SEQ ID NO: 3234087 - RNA, 13 nt, Mycobacterium leprae
uguauccggaggc

SEQ ID NO: 3234088 - RNA, 20 nt, Mycobacterium leprae
uguauggcuccaaguggcug

SEQ ID NO: 3234089 - RNA, 12 nt, Mycobacterium leprae
uuaacacaugca

SEQ ID NO: 3234090 - RNA, 19 nt, Mycobacterium leprae
uuaauauauuccaggucaa

SEQ ID NO: 3234091 - RNA, 19 nt, Mycobacterium leprae
uuaaugucggcgcgacugc

SEQ ID NO: 3234092 - RNA, 16 nt, Mycobacterium leprae
uuaauucuucucuaaa

SEQ ID NO: 3234093 - RNA, 19 nt, Mycobacterium leprae
uuacaauaguaaguggcca

SEQ ID NO: 3234094 - RNA, 14 nt, Mycobacterium leprae
uuacaaugugucaa

SEQ ID NO: 3234095 - RNA, 14 nt, Mycobacterium leprae
uuacacgugccgug

SEQ ID NO: 3234096 - RNA, 20 nt, Mycobacterium leprae
uuaccaagccggugccaggc

SEQ ID NO: 3234097 - RNA, 18 nt, Mycobacterium leprae
uuaccacucgucuuuccg

SEQ ID NO: 3234098 - RNA, 22 nt, Mycobacterium leprae
uuacggcuuugcaaagcagaau

SEQ ID NO: 3234099 - RNA, 19 nt, Mycobacterium leprae
uuacugaaucauguauucg

SEQ ID NO: 3234100 - RNA, 19 nt, Mycobacterium leprae
uuacugagcuuguauugcu

SEQ ID NO: 3234101 - RNA, 20 nt, Mycobacterium leprae
uuacuucggucaggucaugc

SEQ ID NO: 3234102 - RNA, 13 nt, Mycobacterium leprae
uuagaaagcugcg

SEQ ID NO: 3234103 - RNA, 20 nt, Mycobacterium leprae
uuagagaagaauuaauauau

SEQ ID NO: 3234104 - RNA, 15 nt, Mycobacterium leprae
uuagaggcugcaccg

SEQ ID NO: 3234105 - RNA, 21 nt, Mycobacterium leprae
uuagcaacgacgccacagcgg

SEQ ID NO: 3234106 - RNA, 23 nt, Mycobacterium leprae
uuagcaacguguaaggccagcgc

SEQ ID NO: 3234107 - RNA, 19 nt, Mycobacterium leprae
uuagcauagcggccgccag

SEQ ID NO: 3234108 - RNA, 13 nt, Mycobacterium leprae
uuagcgccgcggg

SEQ ID NO: 3234109 - RNA, 14 nt, Mycobacterium leprae
uuagcgugcugugc

SEQ ID NO: 3234110 - RNA, 18 nt, Mycobacterium leprae
uuaggucgaaacuaagcc

SEQ ID NO: 3234111 - RNA, 22 nt, Mycobacterium leprae
uuagucaaaucgauguuguagg

SEQ ID NO: 3234112 - RNA, 22 nt, Mycobacterium leprae
uuauacugcugcgauuccagca

SEQ ID NO: 3234113 - RNA, 23 nt, Mycobacterium leprae
uuauacugcugcgauuccagcaa

SEQ ID NO: 3234114 - RNA, 20 nt, Mycobacterium leprae
uuaucaagggauuccacugc

SEQ ID NO: 3234115 - RNA, 17 nt, Mycobacterium leprae
uuauggaccugaugaca

SEQ ID NO: 3234116 - RNA, 22 nt, Mycobacterium leprae
uuauuccaauccugucaccugg

SEQ ID NO: 3234117 - RNA, 15 nt, Mycobacterium leprae
uuauuccuaaugaau

SEQ ID NO: 3234118 - RNA, 14 nt, Mycobacterium leprae
uuauucuaggcgau

SEQ ID NO: 3234119 - RNA, 15 nt, Mycobacterium leprae
uuauuuauauucaau

SEQ ID NO: 3234120 - RNA, 20 nt, Mycobacterium leprae
uuauuuggcgcacaaaaauc

SEQ ID NO: 3234121 - RNA, 18 nt, Mycobacterium leprae
uucaaauaccaagacuuu

SEQ ID NO: 3234122 - RNA, 13 nt, Mycobacterium leprae
uucaacaaaacca

SEQ ID NO: 3234123 - RNA, 17 nt, Mycobacterium leprae
uucaacaaaaccaucgu

SEQ ID NO: 3234124 - RNA, 16 nt, Mycobacterium leprae
uucaacaccaugguga

SEQ ID NO: 3234125 - RNA, 23 nt, Mycobacterium leprae
uucaacgcaucaccggaaagcug

SEQ ID NO: 3234126 - RNA, 14 nt, Mycobacterium leprae
uucacaaccaucgc

SEQ ID NO: 3234127 - RNA, 16 nt, Mycobacterium leprae
uucacaugucccggug

SEQ ID NO: 3234128 - RNA, 20 nt, Mycobacterium leprae
uucaccaaacuggacuucua

SEQ ID NO: 3234129 - RNA, 21 nt, Mycobacterium leprae
uucaccucguucaagauacug

SEQ ID NO: 3234130 - RNA, 23 nt, Mycobacterium leprae
uucacgaacaacagagcaagccg

SEQ ID NO: 3234131 - RNA, 18 nt, Mycobacterium leprae
uucagagcugcaggucag

SEQ ID NO: 3234132 - RNA, 22 nt, Mycobacterium leprae
uucagaucgacuccgcaagaug

SEQ ID NO: 3234133 - RNA, 22 nt, Mycobacterium leprae
uucagccgggcuaaggugcguu

SEQ ID NO: 3234134 - RNA, 21 nt, Mycobacterium leprae
uucagcguggcuaggccagug

SEQ ID NO: 3234135 - RNA, 21 nt, Mycobacterium leprae
uucaggugugcugcagcauug

SEQ ID NO: 3234136 - RNA, 16 nt, Mycobacterium leprae
uucaguucacgcuggc

SEQ ID NO: 3234137 - RNA, 16 nt, Mycobacterium leprae
uucauagguggugggu

SEQ ID NO: 3234138 - RNA, 18 nt, Mycobacterium leprae
uucauccagcuguugacu

SEQ ID NO: 3234139 - RNA, 15 nt, Mycobacterium leprae
uucaugguguguuca

SEQ ID NO: 3234140 - RNA, 21 nt, Mycobacterium leprae
uucauguccuacacaaacaag

SEQ ID NO: 3234141 - RNA, 18 nt, Mycobacterium leprae
uuccaggacaacggcggc

SEQ ID NO: 3234142 - RNA, 11 nt, Mycobacterium leprae
uuccaggucaa

SEQ ID NO: 3234143 - RNA, 14 nt, Mycobacterium leprae
uucccgacggugaa

SEQ ID NO: 3234144 - RNA, 17 nt, Mycobacterium leprae
uucccgacggugaauca

SEQ ID NO: 3234145 - RNA, 21 nt, Mycobacterium leprae
uuccgagccgacaaucgagca

SEQ ID NO: 3234146 - RNA, 16 nt, Mycobacterium leprae
uuccgcgugugccgcu

SEQ ID NO: 3234147 - RNA, 16 nt, Mycobacterium leprae
uuccggaacaacagac

SEQ ID NO: 3234148 - RNA, 11 nt, Mycobacterium leprae
uuccuaaaauu

SEQ ID NO: 3234149 - RNA, 13 nt, Mycobacterium leprae
uuccucgcgggcg

SEQ ID NO: 3234150 - RNA, 21 nt, Mycobacterium leprae
uuccucuaggggggcggugaa

SEQ ID NO: 3234151 - RNA, 23 nt, Mycobacterium leprae
uuccugacaaccguucgagcccc

SEQ ID NO: 3234152 - RNA, 17 nt, Mycobacterium leprae
uucgacaccgagcagcc

SEQ ID NO: 3234153 - RNA, 18 nt, Mycobacterium leprae
uucgacggcaacggcacc

SEQ ID NO: 3234154 - RNA, 14 nt, Mycobacterium leprae
uucgacuucugguu

SEQ ID NO: 3234155 - RNA, 13 nt, Mycobacterium leprae
uucgauaagaagu

SEQ ID NO: 3234156 - RNA, 18 nt, Mycobacterium leprae
uucgauguguugaacagu

SEQ ID NO: 3234157 - RNA, 14 nt, Mycobacterium leprae
uucgauucugcccg

SEQ ID NO: 3234158 - RNA, 12 nt, Mycobacterium leprae
uucgcaccugau

SEQ ID NO: 3234159 - RNA, 19 nt, Mycobacterium leprae
uucgcagacacagccguca

SEQ ID NO: 3234160 - RNA, 17 nt, Mycobacterium leprae
uucgccacucaaauuca

SEQ ID NO: 3234161 - RNA, 18 nt, Mycobacterium leprae
uucgccauagccgaucuc

SEQ ID NO: 3234162 - RNA, 20 nt, Mycobacterium leprae
uucgccgcacgggaggcguu

SEQ ID NO: 3234163 - RNA, 12 nt, Mycobacterium leprae
uucgccgcggcc

SEQ ID NO: 3234164 - RNA, 21 nt, Mycobacterium leprae
uucgccuuaagagucuagucc

SEQ ID NO: 3234165 - RNA, 16 nt, Mycobacterium leprae
uucgccuuagcacguc

SEQ ID NO: 3234166 - RNA, 23 nt, Mycobacterium leprae
uucgcgaccuugcggcgccccuc

SEQ ID NO: 3234167 - RNA, 17 nt, Mycobacterium leprae
uucgcgaucuggauggc

SEQ ID NO: 3234168 - RNA, 13 nt, Mycobacterium leprae
uucgcugacagca

SEQ ID NO: 3234169 - RNA, 18 nt, Mycobacterium leprae
uucggagucuugaugcca

SEQ ID NO: 3234170 - RNA, 17 nt, Mycobacterium leprae
uucggauucggaucguu

SEQ ID NO: 3234171 - RNA, 16 nt, Mycobacterium leprae
uucggcacagugccug

SEQ ID NO: 3234172 - RNA, 16 nt, Mycobacterium leprae
uucggcgcacacccgg

SEQ ID NO: 3234173 - RNA, 23 nt, Mycobacterium leprae
uucggcuacugcgacagcagcca

SEQ ID NO: 3234174 - RNA, 20 nt, Mycobacterium leprae
uucggucacgggucggcggg

SEQ ID NO: 3234175 - RNA, 17 nt, Mycobacterium leprae
uucgucaaaaaacucau

SEQ ID NO: 3234176 - RNA, 20 nt, Mycobacterium leprae
uucgugagccuaugcggcca

SEQ ID NO: 3234177 - RNA, 15 nt, Mycobacterium leprae
uucgugugcuuugcc

SEQ ID NO: 3234178 - RNA, 14 nt, Mycobacterium leprae
uucuaaccggucaa

SEQ ID NO: 3234179 - RNA, 17 nt, Mycobacterium leprae
uucuaggcggugacuga

SEQ ID NO: 3234180 - RNA, 20 nt, Mycobacterium leprae
uucuaggguguugugggugu

SEQ ID NO: 3234181 - RNA, 22 nt, Mycobacterium leprae
uucucaagcgggcaacaggcgg

SEQ ID NO: 3234182 - RNA, 16 nt, Mycobacterium leprae
uucucauuguggcugg

SEQ ID NO: 3234183 - RNA, 23 nt, Mycobacterium leprae
uucucccgccacucggcagagcg

SEQ ID NO: 3234184 - RNA, 20 nt, Mycobacterium leprae
uucucgagcggcgcaugcca

SEQ ID NO: 3234185 - RNA, 13 nt, Mycobacterium leprae
uucucggcagcag

SEQ ID NO: 3234186 - RNA, 20 nt, Mycobacterium leprae
uucucggguuuuaucugcaa

SEQ ID NO: 3234187 - RNA, 22 nt, Mycobacterium leprae
uucugauggggggugugaugcu

SEQ ID NO: 3234188 - RNA, 22 nt, Mycobacterium leprae
uucugcaugcauauauuuguau

SEQ ID NO: 3234189 - RNA, 22 nt, Mycobacterium leprae
uucugcccggauugauggaugc

SEQ ID NO: 3234190 - RNA, 15 nt, Mycobacterium leprae
uucuggcugggacac

SEQ ID NO: 3234191 - RNA, 15 nt, Mycobacterium leprae
uucuguugugggggu

SEQ ID NO: 3234192 - RNA, 16 nt, Mycobacterium leprae
uucuuacccgagcuga

SEQ ID NO: 3234193 - RNA, 15 nt, Mycobacterium leprae
uucuucucuaaaaag

SEQ ID NO: 3234194 - RNA, 15 nt, Mycobacterium leprae
uucuugaaaaauaag

SEQ ID NO: 3234195 - RNA, 19 nt, Mycobacterium leprae
uucuugauccgagaaaacu

SEQ ID NO: 3234196 - RNA, 16 nt, Mycobacterium leprae
uucuuuuagagaaaac

SEQ ID NO: 3234197 - RNA, 18 nt, Mycobacterium leprae
uugaaacccggaaugacg

SEQ ID NO: 3234198 - RNA, 22 nt, Mycobacterium leprae
uugaacuacgugugcucgcugc

SEQ ID NO: 3234199 - RNA, 20 nt, Mycobacterium leprae
uugaacugcagguuguugac

SEQ ID NO: 3234200 - RNA, 11 nt, Mycobacterium leprae
uugaacuuggc

SEQ ID NO: 3234201 - RNA, 12 nt, Mycobacterium leprae
uuguuagugcug

SEQ ID NO: 3234202 - RNA, 15 nt, Mycobacterium leprae
uuguugaccaaugug

SEQ ID NO: 3234203 - RNA, 18 nt, Mycobacterium leprae
uuguugacguguuuugcu

SEQ ID NO: 3234204 - RNA, 23 nt, Mycobacterium leprae
uuguuguacauaccgaacucgau

SEQ ID NO: 3234205 - RNA, 16 nt, Mycobacterium leprae
uuguuuauguucggca

SEQ ID NO: 3234206 - RNA, 20 nt, Mycobacterium leprae
uuguuuccgauguagcacag

SEQ ID NO: 3234207 - RNA, 16 nt, Mycobacterium leprae
uuuaagcaaucccacg

SEQ ID NO: 3234208 - RNA, 21 nt, Mycobacterium leprae
uuuaagcgaaaaugaaaacaa

SEQ ID NO: 3234209 - RNA, 20 nt, Mycobacterium leprae
uuuacccccagaaccauccc

SEQ ID NO: 3234210 - RNA, 15 nt, Mycobacterium leprae
uuuaccuucaggucu

SEQ ID NO: 3234211 - RNA, 17 nt, Mycobacterium leprae
uuuagagaaaacuuaau

SEQ ID NO: 3234212 - RNA, 22 nt, Mycobacterium leprae
uuuagagaaaacuuaauaucuu

SEQ ID NO: 3234213 - RNA, 18 nt, Mycobacterium leprae
uuuagaggcugcaccggc

SEQ ID NO: 3234214 - RNA, 13 nt, Mycobacterium leprae
uuuagcgacuacc

SEQ ID NO: 3234215 - RNA, 13 nt, Mycobacterium leprae
uuuauacacgcgg

SEQ ID NO: 3234216 - RNA, 14 nt, Mycobacterium leprae
uuuaugacuggccg

SEQ ID NO: 3234217 - RNA, 20 nt, Mycobacterium leprae
uuucaaguucucaacaccca

SEQ ID NO: 3234218 - RNA, 15 nt, Mycobacterium leprae
uuucagccacauugc

SEQ ID NO: 3234219 - RNA, 14 nt, Mycobacterium leprae
uuucagccgggcua

SEQ ID NO: 3234220 - RNA, 21 nt, Mycobacterium leprae
uuucagcucgauggugccauu

SEQ ID NO: 3234221 - RNA, 12 nt, Mycobacterium leprae
uuuccaaaaccc

SEQ ID NO: 3234222 - RNA, 20 nt, Mycobacterium leprae
uuuccaacaaacuacuguug

SEQ ID NO: 3234223 - RNA, 23 nt, Mycobacterium leprae
uuuccaugaugguuuggcugcca

SEQ ID NO: 3234224 - RNA, 17 nt, Mycobacterium leprae
uuucccgcuuagaugcu

SEQ ID NO: 3234225 - RNA, 19 nt, Mycobacterium leprae
uuuccgccucaggguacga

SEQ ID NO: 3234226 - RNA, 15 nt, Mycobacterium leprae
uuuccgcgccccuuc

SEQ ID NO: 3234227 - RNA, 23 nt, Mycobacterium leprae
uuuccgcggcauauguaggugcu

SEQ ID NO: 3234228 - RNA, 13 nt, Mycobacterium leprae
uuucgacauugcc

SEQ ID NO: 3234229 - RNA, 22 nt, Mycobacterium leprae
uuucgagcaguaguccucugcg

SEQ ID NO: 3234230 - RNA, 12 nt, Mycobacterium leprae
uuucgaugaggc

SEQ ID NO: 3234231 - RNA, 22 nt, Mycobacterium leprae
uuucgcauuauuuuuuagaucc

SEQ ID NO: 3234232 - RNA, 17 nt, Mycobacterium leprae
uuucgucgucagcugcu

SEQ ID NO: 3234233 - RNA, 11 nt, Mycobacterium leprae
uuucucuaaaa

SEQ ID NO: 3234234 - RNA, 13 nt, Mycobacterium leprae
uuucucuaaaaga

SEQ ID NO: 3234235 - RNA, 20 nt, Mycobacterium leprae
uuugacgaaaauguuuuguu

SEQ ID NO: 3234236 - RNA, 23 nt, Mycobacterium leprae
uuugauccagccgaacaaacccc

SEQ ID NO: 3234237 - RNA, 22 nt, Mycobacterium leprae
uuugccaaucuaucaagccaca

SEQ ID NO: 3234238 - RNA, 18 nt, Mycobacterium leprae
uuugccaugcacgccggc

SEQ ID NO: 3234239 - RNA, 14 nt, Mycobacterium leprae
uuugcuaacaaggc

SEQ ID NO: 3234240 - RNA, 15 nt, Mycobacterium leprae
uuugcucacguucau

SEQ ID NO: 3234241 - RNA, 20 nt, Mycobacterium leprae
uuugcugcaaugccggacug

SEQ ID NO: 3234242 - RNA, 20 nt, Mycobacterium leprae
uuugcugucguggcugcaca

SEQ ID NO: 3234243 - RNA, 16 nt, Mycobacterium leprae
uuuggcauacucucuc

SEQ ID NO: 3234244 - RNA, 17 nt, Mycobacterium leprae
uuuggcguaguguagcu

SEQ ID NO: 3234245 - RNA, 12 nt, Mycobacterium leprae
uuugggccaggu

SEQ ID NO: 3234246 - RNA, 13 nt, Mycobacterium leprae
uuugggccagguc

SEQ ID NO: 3234247 - RNA, 14 nt, Mycobacterium leprae
uuuggggucuagga

SEQ ID NO: 3234248 - RNA, 23 nt, Mycobacterium leprae
uuuggugaucacgguugcuucca

SEQ ID NO: 3234249 - RNA, 21 nt, Mycobacterium leprae
uuugguuauugcucugucuac

SEQ ID NO: 3234250 - RNA, 14 nt, Mycobacterium leprae
uuuguccugacaga

SEQ ID NO: 3234251 - RNA, 16 nt, Mycobacterium leprae
uuuuaagcgaaaauga

SEQ ID NO: 3234252 - RNA, 14 nt, Mycobacterium leprae
uuuuagagaagaau

SEQ ID NO: 3234253 - RNA, 23 nt, Mycobacterium leprae
uuuuagagaagaauuaauauaua

SEQ ID NO: 3234254 - RNA, 13 nt, Mycobacterium leprae
uuuugcaggccag

SEQ ID NO: 3234255 - RNA, 18 nt, Mycobacterium leprae
uuuugcccaaugcagcaa

SEQ ID NO: 3234256 - RNA, 15 nt, Mycobacterium leprae
uuuugcuagauaucu

SEQ ID NO: 3234257 - RNA, 19 nt, Mycobacterium leprae
uuuuggaccccaaccagac

SEQ ID NO: 3234258 - RNA, 23 nt, Mycobacterium leprae
uuuuggcaguaccaaaguggauu

SEQ ID NO: 3234259 - RNA, 23 nt, Mycobacterium leprae
uuuuggugucuugucagguaucu

SEQ ID NO: 3234260 - RNA, 15 nt, Mycobacterium leprae
uuuugugaacauauc

SEQ ID NO: 3234261 - RNA, 22 nt, Mycobacterium leprae
uuuuguucuguccgcacaaacu

SEQ ID NO: 3234262 - RNA, 11 nt, Mycobacterium leprae
aaaaacuaggu

SEQ ID NO: 3234263 - RNA, 13 nt, Mycobacterium leprae
aaaaacucauguu

SEQ ID NO: 3234264 - RNA, 16 nt, Mycobacterium leprae
aaaacaacguaccuaa

SEQ ID NO: 3234265 - RNA, 20 nt, Mycobacterium leprae
aaaacacuuacaccaacaua

SEQ ID NO: 3234266 - RNA, 13 nt, Mycobacterium leprae
aaaaccacaagca

SEQ ID NO: 3234267 - RNA, 12 nt, Mycobacterium leprae
aaaaccccacac

SEQ ID NO: 3234268 - RNA, 14 nt, Mycobacterium leprae
aaaaccggguucau

SEQ ID NO: 3234269 - RNA, 21 nt, Mycobacterium leprae
aaaaccguguagugcacagaa

SEQ ID NO: 3234270 - RNA, 20 nt, Mycobacterium leprae
aaaacgguuagucagaguga

SEQ ID NO: 3234271 - RNA, 13 nt, Mycobacterium leprae
aaaacguccagua

SEQ ID NO: 3234272 - RNA, 13 nt, Mycobacterium leprae
aaaauaacuauaa

SEQ ID NO: 3234273 - RNA, 16 nt, Mycobacterium leprae
aaaauccucccaguga

SEQ ID NO: 3234274 - RNA, 14 nt, Mycobacterium leprae
aaaauccuucaugu

SEQ ID NO: 3234275 - RNA, 17 nt, Mycobacterium leprae
aaaaucggcgucacggu

SEQ ID NO: 3234276 - RNA, 22 nt, Mycobacterium leprae
aaaaucucugugcgaaaacacu

SEQ ID NO: 3234277 - RNA, 21 nt, Mycobacterium leprae
aaaaucuggcgccauauccuc

SEQ ID NO: 3234278 - RNA, 18 nt, Mycobacterium leprae
aaaaugaguugcaacauc

SEQ ID NO: 3234279 - RNA, 18 nt, Mycobacterium leprae
aaaaugcucccccaaugc

SEQ ID NO: 3234280 - RNA, 20 nt, Mycobacterium leprae
aaaauuccuacccucucagc

SEQ ID NO: 3234281 - RNA, 10 nt, Mycobacterium leprae
aaaauucucg

SEQ ID NO: 3234282 - RNA, 12 nt, Mycobacterium leprae
aaacacagcaag

SEQ ID NO: 3234283 - RNA, 14 nt, Mycobacterium leprae
aaacacagcaagca

SEQ ID NO: 3234284 - RNA, 11 nt, Mycobacterium leprae
aaacagagcug

SEQ ID NO: 3234285 - RNA, 13 nt, Mycobacterium leprae
aaacagagcugau

SEQ ID NO: 3234286 - RNA, 20 nt, Mycobacterium leprae
aaacagugccacagucacgc

SEQ ID NO: 3234287 - RNA, 13 nt, Mycobacterium leprae
aaacaucgaguga

SEQ ID NO: 3234288 - RNA, 15 nt, Mycobacterium leprae
aaaccacaaacucca

SEQ ID NO: 3234289 - RNA, 23 nt, Mycobacterium leprae
aaaccagccgggugaucccgcug

SEQ ID NO: 3234290 - RNA, 15 nt, Mycobacterium leprae
aaaccaugccgccga

SEQ ID NO: 3234291 - RNA, 17 nt, Mycobacterium leprae
aaaccccacacugagaa

SEQ ID NO: 3234292 - RNA, 18 nt, Mycobacterium leprae
aaacccgcgcgugcacaa

SEQ ID NO: 3234293 - RNA, 21 nt, Mycobacterium leprae
aaaccgcaguacuggugcugu

SEQ ID NO: 3234294 - RNA, 21 nt, Mycobacterium leprae
aaaccuuacagucacuauaau

SEQ ID NO: 3234295 - RNA, 13 nt, Mycobacterium leprae
aaacgagauugcc

SEQ ID NO: 3234296 - RNA, 18 nt, Mycobacterium leprae
aaacuacuguugucagug

SEQ ID NO: 3234297 - RNA, 20 nt, Mycobacterium leprae
aaacuacuguugucaguggc

SEQ ID NO: 3234298 - RNA, 18 nt, Mycobacterium leprae
aaacuccagagccgcgcg

SEQ ID NO: 3234299 - RNA, 18 nt, Mycobacterium leprae
aaacugccgguagccugg

SEQ ID NO: 3234300 - RNA, 18 nt, Mycobacterium leprae
aaacugcugcgcaagguu

SEQ ID NO: 3234301 - RNA, 16 nt, Mycobacterium leprae
aaagaacgcgaccugu

SEQ ID NO: 3234302 - RNA, 23 nt, Mycobacterium leprae
aaagaacgcgaccuguuggugag

SEQ ID NO: 3234303 - RNA, 15 nt, Mycobacterium leprae
aaagaauuuaccggc

SEQ ID NO: 3234304 - RNA, 22 nt, Mycobacterium leprae
aaagacgacaacagagcaagca

SEQ ID NO: 3234305 - RNA, 22 nt, Mycobacterium leprae
aaagacggugucggauccccuc

SEQ ID NO: 3234306 - RNA, 17 nt, Mycobacterium leprae
aaagaggccgacagaac

SEQ ID NO: 3234307 - RNA, 13 nt, Mycobacterium leprae
aaagcagaauauu

SEQ ID NO: 3234308 - RNA, 22 nt, Mycobacterium leprae
aaagcccuguucaacgcaucac

SEQ ID NO: 3234309 - RNA, 15 nt, Mycobacterium leprae
aaagccugcuuccaa

SEQ ID NO: 3234310 - RNA, 18 nt, Mycobacterium leprae
aaagcuggcgaacaacaa

SEQ ID NO: 3234311 - RNA, 23 nt, Mycobacterium leprae
aaaggaacgacggauaaguccac

SEQ ID NO: 3234312 - RNA, 20 nt, Mycobacterium leprae
aaaggaguucaacaaaacca

SEQ ID NO: 3234313 - RNA, 22 nt, Mycobacterium leprae
aaaggcuguccuugccggcgcc

SEQ ID NO: 3234314 - RNA, 16 nt, Mycobacterium leprae
aaagggaccgggcucu

SEQ ID NO: 3234315 - RNA, 18 nt, Mycobacterium leprae
aaagggucguaauaauau

SEQ ID NO: 3234316 - RNA, 15 nt, Mycobacterium leprae
aaagucaccugucau

SEQ ID NO: 3234317 - RNA, 22 nt, Mycobacterium leprae
aaagucuugugcguagucgacc

SEQ ID NO: 3234318 - RNA, 21 nt, Mycobacterium leprae
aaauacggcacgccgaacagc

SEQ ID NO: 3234319 - RNA, 23 nt, Mycobacterium leprae
aaauacuacagaugacagcgcga

SEQ ID NO: 3234320 - RNA, 13 nt, Mycobacterium leprae
aaauaguggcuga

SEQ ID NO: 3234321 - RNA, 21 nt, Mycobacterium leprae
aaauauacgacgucaacguua

SEQ ID NO: 3234322 - RNA, 12 nt, Mycobacterium leprae
aaauauacuuua

SEQ ID NO: 3234323 - RNA, 18 nt, Mycobacterium leprae
aaaucauagugaccaaaa

SEQ ID NO: 3234324 - RNA, 22 nt, Mycobacterium leprae
aaauccgcugacaaaaccgcgg

SEQ ID NO: 3234325 - RNA, 21 nt, Mycobacterium leprae
aaauccucacccgcgaucucg

SEQ ID NO: 3234326 - RNA, 21 nt, Mycobacterium leprae
aaaucucacgcccgacgaacg

SEQ ID NO: 3234327 - RNA, 15 nt, Mycobacterium leprae
aaaugaauuggguaa

SEQ ID NO: 3234328 - RNA, 23 nt, Mycobacterium leprae
aaaugccuacccuagagucgacc

SEQ ID NO: 3234329 - RNA, 20 nt, Mycobacterium leprae
aaaugcuggagcgaugucga

SEQ ID NO: 3234330 - RNA, 13 nt, Mycobacterium leprae
aaauggguuuggu

SEQ ID NO: 3234331 - RNA, 21 nt, Mycobacterium leprae
aaauuacguuuaccgauucgg

SEQ ID NO: 3234332 - RNA, 22 nt, Mycobacterium leprae
aaauuacguuuaccgauucggu

SEQ ID NO: 3234333 - RNA, 16 nt, Mycobacterium leprae
aaauuccuacccucuc

SEQ ID NO: 3234334 - RNA, 23 nt, Mycobacterium leprae
aaauuccuacccucucagcaauc

SEQ ID NO: 3234335 - RNA, 22 nt, Mycobacterium leprae
aaauucgcgcuacgauuuugca

SEQ ID NO: 3234336 - RNA, 14 nt, Mycobacterium leprae
aaauugugggggug

SEQ ID NO: 3234337 - RNA, 22 nt, Mycobacterium leprae
aaauuugaggucgacacagaac

SEQ ID NO: 3234338 - RNA, 16 nt, Mycobacterium leprae
aaauuuuaucgcagga

SEQ ID NO: 3234339 - RNA, 19 nt, Mycobacterium leprae
aaauuuucaggcugucauc

SEQ ID NO: 3234340 - RNA, 21 nt, Mycobacterium leprae
aacaaaucauagugaccaaaa

SEQ ID NO: 3234341 - RNA, 22 nt, Mycobacterium leprae
aacaaaucauagugaccaaaau

SEQ ID NO: 3234342 - RNA, 14 nt, Mycobacterium leprae
aacaacaaaaauag

SEQ ID NO: 3234343 - RNA, 14 nt, Mycobacterium leprae
aacaaccgaacaac

SEQ ID NO: 3234344 - RNA, 15 nt, Mycobacterium leprae
aacaaccuggugugc

SEQ ID NO: 3234345 - RNA, 21 nt, Mycobacterium leprae
aacaacuauccucacacucac

SEQ ID NO: 3234346 - RNA, 17 nt, Mycobacterium leprae
aacaagaaaaggaccca

SEQ ID NO: 3234347 - RNA, 21 nt, Mycobacterium leprae
aacaagcgaucggaacaucac

SEQ ID NO: 3234348 - RNA, 19 nt, Mycobacterium leprae
aacaaggugaugcccauca

SEQ ID NO: 3234349 - RNA, 13 nt, Mycobacterium leprae
aacaccccacccg

SEQ ID NO: 3234350 - RNA, 16 nt, Mycobacterium leprae
aacaccucaagcaaua

SEQ ID NO: 3234351 - RNA, 22 nt, Mycobacterium leprae
aacaccuuuuccaauucguaau

SEQ ID NO: 3234352 - RNA, 22 nt, Mycobacterium leprae
aacacgucuagcgaacacacag

SEQ ID NO: 3234353 - RNA, 15 nt, Mycobacterium leprae
aacacuggcgaccgc

SEQ ID NO: 3234354 - RNA, 14 nt, Mycobacterium leprae
aacacuuacaccaa

SEQ ID NO: 3234355 - RNA, 15 nt, Mycobacterium leprae
aacacuuacaccaac

SEQ ID NO: 3234356 - RNA, 11 nt, Mycobacterium leprae
aacagccaaug

SEQ ID NO: 3234357 - RNA, 20 nt, Mycobacterium leprae
aacagccgagcuugcugcuu

SEQ ID NO: 3234358 - RNA, 20 nt, Mycobacterium leprae
aacagccuaaccucacgccu

SEQ ID NO: 3234359 - RNA, 20 nt, Mycobacterium leprae
aacaggcauauaaucgcuuc

SEQ ID NO: 3234360 - RNA, 12 nt, Mycobacterium leprae
aacaggcgccug

SEQ ID NO: 3234361 - RNA, 21 nt, Mycobacterium leprae
aacaggcgguuuaaaagugac

SEQ ID NO: 3234362 - RNA, 18 nt, Mycobacterium leprae
aacagggccgaagcagcc

SEQ ID NO: 3234363 - RNA, 21 nt, Mycobacterium leprae
aacagggccgaagcagccggg

SEQ ID NO: 3234364 - RNA, 14 nt, Mycobacterium leprae
aacagucagccgcg

SEQ ID NO: 3234365 - RNA, 13 nt, Mycobacterium leprae
aacauaaccacau

SEQ ID NO: 3234366 - RNA, 17 nt, Mycobacterium leprae
aacauagccagcaucaa

SEQ ID NO: 3234367 - RNA, 17 nt, Mycobacterium leprae
aacauagucagaucaac

SEQ ID NO: 3234368 - RNA, 18 nt, Mycobacterium leprae
aacauagucagaucaacc

SEQ ID NO: 3234369 - RNA, 22 nt, Mycobacterium leprae
aacauagucagaucaaccaaau

SEQ ID NO: 3234370 - RNA, 17 nt, Mycobacterium leprae
aacaugaacgucacugg

SEQ ID NO: 3234371 - RNA, 19 nt, Mycobacterium leprae
aacauggacaaccugggcg

SEQ ID NO: 3234372 - RNA, 17 nt, Mycobacterium leprae
aacauguagaccaagca

SEQ ID NO: 3234373 - RNA, 16 nt, Mycobacterium leprae
aacauuguucugccau

SEQ ID NO: 3234374 - RNA, 18 nt, Mycobacterium leprae
aacauuuuaaaacuggau

SEQ ID NO: 3234375 - RNA, 17 nt, Mycobacterium leprae
aaccaagcuguuucugu

SEQ ID NO: 3234376 - RNA, 13 nt, Mycobacterium leprae
aaccacacccugg

SEQ ID NO: 3234377 - RNA, 22 nt, Mycobacterium leprae
aaccacauugugugaccagcca

SEQ ID NO: 3234378 - RNA, 16 nt, Mycobacterium leprae
aaccacugcgcccuga

SEQ ID NO: 3234379 - RNA, 15 nt, Mycobacterium leprae
aaccacuuagcguga

SEQ ID NO: 3234380 - RNA, 22 nt, Mycobacterium leprae
aaccacuugcaguacaaugucu

SEQ ID NO: 3234381 - RNA, 22 nt, Mycobacterium leprae
aaccagacccacagcugcgcau

SEQ ID NO: 3234382 - RNA, 13 nt, Mycobacterium leprae
aaccagcgugcaa

SEQ ID NO: 3234383 - RNA, 12 nt, Mycobacterium leprae
aaccaucaacgg

SEQ ID NO: 3234384 - RNA, 17 nt, Mycobacterium leprae
aaccaucccaaaaccac

SEQ ID NO: 3234385 - RNA, 22 nt, Mycobacterium leprae
aacccacuucggcacagugccu

SEQ ID NO: 3234386 - RNA, 21 nt, Mycobacterium leprae
aacccagacgcgaccgccacc

SEQ ID NO: 3234387 - RNA, 22 nt, Mycobacterium leprae
aacccauauucgucaaaaaacu

SEQ ID NO: 3234388 - RNA, 23 nt, Mycobacterium leprae
aaccccacacugagaaaggcaga

SEQ ID NO: 3234389 - RNA, 21 nt, Mycobacterium leprae
aacccgcaaaccaaacaacaa

SEQ ID NO: 3234390 - RNA, 23 nt, Mycobacterium leprae
aacccgugucgaccgacugcaga

SEQ ID NO: 3234391 - RNA, 20 nt, Mycobacterium leprae
aacccguugucaagcacugc

SEQ ID NO: 3234392 - RNA, 12 nt, Mycobacterium leprae
aaccgaagauca

SEQ ID NO: 3234393 - RNA, 20 nt, Mycobacterium leprae
aaccgaccucuuggauuucg

SEQ ID NO: 3234394 - RNA, 19 nt, Mycobacterium leprae
aaccgauacgccagucagu

SEQ ID NO: 3234395 - RNA, 20 nt, Mycobacterium leprae
aaccgcaguacuggugcugu

SEQ ID NO: 3234396 - RNA, 15 nt, Mycobacterium leprae
aaccgccuuugacga

SEQ ID NO: 3234397 - RNA, 18 nt, Mycobacterium leprae
aaccgcgugugcacuccu

SEQ ID NO: 3234398 - RNA, 15 nt, Mycobacterium leprae
aaccgcugugacagc

SEQ ID NO: 3234399 - RNA, 19 nt, Mycobacterium leprae
aaccgggaaauacggcacg

SEQ ID NO: 3234400 - RNA, 16 nt, Mycobacterium leprae
aaccgggccaacuccu

SEQ ID NO: 3234401 - RNA, 17 nt, Mycobacterium leprae
aaccggugauugccgcg

SEQ ID NO: 3234402 - RNA, 21 nt, Mycobacterium leprae
aaccguaguguuuuaccagcc

SEQ ID NO: 3234403 - RNA, 11 nt, Mycobacterium leprae
aaccguucgac

SEQ ID NO: 3234404 - RNA, 19 nt, Mycobacterium leprae
aaccuccacggucaugguc

SEQ ID NO: 3234405 - RNA, 16 nt, Mycobacterium leprae
aaccucggccgaggcg

SEQ ID NO: 3234406 - RNA, 20 nt, Mycobacterium leprae
aaccucguuacgauccaugc

SEQ ID NO: 3234407 - RNA, 16 nt, Mycobacterium leprae
aaccugaucuuggaga

SEQ ID NO: 3234408 - RNA, 16 nt, Mycobacterium leprae
aaccugggcggcauga

SEQ ID NO: 3234409 - RNA, 14 nt, Mycobacterium leprae
aaccuuacagucac

SEQ ID NO: 3234410 - RNA, 17 nt, Mycobacterium leprae
aaccuugguugccgcgg

SEQ ID NO: 3234411 - RNA, 16 nt, Mycobacterium leprae
aaccuuugucgccagu

SEQ ID NO: 3234412 - RNA, 17 nt, Mycobacterium leprae
aacgaagaguaucacaa

SEQ ID NO: 3234413 - RNA, 19 nt, Mycobacterium leprae
aacgaagggaaugcgucag

SEQ ID NO: 3234414 - RNA, 22 nt, Mycobacterium leprae
aacgaauaacugccaaucagca

SEQ ID NO: 3234415 - RNA, 19 nt, Mycobacterium leprae
aacgacaugacauauugua

SEQ ID NO: 3234416 - RNA, 23 nt, Mycobacterium leprae
aacgaccuggugacgucguaaac

SEQ ID NO: 3234417 - RNA, 18 nt, Mycobacterium leprae
aacgacuugaccagccgc

SEQ ID NO: 3234418 - RNA, 22 nt, Mycobacterium leprae
aacgcaccggcguuccggccuc

SEQ ID NO: 3234419 - RNA, 11 nt, Mycobacterium leprae
aacgccaggcg

SEQ ID NO: 3234420 - RNA, 14 nt, Mycobacterium leprae
aacgccaggcgccg

SEQ ID NO: 3234421 - RNA, 18 nt, Mycobacterium leprae
aacgccccuaccccgcgg

SEQ ID NO: 3234422 - RNA, 18 nt, Mycobacterium leprae
aacgccgccuuuacgaag

SEQ ID NO: 3234423 - RNA, 13 nt, Mycobacterium leprae
aacgccggccggu

SEQ ID NO: 3234424 - RNA, 19 nt, Mycobacterium leprae
aacgcgaccuguuggugag

SEQ ID NO: 3234425 - RNA, 17 nt, Mycobacterium leprae
aacgcgaugcgcaccuc

SEQ ID NO: 3234426 - RNA, 11 nt, Mycobacterium leprae
aacgcgcaccu

SEQ ID NO: 3234427 - RNA, 23 nt, Mycobacterium leprae
aacgcugaaaccgggguacaaua

SEQ ID NO: 3234428 - RNA, 16 nt, Mycobacterium leprae
aacgcugaccagcaga

SEQ ID NO: 3234429 - RNA, 16 nt, Mycobacterium leprae
aacgcuggucggaugg

SEQ ID NO: 3234430 - RNA, 14 nt, Mycobacterium leprae
aacgcuucugccuc

SEQ ID NO: 3234431 - RNA, 23 nt, Mycobacterium leprae
aacggaaauggguuuggugggca

SEQ ID NO: 3234432 - RNA, 19 nt, Mycobacterium leprae
aacggaauaaucacagccu

SEQ ID NO: 3234433 - RNA, 13 nt, Mycobacterium leprae
aacggaauacagc

SEQ ID NO: 3234434 - RNA, 23 nt, Mycobacterium leprae
aacggccuguucgggcgcccggu

SEQ ID NO: 3234435 - RNA, 15 nt, Mycobacterium leprae
aacggcggcaagguc

SEQ ID NO: 3234436 - RNA, 17 nt, Mycobacterium leprae
aacggcgucgaauuccg

SEQ ID NO: 3234437 - RNA, 21 nt, Mycobacterium leprae
aacggcugcgugucgacccgu

SEQ ID NO: 3234438 - RNA, 21 nt, Mycobacterium leprae
aacgguaucuccccagguuga

SEQ ID NO: 3234439 - RNA, 21 nt, Mycobacterium leprae
aacgucacgucgacggcggcc

SEQ ID NO: 3234440 - RNA, 15 nt, Mycobacterium leprae
aacgucaucguccuc

SEQ ID NO: 3234441 - RNA, 19 nt, Mycobacterium leprae
aacgucgaucucgacgcga

SEQ ID NO: 3234442 - RNA, 16 nt, Mycobacterium leprae
aacgugcagcuggccg

SEQ ID NO: 3234443 - RNA, 12 nt, Mycobacterium leprae
aacgugcugcug

SEQ ID NO: 3234444 - RNA, 15 nt, Mycobacterium leprae
aacguguaaggccag

SEQ ID NO: 3234445 - RNA, 20 nt, Mycobacterium leprae
aacguuuauuccuaaugaau

SEQ ID NO: 3234446 - RNA, 13 nt, Mycobacterium leprae
aacuacggggcua

SEQ ID NO: 3234447 - RNA, 17 nt, Mycobacterium leprae
aacuacuggauuaauau

SEQ ID NO: 3234448 - RNA, 20 nt, Mycobacterium leprae
aacuacuggauuaauauuua

SEQ ID NO: 3234449 - RNA, 21 nt, Mycobacterium leprae
aacuacuggauuaauauuuag

SEQ ID NO: 3234450 - RNA, 23 nt, Mycobacterium leprae
aacuacuguugucaguggcgaca

SEQ ID NO: 3234451 - RNA, 18 nt, Mycobacterium leprae
aacuagccgaagcggccg

SEQ ID NO: 3234452 - RNA, 22 nt, Mycobacterium leprae
aacuagucgcccggaauuuacc

SEQ ID NO: 3234453 - RNA, 17 nt, Mycobacterium leprae
aacuauccucacacuca

SEQ ID NO: 3234454 - RNA, 14 nt, Mycobacterium leprae
aacucaucggcucc

SEQ ID NO: 3234455 - RNA, 16 nt, Mycobacterium leprae
aacuccagagccgcgc

SEQ ID NO: 3234456 - RNA, 15 nt, Mycobacterium leprae
aacucgaacaucccu

SEQ ID NO: 3234457 - RNA, 18 nt, Mycobacterium leprae
aacugaagauuuggcgag

SEQ ID NO: 3234458 - RNA, 22 nt, Mycobacterium leprae
aacugacauauuugggagccag

SEQ ID NO: 3234459 - RNA, 21 nt, Mycobacterium leprae
aacugacuucagucagcaugg

SEQ ID NO: 3234460 - RNA, 18 nt, Mycobacterium leprae
aacugagcgcguuaggca

SEQ ID NO: 3234461 - RNA, 24 nt, Mycobacterium leprae
aacugaggcgggucagcggcucga

SEQ ID NO: 3234462 - RNA, 14 nt, Mycobacterium leprae
aacugcacuauaag

SEQ ID NO: 3234463 - RNA, 11 nt, Mycobacterium leprae
aacugcagguu

SEQ ID NO: 3234464 - RNA, 17 nt, Mycobacterium leprae
aacugccggcaaccagc

SEQ ID NO: 3234465 - RNA, 18 nt, Mycobacterium leprae
aacuggaguacuggcggc

SEQ ID NO: 3234466 - RNA, 17 nt, Mycobacterium leprae
aacuggaucggucagcc

SEQ ID NO: 3234467 - RNA, 14 nt, Mycobacterium leprae
aacugggugaccac

SEQ ID NO: 3234468 - RNA, 14 nt, Mycobacterium leprae
aacugguugaagcg

SEQ ID NO: 3234469 - RNA, 19 nt, Mycobacterium leprae
aacuuaguuuagagugcag

SEQ ID NO: 3234470 - RNA, 19 nt, Mycobacterium leprae
aacuucagcacuggcauua

SEQ ID NO: 3234471 - RNA, 22 nt, Mycobacterium leprae
aacuucccgacggugaaucagu

SEQ ID NO: 3234472 - RNA, 17 nt, Mycobacterium leprae
aacuugacgaugcugug

SEQ ID NO: 3234473 - RNA, 14 nt, Mycobacterium leprae
aacuugauuucaag

SEQ ID NO: 3234474 - RNA, 14 nt, Mycobacterium leprae
aacuuggcacaaca

SEQ ID NO: 3234475 - RNA, 14 nt, Mycobacterium leprae
aagaaaaggaccca

SEQ ID NO: 3234476 - RNA, 22 nt, Mycobacterium leprae
aagaacguuucgucaguaguuu

SEQ ID NO: 3234477 - RNA, 19 nt, Mycobacterium leprae
aagaaucaugaagaucgag

SEQ ID NO: 3234478 - RNA, 13 nt, Mycobacterium leprae
aagacacgacagc

SEQ ID NO: 3234479 - RNA, 14 nt, Mycobacterium leprae
aagacacgacagcc

SEQ ID NO: 3234480 - RNA, 21 nt, Mycobacterium leprae
aagacauuguccgucgcagca

SEQ ID NO: 3234481 - RNA, 18 nt, Mycobacterium leprae
aagaccgaguugggccau

SEQ ID NO: 3234482 - RNA, 20 nt, Mycobacterium leprae
aagacgagaucagugcaaua

SEQ ID NO: 3234483 - RNA, 17 nt, Mycobacterium leprae
aagacucaccaagauug

SEQ ID NO: 3234484 - RNA, 19 nt, Mycobacterium leprae
aagagaaguagagaaaaau

SEQ ID NO: 3234485 - RNA, 15 nt, Mycobacterium leprae
aagagcccggccccc

SEQ ID NO: 3234486 - RNA, 19 nt, Mycobacterium leprae
aagagccgcggguuucccg

SEQ ID NO: 3234487 - RNA, 15 nt, Mycobacterium leprae
aagagcuggucguuu

SEQ ID NO: 3234488 - RNA, 14 nt, Mycobacterium leprae
aagauaaauaguau

SEQ ID NO: 3234489 - RNA, 16 nt, Mycobacterium leprae
aagauacuccgcgaaa

SEQ ID NO: 3234490 - RNA, 17 nt, Mycobacterium leprae
aagauacuggauucauu

SEQ ID NO: 3234491 - RNA, 20 nt, Mycobacterium leprae
aagaucauguuccgcugaua

SEQ ID NO: 3234492 - RNA, 14 nt, Mycobacterium leprae
aagauccggugguc

SEQ ID NO: 3234493 - RNA, 17 nt, Mycobacterium leprae
aagaugacaccgaacag

SEQ ID NO: 3234494 - RNA, 22 nt, Mycobacterium leprae
aagaugcagguguccuauaaaa

SEQ ID NO: 3234495 - RNA, 21 nt, Mycobacterium leprae
aagaugcugcguucagcgaag

SEQ ID NO: 3234496 - RNA, 17 nt, Mycobacterium leprae
aagauguuccggcgacc

SEQ ID NO: 3234497 - RNA, 20 nt, Mycobacterium leprae
aagauguuccggcgaccagc

SEQ ID NO: 3234498 - RNA, 22 nt, Mycobacterium leprae
aagauugcagcccugagcacca

SEQ ID NO: 3234499 - RNA, 16 nt, Mycobacterium leprae
aagcaaaguccucgaa

SEQ ID NO: 3234500 - RNA, 22 nt, Mycobacterium leprae
aagcaccagcaguggucggcga

SEQ ID NO: 3234501 - RNA, 12 nt, Mycobacterium leprae
aagcacugcacg

SEQ ID NO: 3234502 - RNA, 21 nt, Mycobacterium leprae
aagcagccaaugcugcagcug

SEQ ID NO: 3234503 - RNA, 22 nt, Mycobacterium leprae
aagcaguuccuguguugccauc

SEQ ID NO: 3234504 - RNA, 19 nt, Mycobacterium leprae
aagcauaugggacaacucg

SEQ ID NO: 3234505 - RNA, 21 nt, Mycobacterium leprae
aagcaucuuaacgccaguugc

SEQ ID NO: 3234506 - RNA, 22 nt, Mycobacterium leprae
aagccacauccgagcaggucau

SEQ ID NO: 3234507 - RNA, 17 nt, Mycobacterium leprae
aagccgccgaacaagcc

SEQ ID NO: 3234508 - RNA, 15 nt, Mycobacterium leprae
aagccgcgcaucugc

SEQ ID NO: 3234509 - RNA, 20 nt, Mycobacterium leprae
aagccgcuacucgucaagau

SEQ ID NO: 3234510 - RNA, 12 nt, Mycobacterium leprae
aagccgggaccu

SEQ ID NO: 3234511 - RNA, 17 nt, Mycobacterium leprae
aagccggugccaggcag

SEQ ID NO: 3234512 - RNA, 20 nt, Mycobacterium leprae
aagccgugacucaacauaac

SEQ ID NO: 3234513 - RNA, 14 nt, Mycobacterium leprae
aagccguuggcuug

SEQ ID NO: 3234514 - RNA, 20 nt, Mycobacterium leprae
aagccucgaaccgauccagc

SEQ ID NO: 3234515 - RNA, 14 nt, Mycobacterium leprae
aagccugagaccau

SEQ ID NO: 3234516 - RNA, 23 nt, Mycobacterium leprae
aagccuggucgcguaguuccacc

SEQ ID NO: 3234517 - RNA, 21 nt, Mycobacterium leprae
aagcgcagaugauccggugcc

SEQ ID NO: 3234518 - RNA, 14 nt, Mycobacterium leprae
aagcgcccgcgcau

SEQ ID NO: 3234519 - RNA, 15 nt, Mycobacterium leprae
aagcgcuaugccauc

SEQ ID NO: 3234520 - RNA, 16 nt, Mycobacterium leprae
aagcgggugccgcguc

SEQ ID NO: 3234521 - RNA, 15 nt, Mycobacterium leprae
aagcuaucgguccau

SEQ ID NO: 3234522 - RNA, 15 nt, Mycobacterium leprae
aagcucaagcuugag

SEQ ID NO: 3234523 - RNA, 18 nt, Mycobacterium leprae
aagcucacugacaugucg

SEQ ID NO: 3234524 - RNA, 18 nt, Mycobacterium leprae
aagcucacugugucuuua

SEQ ID NO: 3234525 - RNA, 13 nt, Mycobacterium leprae
aagcugaaagcuu

SEQ ID NO: 3234526 - RNA, 19 nt, Mycobacterium leprae
aagcugagccgacaaucuc

SEQ ID NO: 3234527 - RNA, 18 nt, Mycobacterium leprae
aagcugaugacaguaagu

SEQ ID NO: 3234528 - RNA, 17 nt, Mycobacterium leprae
aagcugguggccccaau

SEQ ID NO: 3234529 - RNA, 19 nt, Mycobacterium leprae
aagcuguagcccggagugc

SEQ ID NO: 3234530 - RNA, 18 nt, Mycobacterium leprae
aagcuugaaguguuguuu

SEQ ID NO: 3234531 - RNA, 12 nt, Mycobacterium leprae
aaggaagaugac

SEQ ID NO: 3234532 - RNA, 17 nt, Mycobacterium leprae
aaggaagaugacaccga

SEQ ID NO: 3234533 - RNA, 23 nt, Mycobacterium leprae
aaggagccgaggcacaacaucac

SEQ ID NO: 3234534 - RNA, 21 nt, Mycobacterium leprae
aaggagcggugguacaauccc

SEQ ID NO: 3234535 - RNA, 19 nt, Mycobacterium leprae
aaggaguucaacaaaacca

SEQ ID NO: 3234536 - RNA, 20 nt, Mycobacterium leprae
aaggaguucaacaaaaccau

SEQ ID NO: 3234537 - RNA, 20 nt, Mycobacterium leprae
aaggaucgagcggagcuggg

SEQ ID NO: 3234538 - RNA, 17 nt, Mycobacterium leprae
aaggcaacgugggcgau

SEQ ID NO: 3234539 - RNA, 14 nt, Mycobacterium leprae
aaggccaagcggaa

SEQ ID NO: 3234540 - RNA, 21 nt, Mycobacterium leprae
aaggccgugucgguaggcugu

SEQ ID NO: 3234541 - RNA, 22 nt, Mycobacterium leprae
aaggccgugucgguaggcuguu

SEQ ID NO: 3234542 - RNA, 16 nt, Mycobacterium leprae
aaggcgauaucgaugc

SEQ ID NO: 3234543 - RNA, 21 nt, Mycobacterium leprae
aaggcgcgguaucucaauccg

SEQ ID NO: 3234544 - RNA, 16 nt, Mycobacterium leprae
aaggcggagaugugga

SEQ ID NO: 3234545 - RNA, 21 nt, Mycobacterium leprae
aaggcucagcgcugaucaacg

SEQ ID NO: 3234546 - RNA, 18 nt, Mycobacterium leprae
aaggcucccaaggaccgg

SEQ ID NO: 3234547 - RNA, 21 nt, Mycobacterium leprae
aaggcuguccuugccggcgcc

SEQ ID NO: 3234548 - RNA, 19 nt, Mycobacterium leprae
aagggacgacgugccgcag

SEQ ID NO: 3234549 - RNA, 18 nt, Mycobacterium leprae
aagggauuccacugccag

SEQ ID NO: 3234550 - RNA, 19 nt, Mycobacterium leprae
aagggcugguggccgaggu

SEQ ID NO: 3234551 - RNA, 13 nt, Mycobacterium leprae
aaggucaaggcug

SEQ ID NO: 3234552 - RNA, 13 nt, Mycobacterium leprae
aaggucaucuacc

SEQ ID NO: 3234553 - RNA, 15 nt, Mycobacterium leprae
aaggucgcgcugccg

SEQ ID NO: 3234554 - RNA, 17 nt, Mycobacterium leprae
aaggucguguugccacc

SEQ ID NO: 3234555 - RNA, 14 nt, Mycobacterium leprae
aaggugaugacccg

SEQ ID NO: 3234556 - RNA, 19 nt, Mycobacterium leprae
aaggugcguugugcgguga

SEQ ID NO: 3234557 - RNA, 19 nt, Mycobacterium leprae
aaggugggcgaucaggagg

SEQ ID NO: 3234558 - RNA, 16 nt, Mycobacterium leprae
aagguggugagcaccu

SEQ ID NO: 3234559 - RNA, 15 nt, Mycobacterium leprae
aagguuguugacgau

SEQ ID NO: 3234560 - RNA, 20 nt, Mycobacterium leprae
aagguuucugagucggauuu

SEQ ID NO: 3234561 - RNA, 23 nt, Mycobacterium leprae
aaguaacgucgaacccucacuca

SEQ ID NO: 3234562 - RNA, 14 nt, Mycobacterium leprae
aaguagacggcucc

SEQ ID NO: 3234563 - RNA, 14 nt, Mycobacterium leprae
aaguagagaaaaau

SEQ ID NO: 3234564 - RNA, 23 nt, Mycobacterium leprae
aaguagcaguguggcauccgcca

SEQ ID NO: 3234565 - RNA, 13 nt, Mycobacterium leprae
aaguaggcgaaga

SEQ ID NO: 3234566 - RNA, 14 nt, Mycobacterium leprae
aagucaagaugauc

SEQ ID NO: 3234567 - RNA, 22 nt, Mycobacterium leprae
aagucacuccgacgguguauaa

SEQ ID NO: 3234568 - RNA, 16 nt, Mycobacterium leprae
aagucagccaaaacuc

SEQ ID NO: 3234569 - RNA, 21 nt, Mycobacterium leprae
aaguccagcacgauggccggu

SEQ ID NO: 3234570 - RNA, 19 nt, Mycobacterium leprae
aagucgaggggacuggaua

SEQ ID NO: 3234571 - RNA, 22 nt, Mycobacterium leprae
aagucgaggggacuggauaugc

SEQ ID NO: 3234572 - RNA, 19 nt, Mycobacterium leprae
aagucggucgccgagcuga

SEQ ID NO: 3234573 - RNA, 14 nt, Mycobacterium leprae
aagucggugcuggc

SEQ ID NO: 3234574 - RNA, 16 nt, Mycobacterium leprae
aagucuucaauccgcg

SEQ ID NO: 3234575 - RNA, 24 nt, Mycobacterium leprae
aagucuugugcguagucgaccgga

SEQ ID NO: 3234576 - RNA, 12 nt, Mycobacterium leprae
aagugacugcgu

SEQ ID NO: 3234577 - RNA, 18 nt, Mycobacterium leprae
aagugacugcguuucaug

SEQ ID NO: 3234578 - RNA, 14 nt, Mycobacterium leprae
aagugaugucuuug

SEQ ID NO: 3234579 - RNA, 19 nt, Mycobacterium leprae
aagugcaccaucugcucuc

SEQ ID NO: 3234580 - RNA, 13 nt, Mycobacterium leprae
aagugcgccagcg

SEQ ID NO: 3234581 - RNA, 19 nt, Mycobacterium leprae
aaguguagucuugaacuca

SEQ ID NO: 3234582 - RNA, 19 nt, Mycobacterium leprae
aaguucggccauggcagcc

SEQ ID NO: 3234583 - RNA, 19 nt, Mycobacterium leprae
aaguuguaagugcaguucc

SEQ ID NO: 3234584 - RNA, 17 nt, Mycobacterium leprae
aaguuugagaacagccu

SEQ ID NO: 3234585 - RNA, 14 nt, Mycobacterium leprae
aaguuuucucuaaa

SEQ ID NO: 3234586 - RNA, 17 nt, Mycobacterium leprae
aauaaccagggccguca

SEQ ID NO: 3234587 - RNA, 18 nt, Mycobacterium leprae
aauaacugugcauaucaa

SEQ ID NO: 3234588 - RNA, 21 nt, Mycobacterium leprae
aauaagcucgugggcggcggc

SEQ ID NO: 3234589 - RNA, 16 nt, Mycobacterium leprae
aauaauauccaaagaa

SEQ ID NO: 3234590 - RNA, 20 nt, Mycobacterium leprae
aauacagagcguagaaacgc

SEQ ID NO: 3234591 - RNA, 19 nt, Mycobacterium leprae
aauacagguggcaucagau

SEQ ID NO: 3234592 - RNA, 16 nt, Mycobacterium leprae
aauaccuaucgacauc

SEQ ID NO: 3234593 - RNA, 18 nt, Mycobacterium leprae
aauaccuaucgacauccu

SEQ ID NO: 3234594 - RNA, 17 nt, Mycobacterium leprae
aauagagcagugcugac

SEQ ID NO: 3234595 - RNA, 17 nt, Mycobacterium leprae
aauagcugccaagcuga

SEQ ID NO: 3234596 - RNA, 14 nt, Mycobacterium leprae
aauaguaaguggcc

SEQ ID NO: 3234597 - RNA, 13 nt, Mycobacterium leprae
aauaguauuauug

SEQ ID NO: 3234598 - RNA, 19 nt, Mycobacterium leprae
aauaguggcugaugucuug

SEQ ID NO: 3234599 - RNA, 18 nt, Mycobacterium leprae
aauauacuugacugccga

SEQ ID NO: 3234600 - RNA, 16 nt, Mycobacterium leprae
aauaucaaugagauaa

SEQ ID NO: 3234601 - RNA, 18 nt, Mycobacterium leprae
aauauccaaagaaguuug

SEQ ID NO: 3234602 - RNA, 11 nt, Mycobacterium leprae
aaucaaugugc

SEQ ID NO: 3234603 - RNA, 14 nt, Mycobacterium leprae
aaucaccagcgacg

SEQ ID NO: 3234604 - RNA, 16 nt, Mycobacterium leprae
aaucaccguacgcauu

SEQ ID NO: 3234605 - RNA, 15 nt, Mycobacterium leprae
aaucagacugcccag

SEQ ID NO: 3234606 - RNA, 21 nt, Mycobacterium leprae
aaucagcaucgacagcaccca

SEQ ID NO: 3234607 - RNA, 22 nt, Mycobacterium leprae
aaucagcgucggacgccggacc

SEQ ID NO: 3234608 - RNA, 13 nt, Mycobacterium leprae
aaucaucgcugcc

SEQ ID NO: 3234609 - RNA, 23 nt, Mycobacterium leprae
aaucaucgcugccaucgacgccg

SEQ ID NO: 3234610 - RNA, 12 nt, Mycobacterium leprae
aauccagccgag

SEQ ID NO: 3234611 - RNA, 22 nt, Mycobacterium leprae
aaucccccaggucaacagcauc

SEQ ID NO: 3234612 - RNA, 11 nt, Mycobacterium leprae
aaucccgaaaa

SEQ ID NO: 3234613 - RNA, 23 nt, Mycobacterium leprae
aauccgcugcacgaaaagaaacg

SEQ ID NO: 3234614 - RNA, 14 nt, Mycobacterium leprae
aauccgcugcccug

SEQ ID NO: 3234615 - RNA, 18 nt, Mycobacterium leprae
aauccgggcgcucagcgg

SEQ ID NO: 3234616 - RNA, 12 nt, Mycobacterium leprae
aauccguucgau

SEQ ID NO: 3234617 - RNA, 17 nt, Mycobacterium leprae
aauccugagaugccagc

SEQ ID NO: 3234618 - RNA, 16 nt, Mycobacterium leprae
aauccuucauguccua

SEQ ID NO: 3234619 - RNA, 13 nt, Mycobacterium leprae
aaucgacgcagca

SEQ ID NO: 3234620 - RNA, 15 nt, Mycobacterium leprae
aaucgagcacggcac

SEQ ID NO: 3234621 - RNA, 16 nt, Mycobacterium leprae
aaucgagcacggcaca

SEQ ID NO: 3234622 - RNA, 13 nt, Mycobacterium leprae
aaucgauccggcg

SEQ ID NO: 3234623 - RNA, 23 nt, Mycobacterium leprae
aaucgauguuguagguugaugag

SEQ ID NO: 3234624 - RNA, 20 nt, Mycobacterium leprae
aaucgcaacccuuuugccca

SEQ ID NO: 3234625 - RNA, 18 nt, Mycobacterium leprae
aaucgcccgcaacaccgu

SEQ ID NO: 3234626 - RNA, 14 nt, Mycobacterium leprae
aaucgcggcacaug

SEQ ID NO: 3234627 - RNA, 17 nt, Mycobacterium leprae
aaucgcuagcgauucgg

SEQ ID NO: 3234628 - RNA, 14 nt, Mycobacterium leprae
aaucgguguugucc

SEQ ID NO: 3234629 - RNA, 16 nt, Mycobacterium leprae
aaucguaaaugccgaa

SEQ ID NO: 3234630 - RNA, 14 nt, Mycobacterium leprae
aaucguccagggug

SEQ ID NO: 3234631 - RNA, 16 nt, Mycobacterium leprae
aaucuaucaagccaca

SEQ ID NO: 3234632 - RNA, 19 nt, Mycobacterium leprae
aaucuccgagcguacuggu

SEQ ID NO: 3234633 - RNA, 18 nt, Mycobacterium leprae
aaucugcccugcacuuca

SEQ ID NO: 3234634 - RNA, 20 nt, Mycobacterium leprae
aaucugcgucaucgacucga

SEQ ID NO: 3234635 - RNA, 15 nt, Mycobacterium leprae
aaucugguuagcaac

SEQ ID NO: 3234636 - RNA, 20 nt, Mycobacterium leprae
aaugaccgcaccgaucugcc

SEQ ID NO: 3234637 - RNA, 19 nt, Mycobacterium leprae
aaugaucgcguugaccaaa

SEQ ID NO: 3234638 - RNA, 13 nt, Mycobacterium leprae
aaugcagcggcag

SEQ ID NO: 3234639 - RNA, 18 nt, Mycobacterium leprae
aaugcaggaggugcagac

SEQ ID NO: 3234640 - RNA, 14 nt, Mycobacterium leprae
aaugccgggcugca

SEQ ID NO: 3234641 - RNA, 18 nt, Mycobacterium leprae
aaugcgucccgagccugu

SEQ ID NO: 3234642 - RNA, 17 nt, Mycobacterium leprae
aaugcuaugauaauuug

SEQ ID NO: 3234643 - RNA, 19 nt, Mycobacterium leprae
aaugcucgaccagguugug

SEQ ID NO: 3234644 - RNA, 13 nt, Mycobacterium leprae
aaugcugagcgaa

SEQ ID NO: 3234645 - RNA, 16 nt, Mycobacterium leprae
aaugcugcagcuggga

SEQ ID NO: 3234646 - RNA, 21 nt, Mycobacterium leprae
aaugcugccugcgucaguaag

SEQ ID NO: 3234647 - RNA, 22 nt, Mycobacterium leprae
aaugcugccugcgucaguaagu

SEQ ID NO: 3234648 - RNA, 19 nt, Mycobacterium leprae
aaugucaauaacguuugcu

SEQ ID NO: 3234649 - RNA, 18 nt, Mycobacterium leprae
aauguccuugagcuaaca

SEQ ID NO: 3234650 - RNA, 13 nt, Mycobacterium leprae
aauguggccgcac

SEQ ID NO: 3234651 - RNA, 12 nt, Mycobacterium leprae
aauguugagugc

SEQ ID NO: 3234652 - RNA, 14 nt, Mycobacterium leprae
aauuaauauauaua

SEQ ID NO: 3234653 - RNA, 13 nt, Mycobacterium leprae
aauuauuccaauc

SEQ ID NO: 3234654 - RNA, 24 nt, Mycobacterium leprae
aauucacgaacaacagagcaagcc

SEQ ID NO: 3234655 - RNA, 16 nt, Mycobacterium leprae
aauuccgcuacaguaa

SEQ ID NO: 3234656 - RNA, 16 nt, Mycobacterium leprae
aauuccuacccucuca

SEQ ID NO: 3234657 - RNA, 19 nt, Mycobacterium leprae
aauucgggcucgacguuga

SEQ ID NO: 3234658 - RNA, 21 nt, Mycobacterium leprae
aauucuagagagguuuuccac

SEQ ID NO: 3234659 - RNA, 16 nt, Mycobacterium leprae
aauugaauccgcugcc

SEQ ID NO: 3234660 - RNA, 22 nt, Mycobacterium leprae
aauugaauccgcugcccugggu

SEQ ID NO: 3234661 - RNA, 14 nt, Mycobacterium leprae
aauugacgccgacc

SEQ ID NO: 3234662 - RNA, 12 nt, Mycobacterium leprae
aauugaucacaa

SEQ ID NO: 3234663 - RNA, 13 nt, Mycobacterium leprae
aauugaucacaaa

SEQ ID NO: 3234664 - RNA, 13 nt, Mycobacterium leprae
aauuggcagagca

SEQ ID NO: 3234665 - RNA, 14 nt, Mycobacterium leprae
aauugggaucgaca

SEQ ID NO: 3234666 - RNA, 16 nt, Mycobacterium leprae
aauuggguaaagugaa

SEQ ID NO: 3234667 - RNA, 13 nt, Mycobacterium leprae
aauuucggcgucg

SEQ ID NO: 3234668 - RNA, 20 nt, Mycobacterium leprae
acaaaaucucacgcccgacg

SEQ ID NO: 3234669 - RNA, 17 nt, Mycobacterium leprae
acaaacguuucgccgca

SEQ ID NO: 3234670 - RNA, 15 nt, Mycobacterium leprae
acaaagaaguaaagc

SEQ ID NO: 3234671 - RNA, 12 nt, Mycobacterium leprae
acaaagcagcau

SEQ ID NO: 3234672 - RNA, 21 nt, Mycobacterium leprae
acaaagcagcauauggaaagu

SEQ ID NO: 3234673 - RNA, 18 nt, Mycobacterium leprae
acaaagcuggcgaacaac

SEQ ID NO: 3234674 - RNA, 21 nt, Mycobacterium leprae
acaaagcuggcgaacaacaaa

SEQ ID NO: 3234675 - RNA, 13 nt, Mycobacterium leprae
acaaagucagcuu

SEQ ID NO: 3234676 - RNA, 18 nt, Mycobacterium leprae
acaaaucagcagcauugc

SEQ ID NO: 3234677 - RNA, 21 nt, Mycobacterium leprae
acaaauccguauaaccugcuu

SEQ ID NO: 3234678 - RNA, 17 nt, Mycobacterium leprae
acaacaaaaauagccgc

SEQ ID NO: 3234679 - RNA, 14 nt, Mycobacterium leprae
acaacaagcgacuu

SEQ ID NO: 3234680 - RNA, 14 nt, Mycobacterium leprae
acaacaccagauca

SEQ ID NO: 3234681 - RNA, 21 nt, Mycobacterium leprae
acaacauccaaccaauugcca

SEQ ID NO: 3234682 - RNA, 13 nt, Mycobacterium leprae
acaaccuuccgca

SEQ ID NO: 3234683 - RNA, 23 nt, Mycobacterium leprae
acaaccuuccgcaaaguuaugca

SEQ ID NO: 3234684 - RNA, 18 nt, Mycobacterium leprae
acaacgcaguuggccacu

SEQ ID NO: 3234685 - RNA, 19 nt, Mycobacterium leprae
acaacgccaaccuaagccu

SEQ ID NO: 3234686 - RNA, 12 nt, Mycobacterium leprae
acaacggaccac

SEQ ID NO: 3234687 - RNA, 15 nt, Mycobacterium leprae
acaacggugagcggc

SEQ ID NO: 3234688 - RNA, 18 nt, Mycobacterium leprae
acaacgucagaagcuggu

SEQ ID NO: 3234689 - RNA, 15 nt, Mycobacterium leprae
acaacguugcugcug

SEQ ID NO: 3234690 - RNA, 18 nt, Mycobacterium leprae
acaacuggaaguacuguc

SEQ ID NO: 3234691 - RNA, 17 nt, Mycobacterium leprae
acaacuggaguacuggc

SEQ ID NO: 3234692 - RNA, 16 nt, Mycobacterium leprae
acaacuucaaccaagc

SEQ ID NO: 3234693 - RNA, 17 nt, Mycobacterium leprae
acaagacuucacucacu

SEQ ID NO: 3234694 - RNA, 15 nt, Mycobacterium leprae
acaagagaagagcug

SEQ ID NO: 3234695 - RNA, 18 nt, Mycobacterium leprae
acaagauugcagcccuga

SEQ ID NO: 3234696 - RNA, 21 nt, Mycobacterium leprae
acaagccgagggucaaaaugu

SEQ ID NO: 3234697 - RNA, 16 nt, Mycobacterium leprae
acaaggaauugcugcg

SEQ ID NO: 3234698 - RNA, 18 nt, Mycobacterium leprae
acaaggguuagcagaaac

SEQ ID NO: 3234699 - RNA, 19 nt, Mycobacterium leprae
acaaggguuagcagaaaca

SEQ ID NO: 3234700 - RNA, 23 nt, Mycobacterium leprae
acaaguagguuguucgacaagcu

SEQ ID NO: 3234701 - RNA, 14 nt, Mycobacterium leprae
acaagucaaaacca

SEQ ID NO: 3234702 - RNA, 17 nt, Mycobacterium leprae
acaaguguuuccacacc

SEQ ID NO: 3234703 - RNA, 12 nt, Mycobacterium leprae
acaauaaacugg

SEQ ID NO: 3234704 - RNA, 20 nt, Mycobacterium leprae
acaaucagucgggccaggcc

SEQ ID NO: 3234705 - RNA, 17 nt, Mycobacterium leprae
acaaucgagcacggcac

SEQ ID NO: 3234706 - RNA, 19 nt, Mycobacterium leprae
acaauggagaacgcugaaa

SEQ ID NO: 3234707 - RNA, 18 nt, Mycobacterium leprae
acaaugggugugacacca

SEQ ID NO: 3234708 - RNA, 14 nt, Mycobacterium leprae
acaaugugucaggc

SEQ ID NO: 3234709 - RNA, 20 nt, Mycobacterium leprae
acaaugugucaggcugccaa

SEQ ID NO: 3234710 - RNA, 13 nt, Mycobacterium leprae
acaauucaacgaa

SEQ ID NO: 3234711 - RNA, 21 nt, Mycobacterium leprae
acacaaagaaguaaagcccug

SEQ ID NO: 3234712 - RNA, 19 nt, Mycobacterium leprae
acacagaacgguucaacgg

SEQ ID NO: 3234713 - RNA, 14 nt, Mycobacterium leprae
acacagccgucagg

SEQ ID NO: 3234714 - RNA, 20 nt, Mycobacterium leprae
acacagccguugcugcugcc

SEQ ID NO: 3234715 - RNA, 16 nt, Mycobacterium leprae
acacaugcaagucgaa

SEQ ID NO: 3234716 - RNA, 19 nt, Mycobacterium leprae
acaccaccaguggcucgcc

SEQ ID NO: 3234717 - RNA, 12 nt, Mycobacterium leprae
acaccacugcca

SEQ ID NO: 3234718 - RNA, 23 nt, Mycobacterium leprae
acaccacugccagcuauccccga

SEQ ID NO: 3234719 - RNA, 18 nt, Mycobacterium leprae
acaccagacguucuagaa

SEQ ID NO: 3234720 - RNA, 15 nt, Mycobacterium leprae
acaccagagacaccu

SEQ ID NO: 3234721 - RNA, 23 nt, Mycobacterium leprae
acaccagcgacuggcuguaguga

SEQ ID NO: 3234722 - RNA, 21 nt, Mycobacterium leprae
acaccauccacaacgucagaa

SEQ ID NO: 3234723 - RNA, 22 nt, Mycobacterium leprae
acacccaagugacugcguuuca

SEQ ID NO: 3234724 - RNA, 14 nt, Mycobacterium leprae
acaccccgcggagu

SEQ ID NO: 3234725 - RNA, 19 nt, Mycobacterium leprae
acacccgguagcgccgagc

SEQ ID NO: 3234726 - RNA, 22 nt, Mycobacterium leprae
acaccgcacaguuccagugccu

SEQ ID NO: 3234727 - RNA, 19 nt, Mycobacterium leprae
acaccguuagguugucggg

SEQ ID NO: 3234728 - RNA, 14 nt, Mycobacterium leprae
acaccuaauccggg

SEQ ID NO: 3234729 - RNA, 15 nt, Mycobacterium leprae
acaccucaccaucuu

SEQ ID NO: 3234730 - RNA, 16 nt, Mycobacterium leprae
acaccuuggugcccac

SEQ ID NO: 3234731 - RNA, 17 nt, Mycobacterium leprae
acacgaaauacaaugca

SEQ ID NO: 3234732 - RNA, 14 nt, Mycobacterium leprae
acacgacagccgca

SEQ ID NO: 3234733 - RNA, 15 nt, Mycobacterium leprae
acacgauacugcugc

SEQ ID NO: 3234734 - RNA, 16 nt, Mycobacterium leprae
acacgauuagcgcggc

SEQ ID NO: 3234735 - RNA, 20 nt, Mycobacterium leprae
acacgauuagcgcggcgcac

SEQ ID NO: 3234736 - RNA, 21 nt, Mycobacterium leprae
acacgcaagagaaaaccaagc

SEQ ID NO: 3234737 - RNA, 12 nt, Mycobacterium leprae
acacgccgcggc

SEQ ID NO: 3234738 - RNA, 13 nt, Mycobacterium leprae
acacggccgucgc

SEQ ID NO: 3234739 - RNA, 19 nt, Mycobacterium leprae
acacggcguggauggcuuc

SEQ ID NO: 3234740 - RNA, 13 nt, Mycobacterium leprae
acacggugccgaa

SEQ ID NO: 3234741 - RNA, 21 nt, Mycobacterium leprae
acacgucacacuaaacugcgu

SEQ ID NO: 3234742 - RNA, 21 nt, Mycobacterium leprae
acacgugcaucgagaacugca

SEQ ID NO: 3234743 - RNA, 22 nt, Mycobacterium leprae
acacguggguaaucugcccugc

SEQ ID NO: 3234744 - RNA, 15 nt, Mycobacterium leprae
acacguuucugcaug

SEQ ID NO: 3234745 - RNA, 14 nt, Mycobacterium leprae
acacuaaacugcgu

SEQ ID NO: 3234746 - RNA, 22 nt, Mycobacterium leprae
acacuacagcgugaaccaaagc

SEQ ID NO: 3234747 - RNA, 18 nt, Mycobacterium leprae
acacuacuccugcugacg

SEQ ID NO: 3234748 - RNA, 22 nt, Mycobacterium leprae
acacuagggaggucaccaaguu

SEQ ID NO: 3234749 - RNA, 21 nt, Mycobacterium leprae
acacucccgacgcggaaagcu

SEQ ID NO: 3234750 - RNA, 13 nt, Mycobacterium leprae
acacugcggcugc

SEQ ID NO: 3234751 - RNA, 14 nt, Mycobacterium leprae
acacuucgggcaag

SEQ ID NO: 3234752 - RNA, 20 nt, Mycobacterium leprae
acacuucuacgaaaaaugag

SEQ ID NO: 3234753 - RNA, 23 nt, Mycobacterium leprae
acagaaccuucaucggaggcgaa

SEQ ID NO: 3234754 - RNA, 21 nt, Mycobacterium leprae
acagaagugguuuuggcagua

SEQ ID NO: 3234755 - RNA, 22 nt, Mycobacterium leprae
acagaccucccugacgcacacc

SEQ ID NO: 3234756 - RNA, 16 nt, Mycobacterium leprae
acagagccggcauaga

SEQ ID NO: 3234757 - RNA, 19 nt, Mycobacterium leprae
acagagcugauggccgcca

SEQ ID NO: 3234758 - RNA, 19 nt, Mycobacterium leprae
acagaggcgcgccgugcca

SEQ ID NO: 3234759 - RNA, 20 nt, Mycobacterium leprae
acagagucaaauucaaccgg

SEQ ID NO: 3234760 - RNA, 22 nt, Mycobacterium leprae
acagagucaaauucaaccggaa

SEQ ID NO: 3234761 - RNA, 16 nt, Mycobacterium leprae
acagaugcgaucgcag

SEQ ID NO: 3234762 - RNA, 21 nt, Mycobacterium leprae
acagaugcgaucgcagucauc

SEQ ID NO: 3234763 - RNA, 21 nt, Mycobacterium leprae
acagcaagacgggggaugcuu

SEQ ID NO: 3234764 - RNA, 20 nt, Mycobacterium leprae
acagcaagauuacccgcggu

SEQ ID NO: 3234765 - RNA, 19 nt, Mycobacterium leprae
acagcaagucgccuacacc

SEQ ID NO: 3234766 - RNA, 18 nt, Mycobacterium leprae
acagcacccccggccagg

SEQ ID NO: 3234767 - RNA, 15 nt, Mycobacterium leprae
acagcacggcgcuca

SEQ ID NO: 3234768 - RNA, 21 nt, Mycobacterium leprae
acagcagagggcaauacgcug

SEQ ID NO: 3234769 - RNA, 17 nt, Mycobacterium leprae
acagcaggcgaguggcg

SEQ ID NO: 3234770 - RNA, 12 nt, Mycobacterium leprae
acagcaguguuc

SEQ ID NO: 3234771 - RNA, 19 nt, Mycobacterium leprae
acagcauccucggcacagu

SEQ ID NO: 3234772 - RNA, 22 nt, Mycobacterium leprae
acagcccaggugcccagccccu

SEQ ID NO: 3234773 - RNA, 18 nt, Mycobacterium leprae
acagcccaguaggcacca

SEQ ID NO: 3234774 - RNA, 16 nt, Mycobacterium leprae
acagccgucagggcag

SEQ ID NO: 3234775 - RNA, 18 nt, Mycobacterium leprae
acagccguugcugcugcc

SEQ ID NO: 3234776 - RNA, 20 nt, Mycobacterium leprae
acagccugccgauauaccug

SEQ ID NO: 3234777 - RNA, 23 nt, Mycobacterium leprae
acagccuugcaaaacgucgaucu

SEQ ID NO: 3234778 - RNA, 23 nt, Mycobacterium leprae
acagcgaugacauggaagccgcc

SEQ ID NO: 3234779 - RNA, 17 nt, Mycobacterium leprae
acagcgcagugugcuuu

SEQ ID NO: 3234780 - RNA, 21 nt, Mycobacterium leprae
acagcgcagugugcuuucggc

SEQ ID NO: 3234781 - RNA, 14 nt, Mycobacterium leprae
acagcgggcggggc

SEQ ID NO: 3234782 - RNA, 22 nt, Mycobacterium leprae
acagcgggcggggcgguggcag

SEQ ID NO: 3234783 - RNA, 22 nt, Mycobacterium leprae
acagcggucauuaucgagauug

SEQ ID NO: 3234784 - RNA, 16 nt, Mycobacterium leprae
acagcuaaccuccacg

SEQ ID NO: 3234785 - RNA, 22 nt, Mycobacterium leprae
acagcuacaccuuggccgccgg

SEQ ID NO: 3234786 - RNA, 14 nt, Mycobacterium leprae
acagcucgacagca

SEQ ID NO: 3234787 - RNA, 17 nt, Mycobacterium leprae
acagcuggcuugucggc

SEQ ID NO: 3234788 - RNA, 21 nt, Mycobacterium leprae
acagcuucggucuggcggagu

SEQ ID NO: 3234789 - RNA, 18 nt, Mycobacterium leprae
acagcuugacaucaguca

SEQ ID NO: 3234790 - RNA, 15 nt, Mycobacterium leprae
acaggaauugguggu

SEQ ID NO: 3234791 - RNA, 16 nt, Mycobacterium leprae
acaggaauuggugguc

SEQ ID NO: 3234792 - RNA, 15 nt, Mycobacterium leprae
acaggacccagcgau

SEQ ID NO: 3234793 - RNA, 19 nt, Mycobacterium leprae
acaggcauauaaucgcuuc

SEQ ID NO: 3234794 - RNA, 18 nt, Mycobacterium leprae
acaggcgcguuugucggc

SEQ ID NO: 3234795 - RNA, 16 nt, Mycobacterium leprae
acagguggcaucagau

SEQ ID NO: 3234796 - RNA, 18 nt, Mycobacterium leprae
acaguaucgaccagccac

SEQ ID NO: 3234797 - RNA, 15 nt, Mycobacterium leprae
acagucagccgcggg

SEQ ID NO: 3234798 - RNA, 14 nt, Mycobacterium leprae
acaguccaccgcca

SEQ ID NO: 3234799 - RNA, 22 nt, Mycobacterium leprae
acagugccacgguggccuuaau

SEQ ID NO: 3234800 - RNA, 22 nt, Mycobacterium leprae
acagugcgguuguacagcucuu

SEQ ID NO: 3234801 - RNA, 22 nt, Mycobacterium leprae
acaguggucugguuaucgauuu

SEQ ID NO: 3234802 - RNA, 15 nt, Mycobacterium leprae
acauaaccacauugu

SEQ ID NO: 3234803 - RNA, 22 nt, Mycobacterium leprae
acauagguagauaaacaucgag

SEQ ID NO: 3234804 - RNA, 13 nt, Mycobacterium leprae
acauaucaacaac

SEQ ID NO: 3234805 - RNA, 23 nt, Mycobacterium leprae
acauauuguacgacaaaauuuuc

SEQ ID NO: 3234806 - RNA, 20 nt, Mycobacterium leprae
acaucaccggcggugucggc

SEQ ID NO: 3234807 - RNA, 19 nt, Mycobacterium leprae
acaucaugaaaucccgcua

SEQ ID NO: 3234808 - RNA, 17 nt, Mycobacterium leprae
acauccaaccaauugcc

SEQ ID NO: 3234809 - RNA, 19 nt, Mycobacterium leprae
acauccucgguaucgucaa

SEQ ID NO: 3234810 - RNA, 20 nt, Mycobacterium leprae
acaucgaaucgaguggccgu

SEQ ID NO: 3234811 - RNA, 16 nt, Mycobacterium leprae
acaucgacccguuguu

SEQ ID NO: 3234812 - RNA, 21 nt, Mycobacterium leprae
acaucgauuuguaaaauuccu

SEQ ID NO: 3234813 - RNA, 14 nt, Mycobacterium leprae
acaucgccaccgac

SEQ ID NO: 3234814 - RNA, 15 nt, Mycobacterium leprae
acaucgccaccgacc

SEQ ID NO: 3234815 - RNA, 20 nt, Mycobacterium leprae
acaucgccaccgaccgccuu

SEQ ID NO: 3234816 - RNA, 20 nt, Mycobacterium leprae
acaucguggaccaagcaucc

SEQ ID NO: 3234817 - RNA, 15 nt, Mycobacterium leprae
acaugaacgucacug

SEQ ID NO: 3234818 - RNA, 17 nt, Mycobacterium leprae
acaugaagccguugggc

SEQ ID NO: 3234819 - RNA, 15 nt, Mycobacterium leprae
acaugacgccuggga

SEQ ID NO: 3234820 - RNA, 21 nt, Mycobacterium leprae
acaugaucaauaccacaauuu

SEQ ID NO: 3234821 - RNA, 17 nt, Mycobacterium leprae
acaugauugcagauguu

SEQ ID NO: 3234822 - RNA, 13 nt, Mycobacterium leprae
acaugcacacuaa

SEQ ID NO: 3234823 - RNA, 18 nt, Mycobacterium leprae
acaugcuuacgugcgccg

SEQ ID NO: 3234824 - RNA, 22 nt, Mycobacterium leprae
acauggacaaccugggcggcau

SEQ ID NO: 3234825 - RNA, 20 nt, Mycobacterium leprae
acauguacggaauaugcuug

SEQ ID NO: 3234826 - RNA, 16 nt, Mycobacterium leprae
acauguagaccaagca

SEQ ID NO: 3234827 - RNA, 15 nt, Mycobacterium leprae
acauucaggaugcug

SEQ ID NO: 3234828 - RNA, 16 nt, Mycobacterium leprae
acauucaggaugcugu

SEQ ID NO: 3234829 - RNA, 22 nt, Mycobacterium leprae
acauugaccacgccgacaccuc

SEQ ID NO: 3234830 - RNA, 16 nt, Mycobacterium leprae
acauuguucugccaug

SEQ ID NO: 3234831 - RNA, 21 nt, Mycobacterium leprae
acauuguucugccaugccagu

SEQ ID NO: 3234832 - RNA, 16 nt, Mycobacterium leprae
acauuucgacaggcug

SEQ ID NO: 3234833 - RNA, 23 nt, Mycobacterium leprae
acauuuuagcuuauacugcugcg

SEQ ID NO: 3234834 - RNA, 13 nt, Mycobacterium leprae
accaaacaacaac

SEQ ID NO: 3234835 - RNA, 16 nt, Mycobacterium leprae
accaaaucgacuacau

SEQ ID NO: 3234836 - RNA, 15 nt, Mycobacterium leprae
accaaccgcgcagca

SEQ ID NO: 3234837 - RNA, 14 nt, Mycobacterium leprae
accaaccuguagac

SEQ ID NO: 3234838 - RNA, 19 nt, Mycobacterium leprae
accaagaaguuaccgagcc

SEQ ID NO: 3234839 - RNA, 23 nt, Mycobacterium leprae
accaagauugcggacaauucaac

SEQ ID NO: 3234840 - RNA, 18 nt, Mycobacterium leprae
accaaggcucccaaggac

SEQ ID NO: 3234841 - RNA, 20 nt, Mycobacterium leprae
accacaaagucaucggcgca

SEQ ID NO: 3234842 - RNA, 12 nt, Mycobacterium leprae
accacacccugg

SEQ ID NO: 3234843 - RNA, 17 nt, Mycobacterium leprae
accacacccuggcuggg

SEQ ID NO: 3234844 - RNA, 15 nt, Mycobacterium leprae
accacacugugccug

SEQ ID NO: 3234845 - RNA, 20 nt, Mycobacterium leprae
accacauugugugaccagcc

SEQ ID NO: 3234846 - RNA, 15 nt, Mycobacterium leprae
accaccaccgccacc

SEQ ID NO: 3234847 - RNA, 13 nt, Mycobacterium leprae
accacccugcgcu

SEQ ID NO: 3234848 - RNA, 16 nt, Mycobacterium leprae
accaccgaaccgggca

SEQ ID NO: 3234849 - RNA, 18 nt, Mycobacterium leprae
accaccgcggugagcggu

SEQ ID NO: 3234850 - RNA, 18 nt, Mycobacterium leprae
accacgcaaugucgccgg

SEQ ID NO: 3234851 - RNA, 16 nt, Mycobacterium leprae
accacgcacacgacag

SEQ ID NO: 3234852 - RNA, 20 nt, Mycobacterium leprae
accacgcacacgacagccgc

SEQ ID NO: 3234853 - RNA, 16 nt, Mycobacterium leprae
accacgucgggcagca

SEQ ID NO: 3234854 - RNA, 21 nt, Mycobacterium leprae
accacgucgggcagcaaccgc

SEQ ID NO: 3234855 - RNA, 15 nt, Mycobacterium leprae
accacugaaccugcc

SEQ ID NO: 3234856 - RNA, 13 nt, Mycobacterium leprae
accacugacgggu

SEQ ID NO: 3234857 - RNA, 23 nt, Mycobacterium leprae
accacugcggugugugggucgcc

SEQ ID NO: 3234858 - RNA, 18 nt, Mycobacterium leprae
accacuuuggcaacgggu

SEQ ID NO: 3234859 - RNA, 15 nt, Mycobacterium leprae
accagaaguggucga

SEQ ID NO: 3234860 - RNA, 16 nt, Mycobacterium leprae
accagauggcuccccg

SEQ ID NO: 3234861 - RNA, 21 nt, Mycobacterium leprae
accagauuggaaaucgcucga

SEQ ID NO: 3234862 - RNA, 14 nt, Mycobacterium leprae
accagcaagggugg

SEQ ID NO: 3234863 - RNA, 13 nt, Mycobacterium leprae
accagcagugguc

SEQ ID NO: 3234864 - RNA, 17 nt, Mycobacterium leprae
accagccaagccgccag

SEQ ID NO: 3234865 - RNA, 11 nt, Mycobacterium leprae
accagccagac

SEQ ID NO: 3234866 - RNA, 14 nt, Mycobacterium leprae
accagccagaccaa

SEQ ID NO: 3234867 - RNA, 16 nt, Mycobacterium leprae
accagccgcaggcacc

SEQ ID NO: 3234868 - RNA, 23 nt, Mycobacterium leprae
accagcgacuggcuguagugaua

SEQ ID NO: 3234869 - RNA, 23 nt, Mycobacterium leprae
accagcgaucgacccaagcaucc

SEQ ID NO: 3234870 - RNA, 19 nt, Mycobacterium leprae
accagcgugcaaauggcac

SEQ ID NO: 3234871 - RNA, 17 nt, Mycobacterium leprae
accagcucacccgcagc

SEQ ID NO: 3234872 - RNA, 21 nt, Mycobacterium leprae
accagcucacccgcagcaccu

SEQ ID NO: 3234873 - RNA, 23 nt, Mycobacterium leprae
accagcucggcaucggccucacc

SEQ ID NO: 3234874 - RNA, 22 nt, Mycobacterium leprae
accagggaagugacgccacagu

SEQ ID NO: 3234875 - RNA, 15 nt, Mycobacterium leprae
accagggguguugca

SEQ ID NO: 3234876 - RNA, 18 nt, Mycobacterium leprae
accagggguguugcacca

SEQ ID NO: 3234877 - RNA, 19 nt, Mycobacterium leprae
accaguugcacaucagcaa

SEQ ID NO: 3234878 - RNA, 14 nt, Mycobacterium leprae
accauaaccgcaua

SEQ ID NO: 3234879 - RNA, 21 nt, Mycobacterium leprae
accauaguuacgacgucgccg

SEQ ID NO: 3234880 - RNA, 16 nt, Mycobacterium leprae
accaucagaaaaccgu

SEQ ID NO: 3234881 - RNA, 22 nt, Mycobacterium leprae
accauccggcgggcgugcuguc

SEQ ID NO: 3234882 - RNA, 20 nt, Mycobacterium leprae
accaucgaaacugccaaagu

SEQ ID NO: 3234883 - RNA, 18 nt, Mycobacterium leprae
accaucuaacccgcaaac

SEQ ID NO: 3234884 - RNA, 22 nt, Mycobacterium leprae
accaucuaacccgcaaaccaaa

SEQ ID NO: 3234885 - RNA, 13 nt, Mycobacterium leprae
accaucugcucuc

SEQ ID NO: 3234886 - RNA, 16 nt, Mycobacterium leprae
accaucugcucucagc

SEQ ID NO: 3234887 - RNA, 18 nt, Mycobacterium leprae
accaugagcacacgcugc

SEQ ID NO: 3234888 - RNA, 16 nt, Mycobacterium leprae
accaugccgcgcgccu

SEQ ID NO: 3234889 - RNA, 21 nt, Mycobacterium leprae
accaugcggcggacgaucgag

SEQ ID NO: 3234890 - RNA, 14 nt, Mycobacterium leprae
accauggaaucguu

SEQ ID NO: 3234891 - RNA, 23 nt, Mycobacterium leprae
accauggucuuaccgugcgcugc

SEQ ID NO: 3234892 - RNA, 14 nt, Mycobacterium leprae
accauuggcgacaa

SEQ ID NO: 3234893 - RNA, 18 nt, Mycobacterium leprae
accauuucugccgcuggu

SEQ ID NO: 3234894 - RNA, 16 nt, Mycobacterium leprae
acccaagcgccagcuc

SEQ ID NO: 3234895 - RNA, 19 nt, Mycobacterium leprae
acccaaggauucagccaag

SEQ ID NO: 3234896 - RNA, 15 nt, Mycobacterium leprae
acccaauagagcagu

SEQ ID NO: 3234897 - RNA, 23 nt, Mycobacterium leprae
acccacggcugucagagugcaga

SEQ ID NO: 3234898 - RNA, 19 nt, Mycobacterium leprae
acccacugggcaagcagug

SEQ ID NO: 3234899 - RNA, 22 nt, Mycobacterium leprae
acccacuucggcacagugccug

SEQ ID NO: 3234900 - RNA, 19 nt, Mycobacterium leprae
acccagacgcgaccgccac

SEQ ID NO: 3234901 - RNA, 20 nt, Mycobacterium leprae
acccagacgcgaccgccacc

SEQ ID NO: 3234902 - RNA, 23 nt, Mycobacterium leprae
acccagcucacaauugacaacac

SEQ ID NO: 3234903 - RNA, 16 nt, Mycobacterium leprae
acccaggguagcugac

SEQ ID NO: 3234904 - RNA, 18 nt, Mycobacterium leprae
acccaguucgugaugguc

SEQ ID NO: 3234905 - RNA, 16 nt, Mycobacterium leprae
accccaaccagaccca

SEQ ID NO: 3234906 - RNA, 20 nt, Mycobacterium leprae
accccagacgucaaccuuug

SEQ ID NO: 3234907 - RNA, 18 nt, Mycobacterium leprae
accccagucgagccaccu

SEQ ID NO: 3234908 - RNA, 22 nt, Mycobacterium leprae
accccgaguucucagucgcaag

SEQ ID NO: 3234909 - RNA, 14 nt, Mycobacterium leprae
accccggacggcca

SEQ ID NO: 3234910 - RNA, 18 nt, Mycobacterium leprae
accccgugccgucccuau

SEQ ID NO: 3234911 - RNA, 21 nt, Mycobacterium leprae
accccguucuguuaagcaucg

SEQ ID NO: 3234912 - RNA, 22 nt, Mycobacterium leprae
accccuacccaaaucagcacca

SEQ ID NO: 3234913 - RNA, 20 nt, Mycobacterium leprae
accccuagaaagacccccgg

SEQ ID NO: 3234914 - RNA, 15 nt, Mycobacterium leprae
acccgacacaaagcu

SEQ ID NO: 3234915 - RNA, 22 nt, Mycobacterium leprae
acccgaggcgcuaggacaacag

SEQ ID NO: 3234916 - RNA, 23 nt, Mycobacterium leprae
acccgaggcgcuaggacaacaga

SEQ ID NO: 3234917 - RNA, 20 nt, Mycobacterium leprae
acccgcaaaccaaacaacaa

SEQ ID NO: 3234918 - RNA, 21 nt, Mycobacterium leprae
acccgcagcaccuugggcgcc

SEQ ID NO: 3234919 - RNA, 16 nt, Mycobacterium leprae
acccgccagggcggca

SEQ ID NO: 3234920 - RNA, 23 nt, Mycobacterium leprae
acccgccagggcggcauucccaa

SEQ ID NO: 3234921 - RNA, 20 nt, Mycobacterium leprae
acccgccucguugcguaccg

SEQ ID NO: 3234922 - RNA, 18 nt, Mycobacterium leprae
acccgcgccgccugcugc

SEQ ID NO: 3234923 - RNA, 16 nt, Mycobacterium leprae
acccgcgcgugcacaa

SEQ ID NO: 3234924 - RNA, 17 nt, Mycobacterium leprae
acccgcgcgugcacaag

SEQ ID NO: 3234925 - RNA, 21 nt, Mycobacterium leprae
acccgcuggugcguggcgacc

SEQ ID NO: 3234926 - RNA, 15 nt, Mycobacterium leprae
acccgcuugucuuug

SEQ ID NO: 3234927 - RNA, 22 nt, Mycobacterium leprae
acccggcagaggcaccuggaau

SEQ ID NO: 3234928 - RNA, 18 nt, Mycobacterium leprae
acccggcagcauccgccg

SEQ ID NO: 3234929 - RNA, 20 nt, Mycobacterium leprae
acccggcagcauccgccgac

SEQ ID NO: 3234930 - RNA, 20 nt, Mycobacterium leprae
acccggccacaacgcggccu

SEQ ID NO: 3234931 - RNA, 17 nt, Mycobacterium leprae
acccggccagauccagc

SEQ ID NO: 3234932 - RNA, 14 nt, Mycobacterium leprae
acccggccgucgcu

SEQ ID NO: 3234933 - RNA, 14 nt, Mycobacterium leprae
acccgggagucgac

SEQ ID NO: 3234934 - RNA, 15 nt, Mycobacterium leprae
acccgggagucgaca

SEQ ID NO: 3234935 - RNA, 17 nt, Mycobacterium leprae
acccgucccgcagcgca

SEQ ID NO: 3234936 - RNA, 20 nt, Mycobacterium leprae
acccgucgaugaucuaaccg

SEQ ID NO: 3234937 - RNA, 19 nt, Mycobacterium leprae
acccgugcccaagacucag

SEQ ID NO: 3234938 - RNA, 16 nt, Mycobacterium leprae
acccguggucagccua

SEQ ID NO: 3234939 - RNA, 19 nt, Mycobacterium leprae
acccguggucagccuagca

SEQ ID NO: 3234940 - RNA, 15 nt, Mycobacterium leprae
acccguugagcugca

SEQ ID NO: 3234941 - RNA, 17 nt, Mycobacterium leprae
acccguuggaucucgcc

SEQ ID NO: 3234942 - RNA, 22 nt, Mycobacterium leprae
acccguugucaagcacugcagu

SEQ ID NO: 3234943 - RNA, 14 nt, Mycobacterium leprae
acccuagagucgac

SEQ ID NO: 3234944 - RNA, 17 nt, Mycobacterium leprae
acccuccucgcggcggu

SEQ ID NO: 3234945 - RNA, 15 nt, Mycobacterium leprae
acccuccugcagguu

SEQ ID NO: 3234946 - RNA, 21 nt, Mycobacterium leprae
acccuccugcagguugcuguc

SEQ ID NO: 3234947 - RNA, 23 nt, Mycobacterium leprae
acccugcgcugagagugccaccg

SEQ ID NO: 3234948 - RNA, 14 nt, Mycobacterium leprae
acccuugagcaccc

SEQ ID NO: 3234949 - RNA, 21 nt, Mycobacterium leprae
acccuuggcgucgguggcggu

SEQ ID NO: 3234950 - RNA, 17 nt, Mycobacterium leprae
accgaaagccgcaccag

SEQ ID NO: 3234951 - RNA, 19 nt, Mycobacterium leprae
accgaaaucaaagcccgca

SEQ ID NO: 3234952 - RNA, 15 nt, Mycobacterium leprae
accgaacccagacgc

SEQ ID NO: 3234953 - RNA, 13 nt, Mycobacterium leprae
accgaccaaccgu

SEQ ID NO: 3234954 - RNA, 17 nt, Mycobacterium leprae
accgaccaaccguagug

SEQ ID NO: 3234955 - RNA, 13 nt, Mycobacterium leprae
accgaccagagcu

SEQ ID NO: 3234956 - RNA, 12 nt, Mycobacterium leprae
accgaccucuug

SEQ ID NO: 3234957 - RNA, 20 nt, Mycobacterium leprae
accgacggaugcccagccag

SEQ ID NO: 3234958 - RNA, 21 nt, Mycobacterium leprae
accgacggaugcccagccagg

SEQ ID NO: 3234959 - RNA, 16 nt, Mycobacterium leprae
accgacggcgccgcac

SEQ ID NO: 3234960 - RNA, 23 nt, Mycobacterium leprae
accgacuucaacggucgcucgga

SEQ ID NO: 3234961 - RNA, 16 nt, Mycobacterium leprae
accgacuuggccgcaa

SEQ ID NO: 3234962 - RNA, 19 nt, Mycobacterium leprae
accgagaucgacgcugcgc

SEQ ID NO: 3234963 - RNA, 23 nt, Mycobacterium leprae
accgagaucuuaaucgagccacu

SEQ ID NO: 3234964 - RNA, 17 nt, Mycobacterium leprae
accgagauuaucgcauc

SEQ ID NO: 3234965 - RNA, 23 nt, Mycobacterium leprae
accgagcucuggucugguccggc

SEQ ID NO: 3234966 - RNA, 19 nt, Mycobacterium leprae
accgauagaccgcuacaac

SEQ ID NO: 3234967 - RNA, 15 nt, Mycobacterium leprae
accgauauccggccu

SEQ ID NO: 3234968 - RNA, 15 nt, Mycobacterium leprae
accgauccggcggcc

SEQ ID NO: 3234969 - RNA, 21 nt, Mycobacterium leprae
accgauccggcggccggcaag

SEQ ID NO: 3234970 - RNA, 22 nt, Mycobacterium leprae
accgaucgugaagauaggucgc

SEQ ID NO: 3234971 - RNA, 14 nt, Mycobacterium leprae
accgaugcagggcc

SEQ ID NO: 3234972 - RNA, 21 nt, Mycobacterium leprae
accgaugcagggccagcccgc

SEQ ID NO: 3234973 - RNA, 19 nt, Mycobacterium leprae
accgaugcucgcccucgga

SEQ ID NO: 3234974 - RNA, 20 nt, Mycobacterium leprae
accgaugcucgcccucggac

SEQ ID NO: 3234975 - RNA, 15 nt, Mycobacterium leprae
accgcaacugguuga

SEQ ID NO: 3234976 - RNA, 18 nt, Mycobacterium leprae
accgcacagagcccagca

SEQ ID NO: 3234977 - RNA, 16 nt, Mycobacterium leprae
accgcagccggagggu

SEQ ID NO: 3234978 - RNA, 18 nt, Mycobacterium leprae
accgcauccggcgccagc

SEQ ID NO: 3234979 - RNA, 19 nt, Mycobacterium leprae
accgccaccuaggccugcu

SEQ ID NO: 3234980 - RNA, 17 nt, Mycobacterium leprae
accgcccgguaucccaa

SEQ ID NO: 3234981 - RNA, 16 nt, Mycobacterium leprae
accgccgaagcagcca

SEQ ID NO: 3234982 - RNA, 23 nt, Mycobacterium leprae
accgccgacgaaugcagcagcca

SEQ ID NO: 3234983 - RNA, 16 nt, Mycobacterium leprae
accgccgagcgcacca

SEQ ID NO: 3234984 - RNA, 20 nt, Mycobacterium leprae
accgccgccauccuugccga

SEQ ID NO: 3234985 - RNA, 15 nt, Mycobacterium leprae
accgccggucgggga

SEQ ID NO: 3234986 - RNA, 14 nt, Mycobacterium leprae
accgccuugucggc

SEQ ID NO: 3234987 - RNA, 16 nt, Mycobacterium leprae
accgccuugucggcaa

SEQ ID NO: 3234988 - RNA, 16 nt, Mycobacterium leprae
accgcgacgccaggcg

SEQ ID NO: 3234989 - RNA, 15 nt, Mycobacterium leprae
accgcggaucgcagu

SEQ ID NO: 3234990 - RNA, 13 nt, Mycobacterium leprae
accgcggauucca

SEQ ID NO: 3234991 - RNA, 14 nt, Mycobacterium leprae
accgcguaacagau

SEQ ID NO: 3234992 - RNA, 14 nt, Mycobacterium leprae
accgcgucggcguc

SEQ ID NO: 3234993 - RNA, 23 nt, Mycobacterium leprae
accgcucgauggccagccguccc

SEQ ID NO: 3234994 - RNA, 16 nt, Mycobacterium leprae
accgcugacacuguca

SEQ ID NO: 3234995 - RNA, 22 nt, Mycobacterium leprae
accgcugggugugucaucauca

SEQ ID NO: 3234996 - RNA, 22 nt, Mycobacterium leprae
accggaauguccaccagccgca

SEQ ID NO: 3234997 - RNA, 24 nt, Mycobacterium leprae
accggaauguccaccagccgcagg

SEQ ID NO: 3234998 - RNA, 17 nt, Mycobacterium leprae
accggaauuccgacgaa

SEQ ID NO: 3234999 - RNA, 20 nt, Mycobacterium leprae
accggaauuccgacgaaggu

SEQ ID NO: 3235000 - RNA, 21 nt, Mycobacterium leprae
accggacagcacccccggcca

SEQ ID NO: 3235001 - RNA, 16 nt, Mycobacterium leprae
accggauacagagcca

SEQ ID NO: 3235002 - RNA, 20 nt, Mycobacterium leprae
accggaucgacggcagcgcu

SEQ ID NO: 3235003 - RNA, 15 nt, Mycobacterium leprae
accggauggcugcaa

SEQ ID NO: 3235004 - RNA, 15 nt, Mycobacterium leprae
accggcauggccgcu

SEQ ID NO: 3235005 - RNA, 19 nt, Mycobacterium leprae
accggccaaaagccuugcg

SEQ ID NO: 3235006 - RNA, 16 nt, Mycobacterium leprae
accggccaaccacagc

SEQ ID NO: 3235007 - RNA, 17 nt, Mycobacterium leprae
accggccaaccacagca

SEQ ID NO: 3235008 - RNA, 19 nt, Mycobacterium leprae
accggccaaccacagcaau

SEQ ID NO: 3235009 - RNA, 15 nt, Mycobacterium leprae
accggccagugcaac

SEQ ID NO: 3235010 - RNA, 16 nt, Mycobacterium leprae
accggcccgaauucau

SEQ ID NO: 3235011 - RNA, 23 nt, Mycobacterium leprae
accggccguaaucaagaucggcc

SEQ ID NO: 3235012 - RNA, 16 nt, Mycobacterium leprae
accggcgaucuugccc

SEQ ID NO: 3235013 - RNA, 20 nt, Mycobacterium leprae
accggcgcuuguaaggccag

SEQ ID NO: 3235014 - RNA, 21 nt, Mycobacterium leprae
accggcggugucggcuaccaa

SEQ ID NO: 3235015 - RNA, 13 nt, Mycobacterium leprae
accggcguucgau

SEQ ID NO: 3235016 - RNA, 22 nt, Mycobacterium leprae
accggcguuuccaaaacccacu

SEQ ID NO: 3235017 - RNA, 15 nt, Mycobacterium leprae
accggcugaggcggc

SEQ ID NO: 3235018 - RNA, 10 nt, Mycobacterium leprae
accggcugcg

SEQ ID NO: 3235019 - RNA, 17 nt, Mycobacterium leprae
accgggaaauacggcac

SEQ ID NO: 3235020 - RNA, 21 nt, Mycobacterium leprae
accgggcagcgccacgccgga

SEQ ID NO: 3235021 - RNA, 17 nt, Mycobacterium leprae
accgggccggccgcgga

SEQ ID NO: 3235022 - RNA, 19 nt, Mycobacterium leprae
accgggcgcccgaacaggc

SEQ ID NO: 3235023 - RNA, 13 nt, Mycobacterium leprae
accgguagcgugg

SEQ ID NO: 3235024 - RNA, 18 nt, Mycobacterium leprae
accggugaugucggcguc

SEQ ID NO: 3235025 - RNA, 18 nt, Mycobacterium leprae
accggugcugcagccacg

SEQ ID NO: 3235026 - RNA, 17 nt, Mycobacterium leprae
accgguuuaccgcaugu

SEQ ID NO: 3235027 - RNA, 23 nt, Mycobacterium leprae
accguacugaacgagaagcagcu

SEQ ID NO: 3235028 - RNA, 22 nt, Mycobacterium leprae
accguaguguuuuaccagccag

SEQ ID NO: 3235029 - RNA, 23 nt, Mycobacterium leprae
accguaguguuuuaccagccaga

SEQ ID NO: 3235030 - RNA, 13 nt, Mycobacterium leprae
accguauauuaac

SEQ ID NO: 3235031 - RNA, 22 nt, Mycobacterium leprae
accguauauuaacgguauauua

SEQ ID NO: 3235032 - RNA, 19 nt, Mycobacterium leprae
accgucgaagugcgccagc

SEQ ID NO: 3235033 - RNA, 21 nt, Mycobacterium leprae
accgucgggaucgcucgucac

SEQ ID NO: 3235034 - RNA, 20 nt, Mycobacterium leprae
accgucgggccugaguggug

SEQ ID NO: 3235035 - RNA, 11 nt, Mycobacterium leprae
accgugcagcu

SEQ ID NO: 3235036 - RNA, 21 nt, Mycobacterium leprae
accgugcagcugccaaccggu

SEQ ID NO: 3235037 - RNA, 22 nt, Mycobacterium leprae
accgugcagcugccaaccggug

SEQ ID NO: 3235038 - RNA, 13 nt, Mycobacterium leprae
accgugcugaugc

SEQ ID NO: 3235039 - RNA, 15 nt, Mycobacterium leprae
accgugguugcugag

SEQ ID NO: 3235040 - RNA, 14 nt, Mycobacterium leprae
accguguagugcac

SEQ ID NO: 3235041 - RNA, 16 nt, Mycobacterium leprae
accguuaacacggugc

SEQ ID NO: 3235042 - RNA, 15 nt, Mycobacterium leprae
accguucguuugggu

SEQ ID NO: 3235043 - RNA, 16 nt, Mycobacterium leprae
accguucguuuggguu

SEQ ID NO: 3235044 - RNA, 14 nt, Mycobacterium leprae
accguugcgucgcu

SEQ ID NO: 3235045 - RNA, 12 nt, Mycobacterium leprae
accuacaugucg

SEQ ID NO: 3235046 - RNA, 12 nt, Mycobacterium leprae
accuaccgcauc

SEQ ID NO: 3235047 - RNA, 16 nt, Mycobacterium leprae
accuagauuaggugug

SEQ ID NO: 3235048 - RNA, 16 nt, Mycobacterium leprae
accuaggccugcugaa

SEQ ID NO: 3235049 - RNA, 23 nt, Mycobacterium leprae
accuaguugguugccaagauacu

SEQ ID NO: 3235050 - RNA, 14 nt, Mycobacterium leprae
accuauacuggaua

SEQ ID NO: 3235051 - RNA, 22 nt, Mycobacterium leprae
accucaccaucuuugacauccg

SEQ ID NO: 3235052 - RNA, 23 nt, Mycobacterium leprae
accucacgaauccuacauccacg

SEQ ID NO: 3235053 - RNA, 18 nt, Mycobacterium leprae
accucacgauuucggcuc

SEQ ID NO: 3235054 - RNA, 14 nt, Mycobacterium leprae
accucagcaacuuc

SEQ ID NO: 3235055 - RNA, 22 nt, Mycobacterium leprae
accucauauuuagcgaccggcc

SEQ ID NO: 3235056 - RNA, 16 nt, Mycobacterium leprae
accuccacggucaugg

SEQ ID NO: 3235057 - RNA, 14 nt, Mycobacterium leprae
accuccagccgcgg

SEQ ID NO: 3235058 - RNA, 15 nt, Mycobacterium leprae
accuccagccgcggg

SEQ ID NO: 3235059 - RNA, 15 nt, Mycobacterium leprae
accuccgcagcaucg

SEQ ID NO: 3235060 - RNA, 22 nt, Mycobacterium leprae
accuccguugucccgcccggcc

SEQ ID NO: 3235061 - RNA, 17 nt, Mycobacterium leprae
accuccuugaccaccac

SEQ ID NO: 3235062 - RNA, 18 nt, Mycobacterium leprae
accucgaacuuguucuuu

SEQ ID NO: 3235063 - RNA, 21 nt, Mycobacterium leprae
accucgccaacgguaucuccc

SEQ ID NO: 3235064 - RNA, 18 nt, Mycobacterium leprae
accucuucagacuggaug

SEQ ID NO: 3235065 - RNA, 14 nt, Mycobacterium leprae
accugaccguugcg

SEQ ID NO: 3235066 - RNA, 16 nt, Mycobacterium leprae
accugcaacgcugcaa

SEQ ID NO: 3235067 - RNA, 18 nt, Mycobacterium leprae
accugcauggacgauauc

SEQ ID NO: 3235068 - RNA, 15 nt, Mycobacterium leprae
accugccuagcaacg

SEQ ID NO: 3235069 - RNA, 16 nt, Mycobacterium leprae
accugcgacgucccaa

SEQ ID NO: 3235070 - RNA, 17 nt, Mycobacterium leprae
accuggaggccaacccu

SEQ ID NO: 3235071 - RNA, 13 nt, Mycobacterium leprae
accugggcggcau

SEQ ID NO: 3235072 - RNA, 22 nt, Mycobacterium leprae
accugguccgucgaguggcuug

SEQ ID NO: 3235073 - RNA, 19 nt, Mycobacterium leprae
accuggugugcgcgccgcc

SEQ ID NO: 3235074 - RNA, 17 nt, Mycobacterium leprae
accuguguaucagugcu

SEQ ID NO: 3235075 - RNA, 19 nt, Mycobacterium leprae
accuuacaaagaucaagau

SEQ ID NO: 3235076 - RNA, 15 nt, Mycobacterium leprae
accuuacagucacua

SEQ ID NO: 3235077 - RNA, 16 nt, Mycobacterium leprae
accuucuaaccgguca

SEQ ID NO: 3235078 - RNA, 21 nt, Mycobacterium leprae
accuugccgcguauaccggcu

SEQ ID NO: 3235079 - RNA, 14 nt, Mycobacterium leprae
accuuggccgccgg

SEQ ID NO: 3235080 - RNA, 16 nt, Mycobacterium leprae
accuugggcgccucgu

SEQ ID NO: 3235081 - RNA, 16 nt, Mycobacterium leprae
accuuguugcagccug

SEQ ID NO: 3235082 - RNA, 20 nt, Mycobacterium leprae
accuuguugcagccuggugu

SEQ ID NO: 3235083 - RNA, 15 nt, Mycobacterium leprae
accuuugcccugcgc

SEQ ID NO: 3235084 - RNA, 15 nt, Mycobacterium leprae
acgaagaugaugccu

SEQ ID NO: 3235085 - RNA, 13 nt, Mycobacterium leprae
acgaagccucauc

SEQ ID NO: 3235086 - RNA, 23 nt, Mycobacterium leprae
acgaagccucaucgaaagcaggc

SEQ ID NO: 3235087 - RNA, 22 nt, Mycobacterium leprae
acgaaggggucgaugaggcucg

SEQ ID NO: 3235088 - RNA, 20 nt, Mycobacterium leprae
acgaaucccgcuaagacgag

SEQ ID NO: 3235089 - RNA, 15 nt, Mycobacterium leprae
acgaaucgcauucgu

SEQ ID NO: 3235090 - RNA, 14 nt, Mycobacterium leprae
acgaaugcugacca

SEQ ID NO: 3235091 - RNA, 15 nt, Mycobacterium leprae
acgaaugcugaccau

SEQ ID NO: 3235092 - RNA, 21 nt, Mycobacterium leprae
acgacaaaauuuucaggcugu

SEQ ID NO: 3235093 - RNA, 21 nt, Mycobacterium leprae
acgacagccgcaaucgccgac

SEQ ID NO: 3235094 - RNA, 16 nt, Mycobacterium leprae
acgacaucuugaccug

SEQ ID NO: 3235095 - RNA, 13 nt, Mycobacterium leprae
acgaccaaaccuc

SEQ ID NO: 3235096 - RNA, 22 nt, Mycobacterium leprae
acgaccaaaccucugcaaccga

SEQ ID NO: 3235097 - RNA, 16 nt, Mycobacterium leprae
acgaccggcugcaccu

SEQ ID NO: 3235098 - RNA, 22 nt, Mycobacterium leprae
acgaccgucuggaacacgaucg

SEQ ID NO: 3235099 - RNA, 18 nt, Mycobacterium leprae
acgacgaguagugauuau

SEQ ID NO: 3235100 - RNA, 11 nt, Mycobacterium leprae
acgacgcauag

SEQ ID NO: 3235101 - RNA, 15 nt, Mycobacterium leprae
acgacgccacagcgg

SEQ ID NO: 3235102 - RNA, 16 nt, Mycobacterium leprae
acgacggugcggcugg

SEQ ID NO: 3235103 - RNA, 22 nt, Mycobacterium leprae
acgacguagaacaagugcaaug

SEQ ID NO: 3235104 - RNA, 13 nt, Mycobacterium leprae
acgacguagccca

SEQ ID NO: 3235105 - RNA, 14 nt, Mycobacterium leprae
acgacguagcccac

SEQ ID NO: 3235106 - RNA, 22 nt, Mycobacterium leprae
acgacgucaaggggacugcgaa

SEQ ID NO: 3235107 - RNA, 23 nt, Mycobacterium leprae
acgacguuaucuugaugcugugu

SEQ ID NO: 3235108 - RNA, 13 nt, Mycobacterium leprae
acgacuugaccag

SEQ ID NO: 3235109 - RNA, 21 nt, Mycobacterium leprae
acgacuugaccagccgcagca

SEQ ID NO: 3235110 - RNA, 14 nt, Mycobacterium leprae
acgagaaugucgca

SEQ ID NO: 3235111 - RNA, 15 nt, Mycobacterium leprae
acgagaaugucgcac

SEQ ID NO: 3235112 - RNA, 14 nt, Mycobacterium leprae
acgagacacugacg

SEQ ID NO: 3235113 - RNA, 13 nt, Mycobacterium leprae
acgagaccagggg

SEQ ID NO: 3235114 - RNA, 14 nt, Mycobacterium leprae
acgagugguugagu

SEQ ID NO: 3235115 - RNA, 15 nt, Mycobacterium leprae
acgauacugcugcac

SEQ ID NO: 3235116 - RNA, 18 nt, Mycobacterium leprae
acgauccacuugacgguc

SEQ ID NO: 3235117 - RNA, 21 nt, Mycobacterium leprae
acgauccggaaaagucgugga

SEQ ID NO: 3235118 - RNA, 18 nt, Mycobacterium leprae
acgaucuaucugacgacu

SEQ ID NO: 3235119 - RNA, 22 nt, Mycobacterium leprae
acgaugaucuuggcccggcucc

SEQ ID NO: 3235120 - RNA, 22 nt, Mycobacterium leprae
acgaugcgugccccggccgccg

SEQ ID NO: 3235121 - RNA, 17 nt, Mycobacterium leprae
acgaugcuugaugucgu

SEQ ID NO: 3235122 - RNA, 17 nt, Mycobacterium leprae
acgaugugcagcagcuc

SEQ ID NO: 3235123 - RNA, 20 nt, Mycobacterium leprae
acgauuacgcacgccuugca

SEQ ID NO: 3235124 - RNA, 16 nt, Mycobacterium leprae
acgauuagcaugacgu

SEQ ID NO: 3235125 - RNA, 19 nt, Mycobacterium leprae
acgauuggcuuaaugaucg

SEQ ID NO: 3235126 - RNA, 13 nt, Mycobacterium leprae
acgauuuugcaac

SEQ ID NO: 3235127 - RNA, 18 nt, Mycobacterium leprae
acgcaaccaaggcuccca

SEQ ID NO: 3235128 - RNA, 20 nt, Mycobacterium leprae
acgcaacgagguaagacaag

SEQ ID NO: 3235129 - RNA, 19 nt, Mycobacterium leprae
acgcaagagaaaaccaagc

SEQ ID NO: 3235130 - RNA, 13 nt, Mycobacterium leprae
acgcaaguucgac

SEQ ID NO: 3235131 - RNA, 16 nt, Mycobacterium leprae
acgcacacgacagccg

SEQ ID NO: 3235132 - RNA, 21 nt, Mycobacterium leprae
acgcaccggcguuccggccuc

SEQ ID NO: 3235133 - RNA, 22 nt, Mycobacterium leprae
acgcagcgcgaacaagaaaagg

SEQ ID NO: 3235134 - RNA, 15 nt, Mycobacterium leprae
acgcaguuggccacu

SEQ ID NO: 3235135 - RNA, 12 nt, Mycobacterium leprae
acgcaugacacc

SEQ ID NO: 3235136 - RNA, 19 nt, Mycobacterium leprae
acgcaugacacccccggga

SEQ ID NO: 3235137 - RNA, 19 nt, Mycobacterium leprae
acgcauuugaagcgguuga

SEQ ID NO: 3235138 - RNA, 14 nt, Mycobacterium leprae
acgccaaacagauc

SEQ ID NO: 3235139 - RNA, 17 nt, Mycobacterium leprae
acgccccuaccccgcgg

SEQ ID NO: 3235140 - RNA, 15 nt, Mycobacterium leprae
acgccgacaccucaa

SEQ ID NO: 3235141 - RNA, 14 nt, Mycobacterium leprae
acgccgauaucgac

SEQ ID NO: 3235142 - RNA, 16 nt, Mycobacterium leprae
acgccgauaucgacca

SEQ ID NO: 3235143 - RNA, 20 nt, Mycobacterium leprae
acgccgauaucgaccagcca

SEQ ID NO: 3235144 - RNA, 22 nt, Mycobacterium leprae
acgccgauaucgaccagccaag

SEQ ID NO: 3235145 - RNA, 22 nt, Mycobacterium leprae
acgccgaucgugccccucgaag

SEQ ID NO: 3235146 - RNA, 22 nt, Mycobacterium leprae
acgccgcggcugggcagccgag

SEQ ID NO: 3235147 - RNA, 23 nt, Mycobacterium leprae
acgccgcggcugggcagccgagg

SEQ ID NO: 3235148 - RNA, 22 nt, Mycobacterium leprae
acgccgggcacuugggucaccg

SEQ ID NO: 3235149 - RNA, 16 nt, Mycobacterium leprae
acgccguagcgcacca

SEQ ID NO: 3235150 - RNA, 17 nt, Mycobacterium leprae
acgccuccacugcuccu

SEQ ID NO: 3235151 - RNA, 18 nt, Mycobacterium leprae
acgccuccacugcuccug

SEQ ID NO: 3235152 - RNA, 22 nt, Mycobacterium leprae
acgccucugccagggguuccaa

SEQ ID NO: 3235153 - RNA, 15 nt, Mycobacterium leprae
acgccugggaaccca

SEQ ID NO: 3235154 - RNA, 17 nt, Mycobacterium leprae
acgcgaacgugcugcug

SEQ ID NO: 3235155 - RNA, 18 nt, Mycobacterium leprae
acgcgacagcugcgguuc

SEQ ID NO: 3235156 - RNA, 13 nt, Mycobacterium leprae
acgcgaccgccac

SEQ ID NO: 3235157 - RNA, 17 nt, Mycobacterium leprae
acgcgaccgccaccaga

SEQ ID NO: 3235158 - RNA, 15 nt, Mycobacterium leprae
acgcgacgccgccau

SEQ ID NO: 3235159 - RNA, 16 nt, Mycobacterium leprae
acgcgaucgccgaaau

SEQ ID NO: 3235160 - RNA, 13 nt, Mycobacterium leprae
acgcgaugcgcac

SEQ ID NO: 3235161 - RNA, 19 nt, Mycobacterium leprae
acgcggaaagcuucugguc

SEQ ID NO: 3235162 - RNA, 22 nt, Mycobacterium leprae
acgcggaaagcuucugguccgu

SEQ ID NO: 3235163 - RNA, 13 nt, Mycobacterium leprae
acgcggcggcggc

SEQ ID NO: 3235164 - RNA, 15 nt, Mycobacterium leprae
acgcggcggcggcca

SEQ ID NO: 3235165 - RNA, 14 nt, Mycobacterium leprae
acgcuaaucgcggg

SEQ ID NO: 3235166 - RNA, 21 nt, Mycobacterium leprae
acgcuagaaacaggcauauaa

SEQ ID NO: 3235167 - RNA, 16 nt, Mycobacterium leprae
acgcuaguguggucga

SEQ ID NO: 3235168 - RNA, 21 nt, Mycobacterium leprae
acgcuauguuggccagcagcg

SEQ ID NO: 3235169 - RNA, 17 nt, Mycobacterium leprae
acgcucaacuguucggc

SEQ ID NO: 3235170 - RNA, 15 nt, Mycobacterium leprae
acgcucaaucggguu

SEQ ID NO: 3235171 - RNA, 22 nt, Mycobacterium leprae
acgcucgaggaagcgcagcucg

SEQ ID NO: 3235172 - RNA, 23 nt, Mycobacterium leprae
acgcucggugagauagcggcggu

SEQ ID NO: 3235173 - RNA, 16 nt, Mycobacterium leprae
acgcugaaaccggggu

SEQ ID NO: 3235174 - RNA, 15 nt, Mycobacterium leprae
acgcugaaccgcguc

SEQ ID NO: 3235175 - RNA, 15 nt, Mycobacterium leprae
acgcugaccagcaga

SEQ ID NO: 3235176 - RNA, 18 nt, Mycobacterium leprae
acgcugauaaggucuggc

SEQ ID NO: 3235177 - RNA, 15 nt, Mycobacterium leprae
acgcugaucgcugau

SEQ ID NO: 3235178 - RNA, 19 nt, Mycobacterium leprae
acgcugcacauucaaccag

SEQ ID NO: 3235179 - RNA, 16 nt, Mycobacterium leprae
acgcugcgcggcugcg

SEQ ID NO: 3235180 - RNA, 20 nt, Mycobacterium leprae
acgcugcgcuucuggcuggg

SEQ ID NO: 3235181 - RNA, 11 nt, Mycobacterium leprae
acgcugcuugc

SEQ ID NO: 3235182 - RNA, 13 nt, Mycobacterium leprae
acgcuggccgccg

SEQ ID NO: 3235183 - RNA, 18 nt, Mycobacterium leprae
acggacgauggugugcag

SEQ ID NO: 3235184 - RNA, 18 nt, Mycobacterium leprae
acggauaaguccacaccu

SEQ ID NO: 3235185 - RNA, 19 nt, Mycobacterium leprae
acggauuucucgugguggc

SEQ ID NO: 3235186 - RNA, 23 nt, Mycobacterium leprae
acggauuucucgugguggcuggc

SEQ ID NO: 3235187 - RNA, 20 nt, Mycobacterium leprae
acggcaaccuucuagcgcag

SEQ ID NO: 3235188 - RNA, 21 nt, Mycobacterium leprae
acggcaaccuucuagcgcaga

SEQ ID NO: 3235189 - RNA, 19 nt, Mycobacterium leprae
acggcaacggcaccaaacc

SEQ ID NO: 3235190 - RNA, 21 nt, Mycobacterium leprae
acggcaccaaacccgccgguc

SEQ ID NO: 3235191 - RNA, 14 nt, Mycobacterium leprae
acggcacgccgaac

SEQ ID NO: 3235192 - RNA, 17 nt, Mycobacterium leprae
acggcagguggaucguc

SEQ ID NO: 3235193 - RNA, 20 nt, Mycobacterium leprae
acggcagguggaucgucggc

SEQ ID NO: 3235194 - RNA, 24 nt, Mycobacterium leprae
acggcagguggaucgucggccgga

SEQ ID NO: 3235195 - RNA, 15 nt, Mycobacterium leprae
acggcccagcaccac

SEQ ID NO: 3235196 - RNA, 20 nt, Mycobacterium leprae
acggcccagcaccacugcgg

SEQ ID NO: 3235197 - RNA, 15 nt, Mycobacterium leprae
acggccggaucaucg

SEQ ID NO: 3235198 - RNA, 16 nt, Mycobacterium leprae
acggcgaccgacuggc

SEQ ID NO: 3235199 - RNA, 17 nt, Mycobacterium leprae
acggcgcggcugcuugu

SEQ ID NO: 3235200 - RNA, 14 nt, Mycobacterium leprae
acggcggccgccac

SEQ ID NO: 3235201 - RNA, 16 nt, Mycobacterium leprae
acggcgggugaugauc

SEQ ID NO: 3235202 - RNA, 20 nt, Mycobacterium leprae
acggcgguguuucucgccga

SEQ ID NO: 3235203 - RNA, 22 nt, Mycobacterium leprae
acggcgguguuucucgccgacc

SEQ ID NO: 3235204 - RNA, 15 nt, Mycobacterium leprae
acggcguggucggcg

SEQ ID NO: 3235205 - RNA, 17 nt, Mycobacterium leprae
acggcugcguuggcauc

SEQ ID NO: 3235206 - RNA, 16 nt, Mycobacterium leprae
acggcuucaucagugu

SEQ ID NO: 3235207 - RNA, 16 nt, Mycobacterium leprae
acggcuuugcugucga

SEQ ID NO: 3235208 - RNA, 12 nt, Mycobacterium leprae
acgggcaccuuu

SEQ ID NO: 3235209 - RNA, 16 nt, Mycobacterium leprae
acgggccgcucgacca

SEQ ID NO: 3235210 - RNA, 13 nt, Mycobacterium leprae
acgggcucacggg

SEQ ID NO: 3235211 - RNA, 17 nt, Mycobacterium leprae
acggggucgucggccag

SEQ ID NO: 3235212 - RNA, 19 nt, Mycobacterium leprae
acggggucgucggccaggc

SEQ ID NO: 3235213 - RNA, 20 nt, Mycobacterium leprae
acggggucgucggccaggcu

SEQ ID NO: 3235214 - RNA, 21 nt, Mycobacterium leprae
acggggucgucggccaggcuc

SEQ ID NO: 3235215 - RNA, 12 nt, Mycobacterium leprae
acggggugggca

SEQ ID NO: 3235216 - RNA, 15 nt, Mycobacterium leprae
acgggugucugaacu

SEQ ID NO: 3235217 - RNA, 22 nt, Mycobacterium leprae
acggguuaccugaccgaaccga

SEQ ID NO: 3235218 - RNA, 20 nt, Mycobacterium leprae
acgguaaguuuucagccaca

SEQ ID NO: 3235219 - RNA, 21 nt, Mycobacterium leprae
acgguaauaaggcgucaagca

SEQ ID NO: 3235220 - RNA, 21 nt, Mycobacterium leprae
acgguauuugcugucguggcu

SEQ ID NO: 3235221 - RNA, 17 nt, Mycobacterium leprae
acggucaacggccucac

SEQ ID NO: 3235222 - RNA, 14 nt, Mycobacterium leprae
acggugcaccagcu

SEQ ID NO: 3235223 - RNA, 18 nt, Mycobacterium leprae
acggugccgaacugcugc

SEQ ID NO: 3235224 - RNA, 20 nt, Mycobacterium leprae
acggugccgaauucgcccga

SEQ ID NO: 3235225 - RNA, 21 nt, Mycobacterium leprae
acggugccgaauucgcccgag

SEQ ID NO: 3235226 - RNA, 16 nt, Mycobacterium leprae
acgguggcaccagugu

SEQ ID NO: 3235227 - RNA, 21 nt, Mycobacterium leprae
acgguguauaauuugaagcug

SEQ ID NO: 3235228 - RNA, 18 nt, Mycobacterium leprae
acgguguugcugaguguu

SEQ ID NO: 3235229 - RNA, 18 nt, Mycobacterium leprae
acgguucuuugcacgggg

SEQ ID NO: 3235230 - RNA, 17 nt, Mycobacterium leprae
acgguuuuguccugugg

SEQ ID NO: 3235231 - RNA, 14 nt, Mycobacterium leprae
acguaccaccgcgg

SEQ ID NO: 3235232 - RNA, 23 nt, Mycobacterium leprae
acguaguccaugaauuacuaccc

SEQ ID NO: 3235233 - RNA, 17 nt, Mycobacterium leprae
acgucacacuaaacugc

SEQ ID NO: 3235234 - RNA, 15 nt, Mycobacterium leprae
acgucacgcugcucg

SEQ ID NO: 3235235 - RNA, 18 nt, Mycobacterium leprae
acgucacgcugcucgagc

SEQ ID NO: 3235236 - RNA, 19 nt, Mycobacterium leprae
acgucagaagcugguggcc

SEQ ID NO: 3235237 - RNA, 23 nt, Mycobacterium leprae
acgucaucgacagaugcgaucgc

SEQ ID NO: 3235238 - RNA, 21 nt, Mycobacterium leprae
acguccacauaauagcgcggu

SEQ ID NO: 3235239 - RNA, 22 nt, Mycobacterium leprae
acguccaguaugucgucaaugg

SEQ ID NO: 3235240 - RNA, 21 nt, Mycobacterium leprae
acguccaucuuguuggccggu

SEQ ID NO: 3235241 - RNA, 18 nt, Mycobacterium leprae
acguccgcggcagcugcu

SEQ ID NO: 3235242 - RNA, 16 nt, Mycobacterium leprae
acgucgccgguagcag

SEQ ID NO: 3235243 - RNA, 20 nt, Mycobacterium leprae
acgucgccgguagcagcggu

SEQ ID NO: 3235244 - RNA, 22 nt, Mycobacterium leprae
acgucggccgaucauggcugga

SEQ ID NO: 3235245 - RNA, 17 nt, Mycobacterium leprae
acgucgguguggugcuc

SEQ ID NO: 3235246 - RNA, 15 nt, Mycobacterium leprae
acgucuagcgaacac

SEQ ID NO: 3235247 - RNA, 22 nt, Mycobacterium leprae
acgucuagcgaacacacagguc

SEQ ID NO: 3235248 - RNA, 17 nt, Mycobacterium leprae
acgucuuuauuagcaug

SEQ ID NO: 3235249 - RNA, 19 nt, Mycobacterium leprae
acgucuuuauuagcaugug

SEQ ID NO: 3235250 - RNA, 19 nt, Mycobacterium leprae
acgugacguacgggugaag

SEQ ID NO: 3235251 - RNA, 21 nt, Mycobacterium leprae
acgugacugcggcucaccgac

SEQ ID NO: 3235252 - RNA, 22 nt, Mycobacterium leprae
acgugacugcggcucaccgacu

SEQ ID NO: 3235253 - RNA, 16 nt, Mycobacterium leprae
acgugcaaacugcugc

SEQ ID NO: 3235254 - RNA, 17 nt, Mycobacterium leprae
acgugcagcuggccgca

SEQ ID NO: 3235255 - RNA, 16 nt, Mycobacterium leprae
acgugccaacucggcc

SEQ ID NO: 3235256 - RNA, 15 nt, Mycobacterium leprae
acgugccgugaucag

SEQ ID NO: 3235257 - RNA, 15 nt, Mycobacterium leprae
acgugcgaguucucc

SEQ ID NO: 3235258 - RNA, 13 nt, Mycobacterium leprae
acgugcgccgcgc

SEQ ID NO: 3235259 - RNA, 14 nt, Mycobacterium leprae
acgugcgccgcgcu

SEQ ID NO: 3235260 - RNA, 23 nt, Mycobacterium leprae
acgugcggcggccuuggcagccg

SEQ ID NO: 3235261 - RNA, 17 nt, Mycobacterium leprae
acgugcugucaccaagc

SEQ ID NO: 3235262 - RNA, 14 nt, Mycobacterium leprae
acguggacuucugc

SEQ ID NO: 3235263 - RNA, 20 nt, Mycobacterium leprae
acgugucugucggcuaaaau

SEQ ID NO: 3235264 - RNA, 19 nt, Mycobacterium leprae
acgugucuucgaccgacau

SEQ ID NO: 3235265 - RNA, 18 nt, Mycobacterium leprae
acguguugauagcgcugg

SEQ ID NO: 3235266 - RNA, 16 nt, Mycobacterium leprae
acguguuuaggaaaca

SEQ ID NO: 3235267 - RNA, 15 nt, Mycobacterium leprae
acguuaaacaaccug

SEQ ID NO: 3235268 - RNA, 17 nt, Mycobacterium leprae
acguuaucuugaugcug

SEQ ID NO: 3235269 - RNA, 23 nt, Mycobacterium leprae
acguuccggccuucgucagcugg

SEQ ID NO: 3235270 - RNA, 22 nt, Mycobacterium leprae
acguucggaucauugcucgcgu

SEQ ID NO: 3235271 - RNA, 12 nt, Mycobacterium leprae
acguugcugcug

SEQ ID NO: 3235272 - RNA, 14 nt, Mycobacterium leprae
acguugcugcuggu

SEQ ID NO: 3235273 - RNA, 18 nt, Mycobacterium leprae
acguuggacgaccacguc

SEQ ID NO: 3235274 - RNA, 21 nt, Mycobacterium leprae
acguuggccggcaugcgaccg

SEQ ID NO: 3235275 - RNA, 16 nt, Mycobacterium leprae
acguuggcuugagugc

SEQ ID NO: 3235276 - RNA, 13 nt, Mycobacterium leprae
acguugucgaaaa

SEQ ID NO: 3235277 - RNA, 15 nt, Mycobacterium leprae
acguuguggcgcgag

SEQ ID NO: 3235278 - RNA, 14 nt, Mycobacterium leprae
acguuuguggugcu

SEQ ID NO: 3235279 - RNA, 14 nt, Mycobacterium leprae
acguuuuguugcua

SEQ ID NO: 3235280 - RNA, 14 nt, Mycobacterium leprae
acuaaaacgccccu

SEQ ID NO: 3235281 - RNA, 14 nt, Mycobacterium leprae
acuaaagucaugca

SEQ ID NO: 3235282 - RNA, 13 nt, Mycobacterium leprae
acuaaagucuuca

SEQ ID NO: 3235283 - RNA, 11 nt, Mycobacterium leprae
acuaaaugcca

SEQ ID NO: 3235284 - RNA, 14 nt, Mycobacterium leprae
acuaacaccgugcc

SEQ ID NO: 3235285 - RNA, 18 nt, Mycobacterium leprae
acuaaccgcagccggccu

SEQ ID NO: 3235286 - RNA, 22 nt, Mycobacterium leprae
acuaagccgaguugaagugcug

SEQ ID NO: 3235287 - RNA, 13 nt, Mycobacterium leprae
acuaauuagaggc

SEQ ID NO: 3235288 - RNA, 16 nt, Mycobacterium leprae
acuaauuagaggccaa

SEQ ID NO: 3235289 - RNA, 14 nt, Mycobacterium leprae
acuaccaaugagca

SEQ ID NO: 3235290 - RNA, 17 nt, Mycobacterium leprae
acuacccgacacaaagc

SEQ ID NO: 3235291 - RNA, 12 nt, Mycobacterium leprae
acuacggggcua

SEQ ID NO: 3235292 - RNA, 21 nt, Mycobacterium leprae
acuacgugugcucgcugcugc

SEQ ID NO: 3235293 - RNA, 18 nt, Mycobacterium leprae
acuacguuggccagcacg

SEQ ID NO: 3235294 - RNA, 21 nt, Mycobacterium leprae
acuacguuggccagcacggcg

SEQ ID NO: 3235295 - RNA, 17 nt, Mycobacterium leprae
acuacuguugucagugg

SEQ ID NO: 3235296 - RNA, 22 nt, Mycobacterium leprae
acuagccaguaagcuugggguc

SEQ ID NO: 3235297 - RNA, 15 nt, Mycobacterium leprae
acuagcuuuaauagg

SEQ ID NO: 3235298 - RNA, 15 nt, Mycobacterium leprae
acuauauaguccgac

SEQ ID NO: 3235299 - RNA, 16 nt, Mycobacterium leprae
acuauauauauauuaa

SEQ ID NO: 3235300 - RNA, 17 nt, Mycobacterium leprae
acuauccaagacaucgg

SEQ ID NO: 3235301 - RNA, 11 nt, Mycobacterium leprae
acuauggcucu

SEQ ID NO: 3235302 - RNA, 20 nt, Mycobacterium leprae
acuauuccggucgucaagcu

SEQ ID NO: 3235303 - RNA, 16 nt, Mycobacterium leprae
acucaaauucaugacg

SEQ ID NO: 3235304 - RNA, 16 nt, Mycobacterium leprae
acucaaugcuguucgg

SEQ ID NO: 3235305 - RNA, 20 nt, Mycobacterium leprae
acucaauugcagcgcgaaca

SEQ ID NO: 3235306 - RNA, 23 nt, Mycobacterium leprae
acucaccgcggcguuauccacgc

SEQ ID NO: 3235307 - RNA, 21 nt, Mycobacterium leprae
acucauagcggcgacugugcu

SEQ ID NO: 3235308 - RNA, 21 nt, Mycobacterium leprae
acucaucaaaaaacagcguga

SEQ ID NO: 3235309 - RNA, 23 nt, Mycobacterium leprae
acucaucgccaaccgucgggauc

SEQ ID NO: 3235310 - RNA, 16 nt, Mycobacterium leprae
acucaugaucgcaggc

SEQ ID NO: 3235311 - RNA, 11 nt, Mycobacterium leprae
acuccagcagc

SEQ ID NO: 3235312 - RNA, 14 nt, Mycobacterium leprae
acuccgaugugggu

SEQ ID NO: 3235313 - RNA, 14 nt, Mycobacterium leprae
acuccguacucacg

SEQ ID NO: 3235314 - RNA, 18 nt, Mycobacterium leprae
acucgaacaucccugggc

SEQ ID NO: 3235315 - RNA, 16 nt, Mycobacterium leprae
acucgaccuugccgaa

SEQ ID NO: 3235316 - RNA, 18 nt, Mycobacterium leprae
acucgagcaaugcugagc

SEQ ID NO: 3235317 - RNA, 13 nt, Mycobacterium leprae
acucgagucgcga

SEQ ID NO: 3235318 - RNA, 16 nt, Mycobacterium leprae
acucgaucguucuuac

SEQ ID NO: 3235319 - RNA, 12 nt, Mycobacterium leprae
acucggcagagc

SEQ ID NO: 3235320 - RNA, 13 nt, Mycobacterium leprae
acucggcagagcg

SEQ ID NO: 3235321 - RNA, 19 nt, Mycobacterium leprae
acucggccgccagguccac

SEQ ID NO: 3235322 - RNA, 22 nt, Mycobacterium leprae
acucggcgccaucgaauccucg

SEQ ID NO: 3235323 - RNA, 21 nt, Mycobacterium leprae
acucgggguuugacaccgcag

SEQ ID NO: 3235324 - RNA, 20 nt, Mycobacterium leprae
acucgguuggcuagcgugcu

SEQ ID NO: 3235325 - RNA, 17 nt, Mycobacterium leprae
acucgucggcaagccaa

SEQ ID NO: 3235326 - RNA, 21 nt, Mycobacterium leprae
acucguuucucauucucugcc

SEQ ID NO: 3235327 - RNA, 13 nt, Mycobacterium leprae
acucucaucgcgg

SEQ ID NO: 3235328 - RNA, 21 nt, Mycobacterium leprae
acucucaucgcggcugccacu

SEQ ID NO: 3235329 - RNA, 22 nt, Mycobacterium leprae
acucucaucgcggcugccacug

SEQ ID NO: 3235330 - RNA, 18 nt, Mycobacterium leprae
acucuccccacugcagga

SEQ ID NO: 3235331 - RNA, 14 nt, Mycobacterium leprae
acucugccgccucg

SEQ ID NO: 3235332 - RNA, 21 nt, Mycobacterium leprae
acucuugacuaaagucaugca

SEQ ID NO: 3235333 - RNA, 19 nt, Mycobacterium leprae
acugacccaagcgccagcu

SEQ ID NO: 3235334 - RNA, 12 nt, Mycobacterium leprae
acugaccggcua

SEQ ID NO: 3235335 - RNA, 18 nt, Mycobacterium leprae
acugacggagcaagcgcu

SEQ ID NO: 3235336 - RNA, 21 nt, Mycobacterium leprae
acugacggguggucuugauuc

SEQ ID NO: 3235337 - RNA, 18 nt, Mycobacterium leprae
acugacguuggcgcucug

SEQ ID NO: 3235338 - RNA, 16 nt, Mycobacterium leprae
acugagaguacugacc

SEQ ID NO: 3235339 - RNA, 17 nt, Mycobacterium leprae
acugagauuaucccgau

SEQ ID NO: 3235340 - RNA, 19 nt, Mycobacterium leprae
acugaggauccugaccuug

SEQ ID NO: 3235341 - RNA, 23 nt, Mycobacterium leprae
acugagugaaccuauugucaggu

SEQ ID NO: 3235342 - RNA, 19 nt, Mycobacterium leprae
acugaugugcugagagcag

SEQ ID NO: 3235343 - RNA, 13 nt, Mycobacterium leprae
acugcacccggcc

SEQ ID NO: 3235344 - RNA, 17 nt, Mycobacterium leprae
acugcacgaccacacug

SEQ ID NO: 3235345 - RNA, 19 nt, Mycobacterium leprae
acugcacggcgugcaggca

SEQ ID NO: 3235346 - RNA, 20 nt, Mycobacterium leprae
acugcagaaauucagcgcca

SEQ ID NO: 3235347 - RNA, 17 nt, Mycobacterium leprae
acugcagcuaaucccau

SEQ ID NO: 3235348 - RNA, 24 nt, Mycobacterium leprae
acugccaaaguccaugugcugaca

SEQ ID NO: 3235349 - RNA, 18 nt, Mycobacterium leprae
acugccagcuauccccga

SEQ ID NO: 3235350 - RNA, 14 nt, Mycobacterium leprae
acugcccagacuca

SEQ ID NO: 3235351 - RNA, 21 nt, Mycobacterium leprae
acugccgaagacuucuucgau

SEQ ID NO: 3235352 - RNA, 13 nt, Mycobacterium leprae
acugcgaaaaauc

SEQ ID NO: 3235353 - RNA, 21 nt, Mycobacterium leprae
acugcggcucaccgacugaga

SEQ ID NO: 3235354 - RNA, 22 nt, Mycobacterium leprae
acugcguuguagaccaugagca

SEQ ID NO: 3235355 - RNA, 16 nt, Mycobacterium leprae
acugcguuucaugacg

SEQ ID NO: 3235356 - RNA, 20 nt, Mycobacterium leprae
acugcuaucgcccaggugcu

SEQ ID NO: 3235357 - RNA, 20 nt, Mycobacterium leprae
acugcucaaccaggucgguc

SEQ ID NO: 3235358 - RNA, 13 nt, Mycobacterium leprae
acugcugcacccg

SEQ ID NO: 3235359 - RNA, 16 nt, Mycobacterium leprae
acugcugcccgcgggg

SEQ ID NO: 3235360 - RNA, 15 nt, Mycobacterium leprae
acugcuucggccagc

SEQ ID NO: 3235361 - RNA, 14 nt, Mycobacterium leprae
acugcuugggcgcu

SEQ ID NO: 3235362 - RNA, 21 nt, Mycobacterium leprae
acuggcaguuagcaugagcug

SEQ ID NO: 3235363 - RNA, 21 nt, Mycobacterium leprae
acuggcaugagccgacugaca

SEQ ID NO: 3235364 - RNA, 15 nt, Mycobacterium leprae
acuggcgaccgcacg

SEQ ID NO: 3235365 - RNA, 16 nt, Mycobacterium leprae
acugggcugagccgcc

SEQ ID NO: 3235366 - RNA, 18 nt, Mycobacterium leprae
acugggcugagccgccgu

SEQ ID NO: 3235367 - RNA, 20 nt, Mycobacterium leprae
acuggggcguccagugauga

SEQ ID NO: 3235368 - RNA, 13 nt, Mycobacterium leprae
acuggugauaaau

SEQ ID NO: 3235369 - RNA, 12 nt, Mycobacterium leprae
acuggugguggc

SEQ ID NO: 3235370 - RNA, 23 nt, Mycobacterium leprae
acuguagagacguaccacucaca

SEQ ID NO: 3235371 - RNA, 21 nt, Mycobacterium leprae
acuguccacucggacaccggg

SEQ ID NO: 3235372 - RNA, 18 nt, Mycobacterium leprae
acugucuaccguugacgu

SEQ ID NO: 3235373 - RNA, 15 nt, Mycobacterium leprae
acugugaucgcaugc

SEQ ID NO: 3235374 - RNA, 13 nt, Mycobacterium leprae
acugugcauauca

SEQ ID NO: 3235375 - RNA, 19 nt, Mycobacterium leprae
acugugcggagcaugacag

SEQ ID NO: 3235376 - RNA, 21 nt, Mycobacterium leprae
acugugcuaaccgggccaacu

SEQ ID NO: 3235377 - RNA, 14 nt, Mycobacterium leprae
acuguugugggcaa

SEQ ID NO: 3235378 - RNA, 15 nt, Mycobacterium leprae
acuuaaguggcuggc

SEQ ID NO: 3235379 - RNA, 13 nt, Mycobacterium leprae
acuuaauaucuuu

SEQ ID NO: 3235380 - RNA, 13 nt, Mycobacterium leprae
acuuaaugugucu

SEQ ID NO: 3235381 - RNA, 20 nt, Mycobacterium leprae
acuuaccgcggcggccaacu

SEQ ID NO: 3235382 - RNA, 22 nt, Mycobacterium leprae
acuuaccgcggcggccaacugu

SEQ ID NO: 3235383 - RNA, 16 nt, Mycobacterium leprae
acuuagauuggaaggc

SEQ ID NO: 3235384 - RNA, 16 nt, Mycobacterium leprae
acuuaguuuagagugc

SEQ ID NO: 3235385 - RNA, 19 nt, Mycobacterium leprae
acuuaguuuagagugcagc

SEQ ID NO: 3235386 - RNA, 19 nt, Mycobacterium leprae
acuuauuuauauucaauuu

SEQ ID NO: 3235387 - RNA, 18 nt, Mycobacterium leprae
acuucaccaauccagcca

SEQ ID NO: 3235388 - RNA, 17 nt, Mycobacterium leprae
acuuccggcuucuccag

SEQ ID NO: 3235389 - RNA, 23 nt, Mycobacterium leprae
acuuccuaugucgugcugaccag

SEQ ID NO: 3235390 - RNA, 13 nt, Mycobacterium leprae
acuuccucugcca

SEQ ID NO: 3235391 - RNA, 16 nt, Mycobacterium leprae
acuucgacgagacacu

SEQ ID NO: 3235392 - RNA, 17 nt, Mycobacterium leprae
acuucgacgaucaccgc

SEQ ID NO: 3235393 - RNA, 24 nt, Mycobacterium leprae
acuucggaaucuuugaucugcugc

SEQ ID NO: 3235394 - RNA, 20 nt, Mycobacterium leprae
acuucgguccgcucaccgcg

SEQ ID NO: 3235395 - RNA, 15 nt, Mycobacterium leprae
acuucuugugcaccg

SEQ ID NO: 3235396 - RNA, 20 nt, Mycobacterium leprae
acuucuuuuaucaagggauu

SEQ ID NO: 3235397 - RNA, 12 nt, Mycobacterium leprae
acuugacacaaa

SEQ ID NO: 3235398 - RNA, 14 nt, Mycobacterium leprae
acuugacgaugcug

SEQ ID NO: 3235399 - RNA, 18 nt, Mycobacterium leprae
acuugacggucgagcugg

SEQ ID NO: 3235400 - RNA, 21 nt, Mycobacterium leprae
acuugcacuaugucgaucggc

SEQ ID NO: 3235401 - RNA, 18 nt, Mycobacterium leprae
acuugcaugugucccugg

SEQ ID NO: 3235402 - RNA, 16 nt, Mycobacterium leprae
acuugcgauagcggug

SEQ ID NO: 3235403 - RNA, 15 nt, Mycobacterium leprae
acuuggucaagguga

SEQ ID NO: 3235404 - RNA, 20 nt, Mycobacterium leprae
acuuguggucucaaugaccg

SEQ ID NO: 3235405 - RNA, 21 nt, Mycobacterium leprae
acuuguucuuugcguccucca

SEQ ID NO: 3235406 - RNA, 16 nt, Mycobacterium leprae
acuuuccugaccgcgg

SEQ ID NO: 3235407 - RNA, 12 nt, Mycobacterium leprae
acuuuuuguggg

SEQ ID NO: 3235408 - RNA, 16 nt, Mycobacterium leprae
agaaaacuuaauaucu

SEQ ID NO: 3235409 - RNA, 13 nt, Mycobacterium leprae
agaaagaauuuac

SEQ ID NO: 3235410 - RNA, 20 nt, Mycobacterium leprae
agaacaaaucagcagcauug

SEQ ID NO: 3235411 - RNA, 18 nt, Mycobacterium leprae
agaaccuauucaaccggu

SEQ ID NO: 3235412 - RNA, 18 nt, Mycobacterium leprae
agaaccuucaucggaggc

SEQ ID NO: 3235413 - RNA, 23 nt, Mycobacterium leprae
agaacgcagucugaucgcucacc

SEQ ID NO: 3235414 - RNA, 21 nt, Mycobacterium leprae
agaacucaauaguguguuugg

SEQ ID NO: 3235415 - RNA, 17 nt, Mycobacterium leprae
agaagaauuaauauaua

SEQ ID NO: 3235416 - RNA, 19 nt, Mycobacterium leprae
agaagaccgugcuccuguu

SEQ ID NO: 3235417 - RNA, 20 nt, Mycobacterium leprae
agaagcagcuauagggcacg

SEQ ID NO: 3235418 - RNA, 15 nt, Mycobacterium leprae
agaagccggcucgcg

SEQ ID NO: 3235419 - RNA, 13 nt, Mycobacterium leprae
agaagucaggcug

SEQ ID NO: 3235420 - RNA, 20 nt, Mycobacterium leprae
agaagugcgacgauuuugcu

SEQ ID NO: 3235421 - RNA, 21 nt, Mycobacterium leprae
agaaguggcuugucacgccgg

SEQ ID NO: 3235422 - RNA, 19 nt, Mycobacterium leprae
agaauauugcgacauccaa

SEQ ID NO: 3235423 - RNA, 20 nt, Mycobacterium leprae
agaauauugcgacauccaaa

SEQ ID NO: 3235424 - RNA, 16 nt, Mycobacterium leprae
agaaucacaaucacaa

SEQ ID NO: 3235425 - RNA, 14 nt, Mycobacterium leprae
agaaucgaucccac

SEQ ID NO: 3235426 - RNA, 17 nt, Mycobacterium leprae
agaaucgccuggucaug

SEQ ID NO: 3235427 - RNA, 18 nt, Mycobacterium leprae
agaaugauaacuaggcua

SEQ ID NO: 3235428 - RNA, 15 nt, Mycobacterium leprae
agaauuuaccggcgu

SEQ ID NO: 3235429 - RNA, 16 nt, Mycobacterium leprae
agaauuuucagcgguc

SEQ ID NO: 3235430 - RNA, 18 nt, Mycobacterium leprae
agacaacccgacggcaca

SEQ ID NO: 3235431 - RNA, 14 nt, Mycobacterium leprae
agacaccguccucg

SEQ ID NO: 3235432 - RNA, 16 nt, Mycobacterium leprae
agacacuccacgcacc

SEQ ID NO: 3235433 - RNA, 14 nt, Mycobacterium leprae
agacagugaugauc

SEQ ID NO: 3235434 - RNA, 17 nt, Mycobacterium leprae
agacauggcuguaucuc

SEQ ID NO: 3235435 - RNA, 14 nt, Mycobacterium leprae
agaccaagcagcau

SEQ ID NO: 3235436 - RNA, 21 nt, Mycobacterium leprae
agaccaccguaagucagaugg

SEQ ID NO: 3235437 - RNA, 22 nt, Mycobacterium leprae
agaccaccguaagucagaugga

SEQ ID NO: 3235438 - RNA, 20 nt, Mycobacterium leprae
agaccagggguguugcacca

SEQ ID NO: 3235439 - RNA, 20 nt, Mycobacterium leprae
agaccaggugaugauggcau

SEQ ID NO: 3235440 - RNA, 15 nt, Mycobacterium leprae
agaccaucacgaucc

SEQ ID NO: 3235441 - RNA, 16 nt, Mycobacterium leprae
agaccaugagcacacg

SEQ ID NO: 3235442 - RNA, 21 nt, Mycobacterium leprae
agacccacagcugcgcauacu

SEQ ID NO: 3235443 - RNA, 21 nt, Mycobacterium leprae
agacccccggauaccgggggu

SEQ ID NO: 3235444 - RNA, 22 nt, Mycobacterium leprae
agaccccuuacgaucucagcca

SEQ ID NO: 3235445 - RNA, 23 nt, Mycobacterium leprae
agacccuuguagcccuccggaaa

SEQ ID NO: 3235446 - RNA, 17 nt, Mycobacterium leprae
agaccgccagaccggcg

SEQ ID NO: 3235447 - RNA, 24 nt, Mycobacterium leprae
agaccgcuaugcggacggacacug

SEQ ID NO: 3235448 - RNA, 12 nt, Mycobacterium leprae
agacgaucgcaa

SEQ ID NO: 3235449 - RNA, 15 nt, Mycobacterium leprae
agacgcgaccgccac

SEQ ID NO: 3235450 - RNA, 19 nt, Mycobacterium leprae
agacggcaugucaauaccc

SEQ ID NO: 3235451 - RNA, 21 nt, Mycobacterium leprae
agacgguguugcugaguguug

SEQ ID NO: 3235452 - RNA, 11 nt, Mycobacterium leprae
agacgucgaug

SEQ ID NO: 3235453 - RNA, 16 nt, Mycobacterium leprae
agacgucugucacccg

SEQ ID NO: 3235454 - RNA, 12 nt, Mycobacterium leprae
agacgugcacaa

SEQ ID NO: 3235455 - RNA, 12 nt, Mycobacterium leprae
agacucagaaau

SEQ ID NO: 3235456 - RNA, 19 nt, Mycobacterium leprae
agacugagucugcgguuca

SEQ ID NO: 3235457 - RNA, 11 nt, Mycobacterium leprae
agacugcaccc

SEQ ID NO: 3235458 - RNA, 14 nt, Mycobacterium leprae
agacugcacccggc

SEQ ID NO: 3235459 - RNA, 14 nt, Mycobacterium leprae
agagaagagcuggu

SEQ ID NO: 3235460 - RNA, 16 nt, Mycobacterium leprae
agagagucgaacacgc

SEQ ID NO: 3235461 - RNA, 15 nt, Mycobacterium leprae
agagagugcggugcu

SEQ ID NO: 3235462 - RNA, 19 nt, Mycobacterium leprae
agagaucgccgcuccgauc

SEQ ID NO: 3235463 - RNA, 16 nt, Mycobacterium leprae
agagaucguccucaug

SEQ ID NO: 3235464 - RNA, 23 nt, Mycobacterium leprae
agagauuucgcaggcuguugugg

SEQ ID NO: 3235465 - RNA, 15 nt, Mycobacterium leprae
agagcacaugaaaac

SEQ ID NO: 3235466 - RNA, 17 nt, Mycobacterium leprae
agagcauggacccacug

SEQ ID NO: 3235467 - RNA, 15 nt, Mycobacterium leprae
agagccacggcaaug

SEQ ID NO: 3235468 - RNA, 11 nt, Mycobacterium leprae
agagcccggca

SEQ ID NO: 3235469 - RNA, 18 nt, Mycobacterium leprae
agagccgcggguuucccg

SEQ ID NO: 3235470 - RNA, 20 nt, Mycobacterium leprae
agagcgucgugaccgcgggg

SEQ ID NO: 3235471 - RNA, 15 nt, Mycobacterium leprae
agagcucacugggcu

SEQ ID NO: 3235472 - RNA, 13 nt, Mycobacterium leprae
agagcugcgacaa

SEQ ID NO: 3235473 - RNA, 21 nt, Mycobacterium leprae
agagcugugccgacaccaucc

SEQ ID NO: 3235474 - RNA, 17 nt, Mycobacterium leprae
agagcugugucaaugac

SEQ ID NO: 3235475 - RNA, 16 nt, Mycobacterium leprae
agaggaugucgagauc

SEQ ID NO: 3235476 - RNA, 17 nt, Mycobacterium leprae
agaggcggucggcggcu

SEQ ID NO: 3235477 - RNA, 18 nt, Mycobacterium leprae
agaggguccggaccugga

SEQ ID NO: 3235478 - RNA, 17 nt, Mycobacterium leprae
agagguccugcagucuu

SEQ ID NO: 3235479 - RNA, 14 nt, Mycobacterium leprae
agagguucuaggua

SEQ ID NO: 3235480 - RNA, 22 nt, Mycobacterium leprae
agagguuuuccacugcauugca

SEQ ID NO: 3235481 - RNA, 19 nt, Mycobacterium leprae
agaguaaccacuugcagua

SEQ ID NO: 3235482 - RNA, 19 nt, Mycobacterium leprae
agaguacggagccaguggc

SEQ ID NO: 3235483 - RNA, 17 nt, Mycobacterium leprae
agaguaucacaacgccg

SEQ ID NO: 3235484 - RNA, 17 nt, Mycobacterium leprae
agagucccucagcggca

SEQ ID NO: 3235485 - RNA, 22 nt, Mycobacterium leprae
agagucgaccgccgaagcagcc

SEQ ID NO: 3235486 - RNA, 10 nt, Mycobacterium leprae
agagugcagc

SEQ ID NO: 3235487 - RNA, 21 nt, Mycobacterium leprae
agauaaagcuuagaaagcugc

SEQ ID NO: 3235488 - RNA, 20 nt, Mycobacterium leprae
agauaacccgugucgaccga

SEQ ID NO: 3235489 - RNA, 16 nt, Mycobacterium leprae
agauacugcaauccgu

SEQ ID NO: 3235490 - RNA, 19 nt, Mycobacterium leprae
agauagacaugugugcugg

SEQ ID NO: 3235491 - RNA, 22 nt, Mycobacterium leprae
agauagacaugugugcuggcca

SEQ ID NO: 3235492 - RNA, 14 nt, Mycobacterium leprae
agauaggucgccga

SEQ ID NO: 3235493 - RNA, 22 nt, Mycobacterium leprae
agauaggugaagguuucugagu

SEQ ID NO: 3235494 - RNA, 23 nt, Mycobacterium leprae
agauagucgagggcucaguguau

SEQ ID NO: 3235495 - RNA, 15 nt, Mycobacterium leprae
agauaucucgccuuc

SEQ ID NO: 3235496 - RNA, 14 nt, Mycobacterium leprae
agaucaaacaugga

SEQ ID NO: 3235497 - RNA, 16 nt, Mycobacterium leprae
agaucacaguccugcc

SEQ ID NO: 3235498 - RNA, 14 nt, Mycobacterium leprae
agauccgauucgcg

SEQ ID NO: 3235499 - RNA, 23 nt, Mycobacterium leprae
agaucgacuugaccuauacugga

SEQ ID NO: 3235500 - RNA, 13 nt, Mycobacterium leprae
agaucgaucucga

SEQ ID NO: 3235501 - RNA, 20 nt, Mycobacterium leprae
agaucgccugguucacuaag

SEQ ID NO: 3235502 - RNA, 21 nt, Mycobacterium leprae
agaucggcauaaucagcgucg

SEQ ID NO: 3235503 - RNA, 20 nt, Mycobacterium leprae
agaucucacccucgccgcga

SEQ ID NO: 3235504 - RNA, 16 nt, Mycobacterium leprae
agaucugauucagauu

SEQ ID NO: 3235505 - RNA, 18 nt, Mycobacterium leprae
agaucuggguaucaguau

SEQ ID NO: 3235506 - RNA, 17 nt, Mycobacterium leprae
agaucuuaaucgagcca

SEQ ID NO: 3235507 - RNA, 16 nt, Mycobacterium leprae
agaucuugcagcuggc

SEQ ID NO: 3235508 - RNA, 22 nt, Mycobacterium leprae
agaucuugccaucgaacgcucu

SEQ ID NO: 3235509 - RNA, 22 nt, Mycobacterium leprae
agaugaguugugcagcugaaau

SEQ ID NO: 3235510 - RNA, 17 nt, Mycobacterium leprae
agaugcaagauuauuac

SEQ ID NO: 3235511 - RNA, 23 nt, Mycobacterium leprae
agaugcgaucgcagucaucaccc

SEQ ID NO: 3235512 - RNA, 19 nt, Mycobacterium leprae
agauggaaggcggagaugu

SEQ ID NO: 3235513 - RNA, 22 nt, Mycobacterium leprae
agauggcgucuugaucgaccuc

SEQ ID NO: 3235514 - RNA, 13 nt, Mycobacterium leprae
agauguaaagcag

SEQ ID NO: 3235515 - RNA, 15 nt, Mycobacterium leprae
agaugucgcagcggc

SEQ ID NO: 3235516 - RNA, 15 nt, Mycobacterium leprae
agauguucaagcgaa

SEQ ID NO: 3235517 - RNA, 14 nt, Mycobacterium leprae
agauguuggcccgu

SEQ ID NO: 3235518 - RNA, 17 nt, Mycobacterium leprae
agauuauuaagauaaag

SEQ ID NO: 3235519 - RNA, 22 nt, Mycobacterium leprae
agauuccaaugucccaccgagu

SEQ ID NO: 3235520 - RNA, 21 nt, Mycobacterium leprae
agauucgucgauaaugccggu

SEQ ID NO: 3235521 - RNA, 19 nt, Mycobacterium leprae
agauugacaccgccggcgu

SEQ ID NO: 3235522 - RNA, 21 nt, Mycobacterium leprae
agauugacgucgguguggugc

SEQ ID NO: 3235523 - RNA, 17 nt, Mycobacterium leprae
agauugcaguccaccag

SEQ ID NO: 3235524 - RNA, 18 nt, Mycobacterium leprae
agauugcggacaauucaa

SEQ ID NO: 3235525 - RNA, 14 nt, Mycobacterium leprae
agcaaaccagguga

SEQ ID NO: 3235526 - RNA, 18 nt, Mycobacterium leprae
agcaaauugccgagcugg

SEQ ID NO: 3235527 - RNA, 13 nt, Mycobacterium leprae
agcaacgacgcca

SEQ ID NO: 3235528 - RNA, 17 nt, Mycobacterium leprae
agcaacguacugcaaug

SEQ ID NO: 3235529 - RNA, 12 nt, Mycobacterium leprae
agcaacugcagc

SEQ ID NO: 3235530 - RNA, 18 nt, Mycobacterium leprae
agcaagcaggcaugccgc

SEQ ID NO: 3235531 - RNA, 13 nt, Mycobacterium leprae
agcaagccgccag

SEQ ID NO: 3235532 - RNA, 14 nt, Mycobacterium leprae
agcaagcgagccau

SEQ ID NO: 3235533 - RNA, 15 nt, Mycobacterium leprae
agcaaggaacaaaau

SEQ ID NO: 3235534 - RNA, 15 nt, Mycobacterium leprae
agcaagguguugcgg

SEQ ID NO: 3235535 - RNA, 15 nt, Mycobacterium leprae
agcaagucccaggac

SEQ ID NO: 3235536 - RNA, 19 nt, Mycobacterium leprae
agcaagucgccuacaccag

SEQ ID NO: 3235537 - RNA, 16 nt, Mycobacterium leprae
agcaauaaccagggcc

SEQ ID NO: 3235538 - RNA, 21 nt, Mycobacterium leprae
agcaauccucagagugugugu

SEQ ID NO: 3235539 - RNA, 12 nt, Mycobacterium leprae
agcaaucugcgu

SEQ ID NO: 3235540 - RNA, 15 nt, Mycobacterium leprae
agcaaugccaaacuu

SEQ ID NO: 3235541 - RNA, 17 nt, Mycobacterium leprae
agcaaugcucugcugau

SEQ ID NO: 3235542 - RNA, 23 nt, Mycobacterium leprae
agcacaaaauucucgcgccaccg

SEQ ID NO: 3235543 - RNA, 14 nt, Mycobacterium leprae
agcacaccagggau

SEQ ID NO: 3235544 - RNA, 22 nt, Mycobacterium leprae
agcacaucaguaucagugccau

SEQ ID NO: 3235545 - RNA, 18 nt, Mycobacterium leprae
agcaccaagucuucgaug

SEQ ID NO: 3235546 - RNA, 12 nt, Mycobacterium leprae
agcaccagcagu

SEQ ID NO: 3235547 - RNA, 13 nt, Mycobacterium leprae
agcacccagcuca

SEQ ID NO: 3235548 - RNA, 17 nt, Mycobacterium leprae
agcacccgcuugucuuu

SEQ ID NO: 3235549 - RNA, 15 nt, Mycobacterium leprae
agcaccgcgccgguc

SEQ ID NO: 3235550 - RNA, 16 nt, Mycobacterium leprae
agcaccggcauggccg

SEQ ID NO: 3235551 - RNA, 20 nt, Mycobacterium leprae
agcaccggcauggccgcugg

SEQ ID NO: 3235552 - RNA, 15 nt, Mycobacterium leprae
agcaccucagcaacu

SEQ ID NO: 3235553 - RNA, 17 nt, Mycobacterium leprae
agcaccugccgcagcgg

SEQ ID NO: 3235554 - RNA, 20 nt, Mycobacterium leprae
agcacgaugacaagagugaa

SEQ ID NO: 3235555 - RNA, 13 nt, Mycobacterium leprae
agcacgaugacau

SEQ ID NO: 3235556 - RNA, 15 nt, Mycobacterium leprae
agcacgaugacauac

SEQ ID NO: 3235557 - RNA, 21 nt, Mycobacterium leprae
agcacugcacggcgugcaggc

SEQ ID NO: 3235558 - RNA, 17 nt, Mycobacterium leprae
agcacugcaguaaccga

SEQ ID NO: 3235559 - RNA, 14 nt, Mycobacterium leprae
agcacuggcauuac

SEQ ID NO: 3235560 - RNA, 17 nt, Mycobacterium leprae
agcacuuacgcgauuca

SEQ ID NO: 3235561 - RNA, 20 nt, Mycobacterium leprae
agcagcacgggguguuggcg

SEQ ID NO: 3235562 - RNA, 15 nt, Mycobacterium leprae
agcagccgaccgccc

SEQ ID NO: 3235563 - RNA, 17 nt, Mycobacterium leprae
agcagccggggugguga

SEQ ID NO: 3235564 - RNA, 20 nt, Mycobacterium leprae
agcagcuauagggcacgcug

SEQ ID NO: 3235565 - RNA, 14 nt, Mycobacterium leprae
agcagcucgggcuc

SEQ ID NO: 3235566 - RNA, 13 nt, Mycobacterium leprae
agcagcugggugg

SEQ ID NO: 3235567 - RNA, 14 nt, Mycobacterium leprae
agcaggaaucccag

SEQ ID NO: 3235568 - RNA, 18 nt, Mycobacterium leprae
agcaggaaucccagcagc

SEQ ID NO: 3235569 - RNA, 19 nt, Mycobacterium leprae
agcaggucgccgaggcgac

SEQ ID NO: 3235570 - RNA, 20 nt, Mycobacterium leprae
agcaggucgccgaggcgacu

SEQ ID NO: 3235571 - RNA, 21 nt, Mycobacterium leprae
agcaggucuuuuagguguggu

SEQ ID NO: 3235572 - RNA, 23 nt, Mycobacterium leprae
agcaguaucguguuagugaacag

SEQ ID NO: 3235573 - RNA, 21 nt, Mycobacterium leprae
agcagugccuuguguucggca

SEQ ID NO: 3235574 - RNA, 17 nt, Mycobacterium leprae
agcaguguucaggccau

SEQ ID NO: 3235575 - RNA, 19 nt, Mycobacterium leprae
agcauagcggccgccagca

SEQ ID NO: 3235576 - RNA, 17 nt, Mycobacterium leprae
agcaucaacgccagcaa

SEQ ID NO: 3235577 - RNA, 22 nt, Mycobacterium leprae
agcaucaacgcguuaacgacga

SEQ ID NO: 3235578 - RNA, 15 nt, Mycobacterium leprae
agcaucagacagagc

SEQ ID NO: 3235579 - RNA, 19 nt, Mycobacterium leprae
agcaucgacagcacccagc

SEQ ID NO: 3235580 - RNA, 23 nt, Mycobacterium leprae
agcaugacgucuucuauacuuua

SEQ ID NO: 3235581 - RNA, 16 nt, Mycobacterium leprae
agcaugcccagaccga

SEQ ID NO: 3235582 - RNA, 17 nt, Mycobacterium leprae
agcaugcccagaccgaa

SEQ ID NO: 3235583 - RNA, 20 nt, Mycobacterium leprae
agcaugcgccuccagcucgu

SEQ ID NO: 3235584 - RNA, 20 nt, Mycobacterium leprae
agcauggacccacugggcaa

SEQ ID NO: 3235585 - RNA, 17 nt, Mycobacterium leprae
agcauguccaagaauca

SEQ ID NO: 3235586 - RNA, 17 nt, Mycobacterium leprae
agcaugucgguggugga

SEQ ID NO: 3235587 - RNA, 19 nt, Mycobacterium leprae
agcauuccuuucagcucga

SEQ ID NO: 3235588 - RNA, 22 nt, Mycobacterium leprae
agcauugcguaauucgacaaug

SEQ ID NO: 3235589 - RNA, 15 nt, Mycobacterium leprae
agccaacagccaaug

SEQ ID NO: 3235590 - RNA, 19 nt, Mycobacterium leprae
agccaaucguguaucgucg

SEQ ID NO: 3235591 - RNA, 22 nt, Mycobacterium leprae
agccaaugcugcagcugggaua

SEQ ID NO: 3235592 - RNA, 22 nt, Mycobacterium leprae
agccacacucgaccuccgcuau

SEQ ID NO: 3235593 - RNA, 22 nt, Mycobacterium leprae
agccacagcgacggaucuguag

SEQ ID NO: 3235594 - RNA, 22 nt, Mycobacterium leprae
agccaccacaaauacuucacca

SEQ ID NO: 3235595 - RNA, 14 nt, Mycobacterium leprae
agccacgcaaacga

SEQ ID NO: 3235596 - RNA, 13 nt, Mycobacterium leprae
agccacggcaaug

SEQ ID NO: 3235597 - RNA, 22 nt, Mycobacterium leprae
agccagaauggaguuggugucu

SEQ ID NO: 3235598 - RNA, 14 nt, Mycobacterium leprae
agccagaccaacau

SEQ ID NO: 3235599 - RNA, 14 nt, Mycobacterium leprae
agccagcaaggcaa

SEQ ID NO: 3235600 - RNA, 19 nt, Mycobacterium leprae
agccaggagaagcgcugca

SEQ ID NO: 3235601 - RNA, 23 nt, Mycobacterium leprae
agccaggagaagcgcugcagcga

SEQ ID NO: 3235602 - RNA, 16 nt, Mycobacterium leprae
agccagggucacaaac

SEQ ID NO: 3235603 - RNA, 19 nt, Mycobacterium leprae
agccaucaccguggccggc

SEQ ID NO: 3235604 - RNA, 18 nt, Mycobacterium leprae
agccaucucuauuuggua

SEQ ID NO: 3235605 - RNA, 23 nt, Mycobacterium leprae
agccaugcaaccacacccuggcu

SEQ ID NO: 3235606 - RNA, 20 nt, Mycobacterium leprae
agccaugucugucagcacau

SEQ ID NO: 3235607 - RNA, 22 nt, Mycobacterium leprae
agcccaggugcccagccccugg

SEQ ID NO: 3235608 - RNA, 21 nt, Mycobacterium leprae
agccccuggcaucaucaacau

SEQ ID NO: 3235609 - RNA, 19 nt, Mycobacterium leprae
agcccgacgcaacugcugg

SEQ ID NO: 3235610 - RNA, 13 nt, Mycobacterium leprae
agcccgauuugga

SEQ ID NO: 3235611 - RNA, 20 nt, Mycobacterium leprae
agcccgcaucggcccgcaac

SEQ ID NO: 3235612 - RNA, 13 nt, Mycobacterium leprae
agcccgccgcggc

SEQ ID NO: 3235613 - RNA, 15 nt, Mycobacterium leprae
agcccgcgccgccgu

SEQ ID NO: 3235614 - RNA, 22 nt, Mycobacterium leprae
agcccgcugcugcgaccgacca

SEQ ID NO: 3235615 - RNA, 18 nt, Mycobacterium leprae
agcccggaauccuguuga

SEQ ID NO: 3235616 - RNA, 22 nt, Mycobacterium leprae
agcccggagugccuguccggag

SEQ ID NO: 3235617 - RNA, 16 nt, Mycobacterium leprae
agcccgggaugacguu

SEQ ID NO: 3235618 - RNA, 13 nt, Mycobacterium leprae
agcccugcccggc

SEQ ID NO: 3235619 - RNA, 14 nt, Mycobacterium leprae
agcccugcccggcc

SEQ ID NO: 3235620 - RNA, 18 nt, Mycobacterium leprae
agccgaacuauccaagac

SEQ ID NO: 3235621 - RNA, 18 nt, Mycobacterium leprae
agccgaagccgccagguu

SEQ ID NO: 3235622 - RNA, 16 nt, Mycobacterium leprae
agccgaagcggccgga

SEQ ID NO: 3235623 - RNA, 19 nt, Mycobacterium leprae
agccgaccgcccgguagca

SEQ ID NO: 3235624 - RNA, 23 nt, Mycobacterium leprae
agccgacgguccugguggcaacg

SEQ ID NO: 3235625 - RNA, 23 nt, Mycobacterium leprae
agccgagguucccggcggccaau

SEQ ID NO: 3235626 - RNA, 16 nt, Mycobacterium leprae
agccgcaaggucacga

SEQ ID NO: 3235627 - RNA, 15 nt, Mycobacterium leprae
agccgcaggucucac

SEQ ID NO: 3235628 - RNA, 21 nt, Mycobacterium leprae
agccgccacgaccaaaccucu

SEQ ID NO: 3235629 - RNA, 15 nt, Mycobacterium leprae
agccgccagugcgca

SEQ ID NO: 3235630 - RNA, 19 nt, Mycobacterium leprae
agccgcgcgcaagucugga

SEQ ID NO: 3235631 - RNA, 23 nt, Mycobacterium leprae
agccgcgcuagcgauguagccaa

SEQ ID NO: 3235632 - RNA, 17 nt, Mycobacterium leprae
agccgcgggcgaugcca

SEQ ID NO: 3235633 - RNA, 23 nt, Mycobacterium leprae
agccgcgguaacggcgguggcag

SEQ ID NO: 3235634 - RNA, 15 nt, Mycobacterium leprae
agccgcguccagaca

SEQ ID NO: 3235635 - RNA, 21 nt, Mycobacterium leprae
agccgcugcggguucguugau

SEQ ID NO: 3235636 - RNA, 18 nt, Mycobacterium leprae
agccggcuuuggcggacu

SEQ ID NO: 3235637 - RNA, 18 nt, Mycobacterium leprae
agccggucgaucgcagcc

SEQ ID NO: 3235638 - RNA, 19 nt, Mycobacterium leprae
agccggucgaucgcagccg

SEQ ID NO: 3235639 - RNA, 20 nt, Mycobacterium leprae
agccgguggccaccgccacc

SEQ ID NO: 3235640 - RNA, 23 nt, Mycobacterium leprae
agccgguggccaccgccaccgaa

SEQ ID NO: 3235641 - RNA, 22 nt, Mycobacterium leprae
agccgucacugugugcagcuug

SEQ ID NO: 3235642 - RNA, 16 nt, Mycobacterium leprae
agccgucgaagcccug

SEQ ID NO: 3235643 - RNA, 18 nt, Mycobacterium leprae
agccgucgaagcccugca

SEQ ID NO: 3235644 - RNA, 19 nt, Mycobacterium leprae
agccgucgagccgauuacc

SEQ ID NO: 3235645 - RNA, 23 nt, Mycobacterium leprae
agccgucgcugugccaaguugua

SEQ ID NO: 3235646 - RNA, 22 nt, Mycobacterium leprae
agccgucuuggccaugggggcg

SEQ ID NO: 3235647 - RNA, 12 nt, Mycobacterium leprae
agccgugcagcc

SEQ ID NO: 3235648 - RNA, 15 nt, Mycobacterium leprae
agccgugcagccuca

SEQ ID NO: 3235649 - RNA, 19 nt, Mycobacterium leprae
agccguggggcucggccag

SEQ ID NO: 3235650 - RNA, 20 nt, Mycobacterium leprae
agccguucggguugcgguca

SEQ ID NO: 3235651 - RNA, 21 nt, Mycobacterium leprae
agccguuggcuuguguggugu

SEQ ID NO: 3235652 - RNA, 23 nt, Mycobacterium leprae
agccuagacugacccaagcgcca

SEQ ID NO: 3235653 - RNA, 13 nt, Mycobacterium leprae
agccuaugcggcc

SEQ ID NO: 3235654 - RNA, 20 nt, Mycobacterium leprae
agccuaugcggccagccagg

SEQ ID NO: 3235655 - RNA, 19 nt, Mycobacterium leprae
agccucaucgaaagcaggc

SEQ ID NO: 3235656 - RNA, 22 nt, Mycobacterium leprae
agccucggcgcuagugaauuca

SEQ ID NO: 3235657 - RNA, 20 nt, Mycobacterium leprae
agccucggucauaacaugau

SEQ ID NO: 3235658 - RNA, 21 nt, Mycobacterium leprae
agccugcacuuuacgugcgua

SEQ ID NO: 3235659 - RNA, 13 nt, Mycobacterium leprae
agccugcuuccaa

SEQ ID NO: 3235660 - RNA, 15 nt, Mycobacterium leprae
agccuguugcaagcg

SEQ ID NO: 3235661 - RNA, 17 nt, Mycobacterium leprae
agccuguuguugugccu

SEQ ID NO: 3235662 - RNA, 23 nt, Mycobacterium leprae
agccuguuguugugccuucugca

SEQ ID NO: 3235663 - RNA, 17 nt, Mycobacterium leprae
agcgaaaaugaaaacaa

SEQ ID NO: 3235664 - RNA, 22 nt, Mycobacterium leprae
agcgaacacacaggucauccuu

SEQ ID NO: 3235665 - RNA, 20 nt, Mycobacterium leprae
agcgaagaguuucugcugcc

SEQ ID NO: 3235666 - RNA, 19 nt, Mycobacterium leprae
agcgacacagccggccggc

SEQ ID NO: 3235667 - RNA, 11 nt, Mycobacterium leprae
agcgacaggca

SEQ ID NO: 3235668 - RNA, 18 nt, Mycobacterium leprae
agcgaccggaugaacacg

SEQ ID NO: 3235669 - RNA, 15 nt, Mycobacterium leprae
agcgaccggccagug

SEQ ID NO: 3235670 - RNA, 19 nt, Mycobacterium leprae
agcgacggaucuguaggga

SEQ ID NO: 3235671 - RNA, 21 nt, Mycobacterium leprae
agcgacuucgaugcgaugcgc

SEQ ID NO: 3235672 - RNA, 19 nt, Mycobacterium leprae
agcgagaaucccaguguau

SEQ ID NO: 3235673 - RNA, 20 nt, Mycobacterium leprae
agcgagccaucgcaauuaac

SEQ ID NO: 3235674 - RNA, 12 nt, Mycobacterium leprae
agcgagcucgag

SEQ ID NO: 3235675 - RNA, 16 nt, Mycobacterium leprae
agcgaucgacccaagc

SEQ ID NO: 3235676 - RNA, 15 nt, Mycobacterium leprae
agcgaugacauggaa

SEQ ID NO: 3235677 - RNA, 18 nt, Mycobacterium leprae
agcgaugggugaaucgcu

SEQ ID NO: 3235678 - RNA, 23 nt, Mycobacterium leprae
agcgaugugugcaggaccgugcu

SEQ ID NO: 3235679 - RNA, 14 nt, Mycobacterium leprae
agcgauucgggaga

SEQ ID NO: 3235680 - RNA, 12 nt, Mycobacterium leprae
agcgauuuggac

SEQ ID NO: 3235681 - RNA, 23 nt, Mycobacterium leprae
agcgcacacguacucuggugaau

SEQ ID NO: 3235682 - RNA, 15 nt, Mycobacterium leprae
agcgcaccgcggauc

SEQ ID NO: 3235683 - RNA, 17 nt, Mycobacterium leprae
agcgcagcaugguggcc

SEQ ID NO: 3235684 - RNA, 21 nt, Mycobacterium leprae
agcgcagugugcuuucggcuc

SEQ ID NO: 3235685 - RNA, 14 nt, Mycobacterium leprae
agcgccaccaugcg

SEQ ID NO: 3235686 - RNA, 17 nt, Mycobacterium leprae
agcgccacgccggacug

SEQ ID NO: 3235687 - RNA, 13 nt, Mycobacterium leprae
agcgcccgcacag

SEQ ID NO: 3235688 - RNA, 22 nt, Mycobacterium leprae
agcgcccgcacagcaccaugga

SEQ ID NO: 3235689 - RNA, 12 nt, Mycobacterium leprae
agcgccgcgggg

SEQ ID NO: 3235690 - RNA, 14 nt, Mycobacterium leprae
agcgccgcuguuca

SEQ ID NO: 3235691 - RNA, 14 nt, Mycobacterium leprae
agcgccucaccaaa

SEQ ID NO: 3235692 - RNA, 15 nt, Mycobacterium leprae
agcgcgauguuggaa

SEQ ID NO: 3235693 - RNA, 15 nt, Mycobacterium leprae
agcgcgguucgccac

SEQ ID NO: 3235694 - RNA, 18 nt, Mycobacterium leprae
agcgcuaugccauccacc

SEQ ID NO: 3235695 - RNA, 19 nt, Mycobacterium leprae
agcgcuaugccauccaccg

SEQ ID NO: 3235696 - RNA, 23 nt, Mycobacterium leprae
agcgcuaugccauccaccgccga

SEQ ID NO: 3235697 - RNA, 18 nt, Mycobacterium leprae
agcgcuauuaagucggcu

SEQ ID NO: 3235698 - RNA, 11 nt, Mycobacterium leprae
agcgcugaucc

SEQ ID NO: 3235699 - RNA, 19 nt, Mycobacterium leprae
agcgcugauccucucccga

SEQ ID NO: 3235700 - RNA, 14 nt, Mycobacterium leprae
agcgcugcgcagcg

SEQ ID NO: 3235701 - RNA, 12 nt, Mycobacterium leprae
agcgcugugauu

SEQ ID NO: 3235702 - RNA, 16 nt, Mycobacterium leprae
agcggaauaucggaga

SEQ ID NO: 3235703 - RNA, 19 nt, Mycobacterium leprae
agcggaccugcgagaucgg

SEQ ID NO: 3235704 - RNA, 20 nt, Mycobacterium leprae
agcggacguacaguggugau

SEQ ID NO: 3235705 - RNA, 15 nt, Mycobacterium leprae
agcggcagagcccgg

SEQ ID NO: 3235706 - RNA, 17 nt, Mycobacterium leprae
agcggcagcggcggccg

SEQ ID NO: 3235707 - RNA, 21 nt, Mycobacterium leprae
agcggcgcaugccaaccugug

SEQ ID NO: 3235708 - RNA, 23 nt, Mycobacterium leprae
agcggcgcaugccaaccugugca

SEQ ID NO: 3235709 - RNA, 13 nt, Mycobacterium leprae
agcgggcggggcg

SEQ ID NO: 3235710 - RNA, 15 nt, Mycobacterium leprae
agcgguaacuggcuc

SEQ ID NO: 3235711 - RNA, 12 nt, Mycobacterium leprae
agcggucaguuu

SEQ ID NO: 3235712 - RNA, 13 nt, Mycobacterium leprae
agcgguccaggcc

SEQ ID NO: 3235713 - RNA, 17 nt, Mycobacterium leprae
agcggucgcagcgcauu

SEQ ID NO: 3235714 - RNA, 19 nt, Mycobacterium leprae
agcggugguacaaucccac

SEQ ID NO: 3235715 - RNA, 22 nt, Mycobacterium leprae
agcggugguacaaucccaccac

SEQ ID NO: 3235716 - RNA, 22 nt, Mycobacterium leprae
agcguaguagcuuucccugcga

SEQ ID NO: 3235717 - RNA, 16 nt, Mycobacterium leprae
agcgucaccaagcgca

SEQ ID NO: 3235718 - RNA, 19 nt, Mycobacterium leprae
agcgucccaaccaaucucc

SEQ ID NO: 3235719 - RNA, 20 nt, Mycobacterium leprae
agcgucccaaccaaucuccg

SEQ ID NO: 3235720 - RNA, 20 nt, Mycobacterium leprae
agcgucgcucacggccacca

SEQ ID NO: 3235721 - RNA, 13 nt, Mycobacterium leprae
agcgucgugaccg

SEQ ID NO: 3235722 - RNA, 13 nt, Mycobacterium leprae
agcgugaauuacu

SEQ ID NO: 3235723 - RNA, 22 nt, Mycobacterium leprae
agcguggucaccgcuguggcag

SEQ ID NO: 3235724 - RNA, 23 nt, Mycobacterium leprae
agcguggucaccgcuguggcaga

SEQ ID NO: 3235725 - RNA, 23 nt, Mycobacterium leprae
agcguucgauaacaguggucugg

SEQ ID NO: 3235726 - RNA, 15 nt, Mycobacterium leprae
agcuaaacagcaauu

SEQ ID NO: 3235727 - RNA, 13 nt, Mycobacterium leprae
agcuaaucccaug

SEQ ID NO: 3235728 - RNA, 16 nt, Mycobacterium leprae
agcuaaucccauggga

SEQ ID NO: 3235729 - RNA, 19 nt, Mycobacterium leprae
agcuacguggucugaagug

SEQ ID NO: 3235730 - RNA, 18 nt, Mycobacterium leprae
agcuauagggcacgcugu

SEQ ID NO: 3235731 - RNA, 18 nt, Mycobacterium leprae
agcucaauuggcagagca

SEQ ID NO: 3235732 - RNA, 18 nt, Mycobacterium leprae
agcucagcaacuuuccug

SEQ ID NO: 3235733 - RNA, 21 nt, Mycobacterium leprae
agcucagcaacuuuccugacc

SEQ ID NO: 3235734 - RNA, 22 nt, Mycobacterium leprae
agcuccauuuuucuugaaaaau

SEQ ID NO: 3235735 - RNA, 17 nt, Mycobacterium leprae
agcucgacgggcggcac

SEQ ID NO: 3235736 - RNA, 18 nt, Mycobacterium leprae
agcucgauggugccauug

SEQ ID NO: 3235737 - RNA, 22 nt, Mycobacterium leprae
agcucgauggugccauuggugg

SEQ ID NO: 3235738 - RNA, 19 nt, Mycobacterium leprae
agcucgcccggacgugcac

SEQ ID NO: 3235739 - RNA, 15 nt, Mycobacterium leprae
agcucggcaucggcc

SEQ ID NO: 3235740 - RNA, 20 nt, Mycobacterium leprae
agcucguuggguaucagcgc

SEQ ID NO: 3235741 - RNA, 21 nt, Mycobacterium leprae
agcucuccggcuaucaggauc

SEQ ID NO: 3235742 - RNA, 16 nt, Mycobacterium leprae
agcucucgaggauuau

SEQ ID NO: 3235743 - RNA, 23 nt, Mycobacterium leprae
agcucucgaggauuaucgccggc

SEQ ID NO: 3235744 - RNA, 15 nt, Mycobacterium leprae
agcucuucucgcaga

SEQ ID NO: 3235745 - RNA, 20 nt, Mycobacterium leprae
agcugcaggccaccguugga

SEQ ID NO: 3235746 - RNA, 16 nt, Mycobacterium leprae
agcugcaucggcaggc

SEQ ID NO: 3235747 - RNA, 12 nt, Mycobacterium leprae
agcugccaagcu

SEQ ID NO: 3235748 - RNA, 13 nt, Mycobacterium leprae
agcugcccggcga

SEQ ID NO: 3235749 - RNA, 21 nt, Mycobacterium leprae
agcugcccggcgaacaugacg

SEQ ID NO: 3235750 - RNA, 18 nt, Mycobacterium leprae
agcugcccgugcucagug

SEQ ID NO: 3235751 - RNA, 19 nt, Mycobacterium leprae
agcugcccuacacucaacu

SEQ ID NO: 3235752 - RNA, 23 nt, Mycobacterium leprae
agcugccggugaccgggccggcc

SEQ ID NO: 3235753 - RNA, 14 nt, Mycobacterium leprae
agcugcgacaacac

SEQ ID NO: 3235754 - RNA, 19 nt, Mycobacterium leprae
agcugcgagucucacccac

SEQ ID NO: 3235755 - RNA, 19 nt, Mycobacterium leprae
agcugcugagcguggcugc

SEQ ID NO: 3235756 - RNA, 13 nt, Mycobacterium leprae
agcuggccaagcg

SEQ ID NO: 3235757 - RNA, 19 nt, Mycobacterium leprae
agcuggccggggccaagcu

SEQ ID NO: 3235758 - RNA, 16 nt, Mycobacterium leprae
agcuggcgaacaacaa

SEQ ID NO: 3235759 - RNA, 17 nt, Mycobacterium leprae
agcuggcgaacaacaaa

SEQ ID NO: 3235760 - RNA, 14 nt, Mycobacterium leprae
agcuggggcggccg

SEQ ID NO: 3235761 - RNA, 19 nt, Mycobacterium leprae
agcuggggcggccgccggc

SEQ ID NO: 3235762 - RNA, 21 nt, Mycobacterium leprae
agcuggguaccgaugugcugg

SEQ ID NO: 3235763 - RNA, 19 nt, Mycobacterium leprae
agcuggugcuggcgucguu

SEQ ID NO: 3235764 - RNA, 19 nt, Mycobacterium leprae
agcuguccaaugucagguc

SEQ ID NO: 3235765 - RNA, 15 nt, Mycobacterium leprae
agcugugagugugca

SEQ ID NO: 3235766 - RNA, 22 nt, Mycobacterium leprae
agcugugcacgugcaaacugcu

SEQ ID NO: 3235767 - RNA, 21 nt, Mycobacterium leprae
agcuguuacgaggacucccuu

SEQ ID NO: 3235768 - RNA, 15 nt, Mycobacterium leprae
agcuguugcuuguug

SEQ ID NO: 3235769 - RNA, 16 nt, Mycobacterium leprae
agcuguugugaagcug

SEQ ID NO: 3235770 - RNA, 11 nt, Mycobacterium leprae
agcuucugguc

SEQ ID NO: 3235771 - RNA, 14 nt, Mycobacterium leprae
agcuugaaguguug

SEQ ID NO: 3235772 - RNA, 16 nt, Mycobacterium leprae
agcuuguauugcuuag

SEQ ID NO: 3235773 - RNA, 14 nt, Mycobacterium leprae
agcuugugcuccug

SEQ ID NO: 3235774 - RNA, 20 nt, Mycobacterium leprae
aggaaaagauaaucgcccug

SEQ ID NO: 3235775 - RNA, 20 nt, Mycobacterium leprae
aggaaaccuuccggcgguca

SEQ ID NO: 3235776 - RNA, 21 nt, Mycobacterium leprae
aggaacgacggauaaguccac

SEQ ID NO: 3235777 - RNA, 11 nt, Mycobacterium leprae
aggacaaaguc

SEQ ID NO: 3235778 - RNA, 15 nt, Mycobacterium leprae
aggacaacagagcac

SEQ ID NO: 3235779 - RNA, 20 nt, Mycobacterium leprae
aggaccaaccgcgcagcaca

SEQ ID NO: 3235780 - RNA, 15 nt, Mycobacterium leprae
aggaccggugcugca

SEQ ID NO: 3235781 - RNA, 22 nt, Mycobacterium leprae
aggaccgugcuauccgcugaua

SEQ ID NO: 3235782 - RNA, 18 nt, Mycobacterium leprae
aggacgauuugcgggccc

SEQ ID NO: 3235783 - RNA, 17 nt, Mycobacterium leprae
aggacgggcggccaggc

SEQ ID NO: 3235784 - RNA, 15 nt, Mycobacterium leprae
aggacucgguuggcu

SEQ ID NO: 3235785 - RNA, 16 nt, Mycobacterium leprae
aggagaggcagggcug

SEQ ID NO: 3235786 - RNA, 14 nt, Mycobacterium leprae
aggagccgaggcac

SEQ ID NO: 3235787 - RNA, 16 nt, Mycobacterium leprae
aggagcgcgcgcgccc

SEQ ID NO: 3235788 - RNA, 20 nt, Mycobacterium leprae
aggagcggugguacaauccc

SEQ ID NO: 3235789 - RNA, 22 nt, Mycobacterium leprae
aggagcggugguacaaucccac

SEQ ID NO: 3235790 - RNA, 21 nt, Mycobacterium leprae
aggagcuacuuuucgugcugc

SEQ ID NO: 3235791 - RNA, 15 nt, Mycobacterium leprae
aggaguguugcagug

SEQ ID NO: 3235792 - RNA, 23 nt, Mycobacterium leprae
aggaguugacaaagaaaaagagc

SEQ ID NO: 3235793 - RNA, 17 nt, Mycobacterium leprae
aggaguuuuucagcgga

SEQ ID NO: 3235794 - RNA, 19 nt, Mycobacterium leprae
aggauaggcgccguuucuu

SEQ ID NO: 3235795 - RNA, 13 nt, Mycobacterium leprae
aggauauggcaga

SEQ ID NO: 3235796 - RNA, 21 nt, Mycobacterium leprae
aggaucgagcggagcugggcg

SEQ ID NO: 3235797 - RNA, 15 nt, Mycobacterium leprae
aggaugacacugcgg

SEQ ID NO: 3235798 - RNA, 12 nt, Mycobacterium leprae
aggauggcgacg

SEQ ID NO: 3235799 - RNA, 15 nt, Mycobacterium leprae
aggauggcgacgucg

SEQ ID NO: 3235800 - RNA, 20 nt, Mycobacterium leprae
aggauuagcccgaccgacca

SEQ ID NO: 3235801 - RNA, 15 nt, Mycobacterium leprae
aggauuugcacgaau

SEQ ID NO: 3235802 - RNA, 13 nt, Mycobacterium leprae
aggcaaccaagau

SEQ ID NO: 3235803 - RNA, 12 nt, Mycobacterium leprae
aggcaccuggaa

SEQ ID NO: 3235804 - RNA, 19 nt, Mycobacterium leprae
aggcacguccccgugcacg

SEQ ID NO: 3235805 - RNA, 14 nt, Mycobacterium leprae
aggcagcagcucga

SEQ ID NO: 3235806 - RNA, 16 nt, Mycobacterium leprae
aggcagcgacgugccg

SEQ ID NO: 3235807 - RNA, 14 nt, Mycobacterium leprae
aggcagcgccugcc

SEQ ID NO: 3235808 - RNA, 15 nt, Mycobacterium leprae
aggcagcgccugccc

SEQ ID NO: 3235809 - RNA, 14 nt, Mycobacterium leprae
aggcaggaucugcu

SEQ ID NO: 3235810 - RNA, 13 nt, Mycobacterium leprae
aggcauaauacaa

SEQ ID NO: 3235811 - RNA, 17 nt, Mycobacterium leprae
aggcauacagugcaccg

SEQ ID NO: 3235812 - RNA, 14 nt, Mycobacterium leprae
aggcaugaaccuca

SEQ ID NO: 3235813 - RNA, 19 nt, Mycobacterium leprae
aggcaugaaccucacccag

SEQ ID NO: 3235814 - RNA, 16 nt, Mycobacterium leprae
aggcaugccgccgggu

SEQ ID NO: 3235815 - RNA, 14 nt, Mycobacterium leprae
aggcauuaagaugu

SEQ ID NO: 3235816 - RNA, 16 nt, Mycobacterium leprae
aggcauuaagauguua

SEQ ID NO: 3235817 - RNA, 21 nt, Mycobacterium leprae
aggccacugggcugagccgcc

SEQ ID NO: 3235818 - RNA, 21 nt, Mycobacterium leprae
aggccagcgcacccauccgau

SEQ ID NO: 3235819 - RNA, 15 nt, Mycobacterium leprae
aggccaggcagcgcc

SEQ ID NO: 3235820 - RNA, 22 nt, Mycobacterium leprae
aggccgacuucggcaacggcgu

SEQ ID NO: 3235821 - RNA, 22 nt, Mycobacterium leprae
aggccggcagggugcgugacaa

SEQ ID NO: 3235822 - RNA, 13 nt, Mycobacterium leprae
aggccggccugga

SEQ ID NO: 3235823 - RNA, 14 nt, Mycobacterium leprae
aggccggccuggaa

SEQ ID NO: 3235824 - RNA, 21 nt, Mycobacterium leprae
aggccggugcuuaccgagauu

SEQ ID NO: 3235825 - RNA, 22 nt, Mycobacterium leprae
aggccguggacgaacuggguga

SEQ ID NO: 3235826 - RNA, 15 nt, Mycobacterium leprae
aggccuagcuggcag

SEQ ID NO: 3235827 - RNA, 16 nt, Mycobacterium leprae
aggccuagcuggcagu

SEQ ID NO: 3235828 - RNA, 16 nt, Mycobacterium leprae
aggccugguucuggau

SEQ ID NO: 3235829 - RNA, 17 nt, Mycobacterium leprae
aggccuugggugguggu

SEQ ID NO: 3235830 - RNA, 14 nt, Mycobacterium leprae
aggcgaagagcggc

SEQ ID NO: 3235831 - RNA, 13 nt, Mycobacterium leprae
aggcgaauugcua

SEQ ID NO: 3235832 - RNA, 23 nt, Mycobacterium leprae
aggcgauaucgaugcaggcguga

SEQ ID NO: 3235833 - RNA, 18 nt, Mycobacterium leprae
aggcgccgcagcaucugu

SEQ ID NO: 3235834 - RNA, 20 nt, Mycobacterium leprae
aggcgccugaaguugaguag

SEQ ID NO: 3235835 - RNA, 14 nt, Mycobacterium leprae
aggcggauggggca

SEQ ID NO: 3235836 - RNA, 21 nt, Mycobacterium leprae
aggcggccacgugcacaucag

SEQ ID NO: 3235837 - RNA, 16 nt, Mycobacterium leprae
aggcggugaccgaacu

SEQ ID NO: 3235838 - RNA, 14 nt, Mycobacterium leprae
aggcggugacugaa

SEQ ID NO: 3235839 - RNA, 13 nt, Mycobacterium leprae
aggcgugagugug

SEQ ID NO: 3235840 - RNA, 20 nt, Mycobacterium leprae
aggcucacccaccgugcauc

SEQ ID NO: 3235841 - RNA, 14 nt, Mycobacterium leprae
aggcugagccauuu

SEQ ID NO: 3235842 - RNA, 15 nt, Mycobacterium leprae
aggcugggcaccacc

SEQ ID NO: 3235843 - RNA, 23 nt, Mycobacterium leprae
aggcuguccuugccggcgccgcu

SEQ ID NO: 3235844 - RNA, 17 nt, Mycobacterium leprae
aggcuucgucacauaau

SEQ ID NO: 3235845 - RNA, 16 nt, Mycobacterium leprae
agggauuccacugcca

SEQ ID NO: 3235846 - RNA, 16 nt, Mycobacterium leprae
agggcaauacgcugcc

SEQ ID NO: 3235847 - RNA, 21 nt, Mycobacterium leprae
agggccgaaacuaaauccggg

SEQ ID NO: 3235848 - RNA, 23 nt, Mycobacterium leprae
agggccggucaacaagccgccga

SEQ ID NO: 3235849 - RNA, 15 nt, Mycobacterium leprae
agggcgauucgagcc

SEQ ID NO: 3235850 - RNA, 20 nt, Mycobacterium leprae
agggcgccgauuuggggguc

SEQ ID NO: 3235851 - RNA, 15 nt, Mycobacterium leprae
agggcggggaaguca

SEQ ID NO: 3235852 - RNA, 14 nt, Mycobacterium leprae
aggggacuggauau

SEQ ID NO: 3235853 - RNA, 21 nt, Mycobacterium leprae
aggggguuaccugggccaggg

SEQ ID NO: 3235854 - RNA, 22 nt, Mycobacterium leprae
agggguccugaccgccugugcu

SEQ ID NO: 3235855 - RNA, 16 nt, Mycobacterium leprae
aggguccggaccugga

SEQ ID NO: 3235856 - RNA, 18 nt, Mycobacterium leprae
agucuucaauccgcgcau

SEQ ID NO: 3235857 - RNA, 17 nt, Mycobacterium leprae
agucuugaugccaaccu

SEQ ID NO: 3235858 - RNA, 16 nt, Mycobacterium leprae
agucuuggacaucacu

SEQ ID NO: 3235859 - RNA, 15 nt, Mycobacterium leprae
agugaccaaaauuua

SEQ ID NO: 3235860 - RNA, 21 nt, Mycobacterium leprae
agugaccgaugcucgcccucg

SEQ ID NO: 3235861 - RNA, 14 nt, Mycobacterium leprae
agugacgucggagu

SEQ ID NO: 3235862 - RNA, 11 nt, Mycobacterium leprae
agugacugcgu

SEQ ID NO: 3235863 - RNA, 23 nt, Mycobacterium leprae
agugagcucaccggcggcgagca

SEQ ID NO: 3235864 - RNA, 18 nt, Mycobacterium leprae
agugaucagguggagcaa

SEQ ID NO: 3235865 - RNA, 18 nt, Mycobacterium leprae
agugaucgccgaugcuga

SEQ ID NO: 3235866 - RNA, 18 nt, Mycobacterium leprae
agugaucugcucggcgaa

SEQ ID NO: 3235867 - RNA, 13 nt, Mycobacterium leprae
agugauggcggaa

SEQ ID NO: 3235868 - RNA, 14 nt, Mycobacterium leprae
agugcaccaucugc

SEQ ID NO: 3235869 - RNA, 13 nt, Mycobacterium leprae
agugcagaucacc

SEQ ID NO: 3235870 - RNA, 24 nt, Mycobacterium leprae
agugcagcacaagacuucacucac

SEQ ID NO: 3235871 - RNA, 16 nt, Mycobacterium leprae
agugccaaacgacaug

SEQ ID NO: 3235872 - RNA, 13 nt, Mycobacterium leprae
agugccaccgcug

SEQ ID NO: 3235873 - RNA, 16 nt, Mycobacterium leprae
agugccacgguggccu

SEQ ID NO: 3235874 - RNA, 15 nt, Mycobacterium leprae
agugccguaaaucgu

SEQ ID NO: 3235875 - RNA, 22 nt, Mycobacterium leprae
agugccuugggcacggagcggc

SEQ ID NO: 3235876 - RNA, 18 nt, Mycobacterium leprae
agugcggcgcccagcacc

SEQ ID NO: 3235877 - RNA, 15 nt, Mycobacterium leprae
agugcuagcggcgcc

SEQ ID NO: 3235878 - RNA, 21 nt, Mycobacterium leprae
agugcucgggugguccggguu

SEQ ID NO: 3235879 - RNA, 17 nt, Mycobacterium leprae
agugcugacgccgggca

SEQ ID NO: 3235880 - RNA, 22 nt, Mycobacterium leprae
agugcugacgccgggcacuugg

SEQ ID NO: 3235881 - RNA, 22 nt, Mycobacterium leprae
agugcugcugcggcgccugcau

SEQ ID NO: 3235882 - RNA, 16 nt, Mycobacterium leprae
agugcugcugugguug

SEQ ID NO: 3235883 - RNA, 14 nt, Mycobacterium leprae
agugcuucccuuga

SEQ ID NO: 3235884 - RNA, 15 nt, Mycobacterium leprae
aguggaauaacagag

SEQ ID NO: 3235885 - RNA, 17 nt, Mycobacterium leprae
aguggacuuuucugcac

SEQ ID NO: 3235886 - RNA, 16 nt, Mycobacterium leprae
aguggauuaccaccgc

SEQ ID NO: 3235887 - RNA, 21 nt, Mycobacterium leprae
aguggcugaugucuuggcuga

SEQ ID NO: 3235888 - RNA, 13 nt, Mycobacterium leprae
aguggcuuuaaag

SEQ ID NO: 3235889 - RNA, 15 nt, Mycobacterium leprae
agugggcccucacgu

SEQ ID NO: 3235890 - RNA, 21 nt, Mycobacterium leprae
agugggggugcggcagcugcc

SEQ ID NO: 3235891 - RNA, 19 nt, Mycobacterium leprae
agugggugaaacccuucac

SEQ ID NO: 3235892 - RNA, 18 nt, Mycobacterium leprae
aguggucacacugguggu

SEQ ID NO: 3235893 - RNA, 19 nt, Mycobacterium leprae
aguggucacacugguggug

SEQ ID NO: 3235894 - RNA, 16 nt, Mycobacterium leprae
agugguucgauucugc

SEQ ID NO: 3235895 - RNA, 23 nt, Mycobacterium leprae
agugguucugcuucgauguguug

SEQ ID NO: 3235896 - RNA, 13 nt, Mycobacterium leprae
agugucagcagca

SEQ ID NO: 3235897 - RNA, 14 nt, Mycobacterium leprae
agugucagcagcag

SEQ ID NO: 3235898 - RNA, 14 nt, Mycobacterium leprae
agugucccuguccu

SEQ ID NO: 3235899 - RNA, 13 nt, Mycobacterium leprae
agugucggguggu

SEQ ID NO: 3235900 - RNA, 20 nt, Mycobacterium leprae
agugugcaggcagcgacgug

SEQ ID NO: 3235901 - RNA, 23 nt, Mycobacterium leprae
agugugcugcauccgacaaagca

SEQ ID NO: 3235902 - RNA, 14 nt, Mycobacterium leprae
aguguuccgggcug

SEQ ID NO: 3235903 - RNA, 22 nt, Mycobacterium leprae
aguguucgcauuccggcccucg

SEQ ID NO: 3235904 - RNA, 23 nt, Mycobacterium leprae
aguguuggcuuucaguuuccgcc

SEQ ID NO: 3235905 - RNA, 16 nt, Mycobacterium leprae
aguguuuccacaccga

SEQ ID NO: 3235906 - RNA, 18 nt, Mycobacterium leprae
aguguuuccacaccgacu

SEQ ID NO: 3235907 - RNA, 23 nt, Mycobacterium leprae
aguuagaggguccggaccuggac

SEQ ID NO: 3235908 - RNA, 16 nt, Mycobacterium leprae
aguuagcaugagcugc

SEQ ID NO: 3235909 - RNA, 19 nt, Mycobacterium leprae
aguuagcaugagcugcugg

SEQ ID NO: 3235910 - RNA, 15 nt, Mycobacterium leprae
aguucaacaaaacca

SEQ ID NO: 3235911 - RNA, 16 nt, Mycobacterium leprae
aguucaacaaaaccau

SEQ ID NO: 3235912 - RNA, 17 nt, Mycobacterium leprae
aguucagcugcuuuacc

SEQ ID NO: 3235913 - RNA, 18 nt, Mycobacterium leprae
aguuccuguguugccauc

SEQ ID NO: 3235914 - RNA, 13 nt, Mycobacterium leprae
aguucggccaugg

SEQ ID NO: 3235915 - RNA, 23 nt, Mycobacterium leprae
aguugaacgcguugcucgacgcg

SEQ ID NO: 3235916 - RNA, 21 nt, Mycobacterium leprae
aguugauccgucgcguugagg

SEQ ID NO: 3235917 - RNA, 21 nt, Mycobacterium leprae
aguuggauucgguguugcugg

SEQ ID NO: 3235918 - RNA, 19 nt, Mycobacterium leprae
aguuguaagugcaguuccu

SEQ ID NO: 3235919 - RNA, 19 nt, Mycobacterium leprae
aguuguguuccgguuccag

SEQ ID NO: 3235920 - RNA, 11 nt, Mycobacterium leprae
aguuguucggu

SEQ ID NO: 3235921 - RNA, 14 nt, Mycobacterium leprae
aguuguugcacaag

SEQ ID NO: 3235922 - RNA, 13 nt, Mycobacterium leprae
aguuuaccgugcc

SEQ ID NO: 3235923 - RNA, 14 nt, Mycobacterium leprae
aguuuagagugcag

SEQ ID NO: 3235924 - RNA, 18 nt, Mycobacterium leprae
aguuuccgccguucuccc

SEQ ID NO: 3235925 - RNA, 14 nt, Mycobacterium leprae
aguuuggcugacac

SEQ ID NO: 3235926 - RNA, 19 nt, Mycobacterium leprae
aguuuucagccacauugcc

SEQ ID NO: 3235927 - RNA, 14 nt, Mycobacterium leprae
aguuuucucuaaaa

SEQ ID NO: 3235928 - RNA, 14 nt, Mycobacterium leprae
aguuuuuguuccua

SEQ ID NO: 3235929 - RNA, 20 nt, Mycobacterium leprae
auaaaauuuaaaaauuuguu

SEQ ID NO: 3235930 - RNA, 15 nt, Mycobacterium leprae
auaaacaucgaguga

SEQ ID NO: 3235931 - RNA, 15 nt, Mycobacterium leprae
auaaauaguauuauu

SEQ ID NO: 3235932 - RNA, 16 nt, Mycobacterium leprae
auaaauuauaaaguua

SEQ ID NO: 3235933 - RNA, 20 nt, Mycobacterium leprae
auaaccuuugcccugcgcgg

SEQ ID NO: 3235934 - RNA, 22 nt, Mycobacterium leprae
auaacguacccgcgagcagcgg

SEQ ID NO: 3235935 - RNA, 17 nt, Mycobacterium leprae
auaacguugcagcgacg

SEQ ID NO: 3235936 - RNA, 16 nt, Mycobacterium leprae
auaagauaaauaguau

SEQ ID NO: 3235937 - RNA, 18 nt, Mycobacterium leprae
auaauauacuugacugcc

SEQ ID NO: 3235938 - RNA, 13 nt, Mycobacterium leprae
auaauauccaaag

SEQ ID NO: 3235939 - RNA, 20 nt, Mycobacterium leprae
auaaucccacucuugacuaa

SEQ ID NO: 3235940 - RNA, 18 nt, Mycobacterium leprae
auacacgcggacagauuc

SEQ ID NO: 3235941 - RNA, 21 nt, Mycobacterium leprae
auacagccucucgacaaagaa

SEQ ID NO: 3235942 - RNA, 14 nt, Mycobacterium leprae
auacagguggcauc

SEQ ID NO: 3235943 - RNA, 23 nt, Mycobacterium leprae
auacagguggcaucagauauccu

SEQ ID NO: 3235944 - RNA, 21 nt, Mycobacterium leprae
auacccccugucuaucacauc

SEQ ID NO: 3235945 - RNA, 18 nt, Mycobacterium leprae
auaccggcgaaucggucu

SEQ ID NO: 3235946 - RNA, 20 nt, Mycobacterium leprae
auaccggugaugucggcguc

SEQ ID NO: 3235947 - RNA, 19 nt, Mycobacterium leprae
auaccguggucggugccga

SEQ ID NO: 3235948 - RNA, 14 nt, Mycobacterium leprae
auaccguuuacugu

SEQ ID NO: 3235949 - RNA, 18 nt, Mycobacterium leprae
auacgguuauugacguga

SEQ ID NO: 3235950 - RNA, 17 nt, Mycobacterium leprae
auacugaugggcagcac

SEQ ID NO: 3235951 - RNA, 21 nt, Mycobacterium leprae
auacugaugugcugagagcag

SEQ ID NO: 3235952 - RNA, 22 nt, Mycobacterium leprae
auacugcaauccguggagagca

SEQ ID NO: 3235953 - RNA, 17 nt, Mycobacterium leprae
auagaacaccgaagcug

SEQ ID NO: 3235954 - RNA, 21 nt, Mycobacterium leprae
auagaacauccgcagcauggu

SEQ ID NO: 3235955 - RNA, 16 nt, Mycobacterium leprae
auagaagacagucuga

SEQ ID NO: 3235956 - RNA, 14 nt, Mycobacterium leprae
auagacucgaucgu

SEQ ID NO: 3235957 - RNA, 21 nt, Mycobacterium leprae
auagccgugaccgacagcucg

SEQ ID NO: 3235958 - RNA, 20 nt, Mycobacterium leprae
auagcgaaaauaacuauaau

SEQ ID NO: 3235959 - RNA, 15 nt, Mycobacterium leprae
auagcgacuguugug

SEQ ID NO: 3235960 - RNA, 14 nt, Mycobacterium leprae
auagcugugcagga

SEQ ID NO: 3235961 - RNA, 13 nt, Mycobacterium leprae
auagcuugcaguu

SEQ ID NO: 3235962 - RNA, 14 nt, Mycobacterium leprae
auagggcacgcugu

SEQ ID NO: 3235963 - RNA, 14 nt, Mycobacterium leprae
auaguauaaggugc

SEQ ID NO: 3235964 - RNA, 17 nt, Mycobacterium leprae
auagucagaucaaccaa

SEQ ID NO: 3235965 - RNA, 16 nt, Mycobacterium leprae
auagucccuugaugua

SEQ ID NO: 3235966 - RNA, 16 nt, Mycobacterium leprae
auaguggcugaugucu

SEQ ID NO: 3235967 - RNA, 21 nt, Mycobacterium leprae
auaguuguuagcgccgcgggg

SEQ ID NO: 3235968 - RNA, 22 nt, Mycobacterium leprae
auauaagcgaaguccuugcugg

SEQ ID NO: 3235969 - RNA, 13 nt, Mycobacterium leprae
aucgacggcagcg

SEQ ID NO: 3235970 - RNA, 15 nt, Mycobacterium leprae
aucgacggcagcgcu

SEQ ID NO: 3235971 - RNA, 15 nt, Mycobacterium leprae
aucgacggccgcaca

SEQ ID NO: 3235972 - RNA, 14 nt, Mycobacterium leprae
aucgagcggagcug

SEQ ID NO: 3235973 - RNA, 13 nt, Mycobacterium leprae
aucgaggccagcc

SEQ ID NO: 3235974 - RNA, 12 nt, Mycobacterium leprae
aucgaggugagc

SEQ ID NO: 3235975 - RNA, 15 nt, Mycobacterium leprae
aucgaggugagcaga

SEQ ID NO: 3235976 - RNA, 18 nt, Mycobacterium leprae
aucgaguccaagcucaac

SEQ ID NO: 3235977 - RNA, 16 nt, Mycobacterium leprae
aucgauaagcagcagc

SEQ ID NO: 3235978 - RNA, 22 nt, Mycobacterium leprae
aucgaucccacugacgccgauu

SEQ ID NO: 3235979 - RNA, 17 nt, Mycobacterium leprae
aucgaugcacuguucac

SEQ ID NO: 3235980 - RNA, 23 nt, Mycobacterium leprae
aucgaugcuugcucuagccgggc

SEQ ID NO: 3235981 - RNA, 17 nt, Mycobacterium leprae
aucgcaccgauccggcg

SEQ ID NO: 3235982 - RNA, 15 nt, Mycobacterium leprae
aucgcaccggcugca

SEQ ID NO: 3235983 - RNA, 13 nt, Mycobacterium leprae
aucgcagcccaga

SEQ ID NO: 3235984 - RNA, 19 nt, Mycobacterium leprae
aucgcaggcaccacaaaca

SEQ ID NO: 3235985 - RNA, 14 nt, Mycobacterium leprae
aucgcagucaucac

SEQ ID NO: 3235986 - RNA, 14 nt, Mycobacterium leprae
aucgcccaggugcu

SEQ ID NO: 3235987 - RNA, 13 nt, Mycobacterium leprae
aucgcccgcccaa

SEQ ID NO: 3235988 - RNA, 12 nt, Mycobacterium leprae
aucgccgaugac

SEQ ID NO: 3235989 - RNA, 13 nt, Mycobacterium leprae
aucgccgaugacc

SEQ ID NO: 3235990 - RNA, 22 nt, Mycobacterium leprae
aucgccgcguggguccguucgu

SEQ ID NO: 3235991 - RNA, 15 nt, Mycobacterium leprae
aucgccggcguugau

SEQ ID NO: 3235992 - RNA, 20 nt, Mycobacterium leprae
aucgccgugguggcucgcgu

SEQ ID NO: 3235993 - RNA, 12 nt, Mycobacterium leprae
aucgccuuccaa

SEQ ID NO: 3235994 - RNA, 14 nt, Mycobacterium leprae
aucgcggcgcgcuc

SEQ ID NO: 3235995 - RNA, 12 nt, Mycobacterium leprae
aucgcggcugcc

SEQ ID NO: 3235996 - RNA, 22 nt, Mycobacterium leprae
aucgcgucgcaucgguggcacg

SEQ ID NO: 3235997 - RNA, 22 nt, Mycobacterium leprae
aucgcgucggcauaucgaccgc

SEQ ID NO: 3235998 - RNA, 16 nt, Mycobacterium leprae
aucgcguuugcaguga

SEQ ID NO: 3235999 - RNA, 19 nt, Mycobacterium leprae
aucgcuaagacucaccaag

SEQ ID NO: 3236000 - RNA, 17 nt, Mycobacterium leprae
aucgcugccggcggcag

SEQ ID NO: 3236001 - RNA, 12 nt, Mycobacterium leprae
aucgcuggucag

SEQ ID NO: 3236002 - RNA, 16 nt, Mycobacterium leprae
aucgcuuagcugagaa

SEQ ID NO: 3236003 - RNA, 14 nt, Mycobacterium leprae
aucgcuuaucaugc

SEQ ID NO: 3236004 - RNA, 23 nt, Mycobacterium leprae
aucgcuuggugcugcugcuggug

SEQ ID NO: 3236005 - RNA, 18 nt, Mycobacterium leprae
aucggaaucgccgcgacg

SEQ ID NO: 3236006 - RNA, 21 nt, Mycobacterium leprae
aucggacacgagcggccucag

SEQ ID NO: 3236007 - RNA, 22 nt, Mycobacterium leprae
aucggcagaucgaucucgacgg

SEQ ID NO: 3236008 - RNA, 22 nt, Mycobacterium leprae
aucggcaggcuguacacuacuc

SEQ ID NO: 3236009 - RNA, 18 nt, Mycobacterium leprae
aucggcauauccgccccg

SEQ ID NO: 3236010 - RNA, 15 nt, Mycobacterium leprae
aucggccucaccugc

SEQ ID NO: 3236011 - RNA, 14 nt, Mycobacterium leprae
aucggcgacuggga

SEQ ID NO: 3236012 - RNA, 21 nt, Mycobacterium leprae
aucggcgcagacuagucgaga

SEQ ID NO: 3236013 - RNA, 20 nt, Mycobacterium leprae
aucggcggcggagcgcaccg

SEQ ID NO: 3236014 - RNA, 22 nt, Mycobacterium leprae
aucggcguacguaugccgccaa

SEQ ID NO: 3236015 - RNA, 21 nt, Mycobacterium leprae
aucggcuacaucgacaaaaac

SEQ ID NO: 3236016 - RNA, 19 nt, Mycobacterium leprae
aucggcuacggcaaccgca

SEQ ID NO: 3236017 - RNA, 21 nt, Mycobacterium leprae
aucggcucccaucggcggcca

SEQ ID NO: 3236018 - RNA, 17 nt, Mycobacterium leprae
aucgggccagagcugcg

SEQ ID NO: 3236019 - RNA, 13 nt, Mycobacterium leprae
aucgggcccagca

SEQ ID NO: 3236020 - RNA, 15 nt, Mycobacterium leprae
aucgggcccagcacc

SEQ ID NO: 3236021 - RNA, 15 nt, Mycobacterium leprae
aucgggcugcgguga

SEQ ID NO: 3236022 - RNA, 20 nt, Mycobacterium leprae
aucggggauucaaucagaca

SEQ ID NO: 3236023 - RNA, 20 nt, Mycobacterium leprae
aucggggcuacaaagcgacc

SEQ ID NO: 3236024 - RNA, 15 nt, Mycobacterium leprae
aucggguugacgcug

SEQ ID NO: 3236025 - RNA, 20 nt, Mycobacterium leprae
aucgguacauuugcggauga

SEQ ID NO: 3236026 - RNA, 16 nt, Mycobacterium leprae
aucgguaguggccggc

SEQ ID NO: 3236027 - RNA, 15 nt, Mycobacterium leprae
aucggucagcucgaa

SEQ ID NO: 3236028 - RNA, 12 nt, Mycobacterium leprae
aucggugaucaa

SEQ ID NO: 3236029 - RNA, 22 nt, Mycobacterium leprae
aucgguguuguccgucagccgu

SEQ ID NO: 3236030 - RNA, 22 nt, Mycobacterium leprae
aucgguuccgcaauuucggcgu

SEQ ID NO: 3236031 - RNA, 14 nt, Mycobacterium leprae
aucguacgaaagau

SEQ ID NO: 3236032 - RNA, 14 nt, Mycobacterium leprae
aucgucaaauuuuc

SEQ ID NO: 3236033 - RNA, 15 nt, Mycobacterium leprae
aucguccucaugccc

SEQ ID NO: 3236034 - RNA, 23 nt, Mycobacterium leprae
aucguccucaugcccaugccagc

SEQ ID NO: 3236035 - RNA, 11 nt, Mycobacterium leprae
aucgucggccg

SEQ ID NO: 3236036 - RNA, 18 nt, Mycobacterium leprae
aucgucgguuagcucgaa

SEQ ID NO: 3236037 - RNA, 20 nt, Mycobacterium leprae
aucgucuaccggcgcggauc

SEQ ID NO: 3236038 - RNA, 20 nt, Mycobacterium leprae
aucgucucgcuccacaucgu

SEQ ID NO: 3236039 - RNA, 18 nt, Mycobacterium leprae
aucgucucgggcgguuga

SEQ ID NO: 3236040 - RNA, 15 nt, Mycobacterium leprae
aucguggugggucac

SEQ ID NO: 3236041 - RNA, 12 nt, Mycobacterium leprae
aucguguggugu

SEQ ID NO: 3236042 - RNA, 14 nt, Mycobacterium leprae
aucgugugguguuu

SEQ ID NO: 3236043 - RNA, 23 nt, Mycobacterium leprae
aucguugaccgcccuggaccgca

SEQ ID NO: 3236044 - RNA, 18 nt, Mycobacterium leprae
aucguugcacggcaaagu

SEQ ID NO: 3236045 - RNA, 15 nt, Mycobacterium leprae
aucguugcgaccggc

SEQ ID NO: 3236046 - RNA, 18 nt, Mycobacterium leprae
aucuaauugcgaugcacu

SEQ ID NO: 3236047 - RNA, 18 nt, Mycobacterium leprae
aucuacccuuuuugucac

SEQ ID NO: 3236048 - RNA, 20 nt, Mycobacterium leprae
aucuagccggggaaaggcau

SEQ ID NO: 3236049 - RNA, 22 nt, Mycobacterium leprae
aucuaguggucgauuacucacg

SEQ ID NO: 3236050 - RNA, 23 nt, Mycobacterium leprae
aucuaguggucgauuacucacgc

SEQ ID NO: 3236051 - RNA, 21 nt, Mycobacterium leprae
aucuauaguugaucauucgau

SEQ ID NO: 3236052 - RNA, 17 nt, Mycobacterium leprae
aucuaucaagccacacg

SEQ ID NO: 3236053 - RNA, 22 nt, Mycobacterium leprae
aucucaacauggaccaccguug

SEQ ID NO: 3236054 - RNA, 11 nt, Mycobacterium leprae
aucucaucguc

SEQ ID NO: 3236055 - RNA, 14 nt, Mycobacterium leprae
aucucaucgucucg

SEQ ID NO: 3236056 - RNA, 20 nt, Mycobacterium leprae
aucuccaccagccggccggg

SEQ ID NO: 3236057 - RNA, 15 nt, Mycobacterium leprae
aucuccccagguuga

SEQ ID NO: 3236058 - RNA, 18 nt, Mycobacterium leprae
aucuccgcaugagccggu

SEQ ID NO: 3236059 - RNA, 23 nt, Mycobacterium leprae
aucucgcgucgugcguuguugau

SEQ ID NO: 3236060 - RNA, 20 nt, Mycobacterium leprae
aucucgcuugguugcgggua

SEQ ID NO: 3236061 - RNA, 20 nt, Mycobacterium leprae
aucucuaugucacuucccac

SEQ ID NO: 3236062 - RNA, 13 nt, Mycobacterium leprae
aucucugugcgaa

SEQ ID NO: 3236063 - RNA, 19 nt, Mycobacterium leprae
aucucugugcgaaaacacu

SEQ ID NO: 3236064 - RNA, 15 nt, Mycobacterium leprae
aucucuguuaugacu

SEQ ID NO: 3236065 - RNA, 17 nt, Mycobacterium leprae
aucucuuccgagccgac

SEQ ID NO: 3236066 - RNA, 19 nt, Mycobacterium leprae
aucugauugaucggugacu

SEQ ID NO: 3236067 - RNA, 23 nt, Mycobacterium leprae
aucugcaacucaucggcucccau

SEQ ID NO: 3236068 - RNA, 15 nt, Mycobacterium leprae
aucugccgugcagcg

SEQ ID NO: 3236069 - RNA, 17 nt, Mycobacterium leprae
aucugcgucgcccucgc

SEQ ID NO: 3236070 - RNA, 21 nt, Mycobacterium leprae
aucugcgucgcccucgccggc

SEQ ID NO: 3236071 - RNA, 14 nt, Mycobacterium leprae
aucugcugauaauc

SEQ ID NO: 3236072 - RNA, 21 nt, Mycobacterium leprae
aucuggcgacucggcgccauc

SEQ ID NO: 3236073 - RNA, 19 nt, Mycobacterium leprae
aucuggggaaugucgaugg

SEQ ID NO: 3236074 - RNA, 23 nt, Mycobacterium leprae
aucugguggauccaggugcugca

SEQ ID NO: 3236075 - RNA, 22 nt, Mycobacterium leprae
aucuguacgcguugauggccga

SEQ ID NO: 3236076 - RNA, 13 nt, Mycobacterium leprae
aucuucagucagg

SEQ ID NO: 3236077 - RNA, 18 nt, Mycobacterium leprae
aucuugaaauucaauacu

SEQ ID NO: 3236078 - RNA, 21 nt, Mycobacterium leprae
aucuuggcccggcuccggugu

SEQ ID NO: 3236079 - RNA, 13 nt, Mycobacterium leprae
aucuuucugguug

SEQ ID NO: 3236080 - RNA, 17 nt, Mycobacterium leprae
aucuuuugaccagcacu

SEQ ID NO: 3236081 - RNA, 20 nt, Mycobacterium leprae
augaauuugccgcgagcacu

SEQ ID NO: 3236082 - RNA, 16 nt, Mycobacterium leprae
augguuuggcugccag

SEQ ID NO: 3236083 - RNA, 17 nt, Mycobacterium leprae
augguuuuggccgcggu

SEQ ID NO: 3236084 - RNA, 23 nt, Mycobacterium leprae
auguacaacgggaucgacaaaau

SEQ ID NO: 3236085 - RNA, 14 nt, Mycobacterium leprae
auguauccaggauu

SEQ ID NO: 3236086 - RNA, 15 nt, Mycobacterium leprae
auguauuacugacuu

SEQ ID NO: 3236087 - RNA, 15 nt, Mycobacterium leprae
augucacuucccacc

SEQ ID NO: 3236088 - RNA, 17 nt, Mycobacterium leprae
augucacuucccaccgu

SEQ ID NO: 3236089 - RNA, 18 nt, Mycobacterium leprae
augucauggccuugaggu

SEQ ID NO: 3236090 - RNA, 16 nt, Mycobacterium leprae
augucccggugcugcc

SEQ ID NO: 3236091 - RNA, 17 nt, Mycobacterium leprae
augucccggugcugccu

SEQ ID NO: 3236092 - RNA, 13 nt, Mycobacterium leprae
auguccgcccuga

SEQ ID NO: 3236093 - RNA, 12 nt, Mycobacterium leprae
augucgaagggc

SEQ ID NO: 3236094 - RNA, 16 nt, Mycobacterium leprae
augucgauggcggugu

SEQ ID NO: 3236095 - RNA, 15 nt, Mycobacterium leprae
augucggccacugca

SEQ ID NO: 3236096 - RNA, 16 nt, Mycobacterium leprae
augucggccacugcac

SEQ ID NO: 3236097 - RNA, 21 nt, Mycobacterium leprae
augucggccacugcacgacca

SEQ ID NO: 3236098 - RNA, 17 nt, Mycobacterium leprae
augucggcgcgacugca

SEQ ID NO: 3236099 - RNA, 14 nt, Mycobacterium leprae
augucgguggugga

SEQ ID NO: 3236100 - RNA, 14 nt, Mycobacterium leprae
augucggugguggg

SEQ ID NO: 3236101 - RNA, 22 nt, Mycobacterium leprae
augucgguggugggugcugcuu

SEQ ID NO: 3236102 - RNA, 14 nt, Mycobacterium leprae
augucgugcugacc

SEQ ID NO: 3236103 - RNA, 15 nt, Mycobacterium leprae
augucguggugccgu

SEQ ID NO: 3236104 - RNA, 19 nt, Mycobacterium leprae
augucuucgucgacuauau

SEQ ID NO: 3236105 - RNA, 16 nt, Mycobacterium leprae
augugaacuucuggau

SEQ ID NO: 3236106 - RNA, 12 nt, Mycobacterium leprae
augugcuggaga

SEQ ID NO: 3236107 - RNA, 17 nt, Mycobacterium leprae
auguggccgcaccugaa

SEQ ID NO: 3236108 - RNA, 18 nt, Mycobacterium leprae
auguggcgcgucgguaga

SEQ ID NO: 3236109 - RNA, 14 nt, Mycobacterium leprae
augugggucuguua

SEQ ID NO: 3236110 - RNA, 16 nt, Mycobacterium leprae
auguuaaacaguuaaa

SEQ ID NO: 3236111 - RNA, 14 nt, Mycobacterium leprae
auguuauguagcug

SEQ ID NO: 3236112 - RNA, 19 nt, Mycobacterium leprae
auguuauuuauagaugcca

SEQ ID NO: 3236113 - RNA, 12 nt, Mycobacterium leprae
auguucuguugu

SEQ ID NO: 3236114 - RNA, 21 nt, Mycobacterium leprae
auguuguuagcucugcugcau

SEQ ID NO: 3236115 - RNA, 21 nt, Mycobacterium leprae
auguuucggaugaauuuuucg

SEQ ID NO: 3236116 - RNA, 20 nt, Mycobacterium leprae
auuacccgcugaugcugccu

SEQ ID NO: 3236117 - RNA, 23 nt, Mycobacterium leprae
auuaccgggcucaccgagacggg

SEQ ID NO: 3236118 - RNA, 15 nt, Mycobacterium leprae
auuaccucggucacc

SEQ ID NO: 3236119 - RNA, 15 nt, Mycobacterium leprae
auuacugacuuggcc

SEQ ID NO: 3236120 - RNA, 23 nt, Mycobacterium leprae
auuaucguuaccggaauuuuuga

SEQ ID NO: 3236121 - RNA, 20 nt, Mycobacterium leprae
auuauuaccgauaaucaaag

SEQ ID NO: 3236122 - RNA, 20 nt, Mycobacterium leprae
auucaugacguuuacaacgu

SEQ ID NO: 3236123 - RNA, 14 nt, Mycobacterium leprae
auucauuguacuga

SEQ ID NO: 3236124 - RNA, 12 nt, Mycobacterium leprae
auuccacugcca

SEQ ID NO: 3236125 - RNA, 20 nt, Mycobacterium leprae
auuccauuccguugaacuug

SEQ ID NO: 3236126 - RNA, 20 nt, Mycobacterium leprae
auuccgacgaagguggcauu

SEQ ID NO: 3236127 - RNA, 22 nt, Mycobacterium leprae
auuccgcuacaguaauggcauu

SEQ ID NO: 3236128 - RNA, 18 nt, Mycobacterium leprae
auuccgguggggguggac

SEQ ID NO: 3236129 - RNA, 17 nt, Mycobacterium leprae
auuccuacccucucagc

SEQ ID NO: 3236130 - RNA, 17 nt, Mycobacterium leprae
auucgcccgagucucug

SEQ ID NO: 3236131 - RNA, 19 nt, Mycobacterium leprae
auucggaucguuugaggaa

SEQ ID NO: 3236132 - RNA, 18 nt, Mycobacterium leprae
auucggcgauauccgccg

SEQ ID NO: 3236133 - RNA, 17 nt, Mycobacterium leprae
auucgggacagugucuu

SEQ ID NO: 3236134 - RNA, 19 nt, Mycobacterium leprae
auucggggggucggcugca

SEQ ID NO: 3236135 - RNA, 18 nt, Mycobacterium leprae
auucggucacgggucggc

SEQ ID NO: 3236136 - RNA, 13 nt, Mycobacterium leprae
auucguacaacgu

SEQ ID NO: 3236137 - RNA, 20 nt, Mycobacterium leprae
auucgucaaaaaacucaugc

SEQ ID NO: 3236138 - RNA, 16 nt, Mycobacterium leprae
auucuaggcgaucgag

SEQ ID NO: 3236139 - RNA, 19 nt, Mycobacterium leprae
auucucgagcggcgcaugc

SEQ ID NO: 3236140 - RNA, 16 nt, Mycobacterium leprae
auucucgcgccaccgc

SEQ ID NO: 3236141 - RNA, 18 nt, Mycobacterium leprae
auucugcuggagaucgac

SEQ ID NO: 3236142 - RNA, 13 nt, Mycobacterium leprae
auucuucucuaaa

SEQ ID NO: 3236143 - RNA, 18 nt, Mycobacterium leprae
auugaaaauuucgucuag

SEQ ID NO: 3236144 - RNA, 20 nt, Mycobacterium leprae
auugaaaauuucgucuaguu

SEQ ID NO: 3236145 - RNA, 17 nt, Mycobacterium leprae
auugaauccgcugcccu

SEQ ID NO: 3236146 - RNA, 19 nt, Mycobacterium leprae
auugacaaaagugcaguga

SEQ ID NO: 3236147 - RNA, 21 nt, Mycobacterium leprae
auugaccacgccgacaccuca

SEQ ID NO: 3236148 - RNA, 14 nt, Mycobacterium leprae
auugaccgacggcg

SEQ ID NO: 3236149 - RNA, 20 nt, Mycobacterium leprae
auugaccgacggcgccgcac

SEQ ID NO: 3236150 - RNA, 12 nt, Mycobacterium leprae
auugaucacaaa

SEQ ID NO: 3236151 - RNA, 19 nt, Mycobacterium leprae
auugaucgggcccagcacc

SEQ ID NO: 3236152 - RNA, 17 nt, Mycobacterium leprae
auugcaauccgccgauc

SEQ ID NO: 3236153 - RNA, 17 nt, Mycobacterium leprae
auugccaacucaccgca

SEQ ID NO: 3236154 - RNA, 21 nt, Mycobacterium leprae
auugccauccucgaugguguc

SEQ ID NO: 3236155 - RNA, 14 nt, Mycobacterium leprae
auugccugaugcca

SEQ ID NO: 3236156 - RNA, 15 nt, Mycobacterium leprae
auugccugaugccau

SEQ ID NO: 3236157 - RNA, 18 nt, Mycobacterium leprae
auugcgauaaugcacugc

SEQ ID NO: 3236158 - RNA, 20 nt, Mycobacterium leprae
auugcggacaauucaacgaa

SEQ ID NO: 3236159 - RNA, 16 nt, Mycobacterium leprae
auugcggcauugcggc

SEQ ID NO: 3236160 - RNA, 16 nt, Mycobacterium leprae
auugcuaccugguugg

SEQ ID NO: 3236161 - RNA, 14 nt, Mycobacterium leprae
auugcuccgcagca

SEQ ID NO: 3236162 - RNA, 20 nt, Mycobacterium leprae
auugcuuagcuaugcaguga

SEQ ID NO: 3236163 - RNA, 16 nt, Mycobacterium leprae
auugcuucgaggcauu

SEQ ID NO: 3236164 - RNA, 13 nt, Mycobacterium leprae
auuggacccgauc

SEQ ID NO: 3236165 - RNA, 17 nt, Mycobacterium leprae
auuggcagagcauucgg

SEQ ID NO: 3236166 - RNA, 21 nt, Mycobacterium leprae
auuggcagagcauucggcugu

SEQ ID NO: 3236167 - RNA, 15 nt, Mycobacterium leprae
auuggcucgacauug

SEQ ID NO: 3236168 - RNA, 20 nt, Mycobacterium leprae
auuggcugagaccgguccac

SEQ ID NO: 3236169 - RNA, 15 nt, Mycobacterium leprae
auugggucaucggcg

SEQ ID NO: 3236170 - RNA, 14 nt, Mycobacterium leprae
auugguggucgcgg

SEQ ID NO: 3236171 - RNA, 23 nt, Mycobacterium leprae
auugguugccgagcuguuccucu

SEQ ID NO: 3236172 - RNA, 16 nt, Mycobacterium leprae
auuguacugacugggg

SEQ ID NO: 3236173 - RNA, 11 nt, Mycobacterium leprae
auuguggcugg

SEQ ID NO: 3236174 - RNA, 21 nt, Mycobacterium leprae
auugugguuaacucuuucccu

SEQ ID NO: 3236175 - RNA, 20 nt, Mycobacterium leprae
auuguguaacgauuagcaug

SEQ ID NO: 3236176 - RNA, 18 nt, Mycobacterium leprae
auuguucugccaugccag

SEQ ID NO: 3236177 - RNA, 15 nt, Mycobacterium leprae
auuguucugcgcugg

SEQ ID NO: 3236178 - RNA, 16 nt, Mycobacterium leprae
auuuaaauuucaagac

SEQ ID NO: 3236179 - RNA, 21 nt, Mycobacterium leprae
auuuaccacucgucuuuccgu

SEQ ID NO: 3236180 - RNA, 22 nt, Mycobacterium leprae
auuuacccgugauaucaaucca

SEQ ID NO: 3236181 - RNA, 21 nt, Mycobacterium leprae
auuuaccggcguucaauaaga

SEQ ID NO: 3236182 - RNA, 14 nt, Mycobacterium leprae
auuuagaggcugca

SEQ ID NO: 3236183 - RNA, 12 nt, Mycobacterium leprae
auuucacuggcc

SEQ ID NO: 3236184 - RNA, 18 nt, Mycobacterium leprae
auuucagggcacacagca

SEQ ID NO: 3236185 - RNA, 21 nt, Mycobacterium leprae
auuucgacggcaacggcacca

SEQ ID NO: 3236186 - RNA, 15 nt, Mycobacterium leprae
auuucucgugguggc

SEQ ID NO: 3236187 - RNA, 15 nt, Mycobacterium leprae
auuugaacugggacc

SEQ ID NO: 3236188 - RNA, 19 nt, Mycobacterium leprae
auuugaggucgacacagaa

SEQ ID NO: 3236189 - RNA, 16 nt, Mycobacterium leprae
auuugcacgcugguug

SEQ ID NO: 3236190 - RNA, 14 nt, Mycobacterium leprae
auuugcgaucaacu

SEQ ID NO: 3236191 - RNA, 22 nt, Mycobacterium leprae
auuugcggcuuguggcuaccau

SEQ ID NO: 3236192 - RNA, 18 nt, Mycobacterium leprae
auuugcugucguggcugc

SEQ ID NO: 3236193 - RNA, 19 nt, Mycobacterium leprae
auuuggauggucggcagcu

SEQ ID NO: 3236194 - RNA, 17 nt, Mycobacterium leprae
auuugguacacuaagcc

SEQ ID NO: 3236195 - RNA, 19 nt, Mycobacterium leprae
caagauccgguggucugcg

SEQ ID NO: 3236196 - RNA, 15 nt, Mycobacterium leprae
caagaucggccagcc

SEQ ID NO: 3236197 - RNA, 16 nt, Mycobacterium leprae
caagauggcgucaccg

SEQ ID NO: 3236198 - RNA, 17 nt, Mycobacterium leprae
caagcagcauccaccac

SEQ ID NO: 3236199 - RNA, 16 nt, Mycobacterium leprae
caagcagucccaaggg

SEQ ID NO: 3236200 - RNA, 19 nt, Mycobacterium leprae
caagccaugcaaccacacc

SEQ ID NO: 3236201 - RNA, 20 nt, Mycobacterium leprae
caagcccccgcggaucgguu

SEQ ID NO: 3236202 - RNA, 19 nt, Mycobacterium leprae
caagcccggauacagcacg

SEQ ID NO: 3236203 - RNA, 17 nt, Mycobacterium leprae
caagccgccagugcgca

SEQ ID NO: 3236204 - RNA, 15 nt, Mycobacterium leprae
caagcgcgugaucuc

SEQ ID NO: 3236205 - RNA, 22 nt, Mycobacterium leprae
caagcgcuaugccauccaccgc

SEQ ID NO: 3236206 - RNA, 15 nt, Mycobacterium leprae
caagcgcuuuuccuu

SEQ ID NO: 3236207 - RNA, 14 nt, Mycobacterium leprae
caagcggguugacu

SEQ ID NO: 3236208 - RNA, 19 nt, Mycobacterium leprae
caagcgguuguccggcgcg

SEQ ID NO: 3236209 - RNA, 16 nt, Mycobacterium leprae
caagcucaucggcgac

SEQ ID NO: 3236210 - RNA, 22 nt, Mycobacterium leprae
caagcuguuacgaggacucccu

SEQ ID NO: 3236211 - RNA, 20 nt, Mycobacterium leprae
caagcuuacuuggucaaggu

SEQ ID NO: 3236212 - RNA, 23 nt, Mycobacterium leprae
caagcuuacuuggucaaggugaa

SEQ ID NO: 3236213 - RNA, 17 nt, Mycobacterium leprae
caaggauucagccaagg

SEQ ID NO: 3236214 - RNA, 18 nt, Mycobacterium leprae
caaggcgguuccgacugg

SEQ ID NO: 3236215 - RNA, 17 nt, Mycobacterium leprae
caagggauuccacugcc

SEQ ID NO: 3236216 - RNA, 14 nt, Mycobacterium leprae
caaggggagcaggu

SEQ ID NO: 3236217 - RNA, 16 nt, Mycobacterium leprae
caaggucgagugcgag

SEQ ID NO: 3236218 - RNA, 19 nt, Mycobacterium leprae
caaggucgagugcgagcca

SEQ ID NO: 3236219 - RNA, 23 nt, Mycobacterium leprae
caaggucgagugcgagccacucc

SEQ ID NO: 3236220 - RNA, 16 nt, Mycobacterium leprae
caaggucgcgcugccg

SEQ ID NO: 3236221 - RNA, 16 nt, Mycobacterium leprae
caaggucguguugcca

SEQ ID NO: 3236222 - RNA, 22 nt, Mycobacterium leprae
caaggugagcguugugggcagc

SEQ ID NO: 3236223 - RNA, 21 nt, Mycobacterium leprae
caagguguugcggugaguaaa

SEQ ID NO: 3236224 - RNA, 16 nt, Mycobacterium leprae
caagguuaacauuuua

SEQ ID NO: 3236225 - RNA, 20 nt, Mycobacterium leprae
caaguaagacagguaauuga

SEQ ID NO: 3236226 - RNA, 14 nt, Mycobacterium leprae
caaguaggucgauu

SEQ ID NO: 3236227 - RNA, 15 nt, Mycobacterium leprae
caaguagguuguucg

SEQ ID NO: 3236228 - RNA, 13 nt, Mycobacterium leprae
caagucaaaacca

SEQ ID NO: 3236229 - RNA, 14 nt, Mycobacterium leprae
caagucaaaaccag

SEQ ID NO: 3236230 - RNA, 20 nt, Mycobacterium leprae
caagucagccuagcagcauc

SEQ ID NO: 3236231 - RNA, 14 nt, Mycobacterium leprae
caaguccagcacga

SEQ ID NO: 3236232 - RNA, 14 nt, Mycobacterium leprae
caagucggucgccg

SEQ ID NO: 3236233 - RNA, 18 nt, Mycobacterium leprae
caagucuucgaugcucug

SEQ ID NO: 3236234 - RNA, 23 nt, Mycobacterium leprae
caagugacugcguuucaugacga

SEQ ID NO: 3236235 - RNA, 20 nt, Mycobacterium leprae
caagugccgcgggugcaguu

SEQ ID NO: 3236236 - RNA, 18 nt, Mycobacterium leprae
caagugcggcgcccagca

SEQ ID NO: 3236237 - RNA, 13 nt, Mycobacterium leprae
caaguggcugcua

SEQ ID NO: 3236238 - RNA, 14 nt, Mycobacterium leprae
caaguggcugcuau

SEQ ID NO: 3236239 - RNA, 17 nt, Mycobacterium leprae
caagugugaaucccgcg

SEQ ID NO: 3236240 - RNA, 20 nt, Mycobacterium leprae
caaguguguucuacccaggc

SEQ ID NO: 3236241 - RNA, 14 nt, Mycobacterium leprae
caaguuugagaaca

SEQ ID NO: 3236242 - RNA, 21 nt, Mycobacterium leprae
caauaacguuugcugcaaugc

SEQ ID NO: 3236243 - RNA, 18 nt, Mycobacterium leprae
caauaagaaagaauuuac

SEQ ID NO: 3236244 - RNA, 19 nt, Mycobacterium leprae
caauaccgaccgaaagccg

SEQ ID NO: 3236245 - RNA, 17 nt, Mycobacterium leprae
caauaguaaguggccaa

SEQ ID NO: 3236246 - RNA, 12 nt, Mycobacterium leprae
caaucacaagga

SEQ ID NO: 3236247 - RNA, 18 nt, Mycobacterium leprae
caaucaccacuuuggcaa

SEQ ID NO: 3236248 - RNA, 16 nt, Mycobacterium leprae
caaucacgcccagcgc

SEQ ID NO: 3236249 - RNA, 21 nt, Mycobacterium leprae
caaucaucgcagagcucacug

SEQ ID NO: 3236250 - RNA, 16 nt, Mycobacterium leprae
caaucccaccacccug

SEQ ID NO: 3236251 - RNA, 21 nt, Mycobacterium leprae
caaucccgaaaaccccacacu

SEQ ID NO: 3236252 - RNA, 12 nt, Mycobacterium leprae
caauccguuguc

SEQ ID NO: 3236253 - RNA, 12 nt, Mycobacterium leprae
caauccguuugc

SEQ ID NO: 3236254 - RNA, 22 nt, Mycobacterium leprae
caauccuggaugugugcacucg

SEQ ID NO: 3236255 - RNA, 24 nt, Mycobacterium leprae
caauccuggaugugugcacucgca

SEQ ID NO: 3236256 - RNA, 17 nt, Mycobacterium leprae
caauccuguagcuguuc

SEQ ID NO: 3236257 - RNA, 14 nt, Mycobacterium leprae
caaucgacucacca

SEQ ID NO: 3236258 - RNA, 23 nt, Mycobacterium leprae
caaucgguccuugaccucauccc

SEQ ID NO: 3236259 - RNA, 12 nt, Mycobacterium leprae
caaucgucgccu

SEQ ID NO: 3236260 - RNA, 20 nt, Mycobacterium leprae
caaucuaauugcgaugcacu

SEQ ID NO: 3236261 - RNA, 19 nt, Mycobacterium leprae
caaucuaucaagccacacg

SEQ ID NO: 3236262 - RNA, 19 nt, Mycobacterium leprae
caaucucggggguugaucc

SEQ ID NO: 3236263 - RNA, 17 nt, Mycobacterium leprae
caaucuuuacgcgcgcc

SEQ ID NO: 3236264 - RNA, 16 nt, Mycobacterium leprae
caaucuuugaccagac

SEQ ID NO: 3236265 - RNA, 19 nt, Mycobacterium leprae
caaugcacgugauggcgcg

SEQ ID NO: 3236266 - RNA, 14 nt, Mycobacterium leprae
caaugcagacacgc

SEQ ID NO: 3236267 - RNA, 14 nt, Mycobacterium leprae
caaugcucucaccc

SEQ ID NO: 3236268 - RNA, 15 nt, Mycobacterium leprae
caaugcucucacccu

SEQ ID NO: 3236269 - RNA, 13 nt, Mycobacterium leprae
caaugcucugcug

SEQ ID NO: 3236270 - RNA, 18 nt, Mycobacterium leprae
caaugcugcagcugggau

SEQ ID NO: 3236271 - RNA, 21 nt, Mycobacterium leprae
caauggcaguagcaucgaaca

SEQ ID NO: 3236272 - RNA, 17 nt, Mycobacterium leprae
caaugucacaucgauuu

SEQ ID NO: 3236273 - RNA, 15 nt, Mycobacterium leprae
caaugucacugcgac

SEQ ID NO: 3236274 - RNA, 19 nt, Mycobacterium leprae
caauguggccgcaccugaa

SEQ ID NO: 3236275 - RNA, 16 nt, Mycobacterium leprae
caauucggcgagcacu

SEQ ID NO: 3236276 - RNA, 24 nt, Mycobacterium leprae
caauucggcgauauccgccggccg

SEQ ID NO: 3236277 - RNA, 15 nt, Mycobacterium leprae
caauucucagcggaa

SEQ ID NO: 3236278 - RNA, 15 nt, Mycobacterium leprae
caauugaauccgcug

SEQ ID NO: 3236279 - RNA, 21 nt, Mycobacterium leprae
caauugacaacacgaucgcag

SEQ ID NO: 3236280 - RNA, 16 nt, Mycobacterium leprae
caauugacgccgaccg

SEQ ID NO: 3236281 - RNA, 17 nt, Mycobacterium leprae
caauugacgccgaccgc

SEQ ID NO: 3236282 - RNA, 23 nt, Mycobacterium leprae
caauugucgugggucagucggaa

SEQ ID NO: 3236283 - RNA, 14 nt, Mycobacterium leprae
caauuuggugauca

SEQ ID NO: 3236284 - RNA, 14 nt, Mycobacterium leprae
cacaaacuccagag

SEQ ID NO: 3236285 - RNA, 20 nt, Mycobacterium leprae
cacaaagaaguaaagcccug

SEQ ID NO: 3236286 - RNA, 19 nt, Mycobacterium leprae
cacaacaagcgacuucgau

SEQ ID NO: 3236287 - RNA, 16 nt, Mycobacterium leprae
cacaacauccaaccaa

SEQ ID NO: 3236288 - RNA, 12 nt, Mycobacterium leprae
cacaacgccgag

SEQ ID NO: 3236289 - RNA, 18 nt, Mycobacterium leprae
cacaacgucagaagcugg

SEQ ID NO: 3236290 - RNA, 22 nt, Mycobacterium leprae
cacaaucacaaggagccaacga

SEQ ID NO: 3236291 - RNA, 13 nt, Mycobacterium leprae
cacacagcggcca

SEQ ID NO: 3236292 - RNA, 18 nt, Mycobacterium leprae
cacaccgacuagcagguc

SEQ ID NO: 3236293 - RNA, 21 nt, Mycobacterium leprae
cacaccuggugugcgcgccgc

SEQ ID NO: 3236294 - RNA, 19 nt, Mycobacterium leprae
cacacgaagccucaucgaa

SEQ ID NO: 3236295 - RNA, 14 nt, Mycobacterium leprae
cacacggccgugca

SEQ ID NO: 3236296 - RNA, 14 nt, Mycobacterium leprae
cacacggcgcgauc

SEQ ID NO: 3236297 - RNA, 18 nt, Mycobacterium leprae
cacacguucggaucauug

SEQ ID NO: 3236298 - RNA, 17 nt, Mycobacterium leprae
cacacuaaaacgccccu

SEQ ID NO: 3236299 - RNA, 18 nt, Mycobacterium leprae
cacacucacgccugcauc

SEQ ID NO: 3236300 - RNA, 20 nt, Mycobacterium leprae
cacacugucacgucggccug

SEQ ID NO: 3236301 - RNA, 13 nt, Mycobacterium leprae
cacacugugccug

SEQ ID NO: 3236302 - RNA, 15 nt, Mycobacterium leprae
cacagaacgguucaa

SEQ ID NO: 3236303 - RNA, 14 nt, Mycobacterium leprae
cacagauucguacc

SEQ ID NO: 3236304 - RNA, 20 nt, Mycobacterium leprae
cacagauucguaccgcgcaa

SEQ ID NO: 3236305 - RNA, 15 nt, Mycobacterium leprae
cacagcaagucgccu

SEQ ID NO: 3236306 - RNA, 19 nt, Mycobacterium leprae
cacagcaagucgccuacac

SEQ ID NO: 3236307 - RNA, 22 nt, Mycobacterium leprae
cacagcaagucgccuacaccag

SEQ ID NO: 3236308 - RNA, 20 nt, Mycobacterium leprae
caccucuucgacaccgagca

SEQ ID NO: 3236309 - RNA, 20 nt, Mycobacterium leprae
caccugcauggacgauaucg

SEQ ID NO: 3236310 - RNA, 23 nt, Mycobacterium leprae
caccugcgacagccgugccucgc

SEQ ID NO: 3236311 - RNA, 16 nt, Mycobacterium leprae
caccugggcugugcug

SEQ ID NO: 3236312 - RNA, 19 nt, Mycobacterium leprae
caccuggugcccgacagcc

SEQ ID NO: 3236313 - RNA, 22 nt, Mycobacterium leprae
caccuggugcccgacagccacc

SEQ ID NO: 3236314 - RNA, 15 nt, Mycobacterium leprae
caccuggugugcgcg

SEQ ID NO: 3236315 - RNA, 18 nt, Mycobacterium leprae
caccuggugugcgcgccg

SEQ ID NO: 3236316 - RNA, 16 nt, Mycobacterium leprae
cacgaacaacagagca

SEQ ID NO: 3236317 - RNA, 15 nt, Mycobacterium leprae
cacgacagccgcaau

SEQ ID NO: 3236318 - RNA, 14 nt, Mycobacterium leprae
cacgagcggccuca

SEQ ID NO: 3236319 - RNA, 23 nt, Mycobacterium leprae
cacgagcggccucagcagcaggc

SEQ ID NO: 3236320 - RNA, 21 nt, Mycobacterium leprae
cacgagcguuuagucaccgcc

SEQ ID NO: 3236321 - RNA, 22 nt, Mycobacterium leprae
cacgauauccggggggagugau

SEQ ID NO: 3236322 - RNA, 17 nt, Mycobacterium leprae
cacgaucaccgcggcgu

SEQ ID NO: 3236323 - RNA, 14 nt, Mycobacterium leprae
cacgauugcucuga

SEQ ID NO: 3236324 - RNA, 11 nt, Mycobacterium leprae
cacgcaaccaa

SEQ ID NO: 3236325 - RNA, 14 nt, Mycobacterium leprae
cacgcacacgacag

SEQ ID NO: 3236326 - RNA, 16 nt, Mycobacterium leprae
cacgcacacgacagcc

SEQ ID NO: 3236327 - RNA, 16 nt, Mycobacterium leprae
cacgccgaacagccgc

SEQ ID NO: 3236328 - RNA, 19 nt, Mycobacterium leprae
cacgccgaacagccgcgcc

SEQ ID NO: 3236329 - RNA, 19 nt, Mycobacterium leprae
cacgccgcggcugggcagc

SEQ ID NO: 3236330 - RNA, 13 nt, Mycobacterium leprae
cacgccggcgucg

SEQ ID NO: 3236331 - RNA, 21 nt, Mycobacterium leprae
cacgccguuaguuucgggccu

SEQ ID NO: 3236332 - RNA, 14 nt, Mycobacterium leprae
cacgcgaccaacgc

SEQ ID NO: 3236333 - RNA, 16 nt, Mycobacterium leprae
cacgcgacgccgccau

SEQ ID NO: 3236334 - RNA, 18 nt, Mycobacterium leprae
cacgcgcgacaguaucga

SEQ ID NO: 3236335 - RNA, 17 nt, Mycobacterium leprae
cacgcgugcggcgccca

SEQ ID NO: 3236336 - RNA, 17 nt, Mycobacterium leprae
cacgcugaucgcugaug

SEQ ID NO: 3236337 - RNA, 13 nt, Mycobacterium leprae
cacgcugcgcggc

SEQ ID NO: 3236338 - RNA, 14 nt, Mycobacterium leprae
cacgcuggccgccg

SEQ ID NO: 3236339 - RNA, 23 nt, Mycobacterium leprae
cacgcugggguuguacagcgauu

SEQ ID NO: 3236340 - RNA, 23 nt, Mycobacterium leprae
cacggaagcccucccagccaucg

SEQ ID NO: 3236341 - RNA, 13 nt, Mycobacterium leprae
cacggcaaaguca

SEQ ID NO: 3236342 - RNA, 22 nt, Mycobacterium leprae
cacggcaacgguuacugccaca

SEQ ID NO: 3236343 - RNA, 19 nt, Mycobacterium leprae
cacggcagcgucaccaagc

SEQ ID NO: 3236344 - RNA, 15 nt, Mycobacterium leprae
cacggcggcaucuca

SEQ ID NO: 3236345 - RNA, 19 nt, Mycobacterium leprae
cacggcggcaucucaacuu

SEQ ID NO: 3236346 - RNA, 12 nt, Mycobacterium leprae
cacggcucgucc

SEQ ID NO: 3236347 - RNA, 23 nt, Mycobacterium leprae
cacggcugacuccguacucacgu

SEQ ID NO: 3236348 - RNA, 20 nt, Mycobacterium leprae
cacgggaggcguugcacugu

SEQ ID NO: 3236349 - RNA, 20 nt, Mycobacterium leprae
cacgggauaggucaguucuc

SEQ ID NO: 3236350 - RNA, 15 nt, Mycobacterium leprae
cacggguggugccca

SEQ ID NO: 3236351 - RNA, 18 nt, Mycobacterium leprae
cacgguauaaaggcgcca

SEQ ID NO: 3236352 - RNA, 17 nt, Mycobacterium leprae
cacggucaacggccuca

SEQ ID NO: 3236353 - RNA, 15 nt, Mycobacterium leprae
cacggucguguaguu

SEQ ID NO: 3236354 - RNA, 19 nt, Mycobacterium leprae
cacggugccgaacugcugc

SEQ ID NO: 3236355 - RNA, 19 nt, Mycobacterium leprae
cacgguugcccgcugccag

SEQ ID NO: 3236356 - RNA, 13 nt, Mycobacterium leprae
cacguccucggcc

SEQ ID NO: 3236357 - RNA, 19 nt, Mycobacterium leprae
cacgucgauucgcucgccg

SEQ ID NO: 3236358 - RNA, 18 nt, Mycobacterium leprae
cacgucgccguuuccgcu

SEQ ID NO: 3236359 - RNA, 14 nt, Mycobacterium leprae
cacgucgcugcguc

SEQ ID NO: 3236360 - RNA, 15 nt, Mycobacterium leprae
cacgugcugccccuc

SEQ ID NO: 3236361 - RNA, 22 nt, Mycobacterium leprae
cacguucgaucggcagccacgg

SEQ ID NO: 3236362 - RNA, 19 nt, Mycobacterium leprae
cacguucuugccauccgcu

SEQ ID NO: 3236363 - RNA, 21 nt, Mycobacterium leprae
cacguugacggauuugcccca

SEQ ID NO: 3236364 - RNA, 12 nt, Mycobacterium leprae
cacguuggaugc

SEQ ID NO: 3236365 - RNA, 15 nt, Mycobacterium leprae
cacuaaaacgccccu

SEQ ID NO: 3236366 - RNA, 12 nt, Mycobacterium leprae
cacuaaacugcg

SEQ ID NO: 3236367 - RNA, 12 nt, Mycobacterium leprae
cacuaaaugcca

SEQ ID NO: 3236368 - RNA, 22 nt, Mycobacterium leprae
cacuaaaugccauaucguuccc

SEQ ID NO: 3236369 - RNA, 15 nt, Mycobacterium leprae
cacuaacaccgugcc

SEQ ID NO: 3236370 - RNA, 21 nt, Mycobacterium leprae
cacuaauaagcucgugggcgg

SEQ ID NO: 3236371 - RNA, 18 nt, Mycobacterium leprae
cacuaccaucuauaguac

SEQ ID NO: 3236372 - RNA, 15 nt, Mycobacterium leprae
cacuacccgacacaa

SEQ ID NO: 3236373 - RNA, 17 nt, Mycobacterium leprae
cacuacccgacacaaag

SEQ ID NO: 3236374 - RNA, 19 nt, Mycobacterium leprae
cacuacuccugcugacggu

SEQ ID NO: 3236375 - RNA, 20 nt, Mycobacterium leprae
cacuacuguugucaguggcg

SEQ ID NO: 3236376 - RNA, 17 nt, Mycobacterium leprae
cacuagcuugugcuccu

SEQ ID NO: 3236377 - RNA, 21 nt, Mycobacterium leprae
cacuagggaggucaccaaguu

SEQ ID NO: 3236378 - RNA, 18 nt, Mycobacterium leprae
cacuauauauauauuaau

SEQ ID NO: 3236379 - RNA, 16 nt, Mycobacterium leprae
cacucacccggucguc

SEQ ID NO: 3236380 - RNA, 14 nt, Mycobacterium leprae
cacucagugguggg

SEQ ID NO: 3236381 - RNA, 15 nt, Mycobacterium leprae
cacucauauccgaga

SEQ ID NO: 3236382 - RNA, 21 nt, Mycobacterium leprae
cacucaugaucgcaggcacca

SEQ ID NO: 3236383 - RNA, 22 nt, Mycobacterium leprae
cacucauugcuguuagacugca

SEQ ID NO: 3236384 - RNA, 16 nt, Mycobacterium leprae
cacucauuggacccag

SEQ ID NO: 3236385 - RNA, 15 nt, Mycobacterium leprae
cacuccgaccgagcg

SEQ ID NO: 3236386 - RNA, 14 nt, Mycobacterium leprae
cacucgacucaccg

SEQ ID NO: 3236387 - RNA, 23 nt, Mycobacterium leprae
cacucguagggaccgcugcggug

SEQ ID NO: 3236388 - RNA, 15 nt, Mycobacterium leprae
cacucucaucgcggc

SEQ ID NO: 3236389 - RNA, 20 nt, Mycobacterium leprae
cacugacggguggucuugau

SEQ ID NO: 3236390 - RNA, 14 nt, Mycobacterium leprae
cacugaguaccgaa

SEQ ID NO: 3236391 - RNA, 13 nt, Mycobacterium leprae
cacugaucccaga

SEQ ID NO: 3236392 - RNA, 19 nt, Mycobacterium leprae
cacugcacgaccacacugu

SEQ ID NO: 3236393 - RNA, 22 nt, Mycobacterium leprae
cacugccagagaugcguagcca

SEQ ID NO: 3236394 - RNA, 15 nt, Mycobacterium leprae
cacugccgaucgaca

SEQ ID NO: 3236395 - RNA, 23 nt, Mycobacterium leprae
cacugcgaacuaguguucggcac

SEQ ID NO: 3236396 - RNA, 22 nt, Mycobacterium leprae
cacugcgaguaacuaaggugac

SEQ ID NO: 3236397 - RNA, 23 nt, Mycobacterium leprae
cacugcucaggucgacgaacgag

SEQ ID NO: 3236398 - RNA, 21 nt, Mycobacterium leprae
cacugcuucggccagcgcauc

SEQ ID NO: 3236399 - RNA, 13 nt, Mycobacterium leprae
cacuggcggccgc

SEQ ID NO: 3236400 - RNA, 18 nt, Mycobacterium leprae
cacugggcugagccgccg

SEQ ID NO: 3236401 - RNA, 13 nt, Mycobacterium leprae
cacugggcugcuc

SEQ ID NO: 3236402 - RNA, 20 nt, Mycobacterium leprae
cacuggugcugucauccuca

SEQ ID NO: 3236403 - RNA, 13 nt, Mycobacterium leprae
cacuggugguggc

SEQ ID NO: 3236404 - RNA, 15 nt, Mycobacterium leprae
cacuggugguggccu

SEQ ID NO: 3236405 - RNA, 22 nt, Mycobacterium leprae
cacugucgcgaccaacccggcg

SEQ ID NO: 3236406 - RNA, 15 nt, Mycobacterium leprae
cacugugucaccuga

SEQ ID NO: 3236407 - RNA, 20 nt, Mycobacterium leprae
cacugugucacgcgaccaac

SEQ ID NO: 3236408 - RNA, 16 nt, Mycobacterium leprae
cacuguuuuaagcgaa

SEQ ID NO: 3236409 - RNA, 18 nt, Mycobacterium leprae
cacuuagcgugagccugg

SEQ ID NO: 3236410 - RNA, 22 nt, Mycobacterium leprae
cacuuaugagcaaaaauccgcu

SEQ ID NO: 3236411 - RNA, 16 nt, Mycobacterium leprae
cacuucagcgacaggc

SEQ ID NO: 3236412 - RNA, 17 nt, Mycobacterium leprae
cacuucccaccguggug

SEQ ID NO: 3236413 - RNA, 17 nt, Mycobacterium leprae
cacuuccggcuucucca

SEQ ID NO: 3236414 - RNA, 19 nt, Mycobacterium leprae
cacuucuuguacagugaug

SEQ ID NO: 3236415 - RNA, 23 nt, Mycobacterium leprae
cacuugacuauauaguccgacca

SEQ ID NO: 3236416 - RNA, 22 nt, Mycobacterium leprae
cacuugcgauaauuaugagugg

SEQ ID NO: 3236417 - RNA, 22 nt, Mycobacterium leprae
cacuugggcaacaccucaagca

SEQ ID NO: 3236418 - RNA, 14 nt, Mycobacterium leprae
cagaaaaccgucgc

SEQ ID NO: 3236419 - RNA, 17 nt, Mycobacterium leprae
cagaaaauucagggaau

SEQ ID NO: 3236420 - RNA, 13 nt, Mycobacterium leprae
cagaaaguugaag

SEQ ID NO: 3236421 - RNA, 14 nt, Mycobacterium leprae
cagccaagccgcca

SEQ ID NO: 3236422 - RNA, 20 nt, Mycobacterium leprae
cagccaaucguguaucgucg

SEQ ID NO: 3236423 - RNA, 20 nt, Mycobacterium leprae
cagccaaugucacaucgauu

SEQ ID NO: 3236424 - RNA, 14 nt, Mycobacterium leprae
cagccacacccgag

SEQ ID NO: 3236425 - RNA, 22 nt, Mycobacterium leprae
cagccaccacucucaucgcggc

SEQ ID NO: 3236426 - RNA, 15 nt, Mycobacterium leprae
cagccaccaucugga

SEQ ID NO: 3236427 - RNA, 15 nt, Mycobacterium leprae
cagccacccgcaucg

SEQ ID NO: 3236428 - RNA, 17 nt, Mycobacterium leprae
cagccaccgacgagcaa

SEQ ID NO: 3236429 - RNA, 15 nt, Mycobacterium leprae
cagccagaccaacau

SEQ ID NO: 3236430 - RNA, 16 nt, Mycobacterium leprae
cagccagcaaggcaac

SEQ ID NO: 3236431 - RNA, 16 nt, Mycobacterium leprae
cagccaucacugaucc

SEQ ID NO: 3236432 - RNA, 15 nt, Mycobacterium leprae
cagccauccgaaacc

SEQ ID NO: 3236433 - RNA, 21 nt, Mycobacterium leprae
cagcccaggugcccagccccu

SEQ ID NO: 3236434 - RNA, 14 nt, Mycobacterium leprae
cagcccgauuugaa

SEQ ID NO: 3236435 - RNA, 14 nt, Mycobacterium leprae
cagcccgcgccgcc

SEQ ID NO: 3236436 - RNA, 15 nt, Mycobacterium leprae
cagcccgcgccgccg

SEQ ID NO: 3236437 - RNA, 16 nt, Mycobacterium leprae
cagcccgcgccgccgu

SEQ ID NO: 3236438 - RNA, 17 nt, Mycobacterium leprae
cagcccgcuagcaucga

SEQ ID NO: 3236439 - RNA, 19 nt, Mycobacterium leprae
cagcccgcuagcaucgacc

SEQ ID NO: 3236440 - RNA, 13 nt, Mycobacterium leprae
cagccgaggggcc

SEQ ID NO: 3236441 - RNA, 18 nt, Mycobacterium leprae
cagccgaggggccgucgg

SEQ ID NO: 3236442 - RNA, 19 nt, Mycobacterium leprae
cagccgaggggccgucggc

SEQ ID NO: 3236443 - RNA, 21 nt, Mycobacterium leprae
cagccgagguucccggcggcc

SEQ ID NO: 3236444 - RNA, 19 nt, Mycobacterium leprae
cagccgcaggcaccauuga

SEQ ID NO: 3236445 - RNA, 13 nt, Mycobacterium leprae
cagccgcgggcga

SEQ ID NO: 3236446 - RNA, 21 nt, Mycobacterium leprae
cagccgcguccagacaccacu

SEQ ID NO: 3236447 - RNA, 18 nt, Mycobacterium leprae
cagccggaggguugccga

SEQ ID NO: 3236448 - RNA, 19 nt, Mycobacterium leprae
cagccgggcuaaggugcgu

SEQ ID NO: 3236449 - RNA, 14 nt, Mycobacterium leprae
cagccgggugaucc

SEQ ID NO: 3236450 - RNA, 16 nt, Mycobacterium leprae
cagccgucgagccgau

SEQ ID NO: 3236451 - RNA, 14 nt, Mycobacterium leprae
cagccgucgcguga

SEQ ID NO: 3236452 - RNA, 13 nt, Mycobacterium leprae
cagccgugccucg

SEQ ID NO: 3236453 - RNA, 22 nt, Mycobacterium leprae
cagccguugcugcugccccccg

SEQ ID NO: 3236454 - RNA, 21 nt, Mycobacterium leprae
cagccuagcagcaucgcgucu

SEQ ID NO: 3236455 - RNA, 23 nt, Mycobacterium leprae
cagccugcgacacuugccgcguu

SEQ ID NO: 3236456 - RNA, 22 nt, Mycobacterium leprae
cagccuugcaaaacgucgaucu

SEQ ID NO: 3236457 - RNA, 17 nt, Mycobacterium leprae
cagcgacacagccggcc

SEQ ID NO: 3236458 - RNA, 16 nt, Mycobacterium leprae
cagcgacgcggaacgc

SEQ ID NO: 3236459 - RNA, 21 nt, Mycobacterium leprae
cagcgacgugccgugaucagu

SEQ ID NO: 3236460 - RNA, 13 nt, Mycobacterium leprae
cagcgacuggauc

SEQ ID NO: 3236461 - RNA, 16 nt, Mycobacterium leprae
cagcgagaagccccau

SEQ ID NO: 3236462 - RNA, 21 nt, Mycobacterium leprae
cagcgagaaucccaguguauu

SEQ ID NO: 3236463 - RNA, 15 nt, Mycobacterium leprae
cagcgaggccguggc

SEQ ID NO: 3236464 - RNA, 14 nt, Mycobacterium leprae
cagcgauugggauc

SEQ ID NO: 3236465 - RNA, 22 nt, Mycobacterium leprae
cagcgauugggaucguacgaaa

SEQ ID NO: 3236466 - RNA, 16 nt, Mycobacterium leprae
cagcgcacgguaagac

SEQ ID NO: 3236467 - RNA, 16 nt, Mycobacterium leprae
cagcgccaauuccucc

SEQ ID NO: 3236468 - RNA, 19 nt, Mycobacterium leprae
cagcgccagaccugccggu

SEQ ID NO: 3236469 - RNA, 14 nt, Mycobacterium leprae
cagcgccugccccg

SEQ ID NO: 3236470 - RNA, 19 nt, Mycobacterium leprae
cagcgcggcaucgucggca

SEQ ID NO: 3236471 - RNA, 15 nt, Mycobacterium leprae
cagcgcucgcuggaa

SEQ ID NO: 3236472 - RNA, 18 nt, Mycobacterium leprae
cagcggcagcggcggccg

SEQ ID NO: 3236473 - RNA, 14 nt, Mycobacterium leprae
cagcggcccaaccc

SEQ ID NO: 3236474 - RNA, 17 nt, Mycobacterium leprae
cagcggcccaacccggc

SEQ ID NO: 3236475 - RNA, 20 nt, Mycobacterium leprae
cagcggcggccgugauuuuc

SEQ ID NO: 3236476 - RNA, 17 nt, Mycobacterium leprae
cagcggcuaugacccga

SEQ ID NO: 3236477 - RNA, 20 nt, Mycobacterium leprae
cagcgggcggggcgguggca

SEQ ID NO: 3236478 - RNA, 15 nt, Mycobacterium leprae
cagcgggggugggcu

SEQ ID NO: 3236479 - RNA, 16 nt, Mycobacterium leprae
cagcgguaacuggcuc

SEQ ID NO: 3236480 - RNA, 23 nt, Mycobacterium leprae
cagcguaaucgcuuggugcugcu

SEQ ID NO: 3236481 - RNA, 16 nt, Mycobacterium leprae
cagcgucaccaagcgc

SEQ ID NO: 3236482 - RNA, 17 nt, Mycobacterium leprae
cagcgucccaaccaauc

SEQ ID NO: 3236483 - RNA, 18 nt, Mycobacterium leprae
cagcgucgcucacggcca

SEQ ID NO: 3236484 - RNA, 15 nt, Mycobacterium leprae
cagcgucggacgccg

SEQ ID NO: 3236485 - RNA, 18 nt, Mycobacterium leprae
cagcgucggacgccggac

SEQ ID NO: 3236486 - RNA, 23 nt, Mycobacterium leprae
cagcgucggacgccggaccccau

SEQ ID NO: 3236487 - RNA, 19 nt, Mycobacterium leprae
cagcgucguggcugugaug

SEQ ID NO: 3236488 - RNA, 15 nt, Mycobacterium leprae
cagcgugcaaauggc

SEQ ID NO: 3236489 - RNA, 17 nt, Mycobacterium leprae
cagcuaaccuccacggu

SEQ ID NO: 3236490 - RNA, 24 nt, Mycobacterium leprae
cagcuaagccugcacuuuacgugc

SEQ ID NO: 3236491 - RNA, 17 nt, Mycobacterium leprae
cagcuaaucccauggga

SEQ ID NO: 3236492 - RNA, 19 nt, Mycobacterium leprae
cagcuaaucccaugggagu

SEQ ID NO: 3236493 - RNA, 22 nt, Mycobacterium leprae
cagcuacaccuuggccgccggc

SEQ ID NO: 3236494 - RNA, 13 nt, Mycobacterium leprae
cagcuaccagggu

SEQ ID NO: 3236495 - RNA, 16 nt, Mycobacterium leprae
cagcuauccccgaucg

SEQ ID NO: 3236496 - RNA, 17 nt, Mycobacterium leprae
cagcucacaauugacaa

SEQ ID NO: 3236497 - RNA, 21 nt, Mycobacterium leprae
cagcucacaauugacaacacg

SEQ ID NO: 3236498 - RNA, 19 nt, Mycobacterium leprae
cagcucacccgcagcaccu

SEQ ID NO: 3236499 - RNA, 18 nt, Mycobacterium leprae
cagcucaggauagcgacu

SEQ ID NO: 3236500 - RNA, 18 nt, Mycobacterium leprae
cagcuccagaacggucug

SEQ ID NO: 3236501 - RNA, 16 nt, Mycobacterium leprae
cagcuccagcucgcgg

SEQ ID NO: 3236502 - RNA, 15 nt, Mycobacterium leprae
cagcuccgaagcacc

SEQ ID NO: 3236503 - RNA, 22 nt, Mycobacterium leprae
cagcucgaacuaacugccuauc

SEQ ID NO: 3236504 - RNA, 16 nt, Mycobacterium leprae
cagcucgauggugcca

SEQ ID NO: 3236505 - RNA, 20 nt, Mycobacterium leprae
cagcucgcggugggcuucca

SEQ ID NO: 3236506 - RNA, 13 nt, Mycobacterium leprae
cagcucggacaag

SEQ ID NO: 3236507 - RNA, 17 nt, Mycobacterium leprae
cagcucggcaucggccu

SEQ ID NO: 3236508 - RNA, 22 nt, Mycobacterium leprae
cagcucguccaucgcgucgucu

SEQ ID NO: 3236509 - RNA, 19 nt, Mycobacterium leprae
cagcucgugguccacggcu

SEQ ID NO: 3236510 - RNA, 18 nt, Mycobacterium leprae
cagcugacgauuaucugc

SEQ ID NO: 3236511 - RNA, 20 nt, Mycobacterium leprae
cagcugcaacaccuccucug

SEQ ID NO: 3236512 - RNA, 18 nt, Mycobacterium leprae
cagcugccauuggccgcu

SEQ ID NO: 3236513 - RNA, 21 nt, Mycobacterium leprae
cagcugccauuggccgcuggu

SEQ ID NO: 3236514 - RNA, 20 nt, Mycobacterium leprae
cagcugcugagcguggcugc

SEQ ID NO: 3236515 - RNA, 23 nt, Mycobacterium leprae
cagcugcuuuaccuucaggucua

SEQ ID NO: 3236516 - RNA, 14 nt, Mycobacterium leprae
cagcuggccaagcg

SEQ ID NO: 3236517 - RNA, 21 nt, Mycobacterium leprae
cagcuggccgggaucggcggc

SEQ ID NO: 3236518 - RNA, 15 nt, Mycobacterium leprae
cagcuggugaccuga

SEQ ID NO: 3236519 - RNA, 16 nt, Mycobacterium leprae
cagcuggugcuggcgu

SEQ ID NO: 3236520 - RNA, 16 nt, Mycobacterium leprae
cagcugguggucacug

SEQ ID NO: 3236521 - RNA, 18 nt, Mycobacterium leprae
cagcuguugacugcgaaa

SEQ ID NO: 3236522 - RNA, 18 nt, Mycobacterium leprae
cagcuucgcagacacagc

SEQ ID NO: 3236523 - RNA, 15 nt, Mycobacterium leprae
cagcuucggucuggc

SEQ ID NO: 3236524 - RNA, 22 nt, Mycobacterium leprae
cagcuugaacgccgcgagcaaa

SEQ ID NO: 3236525 - RNA, 21 nt, Mycobacterium leprae
cagcuugacaucagucagcau

SEQ ID NO: 3236526 - RNA, 13 nt, Mycobacterium leprae
cagcuuguuggcc

SEQ ID NO: 3236527 - RNA, 17 nt, Mycobacterium leprae
cagcuuguuggccaucg

SEQ ID NO: 3236528 - RNA, 23 nt, Mycobacterium leprae
caggaacgcgucggugacucuga

SEQ ID NO: 3236529 - RNA, 19 nt, Mycobacterium leprae
caggaagugcucaauuuag

SEQ ID NO: 3236530 - RNA, 17 nt, Mycobacterium leprae
caggaauuuagaggcug

SEQ ID NO: 3236531 - RNA, 17 nt, Mycobacterium leprae
caggacaaagucagcuu

SEQ ID NO: 3236532 - RNA, 22 nt, Mycobacterium leprae
caggacauauuaagacgcugau

SEQ ID NO: 3236533 - RNA, 16 nt, Mycobacterium leprae
cagucuuugggccauc

SEQ ID NO: 3236534 - RNA, 23 nt, Mycobacterium leprae
cagucuuugggccaucggcagau

SEQ ID NO: 3236535 - RNA, 16 nt, Mycobacterium leprae
cagugaacacgcugau

SEQ ID NO: 3236536 - RNA, 13 nt, Mycobacterium leprae
cagugaagaccau

SEQ ID NO: 3236537 - RNA, 17 nt, Mycobacterium leprae
cagugacggcgucgaau

SEQ ID NO: 3236538 - RNA, 18 nt, Mycobacterium leprae
cagugagugcauucugac

SEQ ID NO: 3236539 - RNA, 15 nt, Mycobacterium leprae
cagugaugaucggca

SEQ ID NO: 3236540 - RNA, 19 nt, Mycobacterium leprae
cagugaugaucggcaaaau

SEQ ID NO: 3236541 - RNA, 23 nt, Mycobacterium leprae
cagugcacgagcggguguuuccg

SEQ ID NO: 3236542 - RNA, 13 nt, Mycobacterium leprae
cagugcacucuuc

SEQ ID NO: 3236543 - RNA, 16 nt, Mycobacterium leprae
cagugcaguucaccac

SEQ ID NO: 3236544 - RNA, 21 nt, Mycobacterium leprae
cagugcaucgaugauccggcc

SEQ ID NO: 3236545 - RNA, 13 nt, Mycobacterium leprae
cagugccgccgau

SEQ ID NO: 3236546 - RNA, 14 nt, Mycobacterium leprae
cagugccggaaccc

SEQ ID NO: 3236547 - RNA, 14 nt, Mycobacterium leprae
cagugccguaaauc

SEQ ID NO: 3236548 - RNA, 20 nt, Mycobacterium leprae
cagugccugaccaucgggca

SEQ ID NO: 3236549 - RNA, 19 nt, Mycobacterium leprae
cagugccuugggcacggag

SEQ ID NO: 3236550 - RNA, 13 nt, Mycobacterium leprae
cagugcuagcagc

SEQ ID NO: 3236551 - RNA, 14 nt, Mycobacterium leprae
cagugcuucccuug

SEQ ID NO: 3236552 - RNA, 17 nt, Mycobacterium leprae
caguggcaacugaagau

SEQ ID NO: 3236553 - RNA, 17 nt, Mycobacterium leprae
caguggcguggccguga

SEQ ID NO: 3236554 - RNA, 14 nt, Mycobacterium leprae
caguggcugcaccg

SEQ ID NO: 3236555 - RNA, 17 nt, Mycobacterium leprae
cagugggccaguggcuu

SEQ ID NO: 3236556 - RNA, 17 nt, Mycobacterium leprae
cagugggggugcggcag

SEQ ID NO: 3236557 - RNA, 20 nt, Mycobacterium leprae
cagugggugaaacccuucac

SEQ ID NO: 3236558 - RNA, 19 nt, Mycobacterium leprae
cagugugccagcgcucgcu

SEQ ID NO: 3236559 - RNA, 10 nt, Mycobacterium leprae
caguguggcc

SEQ ID NO: 3236560 - RNA, 19 nt, Mycobacterium leprae
caguguucaggccaucaga

SEQ ID NO: 3236561 - RNA, 19 nt, Mycobacterium leprae
caguuagcaugagcugcug

SEQ ID NO: 3236562 - RNA, 18 nt, Mycobacterium leprae
caguucaccacaucaucg

SEQ ID NO: 3236563 - RNA, 16 nt, Mycobacterium leprae
caguucacgcuggccg

SEQ ID NO: 3236564 - RNA, 23 nt, Mycobacterium leprae
caguuccuguguugccaucgacg

SEQ ID NO: 3236565 - RNA, 13 nt, Mycobacterium leprae
caguucgacuggc

SEQ ID NO: 3236566 - RNA, 19 nt, Mycobacterium leprae
caguugcucgucaucgacg

SEQ ID NO: 3236567 - RNA, 16 nt, Mycobacterium leprae
caguugcuugucuucu

SEQ ID NO: 3236568 - RNA, 19 nt, Mycobacterium leprae
caguuggguuugcugucaa

SEQ ID NO: 3236569 - RNA, 17 nt, Mycobacterium leprae
cauaaaauauaacgcga

SEQ ID NO: 3236570 - RNA, 19 nt, Mycobacterium leprae
cauaacacccgguuggcca

SEQ ID NO: 3236571 - RNA, 17 nt, Mycobacterium leprae
cauacagcuaaccucca

SEQ ID NO: 3236572 - RNA, 17 nt, Mycobacterium leprae
cauacagugcaccggug

SEQ ID NO: 3236573 - RNA, 18 nt, Mycobacterium leprae
cauaccgaacucgaugcc

SEQ ID NO: 3236574 - RNA, 17 nt, Mycobacterium leprae
cauacucgacgaaccaa

SEQ ID NO: 3236575 - RNA, 15 nt, Mycobacterium leprae
cauacuggcacgcca

SEQ ID NO: 3236576 - RNA, 16 nt, Mycobacterium leprae
cauagaacaccgaagc

SEQ ID NO: 3236577 - RNA, 19 nt, Mycobacterium leprae
cauagaaccugccuagcaa

SEQ ID NO: 3236578 - RNA, 12 nt, Mycobacterium leprae
cauagccgaucu

SEQ ID NO: 3236579 - RNA, 23 nt, Mycobacterium leprae
cauagcgguuuccggcaccaaug

SEQ ID NO: 3236580 - RNA, 18 nt, Mycobacterium leprae
cauagggagaaugccaca

SEQ ID NO: 3236581 - RNA, 22 nt, Mycobacterium leprae
cauagggagaaugccacaggcg

SEQ ID NO: 3236582 - RNA, 14 nt, Mycobacterium leprae
cauagguggugggu

SEQ ID NO: 3236583 - RNA, 14 nt, Mycobacterium leprae
cauagugaccaaaa

SEQ ID NO: 3236584 - RNA, 16 nt, Mycobacterium leprae
cauagugcaagugcac

SEQ ID NO: 3236585 - RNA, 23 nt, Mycobacterium leprae
cauagugcaagugcaccaucugc

SEQ ID NO: 3236586 - RNA, 19 nt, Mycobacterium leprae
cauauagcgucccagcucc

SEQ ID NO: 3236587 - RNA, 17 nt, Mycobacterium leprae
cauaucaaaccaguacc

SEQ ID NO: 3236588 - RNA, 15 nt, Mycobacterium leprae
cauaucgcgcaacga

SEQ ID NO: 3236589 - RNA, 19 nt, Mycobacterium leprae
cauaucgcgcaacgacugu

SEQ ID NO: 3236590 - RNA, 17 nt, Mycobacterium leprae
cauaucuaauugggauc

SEQ ID NO: 3236591 - RNA, 13 nt, Mycobacterium leprae
cauaugcagcugc

SEQ ID NO: 3236592 - RNA, 22 nt, Mycobacterium leprae
cauauucgucaaaaaacucaug

SEQ ID NO: 3236593 - RNA, 13 nt, Mycobacterium leprae
caucagauauccu

SEQ ID NO: 3236594 - RNA, 23 nt, Mycobacterium leprae
caucagauucacagucggcgcag

SEQ ID NO: 3236595 - RNA, 11 nt, Mycobacterium leprae
caucaucaccg

SEQ ID NO: 3236596 - RNA, 21 nt, Mycobacterium leprae
caucaucgaucagacccuugg

SEQ ID NO: 3236597 - RNA, 22 nt, Mycobacterium leprae
caucaucgcuaagacucaccaa

SEQ ID NO: 3236598 - RNA, 14 nt, Mycobacterium leprae
cauccaacacgccg

SEQ ID NO: 3236599 - RNA, 13 nt, Mycobacterium leprae
cauccaccaccga

SEQ ID NO: 3236600 - RNA, 14 nt, Mycobacterium leprae
cauccaccgccgag

SEQ ID NO: 3236601 - RNA, 17 nt, Mycobacterium leprae
cauccaggauagccgau

SEQ ID NO: 3236602 - RNA, 18 nt, Mycobacterium leprae
cauccaggauagccgauu

SEQ ID NO: 3236603 - RNA, 17 nt, Mycobacterium leprae
cauccaucgcaucugcc

SEQ ID NO: 3236604 - RNA, 13 nt, Mycobacterium leprae
caucccagcaacg

SEQ ID NO: 3236605 - RNA, 22 nt, Mycobacterium leprae
caucccagugugcugcauccga

SEQ ID NO: 3236606 - RNA, 22 nt, Mycobacterium leprae
cauccccgaaaggauggggcca

SEQ ID NO: 3236607 - RNA, 20 nt, Mycobacterium leprae
caucccgaagugaucggcga

SEQ ID NO: 3236608 - RNA, 21 nt, Mycobacterium leprae
caucccgaagugaucggcgac

SEQ ID NO: 3236609 - RNA, 13 nt, Mycobacterium leprae
caucccugggccg

SEQ ID NO: 3236610 - RNA, 23 nt, Mycobacterium leprae
cauccgaaacccgaaaccaagcc

SEQ ID NO: 3236611 - RNA, 20 nt, Mycobacterium leprae
cauccgaucaauggcagcca

SEQ ID NO: 3236612 - RNA, 17 nt, Mycobacterium leprae
cauccgcaagcgcgccg

SEQ ID NO: 3236613 - RNA, 22 nt, Mycobacterium leprae
cauccgcaagcgcgccgagugg

SEQ ID NO: 3236614 - RNA, 14 nt, Mycobacterium leprae
cauccgcagcacua

SEQ ID NO: 3236615 - RNA, 15 nt, Mycobacterium leprae
cauccgccacaugug

SEQ ID NO: 3236616 - RNA, 21 nt, Mycobacterium leprae
cauccggcguuaaacgcgauc

SEQ ID NO: 3236617 - RNA, 13 nt, Mycobacterium leprae
cauccgggccagu

SEQ ID NO: 3236618 - RNA, 15 nt, Mycobacterium leprae
cauccguccaccccg

SEQ ID NO: 3236619 - RNA, 22 nt, Mycobacterium leprae
cauccguuccucuuaacaacuu

SEQ ID NO: 3236620 - RNA, 12 nt, Mycobacterium leprae
cauccugcugua

SEQ ID NO: 3236621 - RNA, 20 nt, Mycobacterium leprae
caucgaaccgacgaugcugu

SEQ ID NO: 3236622 - RNA, 16 nt, Mycobacterium leprae
caucgaacggcggggc

SEQ ID NO: 3236623 - RNA, 14 nt, Mycobacterium leprae
caucgacagcaccc

SEQ ID NO: 3236624 - RNA, 18 nt, Mycobacterium leprae
caucgacagcacccagcu

SEQ ID NO: 3236625 - RNA, 19 nt, Mycobacterium leprae
caucgacaucccagcaacg

SEQ ID NO: 3236626 - RNA, 14 nt, Mycobacterium leprae
caucgacgccgccg

SEQ ID NO: 3236627 - RNA, 13 nt, Mycobacterium leprae
caucgaucagacc

SEQ ID NO: 3236628 - RNA, 14 nt, Mycobacterium leprae
caucgaugcacugu

SEQ ID NO: 3236629 - RNA, 17 nt, Mycobacterium leprae
caucgcagagcucacug

SEQ ID NO: 3236630 - RNA, 13 nt, Mycobacterium leprae
caucgcagcgauu

SEQ ID NO: 3236631 - RNA, 14 nt, Mycobacterium leprae
caucgcaucugcca

SEQ ID NO: 3236632 - RNA, 23 nt, Mycobacterium leprae
caucgccaacccgggagucgaca

SEQ ID NO: 3236633 - RNA, 19 nt, Mycobacterium leprae
caucgccaaccgucgggau

SEQ ID NO: 3236634 - RNA, 14 nt, Mycobacterium leprae
caucgccaccgacc

SEQ ID NO: 3236635 - RNA, 21 nt, Mycobacterium leprae
caucgccgugguggcucgcgu

SEQ ID NO: 3236636 - RNA, 13 nt, Mycobacterium leprae
caucgccuuccaa

SEQ ID NO: 3236637 - RNA, 15 nt, Mycobacterium leprae
caucgcggcugccac

SEQ ID NO: 3236638 - RNA, 22 nt, Mycobacterium leprae
caucgcggucugggcgugugca

SEQ ID NO: 3236639 - RNA, 13 nt, Mycobacterium leprae
caucgcgucgucu

SEQ ID NO: 3236640 - RNA, 14 nt, Mycobacterium leprae
caucgcgucuucca

SEQ ID NO: 3236641 - RNA, 16 nt, Mycobacterium leprae
caucgcugccaucgac

SEQ ID NO: 3236642 - RNA, 17 nt, Mycobacterium leprae
caucgcugccaucgacg

SEQ ID NO: 3236643 - RNA, 22 nt, Mycobacterium leprae
caucggaaucgccgcgacgaac

SEQ ID NO: 3236644 - RNA, 20 nt, Mycobacterium leprae
caucggacaggaucggugau

SEQ ID NO: 3236645 - RNA, 19 nt, Mycobacterium leprae
caucggacuaauggcaccc

SEQ ID NO: 3236646 - RNA, 20 nt, Mycobacterium leprae
ccaaaccgaagaucaccgcc

SEQ ID NO: 3236647 - RNA, 21 nt, Mycobacterium leprae
ccaaaccguugaagagcgaaa

SEQ ID NO: 3236648 - RNA, 18 nt, Mycobacterium leprae
ccaaaccucugcaaccga

SEQ ID NO: 3236649 - RNA, 22 nt, Mycobacterium leprae
ccaaacuugguuaauaucaaug

SEQ ID NO: 3236650 - RNA, 17 nt, Mycobacterium leprae
ccaacaccccgauucca

SEQ ID NO: 3236651 - RNA, 19 nt, Mycobacterium leprae
ccaacagccaaugucacau

SEQ ID NO: 3236652 - RNA, 22 nt, Mycobacterium leprae
ccaaccgacgauuccuggaaag

SEQ ID NO: 3236653 - RNA, 13 nt, Mycobacterium leprae
ccaaccugugcau

SEQ ID NO: 3236654 - RNA, 19 nt, Mycobacterium leprae
ccaacgauacugaugggca

SEQ ID NO: 3236655 - RNA, 13 nt, Mycobacterium leprae
ccaacgcgcaccu

SEQ ID NO: 3236656 - RNA, 14 nt, Mycobacterium leprae
ccaacgcggccgca

SEQ ID NO: 3236657 - RNA, 15 nt, Mycobacterium leprae
ccaacgggaacagcg

SEQ ID NO: 3236658 - RNA, 17 nt, Mycobacterium leprae
ccaacgguaucucccca

SEQ ID NO: 3236659 - RNA, 21 nt, Mycobacterium leprae
ccaacuaggauagauccacca

SEQ ID NO: 3236660 - RNA, 16 nt, Mycobacterium leprae
ccaacuagucgcccgg

SEQ ID NO: 3236661 - RNA, 22 nt, Mycobacterium leprae
ccaacuaugcuggcuaagacgc

SEQ ID NO: 3236662 - RNA, 15 nt, Mycobacterium leprae
ccaacucggccgcca

SEQ ID NO: 3236663 - RNA, 18 nt, Mycobacterium leprae
ccaagaccaccugucugg

SEQ ID NO: 3236664 - RNA, 23 nt, Mycobacterium leprae
ccaagacucagugaagaccaucu

SEQ ID NO: 3236665 - RNA, 22 nt, Mycobacterium leprae
ccaagauagcgcagacaauucg

SEQ ID NO: 3236666 - RNA, 18 nt, Mycobacterium leprae
ccaagauggcgucaccgu

SEQ ID NO: 3236667 - RNA, 19 nt, Mycobacterium leprae
ccaagcuguuucuguauua

SEQ ID NO: 3236668 - RNA, 18 nt, Mycobacterium leprae
ccaaggggcuacaaucua

SEQ ID NO: 3236669 - RNA, 17 nt, Mycobacterium leprae
ccaaguaagacagguaa

SEQ ID NO: 3236670 - RNA, 16 nt, Mycobacterium leprae
ccaagugaugucuuug

SEQ ID NO: 3236671 - RNA, 16 nt, Mycobacterium leprae
ccaaguggcugcuaug

SEQ ID NO: 3236672 - RNA, 21 nt, Mycobacterium leprae
ccaauaagagguaaugcugcc

SEQ ID NO: 3236673 - RNA, 15 nt, Mycobacterium leprae
ccaauccaccgugcu

SEQ ID NO: 3236674 - RNA, 17 nt, Mycobacterium leprae
ccaauccgauuuguaca

SEQ ID NO: 3236675 - RNA, 22 nt, Mycobacterium leprae
ccaaucuguuccgcgugugccg

SEQ ID NO: 3236676 - RNA, 14 nt, Mycobacterium leprae
ccaaucuuugacca

SEQ ID NO: 3236677 - RNA, 14 nt, Mycobacterium leprae
ccaaugcagcaacg

SEQ ID NO: 3236678 - RNA, 21 nt, Mycobacterium leprae
ccaaugcagcaacgugcaguc

SEQ ID NO: 3236679 - RNA, 18 nt, Mycobacterium leprae
ccaauucacgaacaacag

SEQ ID NO: 3236680 - RNA, 17 nt, Mycobacterium leprae
ccaauucguaauuccug

SEQ ID NO: 3236681 - RNA, 21 nt, Mycobacterium leprae
ccaauugccauccucgauggu

SEQ ID NO: 3236682 - RNA, 18 nt, Mycobacterium leprae
ccacaagcaacugcagcu

SEQ ID NO: 3236683 - RNA, 23 nt, Mycobacterium leprae
ccacaagcagaauuggagugaag

SEQ ID NO: 3236684 - RNA, 15 nt, Mycobacterium leprae
ccacaauucuucgcu

SEQ ID NO: 3236685 - RNA, 20 nt, Mycobacterium leprae
ccacaauucuucgcucagca

SEQ ID NO: 3236686 - RNA, 19 nt, Mycobacterium leprae
ccacacucgaccuccgcua

SEQ ID NO: 3236687 - RNA, 15 nt, Mycobacterium leprae
ccacagcaucaacgc

SEQ ID NO: 3236688 - RNA, 15 nt, Mycobacterium leprae
ccacaggcagagcca

SEQ ID NO: 3236689 - RNA, 21 nt, Mycobacterium leprae
ccacaggcgauucauggcuug

SEQ ID NO: 3236690 - RNA, 19 nt, Mycobacterium leprae
ccacagucacgccugaugc

SEQ ID NO: 3236691 - RNA, 17 nt, Mycobacterium leprae
ccacauaugccgccaug

SEQ ID NO: 3236692 - RNA, 16 nt, Mycobacterium leprae
ccacauugaccacgcc

SEQ ID NO: 3236693 - RNA, 19 nt, Mycobacterium leprae
ccacauugaccacgccgac

SEQ ID NO: 3236694 - RNA, 13 nt, Mycobacterium leprae
ccacauuugcgaa

SEQ ID NO: 3236695 - RNA, 13 nt, Mycobacterium leprae
ccaccacucucau

SEQ ID NO: 3236696 - RNA, 21 nt, Mycobacterium leprae
ccaccaguggcucgccgcgca

SEQ ID NO: 3236697 - RNA, 22 nt, Mycobacterium leprae
ccaccauauaagcgaaguccuu

SEQ ID NO: 3236698 - RNA, 11 nt, Mycobacterium leprae
ccaccauguuu

SEQ ID NO: 3236699 - RNA, 19 nt, Mycobacterium leprae
ccacccaaggauucagcca

SEQ ID NO: 3236700 - RNA, 15 nt, Mycobacterium leprae
ccacccacggcuguc

SEQ ID NO: 3236701 - RNA, 16 nt, Mycobacterium leprae
ccacccgucccgcagc

SEQ ID NO: 3236702 - RNA, 21 nt, Mycobacterium leprae
ccaccgaacccagacgcgacc

SEQ ID NO: 3236703 - RNA, 13 nt, Mycobacterium leprae
ccaccgaccgccu

SEQ ID NO: 3236704 - RNA, 21 nt, Mycobacterium leprae
ccaccgccaccgaacccagac

SEQ ID NO: 3236705 - RNA, 16 nt, Mycobacterium leprae
ccaccgcuacggcggu

SEQ ID NO: 3236706 - RNA, 17 nt, Mycobacterium leprae
ccaccguaagucagaug

SEQ ID NO: 3236707 - RNA, 20 nt, Mycobacterium leprae
ccaccgucgguacuguuggu

SEQ ID NO: 3236708 - RNA, 22 nt, Mycobacterium leprae
ccaccuggucaccaaccggccg

SEQ ID NO: 3236709 - RNA, 15 nt, Mycobacterium leprae
ccacgaaaaucuggc

SEQ ID NO: 3236710 - RNA, 13 nt, Mycobacterium leprae
ccacgacaucuug

SEQ ID NO: 3236711 - RNA, 14 nt, Mycobacterium leprae
ccacgaccaaaccu

SEQ ID NO: 3236712 - RNA, 20 nt, Mycobacterium leprae
ccacgaggggguuaccuggg

SEQ ID NO: 3236713 - RNA, 16 nt, Mycobacterium leprae
ccacgauucugcugga

SEQ ID NO: 3236714 - RNA, 22 nt, Mycobacterium leprae
ccacgauucugcuggagaucga

SEQ ID NO: 3236715 - RNA, 18 nt, Mycobacterium leprae
ccacgccgauaucgacca

SEQ ID NO: 3236716 - RNA, 21 nt, Mycobacterium leprae
ccacgccgauaucgaccagcc

SEQ ID NO: 3236717 - RNA, 16 nt, Mycobacterium leprae
ccacgccgugcuucca

SEQ ID NO: 3236718 - RNA, 21 nt, Mycobacterium leprae
ccacgcuggcacuccgaccga

SEQ ID NO: 3236719 - RNA, 13 nt, Mycobacterium leprae
ccacggcggcauc

SEQ ID NO: 3236720 - RNA, 16 nt, Mycobacterium leprae
ccacggcggcaucuca

SEQ ID NO: 3236721 - RNA, 20 nt, Mycobacterium leprae
ccacggcgggugaugaucac

SEQ ID NO: 3236722 - RNA, 15 nt, Mycobacterium leprae
ccacgucgaucagcg

SEQ ID NO: 3236723 - RNA, 13 nt, Mycobacterium leprae
ccacgucgcccaa

SEQ ID NO: 3236724 - RNA, 13 nt, Mycobacterium leprae
ccacgucgccggu

SEQ ID NO: 3236725 - RNA, 23 nt, Mycobacterium leprae
ccacgucgccgguagcagcggua

SEQ ID NO: 3236726 - RNA, 19 nt, Mycobacterium leprae
ccacgucgccguuuccgcu

SEQ ID NO: 3236727 - RNA, 19 nt, Mycobacterium leprae
ccacgucgggcagcaaccg

SEQ ID NO: 3236728 - RNA, 20 nt, Mycobacterium leprae
ccacgucgggcagcaaccgc

SEQ ID NO: 3236729 - RNA, 17 nt, Mycobacterium leprae
ccacuauuucaaagcgc

SEQ ID NO: 3236730 - RNA, 12 nt, Mycobacterium leprae
ccacucggacac

SEQ ID NO: 3236731 - RNA, 18 nt, Mycobacterium leprae
ccacugaaccugccaucc

SEQ ID NO: 3236732 - RNA, 22 nt, Mycobacterium leprae
ccacugcagggcgagcugcgcc

SEQ ID NO: 3236733 - RNA, 17 nt, Mycobacterium leprae
ccacuggugguggccuc

SEQ ID NO: 3236734 - RNA, 14 nt, Mycobacterium leprae
ccacugucgcccga

SEQ ID NO: 3236735 - RNA, 18 nt, Mycobacterium leprae
ccacuguuuuaagcgaaa

SEQ ID NO: 3236736 - RNA, 21 nt, Mycobacterium leprae
ccacuugacggucgagcugga

SEQ ID NO: 3236737 - RNA, 16 nt, Mycobacterium leprae
ccacuugggcaacacc

SEQ ID NO: 3236738 - RNA, 20 nt, Mycobacterium leprae
ccagaaaguacugaccggcu

SEQ ID NO: 3236739 - RNA, 21 nt, Mycobacterium leprae
ccagaaaguacugaccggcua

SEQ ID NO: 3236740 - RNA, 17 nt, Mycobacterium leprae
ccagaccgaaaaccaca

SEQ ID NO: 3236741 - RNA, 16 nt, Mycobacterium leprae
ccagacgcgaccgcca

SEQ ID NO: 3236742 - RNA, 13 nt, Mycobacterium leprae
ccagacgucaacc

SEQ ID NO: 3236743 - RNA, 21 nt, Mycobacterium leprae
ccagacucagaaaucguucga

SEQ ID NO: 3236744 - RNA, 22 nt, Mycobacterium leprae
ccagagacgaagacauaucaac

SEQ ID NO: 3236745 - RNA, 18 nt, Mycobacterium leprae
ccagagaugcguagccau

SEQ ID NO: 3236746 - RNA, 19 nt, Mycobacterium leprae
ccagauagcccgauuugga

SEQ ID NO: 3236747 - RNA, 15 nt, Mycobacterium leprae
ccagaugaacagccc

SEQ ID NO: 3236748 - RNA, 16 nt, Mycobacterium leprae
ccagauggcgccaaga

SEQ ID NO: 3236749 - RNA, 13 nt, Mycobacterium leprae
ccagauggcuccc

SEQ ID NO: 3236750 - RNA, 20 nt, Mycobacterium leprae
ccagauugcaguccaccaga

SEQ ID NO: 3236751 - RNA, 15 nt, Mycobacterium leprae
ccagcaaacuccuga

SEQ ID NO: 3236752 - RNA, 15 nt, Mycobacterium leprae
ccagcaagcaggcau

SEQ ID NO: 3236753 - RNA, 14 nt, Mycobacterium leprae
ccagcagaccgcua

SEQ ID NO: 3236754 - RNA, 20 nt, Mycobacterium leprae
ccagcagguugaggaggugc

SEQ ID NO: 3236755 - RNA, 17 nt, Mycobacterium leprae
ccagcaguggucggcga

SEQ ID NO: 3236756 - RNA, 19 nt, Mycobacterium leprae
ccagcaguggucggcgaag

SEQ ID NO: 3236757 - RNA, 13 nt, Mycobacterium leprae
ccagccaacggga

SEQ ID NO: 3236758 - RNA, 16 nt, Mycobacterium leprae
ccagccagaccaacau

SEQ ID NO: 3236759 - RNA, 19 nt, Mycobacterium leprae
cccagaaccaucccaaaac

SEQ ID NO: 3236760 - RNA, 13 nt, Mycobacterium leprae
cccagaacugguc

SEQ ID NO: 3236761 - RNA, 11 nt, Mycobacterium leprae
cccagcaccac

SEQ ID NO: 3236762 - RNA, 22 nt, Mycobacterium leprae
cccagcacgcaaccgccggcaa

SEQ ID NO: 3236763 - RNA, 16 nt, Mycobacterium leprae
cccagcacgcgcgaca

SEQ ID NO: 3236764 - RNA, 13 nt, Mycobacterium leprae
cccagcagguuga

SEQ ID NO: 3236765 - RNA, 13 nt, Mycobacterium leprae
cccagcaguuacu

SEQ ID NO: 3236766 - RNA, 17 nt, Mycobacterium leprae
cccagcgauaucaagcu

SEQ ID NO: 3236767 - RNA, 19 nt, Mycobacterium leprae
cccagcuccagaacggucu

SEQ ID NO: 3236768 - RNA, 22 nt, Mycobacterium leprae
cccaggguagcugacgguugcu

SEQ ID NO: 3236769 - RNA, 19 nt, Mycobacterium leprae
cccaggugucuuccagugg

SEQ ID NO: 3236770 - RNA, 21 nt, Mycobacterium leprae
cccaggugucuuccaguggcu

SEQ ID NO: 3236771 - RNA, 22 nt, Mycobacterium leprae
cccaguaaugugcuaucaccgc

SEQ ID NO: 3236772 - RNA, 21 nt, Mycobacterium leprae
cccaguagucgcggguacccc

SEQ ID NO: 3236773 - RNA, 15 nt, Mycobacterium leprae
cccagugugcugcau

SEQ ID NO: 3236774 - RNA, 14 nt, Mycobacterium leprae
cccauaacgugcug

SEQ ID NO: 3236775 - RNA, 20 nt, Mycobacterium leprae
cccauccgaaucaccgcugg

SEQ ID NO: 3236776 - RNA, 16 nt, Mycobacterium leprae
cccauccgggccaguc

SEQ ID NO: 3236777 - RNA, 16 nt, Mycobacterium leprae
cccauccguccacccc

SEQ ID NO: 3236778 - RNA, 13 nt, Mycobacterium leprae
cccaucucaucuu

SEQ ID NO: 3236779 - RNA, 12 nt, Mycobacterium leprae
cccaucugcuug

SEQ ID NO: 3236780 - RNA, 12 nt, Mycobacterium leprae
ccccaaccagac

SEQ ID NO: 3236781 - RNA, 21 nt, Mycobacterium leprae
ccccacacugagaaaggcaga

SEQ ID NO: 3236782 - RNA, 15 nt, Mycobacterium leprae
ccccacccgucccgc

SEQ ID NO: 3236783 - RNA, 13 nt, Mycobacterium leprae
ccccagucgccag

SEQ ID NO: 3236784 - RNA, 22 nt, Mycobacterium leprae
ccccagucgccagagccggcgg

SEQ ID NO: 3236785 - RNA, 23 nt, Mycobacterium leprae
ccccauagcgccucaaugcagac

SEQ ID NO: 3236786 - RNA, 13 nt, Mycobacterium leprae
ccccgaacccggc

SEQ ID NO: 3236787 - RNA, 20 nt, Mycobacterium leprae
ccccgcuucaacguugaagc

SEQ ID NO: 3236788 - RNA, 19 nt, Mycobacterium leprae
ccccggacccgagccgcag

SEQ ID NO: 3236789 - RNA, 12 nt, Mycobacterium leprae
ccccggccaggu

SEQ ID NO: 3236790 - RNA, 12 nt, Mycobacterium leprae
ccccugcggcua

SEQ ID NO: 3236791 - RNA, 15 nt, Mycobacterium leprae
cccgaaaaccccaca

SEQ ID NO: 3236792 - RNA, 18 nt, Mycobacterium leprae
cccgaaaggauggggcca

SEQ ID NO: 3236793 - RNA, 20 nt, Mycobacterium leprae
cccgaaagugccguuggccc

SEQ ID NO: 3236794 - RNA, 21 nt, Mycobacterium leprae
cccgaauucaucgaauaccuu

SEQ ID NO: 3236795 - RNA, 22 nt, Mycobacterium leprae
cccgacucagggcccagaucca

SEQ ID NO: 3236796 - RNA, 13 nt, Mycobacterium leprae
cccgaguucucag

SEQ ID NO: 3236797 - RNA, 20 nt, Mycobacterium leprae
cccgcaaaccaaacaacaac

SEQ ID NO: 3236798 - RNA, 16 nt, Mycobacterium leprae
cccgcacagcaccaug

SEQ ID NO: 3236799 - RNA, 18 nt, Mycobacterium leprae
cccgcacagcaccaugga

SEQ ID NO: 3236800 - RNA, 22 nt, Mycobacterium leprae
cccgcaucguugucggcuccuc

SEQ ID NO: 3236801 - RNA, 18 nt, Mycobacterium leprae
cccgccacucauauccga

SEQ ID NO: 3236802 - RNA, 16 nt, Mycobacterium leprae
cccgccagaucacauu

SEQ ID NO: 3236803 - RNA, 17 nt, Mycobacterium leprae
cccgccagaucacauug

SEQ ID NO: 3236804 - RNA, 21 nt, Mycobacterium leprae
cccgccagggcggcauuccca

SEQ ID NO: 3236805 - RNA, 15 nt, Mycobacterium leprae
cccgccccaccauaa

SEQ ID NO: 3236806 - RNA, 16 nt, Mycobacterium leprae
cccgcgacggccggcg

SEQ ID NO: 3236807 - RNA, 14 nt, Mycobacterium leprae
cccgcgccgccguu

SEQ ID NO: 3236808 - RNA, 12 nt, Mycobacterium leprae
cccgcgccgccu

SEQ ID NO: 3236809 - RNA, 12 nt, Mycobacterium leprae
cccgcggaucgg

SEQ ID NO: 3236810 - RNA, 20 nt, Mycobacterium leprae
cccgcuagcaucgaccacgu

SEQ ID NO: 3236811 - RNA, 12 nt, Mycobacterium leprae
cccgcugcugcg

SEQ ID NO: 3236812 - RNA, 13 nt, Mycobacterium leprae
cccgcuggugcgu

SEQ ID NO: 3236813 - RNA, 23 nt, Mycobacterium leprae
cccgcuggugcguggcgaccgca

SEQ ID NO: 3236814 - RNA, 21 nt, Mycobacterium leprae
cccgcuguaucguccucaaga

SEQ ID NO: 3236815 - RNA, 16 nt, Mycobacterium leprae
cccggacaagucagcc

SEQ ID NO: 3236816 - RNA, 17 nt, Mycobacterium leprae
cccggacaagucagccu

SEQ ID NO: 3236817 - RNA, 18 nt, Mycobacterium leprae
cccggacaguccaccgcc

SEQ ID NO: 3236818 - RNA, 17 nt, Mycobacterium leprae
cccggacggcccagcac

SEQ ID NO: 3236819 - RNA, 18 nt, Mycobacterium leprae
cccggacggcccagcacc

SEQ ID NO: 3236820 - RNA, 19 nt, Mycobacterium leprae
cccggacggcccagcacca

SEQ ID NO: 3236821 - RNA, 21 nt, Mycobacterium leprae
cccggacggcccagcaccacu

SEQ ID NO: 3236822 - RNA, 16 nt, Mycobacterium leprae
cccggauacagcacgg

SEQ ID NO: 3236823 - RNA, 16 nt, Mycobacterium leprae
cccggcgauugccacc

SEQ ID NO: 3236824 - RNA, 18 nt, Mycobacterium leprae
cccggcggcacgguguug

SEQ ID NO: 3236825 - RNA, 23 nt, Mycobacterium leprae
cccggcgugcaggauucacccga

SEQ ID NO: 3236826 - RNA, 17 nt, Mycobacterium leprae
cccgggggccagcguug

SEQ ID NO: 3236827 - RNA, 19 nt, Mycobacterium leprae
cccgggggcgguggaagga

SEQ ID NO: 3236828 - RNA, 14 nt, Mycobacterium leprae
cccgggucgagcag

SEQ ID NO: 3236829 - RNA, 13 nt, Mycobacterium leprae
cccgguagcgccg

SEQ ID NO: 3236830 - RNA, 18 nt, Mycobacterium leprae
cccggugguguuccagug

SEQ ID NO: 3236831 - RNA, 21 nt, Mycobacterium leprae
cccggugugcccucgcugccg

SEQ ID NO: 3236832 - RNA, 23 nt, Mycobacterium leprae
cccgguuacguccgcggcagcug

SEQ ID NO: 3236833 - RNA, 18 nt, Mycobacterium leprae
cccgguuaguccgaccgc

SEQ ID NO: 3236834 - RNA, 22 nt, Mycobacterium leprae
cccguagaacacguucuugcca

SEQ ID NO: 3236835 - RNA, 23 nt, Mycobacterium leprae
cccguaguuguguuccgguucca

SEQ ID NO: 3236836 - RNA, 17 nt, Mycobacterium leprae
cccgucgcugcuggaug

SEQ ID NO: 3236837 - RNA, 15 nt, Mycobacterium leprae
cccgucguggccgag

SEQ ID NO: 3236838 - RNA, 18 nt, Mycobacterium leprae
cccguuaacgaguugacc

SEQ ID NO: 3236839 - RNA, 22 nt, Mycobacterium leprae
cccuaggcugaugcggucaugc

SEQ ID NO: 3236840 - RNA, 15 nt, Mycobacterium leprae
cccucccagccaucg

SEQ ID NO: 3236841 - RNA, 16 nt, Mycobacterium leprae
cccuccuuuucgccgg

SEQ ID NO: 3236842 - RNA, 12 nt, Mycobacterium leprae
cccucucagcaa

SEQ ID NO: 3236843 - RNA, 22 nt, Mycobacterium leprae
cccucuucuaggcaugaaccuc

SEQ ID NO: 3236844 - RNA, 18 nt, Mycobacterium leprae
cccucuuugaucagcaag

SEQ ID NO: 3236845 - RNA, 16 nt, Mycobacterium leprae
cccuggcaucaucaac

SEQ ID NO: 3236846 - RNA, 14 nt, Mycobacterium leprae
cccuggccggcaca

SEQ ID NO: 3236847 - RNA, 15 nt, Mycobacterium leprae
cccugggccggcaca

SEQ ID NO: 3236848 - RNA, 13 nt, Mycobacterium leprae
cccuggugagaca

SEQ ID NO: 3236849 - RNA, 21 nt, Mycobacterium leprae
cccuuacgaucucagccagga

SEQ ID NO: 3236850 - RNA, 14 nt, Mycobacterium leprae
cccuucacaagugg

SEQ ID NO: 3236851 - RNA, 15 nt, Mycobacterium leprae
cccuucacuuccgcu

SEQ ID NO: 3236852 - RNA, 14 nt, Mycobacterium leprae
cccuucuccaccac

SEQ ID NO: 3236853 - RNA, 13 nt, Mycobacterium leprae
cccuugagcaccc

SEQ ID NO: 3236854 - RNA, 20 nt, Mycobacterium leprae
ccgaaaacacgggcaccaga

SEQ ID NO: 3236855 - RNA, 21 nt, Mycobacterium leprae
ccgaaaacacgggcaccagau

SEQ ID NO: 3236856 - RNA, 14 nt, Mycobacterium leprae
ccgaaaccaagcca

SEQ ID NO: 3236857 - RNA, 20 nt, Mycobacterium leprae
ccgaaagugccguuggccca

SEQ ID NO: 3236858 - RNA, 15 nt, Mycobacterium leprae
ccgaacagccgcgcc

SEQ ID NO: 3236859 - RNA, 12 nt, Mycobacterium leprae
ccgaaccgggca

SEQ ID NO: 3236860 - RNA, 21 nt, Mycobacterium leprae
ccgaaccugugcguaaggaag

SEQ ID NO: 3236861 - RNA, 12 nt, Mycobacterium leprae
ccgaacuuggga

SEQ ID NO: 3236862 - RNA, 17 nt, Mycobacterium leprae
ccgaagaucaccgccac

SEQ ID NO: 3236863 - RNA, 13 nt, Mycobacterium leprae
ccgaagccgcgca

SEQ ID NO: 3236864 - RNA, 15 nt, Mycobacterium leprae
ccgaagccgggcgag

SEQ ID NO: 3236865 - RNA, 20 nt, Mycobacterium leprae
ccgaauauuuucaagacugc

SEQ ID NO: 3236866 - RNA, 16 nt, Mycobacterium leprae
ccgaaucguuccaccc

SEQ ID NO: 3236867 - RNA, 20 nt, Mycobacterium leprae
ccgaauuaccauuggcgaca

SEQ ID NO: 3236868 - RNA, 17 nt, Mycobacterium leprae
ccgacaccgauaccagc

SEQ ID NO: 3236869 - RNA, 23 nt, Mycobacterium leprae
ccgacaccgauaccagcggcaga

SEQ ID NO: 3236870 - RNA, 18 nt, Mycobacterium leprae
ccgacaguuuaccgugcc

SEQ ID NO: 3236871 - RNA, 15 nt, Mycobacterium leprae
ccgacauuugggauu

SEQ ID NO: 3236872 - RNA, 17 nt, Mycobacterium leprae
ccgcuccgcgcacagug

SEQ ID NO: 3236873 - RNA, 19 nt, Mycobacterium leprae
ccgcucgaccaugugaccg

SEQ ID NO: 3236874 - RNA, 13 nt, Mycobacterium leprae
ccgcugacaugac

SEQ ID NO: 3236875 - RNA, 22 nt, Mycobacterium leprae
ccgcugauacgugccggccucg

SEQ ID NO: 3236876 - RNA, 11 nt, Mycobacterium leprae
ccgcugcaucc

SEQ ID NO: 3236877 - RNA, 18 nt, Mycobacterium leprae
ccgcugcauccgcagcac

SEQ ID NO: 3236878 - RNA, 19 nt, Mycobacterium leprae
ccgcugcauccgcagcacu

SEQ ID NO: 3236879 - RNA, 19 nt, Mycobacterium leprae
ccgcugcccugggugacca

SEQ ID NO: 3236880 - RNA, 16 nt, Mycobacterium leprae
ccgcuggaucggugcu

SEQ ID NO: 3236881 - RNA, 22 nt, Mycobacterium leprae
ccgcugguaucggugucggcgg

SEQ ID NO: 3236882 - RNA, 13 nt, Mycobacterium leprae
ccgcuucaacguu

SEQ ID NO: 3236883 - RNA, 18 nt, Mycobacterium leprae
ccgcuucagagugcaccg

SEQ ID NO: 3236884 - RNA, 17 nt, Mycobacterium leprae
ccggaaagcugaaagcu

SEQ ID NO: 3236885 - RNA, 16 nt, Mycobacterium leprae
ccggaaauacggcagu

SEQ ID NO: 3236886 - RNA, 19 nt, Mycobacterium leprae
ccggaaucccacgcaacca

SEQ ID NO: 3236887 - RNA, 17 nt, Mycobacterium leprae
ccggaauguccaccagc

SEQ ID NO: 3236888 - RNA, 18 nt, Mycobacterium leprae
ccggaauuccgacgaagg

SEQ ID NO: 3236889 - RNA, 22 nt, Mycobacterium leprae
ccggaauuccgacgaagguggc

SEQ ID NO: 3236890 - RNA, 18 nt, Mycobacterium leprae
ccggacaguccaccgcca

SEQ ID NO: 3236891 - RNA, 21 nt, Mycobacterium leprae
ccggaccaucgucagucggcc

SEQ ID NO: 3236892 - RNA, 13 nt, Mycobacterium leprae
ccggacccgagcc

SEQ ID NO: 3236893 - RNA, 11 nt, Mycobacterium leprae
ccggaccugga

SEQ ID NO: 3236894 - RNA, 12 nt, Mycobacterium leprae
ccggaccuggac

SEQ ID NO: 3236895 - RNA, 19 nt, Mycobacterium leprae
ccggacgauuugcgaucaa

SEQ ID NO: 3236896 - RNA, 23 nt, Mycobacterium leprae
ccggacggcaccuacaacuucaa

SEQ ID NO: 3236897 - RNA, 23 nt, Mycobacterium leprae
ccggauaggucgcgauucguaua

SEQ ID NO: 3236898 - RNA, 20 nt, Mycobacterium leprae
ccggaucgacggcagcgcug

SEQ ID NO: 3236899 - RNA, 11 nt, Mycobacterium leprae
ccggcaccaau

SEQ ID NO: 3236900 - RNA, 21 nt, Mycobacterium leprae
ccggcaccaauguugcccgca

SEQ ID NO: 3236901 - RNA, 22 nt, Mycobacterium leprae
ccggcagacgugcuacugcgau

SEQ ID NO: 3236902 - RNA, 14 nt, Mycobacterium leprae
ccggcagcauccgc

SEQ ID NO: 3236903 - RNA, 15 nt, Mycobacterium leprae
ccggccaaaauggca

SEQ ID NO: 3236904 - RNA, 12 nt, Mycobacterium leprae
ccggccaccacg

SEQ ID NO: 3236905 - RNA, 15 nt, Mycobacterium leprae
ccggccaccggcgcu

SEQ ID NO: 3236906 - RNA, 22 nt, Mycobacterium leprae
ccggccaggugguaucugcacc

SEQ ID NO: 3236907 - RNA, 16 nt, Mycobacterium leprae
ccggccgcggacaaga

SEQ ID NO: 3236908 - RNA, 16 nt, Mycobacterium leprae
ccggccggccccugag

SEQ ID NO: 3236909 - RNA, 14 nt, Mycobacterium leprae
ccggccgucggcgg

SEQ ID NO: 3236910 - RNA, 15 nt, Mycobacterium leprae
ccggccuccggugcc

SEQ ID NO: 3236911 - RNA, 16 nt, Mycobacterium leprae
ccggccucgugcugcg

SEQ ID NO: 3236912 - RNA, 17 nt, Mycobacterium leprae
ccggccuucgucagcug

SEQ ID NO: 3236913 - RNA, 23 nt, Mycobacterium leprae
ccggcgaacucggagcaaggugg

SEQ ID NO: 3236914 - RNA, 19 nt, Mycobacterium leprae
ccggcgaagacgccgccgg

SEQ ID NO: 3236915 - RNA, 18 nt, Mycobacterium leprae
ccggcgaccaguuuacau

SEQ ID NO: 3236916 - RNA, 14 nt, Mycobacterium leprae
ccggcgccgcugcu

SEQ ID NO: 3236917 - RNA, 14 nt, Mycobacterium leprae
ccggcggccaccgc

SEQ ID NO: 3236918 - RNA, 17 nt, Mycobacterium leprae
ccggcgucaggccaggc

SEQ ID NO: 3236919 - RNA, 12 nt, Mycobacterium leprae
ccggcgucggcc

SEQ ID NO: 3236920 - RNA, 23 nt, Mycobacterium leprae
ccggcgugcggucuuagcaacgu

SEQ ID NO: 3236921 - RNA, 24 nt, Mycobacterium leprae
ccggcguguggggguccgcgcacg

SEQ ID NO: 3236922 - RNA, 18 nt, Mycobacterium leprae
ccggcguuccggccucgg

SEQ ID NO: 3236923 - RNA, 19 nt, Mycobacterium leprae
ccggcuagguaccccaguc

SEQ ID NO: 3236924 - RNA, 19 nt, Mycobacterium leprae
ccggcuaguugccuggccu

SEQ ID NO: 3236925 - RNA, 20 nt, Mycobacterium leprae
ccggcuauguggcgcgucgg

SEQ ID NO: 3236926 - RNA, 20 nt, Mycobacterium leprae
ccggcucauuggagugguua

SEQ ID NO: 3236927 - RNA, 23 nt, Mycobacterium leprae
ccggcugaggcggccggcacuga

SEQ ID NO: 3236928 - RNA, 12 nt, Mycobacterium leprae
ccggcugcagug

SEQ ID NO: 3236929 - RNA, 18 nt, Mycobacterium leprae
ccggcuuuggcggacugc

SEQ ID NO: 3236930 - RNA, 15 nt, Mycobacterium leprae
ccgggaucggcggca

SEQ ID NO: 3236931 - RNA, 14 nt, Mycobacterium leprae
ccgggccagucggu

SEQ ID NO: 3236932 - RNA, 12 nt, Mycobacterium leprae
ccgggcgcgcgc

SEQ ID NO: 3236933 - RNA, 14 nt, Mycobacterium leprae
ccgggcguuucccu

SEQ ID NO: 3236934 - RNA, 14 nt, Mycobacterium leprae
ccgggucagaguuu

SEQ ID NO: 3236935 - RNA, 18 nt, Mycobacterium leprae
ccggguucuugaucgacg

SEQ ID NO: 3236936 - RNA, 16 nt, Mycobacterium leprae
ccgguaagcgugcgau

SEQ ID NO: 3236937 - RNA, 13 nt, Mycobacterium leprae
ccgguagccugga

SEQ ID NO: 3236938 - RNA, 22 nt, Mycobacterium leprae
ccgguagucgcuaaauauuaau

SEQ ID NO: 3236939 - RNA, 23 nt, Mycobacterium leprae
ccggucaacaagccgccgacacc

SEQ ID NO: 3236940 - RNA, 16 nt, Mycobacterium leprae
ccggucaagagccgcg

SEQ ID NO: 3236941 - RNA, 19 nt, Mycobacterium leprae
ccggucggcggcgccgauc

SEQ ID NO: 3236942 - RNA, 21 nt, Mycobacterium leprae
ccggucggggaaggccaagcg

SEQ ID NO: 3236943 - RNA, 16 nt, Mycobacterium leprae
ccggucgucaagcuca

SEQ ID NO: 3236944 - RNA, 14 nt, Mycobacterium leprae
ccggucuuuucgcg

SEQ ID NO: 3236945 - RNA, 12 nt, Mycobacterium leprae
ccggugaaccgu

SEQ ID NO: 3236946 - RNA, 13 nt, Mycobacterium leprae
ccggugagggacg

SEQ ID NO: 3236947 - RNA, 22 nt, Mycobacterium leprae
ccggugaugucggcguccucgg

SEQ ID NO: 3236948 - RNA, 18 nt, Mycobacterium leprae
ccggugauguggccgugg

SEQ ID NO: 3236949 - RNA, 21 nt, Mycobacterium leprae
ccggugcagcucguccaucgc

SEQ ID NO: 3236950 - RNA, 18 nt, Mycobacterium leprae
ccggugcugcagccacga

SEQ ID NO: 3236951 - RNA, 14 nt, Mycobacterium leprae
ccgguggccaccgc

SEQ ID NO: 3236952 - RNA, 15 nt, Mycobacterium leprae
ccgguggccaccgcc

SEQ ID NO: 3236953 - RNA, 17 nt, Mycobacterium leprae
ccgguggccaccgccac

SEQ ID NO: 3236954 - RNA, 18 nt, Mycobacterium leprae
ccgguggccaccgccacc

SEQ ID NO: 3236955 - RNA, 19 nt, Mycobacterium leprae
ccgguggcuauacccccug

SEQ ID NO: 3236956 - RNA, 13 nt, Mycobacterium leprae
ccgguguggagug

SEQ ID NO: 3236957 - RNA, 16 nt, Mycobacterium leprae
ccgguguggucagcau

SEQ ID NO: 3236958 - RNA, 16 nt, Mycobacterium leprae
ccgguuggccaacugu

SEQ ID NO: 3236959 - RNA, 19 nt, Mycobacterium leprae
ccguaaaucggcaugaugu

SEQ ID NO: 3236960 - RNA, 16 nt, Mycobacterium leprae
ccguaagacacuuccu

SEQ ID NO: 3236961 - RNA, 16 nt, Mycobacterium leprae
ccguaagucagaugga

SEQ ID NO: 3236962 - RNA, 21 nt, Mycobacterium leprae
ccguacaugcuggcaguggca

SEQ ID NO: 3236963 - RNA, 14 nt, Mycobacterium leprae
ccguagaguucuau

SEQ ID NO: 3236964 - RNA, 21 nt, Mycobacterium leprae
ccguagaguucuaucaacauu

SEQ ID NO: 3236965 - RNA, 22 nt, Mycobacterium leprae
ccguaguguuuuaccagccaga

SEQ ID NO: 3236966 - RNA, 12 nt, Mycobacterium leprae
ccguauauuaac

SEQ ID NO: 3236967 - RNA, 22 nt, Mycobacterium leprae
ccguauauuaacgguauauuaa

SEQ ID NO: 3236968 - RNA, 19 nt, Mycobacterium leprae
ccguauccuggucaucugu

SEQ ID NO: 3236969 - RNA, 13 nt, Mycobacterium leprae
ccguauugguugc

SEQ ID NO: 3236970 - RNA, 22 nt, Mycobacterium leprae
ccguauugguugccgagcuguu

SEQ ID NO: 3236971 - RNA, 22 nt, Mycobacterium leprae
ccgucaaagucagccaaaacuc

SEQ ID NO: 3236972 - RNA, 19 nt, Mycobacterium leprae
ccgucagcgugcuccaggg

SEQ ID NO: 3236973 - RNA, 20 nt, Mycobacterium leprae
ccgucagcgugcuccagggu

SEQ ID NO: 3236974 - RNA, 14 nt, Mycobacterium leprae
ccgucagggcagca

SEQ ID NO: 3236975 - RNA, 16 nt, Mycobacterium leprae
ccguccugccggugcg

SEQ ID NO: 3236976 - RNA, 14 nt, Mycobacterium leprae
ccgucgaaauuguu

SEQ ID NO: 3236977 - RNA, 14 nt, Mycobacterium leprae
ccgucgcgcgugcc

SEQ ID NO: 3236978 - RNA, 19 nt, Mycobacterium leprae
ccgucgcgggauucacacu

SEQ ID NO: 3236979 - RNA, 19 nt, Mycobacterium leprae
ccgucgcgggguuggccac

SEQ ID NO: 3236980 - RNA, 17 nt, Mycobacterium leprae
ccgucggaugauagccg

SEQ ID NO: 3236981 - RNA, 20 nt, Mycobacterium leprae
ccgucuaguggcgcggcacg

SEQ ID NO: 3236982 - RNA, 13 nt, Mycobacterium leprae
ccgucucucaggc

SEQ ID NO: 3236983 - RNA, 14 nt, Mycobacterium leprae
ccgucucucaggcc

SEQ ID NO: 3236984 - RNA, 18 nt, Mycobacterium leprae
ccgucuggaacacgaucg

SEQ ID NO: 3236985 - RNA, 16 nt, Mycobacterium leprae
ccuggugugcgcgccg

SEQ ID NO: 3236986 - RNA, 18 nt, Mycobacterium leprae
ccugguugggcaucgccg

SEQ ID NO: 3236987 - RNA, 22 nt, Mycobacterium leprae
ccugucacuacguccacuagcc

SEQ ID NO: 3236988 - RNA, 22 nt, Mycobacterium leprae
ccugucuaucacauccgauuug

SEQ ID NO: 3236989 - RNA, 22 nt, Mycobacterium leprae
ccuguguugccaucgacgccgc

SEQ ID NO: 3236990 - RNA, 15 nt, Mycobacterium leprae
ccuguucauggugug

SEQ ID NO: 3236991 - RNA, 15 nt, Mycobacterium leprae
ccuguuuuuggaccc

SEQ ID NO: 3236992 - RNA, 15 nt, Mycobacterium leprae
ccuuaccgguucagg

SEQ ID NO: 3236993 - RNA, 13 nt, Mycobacterium leprae
ccuucacuuccgc

SEQ ID NO: 3236994 - RNA, 14 nt, Mycobacterium leprae
ccuucagcacagcc

SEQ ID NO: 3236995 - RNA, 13 nt, Mycobacterium leprae
ccuucauguccua

SEQ ID NO: 3236996 - RNA, 18 nt, Mycobacterium leprae
ccuuccaacgcggccgca

SEQ ID NO: 3236997 - RNA, 19 nt, Mycobacterium leprae
ccuuccaacgcggccgcaa

SEQ ID NO: 3236998 - RNA, 20 nt, Mycobacterium leprae
ccuuccggccuccggugccc

SEQ ID NO: 3236999 - RNA, 13 nt, Mycobacterium leprae
ccuucgauuccag

SEQ ID NO: 3237000 - RNA, 22 nt, Mycobacterium leprae
ccuucggagucuugaugccaac

SEQ ID NO: 3237001 - RNA, 12 nt, Mycobacterium leprae
ccuucgucagcu

SEQ ID NO: 3237002 - RNA, 17 nt, Mycobacterium leprae
ccuucuaugacaacggu

SEQ ID NO: 3237003 - RNA, 15 nt, Mycobacterium leprae
ccuucuccaccaccg

SEQ ID NO: 3237004 - RNA, 14 nt, Mycobacterium leprae
ccuugaccaccacc

SEQ ID NO: 3237005 - RNA, 15 nt, Mycobacterium leprae
ccuugaccaccaccg

SEQ ID NO: 3237006 - RNA, 17 nt, Mycobacterium leprae
ccuugaccaccaccgcc

SEQ ID NO: 3237007 - RNA, 17 nt, Mycobacterium leprae
ccuugaggugucggcgu

SEQ ID NO: 3237008 - RNA, 13 nt, Mycobacterium leprae
ccuugcggcgccc

SEQ ID NO: 3237009 - RNA, 14 nt, Mycobacterium leprae
ccuugcuggugauc

SEQ ID NO: 3237010 - RNA, 17 nt, Mycobacterium leprae
ccuugcuggugaucagg

SEQ ID NO: 3237011 - RNA, 17 nt, Mycobacterium leprae
ccuuggcgucgaucagg

SEQ ID NO: 3237012 - RNA, 15 nt, Mycobacterium leprae
ccuuggcgucggugg

SEQ ID NO: 3237013 - RNA, 13 nt, Mycobacterium leprae
ccuuggugcgggc

SEQ ID NO: 3237014 - RNA, 16 nt, Mycobacterium leprae
ccuuguugcaaaccug

SEQ ID NO: 3237015 - RNA, 21 nt, Mycobacterium leprae
ccuuuagcuugguugacagca

SEQ ID NO: 3237016 - RNA, 22 nt, Mycobacterium leprae
ccuuucaggugugcugcagcau

SEQ ID NO: 3237017 - RNA, 18 nt, Mycobacterium leprae
ccuuugacgaaaauguuu

SEQ ID NO: 3237018 - RNA, 14 nt, Mycobacterium leprae
ccuuuucgaccaca

SEQ ID NO: 3237019 - RNA, 19 nt, Mycobacterium leprae
ccuuuugcccaaugcagca

SEQ ID NO: 3237020 - RNA, 16 nt, Mycobacterium leprae
cgaaaacacuuacacc

SEQ ID NO: 3237021 - RNA, 15 nt, Mycobacterium leprae
cgaaaaccacaagca

SEQ ID NO: 3237022 - RNA, 17 nt, Mycobacterium leprae
cgaaaacccgcgcgugc

SEQ ID NO: 3237023 - RNA, 13 nt, Mycobacterium leprae
cgaaaauaacuau

SEQ ID NO: 3237024 - RNA, 16 nt, Mycobacterium leprae
cgaaacccgaaaccaa

SEQ ID NO: 3237025 - RNA, 14 nt, Mycobacterium leprae
cgaaacgcgaagca

SEQ ID NO: 3237026 - RNA, 21 nt, Mycobacterium leprae
cgaaacgcuauggauacucaa

SEQ ID NO: 3237027 - RNA, 21 nt, Mycobacterium leprae
cgaaacguucauagaaccugc

SEQ ID NO: 3237028 - RNA, 13 nt, Mycobacterium leprae
cgaaagaugcugc

SEQ ID NO: 3237029 - RNA, 16 nt, Mycobacterium leprae
cgaaaggauggggcca

SEQ ID NO: 3237030 - RNA, 21 nt, Mycobacterium leprae
cgaaaucgacguuugcaggug

SEQ ID NO: 3237031 - RNA, 21 nt, Mycobacterium leprae
cgaaaugcauuggaugagaua

SEQ ID NO: 3237032 - RNA, 13 nt, Mycobacterium leprae
cgaacaacaaaaa

SEQ ID NO: 3237033 - RNA, 21 nt, Mycobacterium leprae
cgaacacccuggaauccgcgc

SEQ ID NO: 3237034 - RNA, 17 nt, Mycobacterium leprae
cgaacagccgcgccaac

SEQ ID NO: 3237035 - RNA, 22 nt, Mycobacterium leprae
cgaacagcggggauaggagccc

SEQ ID NO: 3237036 - RNA, 21 nt, Mycobacterium leprae
cgaacagugggggugcggcag

SEQ ID NO: 3237037 - RNA, 17 nt, Mycobacterium leprae
cgaacaguucgauaccg

SEQ ID NO: 3237038 - RNA, 23 nt, Mycobacterium leprae
cgaacaguucgcacgaaauggcg

SEQ ID NO: 3237039 - RNA, 23 nt, Mycobacterium leprae
cgaacccagacgcgaccgccacc

SEQ ID NO: 3237040 - RNA, 13 nt, Mycobacterium leprae
cgaaccggacagc

SEQ ID NO: 3237041 - RNA, 15 nt, Mycobacterium leprae
cgaaccggacagcac

SEQ ID NO: 3237042 - RNA, 17 nt, Mycobacterium leprae
cgaaccggacagcaccc

SEQ ID NO: 3237043 - RNA, 14 nt, Mycobacterium leprae
cgaaccuccaccac

SEQ ID NO: 3237044 - RNA, 20 nt, Mycobacterium leprae
cgaaccugacgaacucgccg

SEQ ID NO: 3237045 - RNA, 22 nt, Mycobacterium leprae
cgaacgagugcgcugcagcaac

SEQ ID NO: 3237046 - RNA, 15 nt, Mycobacterium leprae
cgaacguaccaccgc

SEQ ID NO: 3237047 - RNA, 14 nt, Mycobacterium leprae
cgaacgugcugcug

SEQ ID NO: 3237048 - RNA, 23 nt, Mycobacterium leprae
cgaacuaguguucggcacccauc

SEQ ID NO: 3237049 - RNA, 19 nt, Mycobacterium leprae
cgaacuauccaagacaucg

SEQ ID NO: 3237050 - RNA, 19 nt, Mycobacterium leprae
cgaacugggugaccaccca

SEQ ID NO: 3237051 - RNA, 17 nt, Mycobacterium leprae
cgaagacauaucaacaa

SEQ ID NO: 3237052 - RNA, 21 nt, Mycobacterium leprae
cgaagacaucgaaucgagugg

SEQ ID NO: 3237053 - RNA, 13 nt, Mycobacterium leprae
cgaagacauggcg

SEQ ID NO: 3237054 - RNA, 16 nt, Mycobacterium leprae
cgaagagcggcacgau

SEQ ID NO: 3237055 - RNA, 14 nt, Mycobacterium leprae
cgaagagcugcagc

SEQ ID NO: 3237056 - RNA, 19 nt, Mycobacterium leprae
cgaagaucaccgccaccac

SEQ ID NO: 3237057 - RNA, 19 nt, Mycobacterium leprae
cgaagcacccggaaggugu

SEQ ID NO: 3237058 - RNA, 13 nt, Mycobacterium leprae
cgaagcagccggg

SEQ ID NO: 3237059 - RNA, 14 nt, Mycobacterium leprae
cgaagccaaaaacu

SEQ ID NO: 3237060 - RNA, 20 nt, Mycobacterium leprae
cgaagccgggaccuuucccg

SEQ ID NO: 3237061 - RNA, 15 nt, Mycobacterium leprae
cgaagccucaucgaa

SEQ ID NO: 3237062 - RNA, 20 nt, Mycobacterium leprae
cgaagcgauugggugggcuu

SEQ ID NO: 3237063 - RNA, 16 nt, Mycobacterium leprae
cgaagcgcagcgaagc

SEQ ID NO: 3237064 - RNA, 19 nt, Mycobacterium leprae
cgaagggaaugcgucagug

SEQ ID NO: 3237065 - RNA, 20 nt, Mycobacterium leprae
cgaaggggucgaugaggcuc

SEQ ID NO: 3237066 - RNA, 18 nt, Mycobacterium leprae
cgaaggugagucgacagc

SEQ ID NO: 3237067 - RNA, 18 nt, Mycobacterium leprae
cgaagugcgccagcgaca

SEQ ID NO: 3237068 - RNA, 16 nt, Mycobacterium leprae
cgaagugcgucauccc

SEQ ID NO: 3237069 - RNA, 23 nt, Mycobacterium leprae
cgaauagccgguggccaccgcca

SEQ ID NO: 3237070 - RNA, 23 nt, Mycobacterium leprae
cgaauauuuucaagacugcaccc

SEQ ID NO: 3237071 - RNA, 13 nt, Mycobacterium leprae
cgaaucaccgcug

SEQ ID NO: 3237072 - RNA, 21 nt, Mycobacterium leprae
cgaaucaccgcuggguguguc

SEQ ID NO: 3237073 - RNA, 18 nt, Mycobacterium leprae
cgaaucaugucgaacaac

SEQ ID NO: 3237074 - RNA, 17 nt, Mycobacterium leprae
cgaauccgccucggugu

SEQ ID NO: 3237075 - RNA, 15 nt, Mycobacterium leprae
cgaauccuacaucca

SEQ ID NO: 3237076 - RNA, 15 nt, Mycobacterium leprae
cgaauccucgauggc

SEQ ID NO: 3237077 - RNA, 13 nt, Mycobacterium leprae
cgaaucgaguggc

SEQ ID NO: 3237078 - RNA, 16 nt, Mycobacterium leprae
cgaaucgcuagcgauu

SEQ ID NO: 3237079 - RNA, 22 nt, Mycobacterium leprae
cgaaucgguacauuugcggaug

SEQ ID NO: 3237080 - RNA, 16 nt, Mycobacterium leprae
cgaauugaccgacggc

SEQ ID NO: 3237081 - RNA, 22 nt, Mycobacterium leprae
cgaauugaucgggcccagcacc

SEQ ID NO: 3237082 - RNA, 20 nt, Mycobacterium leprae
cgacaaaauuuucaggcugu

SEQ ID NO: 3237083 - RNA, 13 nt, Mycobacterium leprae
cgacaaagcucag

SEQ ID NO: 3237084 - RNA, 16 nt, Mycobacterium leprae
cgacaccauccacaac

SEQ ID NO: 3237085 - RNA, 15 nt, Mycobacterium leprae
cgacaccgagcagcc

SEQ ID NO: 3237086 - RNA, 18 nt, Mycobacterium leprae
cgacaccgauaccagcgg

SEQ ID NO: 3237087 - RNA, 22 nt, Mycobacterium leprae
cgacaccgauaccagcggcaga

SEQ ID NO: 3237088 - RNA, 15 nt, Mycobacterium leprae
cgacaccucaaggcc

SEQ ID NO: 3237089 - RNA, 19 nt, Mycobacterium leprae
cgacaccucaaggccauga

SEQ ID NO: 3237090 - RNA, 12 nt, Mycobacterium leprae
cgacaccucacc

SEQ ID NO: 3237091 - RNA, 19 nt, Mycobacterium leprae
cgacaccucaccaucuuug

SEQ ID NO: 3237092 - RNA, 13 nt, Mycobacterium leprae
cgacacgcgcgac

SEQ ID NO: 3237093 - RNA, 11 nt, Mycobacterium leprae
cgacacggcga

SEQ ID NO: 3237094 - RNA, 15 nt, Mycobacterium leprae
cgacacuugccgcgu

SEQ ID NO: 3237095 - RNA, 14 nt, Mycobacterium leprae
cgacagcacccagc

SEQ ID NO: 3237096 - RNA, 23 nt, Mycobacterium leprae
cgacagcagguagacgcgcuaaa

SEQ ID NO: 3237097 - RNA, 12 nt, Mycobacterium leprae
cgacagccugcc

SEQ ID NO: 3237098 - RNA, 21 nt, Mycobacterium leprae
guggucuugauucucgagcga

SEQ ID NO: 3237099 - RNA, 19 nt, Mycobacterium leprae
gugguggucgaccgcggug

SEQ ID NO: 3237100 - RNA, 19 nt, Mycobacterium leprae
gugguguggcccgacggcg

SEQ ID NO: 3237101 - RNA, 13 nt, Mycobacterium leprae
gugguugagucgu

SEQ ID NO: 3237102 - RNA, 15 nt, Mycobacterium leprae
guguaaggccagcgc

SEQ ID NO: 3237103 - RNA, 17 nt, Mycobacterium leprae
guguacucgcgauggca

SEQ ID NO: 3237104 - RNA, 21 nt, Mycobacterium leprae
guguagcugcagcgacuggau

SEQ ID NO: 3237105 - RNA, 22 nt, Mycobacterium leprae
gugucaccuguuucagcguggc

SEQ ID NO: 3237106 - RNA, 13 nt, Mycobacterium leprae
gugucagcagcag

SEQ ID NO: 3237107 - RNA, 23 nt, Mycobacterium leprae
guguccacaaccucggccgaggc

SEQ ID NO: 3237108 - RNA, 21 nt, Mycobacterium leprae
guguccgcaaaaugcuccccc

SEQ ID NO: 3237109 - RNA, 14 nt, Mycobacterium leprae
guguccgucgacgu

SEQ ID NO: 3237110 - RNA, 19 nt, Mycobacterium leprae
gugucgagcuggcugugcc

SEQ ID NO: 3237111 - RNA, 22 nt, Mycobacterium leprae
gugucgaugaugcgcuguuguu

SEQ ID NO: 3237112 - RNA, 16 nt, Mycobacterium leprae
gugucugaacugguga

SEQ ID NO: 3237113 - RNA, 12 nt, Mycobacterium leprae
gugucuguggcg

SEQ ID NO: 3237114 - RNA, 19 nt, Mycobacterium leprae
gugucuugucuaccagcac

SEQ ID NO: 3237115 - RNA, 17 nt, Mycobacterium leprae
gugugacaccagcgacg

SEQ ID NO: 3237116 - RNA, 16 nt, Mycobacterium leprae
gugugcaggaccgugc

SEQ ID NO: 3237117 - RNA, 15 nt, Mycobacterium leprae
gugugcgcgccgccc

SEQ ID NO: 3237118 - RNA, 13 nt, Mycobacterium leprae
gugugcuuucggc

SEQ ID NO: 3237119 - RNA, 20 nt, Mycobacterium leprae
gugugcuuugccgcagugga

SEQ ID NO: 3237120 - RNA, 22 nt, Mycobacterium leprae
gugugcuuugccgcaguggaca

SEQ ID NO: 3237121 - RNA, 15 nt, Mycobacterium leprae
guguggcauccgcca

SEQ ID NO: 3237122 - RNA, 19 nt, Mycobacterium leprae
guguggcccgacggcgcgg

SEQ ID NO: 3237123 - RNA, 21 nt, Mycobacterium leprae
gugugguguucuuaggcacug

SEQ ID NO: 3237124 - RNA, 22 nt, Mycobacterium leprae
gugugguuucgaucaugccugg

SEQ ID NO: 3237125 - RNA, 22 nt, Mycobacterium leprae
guguguccuuaacugacuggug

SEQ ID NO: 3237126 - RNA, 15 nt, Mycobacterium leprae
guguguguggcaccg

SEQ ID NO: 3237127 - RNA, 14 nt, Mycobacterium leprae
guguguugcagugu

SEQ ID NO: 3237128 - RNA, 16 nt, Mycobacterium leprae
guguuccgggcugaga

SEQ ID NO: 3237129 - RNA, 19 nt, Mycobacterium leprae
guguucgcuccgcccacua

SEQ ID NO: 3237130 - RNA, 22 nt, Mycobacterium leprae
guguucuuaggcacuggccagu

SEQ ID NO: 3237131 - RNA, 14 nt, Mycobacterium leprae
guguugccaccgac

SEQ ID NO: 3237132 - RNA, 23 nt, Mycobacterium leprae
guguugcgggguuuuuguuggug

SEQ ID NO: 3237133 - RNA, 15 nt, Mycobacterium leprae
guguugcuggcggug

SEQ ID NO: 3237134 - RNA, 13 nt, Mycobacterium leprae
guguugugguggg

SEQ ID NO: 3237135 - RNA, 13 nt, Mycobacterium leprae
guguuuaggaaac

SEQ ID NO: 3237136 - RNA, 17 nt, Mycobacterium leprae
guguuucauagguggug

SEQ ID NO: 3237137 - RNA, 16 nt, Mycobacterium leprae
guguuuuaccagccag

SEQ ID NO: 3237138 - RNA, 14 nt, Mycobacterium leprae
guguuuugcugugu

SEQ ID NO: 3237139 - RNA, 17 nt, Mycobacterium leprae
guguuuugucgguggug

SEQ ID NO: 3237140 - RNA, 19 nt, Mycobacterium leprae
guguuuugucggugguggg

SEQ ID NO: 3237141 - RNA, 18 nt, Mycobacterium leprae
guguuuuuauacacggug

SEQ ID NO: 3237142 - RNA, 15 nt, Mycobacterium leprae
guuaacgaagaguau

SEQ ID NO: 3237143 - RNA, 15 nt, Mycobacterium leprae
guuaagcaucggcag

SEQ ID NO: 3237144 - RNA, 20 nt, Mycobacterium leprae
guuaauauaccguuaauaua

SEQ ID NO: 3237145 - RNA, 15 nt, Mycobacterium leprae
guuacaucacaggau

SEQ ID NO: 3237146 - RNA, 23 nt, Mycobacterium leprae
guuaccccggaucaggcugggga

SEQ ID NO: 3237147 - RNA, 17 nt, Mycobacterium leprae
guuaccgagccggucga

SEQ ID NO: 3237148 - RNA, 16 nt, Mycobacterium leprae
guuaccgguguuccgc

SEQ ID NO: 3237149 - RNA, 15 nt, Mycobacterium leprae
guuaccguauauuaa

SEQ ID NO: 3237150 - RNA, 21 nt, Mycobacterium leprae
guuaccgucgggccugagugg

SEQ ID NO: 3237151 - RNA, 15 nt, Mycobacterium leprae
guuacgauccaugcc

SEQ ID NO: 3237152 - RNA, 19 nt, Mycobacterium leprae
guuacgauccaugccgagu

SEQ ID NO: 3237153 - RNA, 14 nt, Mycobacterium leprae
guuacugagguacc

SEQ ID NO: 3237154 - RNA, 16 nt, Mycobacterium leprae
guuacugucggugccg

SEQ ID NO: 3237155 - RNA, 21 nt, Mycobacterium leprae
guuagaggguccggaccugga

SEQ ID NO: 3237156 - RNA, 16 nt, Mycobacterium leprae
guuagaugucgcagcg

SEQ ID NO: 3237157 - RNA, 13 nt, Mycobacterium leprae
guuagcgccgaga

SEQ ID NO: 3237158 - RNA, 16 nt, Mycobacterium leprae
guuagcgccgcggggu

SEQ ID NO: 3237159 - RNA, 13 nt, Mycobacterium leprae
guuagguuggugg

SEQ ID NO: 3237160 - RNA, 15 nt, Mycobacterium leprae
guuagguugguggug

SEQ ID NO: 3237161 - RNA, 16 nt, Mycobacterium leprae
guuagucuggcuggcc

SEQ ID NO: 3237162 - RNA, 14 nt, Mycobacterium leprae
guuagugccaguuc

SEQ ID NO: 3237163 - RNA, 14 nt, Mycobacterium leprae
guuauauuguccga

SEQ ID NO: 3237164 - RNA, 21 nt, Mycobacterium leprae
guuauauuguccgagcuuuuc

SEQ ID NO: 3237165 - RNA, 13 nt, Mycobacterium leprae
guuauccacagca

SEQ ID NO: 3237166 - RNA, 13 nt, Mycobacterium leprae
guuaucgagguga

SEQ ID NO: 3237167 - RNA, 21 nt, Mycobacterium leprae
guuaucgaucucgcauauuca

SEQ ID NO: 3237168 - RNA, 18 nt, Mycobacterium leprae
guuaucuagcccagaagc

SEQ ID NO: 3237169 - RNA, 18 nt, Mycobacterium leprae
guuauucucuguugcugu

SEQ ID NO: 3237170 - RNA, 14 nt, Mycobacterium leprae
guucaaaagccaca

SEQ ID NO: 3237171 - RNA, 21 nt, Mycobacterium leprae
guucaaaagccacacgcgacg

SEQ ID NO: 3237172 - RNA, 17 nt, Mycobacterium leprae
guucaacgggugucuga

SEQ ID NO: 3237173 - RNA, 15 nt, Mycobacterium leprae
guucaauggugccga

SEQ ID NO: 3237174 - RNA, 18 nt, Mycobacterium leprae
guucaauggugccgagcg

SEQ ID NO: 3237175 - RNA, 17 nt, Mycobacterium leprae
guucaccacaucaucga

SEQ ID NO: 3237176 - RNA, 19 nt, Mycobacterium leprae
guucaccggcaucggacag

SEQ ID NO: 3237177 - RNA, 17 nt, Mycobacterium leprae
guuccagucgaagguga

SEQ ID NO: 3237178 - RNA, 20 nt, Mycobacterium leprae
guuccauuccagaugccguu

SEQ ID NO: 3237179 - RNA, 21 nt, Mycobacterium leprae
guuccccgguuccgucucuca

SEQ ID NO: 3237180 - RNA, 12 nt, Mycobacterium leprae
guucccggcggc

SEQ ID NO: 3237181 - RNA, 18 nt, Mycobacterium leprae
guucccugacuguuuccg

SEQ ID NO: 3237182 - RNA, 20 nt, Mycobacterium leprae
guuccgacaaaccaggcgac

SEQ ID NO: 3237183 - RNA, 20 nt, Mycobacterium leprae
guuccgcccagugacgucgg

SEQ ID NO: 3237184 - RNA, 22 nt, Mycobacterium leprae
guuccgcgcuagacgucuguca

SEQ ID NO: 3237185 - RNA, 21 nt, Mycobacterium leprae
guuccuauguuggucugcuca

SEQ ID NO: 3237186 - RNA, 14 nt, Mycobacterium leprae
guuccucccacgac

SEQ ID NO: 3237187 - RNA, 18 nt, Mycobacterium leprae
guucgacaagcccccgcg

SEQ ID NO: 3237188 - RNA, 23 nt, Mycobacterium leprae
guucgacauacaggacgaucggg

SEQ ID NO: 3237189 - RNA, 23 nt, Mycobacterium leprae
guucgaucacguuucguggcaag

SEQ ID NO: 3237190 - RNA, 13 nt, Mycobacterium leprae
guucgaucggcag

SEQ ID NO: 3237191 - RNA, 21 nt, Mycobacterium leprae
guucgcuuguguacuccacca

SEQ ID NO: 3237192 - RNA, 21 nt, Mycobacterium leprae
guucggcuacugcgacagcag

SEQ ID NO: 3237193 - RNA, 17 nt, Mycobacterium leprae
guucggcuaugagacga

SEQ ID NO: 3237194 - RNA, 20 nt, Mycobacterium leprae
guucguaaccuuguugcagc

SEQ ID NO: 3237195 - RNA, 14 nt, Mycobacterium leprae
guucgugaucgacg

SEQ ID NO: 3237196 - RNA, 13 nt, Mycobacterium leprae
guucuacccaggc

SEQ ID NO: 3237197 - RNA, 14 nt, Mycobacterium leprae
guucugcgcuggcc

SEQ ID NO: 3237198 - RNA, 21 nt, Mycobacterium leprae
guucugcggggggccuuaucc

SEQ ID NO: 3237199 - RNA, 23 nt, Mycobacterium leprae
guucuggcacccacgcugcgcgg

SEQ ID NO: 3237200 - RNA, 16 nt, Mycobacterium leprae
guucuguccgcacaaa

SEQ ID NO: 3237201 - RNA, 14 nt, Mycobacterium leprae
guucuguugugggg

SEQ ID NO: 3237202 - RNA, 18 nt, Mycobacterium leprae
guucuuacccgagcugac

SEQ ID NO: 3237203 - RNA, 20 nt, Mycobacterium leprae
guucuugaucgacguccaca

SEQ ID NO: 3237204 - RNA, 17 nt, Mycobacterium leprae
guugaaaacgguuaguc

SEQ ID NO: 3237205 - RNA, 20 nt, Mycobacterium leprae
guugaccaaaccgaagauca

SEQ ID NO: 3237206 - RNA, 23 nt, Mycobacterium leprae
guugaccggcccucagccagcaa

SEQ ID NO: 3237207 - RNA, 16 nt, Mycobacterium leprae
guugaccugggggauu

SEQ ID NO: 3237208 - RNA, 17 nt, Mycobacterium leprae
guugacgaccggcugca

SEQ ID NO: 3237209 - RNA, 16 nt, Mycobacterium leprae
guugacgcccuccugg

SEQ ID NO: 3237210 - RNA, 16 nt, Mycobacterium leprae
guugacguggugauca

SEQ ID NO: 3237211 - RNA, 16 nt, Mycobacterium leprae
guugacugcgaaaaau

SEQ ID NO: 3237212 - RNA, 17 nt, Mycobacterium leprae
guugagacaacccgacg

SEQ ID NO: 3237213 - RNA, 16 nt, Mycobacterium leprae
guugauagcgcuggug

SEQ ID NO: 3237214 - RNA, 20 nt, Mycobacterium leprae
guugaucauucgauccaaug

SEQ ID NO: 3237215 - RNA, 18 nt, Mycobacterium leprae
guugaucuggaucagcgc

SEQ ID NO: 3237216 - RNA, 18 nt, Mycobacterium leprae
guugcacaucagcaaaga

SEQ ID NO: 3237217 - RNA, 17 nt, Mycobacterium leprae
guugcacggcaaaguca

SEQ ID NO: 3237218 - RNA, 19 nt, Mycobacterium leprae
guugcacggcaaagucaug

SEQ ID NO: 3237219 - RNA, 14 nt, Mycobacterium leprae
guugcaguguugug

SEQ ID NO: 3237220 - RNA, 21 nt, Mycobacterium leprae
guugccagauagucgagggcu

SEQ ID NO: 3237221 - RNA, 22 nt, Mycobacterium leprae
guugccgaaccucgccaccugg

SEQ ID NO: 3237222 - RNA, 22 nt, Mycobacterium leprae
guugccugucgauuaccacugc

SEQ ID NO: 3237223 - RNA, 18 nt, Mycobacterium leprae
guugcgggguuuuuguug

SEQ ID NO: 3237224 - RNA, 15 nt, Mycobacterium leprae
guugcggugaguaaa

SEQ ID NO: 3237225 - RNA, 17 nt, Mycobacterium leprae
guugcggugaguaaaca

SEQ ID NO: 3237226 - RNA, 23 nt, Mycobacterium leprae
guugcucgacaggggcuauggcu

SEQ ID NO: 3237227 - RNA, 15 nt, Mycobacterium leprae
guugcuuguugccgc

SEQ ID NO: 3237228 - RNA, 14 nt, Mycobacterium leprae
guuggccagcacgg

SEQ ID NO: 3237229 - RNA, 17 nt, Mycobacterium leprae
guuggcccgucgacccu

SEQ ID NO: 3237230 - RNA, 20 nt, Mycobacterium leprae
guuggcgacgugaucgacga

SEQ ID NO: 3237231 - RNA, 23 nt, Mycobacterium leprae
guugggagaucuuuucggcugca

SEQ ID NO: 3237232 - RNA, 23 nt, Mycobacterium leprae
guugggagugcuagcggcgccag

SEQ ID NO: 3237233 - RNA, 15 nt, Mycobacterium leprae
guuggguaucagcgc

SEQ ID NO: 3237234 - RNA, 16 nt, Mycobacterium leprae
guuggucggcgcuggc

SEQ ID NO: 3237235 - RNA, 13 nt, Mycobacterium leprae
guugguggguggc

SEQ ID NO: 3237236 - RNA, 14 nt, Mycobacterium leprae
guuggugucaacag

SEQ ID NO: 3237237 - RNA, 17 nt, Mycobacterium leprae
guuguaguagaccuuga

SEQ ID NO: 3237238 - RNA, 17 nt, Mycobacterium leprae
guugucggucgacacga

SEQ ID NO: 3237239 - RNA, 10 nt, Mycobacterium leprae
guuguggugg

SEQ ID NO: 3237240 - RNA, 19 nt, Mycobacterium leprae
guuguucaacaacaauacu

SEQ ID NO: 3237241 - RNA, 15 nt, Mycobacterium leprae
guuguuguggugugc

SEQ ID NO: 3237242 - RNA, 14 nt, Mycobacterium leprae
guuguuuggcaacg

SEQ ID NO: 3237243 - RNA, 13 nt, Mycobacterium leprae
guuguuuuuguug

SEQ ID NO: 3237244 - RNA, 19 nt, Mycobacterium leprae
guuuaccaagccggugcca

SEQ ID NO: 3237245 - RNA, 19 nt, Mycobacterium leprae
guuuaccauuuccgcuaau

SEQ ID NO: 3237246 - RNA, 11 nt, Mycobacterium leprae
guuuaccgcau

SEQ ID NO: 3237247 - RNA, 17 nt, Mycobacterium leprae
guuuaccgugguugcug

SEQ ID NO: 3237248 - RNA, 19 nt, Mycobacterium leprae
guuuacgcucgguaaguug

SEQ ID NO: 3237249 - RNA, 17 nt, Mycobacterium leprae
guuuacuaggccccaga

SEQ ID NO: 3237250 - RNA, 12 nt, Mycobacterium leprae
guuuaucagccu

SEQ ID NO: 3237251 - RNA, 20 nt, Mycobacterium leprae
guuucacaaccaucgcuggc

SEQ ID NO: 3237252 - RNA, 16 nt, Mycobacterium leprae
guuucauagguggugg

SEQ ID NO: 3237253 - RNA, 13 nt, Mycobacterium leprae
guuucccagagcu

SEQ ID NO: 3237254 - RNA, 19 nt, Mycobacterium leprae
guuuccgaucaucgaggug

SEQ ID NO: 3237255 - RNA, 17 nt, Mycobacterium leprae
guuucgggaaagcugag

SEQ ID NO: 3237256 - RNA, 15 nt, Mycobacterium leprae
guuucugcugccgcg

SEQ ID NO: 3237257 - RNA, 21 nt, Mycobacterium leprae
guuugaagucgcuguuggugu

SEQ ID NO: 3237258 - RNA, 17 nt, Mycobacterium leprae
guuugacgcaugacacc

SEQ ID NO: 3237259 - RNA, 19 nt, Mycobacterium leprae
guuugcguugaugauguuu

SEQ ID NO: 3237260 - RNA, 19 nt, Mycobacterium leprae
guuugcuauccguuggcgg

SEQ ID NO: 3237261 - RNA, 13 nt, Mycobacterium leprae
guuugcugucaag

SEQ ID NO: 3237262 - RNA, 13 nt, Mycobacterium leprae
guuuggcugacac

SEQ ID NO: 3237263 - RNA, 14 nt, Mycobacterium leprae
guuugggugguggu

SEQ ID NO: 3237264 - RNA, 15 nt, Mycobacterium leprae
guuugggugguggug

SEQ ID NO: 3237265 - RNA, 14 nt, Mycobacterium leprae
guuugggugguguu

SEQ ID NO: 3237266 - RNA, 19 nt, Mycobacterium leprae
guuugucagauaacgggug

SEQ ID NO: 3237267 - RNA, 15 nt, Mycobacterium leprae
guuuuaccagccaga

SEQ ID NO: 3237268 - RNA, 13 nt, Mycobacterium leprae
guuuuagugugca

SEQ ID NO: 3237269 - RNA, 22 nt, Mycobacterium leprae
guuuucaccaaacuggacuucu

SEQ ID NO: 3237270 - RNA, 19 nt, Mycobacterium leprae
guuuucagccacauugccg

SEQ ID NO: 3237271 - RNA, 14 nt, Mycobacterium leprae
guuuucucuaaaag

SEQ ID NO: 3237272 - RNA, 15 nt, Mycobacterium leprae
guuuugccaaucuau

SEQ ID NO: 3237273 - RNA, 20 nt, Mycobacterium leprae
guuuugcuguguugcggggu

SEQ ID NO: 3237274 - RNA, 14 nt, Mycobacterium leprae
guuuugucgguggu

SEQ ID NO: 3237275 - RNA, 17 nt, Mycobacterium leprae
uaaaaaccuguguauca

SEQ ID NO: 3237276 - RNA, 15 nt, Mycobacterium leprae
uaaaaagauauuaag

SEQ ID NO: 3237277 - RNA, 17 nt, Mycobacterium leprae
uaaaaagauauuaaguu

SEQ ID NO: 3237278 - RNA, 23 nt, Mycobacterium leprae
uaaaaccgguuugauccagccga

SEQ ID NO: 3237279 - RNA, 13 nt, Mycobacterium leprae
uaaacacgugcau

SEQ ID NO: 3237280 - RNA, 19 nt, Mycobacterium leprae
uaaacauugugcuagcuga

SEQ ID NO: 3237281 - RNA, 22 nt, Mycobacterium leprae
uaaaccuuacagucacuauaau

SEQ ID NO: 3237282 - RNA, 16 nt, Mycobacterium leprae
uaaacggaauacagcg

SEQ ID NO: 3237283 - RNA, 16 nt, Mycobacterium leprae
uaaacuugguccgacg

SEQ ID NO: 3237284 - RNA, 20 nt, Mycobacterium leprae
uaaaggaguucaacaaaacc

SEQ ID NO: 3237285 - RNA, 13 nt, Mycobacterium leprae
uaaagugcugcug

SEQ ID NO: 3237286 - RNA, 16 nt, Mycobacterium leprae
uaaaguucccucccuu

SEQ ID NO: 3237287 - RNA, 16 nt, Mycobacterium leprae
uaaauaguauuauuga

SEQ ID NO: 3237288 - RNA, 17 nt, Mycobacterium leprae
uaaauaguauuauugac

SEQ ID NO: 3237289 - RNA, 21 nt, Mycobacterium leprae
uaaauauacuuuacuuuauau

SEQ ID NO: 3237290 - RNA, 22 nt, Mycobacterium leprae
uaaauccgggcgcucagcggcc

SEQ ID NO: 3237291 - RNA, 12 nt, Mycobacterium leprae
uaacaccgugcc

SEQ ID NO: 3237292 - RNA, 18 nt, Mycobacterium leprae
uaacaucauucacccuuu

SEQ ID NO: 3237293 - RNA, 22 nt, Mycobacterium leprae
uaacauuugauguccauggcuu

SEQ ID NO: 3237294 - RNA, 15 nt, Mycobacterium leprae
uaaccacuugcagua

SEQ ID NO: 3237295 - RNA, 20 nt, Mycobacterium leprae
uaaccagggccgucagagcu

SEQ ID NO: 3237296 - RNA, 23 nt, Mycobacterium leprae
uaacccgcaaaccaaacaacaac

SEQ ID NO: 3237297 - RNA, 19 nt, Mycobacterium leprae
uaaccgcucgauggccagc

SEQ ID NO: 3237298 - RNA, 20 nt, Mycobacterium leprae
uaaccgggaaauacggcacg

SEQ ID NO: 3237299 - RNA, 20 nt, Mycobacterium leprae
uaaccggucaaucagguuga

SEQ ID NO: 3237300 - RNA, 15 nt, Mycobacterium leprae
uaaccucacgccuaa

SEQ ID NO: 3237301 - RNA, 16 nt, Mycobacterium leprae
uaacgauuagcaugac

SEQ ID NO: 3237302 - RNA, 20 nt, Mycobacterium leprae
uaacguucggugacgaacau

SEQ ID NO: 3237303 - RNA, 11 nt, Mycobacterium leprae
uaacuaaucca

SEQ ID NO: 3237304 - RNA, 17 nt, Mycobacterium leprae
uaacucaucaaaaaaca

SEQ ID NO: 3237305 - RNA, 20 nt, Mycobacterium leprae
uaacuggcaguacgucugua

SEQ ID NO: 3237306 - RNA, 17 nt, Mycobacterium leprae
uaacuuaaucgccggcg

SEQ ID NO: 3237307 - RNA, 17 nt, Mycobacterium leprae
uaacuuuauaaguuguu

SEQ ID NO: 3237308 - RNA, 16 nt, Mycobacterium leprae
uaagaaagaauuuacc

SEQ ID NO: 3237309 - RNA, 13 nt, Mycobacterium leprae
uaagacaaggugu

SEQ ID NO: 3237310 - RNA, 18 nt, Mycobacterium leprae
uaagagaaguagagaaaa

SEQ ID NO: 3237311 - RNA, 13 nt, Mycobacterium leprae
uaagagauugucc

SEQ ID NO: 3237312 - RNA, 22 nt, Mycobacterium leprae
uaagagguuuaccgccaucggc

SEQ ID NO: 3237313 - RNA, 17 nt, Mycobacterium leprae
uaagauuuaagcaggcu

SEQ ID NO: 3237314 - RNA, 13 nt, Mycobacterium leprae
uaagcacugcacg

SEQ ID NO: 3237315 - RNA, 23 nt, Mycobacterium leprae
uaagccaucaccguggccggccc

SEQ ID NO: 3237316 - RNA, 17 nt, Mycobacterium leprae
uaagcgaaaaugaaaac

SEQ ID NO: 3237317 - RNA, 16 nt, Mycobacterium leprae
uaaggagucgcacugg

SEQ ID NO: 3237318 - RNA, 18 nt, Mycobacterium leprae
uaaggccaggauggugcc

SEQ ID NO: 3237319 - RNA, 22 nt, Mycobacterium leprae
uaaguaggcggucauguagcua

SEQ ID NO: 3237320 - RNA, 20 nt, Mycobacterium leprae
uaaguggcuggcuuaggagu

SEQ ID NO: 3237321 - RNA, 14 nt, Mycobacterium leprae
uaaguuuucucuaa

SEQ ID NO: 3237322 - RNA, 20 nt, Mycobacterium leprae
uaauaguugccuaucagacg

SEQ ID NO: 3237323 - RNA, 22 nt, Mycobacterium leprae
uaauauacgguaacuacuggau

SEQ ID NO: 3237324 - RNA, 14 nt, Mycobacterium leprae
uaauauauauauag

SEQ ID NO: 3237325 - RNA, 16 nt, Mycobacterium leprae
uaauaucuuuuuagag

SEQ ID NO: 3237326 - RNA, 18 nt, Mycobacterium leprae
uaaucaaagguuaucgau

SEQ ID NO: 3237327 - RNA, 21 nt, Mycobacterium leprae
uaaucccacucuugacuaaag

SEQ ID NO: 3237328 - RNA, 15 nt, Mycobacterium leprae
uaaucgcauuuaccg

SEQ ID NO: 3237329 - RNA, 19 nt, Mycobacterium leprae
uaaucguuccuaccggcca

SEQ ID NO: 3237330 - RNA, 22 nt, Mycobacterium leprae
uaaucucgucgauggccgccuu

SEQ ID NO: 3237331 - RNA, 22 nt, Mycobacterium leprae
uaaugccaagcaguuccugugu

SEQ ID NO: 3237332 - RNA, 21 nt, Mycobacterium leprae
uaaugccgggcugcaccgagc

SEQ ID NO: 3237333 - RNA, 17 nt, Mycobacterium leprae
uaaugccgguggccagc

SEQ ID NO: 3237334 - RNA, 16 nt, Mycobacterium leprae
uaauggccggcgccug

SEQ ID NO: 3237335 - RNA, 16 nt, Mycobacterium leprae
uaaugucgaagggcug

SEQ ID NO: 3237336 - RNA, 17 nt, Mycobacterium leprae
uaauuacaucggcccac

SEQ ID NO: 3237337 - RNA, 14 nt, Mycobacterium leprae
uaauuccugcagcc

SEQ ID NO: 3237338 - RNA, 16 nt, Mycobacterium leprae
uaauucuucucuaaaa

SEQ ID NO: 3237339 - RNA, 19 nt, Mycobacterium leprae
uaauucuucucuaaaaaga

SEQ ID NO: 3237340 - RNA, 18 nt, Mycobacterium leprae
uacaaaaucguccgcgua

SEQ ID NO: 3237341 - RNA, 14 nt, Mycobacterium leprae
uacaacguugcugc

SEQ ID NO: 3237342 - RNA, 18 nt, Mycobacterium leprae
uacaaugugucaaaaggc

SEQ ID NO: 3237343 - RNA, 18 nt, Mycobacterium leprae
uacaccaacauagucaga

SEQ ID NO: 3237344 - RNA, 22 nt, Mycobacterium leprae
uacaccaacauagucagaucaa

SEQ ID NO: 3237345 - RNA, 20 nt, Mycobacterium leprae
uacagcaguguucaggccau

SEQ ID NO: 3237346 - RNA, 15 nt, Mycobacterium leprae
uacagcgauucugug

SEQ ID NO: 3237347 - RNA, 18 nt, Mycobacterium leprae
uacagcgugaaccaaagc

SEQ ID NO: 3237348 - RNA, 19 nt, Mycobacterium leprae
uacauagguagauaaacau

SEQ ID NO: 3237349 - RNA, 14 nt, Mycobacterium leprae
uacauaguccaguc

SEQ ID NO: 3237350 - RNA, 15 nt, Mycobacterium leprae
uacaucgacaaaaac

SEQ ID NO: 3237351 - RNA, 14 nt, Mycobacterium leprae
uacaugcuggcagu

SEQ ID NO: 3237352 - RNA, 14 nt, Mycobacterium leprae
uaccaacaccccga

SEQ ID NO: 3237353 - RNA, 22 nt, Mycobacterium leprae
uaccaacaccccgauuccaccu

SEQ ID NO: 3237354 - RNA, 20 nt, Mycobacterium leprae
uaccagccagaccaacauga

SEQ ID NO: 3237355 - RNA, 18 nt, Mycobacterium leprae
uaccaguugcuugucuuc

SEQ ID NO: 3237356 - RNA, 14 nt, Mycobacterium leprae
uacccacgacaucu

SEQ ID NO: 3237357 - RNA, 16 nt, Mycobacterium leprae
uacccaggccuguugc

SEQ ID NO: 3237358 - RNA, 15 nt, Mycobacterium leprae
uacccgcgagcagcg

SEQ ID NO: 3237359 - RNA, 20 nt, Mycobacterium leprae
uacccgcuuucgccauagcc

SEQ ID NO: 3237360 - RNA, 18 nt, Mycobacterium leprae
uaccgacaccgccgacga

SEQ ID NO: 3237361 - RNA, 14 nt, Mycobacterium leprae
uaccgacuugccga

SEQ ID NO: 3237362 - RNA, 19 nt, Mycobacterium leprae
uaccgcccaguaaugugcu

SEQ ID NO: 3237363 - RNA, 16 nt, Mycobacterium leprae
uaccggccaaccacag

SEQ ID NO: 3237364 - RNA, 20 nt, Mycobacterium leprae
uaccggcguucaauaagaaa

SEQ ID NO: 3237365 - RNA, 20 nt, Mycobacterium leprae
uaccggcguucgauaagaag

SEQ ID NO: 3237366 - RNA, 18 nt, Mycobacterium leprae
uaccggcugaaaggaacg

SEQ ID NO: 3237367 - RNA, 17 nt, Mycobacterium leprae
uaccgguguuccgccca

SEQ ID NO: 3237368 - RNA, 19 nt, Mycobacterium leprae
uaccgucgggccugagugg

SEQ ID NO: 3237369 - RNA, 20 nt, Mycobacterium leprae
uaccucagugucagcagcag

SEQ ID NO: 3237370 - RNA, 22 nt, Mycobacterium leprae
uaccuucuguauggcuccaagu

SEQ ID NO: 3237371 - RNA, 14 nt, Mycobacterium leprae
uacgacacuucuac

SEQ ID NO: 3237372 - RNA, 21 nt, Mycobacterium leprae
uacgacgacucaguggcgggc

SEQ ID NO: 3237373 - RNA, 14 nt, Mycobacterium leprae
uacgacgucgccga

SEQ ID NO: 3237374 - RNA, 22 nt, Mycobacterium leprae
uacgccaaacagauccugcuca

SEQ ID NO: 3237375 - RNA, 17 nt, Mycobacterium leprae
uacgcgcgcucacagca

SEQ ID NO: 3237376 - RNA, 19 nt, Mycobacterium leprae
uacgcguacuccagcagcg

SEQ ID NO: 3237377 - RNA, 14 nt, Mycobacterium leprae
uacgcuagagucau

SEQ ID NO: 3237378 - RNA, 19 nt, Mycobacterium leprae
uacgcugauaaggucuggc

SEQ ID NO: 3237379 - RNA, 14 nt, Mycobacterium leprae
uacggagccagugg

SEQ ID NO: 3237380 - RNA, 19 nt, Mycobacterium leprae
uacggcgacucaucgccaa

SEQ ID NO: 3237381 - RNA, 22 nt, Mycobacterium leprae
uacggcggcgauccucaaccag

SEQ ID NO: 3237382 - RNA, 19 nt, Mycobacterium leprae
uacggcguaucgcugugca

SEQ ID NO: 3237383 - RNA, 18 nt, Mycobacterium leprae
uacggucaaaggcaucca

SEQ ID NO: 3237384 - RNA, 20 nt, Mycobacterium leprae
uacgguuaccgucgggccug

SEQ ID NO: 3237385 - RNA, 16 nt, Mycobacterium leprae
uacgucgaggaccgcc

SEQ ID NO: 3237386 - RNA, 17 nt, Mycobacterium leprae
uacgucgaggaccgcca

SEQ ID NO: 3237387 - RNA, 19 nt, Mycobacterium leprae
uacguuagucuggcuggcc

SEQ ID NO: 3237388 - RNA, 20 nt, Mycobacterium leprae
uacuaucugcgugccgagcc

SEQ ID NO: 3237389 - RNA, 14 nt, Mycobacterium leprae
uacucaaugcuguu

SEQ ID NO: 3237390 - RNA, 13 nt, Mycobacterium leprae
uacuccagcagcg

SEQ ID NO: 3237391 - RNA, 18 nt, Mycobacterium leprae
uacucccggcuucgccuu

SEQ ID NO: 3237392 - RNA, 22 nt, Mycobacterium leprae
uacucgcgcagcaaucaaugug

SEQ ID NO: 3237393 - RNA, 22 nt, Mycobacterium leprae
uacucuagcuggucccacagcc

SEQ ID NO: 3237394 - RNA, 15 nt, Mycobacterium leprae
uacugaccgacucac

SEQ ID NO: 3237395 - RNA, 22 nt, Mycobacterium leprae
uacugaccggcuaccggcccga

SEQ ID NO: 3237396 - RNA, 19 nt, Mycobacterium leprae
uacugauuugaacuuggca

SEQ ID NO: 3237397 - RNA, 15 nt, Mycobacterium leprae
uacugcgacagcagc

SEQ ID NO: 3237398 - RNA, 18 nt, Mycobacterium leprae
uacugcgacagcagccac

SEQ ID NO: 3237399 - RNA, 15 nt, Mycobacterium leprae
uacugcugcccgcgg

SEQ ID NO: 3237400 - RNA, 18 nt, Mycobacterium leprae
uacuggcacgccagcugg

SEQ ID NO: 3237401 - RNA, 21 nt, Mycobacterium leprae
uacuggcaguuagcaugagcu

SEQ ID NO: 3237402 - RNA, 13 nt, Mycobacterium leprae
uacuggugcugug

SEQ ID NO: 3237403 - RNA, 14 nt, Mycobacterium leprae
uacuggugcugugu

SEQ ID NO: 3237404 - RNA, 16 nt, Mycobacterium leprae
uacuguugguaaccag

SEQ ID NO: 3237405 - RNA, 16 nt, Mycobacterium leprae
uacuuggcagugugca

SEQ ID NO: 3237406 - RNA, 19 nt, Mycobacterium leprae
uacuuggcagugugcaugu

SEQ ID NO: 3237407 - RNA, 14 nt, Mycobacterium leprae
uacuuuauauacuu

SEQ ID NO: 3237408 - RNA, 22 nt, Mycobacterium leprae
uacuuugugugcauguucuguu

SEQ ID NO: 3237409 - RNA, 15 nt, Mycobacterium leprae
uagaaagacccccgg

SEQ ID NO: 3237410 - RNA, 11 nt, Mycobacterium leprae
uagaacaaacg

SEQ ID NO: 3237411 - RNA, 19 nt, Mycobacterium leprae
uagaacaaaucagcagcau

SEQ ID NO: 3237412 - RNA, 16 nt, Mycobacterium leprae
uagaacaagugcaaug

SEQ ID NO: 3237413 - RNA, 17 nt, Mycobacterium leprae
uagaacacguucuugcc

SEQ ID NO: 3237414 - RNA, 16 nt, Mycobacterium leprae
uagaacauccgcagca

SEQ ID NO: 3237415 - RNA, 22 nt, Mycobacterium leprae
uagaccaagcagcauccaccac

SEQ ID NO: 3237416 - RNA, 19 nt, Mycobacterium leprae
uagaccgaaucguccugca

SEQ ID NO: 3237417 - RNA, 14 nt, Mycobacterium leprae
uagacgcucggcca

SEQ ID NO: 3237418 - RNA, 17 nt, Mycobacterium leprae
uagagaaaaaugcugca

SEQ ID NO: 3237419 - RNA, 16 nt, Mycobacterium leprae
uagagaagaauuaaua

SEQ ID NO: 3237420 - RNA, 15 nt, Mycobacterium leprae
uagagcugcgacaac

SEQ ID NO: 3237421 - RNA, 21 nt, Mycobacterium leprae
uagaucuguaggcacaagccg

SEQ ID NO: 3237422 - RNA, 18 nt, Mycobacterium leprae
uagaucuugaguguagca

SEQ ID NO: 3237423 - RNA, 17 nt, Mycobacterium leprae
uagauggagccaccaca

SEQ ID NO: 3237424 - RNA, 16 nt, Mycobacterium leprae
uagauguuaauuuauu

SEQ ID NO: 3237425 - RNA, 14 nt, Mycobacterium leprae
uagauuuagcacuu

SEQ ID NO: 3237426 - RNA, 22 nt, Mycobacterium leprae
uagcaacagcaagcgagccauc

SEQ ID NO: 3237427 - RNA, 18 nt, Mycobacterium leprae
uagcaacgucacgucgac

SEQ ID NO: 3237428 - RNA, 19 nt, Mycobacterium leprae
uagcaacguguaaggccag

SEQ ID NO: 3237429 - RNA, 20 nt, Mycobacterium leprae
uagcaacguguaaggccagc

SEQ ID NO: 3237430 - RNA, 17 nt, Mycobacterium leprae
uagcaauaaccagggcc

SEQ ID NO: 3237431 - RNA, 17 nt, Mycobacterium leprae
uagcagaguaaccacuu

SEQ ID NO: 3237432 - RNA, 22 nt, Mycobacterium leprae
uagcagaguaaccacuugcagu

SEQ ID NO: 3237433 - RNA, 14 nt, Mycobacterium leprae
uagcagcaucgcgu

SEQ ID NO: 3237434 - RNA, 19 nt, Mycobacterium leprae
uagcaggacgcacccugca

SEQ ID NO: 3237435 - RNA, 13 nt, Mycobacterium leprae
uagcaguguggca

SEQ ID NO: 3237436 - RNA, 14 nt, Mycobacterium leprae
uagcaguguggcau

SEQ ID NO: 3237437 - RNA, 20 nt, Mycobacterium leprae
uagcaguguggcauccgcca

SEQ ID NO: 3237438 - RNA, 13 nt, Mycobacterium leprae
uagcauaacauuu

SEQ ID NO: 3237439 - RNA, 23 nt, Mycobacterium leprae
uagcaucccgaagugaucggcga

SEQ ID NO: 3237440 - RNA, 14 nt, Mycobacterium leprae
uagcaucgaccacg

SEQ ID NO: 3237441 - RNA, 16 nt, Mycobacterium leprae
uagccacucgccacua

SEQ ID NO: 3237442 - RNA, 20 nt, Mycobacterium leprae
uagccgauuagacacacuuc

SEQ ID NO: 3237443 - RNA, 13 nt, Mycobacterium leprae
uagccgcuugccu

SEQ ID NO: 3237444 - RNA, 15 nt, Mycobacterium leprae
uagccgguggccacc

SEQ ID NO: 3237445 - RNA, 12 nt, Mycobacterium leprae
uagccucggcgc

SEQ ID NO: 3237446 - RNA, 13 nt, Mycobacterium leprae
uagcgaaaauaac

SEQ ID NO: 3237447 - RNA, 15 nt, Mycobacterium leprae
uagcgaacacacagg

SEQ ID NO: 3237448 - RNA, 17 nt, Mycobacterium leprae
uagcgcagcugaauacu

SEQ ID NO: 3237449 - RNA, 20 nt, Mycobacterium leprae
uagcgccgggguguggcacg

SEQ ID NO: 3237450 - RNA, 23 nt, Mycobacterium leprae
uagcgccgggguguggcacguug

SEQ ID NO: 3237451 - RNA, 16 nt, Mycobacterium leprae
uagcggccuaggacgc

SEQ ID NO: 3237452 - RNA, 19 nt, Mycobacterium leprae
uagcggccuaggacgccgc

SEQ ID NO: 3237453 - RNA, 14 nt, Mycobacterium leprae
uagcggcgccaggc

SEQ ID NO: 3237454 - RNA, 15 nt, Mycobacterium leprae
uagcgguuuccggca

SEQ ID NO: 3237455 - RNA, 18 nt, Mycobacterium leprae
uagcgucggcggucagga

SEQ ID NO: 3237456 - RNA, 15 nt, Mycobacterium leprae
uagcgugagccuggc

SEQ ID NO: 3237457 - RNA, 23 nt, Mycobacterium leprae
uagcgugagccuggcaccguguc

SEQ ID NO: 3237458 - RNA, 12 nt, Mycobacterium leprae
uagcguggguuc

SEQ ID NO: 3237459 - RNA, 14 nt, Mycobacterium leprae
uagcuaaagugcug

SEQ ID NO: 3237460 - RNA, 15 nt, Mycobacterium leprae
uagcuagaccgaauc

SEQ ID NO: 3237461 - RNA, 13 nt, Mycobacterium leprae
uagcuagccgacg

SEQ ID NO: 3237462 - RNA, 20 nt, Mycobacterium leprae
uagcugauuuggccgccauc

SEQ ID NO: 3237463 - RNA, 17 nt, Mycobacterium leprae
uagcugcaucggcaggc

SEQ ID NO: 3237464 - RNA, 21 nt, Mycobacterium leprae
uagcugccagcuucgcagaca

SEQ ID NO: 3237465 - RNA, 19 nt, Mycobacterium leprae
uagcuggcagucggcaaga

SEQ ID NO: 3237466 - RNA, 17 nt, Mycobacterium leprae
uagcuuauacugcugcg

SEQ ID NO: 3237467 - RNA, 20 nt, Mycobacterium leprae
uaggaaacauuguucugcca

SEQ ID NO: 3237468 - RNA, 17 nt, Mycobacterium leprae
uaggaacgcaacgaggu

SEQ ID NO: 3237469 - RNA, 20 nt, Mycobacterium leprae
uaggaacgcaacgagguaag

SEQ ID NO: 3237470 - RNA, 21 nt, Mycobacterium leprae
uaggauuucgcuaaguccucc

SEQ ID NO: 3237471 - RNA, 11 nt, Mycobacterium leprae
uaggcacagcc

SEQ ID NO: 3237472 - RNA, 18 nt, Mycobacterium leprae
uaggcaccacgcacacga

SEQ ID NO: 3237473 - RNA, 17 nt, Mycobacterium leprae
uaggcgaagagcggcac

SEQ ID NO: 3237474 - RNA, 13 nt, Mycobacterium leprae
uaggcguccgcgg

SEQ ID NO: 3237475 - RNA, 15 nt, Mycobacterium leprae
uaggcgugagccggu

SEQ ID NO: 3237476 - RNA, 14 nt, Mycobacterium leprae
uaggcuucaucauu

SEQ ID NO: 3237477 - RNA, 16 nt, Mycobacterium leprae
uagggagaaugccaca

SEQ ID NO: 3237478 - RNA, 17 nt, Mycobacterium leprae
uagggagaaugccacag

SEQ ID NO: 3237479 - RNA, 16 nt, Mycobacterium leprae
uaggucaguucucgcc

SEQ ID NO: 3237480 - RNA, 20 nt, Mycobacterium leprae
uaggucugaccuaucaaucc

SEQ ID NO: 3237481 - RNA, 16 nt, Mycobacterium leprae
uagguguagcagcugc

SEQ ID NO: 3237482 - RNA, 21 nt, Mycobacterium leprae
uagucaccgccgaagagcugc

SEQ ID NO: 3237483 - RNA, 15 nt, Mycobacterium leprae
uagucacuauauaua

SEQ ID NO: 3237484 - RNA, 21 nt, Mycobacterium leprae
uagucagugauauuaauggag

SEQ ID NO: 3237485 - RNA, 14 nt, Mycobacterium leprae
uagucauguuguug

SEQ ID NO: 3237486 - RNA, 15 nt, Mycobacterium leprae
uaguccgaccagucg

SEQ ID NO: 3237487 - RNA, 14 nt, Mycobacterium leprae
uaguccggaaagau

SEQ ID NO: 3237488 - RNA, 22 nt, Mycobacterium leprae
uaguccucugcgguaucgccga

SEQ ID NO: 3237489 - RNA, 20 nt, Mycobacterium leprae
uagucgcccggaauuuaccc

SEQ ID NO: 3237490 - RNA, 17 nt, Mycobacterium leprae
uagucgcuaaauauuaa

SEQ ID NO: 3237491 - RNA, 20 nt, Mycobacterium leprae
uagucggccggcucgcaucc

SEQ ID NO: 3237492 - RNA, 19 nt, Mycobacterium leprae
uagucgguuacaucgucaa

SEQ ID NO: 3237493 - RNA, 17 nt, Mycobacterium leprae
uagucugcacgucggcc

SEQ ID NO: 3237494 - RNA, 13 nt, Mycobacterium leprae
uagugcacacggc

SEQ ID NO: 3237495 - RNA, 15 nt, Mycobacterium leprae
uagugcugcagguau

SEQ ID NO: 3237496 - RNA, 16 nt, Mycobacterium leprae
uagugcugcagguaua

SEQ ID NO: 3237497 - RNA, 19 nt, Mycobacterium leprae
uagugguucgauucugccc

SEQ ID NO: 3237498 - RNA, 21 nt, Mycobacterium leprae
uagugguucgauucugcccgg

SEQ ID NO: 3237499 - RNA, 19 nt, Mycobacterium leprae
uaguguacagaccgucgaa

SEQ ID NO: 3237500 - RNA, 10 nt, Mycobacterium leprae
uagugugaca

SEQ ID NO: 3237501 - RNA, 13 nt, Mycobacterium leprae
uaguguguuuggu

SEQ ID NO: 3237502 - RNA, 14 nt, Mycobacterium leprae
uaguguguuugguu

SEQ ID NO: 3237503 - RNA, 15 nt, Mycobacterium leprae
uaguuauaccgugca

SEQ ID NO: 3237504 - RNA, 17 nt, Mycobacterium leprae
uaguucgacaccggcca

SEQ ID NO: 3237505 - RNA, 22 nt, Mycobacterium leprae
uaguuuagagugcagcacaaga

SEQ ID NO: 3237506 - RNA, 15 nt, Mycobacterium leprae
uauaacaaaucauag

SEQ ID NO: 3237507 - RNA, 21 nt, Mycobacterium leprae
uauaacgcgaugcgcaccucg

SEQ ID NO: 3237508 - RNA, 14 nt, Mycobacterium leprae
uauaacggcuucau

SEQ ID NO: 3237509 - RNA, 15 nt, Mycobacterium leprae
uauagcacacgaccg

SEQ ID NO: 3237510 - RNA, 19 nt, Mycobacterium leprae
uauauaguccgaccagucg

SEQ ID NO: 3237511 - RNA, 20 nt, Mycobacterium leprae
uauauuaaccguagucacua

SEQ ID NO: 3237512 - RNA, 23 nt, Mycobacterium leprae
uaucaaaccaguaccuuggucac

SEQ ID NO: 3237513 - RNA, 15 nt, Mycobacterium leprae
uaucaagccacacgg

SEQ ID NO: 3237514 - RNA, 22 nt, Mycobacterium leprae
uaucaagggauuccacugccag

SEQ ID NO: 3237515 - RNA, 19 nt, Mycobacterium leprae
uaucaaucacgcccagcgc

SEQ ID NO: 3237516 - RNA, 20 nt, Mycobacterium leprae
uaucaaucacgcccagcgca

SEQ ID NO: 3237517 - RNA, 22 nt, Mycobacterium leprae
uaucaauccauccgguuguguu

SEQ ID NO: 3237518 - RNA, 17 nt, Mycobacterium leprae
uaucagcgcgcacagcu

SEQ ID NO: 3237519 - RNA, 13 nt, Mycobacterium leprae
uaucaugcauccu

SEQ ID NO: 3237520 - RNA, 16 nt, Mycobacterium leprae
uauccaaagaaguuug

SEQ ID NO: 3237521 - RNA, 14 nt, Mycobacterium leprae
uauccaaggugaug

SEQ ID NO: 3237522 - RNA, 21 nt, Mycobacterium leprae
uauccaguaaguggaggugau

SEQ ID NO: 3237523 - RNA, 12 nt, Mycobacterium leprae
uauccguugcca

SEQ ID NO: 3237524 - RNA, 21 nt, Mycobacterium leprae
uauccucacacucacgccugc

SEQ ID NO: 3237525 - RNA, 22 nt, Mycobacterium leprae
uaucgaccagccacgcaaacga

SEQ ID NO: 3237526 - RNA, 13 nt, Mycobacterium leprae
uaucgcaggaucg

SEQ ID NO: 3237527 - RNA, 16 nt, Mycobacterium leprae
uaucgcaugugauacu

SEQ ID NO: 3237528 - RNA, 16 nt, Mycobacterium leprae
uaucgcccaggugcug

SEQ ID NO: 3237529 - RNA, 18 nt, Mycobacterium leprae
uaucgccgguggcuauac

SEQ ID NO: 3237530 - RNA, 21 nt, Mycobacterium leprae
uaucgcuacccuugagcaccc

SEQ ID NO: 3237531 - RNA, 22 nt, Mycobacterium leprae
uaucggacacgagcggccucag

SEQ ID NO: 3237532 - RNA, 15 nt, Mycobacterium leprae
uaucggcauauccgc

SEQ ID NO: 3237533 - RNA, 17 nt, Mycobacterium leprae
uaucggcgagaugcgcu

SEQ ID NO: 3237534 - RNA, 16 nt, Mycobacterium leprae
uaucgucaaauuuucc

SEQ ID NO: 3237535 - RNA, 21 nt, Mycobacterium leprae
uaucguccucaagacuucagg

SEQ ID NO: 3237536 - RNA, 20 nt, Mycobacterium leprae
uaucguggcagcuguauaac

SEQ ID NO: 3237537 - RNA, 13 nt, Mycobacterium leprae
uaucugcaacuca

SEQ ID NO: 3237538 - RNA, 20 nt, Mycobacterium leprae
uaucugggaacauaaccaca

SEQ ID NO: 3237539 - RNA, 14 nt, Mycobacterium leprae
uaugacaagaccac

SEQ ID NO: 3237540 - RNA, 18 nt, Mycobacterium leprae
uaugacccaauccaagac

SEQ ID NO: 3237541 - RNA, 22 nt, Mycobacterium leprae
uaugagcaaaaauccgcugcgu

SEQ ID NO: 3237542 - RNA, 15 nt, Mycobacterium leprae
uaugauggcguucgu

SEQ ID NO: 3237543 - RNA, 14 nt, Mycobacterium leprae
uaugccguuccuga

SEQ ID NO: 3237544 - RNA, 20 nt, Mycobacterium leprae
uaugccucgagcaaaccagg

SEQ ID NO: 3237545 - RNA, 22 nt, Mycobacterium leprae
uaugcgucguacucuggcuggu

SEQ ID NO: 3237546 - RNA, 23 nt, Mycobacterium leprae
uauggccgaacgugagcgacagc

SEQ ID NO: 3237547 - RNA, 15 nt, Mycobacterium leprae
uauggcgccguggag

SEQ ID NO: 3237548 - RNA, 14 nt, Mycobacterium leprae
uauggcgcugaggu

SEQ ID NO: 3237549 - RNA, 17 nt, Mycobacterium leprae
uauggcuaagcuaggcg

SEQ ID NO: 3237550 - RNA, 19 nt, Mycobacterium leprae
uauggcuccaaguggcugc

SEQ ID NO: 3237551 - RNA, 15 nt, Mycobacterium leprae
uauggcuccauagaa

SEQ ID NO: 3237552 - RNA, 22 nt, Mycobacterium leprae
uaugggaccgggcguuucccua

SEQ ID NO: 3237553 - RNA, 13 nt, Mycobacterium leprae
uaugguagucagu

SEQ ID NO: 3237554 - RNA, 20 nt, Mycobacterium leprae
uaugguccaacgugguuggc

SEQ ID NO: 3237555 - RNA, 15 nt, Mycobacterium leprae
uauguccaacaaggu

SEQ ID NO: 3237556 - RNA, 21 nt, Mycobacterium leprae
uaugugccgccgacggccgga

SEQ ID NO: 3237557 - RNA, 13 nt, Mycobacterium leprae
uauuaagauaaag

SEQ ID NO: 3237558 - RNA, 16 nt, Mycobacterium leprae
uauuaaucuggcuggg

SEQ ID NO: 3237559 - RNA, 17 nt, Mycobacterium leprae
uauuaauggagaugcca

SEQ ID NO: 3237560 - RNA, 17 nt, Mycobacterium leprae
uauuaauucuucucuaa

SEQ ID NO: 3237561 - RNA, 14 nt, Mycobacterium leprae
uauucaauuuucgc

SEQ ID NO: 3237562 - RNA, 14 nt, Mycobacterium leprae
uauucagaauucua

SEQ ID NO: 3237563 - RNA, 16 nt, Mycobacterium leprae
uauucgcuacgcccga

SEQ ID NO: 3237564 - RNA, 20 nt, Mycobacterium leprae
uauucugcacgcccaacaca

SEQ ID NO: 3237565 - RNA, 14 nt, Mycobacterium leprae
uauugcauuggcug

SEQ ID NO: 3237566 - RNA, 19 nt, Mycobacterium leprae
uauugucggucugccuuga

SEQ ID NO: 3237567 - RNA, 13 nt, Mycobacterium leprae
uauuuccuaaaau

SEQ ID NO: 3237568 - RNA, 14 nt, Mycobacterium leprae
uauuugaugacaga

SEQ ID NO: 3237569 - RNA, 19 nt, Mycobacterium leprae
ucaaacauggacaaccugg

SEQ ID NO: 3237570 - RNA, 19 nt, Mycobacterium leprae
ucaaagcccuucacuuccg

SEQ ID NO: 3237571 - RNA, 21 nt, Mycobacterium leprae
ucaaagcuagccaccaaguac

SEQ ID NO: 3237572 - RNA, 17 nt, Mycobacterium leprae
ucaaagguuaucgaucu

SEQ ID NO: 3237573 - RNA, 14 nt, Mycobacterium leprae
ucaaagucagccaa

SEQ ID NO: 3237574 - RNA, 13 nt, Mycobacterium leprae
ucaaagucgcggg

SEQ ID NO: 3237575 - RNA, 13 nt, Mycobacterium leprae
ucaacaaaaccau

SEQ ID NO: 3237576 - RNA, 18 nt, Mycobacterium leprae
ucaacagcgcagugugcu

SEQ ID NO: 3237577 - RNA, 17 nt, Mycobacterium leprae
ucaacauggaccaccgu

SEQ ID NO: 3237578 - RNA, 20 nt, Mycobacterium leprae
ucaacauggcgaucugcauu

SEQ ID NO: 3237579 - RNA, 18 nt, Mycobacterium leprae
ucaacauuguaaucagcc

SEQ ID NO: 3237580 - RNA, 14 nt, Mycobacterium leprae
ucaaccaaaugcua

SEQ ID NO: 3237581 - RNA, 17 nt, Mycobacterium leprae
ucaaccaaaugcuauga

SEQ ID NO: 3237582 - RNA, 21 nt, Mycobacterium leprae
ucaaccaaaugcuaugauaau

SEQ ID NO: 3237583 - RNA, 12 nt, Mycobacterium leprae
ucaaccaacaug

SEQ ID NO: 3237584 - RNA, 15 nt, Mycobacterium leprae
ucaaccgugucggcc

SEQ ID NO: 3237585 - RNA, 23 nt, Mycobacterium leprae
ucaacgaauacgagcuccucaua

SEQ ID NO: 3237586 - RNA, 12 nt, Mycobacterium leprae
ucaacgccagca

SEQ ID NO: 3237587 - RNA, 19 nt, Mycobacterium leprae
ucaacgcgaaaggguagcc

SEQ ID NO: 3237588 - RNA, 12 nt, Mycobacterium leprae
ucaacggccuca

SEQ ID NO: 3237589 - RNA, 13 nt, Mycobacterium leprae
ucaacggccucac

SEQ ID NO: 3237590 - RNA, 17 nt, Mycobacterium leprae
ucaacgugauggacgac

SEQ ID NO: 3237591 - RNA, 12 nt, Mycobacterium leprae
ucaacgugcgca

SEQ ID NO: 3237592 - RNA, 17 nt, Mycobacterium leprae
ucaacucuucugcugga

SEQ ID NO: 3237593 - RNA, 17 nt, Mycobacterium leprae
ucaagaugaucgucaua

SEQ ID NO: 3237594 - RNA, 20 nt, Mycobacterium leprae
ucaagcaauagagauagcgc

SEQ ID NO: 3237595 - RNA, 21 nt, Mycobacterium leprae
ucaagcaauagagauagcgcc

SEQ ID NO: 3237596 - RNA, 21 nt, Mycobacterium leprae
ucaaggccaauccgcagucgg

SEQ ID NO: 3237597 - RNA, 19 nt, Mycobacterium leprae
ucaaggccaaugcucgcag

SEQ ID NO: 3237598 - RNA, 14 nt, Mycobacterium leprae
ucaaggugucgucg

SEQ ID NO: 3237599 - RNA, 22 nt, Mycobacterium leprae
ucaagucacaccacuaccccga

SEQ ID NO: 3237600 - RNA, 19 nt, Mycobacterium leprae
ucaagucugaaggcaaaau

SEQ ID NO: 3237601 - RNA, 18 nt, Mycobacterium leprae
ucaaucccguguucugcg

SEQ ID NO: 3237602 - RNA, 22 nt, Mycobacterium leprae
ucaauccugcguagcaaggugu

SEQ ID NO: 3237603 - RNA, 23 nt, Mycobacterium leprae
ucaaugggugcucgcacugcguu

SEQ ID NO: 3237604 - RNA, 14 nt, Mycobacterium leprae
ucacacccgcacag

SEQ ID NO: 3237605 - RNA, 23 nt, Mycobacterium leprae
ucacagagcugugucaaugacaa

SEQ ID NO: 3237606 - RNA, 14 nt, Mycobacterium leprae
ucacaguccugccc

SEQ ID NO: 3237607 - RNA, 19 nt, Mycobacterium leprae
ucacaguccugcccggaca

SEQ ID NO: 3237608 - RNA, 23 nt, Mycobacterium leprae
ucaccaaaucgacuacauccagg

SEQ ID NO: 3237609 - RNA, 19 nt, Mycobacterium leprae
ucaccaacagucccuucgc

SEQ ID NO: 3237610 - RNA, 21 nt, Mycobacterium leprae
ucaccaagcgcagaugauccg

SEQ ID NO: 3237611 - RNA, 17 nt, Mycobacterium leprae
ucaccaauagccgacca

SEQ ID NO: 3237612 - RNA, 15 nt, Mycobacterium leprae
ucaccaauccagcca

SEQ ID NO: 3237613 - RNA, 18 nt, Mycobacterium leprae
ucaccaauccagccaaca

SEQ ID NO: 3237614 - RNA, 19 nt, Mycobacterium leprae
ucaccacgaucaccgcggc

SEQ ID NO: 3237615 - RNA, 17 nt, Mycobacterium leprae
ucaccacuuuggcaacg

SEQ ID NO: 3237616 - RNA, 21 nt, Mycobacterium leprae
ucaccagauuggaaaucgcuc

SEQ ID NO: 3237617 - RNA, 16 nt, Mycobacterium leprae
ucacccaccuuggcgu

SEQ ID NO: 3237618 - RNA, 20 nt, Mycobacterium leprae
ucacccaccuuggcgucgau

SEQ ID NO: 3237619 - RNA, 15 nt, Mycobacterium leprae
ucacccgcagcaccu

SEQ ID NO: 3237620 - RNA, 20 nt, Mycobacterium leprae
ucacccgcagcaccuugggc

SEQ ID NO: 3237621 - RNA, 21 nt, Mycobacterium leprae
ucacccgcgauagcuugcagu

SEQ ID NO: 3237622 - RNA, 14 nt, Mycobacterium leprae
ucacccgcgccgcc

SEQ ID NO: 3237623 - RNA, 12 nt, Mycobacterium leprae
ucacccgcggua

SEQ ID NO: 3237624 - RNA, 18 nt, Mycobacterium leprae
ucacccgucguggccgag

SEQ ID NO: 3237625 - RNA, 16 nt, Mycobacterium leprae
ucaccgaccuucgcga

SEQ ID NO: 3237626 - RNA, 17 nt, Mycobacterium leprae
ucaccgaccuucgcgau

SEQ ID NO: 3237627 - RNA, 22 nt, Mycobacterium leprae
ucaccgacggaugcccagccag

SEQ ID NO: 3237628 - RNA, 17 nt, Mycobacterium leprae
ucaccgcagccggaggg

SEQ ID NO: 3237629 - RNA, 22 nt, Mycobacterium leprae
ucaccgccuacauccuggcguu

SEQ ID NO: 3237630 - RNA, 14 nt, Mycobacterium leprae
ucaccgcggccgac

SEQ ID NO: 3237631 - RNA, 21 nt, Mycobacterium leprae
ucaccggaaagcugaaagcuu

SEQ ID NO: 3237632 - RNA, 12 nt, Mycobacterium leprae
ucaccggccacc

SEQ ID NO: 3237633 - RNA, 14 nt, Mycobacterium leprae
ucaccggcgguguc

SEQ ID NO: 3237634 - RNA, 13 nt, Mycobacterium leprae
ucaccgugcagcg

SEQ ID NO: 3237635 - RNA, 14 nt, Mycobacterium leprae
ucaccucguauggc

SEQ ID NO: 3237636 - RNA, 10 nt, Mycobacterium leprae
ucaccugaaa

SEQ ID NO: 3237637 - RNA, 19 nt, Mycobacterium leprae
ucaccugcgacagccgugc

SEQ ID NO: 3237638 - RNA, 17 nt, Mycobacterium leprae
ucacgcagucauccacu

SEQ ID NO: 3237639 - RNA, 21 nt, Mycobacterium leprae
ucacgcgaccaacgccgagcc

SEQ ID NO: 3237640 - RNA, 14 nt, Mycobacterium leprae
ucacgcgcagugca

SEQ ID NO: 3237641 - RNA, 17 nt, Mycobacterium leprae
ucacgcuggccgccggg

SEQ ID NO: 3237642 - RNA, 14 nt, Mycobacterium leprae
ucacggccaccaua

SEQ ID NO: 3237643 - RNA, 22 nt, Mycobacterium leprae
ucacgggucggcggggugucug

SEQ ID NO: 3237644 - RNA, 17 nt, Mycobacterium leprae
ucacgucgacggcggcc

SEQ ID NO: 3237645 - RNA, 12 nt, Mycobacterium leprae
ucacgucggcgu

SEQ ID NO: 3237646 - RNA, 17 nt, Mycobacterium leprae
ucacguugucgaaaaau

SEQ ID NO: 3237647 - RNA, 15 nt, Mycobacterium leprae
ucacuacguccacua

SEQ ID NO: 3237648 - RNA, 15 nt, Mycobacterium leprae
ucacuacguuggcca

SEQ ID NO: 3237649 - RNA, 20 nt, Mycobacterium leprae
ucacuacguuggccagcacg

SEQ ID NO: 3237650 - RNA, 17 nt, Mycobacterium leprae
ucacuauauauauauua

SEQ ID NO: 3237651 - RNA, 20 nt, Mycobacterium leprae
ucacuggcccgcgucgccuu

SEQ ID NO: 3237652 - RNA, 22 nt, Mycobacterium leprae
ucacugugucuuuacauuuuga

SEQ ID NO: 3237653 - RNA, 18 nt, Mycobacterium leprae
ucacuuauguguacuguu

SEQ ID NO: 3237654 - RNA, 22 nt, Mycobacterium leprae
ucacuuccgcuuugccgcugug

SEQ ID NO: 3237655 - RNA, 15 nt, Mycobacterium leprae
ucacuugcugaccga

SEQ ID NO: 3237656 - RNA, 16 nt, Mycobacterium leprae
ucagacgccggggaac

SEQ ID NO: 3237657 - RNA, 14 nt, Mycobacterium leprae
ucagacugcccaga

SEQ ID NO: 3237658 - RNA, 18 nt, Mycobacterium leprae
ucagacugcccagacuca

SEQ ID NO: 3237659 - RNA, 11 nt, Mycobacterium leprae
ucagacuggau

SEQ ID NO: 3237660 - RNA, 23 nt, Mycobacterium leprae
ucagacuggauggcgaucgccuu

SEQ ID NO: 3237661 - RNA, 12 nt, Mycobacterium leprae
ucagagugcaga

SEQ ID NO: 3237662 - RNA, 16 nt, Mycobacterium leprae
ucagagugcagaucac

SEQ ID NO: 3237663 - RNA, 12 nt, Mycobacterium leprae
ucagaguuucau

SEQ ID NO: 3237664 - RNA, 18 nt, Mycobacterium leprae
ucagauauccuaggccac

SEQ ID NO: 3237665 - RNA, 20 nt, Mycobacterium leprae
ucagaucaaccaaaugcuau

SEQ ID NO: 3237666 - RNA, 21 nt, Mycobacterium leprae
ucagcaacacuggcgaccgca

SEQ ID NO: 3237667 - RNA, 21 nt, Mycobacterium leprae
ucagcacaaucaaccaggcaa

SEQ ID NO: 3237668 - RNA, 20 nt, Mycobacterium leprae
ucagcacauggacuuuggca

SEQ ID NO: 3237669 - RNA, 17 nt, Mycobacterium leprae
ucagcaccgcgccgguc

SEQ ID NO: 3237670 - RNA, 20 nt, Mycobacterium leprae
ucagcaccggcauggccgcu

SEQ ID NO: 3237671 - RNA, 22 nt, Mycobacterium leprae
ucagcacucgacucaccgcggc

SEQ ID NO: 3237672 - RNA, 12 nt, Mycobacterium leprae
ucagcagcaguu

SEQ ID NO: 3237673 - RNA, 21 nt, Mycobacterium leprae
ucagcaggaaucccagcagcu

SEQ ID NO: 3237674 - RNA, 15 nt, Mycobacterium leprae
ucagcaucagacaga

SEQ ID NO: 3237675 - RNA, 13 nt, Mycobacterium leprae
ucagcaucgacag

SEQ ID NO: 3237676 - RNA, 17 nt, Mycobacterium leprae
ucagcauggacgaaucc

SEQ ID NO: 3237677 - RNA, 21 nt, Mycobacterium leprae
ucagcauggcgaugcgcagcc

SEQ ID NO: 3237678 - RNA, 17 nt, Mycobacterium leprae
ucagcaugucggccacu

SEQ ID NO: 3237679 - RNA, 23 nt, Mycobacterium leprae
ucagccagggucacaaaccccuc

SEQ ID NO: 3237680 - RNA, 14 nt, Mycobacterium leprae
ucagccgucgcugu

SEQ ID NO: 3237681 - RNA, 17 nt, Mycobacterium leprae
ucagccuaugauggcgu

SEQ ID NO: 3237682 - RNA, 22 nt, Mycobacterium leprae
ucagcgaagaguuucugcugcc

SEQ ID NO: 3237683 - RNA, 19 nt, Mycobacterium leprae
ucagcgcgauguuggaacg

SEQ ID NO: 3237684 - RNA, 13 nt, Mycobacterium leprae
ucagcgcugcuuc

SEQ ID NO: 3237685 - RNA, 14 nt, Mycobacterium leprae
ucagcgcugcuuca

SEQ ID NO: 3237686 - RNA, 21 nt, Mycobacterium leprae
ucagcggacugcuagccggcu

SEQ ID NO: 3237687 - RNA, 17 nt, Mycobacterium leprae
ucagcggcauuucgcag

SEQ ID NO: 3237688 - RNA, 16 nt, Mycobacterium leprae
ucagcgggggugggcu

SEQ ID NO: 3237689 - RNA, 21 nt, Mycobacterium leprae
ucagcgguaagcggauccugu

SEQ ID NO: 3237690 - RNA, 19 nt, Mycobacterium leprae
ucagcgucggacgccggac

SEQ ID NO: 3237691 - RNA, 21 nt, Mycobacterium leprae
ucaggacggugaaaucaucua

SEQ ID NO: 3237692 - RNA, 22 nt, Mycobacterium leprae
ucaggacucggauccaucagac

SEQ ID NO: 3237693 - RNA, 19 nt, Mycobacterium leprae
ucaggauaccgaacagugg

SEQ ID NO: 3237694 - RNA, 14 nt, Mycobacterium leprae
ucaggaugcugucg

SEQ ID NO: 3237695 - RNA, 19 nt, Mycobacterium leprae
ucaggauuuugacgccgcc

SEQ ID NO: 3237696 - RNA, 13 nt, Mycobacterium leprae
ucaggcugucauc

SEQ ID NO: 3237697 - RNA, 18 nt, Mycobacterium leprae
ucaggcugucaucagaaa

SEQ ID NO: 3237698 - RNA, 12 nt, Mycobacterium leprae
ucagggcagcag

SEQ ID NO: 3237699 - RNA, 15 nt, Mycobacterium leprae
ucagguccaacgcgg

SEQ ID NO: 3237700 - RNA, 20 nt, Mycobacterium leprae
ucaggucuacucgccugauc

SEQ ID NO: 3237701 - RNA, 21 nt, Mycobacterium leprae
ucaggucuacucgccugaucc

SEQ ID NO: 3237702 - RNA, 16 nt, Mycobacterium leprae
ucagugaagugcucgg

SEQ ID NO: 3237703 - RNA, 11 nt, Mycobacterium leprae
ucagugcggaa

SEQ ID NO: 3237704 - RNA, 21 nt, Mycobacterium leprae
ucagugcgugaucgacaucgu

SEQ ID NO: 3237705 - RNA, 14 nt, Mycobacterium leprae
ucaguuuggcgcug

SEQ ID NO: 3237706 - RNA, 18 nt, Mycobacterium leprae
ucauaacuauucaugaaa

SEQ ID NO: 3237707 - RNA, 23 nt, Mycobacterium leprae
ucauaggcuucaucauuuucaac

SEQ ID NO: 3237708 - RNA, 17 nt, Mycobacterium leprae
ucauagggagaaugcca

SEQ ID NO: 3237709 - RNA, 21 nt, Mycobacterium leprae
ucauagggagaaugccacagg

SEQ ID NO: 3237710 - RNA, 14 nt, Mycobacterium leprae
ucauaggugguggg

SEQ ID NO: 3237711 - RNA, 22 nt, Mycobacterium leprae
ucaucagauucacagucggcgc

SEQ ID NO: 3237712 - RNA, 22 nt, Mycobacterium leprae
ucaucaguguguccacaaccuc

SEQ ID NO: 3237713 - RNA, 18 nt, Mycobacterium leprae
ucaucccagaacuggucc

SEQ ID NO: 3237714 - RNA, 15 nt, Mycobacterium leprae
ucauccccaucgcuu

SEQ ID NO: 3237715 - RNA, 23 nt, Mycobacterium leprae
ucauccgaaaggauaggcgccgu

SEQ ID NO: 3237716 - RNA, 15 nt, Mycobacterium leprae
ucaucgaugcacugu

SEQ ID NO: 3237717 - RNA, 23 nt, Mycobacterium leprae
ucaucgcccaccgcaacgccucc

SEQ ID NO: 3237718 - RNA, 12 nt, Mycobacterium leprae
ucaucgcuaaga

SEQ ID NO: 3237719 - RNA, 16 nt, Mycobacterium leprae
ucaucgcuaagacuca

SEQ ID NO: 3237720 - RNA, 15 nt, Mycobacterium leprae
ucaucgcugccaucg

SEQ ID NO: 3237721 - RNA, 23 nt, Mycobacterium leprae
ucaucgcugccaucgacgccguc

SEQ ID NO: 3237722 - RNA, 23 nt, Mycobacterium leprae
ucaucuaaacugacgcugcgcug

SEQ ID NO: 3237723 - RNA, 12 nt, Mycobacterium leprae
ucaucuagagaa

SEQ ID NO: 3237724 - RNA, 20 nt, Mycobacterium leprae
ucaucuagagaaacaccuuu

SEQ ID NO: 3237725 - RNA, 19 nt, Mycobacterium leprae
ucaucuaucuccaccagcc

SEQ ID NO: 3237726 - RNA, 23 nt, Mycobacterium leprae
ucaucuaucuccaccagccggcc

SEQ ID NO: 3237727 - RNA, 17 nt, Mycobacterium leprae
ucaucugccaggcgcga

SEQ ID NO: 3237728 - RNA, 21 nt, Mycobacterium leprae
ucaucuguagcuucgucgcau

SEQ ID NO: 3237729 - RNA, 14 nt, Mycobacterium leprae
ucaucuugggcauc

SEQ ID NO: 3237730 - RNA, 18 nt, Mycobacterium leprae
ucaugacguuuacaacgu

SEQ ID NO: 3237731 - RNA, 22 nt, Mycobacterium leprae
ucaugagcgucgcuccuucuua

SEQ ID NO: 3237732 - RNA, 19 nt, Mycobacterium leprae
ucaugaucgcaggcaccac

SEQ ID NO: 3237733 - RNA, 12 nt, Mycobacterium leprae
ucaugccagggc

SEQ ID NO: 3237734 - RNA, 14 nt, Mycobacterium leprae
ucaugcuagggcug

SEQ ID NO: 3237735 - RNA, 14 nt, Mycobacterium leprae
ucauggcaguccac

SEQ ID NO: 3237736 - RNA, 16 nt, Mycobacterium leprae
ucauggccgcagugau

SEQ ID NO: 3237737 - RNA, 19 nt, Mycobacterium leprae
ucauggccuugaggugucg

SEQ ID NO: 3237738 - RNA, 22 nt, Mycobacterium leprae
ucauggccuugaggugucggcg

SEQ ID NO: 3237739 - RNA, 14 nt, Mycobacterium leprae
ucauguuccgcuga

SEQ ID NO: 3237740 - RNA, 18 nt, Mycobacterium leprae
ucauguucucaaggcaau

SEQ ID NO: 3237741 - RNA, 19 nt, Mycobacterium leprae
ucauucgauccaaugacua

SEQ ID NO: 3237742 - RNA, 15 nt, Mycobacterium leprae
ucauucuugugucca

SEQ ID NO: 3237743 - RNA, 19 nt, Mycobacterium leprae
ucauuggagugguuagaca

SEQ ID NO: 3237744 - RNA, 22 nt, Mycobacterium leprae
ucauuguccaagccgagacuga

SEQ ID NO: 3237745 - RNA, 14 nt, Mycobacterium leprae
ucauuuucgagcaa

SEQ ID NO: 3237746 - RNA, 20 nt, Mycobacterium leprae
uccaaagggucguaauaaua

SEQ ID NO: 3237747 - RNA, 19 nt, Mycobacterium leprae
uccaacaaacuacuguugu

SEQ ID NO: 3237748 - RNA, 21 nt, Mycobacterium leprae
uccaacaaacuacuguuguca

SEQ ID NO: 3237749 - RNA, 14 nt, Mycobacterium leprae
uccaacacgccgau

SEQ ID NO: 3237750 - RNA, 18 nt, Mycobacterium leprae
uccaaccaauugccaucc

SEQ ID NO: 3237751 - RNA, 14 nt, Mycobacterium leprae
uccaagaccaccug

SEQ ID NO: 3237752 - RNA, 20 nt, Mycobacterium leprae
uccaagccgagacugaaugc

SEQ ID NO: 3237753 - RNA, 15 nt, Mycobacterium leprae
uccaagccggucggg

SEQ ID NO: 3237754 - RNA, 13 nt, Mycobacterium leprae
uccaaguggcugc

SEQ ID NO: 3237755 - RNA, 14 nt, Mycobacterium leprae
uccaaguggcugcu

SEQ ID NO: 3237756 - RNA, 19 nt, Mycobacterium leprae
uccaauagcagaguaacca

SEQ ID NO: 3237757 - RNA, 19 nt, Mycobacterium leprae
uccaauucacgaacaacag

SEQ ID NO: 3237758 - RNA, 22 nt, Mycobacterium leprae
uccaccacacgucgagccuguc

SEQ ID NO: 3237759 - RNA, 23 nt, Mycobacterium leprae
uccaccagccgcaggcaccauug

SEQ ID NO: 3237760 - RNA, 14 nt, Mycobacterium leprae
uccaccagccggcc

SEQ ID NO: 3237761 - RNA, 15 nt, Mycobacterium leprae
uccaccgagacguug

SEQ ID NO: 3237762 - RNA, 21 nt, Mycobacterium leprae
uccaccgagacguugcuggga

SEQ ID NO: 3237763 - RNA, 13 nt, Mycobacterium leprae
uccaccgccaggc

SEQ ID NO: 3237764 - RNA, 19 nt, Mycobacterium leprae
uccaccgccaggcuuaucc

SEQ ID NO: 3237765 - RNA, 22 nt, Mycobacterium leprae
uccaccggaaguuagcgcagcu

SEQ ID NO: 3237766 - RNA, 14 nt, Mycobacterium leprae
uccacguuguccgc

SEQ ID NO: 3237767 - RNA, 17 nt, Mycobacterium leprae
uccacuggcuaaaucgu

SEQ ID NO: 3237768 - RNA, 17 nt, Mycobacterium leprae
uccacuugacggucgag

SEQ ID NO: 3237769 - RNA, 16 nt, Mycobacterium leprae
uccacuugacuggcuu

SEQ ID NO: 3237770 - RNA, 16 nt, Mycobacterium leprae
uccagaacggucuggc

SEQ ID NO: 3237771 - RNA, 17 nt, Mycobacterium leprae
uccagaaucacagcuac

SEQ ID NO: 3237772 - RNA, 18 nt, Mycobacterium leprae
uccagacaccacugccag

SEQ ID NO: 3237773 - RNA, 20 nt, Mycobacterium leprae
uccagaugccguuuucacca

SEQ ID NO: 3237774 - RNA, 20 nt, Mycobacterium leprae
uccagcaucauaaaaaccug

SEQ ID NO: 3237775 - RNA, 18 nt, Mycobacterium leprae
uccagccaucacugaucc

SEQ ID NO: 3237776 - RNA, 12 nt, Mycobacterium leprae
uccagccgaggg

SEQ ID NO: 3237777 - RNA, 14 nt, Mycobacterium leprae
uccagccgcgggcg

SEQ ID NO: 3237778 - RNA, 20 nt, Mycobacterium leprae
uccagcgaagguagcccguu

SEQ ID NO: 3237779 - RNA, 18 nt, Mycobacterium leprae
uccagcgguaacuggcuc

SEQ ID NO: 3237780 - RNA, 19 nt, Mycobacterium leprae
uccagcugucagugucgca

SEQ ID NO: 3237781 - RNA, 14 nt, Mycobacterium leprae
uccagucgcauccu

SEQ ID NO: 3237782 - RNA, 16 nt, Mycobacterium leprae
uccaguggcugcaccg

SEQ ID NO: 3237783 - RNA, 19 nt, Mycobacterium leprae
uccaguggcugcaccggcu

SEQ ID NO: 3237784 - RNA, 15 nt, Mycobacterium leprae
uccaguguaguguca

SEQ ID NO: 3237785 - RNA, 17 nt, Mycobacterium leprae
uccaguguagugucaau

SEQ ID NO: 3237786 - RNA, 23 nt, Mycobacterium leprae
uccauacccaggguagcugacgg

SEQ ID NO: 3237787 - RNA, 16 nt, Mycobacterium leprae
uccaucagcaccgaga

SEQ ID NO: 3237788 - RNA, 14 nt, Mycobacterium leprae
uccauccguggcga

SEQ ID NO: 3237789 - RNA, 12 nt, Mycobacterium leprae
uccaugaugguu

SEQ ID NO: 3237790 - RNA, 18 nt, Mycobacterium leprae
uccaugccacugucgcga

SEQ ID NO: 3237791 - RNA, 17 nt, Mycobacterium leprae
uccauugaccucuucag

SEQ ID NO: 3237792 - RNA, 16 nt, Mycobacterium leprae
uccauuuucguggcga

SEQ ID NO: 3237793 - RNA, 20 nt, Mycobacterium leprae
ucccaaccgcgacgccaggc

SEQ ID NO: 3237794 - RNA, 20 nt, Mycobacterium leprae
ucccaccacccugcgcugag

SEQ ID NO: 3237795 - RNA, 22 nt, Mycobacterium leprae
ucccaccggcggcuggugcggc

SEQ ID NO: 3237796 - RNA, 16 nt, Mycobacterium leprae
ucccacgacggugcgg

SEQ ID NO: 3237797 - RNA, 18 nt, Mycobacterium leprae
ucccacggcggcaucuca

SEQ ID NO: 3237798 - RNA, 23 nt, Mycobacterium leprae
ucccagaacugguccgccagcga

SEQ ID NO: 3237799 - RNA, 17 nt, Mycobacterium leprae
ucccagccuaaauccgg

SEQ ID NO: 3237800 - RNA, 23 nt, Mycobacterium leprae
ucccaggggggcgcggucgccga

SEQ ID NO: 3237801 - RNA, 13 nt, Mycobacterium leprae
ucccaucggcugc

SEQ ID NO: 3237802 - RNA, 17 nt, Mycobacterium leprae
uccccgcccaaggcucc

SEQ ID NO: 3237803 - RNA, 17 nt, Mycobacterium leprae
uccccucgcuccaacaa

SEQ ID NO: 3237804 - RNA, 18 nt, Mycobacterium leprae
ucccgaaacgccucugcc

SEQ ID NO: 3237805 - RNA, 18 nt, Mycobacterium leprae
ucccgauagcugccagcu

SEQ ID NO: 3237806 - RNA, 20 nt, Mycobacterium leprae
ucccgaugaccuugaaagcg

SEQ ID NO: 3237807 - RNA, 16 nt, Mycobacterium leprae
ucccgcccggccagua

SEQ ID NO: 3237808 - RNA, 12 nt, Mycobacterium leprae
ucccgcucugcg

SEQ ID NO: 3237809 - RNA, 16 nt, Mycobacterium leprae
ucccgggggccagcgu

SEQ ID NO: 3237810 - RNA, 21 nt, Mycobacterium leprae
ucccgguuacguccgcggcag

SEQ ID NO: 3237811 - RNA, 22 nt, Mycobacterium leprae
ucccucagcggcauuucgcagu

SEQ ID NO: 3237812 - RNA, 17 nt, Mycobacterium leprae
ucccugacgcacaccgu

SEQ ID NO: 3237813 - RNA, 13 nt, Mycobacterium leprae
ucccugacgcgca

SEQ ID NO: 3237814 - RNA, 17 nt, Mycobacterium leprae
ucccugacuguuuccgc

SEQ ID NO: 3237815 - RNA, 19 nt, Mycobacterium leprae
ucccugacuguuuccgcgg

SEQ ID NO: 3237816 - RNA, 15 nt, Mycobacterium leprae
ucccugauccuucuu

SEQ ID NO: 3237817 - RNA, 12 nt, Mycobacterium leprae
ucccuucgccga

SEQ ID NO: 3237818 - RNA, 16 nt, Mycobacterium leprae
ucccuugaacugcagg

SEQ ID NO: 3237819 - RNA, 20 nt, Mycobacterium leprae
uccgaaacccgaaaccaagc

SEQ ID NO: 3237820 - RNA, 15 nt, Mycobacterium leprae
uccgaacggggcggc

SEQ ID NO: 3237821 - RNA, 18 nt, Mycobacterium leprae
uccgaacggggcggcacc

SEQ ID NO: 3237822 - RNA, 19 nt, Mycobacterium leprae
uccgaagcagccaaugcug

SEQ ID NO: 3237823 - RNA, 16 nt, Mycobacterium leprae
uccgacaaaccaggcg

SEQ ID NO: 3237824 - RNA, 15 nt, Mycobacterium leprae
uccgacaaagcagca

SEQ ID NO: 3237825 - RNA, 16 nt, Mycobacterium leprae
uccgacaaagcagcau

SEQ ID NO: 3237826 - RNA, 22 nt, Mycobacterium leprae
uccgaccagucgagauaguccg

SEQ ID NO: 3237827 - RNA, 20 nt, Mycobacterium leprae
uccgacggcuggcugcugca

SEQ ID NO: 3237828 - RNA, 22 nt, Mycobacterium leprae
uccgacggcuggcugcugcaga

SEQ ID NO: 3237829 - RNA, 14 nt, Mycobacterium leprae
uccgagcuuuucca

SEQ ID NO: 3237830 - RNA, 16 nt, Mycobacterium leprae
uccgagcuuuuccagc

SEQ ID NO: 3237831 - RNA, 18 nt, Mycobacterium leprae
uccgagcuuuuccagcgg

SEQ ID NO: 3237832 - RNA, 18 nt, Mycobacterium leprae
uccgaucaauggcagcca

SEQ ID NO: 3237833 - RNA, 13 nt, Mycobacterium leprae
uccgaucgcaccg

SEQ ID NO: 3237834 - RNA, 15 nt, Mycobacterium leprae
uccgaugugggucug

SEQ ID NO: 3237835 - RNA, 18 nt, Mycobacterium leprae
uccgcaagcgcgccgagu

SEQ ID NO: 3237836 - RNA, 23 nt, Mycobacterium leprae
uccgcagcacuaaagucuucaau

SEQ ID NO: 3237837 - RNA, 21 nt, Mycobacterium leprae
uccgcaggacaaagucagcuu

SEQ ID NO: 3237838 - RNA, 15 nt, Mycobacterium leprae
uccgccagcgacacc

SEQ ID NO: 3237839 - RNA, 22 nt, Mycobacterium leprae
uccgccgaucccgaaagugccg

SEQ ID NO: 3237840 - RNA, 19 nt, Mycobacterium leprae
uccgccguuuuaccccgga

SEQ ID NO: 3237841 - RNA, 18 nt, Mycobacterium leprae
uccgcgcaacacccaggu

SEQ ID NO: 3237842 - RNA, 18 nt, Mycobacterium leprae
uccgcgcagggccugggg

SEQ ID NO: 3237843 - RNA, 15 nt, Mycobacterium leprae
uccgcgccccuuccu

SEQ ID NO: 3237844 - RNA, 12 nt, Mycobacterium leprae
uccgcgccggcg

SEQ ID NO: 3237845 - RNA, 13 nt, Mycobacterium leprae
uccgcgccggcgu

SEQ ID NO: 3237846 - RNA, 21 nt, Mycobacterium leprae
uccgcggcggccccuuucacg

SEQ ID NO: 3237847 - RNA, 19 nt, Mycobacterium leprae
uccgcgggagcggugccgc

SEQ ID NO: 3237848 - RNA, 21 nt, Mycobacterium leprae
uccgcgucacucuaccucggu

SEQ ID NO: 3237849 - RNA, 22 nt, Mycobacterium leprae
uccgcuaaggcagcccgcgccg

SEQ ID NO: 3237850 - RNA, 19 nt, Mycobacterium leprae
uccgcucaaagccugcguc

SEQ ID NO: 3237851 - RNA, 14 nt, Mycobacterium leprae
uccgcucaccgcgg

SEQ ID NO: 3237852 - RNA, 18 nt, Mycobacterium leprae
uccggaaaucgagaauuu

SEQ ID NO: 3237853 - RNA, 14 nt, Mycobacterium leprae
uccggacuauacuu

SEQ ID NO: 3237854 - RNA, 20 nt, Mycobacterium leprae
uccggauuuuccugcgcgaa

SEQ ID NO: 3237855 - RNA, 19 nt, Mycobacterium leprae
uccggcgcggguccgcguu

SEQ ID NO: 3237856 - RNA, 15 nt, Mycobacterium leprae
uccggcuaucaggau

SEQ ID NO: 3237857 - RNA, 14 nt, Mycobacterium leprae
uccggcuucuccag

SEQ ID NO: 3237858 - RNA, 20 nt, Mycobacterium leprae
uccgggucaccucguauggc

SEQ ID NO: 3237859 - RNA, 16 nt, Mycobacterium leprae
uccggguuaucuaacu

SEQ ID NO: 3237860 - RNA, 13 nt, Mycobacterium leprae
uccgguugcgugg

SEQ ID NO: 3237861 - RNA, 18 nt, Mycobacterium leprae
uccgguuggcugccgucg

SEQ ID NO: 3237862 - RNA, 15 nt, Mycobacterium leprae
uccguauaaccugcu

SEQ ID NO: 3237863 - RNA, 16 nt, Mycobacterium leprae
uccgucucucaggccg

SEQ ID NO: 3237864 - RNA, 19 nt, Mycobacterium leprae
uccguggcgagacacccgg

SEQ ID NO: 3237865 - RNA, 20 nt, Mycobacterium leprae
uccguugggguagugcugca

SEQ ID NO: 3237866 - RNA, 18 nt, Mycobacterium leprae
uccguuguccgcggcuau

SEQ ID NO: 3237867 - RNA, 13 nt, Mycobacterium leprae
uccuaagagguuu

SEQ ID NO: 3237868 - RNA, 12 nt, Mycobacterium leprae
uccuacagcagu

SEQ ID NO: 3237869 - RNA, 22 nt, Mycobacterium leprae
uccuacagcaguguucaggcca

SEQ ID NO: 3237870 - RNA, 12 nt, Mycobacterium leprae
uccuaccggcca

SEQ ID NO: 3237871 - RNA, 14 nt, Mycobacterium leprae
uccuaggaucagaa

SEQ ID NO: 3237872 - RNA, 22 nt, Mycobacterium leprae
uccuagggugccuugacuucuu

SEQ ID NO: 3237873 - RNA, 19 nt, Mycobacterium leprae
uccuauaaaacacuucaac

SEQ ID NO: 3237874 - RNA, 22 nt, Mycobacterium leprae
uccuaugucgugcugaccaggg

SEQ ID NO: 3237875 - RNA, 20 nt, Mycobacterium leprae
uccucacguugucgaaaaau

SEQ ID NO: 3237876 - RNA, 23 nt, Mycobacterium leprae
uccucacguugucgaaaaaucag

SEQ ID NO: 3237877 - RNA, 20 nt, Mycobacterium leprae
uccucagaguguguguggca

SEQ ID NO: 3237878 - RNA, 14 nt, Mycobacterium leprae
uccucaucccauga

SEQ ID NO: 3237879 - RNA, 16 nt, Mycobacterium leprae
uccucaugcccaugcc

SEQ ID NO: 3237880 - RNA, 17 nt, Mycobacterium leprae
uccucgaccaccagggc

SEQ ID NO: 3237881 - RNA, 13 nt, Mycobacterium leprae
uccucgacccacc

SEQ ID NO: 3237882 - RNA, 14 nt, Mycobacterium leprae
uccucgcucggcaa

SEQ ID NO: 3237883 - RNA, 14 nt, Mycobacterium leprae
uccucggcccaugg

SEQ ID NO: 3237884 - RNA, 21 nt, Mycobacterium leprae
uccucgggggugcaagucagu

SEQ ID NO: 3237885 - RNA, 13 nt, Mycobacterium leprae
uccucgucgguga

SEQ ID NO: 3237886 - RNA, 19 nt, Mycobacterium leprae
uccucuucgcguaggugcg

SEQ ID NO: 3237887 - RNA, 14 nt, Mycobacterium leprae
uccugacaaccguu

SEQ ID NO: 3237888 - RNA, 21 nt, Mycobacterium leprae
uccugagacaucgccaccgac

SEQ ID NO: 3237889 - RNA, 21 nt, Mycobacterium leprae
uccugagaugccagccaacgg

SEQ ID NO: 3237890 - RNA, 22 nt, Mycobacterium leprae
uccugauuaauaacgccggccg

SEQ ID NO: 3237891 - RNA, 13 nt, Mycobacterium leprae
uccugcagcgcgg

SEQ ID NO: 3237892 - RNA, 13 nt, Mycobacterium leprae
uccugcagguugc

SEQ ID NO: 3237893 - RNA, 20 nt, Mycobacterium leprae
uccugcagguugcugucgug

SEQ ID NO: 3237894 - RNA, 22 nt, Mycobacterium leprae
uccugcguucgguagcgcgcug

SEQ ID NO: 3237895 - RNA, 14 nt, Mycobacterium leprae
uccugcuguaauau

SEQ ID NO: 3237896 - RNA, 16 nt, Mycobacterium leprae
uccuggaugccgaccg

SEQ ID NO: 3237897 - RNA, 19 nt, Mycobacterium leprae
uccuggcgaucgauccagu

SEQ ID NO: 3237898 - RNA, 14 nt, Mycobacterium leprae
uccugguggcaacg

SEQ ID NO: 3237899 - RNA, 18 nt, Mycobacterium leprae
uccugguggcaacgcugc

SEQ ID NO: 3237900 - RNA, 24 nt, Mycobacterium leprae
uccuguguugccaucgacgccgcc

SEQ ID NO: 3237901 - RNA, 16 nt, Mycobacterium leprae
uccuguugacguguuu

SEQ ID NO: 3237902 - RNA, 14 nt, Mycobacterium leprae
uccuguugauuuuu

SEQ ID NO: 3237903 - RNA, 15 nt, Mycobacterium leprae
uccuucauguccuac

SEQ ID NO: 3237904 - RNA, 15 nt, Mycobacterium leprae
uccuucuaugacaac

SEQ ID NO: 3237905 - RNA, 15 nt, Mycobacterium leprae
uccuugaccaccacc

SEQ ID NO: 3237906 - RNA, 19 nt, Mycobacterium leprae
uccuugccggcgccgcugc

SEQ ID NO: 3237907 - RNA, 22 nt, Mycobacterium leprae
uccuuggaaccaucaacggcua

SEQ ID NO: 3237908 - RNA, 20 nt, Mycobacterium leprae
ucgaaacugccaaaguccau

SEQ ID NO: 3237909 - RNA, 18 nt, Mycobacterium leprae
ucgaaaugggaucgagcg

SEQ ID NO: 3237910 - RNA, 20 nt, Mycobacterium leprae
ucgaacuuuuccaugcugcc

SEQ ID NO: 3237911 - RNA, 15 nt, Mycobacterium leprae
ucgaagccaaaaacu

SEQ ID NO: 3237912 - RNA, 19 nt, Mycobacterium leprae
ucgaauaccuuuucaacag

SEQ ID NO: 3237913 - RNA, 14 nt, Mycobacterium leprae
ucgaaucagcaucg

SEQ ID NO: 3237914 - RNA, 18 nt, Mycobacterium leprae
ucgaaucagcaucgacag

SEQ ID NO: 3237915 - RNA, 21 nt, Mycobacterium leprae
ucgacaaccucguuacgaucc

SEQ ID NO: 3237916 - RNA, 12 nt, Mycobacterium leprae
ucgacaaggucg

SEQ ID NO: 3237917 - RNA, 16 nt, Mycobacterium leprae
ucgacauacaggacga

SEQ ID NO: 3237918 - RNA, 20 nt, Mycobacterium leprae
ucgacauagugcaagugcac

SEQ ID NO: 3237919 - RNA, 19 nt, Mycobacterium leprae
ucgacaucccagcaacgcu

SEQ ID NO: 3237920 - RNA, 19 nt, Mycobacterium leprae
ucgacauccugaugcucua

SEQ ID NO: 3237921 - RNA, 19 nt, Mycobacterium leprae
ucgaccaacgguucgcuug

SEQ ID NO: 3237922 - RNA, 19 nt, Mycobacterium leprae
ucgaccagccaagccgcca

SEQ ID NO: 3237923 - RNA, 17 nt, Mycobacterium leprae
ucgacccggugguguuc

SEQ ID NO: 3237924 - RNA, 22 nt, Mycobacterium leprae
ucgaccgacugcagaaauucag

SEQ ID NO: 3237925 - RNA, 18 nt, Mycobacterium leprae
ucgaccgccgaagcagcc

SEQ ID NO: 3237926 - RNA, 19 nt, Mycobacterium leprae
ucgaccuccuugaccacca

SEQ ID NO: 3237927 - RNA, 23 nt, Mycobacterium leprae
ucgaccuccuugaccaccaccgc

SEQ ID NO: 3237928 - RNA, 23 nt, Mycobacterium leprae
ucgacgaaccaacaccccacccg

SEQ ID NO: 3237929 - RNA, 17 nt, Mycobacterium leprae
ucgacgacugccgaccg

SEQ ID NO: 3237930 - RNA, 18 nt, Mycobacterium leprae
ucgacgcagcaacuguuu

SEQ ID NO: 3237931 - RNA, 21 nt, Mycobacterium leprae
ucgacgcagcaacuguuuggu

SEQ ID NO: 3237932 - RNA, 23 nt, Mycobacterium leprae
ucgacgcgagaaaaucagaugua

SEQ ID NO: 3237933 - RNA, 17 nt, Mycobacterium leprae
ucgacggagcgcaggaa

SEQ ID NO: 3237934 - RNA, 15 nt, Mycobacterium leprae
ucgacggccgcacag

SEQ ID NO: 3237935 - RNA, 15 nt, Mycobacterium leprae
ucgacggcuggcagc

SEQ ID NO: 3237936 - RNA, 19 nt, Mycobacterium leprae
ucgacgggucacagguaaa

SEQ ID NO: 3237937 - RNA, 21 nt, Mycobacterium leprae
ucgacucgaaacgcgaagcac

SEQ ID NO: 3237938 - RNA, 14 nt, Mycobacterium leprae
ucgacuuccggccc

SEQ ID NO: 3237939 - RNA, 18 nt, Mycobacterium leprae
ucgacuucgcagccaccg

SEQ ID NO: 3237940 - RNA, 20 nt, Mycobacterium leprae
ucgacuucugguugacauuu

SEQ ID NO: 3237941 - RNA, 18 nt, Mycobacterium leprae
ucgagaagggagugcagu

SEQ ID NO: 3237942 - RNA, 21 nt, Mycobacterium leprae
ucgagaagggagugcagugcc

SEQ ID NO: 3237943 - RNA, 19 nt, Mycobacterium leprae
ucgagaaguacgaaaugaa

SEQ ID NO: 3237944 - RNA, 19 nt, Mycobacterium leprae
ucgagaauuuaccggcguu

SEQ ID NO: 3237945 - RNA, 17 nt, Mycobacterium leprae
ucgagauaguccgacca

SEQ ID NO: 3237946 - RNA, 19 nt, Mycobacterium leprae
ucgagaucaacguuuugcc

SEQ ID NO: 3237947 - RNA, 13 nt, Mycobacterium leprae
ucgagcaaaccag

SEQ ID NO: 3237948 - RNA, 17 nt, Mycobacterium leprae
ucgagcgauggcugccg

SEQ ID NO: 3237949 - RNA, 11 nt, Mycobacterium leprae
ucgagcgauug

SEQ ID NO: 3237950 - RNA, 18 nt, Mycobacterium leprae
ucgagcgauugugcggaa

SEQ ID NO: 3237951 - RNA, 14 nt, Mycobacterium leprae
ucgagcuggcugug

SEQ ID NO: 3237952 - RNA, 15 nt, Mycobacterium leprae
ucgagcuggcugugc

SEQ ID NO: 3237953 - RNA, 15 nt, Mycobacterium leprae
ucgaggccagccugc

SEQ ID NO: 3237954 - RNA, 17 nt, Mycobacterium leprae
ucgaguccaagcucaac

SEQ ID NO: 3237955 - RNA, 14 nt, Mycobacterium leprae
ucgagugcagcuaa

SEQ ID NO: 3237956 - RNA, 14 nt, Mycobacterium leprae
ucgaguugguuaau

SEQ ID NO: 3237957 - RNA, 18 nt, Mycobacterium leprae
ucgaguuuggacuuuaau

SEQ ID NO: 3237958 - RNA, 14 nt, Mycobacterium leprae
ucgauaagcagcag

SEQ ID NO: 3237959 - RNA, 16 nt, Mycobacterium leprae
ucgauaagcagcagcg

SEQ ID NO: 3237960 - RNA, 16 nt, Mycobacterium leprae
ucgauaaugccggugg

SEQ ID NO: 3237961 - RNA, 17 nt, Mycobacterium leprae
ucgauacggccaauacc

SEQ ID NO: 3237962 - RNA, 22 nt, Mycobacterium leprae
ucgaucagcuaccagggucggc

SEQ ID NO: 3237963 - RNA, 23 nt, Mycobacterium leprae
ucgaucagcuaccagggucggcc

SEQ ID NO: 3237964 - RNA, 17 nt, Mycobacterium leprae
ucgaucauggauuaccu

SEQ ID NO: 3237965 - RNA, 15 nt, Mycobacterium leprae
ucgauccaaugacua

SEQ ID NO: 3237966 - RNA, 17 nt, Mycobacterium leprae
ucgauccagugccggaa

SEQ ID NO: 3237967 - RNA, 17 nt, Mycobacterium leprae
ucgauccgcucaaagcc

SEQ ID NO: 3237968 - RNA, 18 nt, Mycobacterium leprae
ucgauccgucguaggcug

SEQ ID NO: 3237969 - RNA, 13 nt, Mycobacterium leprae
ucgaucggcagcc

SEQ ID NO: 3237970 - RNA, 14 nt, Mycobacterium leprae
ucgaucggcagcca

SEQ ID NO: 3237971 - RNA, 18 nt, Mycobacterium leprae
ucgaucuggacaaagucu

SEQ ID NO: 3237972 - RNA, 12 nt, Mycobacterium leprae
ucgaugaggcuu

SEQ ID NO: 3237973 - RNA, 22 nt, Mycobacterium leprae
ucgaugauccggccgucggcgg

SEQ ID NO: 3237974 - RNA, 18 nt, Mycobacterium leprae
ucgaugauuggccauugu

SEQ ID NO: 3237975 - RNA, 16 nt, Mycobacterium leprae
ucgaugcaggcguggg

SEQ ID NO: 3237976 - RNA, 20 nt, Mycobacterium leprae
ucgaugcgaaucaugucgaa

SEQ ID NO: 3237977 - RNA, 20 nt, Mycobacterium leprae
ucgauggcgguguuagcaug

SEQ ID NO: 3237978 - RNA, 20 nt, Mycobacterium leprae
ucgauggugucguguuacaa

SEQ ID NO: 3237979 - RNA, 14 nt, Mycobacterium leprae
ucgauucaccgauc

SEQ ID NO: 3237980 - RNA, 23 nt, Mycobacterium leprae
ucgauucaccgaucgacaauguc

SEQ ID NO: 3237981 - RNA, 14 nt, Mycobacterium leprae
ucgauucugcccgg

SEQ ID NO: 3237982 - RNA, 17 nt, Mycobacterium leprae
ucgauuugaaaaaugcc

SEQ ID NO: 3237983 - RNA, 21 nt, Mycobacterium leprae
ucgcacagcaggucgccgacg

SEQ ID NO: 3237984 - RNA, 18 nt, Mycobacterium leprae
ucgcaccgauauccggcc

SEQ ID NO: 3237985 - RNA, 20 nt, Mycobacterium leprae
ucgcacgauccgugaauaca

SEQ ID NO: 3237986 - RNA, 14 nt, Mycobacterium leprae
ucgcacugcguugu

SEQ ID NO: 3237987 - RNA, 14 nt, Mycobacterium leprae
ucgcagacacagcc

SEQ ID NO: 3237988 - RNA, 13 nt, Mycobacterium leprae
ucgcagagcucac

SEQ ID NO: 3237989 - RNA, 19 nt, Mycobacterium leprae
ucgcagccuaggugaucgu

SEQ ID NO: 3237990 - RNA, 20 nt, Mycobacterium leprae
ucgcaggaguaauaacugug

SEQ ID NO: 3237991 - RNA, 22 nt, Mycobacterium leprae
ucgcauccucgacuuccggccc

SEQ ID NO: 3237992 - RNA, 16 nt, Mycobacterium leprae
ucgcaugugauacugc

SEQ ID NO: 3237993 - RNA, 20 nt, Mycobacterium leprae
ucgccaccgaccgccuuguc

SEQ ID NO: 3237994 - RNA, 21 nt, Mycobacterium leprae
ucgccacugaccuauuuuucc

SEQ ID NO: 3237995 - RNA, 17 nt, Mycobacterium leprae
ucgccagugccuucguc

SEQ ID NO: 3237996 - RNA, 20 nt, Mycobacterium leprae
ucgccagugccuucgucaau

SEQ ID NO: 3237997 - RNA, 19 nt, Mycobacterium leprae
ucgcccaacguaucggcga

SEQ ID NO: 3237998 - RNA, 14 nt, Mycobacterium leprae
ucgcccaggugcug

SEQ ID NO: 3237999 - RNA, 13 nt, Mycobacterium leprae
ucgccccaacuac

SEQ ID NO: 3238000 - RNA, 19 nt, Mycobacterium leprae
ucgcccgagucucuggugc

SEQ ID NO: 3238001 - RNA, 22 nt, Mycobacterium leprae
ucgcccgcuuaaccaucagaaa

SEQ ID NO: 3238002 - RNA, 21 nt, Mycobacterium leprae
ucgcccucuuugaucagcaag

SEQ ID NO: 3238003 - RNA, 17 nt, Mycobacterium leprae
ucgccgacgucuucaau

SEQ ID NO: 3238004 - RNA, 18 nt, Mycobacterium leprae
ucgccgagcucaaacgac

SEQ ID NO: 3238005 - RNA, 20 nt, Mycobacterium leprae
ucgccgaugcgcuguugggu

SEQ ID NO: 3238006 - RNA, 17 nt, Mycobacterium leprae
ucgccgcccgcuggauc

SEQ ID NO: 3238007 - RNA, 12 nt, Mycobacterium leprae
ucgccgccggcg

SEQ ID NO: 3238008 - RNA, 19 nt, Mycobacterium leprae
ucgccgcgcaucaucgccc

SEQ ID NO: 3238009 - RNA, 21 nt, Mycobacterium leprae
ucgccgcgccacuguagagcu

SEQ ID NO: 3238010 - RNA, 19 nt, Mycobacterium leprae
ucgccuaaagcggcaagca

SEQ ID NO: 3238011 - RNA, 22 nt, Mycobacterium leprae
ucgccuggucauggcuucguca

SEQ ID NO: 3238012 - RNA, 20 nt, Mycobacterium leprae
ucgcgauccaucagcaccga

SEQ ID NO: 3238013 - RNA, 13 nt, Mycobacterium leprae
ucgcgcaccgcga

SEQ ID NO: 3238014 - RNA, 22 nt, Mycobacterium leprae
ucgcgcagcaaucaaugugcgg

SEQ ID NO: 3238015 - RNA, 17 nt, Mycobacterium leprae
ucgcgccaccgccgguc

SEQ ID NO: 3238016 - RNA, 18 nt, Mycobacterium leprae
ucgcgcuacgauuuugca

SEQ ID NO: 3238017 - RNA, 16 nt, Mycobacterium leprae
ucgcgcugaagccgcu

SEQ ID NO: 3238018 - RNA, 18 nt, Mycobacterium leprae
ucgcggaaguaacgucga

SEQ ID NO: 3238019 - RNA, 20 nt, Mycobacterium leprae
ucgcgggacaacaccacuuc

SEQ ID NO: 3238020 - RNA, 14 nt, Mycobacterium leprae
ucgcgggacgugca

SEQ ID NO: 3238021 - RNA, 20 nt, Mycobacterium leprae
ucgcgggugggucgaugaug

SEQ ID NO: 3238022 - RNA, 19 nt, Mycobacterium leprae
ucgcguagugauggcggaa

SEQ ID NO: 3238023 - RNA, 23 nt, Mycobacterium leprae
ucgcgucgagaaguuaccgacgc

SEQ ID NO: 3238024 - RNA, 18 nt, Mycobacterium leprae
ucgcgucgcaucgguggc

SEQ ID NO: 3238025 - RNA, 12 nt, Mycobacterium leprae
ucgcgucgcgcc

SEQ ID NO: 3238026 - RNA, 16 nt, Mycobacterium leprae
ucgcgucguugcgcug

SEQ ID NO: 3238027 - RNA, 17 nt, Mycobacterium leprae
ucgcgugccagcgcugc

SEQ ID NO: 3238028 - RNA, 13 nt, Mycobacterium leprae
ucgcuagcgauuc

SEQ ID NO: 3238029 - RNA, 18 nt, Mycobacterium leprae
ucgcucgguaagcuggcu

SEQ ID NO: 3238030 - RNA, 13 nt, Mycobacterium leprae
ucgcugaccggug

SEQ ID NO: 3238031 - RNA, 14 nt, Mycobacterium leprae
ucgcugaccggugc

SEQ ID NO: 3238032 - RNA, 14 nt, Mycobacterium leprae
ucgcugcuuccuga

SEQ ID NO: 3238033 - RNA, 15 nt, Mycobacterium leprae
ucgcuggcccugccu

SEQ ID NO: 3238034 - RNA, 18 nt, Mycobacterium leprae
ucgcuggcucugucgucg

SEQ ID NO: 3238035 - RNA, 15 nt, Mycobacterium leprae
ucgcuguauucugca

SEQ ID NO: 3238036 - RNA, 12 nt, Mycobacterium leprae
ucgcuguauuga

SEQ ID NO: 3238037 - RNA, 23 nt, Mycobacterium leprae
ucgcuucgugguuaggucagcug

SEQ ID NO: 3238038 - RNA, 18 nt, Mycobacterium leprae
ucgcuugcuaccaguguc

SEQ ID NO: 3238039 - RNA, 18 nt, Mycobacterium leprae
ucgcuuggugcugcugcu

SEQ ID NO: 3238040 - RNA, 15 nt, Mycobacterium leprae
ucgcuuuccgcgccc

SEQ ID NO: 3238041 - RNA, 19 nt, Mycobacterium leprae
ucggaaacacagcaagcag

SEQ ID NO: 3238042 - RNA, 16 nt, Mycobacterium leprae
ucggaaccgcagcugc

SEQ ID NO: 3238043 - RNA, 22 nt, Mycobacterium leprae
ucggaaccgcagcugcucggcc

SEQ ID NO: 3238044 - RNA, 13 nt, Mycobacterium leprae
ucggaagcguugu

SEQ ID NO: 3238045 - RNA, 15 nt, Mycobacterium leprae
ucggaaucgccgcga

SEQ ID NO: 3238046 - RNA, 20 nt, Mycobacterium leprae
ucggaaucuuugaucugcug

SEQ ID NO: 3238047 - RNA, 15 nt, Mycobacterium leprae
ucggacacgagcggc

SEQ ID NO: 3238048 - RNA, 19 nt, Mycobacterium leprae
ucggacgugguccgaucgc

SEQ ID NO: 3238049 - RNA, 20 nt, Mycobacterium leprae
ucggaguucuucacacgagc

SEQ ID NO: 3238050 - RNA, 13 nt, Mycobacterium leprae
ucggcaacggcgu

SEQ ID NO: 3238051 - RNA, 22 nt, Mycobacterium leprae
ucggcacagugccugaccaucg

SEQ ID NO: 3238052 - RNA, 18 nt, Mycobacterium leprae
ucggcaccaaaggcgcug

SEQ ID NO: 3238053 - RNA, 16 nt, Mycobacterium leprae
ucggcacuucgcugag

SEQ ID NO: 3238054 - RNA, 15 nt, Mycobacterium leprae
ucggcagaucgaucu

SEQ ID NO: 3238055 - RNA, 21 nt, Mycobacterium leprae
ucggcagaugcccuuugcggu

SEQ ID NO: 3238056 - RNA, 14 nt, Mycobacterium leprae
ucggcagccacggu

SEQ ID NO: 3238057 - RNA, 14 nt, Mycobacterium leprae
ucggcauauccgcc

SEQ ID NO: 3238058 - RNA, 15 nt, Mycobacterium leprae
ucggcauauccgccc

SEQ ID NO: 3238059 - RNA, 14 nt, Mycobacterium leprae
ucggcaucugcuac

SEQ ID NO: 3238060 - RNA, 22 nt, Mycobacterium leprae
ucggcaugacuguguacgaagc

SEQ ID NO: 3238061 - RNA, 18 nt, Mycobacterium leprae
ucggcauugccggggcug

SEQ ID NO: 3238062 - RNA, 15 nt, Mycobacterium leprae
ucggccaggugugcc

SEQ ID NO: 3238063 - RNA, 19 nt, Mycobacterium leprae
ucggccaguaccuccagcc

SEQ ID NO: 3238064 - RNA, 23 nt, Mycobacterium leprae
ucggccgaggcgcaaagucgacg

SEQ ID NO: 3238065 - RNA, 21 nt, Mycobacterium leprae
ucggccguggcuuccucgaca

SEQ ID NO: 3238066 - RNA, 15 nt, Mycobacterium leprae
ucggcgacacagagc

SEQ ID NO: 3238067 - RNA, 20 nt, Mycobacterium leprae
ucggcgauauccgccggccg

SEQ ID NO: 3238068 - RNA, 19 nt, Mycobacterium leprae
ucggcgcgacugcaguguc

SEQ ID NO: 3238069 - RNA, 22 nt, Mycobacterium leprae
ucggcggcggagcgcaccgcgg

SEQ ID NO: 3238070 - RNA, 14 nt, Mycobacterium leprae
ucggcggcuuguuu

SEQ ID NO: 3238071 - RNA, 21 nt, Mycobacterium leprae
ucggcggcuuguuuguugcca

SEQ ID NO: 3238072 - RNA, 14 nt, Mycobacterium leprae
ucggcgguucacau

SEQ ID NO: 3238073 - RNA, 21 nt, Mycobacterium leprae
ucggcguacguaugccgccaa

SEQ ID NO: 3238074 - RNA, 14 nt, Mycobacterium leprae
ucggcgucgguggc

SEQ ID NO: 3238075 - RNA, 23 nt, Mycobacterium leprae
ucggcgucgugaucggcauggcg

SEQ ID NO: 3238076 - RNA, 20 nt, Mycobacterium leprae
ucggcguggucaauguggcc

SEQ ID NO: 3238077 - RNA, 17 nt, Mycobacterium leprae
ucggcguugagcgcagc

SEQ ID NO: 3238078 - RNA, 22 nt, Mycobacterium leprae
ucggcuacugcgacagcagcca

SEQ ID NO: 3238079 - RNA, 19 nt, Mycobacterium leprae
ucggcuagccgugcagccu

SEQ ID NO: 3238080 - RNA, 17 nt, Mycobacterium leprae
ucggcugaaccgcugug

SEQ ID NO: 3238081 - RNA, 16 nt, Mycobacterium leprae
ucggcugucgcggaau

SEQ ID NO: 3238082 - RNA, 15 nt, Mycobacterium leprae
ucggcuugccgauau

SEQ ID NO: 3238083 - RNA, 19 nt, Mycobacterium leprae
ucgggaccuaccgcaucgg

SEQ ID NO: 3238084 - RNA, 18 nt, Mycobacterium leprae
ucgggccguuauccacag

SEQ ID NO: 3238085 - RNA, 20 nt, Mycobacterium leprae
ucgggccguuauccacagca

SEQ ID NO: 3238086 - RNA, 19 nt, Mycobacterium leprae
ucgggccucgccguugcua

SEQ ID NO: 3238087 - RNA, 20 nt, Mycobacterium leprae
ucgggugcucacaggcagca

SEQ ID NO: 3238088 - RNA, 23 nt, Mycobacterium leprae
ucggguuuuagauugacaccgcc

SEQ ID NO: 3238089 - RNA, 16 nt, Mycobacterium leprae
ucgguaacgcugacca

SEQ ID NO: 3238090 - RNA, 19 nt, Mycobacterium leprae
ucgguaacgcugaccagca

SEQ ID NO: 3238091 - RNA, 19 nt, Mycobacterium leprae
ucgguaagcuggcucgguc

SEQ ID NO: 3238092 - RNA, 15 nt, Mycobacterium leprae
ucgguaccagcggca

SEQ ID NO: 3238093 - RNA, 17 nt, Mycobacterium leprae
ucgguaggcuguuguca

SEQ ID NO: 3238094 - RNA, 21 nt, Mycobacterium leprae
ucgguaucggcauauccgccc

SEQ ID NO: 3238095 - RNA, 18 nt, Mycobacterium leprae
ucgguaucgucaaauuuu

SEQ ID NO: 3238096 - RNA, 22 nt, Mycobacterium leprae
ucggucaccccgagcucggccu

SEQ ID NO: 3238097 - RNA, 18 nt, Mycobacterium leprae
ucggucgcauugccaacg

SEQ ID NO: 3238098 - RNA, 14 nt, Mycobacterium leprae
ucggucugcucggc

SEQ ID NO: 3238099 - RNA, 17 nt, Mycobacterium leprae
ucggucugcucggcgaa

SEQ ID NO: 3238100 - RNA, 12 nt, Mycobacterium leprae
ucggucuugucc

SEQ ID NO: 3238101 - RNA, 13 nt, Mycobacterium leprae
ucggugccgccau

SEQ ID NO: 3238102 - RNA, 16 nt, Mycobacterium leprae
ucgguggcagccggcu

SEQ ID NO: 3238103 - RNA, 21 nt, Mycobacterium leprae
ucgguggugggugcugcuugg

SEQ ID NO: 3238104 - RNA, 17 nt, Mycobacterium leprae
ucgguguucgcuccgcc

SEQ ID NO: 3238105 - RNA, 21 nt, Mycobacterium leprae
ucgguguugaucgaccgcuga

SEQ ID NO: 3238106 - RNA, 22 nt, Mycobacterium leprae
ucgguucgacauacaggacgau

SEQ ID NO: 3238107 - RNA, 20 nt, Mycobacterium leprae
ucgguuguuguggugugcgc

SEQ ID NO: 3238108 - RNA, 14 nt, Mycobacterium leprae
ucgguuuccucauu

SEQ ID NO: 3238109 - RNA, 18 nt, Mycobacterium leprae
ucguacucguauuccucg

SEQ ID NO: 3238110 - RNA, 14 nt, Mycobacterium leprae
ucguagcgcccagu

SEQ ID NO: 3238111 - RNA, 15 nt, Mycobacterium leprae
ucgucagauccggcc

SEQ ID NO: 3238112 - RNA, 21 nt, Mycobacterium leprae
ucgucagauccggccguugag

SEQ ID NO: 3238113 - RNA, 14 nt, Mycobacterium leprae
ucgucaucgacgau

SEQ ID NO: 3238114 - RNA, 10 nt, Mycobacterium leprae
ucgucgacga

SEQ ID NO: 3238115 - RNA, 15 nt, Mycobacterium leprae
ucgucgacuauaucc

SEQ ID NO: 3238116 - RNA, 18 nt, Mycobacterium leprae
ucgucgaguaugucguca

SEQ ID NO: 3238117 - RNA, 15 nt, Mycobacterium leprae
ucgucggaagcugcc

SEQ ID NO: 3238118 - RNA, 15 nt, Mycobacterium leprae
ucgucggccagcacu

SEQ ID NO: 3238119 - RNA, 16 nt, Mycobacterium leprae
ucgucggccagcacuu

SEQ ID NO: 3238120 - RNA, 13 nt, Mycobacterium leprae
ucgucggcgguuc

SEQ ID NO: 3238121 - RNA, 17 nt, Mycobacterium leprae
ucgucgggugcgcagca

SEQ ID NO: 3238122 - RNA, 19 nt, Mycobacterium leprae
ucgucgugcugaucaccgg

SEQ ID NO: 3238123 - RNA, 21 nt, Mycobacterium leprae
ucgugaaucaugccgcagcau

SEQ ID NO: 3238124 - RNA, 20 nt, Mycobacterium leprae
ucgugaggugugaccgugca

SEQ ID NO: 3238125 - RNA, 20 nt, Mycobacterium leprae
ucgugcaggcgcucaauguc

SEQ ID NO: 3238126 - RNA, 20 nt, Mycobacterium leprae
ucgugcggucaaaggcuguc

SEQ ID NO: 3238127 - RNA, 21 nt, Mycobacterium leprae
ucgugcguuguugaugguguc

SEQ ID NO: 3238128 - RNA, 22 nt, Mycobacterium leprae
ucgugcguuguugauggugucg

SEQ ID NO: 3238129 - RNA, 17 nt, Mycobacterium leprae
ucgugcugaucaccggc

SEQ ID NO: 3238130 - RNA, 14 nt, Mycobacterium leprae
ucgugcugcgugcc

SEQ ID NO: 3238131 - RNA, 19 nt, Mycobacterium leprae
ucgugcuguugucagcaga

SEQ ID NO: 3238132 - RNA, 23 nt, Mycobacterium leprae
ucgugcuguugucagcagaccac

SEQ ID NO: 3238133 - RNA, 13 nt, Mycobacterium leprae
ucguggagcaccu

SEQ ID NO: 3238134 - RNA, 14 nt, Mycobacterium leprae
ucguggagcaccuc

SEQ ID NO: 3238135 - RNA, 19 nt, Mycobacterium leprae
ucguggcaagcgcgugauc

SEQ ID NO: 3238136 - RNA, 17 nt, Mycobacterium leprae
ucguggcagaggcugca

SEQ ID NO: 3238137 - RNA, 14 nt, Mycobacterium leprae
ucgugguggcuggc

SEQ ID NO: 3238138 - RNA, 15 nt, Mycobacterium leprae
ucguggugugcaucc

SEQ ID NO: 3238139 - RNA, 22 nt, Mycobacterium leprae
ucguguagcuagaccgaaucgu

SEQ ID NO: 3238140 - RNA, 13 nt, Mycobacterium leprae
ucguuaaccguuc

SEQ ID NO: 3238141 - RNA, 20 nt, Mycobacterium leprae
ucguucaguuugguccaggc

SEQ ID NO: 3238142 - RNA, 11 nt, Mycobacterium leprae
ucguugacgcc

SEQ ID NO: 3238143 - RNA, 22 nt, Mycobacterium leprae
ucguugucggcuccuccagcau

SEQ ID NO: 3238144 - RNA, 15 nt, Mycobacterium leprae
ucguugucggucgac

SEQ ID NO: 3238145 - RNA, 20 nt, Mycobacterium leprae
ucguuguuugucagauaacg

SEQ ID NO: 3238146 - RNA, 19 nt, Mycobacterium leprae
ucguuucucauucucugcc

SEQ ID NO: 3238147 - RNA, 18 nt, Mycobacterium leprae
ucguuuggguuggguggg

SEQ ID NO: 3238148 - RNA, 22 nt, Mycobacterium leprae
ucguuuggguugggugggggug

SEQ ID NO: 3238149 - RNA, 15 nt, Mycobacterium leprae
ucuaccagcacccgc

SEQ ID NO: 3238150 - RNA, 18 nt, Mycobacterium leprae
ucuaccuguugaauauac

SEQ ID NO: 3238151 - RNA, 18 nt, Mycobacterium leprae
ucuacggucaggugucug

SEQ ID NO: 3238152 - RNA, 13 nt, Mycobacterium leprae
ucuagauaacuau

SEQ ID NO: 3238153 - RNA, 20 nt, Mycobacterium leprae
ucuagauaagauaaauagua

SEQ ID NO: 3238154 - RNA, 14 nt, Mycobacterium leprae
ucuagcauuccucg

SEQ ID NO: 3238155 - RNA, 15 nt, Mycobacterium leprae
ucuagccaagcuccc

SEQ ID NO: 3238156 - RNA, 16 nt, Mycobacterium leprae
ucuagccucggucaua

SEQ ID NO: 3238157 - RNA, 20 nt, Mycobacterium leprae
ucucaacacccaagugacug

SEQ ID NO: 3238158 - RNA, 14 nt, Mycobacterium leprae
ucucaaugaccgca

SEQ ID NO: 3238159 - RNA, 18 nt, Mycobacterium leprae
ucucaccaauagccgacc

SEQ ID NO: 3238160 - RNA, 14 nt, Mycobacterium leprae
ucucacgcccgacg

SEQ ID NO: 3238161 - RNA, 20 nt, Mycobacterium leprae
ucucagccaggagaagcgcu

SEQ ID NO: 3238162 - RNA, 15 nt, Mycobacterium leprae
ucucagcuccgaagc

SEQ ID NO: 3238163 - RNA, 20 nt, Mycobacterium leprae
ucucagcuccgaagcagcca

SEQ ID NO: 3238164 - RNA, 15 nt, Mycobacterium leprae
ucucauucucugccu

SEQ ID NO: 3238165 - RNA, 19 nt, Mycobacterium leprae
ucuccaccagccggccggg

SEQ ID NO: 3238166 - RNA, 16 nt, Mycobacterium leprae
ucuccagucgcauccu

SEQ ID NO: 3238167 - RNA, 14 nt, Mycobacterium leprae
ucucccaauccugg

SEQ ID NO: 3238168 - RNA, 13 nt, Mycobacterium leprae
ucucccgccacuc

SEQ ID NO: 3238169 - RNA, 22 nt, Mycobacterium leprae
ucucccgccacucggcagagcg

SEQ ID NO: 3238170 - RNA, 23 nt, Mycobacterium leprae
ucuccgcaacgggacaagucaaa

SEQ ID NO: 3238171 - RNA, 18 nt, Mycobacterium leprae
ucuccgugaugaacuucg

SEQ ID NO: 3238172 - RNA, 13 nt, Mycobacterium leprae
ucuccuggucucc

SEQ ID NO: 3238173 - RNA, 20 nt, Mycobacterium leprae
ucucgacaaccucuagccaa

SEQ ID NO: 3238174 - RNA, 22 nt, Mycobacterium leprae
ucucgcauauucagaauucuau

SEQ ID NO: 3238175 - RNA, 16 nt, Mycobacterium leprae
ucucgccgccuucucc

SEQ ID NO: 3238176 - RNA, 19 nt, Mycobacterium leprae
ucucgccuucgauacggca

SEQ ID NO: 3238177 - RNA, 23 nt, Mycobacterium leprae
ucucgcgucgugcguuguugaug

SEQ ID NO: 3238178 - RNA, 23 nt, Mycobacterium leprae
ucucggugucggacuugucgucg

SEQ ID NO: 3238179 - RNA, 23 nt, Mycobacterium leprae
ucucgugaaacgagauugccgac

SEQ ID NO: 3238180 - RNA, 14 nt, Mycobacterium leprae
ucucgugguggcug

SEQ ID NO: 3238181 - RNA, 18 nt, Mycobacterium leprae
ucucgugguggcuggcua

SEQ ID NO: 3238182 - RNA, 13 nt, Mycobacterium leprae
ucucuaaaagaau

SEQ ID NO: 3238183 - RNA, 17 nt, Mycobacterium leprae
ucucucaggccgucguu

SEQ ID NO: 3238184 - RNA, 19 nt, Mycobacterium leprae
ucucuggugcgccaacacu

SEQ ID NO: 3238185 - RNA, 22 nt, Mycobacterium leprae
ucugacguuguuuuuguuggcc

SEQ ID NO: 3238186 - RNA, 21 nt, Mycobacterium leprae
ucugaggucaccggccaccgg

SEQ ID NO: 3238187 - RNA, 16 nt, Mycobacterium leprae
ucugcacccgccaggg

SEQ ID NO: 3238188 - RNA, 11 nt, Mycobacterium leprae
ucugcacggca

SEQ ID NO: 3238189 - RNA, 17 nt, Mycobacterium leprae
ucugccaugccaguuca

SEQ ID NO: 3238190 - RNA, 13 nt, Mycobacterium leprae
ucugcccuugccc

SEQ ID NO: 3238191 - RNA, 14 nt, Mycobacterium leprae
ucugcgaacacuga

SEQ ID NO: 3238192 - RNA, 14 nt, Mycobacterium leprae
ucugcgaacagccg

SEQ ID NO: 3238193 - RNA, 14 nt, Mycobacterium leprae
ucugcgcuggccac

SEQ ID NO: 3238194 - RNA, 21 nt, Mycobacterium leprae
ucugcggcguagguuggcgac

SEQ ID NO: 3238195 - RNA, 13 nt, Mycobacterium leprae
ucugcugaucaga

SEQ ID NO: 3238196 - RNA, 17 nt, Mycobacterium leprae
ucugcuuguggcggagc

SEQ ID NO: 3238197 - RNA, 18 nt, Mycobacterium leprae
ucuggauggccgccagca

SEQ ID NO: 3238198 - RNA, 23 nt, Mycobacterium leprae
ucuggauuucagggcacacagca

SEQ ID NO: 3238199 - RNA, 15 nt, Mycobacterium leprae
ucuggguagaccgcc

SEQ ID NO: 3238200 - RNA, 20 nt, Mycobacterium leprae
ucugggugguguggcccgac

SEQ ID NO: 3238201 - RNA, 21 nt, Mycobacterium leprae
ucugguaacggaccuggcaaa

SEQ ID NO: 3238202 - RNA, 21 nt, Mycobacterium leprae
ucuggugcgccaacacuagcg

SEQ ID NO: 3238203 - RNA, 15 nt, Mycobacterium leprae
ucugguugcacggca

SEQ ID NO: 3238204 - RNA, 13 nt, Mycobacterium leprae
ucuguaggcacaa

SEQ ID NO: 3238205 - RNA, 16 nt, Mycobacterium leprae
ucuguaguagcccaca

SEQ ID NO: 3238206 - RNA, 23 nt, Mycobacterium leprae
ucuguauggcuccaaguggcugc

SEQ ID NO: 3238207 - RNA, 18 nt, Mycobacterium leprae
ucuguccagaaggggcug

SEQ ID NO: 3238208 - RNA, 13 nt, Mycobacterium leprae
ucuguccgcacaa

SEQ ID NO: 3238209 - RNA, 15 nt, Mycobacterium leprae
ucugucgcgucgaca

SEQ ID NO: 3238210 - RNA, 12 nt, Mycobacterium leprae
ucugucgucgaa

SEQ ID NO: 3238211 - RNA, 21 nt, Mycobacterium leprae
ucuuagcaacguguaaggcca

SEQ ID NO: 3238212 - RNA, 14 nt, Mycobacterium leprae
ucuucaauccgcgc

SEQ ID NO: 3238213 - RNA, 17 nt, Mycobacterium leprae
ucuuccgccgcuacacu

SEQ ID NO: 3238214 - RNA, 17 nt, Mycobacterium leprae
ucuuccuacggcuucca

SEQ ID NO: 3238215 - RNA, 23 nt, Mycobacterium leprae
ucuuccuacggcuuccaaguuga

SEQ ID NO: 3238216 - RNA, 23 nt, Mycobacterium leprae
ucuuccuguagaugaguugugca

SEQ ID NO: 3238217 - RNA, 14 nt, Mycobacterium leprae
ucuucgaugcucug

SEQ ID NO: 3238218 - RNA, 19 nt, Mycobacterium leprae
ucuucgcagccuaggugau

SEQ ID NO: 3238219 - RNA, 14 nt, Mycobacterium leprae
ucuucgccuuguca

SEQ ID NO: 3238220 - RNA, 12 nt, Mycobacterium leprae
ucuucucuaaaa

SEQ ID NO: 3238221 - RNA, 13 nt, Mycobacterium leprae
ucuucucuaaaaa

SEQ ID NO: 3238222 - RNA, 19 nt, Mycobacterium leprae
ucuugaaauucaauacuuu

SEQ ID NO: 3238223 - RNA, 16 nt, Mycobacterium leprae
ucuugaugccaaccug

SEQ ID NO: 3238224 - RNA, 13 nt, Mycobacterium leprae
ucuugccaagguc

SEQ ID NO: 3238225 - RNA, 17 nt, Mycobacterium leprae
ucuuggggacgccggcg

SEQ ID NO: 3238226 - RNA, 14 nt, Mycobacterium leprae
ucuuggugaugucg

SEQ ID NO: 3238227 - RNA, 23 nt, Mycobacterium leprae
ucuuguaguagcaggucgaggac

SEQ ID NO: 3238228 - RNA, 17 nt, Mycobacterium leprae
ucuuugccuucgugaug

SEQ ID NO: 3238229 - RNA, 23 nt, Mycobacterium leprae
ucuuuuuagagaagaauuaauau

SEQ ID NO: 3238230 - RNA, 20 nt, Mycobacterium leprae
ugaaaacagcgccucaccaa

SEQ ID NO: 3238231 - RNA, 22 nt, Mycobacterium leprae
ugaaaaccguguagugcacaga

SEQ ID NO: 3238232 - RNA, 23 nt, Mycobacterium leprae
ugaaaacgguuagucagagugac

SEQ ID NO: 3238233 - RNA, 19 nt, Mycobacterium leprae
ugaaaccgggguacaauaa

SEQ ID NO: 3238234 - RNA, 15 nt, Mycobacterium leprae
ugaacacgcugaucg

SEQ ID NO: 3238235 - RNA, 14 nt, Mycobacterium leprae
ugaacaggcgccug

SEQ ID NO: 3238236 - RNA, 22 nt, Mycobacterium leprae
ugaaccgcugugacagcgugcc

SEQ ID NO: 3238237 - RNA, 21 nt, Mycobacterium leprae
ugaaccuauugucagguggcu

SEQ ID NO: 3238238 - RNA, 22 nt, Mycobacterium leprae
ugaacgaucgggauguccuucg

SEQ ID NO: 3238239 - RNA, 22 nt, Mycobacterium leprae
ugaacgcguugcucgacgcgga

SEQ ID NO: 3238240 - RNA, 16 nt, Mycobacterium leprae
ugaacguuuuuucccg

SEQ ID NO: 3238241 - RNA, 19 nt, Mycobacterium leprae
ugaacugcgguauccaucc

SEQ ID NO: 3238242 - RNA, 17 nt, Mycobacterium leprae
ugaacuggaucggucag

SEQ ID NO: 3238243 - RNA, 21 nt, Mycobacterium leprae
ugaacuugauuucaaggaauu

SEQ ID NO: 3238244 - RNA, 19 nt, Mycobacterium leprae
ugaagauccuauccggaaa

SEQ ID NO: 3238245 - RNA, 19 nt, Mycobacterium leprae
ugaagggccggguaaguuc

SEQ ID NO: 3238246 - RNA, 21 nt, Mycobacterium leprae
ugaauagcuaaagugcugcug

SEQ ID NO: 3238247 - RNA, 23 nt, Mycobacterium leprae
ugaauagucggcaaugcucucac

SEQ ID NO: 3238248 - RNA, 17 nt, Mycobacterium leprae
ugaaucaugccgcagca

SEQ ID NO: 3238249 - RNA, 18 nt, Mycobacterium leprae
ugaauccccgauccagac

SEQ ID NO: 3238250 - RNA, 23 nt, Mycobacterium leprae
ugaauguccauauagcgucccag

SEQ ID NO: 3238251 - RNA, 19 nt, Mycobacterium leprae
ugaauucagccgugcccaa

SEQ ID NO: 3238252 - RNA, 14 nt, Mycobacterium leprae
ugacaaaagugcag

SEQ ID NO: 3238253 - RNA, 20 nt, Mycobacterium leprae
ugacaaagcccacgccuagc

SEQ ID NO: 3238254 - RNA, 12 nt, Mycobacterium leprae
ugacaacgccgc

SEQ ID NO: 3238255 - RNA, 19 nt, Mycobacterium leprae
ugacaagagugaaaguagg

SEQ ID NO: 3238256 - RNA, 17 nt, Mycobacterium leprae
ugacaaucgacucacca

SEQ ID NO: 3238257 - RNA, 12 nt, Mycobacterium leprae
ugacaccgccgg

SEQ ID NO: 3238258 - RNA, 22 nt, Mycobacterium leprae
ugacaggcgcguuugucggcgu

SEQ ID NO: 3238259 - RNA, 14 nt, Mycobacterium leprae
ugacaucgacccgu

SEQ ID NO: 3238260 - RNA, 17 nt, Mycobacterium leprae
ugacauuuucaccgaac

SEQ ID NO: 3238261 - RNA, 14 nt, Mycobacterium leprae
ugaccacgccgaca

SEQ ID NO: 3238262 - RNA, 16 nt, Mycobacterium leprae
ugaccacucgcgacga

SEQ ID NO: 3238263 - RNA, 17 nt, Mycobacterium leprae
ugaccagggaagugacg

SEQ ID NO: 3238264 - RNA, 14 nt, Mycobacterium leprae
ugaccagggucauu

SEQ ID NO: 3238265 - RNA, 22 nt, Mycobacterium leprae
ugaccagucuuccguacgccgc

SEQ ID NO: 3238266 - RNA, 22 nt, Mycobacterium leprae
ugaccauugaacuacgugugcu

SEQ ID NO: 3238267 - RNA, 22 nt, Mycobacterium leprae
ugacccaagcgccagcucagga

SEQ ID NO: 3238268 - RNA, 19 nt, Mycobacterium leprae
ugacccaauccaagaccac

SEQ ID NO: 3238269 - RNA, 13 nt, Mycobacterium leprae
ugacccaguaccg

SEQ ID NO: 3238270 - RNA, 22 nt, Mycobacterium leprae
ugaccgacggcgccgcacagcg

SEQ ID NO: 3238271 - RNA, 19 nt, Mycobacterium leprae
ugaccgacucaccgguaca

SEQ ID NO: 3238272 - RNA, 19 nt, Mycobacterium leprae
ugaccgcaccgaucugccc

SEQ ID NO: 3238273 - RNA, 14 nt, Mycobacterium leprae
ugaccgcaucaccg

SEQ ID NO: 3238274 - RNA, 16 nt, Mycobacterium leprae
ugaccgcccuggaccg

SEQ ID NO: 3238275 - RNA, 22 nt, Mycobacterium leprae
ugaccgccgccauccuugccga

SEQ ID NO: 3238276 - RNA, 16 nt, Mycobacterium leprae
ugaccgcggauuccag

SEQ ID NO: 3238277 - RNA, 15 nt, Mycobacterium leprae
ugaccgcggugcagu

SEQ ID NO: 3238278 - RNA, 20 nt, Mycobacterium leprae
ugaccggacgauuugcgauc

SEQ ID NO: 3238279 - RNA, 20 nt, Mycobacterium leprae
ugaccggccaaaauggcacg

SEQ ID NO: 3238280 - RNA, 19 nt, Mycobacterium leprae
ugaccgugcuacgccaggg

SEQ ID NO: 3238281 - RNA, 21 nt, Mycobacterium leprae
ugaccucgaacuuguucuuug

SEQ ID NO: 3238282 - RNA, 22 nt, Mycobacterium leprae
ugaccucgaacuuguucuuugc

SEQ ID NO: 3238283 - RNA, 15 nt, Mycobacterium leprae
ugaccucgccgucgc

SEQ ID NO: 3238284 - RNA, 14 nt, Mycobacterium leprae
ugaccucuucaggc

SEQ ID NO: 3238285 - RNA, 14 nt, Mycobacterium leprae
ugacgaaacggcgu

SEQ ID NO: 3238286 - RNA, 20 nt, Mycobacterium leprae
ugacgacauugugggccgcu

SEQ ID NO: 3238287 - RNA, 21 nt, Mycobacterium leprae
ugacgacauugugggccgcua

SEQ ID NO: 3238288 - RNA, 19 nt, Mycobacterium leprae
ugacgacuucuucugccug

SEQ ID NO: 3238289 - RNA, 14 nt, Mycobacterium leprae
ugacgcaugacacc

SEQ ID NO: 3238290 - RNA, 23 nt, Mycobacterium leprae
ugacgccaauuuagcaaugccac

SEQ ID NO: 3238291 - RNA, 15 nt, Mycobacterium leprae
ugacgcgacgccggc

SEQ ID NO: 3238292 - RNA, 15 nt, Mycobacterium leprae
ugacggcacagugcu

SEQ ID NO: 3238293 - RNA, 20 nt, Mycobacterium leprae
ugacggcggcagcuggaaag

SEQ ID NO: 3238294 - RNA, 17 nt, Mycobacterium leprae
ugacgucuucuauacuu

SEQ ID NO: 3238295 - RNA, 17 nt, Mycobacterium leprae
ugacguguuuugcugug

SEQ ID NO: 3238296 - RNA, 20 nt, Mycobacterium leprae
ugacguguuuugcuguguug

SEQ ID NO: 3238297 - RNA, 21 nt, Mycobacterium leprae
ugacguguuuugcuguguugc

SEQ ID NO: 3238298 - RNA, 15 nt, Mycobacterium leprae
ugacuaguccggaaa

SEQ ID NO: 3238299 - RNA, 15 nt, Mycobacterium leprae
ugacucgacauagaa

SEQ ID NO: 3238300 - RNA, 20 nt, Mycobacterium leprae
ugacucgccggcgucaaagu

SEQ ID NO: 3238301 - RNA, 15 nt, Mycobacterium leprae
ugacucugaccgaca

SEQ ID NO: 3238302 - RNA, 19 nt, Mycobacterium leprae
ugacugccugcuuucgaug

SEQ ID NO: 3238303 - RNA, 15 nt, Mycobacterium leprae
ugacugcguuucaug

SEQ ID NO: 3238304 - RNA, 22 nt, Mycobacterium leprae
ugagaacucaauaguguguuug

SEQ ID NO: 3238305 - RNA, 19 nt, Mycobacterium leprae
ugagacauuucgacaggcu

SEQ ID NO: 3238306 - RNA, 22 nt, Mycobacterium leprae
ugagacauuucgacaggcuguc

SEQ ID NO: 3238307 - RNA, 17 nt, Mycobacterium leprae
ugagaccgguccaccug

SEQ ID NO: 3238308 - RNA, 13 nt, Mycobacterium leprae
ugagaugccagcc

SEQ ID NO: 3238309 - RNA, 15 nt, Mycobacterium leprae
ugagcaauuucuucu

SEQ ID NO: 3238310 - RNA, 15 nt, Mycobacterium leprae
ugagcacacgcugcg

SEQ ID NO: 3238311 - RNA, 18 nt, Mycobacterium leprae
ugagcacgccaaucgccu

SEQ ID NO: 3238312 - RNA, 13 nt, Mycobacterium leprae
ugagccuggcacc

SEQ ID NO: 3238313 - RNA, 14 nt, Mycobacterium leprae
ugagccuggcaccg

SEQ ID NO: 3238314 - RNA, 23 nt, Mycobacterium leprae
ugagcgcgaacagaucuucccua

SEQ ID NO: 3238315 - RNA, 14 nt, Mycobacterium leprae
ugagcggcagagcc

SEQ ID NO: 3238316 - RNA, 15 nt, Mycobacterium leprae
ugagcggccaucucu

SEQ ID NO: 3238317 - RNA, 17 nt, Mycobacterium leprae
ugagcgggccagcacca

SEQ ID NO: 3238318 - RNA, 23 nt, Mycobacterium leprae
ugagcgguucaucgacaggaaac

SEQ ID NO: 3238319 - RNA, 13 nt, Mycobacterium leprae
ugagcguggcugc

SEQ ID NO: 3238320 - RNA, 16 nt, Mycobacterium leprae
ugagcuuacggacuga

SEQ ID NO: 3238321 - RNA, 20 nt, Mycobacterium leprae
ugaggaacgacuugaccagc

SEQ ID NO: 3238322 - RNA, 22 nt, Mycobacterium leprae
ugaggaauucgaaucgguaccg

SEQ ID NO: 3238323 - RNA, 20 nt, Mycobacterium leprae
ugaggcggccggcacugaga

SEQ ID NO: 3238324 - RNA, 18 nt, Mycobacterium leprae
ugaggcgggucagcggcu

SEQ ID NO: 3238325 - RNA, 13 nt, Mycobacterium leprae
ugaggcucgugca

SEQ ID NO: 3238326 - RNA, 16 nt, Mycobacterium leprae
ugaggcucgugcacug

SEQ ID NO: 3238327 - RNA, 21 nt, Mycobacterium leprae
ugaggcuucuuacggcuuugc

SEQ ID NO: 3238328 - RNA, 20 nt, Mycobacterium leprae
ugaggguguuggucuguuug

SEQ ID NO: 3238329 - RNA, 15 nt, Mycobacterium leprae
ugagguguugggagc

SEQ ID NO: 3238330 - RNA, 21 nt, Mycobacterium leprae
ugagguuacuaucugcgugcc

SEQ ID NO: 3238331 - RNA, 13 nt, Mycobacterium leprae
ugagucuucgauc

SEQ ID NO: 3238332 - RNA, 17 nt, Mycobacterium leprae
ugagugaucugcucggc

SEQ ID NO: 3238333 - RNA, 15 nt, Mycobacterium leprae
ugaguugaugugauc

SEQ ID NO: 3238334 - RNA, 19 nt, Mycobacterium leprae
ugaguuuugaacuuucggc

SEQ ID NO: 3238335 - RNA, 13 nt, Mycobacterium leprae
ugauaacuaggcu

SEQ ID NO: 3238336 - RNA, 18 nt, Mycobacterium leprae
ugauaaggucuggcaccg

SEQ ID NO: 3238337 - RNA, 22 nt, Mycobacterium leprae
ugauaauuuggcgccagaccaa

SEQ ID NO: 3238338 - RNA, 14 nt, Mycobacterium leprae
ugauaauuuggcug

SEQ ID NO: 3238339 - RNA, 15 nt, Mycobacterium leprae
ugauacgugccggcc

SEQ ID NO: 3238340 - RNA, 20 nt, Mycobacterium leprae
ugauagccguaguaagucga

SEQ ID NO: 3238341 - RNA, 23 nt, Mycobacterium leprae
ugauauuaauggagaugccaacg

SEQ ID NO: 3238342 - RNA, 16 nt, Mycobacterium leprae
ugauauucaagucaca

SEQ ID NO: 3238343 - RNA, 13 nt, Mycobacterium leprae
ugaucaccaucgu

SEQ ID NO: 3238344 - RNA, 16 nt, Mycobacterium leprae
ugaucacccgcgguag

SEQ ID NO: 3238345 - RNA, 17 nt, Mycobacterium leprae
ugaucaccggccagccu

SEQ ID NO: 3238346 - RNA, 14 nt, Mycobacterium leprae
ugaucagacggcga

SEQ ID NO: 3238347 - RNA, 18 nt, Mycobacterium leprae
ugaucaggaugauuucgc

SEQ ID NO: 3238348 - RNA, 19 nt, Mycobacterium leprae
ugauccagccgaacaaacc

SEQ ID NO: 3238349 - RNA, 14 nt, Mycobacterium leprae
ugauccuucuuuuc

SEQ ID NO: 3238350 - RNA, 16 nt, Mycobacterium leprae
ugauccuucuuuucga

SEQ ID NO: 3238351 - RNA, 21 nt, Mycobacterium leprae
ugaucgacaucgugugguguu

SEQ ID NO: 3238352 - RNA, 15 nt, Mycobacterium leprae
ugaucgacggcuggc

SEQ ID NO: 3238353 - RNA, 19 nt, Mycobacterium leprae
ugaucgagaagggagugca

SEQ ID NO: 3238354 - RNA, 18 nt, Mycobacterium leprae
ugaucgggcccagcaccc

SEQ ID NO: 3238355 - RNA, 16 nt, Mycobacterium leprae
ugaucggugacuuggc

SEQ ID NO: 3238356 - RNA, 21 nt, Mycobacterium leprae
ugaucguuaccgacaccgccg

SEQ ID NO: 3238357 - RNA, 22 nt, Mycobacterium leprae
ugaucguuaccgacaccgccga

SEQ ID NO: 3238358 - RNA, 13 nt, Mycobacterium leprae
ugaugacccguag

SEQ ID NO: 3238359 - RNA, 15 nt, Mycobacterium leprae
ugaugcacgcgcgcc

SEQ ID NO: 3238360 - RNA, 20 nt, Mycobacterium leprae
ugaugcacgcgcgccugggu

SEQ ID NO: 3238361 - RNA, 18 nt, Mycobacterium leprae
ugaugccaggggcugggc

SEQ ID NO: 3238362 - RNA, 15 nt, Mycobacterium leprae
ugaugccgaagcaga

SEQ ID NO: 3238363 - RNA, 21 nt, Mycobacterium leprae
ugaugccgaagcagacugagu

SEQ ID NO: 3238364 - RNA, 22 nt, Mycobacterium leprae
ugaugccgugguagucagcaca

SEQ ID NO: 3238365 - RNA, 22 nt, Mycobacterium leprae
ugaugcggacgacgcugagagg

SEQ ID NO: 3238366 - RNA, 19 nt, Mycobacterium leprae
ugaugcuguggugugcguu

SEQ ID NO: 3238367 - RNA, 14 nt, Mycobacterium leprae
ugauggcgcguggu

SEQ ID NO: 3238368 - RNA, 16 nt, Mycobacterium leprae
ugaugguccuggcugc

SEQ ID NO: 3238369 - RNA, 18 nt, Mycobacterium leprae
ugaugguguagcugagcc

SEQ ID NO: 3238370 - RNA, 19 nt, Mycobacterium leprae
ugaugguuuggcugccaga

SEQ ID NO: 3238371 - RNA, 16 nt, Mycobacterium leprae
ugaugucuuggcugac

SEQ ID NO: 3238372 - RNA, 20 nt, Mycobacterium leprae
ugaugucuuugcguaguguu

SEQ ID NO: 3238373 - RNA, 16 nt, Mycobacterium leprae
ugauguuaucccuugc

SEQ ID NO: 3238374 - RNA, 15 nt, Mycobacterium leprae
ugauucagcgcugau

SEQ ID NO: 3238375 - RNA, 16 nt, Mycobacterium leprae
ugauucgacaccaacu

SEQ ID NO: 3238376 - RNA, 13 nt, Mycobacterium leprae
ugauugaucggug

SEQ ID NO: 3238377 - RNA, 17 nt, Mycobacterium leprae
ugauugcugcaucugaa

SEQ ID NO: 3238378 - RNA, 18 nt, Mycobacterium leprae
ugauuggcugagaccggu

SEQ ID NO: 3238379 - RNA, 16 nt, Mycobacterium leprae
ugauuguguguaggug

SEQ ID NO: 3238380 - RNA, 14 nt, Mycobacterium leprae
ugcaaaacgucgau

SEQ ID NO: 3238381 - RNA, 16 nt, Mycobacterium leprae
ugcaaauggcacugau

SEQ ID NO: 3238382 - RNA, 21 nt, Mycobacterium leprae
ugcaaauggcacugauacuga

SEQ ID NO: 3238383 - RNA, 21 nt, Mycobacterium leprae
ugcaaccacacccuggcuggg

SEQ ID NO: 3238384 - RNA, 22 nt, Mycobacterium leprae
ugcaaccuccguugucccgccc

SEQ ID NO: 3238385 - RNA, 16 nt, Mycobacterium leprae
ugcaacgacuggauga

SEQ ID NO: 3238386 - RNA, 18 nt, Mycobacterium leprae
ugcaacgcugcaaggugg

SEQ ID NO: 3238387 - RNA, 20 nt, Mycobacterium leprae
ugcaacgcugcaaggugggc

SEQ ID NO: 3238388 - RNA, 20 nt, Mycobacterium leprae
ugcaaggucguguugccacc

SEQ ID NO: 3238389 - RNA, 22 nt, Mycobacterium leprae
ugcaaggugggcgaucaggagg

SEQ ID NO: 3238390 - RNA, 21 nt, Mycobacterium leprae
ugcaauaccuaucgacauccu

SEQ ID NO: 3238391 - RNA, 18 nt, Mycobacterium leprae
ugcaaucaaucauuaccg

SEQ ID NO: 3238392 - RNA, 13 nt, Mycobacterium leprae
ugcacacuaaaac

SEQ ID NO: 3238393 - RNA, 17 nt, Mycobacterium leprae
ugcacauucaaccagcc

SEQ ID NO: 3238394 - RNA, 14 nt, Mycobacterium leprae
ugcacauugggauc

SEQ ID NO: 3238395 - RNA, 15 nt, Mycobacterium leprae
ugcaccacggucguc

SEQ ID NO: 3238396 - RNA, 16 nt, Mycobacterium leprae
ugcaccauaccgacga

SEQ ID NO: 3238397 - RNA, 20 nt, Mycobacterium leprae
ugcaccauuucugccgcugg

SEQ ID NO: 3238398 - RNA, 17 nt, Mycobacterium leprae
ugcacccggccgucgcu

SEQ ID NO: 3238399 - RNA, 12 nt, Mycobacterium leprae
ugcacccgucgc

SEQ ID NO: 3238400 - RNA, 15 nt, Mycobacterium leprae
ugcacccgucgcuga

SEQ ID NO: 3238401 - RNA, 19 nt, Mycobacterium leprae
ugcaccgacggugcugaug

SEQ ID NO: 3238402 - RNA, 17 nt, Mycobacterium leprae
ugcaccgucuuugcuaa

SEQ ID NO: 3238403 - RNA, 19 nt, Mycobacterium leprae
ugcaccguggcaacgacca

SEQ ID NO: 3238404 - RNA, 15 nt, Mycobacterium leprae
ugcacgcgcgccugg

SEQ ID NO: 3238405 - RNA, 23 nt, Mycobacterium leprae
ugcacgcgcgccugggugaaucg

SEQ ID NO: 3238406 - RNA, 20 nt, Mycobacterium leprae
ugcacggggacgugccuguu

SEQ ID NO: 3238407 - RNA, 19 nt, Mycobacterium leprae
ugcacuaacgugcagcugg

SEQ ID NO: 3238408 - RNA, 21 nt, Mycobacterium leprae
ugcacugugucaccugaaaga

SEQ ID NO: 3238409 - RNA, 18 nt, Mycobacterium leprae
ugcagaaauucagcgcca

SEQ ID NO: 3238410 - RNA, 19 nt, Mycobacterium leprae
ugcagaaauucagcgccag

SEQ ID NO: 3238411 - RNA, 15 nt, Mycobacterium leprae
ugcagaccggauaca

SEQ ID NO: 3238412 - RNA, 19 nt, Mycobacterium leprae
ugcagacuuuggagcagga

SEQ ID NO: 3238413 - RNA, 13 nt, Mycobacterium leprae
ugcagaucaccaa

SEQ ID NO: 3238414 - RNA, 14 nt, Mycobacterium leprae
ugcagaucaccaac

SEQ ID NO: 3238415 - RNA, 20 nt, Mycobacterium leprae
ugcagauguugcagcaguuc

SEQ ID NO: 3238416 - RNA, 16 nt, Mycobacterium leprae
ugcagcaacgugcagu

SEQ ID NO: 3238417 - RNA, 22 nt, Mycobacterium leprae
ugcagcacaagacuucacucac

SEQ ID NO: 3238418 - RNA, 20 nt, Mycobacterium leprae
ugcagccacgaaaaucuggc

SEQ ID NO: 3238419 - RNA, 23 nt, Mycobacterium leprae
ugcagcgaccucaugcccgggau

SEQ ID NO: 3238420 - RNA, 14 nt, Mycobacterium leprae
ugcagcgacuggau

SEQ ID NO: 3238421 - RNA, 19 nt, Mycobacterium leprae
ugcagcgaggccguggccg

SEQ ID NO: 3238422 - RNA, 17 nt, Mycobacterium leprae
ugcagcggcaguccgcg

SEQ ID NO: 3238423 - RNA, 20 nt, Mycobacterium leprae
ugcagcuaauuuuccacagg

SEQ ID NO: 3238424 - RNA, 21 nt, Mycobacterium leprae
ugcagcuuguuggccaucggg

SEQ ID NO: 3238425 - RNA, 13 nt, Mycobacterium leprae
ugcaggaccgugc

SEQ ID NO: 3238426 - RNA, 17 nt, Mycobacterium leprae
ugcaggcagucuuucag

SEQ ID NO: 3238427 - RNA, 21 nt, Mycobacterium leprae
ugcaggcugcauccugcagca

SEQ ID NO: 3238428 - RNA, 20 nt, Mycobacterium leprae
ugcagggcgagcugcgccga

SEQ ID NO: 3238429 - RNA, 16 nt, Mycobacterium leprae
ugcagguacuagcacg

SEQ ID NO: 3238430 - RNA, 20 nt, Mycobacterium leprae
ugcaggugacgguguuggug

SEQ ID NO: 3238431 - RNA, 20 nt, Mycobacterium leprae
ugcagguucgcgucgcccgu

SEQ ID NO: 3238432 - RNA, 13 nt, Mycobacterium leprae
ugcagucgcucag

SEQ ID NO: 3238433 - RNA, 18 nt, Mycobacterium leprae
ugcaguucaccacaucau

SEQ ID NO: 3238434 - RNA, 16 nt, Mycobacterium leprae
ugcaucagcaccgcgc

SEQ ID NO: 3238435 - RNA, 16 nt, Mycobacterium leprae
ugcaucccuuuuugcu

SEQ ID NO: 3238436 - RNA, 19 nt, Mycobacterium leprae
ugcaucgguaaccauaaga

SEQ ID NO: 3238437 - RNA, 22 nt, Mycobacterium leprae
ugcaugaggacugcugaccggg

SEQ ID NO: 3238438 - RNA, 19 nt, Mycobacterium leprae
ugcauucgaaaaucgccua

SEQ ID NO: 3238439 - RNA, 16 nt, Mycobacterium leprae
ugcauucugacuuugc

SEQ ID NO: 3238440 - RNA, 21 nt, Mycobacterium leprae
ugcauugcaauccgccgaucc

SEQ ID NO: 3238441 - RNA, 12 nt, Mycobacterium leprae
ugcauuggcuga

SEQ ID NO: 3238442 - RNA, 13 nt, Mycobacterium leprae
ugccaaaguccau

SEQ ID NO: 3238443 - RNA, 18 nt, Mycobacterium leprae
ugccaaaguccaugugcu

SEQ ID NO: 3238444 - RNA, 23 nt, Mycobacterium leprae
ugccaaaguuagcggagaccccc

SEQ ID NO: 3238445 - RNA, 13 nt, Mycobacterium leprae
ugccaaccugcgc

SEQ ID NO: 3238446 - RNA, 20 nt, Mycobacterium leprae
ugccaccaccaccccuaccc

SEQ ID NO: 3238447 - RNA, 18 nt, Mycobacterium leprae
ugccaccgacaaagcuca

SEQ ID NO: 3238448 - RNA, 21 nt, Mycobacterium leprae
ugccacggccccggaugcgug

SEQ ID NO: 3238449 - RNA, 13 nt, Mycobacterium leprae
ugccacgguggcc

SEQ ID NO: 3238450 - RNA, 14 nt, Mycobacterium leprae
ugccacugucgcga

SEQ ID NO: 3238451 - RNA, 18 nt, Mycobacterium leprae
ugccacugugucacgcga

SEQ ID NO: 3238452 - RNA, 21 nt, Mycobacterium leprae
ugccacugugucacgcgacca

SEQ ID NO: 3238453 - RNA, 19 nt, Mycobacterium leprae
ugccagaauuuucagcggu

SEQ ID NO: 3238454 - RNA, 18 nt, Mycobacterium leprae
ugccaggcagcugugcac

SEQ ID NO: 3238455 - RNA, 21 nt, Mycobacterium leprae
ugccaggcagcugugcacgug

SEQ ID NO: 3238456 - RNA, 22 nt, Mycobacterium leprae
ugccaggggcugggcaccuggg

SEQ ID NO: 3238457 - RNA, 17 nt, Mycobacterium leprae
ugccauacauccgucgc

SEQ ID NO: 3238458 - RNA, 16 nt, Mycobacterium leprae
ugccauccaccgccga

SEQ ID NO: 3238459 - RNA, 16 nt, Mycobacterium leprae
ugccauccggugcuga

SEQ ID NO: 3238460 - RNA, 15 nt, Mycobacterium leprae
ugccaucgacgccgc

SEQ ID NO: 3238461 - RNA, 22 nt, Mycobacterium leprae
ugccaucgacgccgccguugcc

SEQ ID NO: 3238462 - RNA, 17 nt, Mycobacterium leprae
ugccauuggugggauga

SEQ ID NO: 3238463 - RNA, 13 nt, Mycobacterium leprae
ugcccaccauguu

SEQ ID NO: 3238464 - RNA, 20 nt, Mycobacterium leprae
ugcccagaugaauucgcuga

SEQ ID NO: 3238465 - RNA, 23 nt, Mycobacterium leprae
ugcccagcauuauccgggcugga

SEQ ID NO: 3238466 - RNA, 17 nt, Mycobacterium leprae
ugcccagccccuggcau

SEQ ID NO: 3238467 - RNA, 21 nt, Mycobacterium leprae
ugcccagccccuggcaucauc

SEQ ID NO: 3238468 - RNA, 19 nt, Mycobacterium leprae
ugccccagucgccagagcc

SEQ ID NO: 3238469 - RNA, 13 nt, Mycobacterium leprae
ugccccgcgcucu

SEQ ID NO: 3238470 - RNA, 13 nt, Mycobacterium leprae
ugccccgcuggug

SEQ ID NO: 3238471 - RNA, 16 nt, Mycobacterium leprae
ugccccggccgccguc

SEQ ID NO: 3238472 - RNA, 12 nt, Mycobacterium leprae
ugcccgacagcc

SEQ ID NO: 3238473 - RNA, 23 nt, Mycobacterium leprae
ugcccgacgaggcggugaccgaa

SEQ ID NO: 3238474 - RNA, 13 nt, Mycobacterium leprae
ugcccgcgggggu

SEQ ID NO: 3238475 - RNA, 14 nt, Mycobacterium leprae
ugcccggccguuuc

SEQ ID NO: 3238476 - RNA, 14 nt, Mycobacterium leprae
ugcccucgcugccg

SEQ ID NO: 3238477 - RNA, 16 nt, Mycobacterium leprae
ugccgaaagccugcuu

SEQ ID NO: 3238478 - RNA, 15 nt, Mycobacterium leprae
ugccgaacugcugca

SEQ ID NO: 3238479 - RNA, 21 nt, Mycobacterium leprae
ugccgaauucgcccgagucuc

SEQ ID NO: 3238480 - RNA, 20 nt, Mycobacterium leprae
ugccgacaguuuaccgugcc

SEQ ID NO: 3238481 - RNA, 13 nt, Mycobacterium leprae
ugccgagccugga

SEQ ID NO: 3238482 - RNA, 21 nt, Mycobacterium leprae
ugccgagcugguaggugacgc

SEQ ID NO: 3238483 - RNA, 19 nt, Mycobacterium leprae
ugccgaucucguguuacau

SEQ ID NO: 3238484 - RNA, 15 nt, Mycobacterium leprae
ugccgccgacggccg

SEQ ID NO: 3238485 - RNA, 15 nt, Mycobacterium leprae
ugccgccgaucggua

SEQ ID NO: 3238486 - RNA, 16 nt, Mycobacterium leprae
ugccgccgaucgguau

SEQ ID NO: 3238487 - RNA, 13 nt, Mycobacterium leprae
ugccgccgggacg

SEQ ID NO: 3238488 - RNA, 19 nt, Mycobacterium leprae
ugccgccgggugcagcagu

SEQ ID NO: 3238489 - RNA, 14 nt, Mycobacterium leprae
ugccgcgcguuggc

SEQ ID NO: 3238490 - RNA, 15 nt, Mycobacterium leprae
ugccgcggcugcgcu

SEQ ID NO: 3238491 - RNA, 22 nt, Mycobacterium leprae
ugccgcggucuaguuguugaca

SEQ ID NO: 3238492 - RNA, 18 nt, Mycobacterium leprae
ugccgcuccgcgcacagu

SEQ ID NO: 3238493 - RNA, 21 nt, Mycobacterium leprae
ugccgcugguaucggugucgg

SEQ ID NO: 3238494 - RNA, 17 nt, Mycobacterium leprae
ugccgcugucgauggac

SEQ ID NO: 3238495 - RNA, 13 nt, Mycobacterium leprae
ugccggcgccgcu

SEQ ID NO: 3238496 - RNA, 17 nt, Mycobacterium leprae
ugccggcggcagauguu

SEQ ID NO: 3238497 - RNA, 17 nt, Mycobacterium leprae
ugccggggcugcgcugg

SEQ ID NO: 3238498 - RNA, 14 nt, Mycobacterium leprae
ugccggugaccggg

SEQ ID NO: 3238499 - RNA, 17 nt, Mycobacterium leprae
ugccggugaccgggccg

SEQ ID NO: 3238500 - RNA, 23 nt, Mycobacterium leprae
ugccggugcggucccaucgcuga

SEQ ID NO: 3238501 - RNA, 16 nt, Mycobacterium leprae
ugccgugguagucagc

SEQ ID NO: 3238502 - RNA, 12 nt, Mycobacterium leprae
ugccgugugcuu

SEQ ID NO: 3238503 - RNA, 19 nt, Mycobacterium leprae
ugccucaacuauccagccc

SEQ ID NO: 3238504 - RNA, 17 nt, Mycobacterium leprae
ugccucgagcaaaccag

SEQ ID NO: 3238505 - RNA, 22 nt, Mycobacterium leprae
ugccucgucguuguuugaugug

SEQ ID NO: 3238506 - RNA, 11 nt, Mycobacterium leprae
ugccuggccuc

SEQ ID NO: 3238507 - RNA, 13 nt, Mycobacterium leprae
ugccuguccggag

SEQ ID NO: 3238508 - RNA, 15 nt, Mycobacterium leprae
ugccuucgugauggc

SEQ ID NO: 3238509 - RNA, 16 nt, Mycobacterium leprae
ugccuugacuucuugu

SEQ ID NO: 3238510 - RNA, 23 nt, Mycobacterium leprae
ugcgaaaacacuuacaccaacau

SEQ ID NO: 3238511 - RNA, 15 nt, Mycobacterium leprae
ugcgaacagccgagc

SEQ ID NO: 3238512 - RNA, 23 nt, Mycobacterium leprae
ugcgacaucucggucaggugcgc

SEQ ID NO: 3238513 - RNA, 22 nt, Mycobacterium leprae
ugcgacauucaccaguaaccac

SEQ ID NO: 3238514 - RNA, 22 nt, Mycobacterium leprae
ugcgaccgccgguuucgcccca

SEQ ID NO: 3238515 - RNA, 22 nt, Mycobacterium leprae
ugcgaccugaacauuaguuccu

SEQ ID NO: 3238516 - RNA, 13 nt, Mycobacterium leprae
ugcgacgaccucc

SEQ ID NO: 3238517 - RNA, 17 nt, Mycobacterium leprae
ugcgagaguacggagcc

SEQ ID NO: 3238518 - RNA, 19 nt, Mycobacterium leprae
ugcgagauccgugcgccuu

SEQ ID NO: 3238519 - RNA, 18 nt, Mycobacterium leprae
ugcgaguagucgugcuga

SEQ ID NO: 3238520 - RNA, 18 nt, Mycobacterium leprae
ugcgauaucggauucguu

SEQ ID NO: 3238521 - RNA, 14 nt, Mycobacterium leprae
ugcgaugcuggccg

SEQ ID NO: 3238522 - RNA, 13 nt, Mycobacterium leprae
ugcgauuccagca

SEQ ID NO: 3238523 - RNA, 15 nt, Mycobacterium leprae
ugcgcaacuucaacu

SEQ ID NO: 3238524 - RNA, 17 nt, Mycobacterium leprae
ugcgcaccucgcugcag

SEQ ID NO: 3238525 - RNA, 22 nt, Mycobacterium leprae
ugcgcagcaauugacgccgacc

SEQ ID NO: 3238526 - RNA, 16 nt, Mycobacterium leprae
ugcgcauccucggacu

SEQ ID NO: 3238527 - RNA, 17 nt, Mycobacterium leprae
ugcgccaggggaaccau

SEQ ID NO: 3238528 - RNA, 20 nt, Mycobacterium leprae
ugcgccggcgcgcaggcugc

SEQ ID NO: 3238529 - RNA, 14 nt, Mycobacterium leprae
ugcgcgcacccaag

SEQ ID NO: 3238530 - RNA, 19 nt, Mycobacterium leprae
ugcgcgccgcccagcaguu

SEQ ID NO: 3238531 - RNA, 16 nt, Mycobacterium leprae
ugcgcggcugccgcac

SEQ ID NO: 3238532 - RNA, 13 nt, Mycobacterium leprae
ugcgcguccaggg

SEQ ID NO: 3238533 - RNA, 19 nt, Mycobacterium leprae
ugcgcugcagcaacagcca

SEQ ID NO: 3238534 - RNA, 21 nt, Mycobacterium leprae
ugcggacggacacuguccacu

SEQ ID NO: 3238535 - RNA, 21 nt, Mycobacterium leprae
ugcggaucgagggauccaaga

SEQ ID NO: 3238536 - RNA, 18 nt, Mycobacterium leprae
ugcggaucggugcaugca

SEQ ID NO: 3238537 - RNA, 22 nt, Mycobacterium leprae
ugcggcagggcguugccguccc

SEQ ID NO: 3238538 - RNA, 21 nt, Mycobacterium leprae
ugcggcauucgcaaagcggca

SEQ ID NO: 3238539 - RNA, 15 nt, Mycobacterium leprae
ugcggcgccccucug

SEQ ID NO: 3238540 - RNA, 12 nt, Mycobacterium leprae
ugcggcgguggg

SEQ ID NO: 3238541 - RNA, 16 nt, Mycobacterium leprae
ugcgggacagaagcau

SEQ ID NO: 3238542 - RNA, 21 nt, Mycobacterium leprae
ugcggggggccuuaucccacc

SEQ ID NO: 3238543 - RNA, 16 nt, Mycobacterium leprae
ugcgguaaacacuucu

SEQ ID NO: 3238544 - RNA, 17 nt, Mycobacterium leprae
ugcgguaaacacuucuu

SEQ ID NO: 3238545 - RNA, 13 nt, Mycobacterium leprae
ugcggucaucagg

SEQ ID NO: 3238546 - RNA, 18 nt, Mycobacterium leprae
ugcggugacggucgugcu

SEQ ID NO: 3238547 - RNA, 19 nt, Mycobacterium leprae
ugcgguuuucggccacgac

SEQ ID NO: 3238548 - RNA, 23 nt, Mycobacterium leprae
ugcguaaucgccgguggcaaccg

SEQ ID NO: 3238549 - RNA, 15 nt, Mycobacterium leprae
ugcguaauggccggc

SEQ ID NO: 3238550 - RNA, 22 nt, Mycobacterium leprae
ugcguaccggaauguccaccag

SEQ ID NO: 3238551 - RNA, 21 nt, Mycobacterium leprae
ugcguacggagauagacaugu

SEQ ID NO: 3238552 - RNA, 12 nt, Mycobacterium leprae
ugcgucaaagcu

SEQ ID NO: 3238553 - RNA, 15 nt, Mycobacterium leprae
ugcgucgcccucgcc

SEQ ID NO: 3238554 - RNA, 21 nt, Mycobacterium leprae
ugcgucgcugugugcgcgccg

SEQ ID NO: 3238555 - RNA, 15 nt, Mycobacterium leprae
ugcgugccccggccg

SEQ ID NO: 3238556 - RNA, 21 nt, Mycobacterium leprae
ugcgugccccggccgccgucc

SEQ ID NO: 3238557 - RNA, 24 nt, Mycobacterium leprae
ugcguggcugcuuacucgcgccgu

SEQ ID NO: 3238558 - RNA, 15 nt, Mycobacterium leprae
ugcguucagcgaaga

SEQ ID NO: 3238559 - RNA, 20 nt, Mycobacterium leprae
ugcguugucgucggccgcgg

SEQ ID NO: 3238560 - RNA, 16 nt, Mycobacterium leprae
ugcguuuuaugacugg

SEQ ID NO: 3238561 - RNA, 12 nt, Mycobacterium leprae
ugcuaacaaggc

SEQ ID NO: 3238562 - RNA, 20 nt, Mycobacterium leprae
ugcuaccaguguccgucgac

SEQ ID NO: 3238563 - RNA, 14 nt, Mycobacterium leprae
ugcuacgugacugc

SEQ ID NO: 3238564 - RNA, 21 nt, Mycobacterium leprae
ugcuagcagcgcgcagaacac

SEQ ID NO: 3238565 - RNA, 14 nt, Mycobacterium leprae
ugcuagcggcgcca

SEQ ID NO: 3238566 - RNA, 18 nt, Mycobacterium leprae
ugcuauccaauucgccga

SEQ ID NO: 3238567 - RNA, 21 nt, Mycobacterium leprae
ugcuauccgcggugugucccg

SEQ ID NO: 3238568 - RNA, 23 nt, Mycobacterium leprae
ugcuaucgcccaggugcuggcug

SEQ ID NO: 3238569 - RNA, 20 nt, Mycobacterium leprae
ugcuaugauaauuuggcuga

SEQ ID NO: 3238570 - RNA, 13 nt, Mycobacterium leprae
ugcuaugguuggu

SEQ ID NO: 3238571 - RNA, 17 nt, Mycobacterium leprae
ugcuauuuggugaagau

SEQ ID NO: 3238572 - RNA, 14 nt, Mycobacterium leprae
ugcucaaucagcga

SEQ ID NO: 3238573 - RNA, 21 nt, Mycobacterium leprae
ugcucacguucauuauggggg

SEQ ID NO: 3238574 - RNA, 14 nt, Mycobacterium leprae
ugcucauggcaccg

SEQ ID NO: 3238575 - RNA, 15 nt, Mycobacterium leprae
ugcucggccagagcu

SEQ ID NO: 3238576 - RNA, 22 nt, Mycobacterium leprae
ugcucggcgaagucaagaugau

SEQ ID NO: 3238577 - RNA, 20 nt, Mycobacterium leprae
ugcucgguauuugcggugga

SEQ ID NO: 3238578 - RNA, 16 nt, Mycobacterium leprae
ugcucguagcggcggc

SEQ ID NO: 3238579 - RNA, 19 nt, Mycobacterium leprae
ugcucgucaucgacgaugc

SEQ ID NO: 3238580 - RNA, 12 nt, Mycobacterium leprae
ugcucucagcac

SEQ ID NO: 3238581 - RNA, 23 nt, Mycobacterium leprae
ugcucugaccagagguucuaggu

SEQ ID NO: 3238582 - RNA, 13 nt, Mycobacterium leprae
ugcugacgccggg

SEQ ID NO: 3238583 - RNA, 14 nt, Mycobacterium leprae
ugcugagagcagau

SEQ ID NO: 3238584 - RNA, 19 nt, Mycobacterium leprae
ugcugaggguggcgccggc

SEQ ID NO: 3238585 - RNA, 22 nt, Mycobacterium leprae
ugcugaggguggcgccggcgug

SEQ ID NO: 3238586 - RNA, 14 nt, Mycobacterium leprae
ugcugauggccggc

SEQ ID NO: 3238587 - RNA, 15 nt, Mycobacterium leprae
ugcugauggccggcc

SEQ ID NO: 3238588 - RNA, 18 nt, Mycobacterium leprae
ugcugauggccggccugg

SEQ ID NO: 3238589 - RNA, 15 nt, Mycobacterium leprae
ugcugcagccacgaa

SEQ ID NO: 3238590 - RNA, 13 nt, Mycobacterium leprae
ugcugcagcuggg

SEQ ID NO: 3238591 - RNA, 22 nt, Mycobacterium leprae
ugcugcauccgacaaagcagca

SEQ ID NO: 3238592 - RNA, 21 nt, Mycobacterium leprae
ugcugccacauguuuccggca

SEQ ID NO: 3238593 - RNA, 15 nt, Mycobacterium leprae
ugcugccuagaugau

SEQ ID NO: 3238594 - RNA, 18 nt, Mycobacterium leprae
ugcugcggcgcccuagac

SEQ ID NO: 3238595 - RNA, 16 nt, Mycobacterium leprae
ugcuggagggcaucaa

SEQ ID NO: 3238596 - RNA, 13 nt, Mycobacterium leprae
ugcuggcaagcuc

SEQ ID NO: 3238597 - RNA, 22 nt, Mycobacterium leprae
ugcuggcaagcucggguguguc

SEQ ID NO: 3238598 - RNA, 20 nt, Mycobacterium leprae
ugcuggccguguugcugcua

SEQ ID NO: 3238599 - RNA, 22 nt, Mycobacterium leprae
ugcugggacauccgcugauugg

SEQ ID NO: 3238600 - RNA, 23 nt, Mycobacterium leprae
ugcugggacauccgcugauuggc

SEQ ID NO: 3238601 - RNA, 16 nt, Mycobacterium leprae
ugcuggugaucaggau

SEQ ID NO: 3238602 - RNA, 20 nt, Mycobacterium leprae
ugcugguucuuggcuugcug

SEQ ID NO: 3238603 - RNA, 15 nt, Mycobacterium leprae
ugcuguguugcgggg

SEQ ID NO: 3238604 - RNA, 23 nt, Mycobacterium leprae
ugcuguucggugacuucggccgg

SEQ ID NO: 3238605 - RNA, 13 nt, Mycobacterium leprae
ugcuguuggggau

SEQ ID NO: 3238606 - RNA, 20 nt, Mycobacterium leprae
ugcuguuguaagcacugcac

SEQ ID NO: 3238607 - RNA, 20 nt, Mycobacterium leprae
ugcuuaccucagugucagca

SEQ ID NO: 3238608 - RNA, 21 nt, Mycobacterium leprae
ugcuuacgcagcgaguguccg

SEQ ID NO: 3238609 - RNA, 18 nt, Mycobacterium leprae
ugcuuagcauagcggccg

SEQ ID NO: 3238610 - RNA, 21 nt, Mycobacterium leprae
ugcuuagcauagcggccgcca

SEQ ID NO: 3238611 - RNA, 16 nt, Mycobacterium leprae
ugcuuagcuaugcagu

SEQ ID NO: 3238612 - RNA, 23 nt, Mycobacterium leprae
ugcuuccaacccguugucaagca

SEQ ID NO: 3238613 - RNA, 14 nt, Mycobacterium leprae
ugcuucgaggcauu

SEQ ID NO: 3238614 - RNA, 17 nt, Mycobacterium leprae
ugcuugcuggcugaggg

SEQ ID NO: 3238615 - RNA, 20 nt, Mycobacterium leprae
ugcuugggcauuuucggcua

SEQ ID NO: 3238616 - RNA, 19 nt, Mycobacterium leprae
ugcuugggcgcuucaccga

SEQ ID NO: 3238617 - RNA, 14 nt, Mycobacterium leprae
ugcuuguugccgcc

SEQ ID NO: 3238618 - RNA, 21 nt, Mycobacterium leprae
ugcuuguugccgccgggacgc

SEQ ID NO: 3238619 - RNA, 12 nt, Mycobacterium leprae
ugcuuugggggu

SEQ ID NO: 3238620 - RNA, 13 nt, Mycobacterium leprae
uggaaacgggugg

SEQ ID NO: 3238621 - RNA, 13 nt, Mycobacterium leprae
uggaaagucagca

SEQ ID NO: 3238622 - RNA, 15 nt, Mycobacterium leprae
uggaaagucagcauc

SEQ ID NO: 3238623 - RNA, 14 nt, Mycobacterium leprae
uggaacaaccggua

SEQ ID NO: 3238624 - RNA, 17 nt, Mycobacterium leprae
uggaagccgccguggug

SEQ ID NO: 3238625 - RNA, 18 nt, Mycobacterium leprae
uggaagcugaauggucau

SEQ ID NO: 3238626 - RNA, 20 nt, Mycobacterium leprae
uggaauaacagagugcacca

SEQ ID NO: 3238627 - RNA, 18 nt, Mycobacterium leprae
uggacaacacguuucugc

SEQ ID NO: 3238628 - RNA, 22 nt, Mycobacterium leprae
uggacagaacaccccgcggagu

SEQ ID NO: 3238629 - RNA, 20 nt, Mycobacterium leprae
uggacagaugagcucagucg

SEQ ID NO: 3238630 - RNA, 19 nt, Mycobacterium leprae
uggacaucacuugcugacc

SEQ ID NO: 3238631 - RNA, 15 nt, Mycobacterium leprae
uggaccgcgccgcgu

SEQ ID NO: 3238632 - RNA, 18 nt, Mycobacterium leprae
uggaccgcgccgcguggg

SEQ ID NO: 3238633 - RNA, 19 nt, Mycobacterium leprae
uggaccugaugacagcgau

SEQ ID NO: 3238634 - RNA, 22 nt, Mycobacterium leprae
uggacgaacugggugaccaccc

SEQ ID NO: 3238635 - RNA, 19 nt, Mycobacterium leprae
uggacgcagugaacacgcu

SEQ ID NO: 3238636 - RNA, 16 nt, Mycobacterium leprae
uggacucggucugcug

SEQ ID NO: 3238637 - RNA, 22 nt, Mycobacterium leprae
uggagaauguuguuagugcugc

SEQ ID NO: 3238638 - RNA, 22 nt, Mycobacterium leprae
uggagcaauuucauuaacaggu

SEQ ID NO: 3238639 - RNA, 17 nt, Mycobacterium leprae
uggagcaccuggucuau

SEQ ID NO: 3238640 - RNA, 16 nt, Mycobacterium leprae
uggaggugcggcuggc

SEQ ID NO: 3238641 - RNA, 23 nt, Mycobacterium leprae
uggagucauaccguuuacugugu

SEQ ID NO: 3238642 - RNA, 16 nt, Mycobacterium leprae
uggaguucgucugaau

SEQ ID NO: 3238643 - RNA, 20 nt, Mycobacterium leprae
uggauaccacugacgggugg

SEQ ID NO: 3238644 - RNA, 16 nt, Mycobacterium leprae
uggauacguagcgucg

SEQ ID NO: 3238645 - RNA, 23 nt, Mycobacterium leprae
uggauacucaauugcagcgcgaa

SEQ ID NO: 3238646 - RNA, 17 nt, Mycobacterium leprae
uggauauagcaacagca

SEQ ID NO: 3238647 - RNA, 17 nt, Mycobacterium leprae
uggauccaggugcugca

SEQ ID NO: 3238648 - RNA, 16 nt, Mycobacterium leprae
uggaucgcacuuggug

SEQ ID NO: 3238649 - RNA, 22 nt, Mycobacterium leprae
uggaucgguaccagcggcagcg

SEQ ID NO: 3238650 - RNA, 15 nt, Mycobacterium leprae
uggaucggugcuaug

SEQ ID NO: 3238651 - RNA, 15 nt, Mycobacterium leprae
uggaugaccauaaug

SEQ ID NO: 3238652 - RNA, 19 nt, Mycobacterium leprae
uggauggcgaucgccuugu

SEQ ID NO: 3238653 - RNA, 15 nt, Mycobacterium leprae
uggaugguuagcaug

SEQ ID NO: 3238654 - RNA, 22 nt, Mycobacterium leprae
uggaugguuagcaugagcacgc

SEQ ID NO: 3238655 - RNA, 17 nt, Mycobacterium leprae
uggcaaccgacacaccc

SEQ ID NO: 3238656 - RNA, 21 nt, Mycobacterium leprae
uggcaacgcugcccaccagua

SEQ ID NO: 3238657 - RNA, 18 nt, Mycobacterium leprae
uggcaccagugugccagc

SEQ ID NO: 3238658 - RNA, 19 nt, Mycobacterium leprae
uggcaccagugugccagcg

SEQ ID NO: 3238659 - RNA, 21 nt, Mycobacterium leprae
uggcaccagugugccagcgcu

SEQ ID NO: 3238660 - RNA, 22 nt, Mycobacterium leprae
uggcaccgugucgucuuccgga

SEQ ID NO: 3238661 - RNA, 14 nt, Mycobacterium leprae
uggcacguuggaug

SEQ ID NO: 3238662 - RNA, 16 nt, Mycobacterium leprae
uggcacugggcugcuc

SEQ ID NO: 3238663 - RNA, 14 nt, Mycobacterium leprae
uggcagaggcugca

SEQ ID NO: 3238664 - RNA, 21 nt, Mycobacterium leprae
uggcagcaaggcuuggccagc

SEQ ID NO: 3238665 - RNA, 16 nt, Mycobacterium leprae
uggcagccgccagcgu

SEQ ID NO: 3238666 - RNA, 18 nt, Mycobacterium leprae
uggcagucggcucaacca

SEQ ID NO: 3238667 - RNA, 18 nt, Mycobacterium leprae
uggcagucuuggcucaca

SEQ ID NO: 3238668 - RNA, 16 nt, Mycobacterium leprae
uggcaucggcauugcc

SEQ ID NO: 3238669 - RNA, 18 nt, Mycobacterium leprae
uggcaucuuacuggggcg

SEQ ID NO: 3238670 - RNA, 18 nt, Mycobacterium leprae
uggcauggcgcugguugu

SEQ ID NO: 3238671 - RNA, 22 nt, Mycobacterium leprae
uggcauuuugggaguggugcuc

SEQ ID NO: 3238672 - RNA, 23 nt, Mycobacterium leprae
uggccaaacuaucggugaugguc

SEQ ID NO: 3238673 - RNA, 14 nt, Mycobacterium leprae
uggccaagccgccc

SEQ ID NO: 3238674 - RNA, 18 nt, Mycobacterium leprae
uggccaagcggaaaugac

SEQ ID NO: 3238675 - RNA, 13 nt, Mycobacterium leprae
uggccaccgccac

SEQ ID NO: 3238676 - RNA, 12 nt, Mycobacterium leprae
uggccagcaagu

SEQ ID NO: 3238677 - RNA, 14 nt, Mycobacterium leprae
uggccagcacggcg

SEQ ID NO: 3238678 - RNA, 14 nt, Mycobacterium leprae
uggccagccguccc

SEQ ID NO: 3238679 - RNA, 18 nt, Mycobacterium leprae
uggcccauccgggccagu

SEQ ID NO: 3238680 - RNA, 20 nt, Mycobacterium leprae
uggccccggacccgagccgc

SEQ ID NO: 3238681 - RNA, 22 nt, Mycobacterium leprae
uggcccgacggcgcggcugcuu

SEQ ID NO: 3238682 - RNA, 22 nt, Mycobacterium leprae
uggcccgcgucgccuuagccga

SEQ ID NO: 3238683 - RNA, 21 nt, Mycobacterium leprae
uggcccgucgcugcuggauga

SEQ ID NO: 3238684 - RNA, 21 nt, Mycobacterium leprae
uggcccuguuccucgcgggcg

SEQ ID NO: 3238685 - RNA, 21 nt, Mycobacterium leprae
uggccgcaaguuuagcaacaa

SEQ ID NO: 3238686 - RNA, 16 nt, Mycobacterium leprae
uggccgcaccugaaca

SEQ ID NO: 3238687 - RNA, 17 nt, Mycobacterium leprae
uggccgcagugaucaca

SEQ ID NO: 3238688 - RNA, 18 nt, Mycobacterium leprae
uggccgcagugaucacau

SEQ ID NO: 3238689 - RNA, 16 nt, Mycobacterium leprae
uggccgccaggucagc

SEQ ID NO: 3238690 - RNA, 18 nt, Mycobacterium leprae
uggccgcggucgugcugc

SEQ ID NO: 3238691 - RNA, 17 nt, Mycobacterium leprae
uggccgcucuagaaauu

SEQ ID NO: 3238692 - RNA, 13 nt, Mycobacterium leprae
uggccgcuggggc

SEQ ID NO: 3238693 - RNA, 14 nt, Mycobacterium leprae
uggccgcuggggca

SEQ ID NO: 3238694 - RNA, 17 nt, Mycobacterium leprae
uggccggaacagcaucc

SEQ ID NO: 3238695 - RNA, 19 nt, Mycobacterium leprae
uggccggauguuuggcugu

SEQ ID NO: 3238696 - RNA, 17 nt, Mycobacterium leprae
uggccggcaugggccgg

SEQ ID NO: 3238697 - RNA, 20 nt, Mycobacterium leprae
uggccgggaucggcggcacc

SEQ ID NO: 3238698 - RNA, 15 nt, Mycobacterium leprae
uggccgugcuagucg

SEQ ID NO: 3238699 - RNA, 13 nt, Mycobacterium leprae
uggccuaccgggc

SEQ ID NO: 3238700 - RNA, 23 nt, Mycobacterium leprae
uggccuccgacaggucaguuuca

SEQ ID NO: 3238701 - RNA, 16 nt, Mycobacterium leprae
uggccuguucauggug

SEQ ID NO: 3238702 - RNA, 14 nt, Mycobacterium leprae
uggccuugcuguga

SEQ ID NO: 3238703 - RNA, 13 nt, Mycobacterium leprae
uggcgacaguguu

SEQ ID NO: 3238704 - RNA, 18 nt, Mycobacterium leprae
uggcgaccgcaccggcga

SEQ ID NO: 3238705 - RNA, 14 nt, Mycobacterium leprae
uggcgacgugaucg

SEQ ID NO: 3238706 - RNA, 14 nt, Mycobacterium leprae
uggcgagcaucugg

SEQ ID NO: 3238707 - RNA, 20 nt, Mycobacterium leprae
uggcgaucggcucgauggga

SEQ ID NO: 3238708 - RNA, 13 nt, Mycobacterium leprae
uggcgaucugcau

SEQ ID NO: 3238709 - RNA, 11 nt, Mycobacterium leprae
uggcgccgagu

SEQ ID NO: 3238710 - RNA, 23 nt, Mycobacterium leprae
uggcgcgucuuacuguacgguug

SEQ ID NO: 3238711 - RNA, 17 nt, Mycobacterium leprae
uggcgcuccaauuugga

SEQ ID NO: 3238712 - RNA, 23 nt, Mycobacterium leprae
uggcgcuuaauguagcauguacu

SEQ ID NO: 3238713 - RNA, 19 nt, Mycobacterium leprae
uggcggagcgcggagcugg

SEQ ID NO: 3238714 - RNA, 14 nt, Mycobacterium leprae
uggcggaggcuggg

SEQ ID NO: 3238715 - RNA, 14 nt, Mycobacterium leprae
uggcggugugugca

SEQ ID NO: 3238716 - RNA, 16 nt, Mycobacterium leprae
uggcgguguuagcaug

SEQ ID NO: 3238717 - RNA, 20 nt, Mycobacterium leprae
uggcguagcggagcggcggc

SEQ ID NO: 3238718 - RNA, 23 nt, Mycobacterium leprae
uggcgucaucgacaucccagcaa

SEQ ID NO: 3238719 - RNA, 13 nt, Mycobacterium leprae
uggcgucgguggc

SEQ ID NO: 3238720 - RNA, 17 nt, Mycobacterium leprae
uggcgucguuuuggcgc

SEQ ID NO: 3238721 - RNA, 23 nt, Mycobacterium leprae
uggcgugacggauacggaaagca

SEQ ID NO: 3238722 - RNA, 19 nt, Mycobacterium leprae
uggcguuuggugcugcgcu

SEQ ID NO: 3238723 - RNA, 19 nt, Mycobacterium leprae
uggcuaagaucuucggauu

SEQ ID NO: 3238724 - RNA, 15 nt, Mycobacterium leprae
uggcuaccaugccac

SEQ ID NO: 3238725 - RNA, 17 nt, Mycobacterium leprae
uggcuauggguaggccg

SEQ ID NO: 3238726 - RNA, 16 nt, Mycobacterium leprae
uggcuccauccugccu

SEQ ID NO: 3238727 - RNA, 15 nt, Mycobacterium leprae
uggcugauucgaaau

SEQ ID NO: 3238728 - RNA, 19 nt, Mycobacterium leprae
uggcugcaacgacuggaug

SEQ ID NO: 3238729 - RNA, 11 nt, Mycobacterium leprae
uggcugcccaa

SEQ ID NO: 3238730 - RNA, 13 nt, Mycobacterium leprae
uggcugcgccggc

SEQ ID NO: 3238731 - RNA, 13 nt, Mycobacterium leprae
uggcuguagugau

SEQ ID NO: 3238732 - RNA, 13 nt, Mycobacterium leprae
uggcuugagugcu

SEQ ID NO: 3238733 - RNA, 18 nt, Mycobacterium leprae
uggcuuugggaucuuuug

SEQ ID NO: 3238734 - RNA, 18 nt, Mycobacterium leprae
ugggaaaagcaggcggaa

SEQ ID NO: 3238735 - RNA, 22 nt, Mycobacterium leprae
ugggaccgggcguuucccuauc

SEQ ID NO: 3238736 - RNA, 20 nt, Mycobacterium leprae
ugggagaucuuuucggcugc

SEQ ID NO: 3238737 - RNA, 13 nt, Mycobacterium leprae
ugggaguggugcu

SEQ ID NO: 3238738 - RNA, 15 nt, Mycobacterium leprae
ugggaguggugcucc

SEQ ID NO: 3238739 - RNA, 12 nt, Mycobacterium leprae
ugggaucgacac

SEQ ID NO: 3238740 - RNA, 18 nt, Mycobacterium leprae
ugggaucuuuugaccagc

SEQ ID NO: 3238741 - RNA, 14 nt, Mycobacterium leprae
ugggauugggcauc

SEQ ID NO: 3238742 - RNA, 18 nt, Mycobacterium leprae
ugggcacggagcggccgc

SEQ ID NO: 3238743 - RNA, 21 nt, Mycobacterium leprae
ugggcacggagcggccgcgag

SEQ ID NO: 3238744 - RNA, 13 nt, Mycobacterium leprae
ugggcagccugga

SEQ ID NO: 3238745 - RNA, 15 nt, Mycobacterium leprae
ugggcagcuaagaag

SEQ ID NO: 3238746 - RNA, 19 nt, Mycobacterium leprae
ugggcagcuugaacgccgc

SEQ ID NO: 3238747 - RNA, 22 nt, Mycobacterium leprae
ugggcagcuugaacgccgcgag

SEQ ID NO: 3238748 - RNA, 15 nt, Mycobacterium leprae
ugggcaguaucaucg

SEQ ID NO: 3238749 - RNA, 23 nt, Mycobacterium leprae
ugggccaggucggcuagccgugc

SEQ ID NO: 3238750 - RNA, 14 nt, Mycobacterium leprae
ugggcggcguuggc

SEQ ID NO: 3238751 - RNA, 12 nt, Mycobacterium leprae
ugggcucguguu

SEQ ID NO: 3238752 - RNA, 15 nt, Mycobacterium leprae
ugggcuuccagcaga

SEQ ID NO: 3238753 - RNA, 17 nt, Mycobacterium leprae
ugggcuuccagcagacc

SEQ ID NO: 3238754 - RNA, 19 nt, Mycobacterium leprae
uggggcugcauugugcugc

SEQ ID NO: 3238755 - RNA, 21 nt, Mycobacterium leprae
ugggggucuaauuuuugccga

SEQ ID NO: 3238756 - RNA, 15 nt, Mycobacterium leprae
ugggguguggguggu

SEQ ID NO: 3238757 - RNA, 15 nt, Mycobacterium leprae
uggguaaaaccgguu

SEQ ID NO: 3238758 - RNA, 12 nt, Mycobacterium leprae
uggguagucagc

SEQ ID NO: 3238759 - RNA, 14 nt, Mycobacterium leprae
ugggucaccacuga

SEQ ID NO: 3238760 - RNA, 18 nt, Mycobacterium leprae
ugggucaccacugaaccu

SEQ ID NO: 3238761 - RNA, 20 nt, Mycobacterium leprae
ugggucgaucgcuggucagu

SEQ ID NO: 3238762 - RNA, 18 nt, Mycobacterium leprae
ugggucuggaagcgcuga

SEQ ID NO: 3238763 - RNA, 23 nt, Mycobacterium leprae
ugggugagcugugccggaggcga

SEQ ID NO: 3238764 - RNA, 17 nt, Mycobacterium leprae
uggguggugguguugug

SEQ ID NO: 3238765 - RNA, 18 nt, Mycobacterium leprae
ugggugugucaucaucac

SEQ ID NO: 3238766 - RNA, 13 nt, Mycobacterium leprae
uggguuggguggg

SEQ ID NO: 3238767 - RNA, 15 nt, Mycobacterium leprae
uggguuggguggggg

SEQ ID NO: 3238768 - RNA, 15 nt, Mycobacterium leprae
ugguaaagccguugg

SEQ ID NO: 3238769 - RNA, 19 nt, Mycobacterium leprae
ugguaaagccguuggcuug

SEQ ID NO: 3238770 - RNA, 17 nt, Mycobacterium leprae
ugguacaaucccaccac

SEQ ID NO: 3238771 - RNA, 22 nt, Mycobacterium leprae
ugguaguggcgaguggcuauga

SEQ ID NO: 3238772 - RNA, 18 nt, Mycobacterium leprae
uggucaagugucgggugg

SEQ ID NO: 3238773 - RNA, 17 nt, Mycobacterium leprae
uggucacaccuggugug

SEQ ID NO: 3238774 - RNA, 15 nt, Mycobacterium leprae
uggucacacuggugg

SEQ ID NO: 3238775 - RNA, 13 nt, Mycobacterium leprae
uggucaccgcugu

SEQ ID NO: 3238776 - RNA, 14 nt, Mycobacterium leprae
uggucaccgcugug

SEQ ID NO: 3238777 - RNA, 20 nt, Mycobacterium leprae
uggucacgguugcccgcugc

SEQ ID NO: 3238778 - RNA, 14 nt, Mycobacterium leprae
uggucagcaguucu

SEQ ID NO: 3238779 - RNA, 17 nt, Mycobacterium leprae
uggucagcaugcccaga

SEQ ID NO: 3238780 - RNA, 19 nt, Mycobacterium leprae
uggucagguccaacgcggc

SEQ ID NO: 3238781 - RNA, 18 nt, Mycobacterium leprae
uggucccgcagccgcguc

SEQ ID NO: 3238782 - RNA, 17 nt, Mycobacterium leprae
ugguccuggcugcgaug

SEQ ID NO: 3238783 - RNA, 21 nt, Mycobacterium leprae
uggucgacgguaaguuuucag

SEQ ID NO: 3238784 - RNA, 16 nt, Mycobacterium leprae
uggucgagcagcucca

SEQ ID NO: 3238785 - RNA, 19 nt, Mycobacterium leprae
uggucgagcagcuccagcu

SEQ ID NO: 3238786 - RNA, 21 nt, Mycobacterium leprae
uggucgagcagcuccagcucg

SEQ ID NO: 3238787 - RNA, 18 nt, Mycobacterium leprae
uggucgauauccccgacg

SEQ ID NO: 3238788 - RNA, 13 nt, Mycobacterium leprae
uggucgcuuguuc

SEQ ID NO: 3238789 - RNA, 14 nt, Mycobacterium leprae
uggucgcuuguucg

SEQ ID NO: 3238790 - RNA, 23 nt, Mycobacterium leprae
uggucucaaugaccgcaccgauc

SEQ ID NO: 3238791 - RNA, 15 nt, Mycobacterium leprae
uggucucacgcuggg

SEQ ID NO: 3238792 - RNA, 22 nt, Mycobacterium leprae
uggugaauagcuaaagugcugc

SEQ ID NO: 3238793 - RNA, 20 nt, Mycobacterium leprae
uggugacaacgccgccaagu

SEQ ID NO: 3238794 - RNA, 12 nt, Mycobacterium leprae
uggugauaaauu

SEQ ID NO: 3238795 - RNA, 19 nt, Mycobacterium leprae
uggugcaagggauaacauc

SEQ ID NO: 3238796 - RNA, 16 nt, Mycobacterium leprae
uggugccgaucccggc

SEQ ID NO: 3238797 - RNA, 15 nt, Mycobacterium leprae
uggugccguccucgu

SEQ ID NO: 3238798 - RNA, 17 nt, Mycobacterium leprae
uggugcuccgaugcagc

SEQ ID NO: 3238799 - RNA, 13 nt, Mycobacterium leprae
uggugcugcccga

SEQ ID NO: 3238800 - RNA, 17 nt, Mycobacterium leprae
uggugggcacaucagcc

SEQ ID NO: 3238801 - RNA, 14 nt, Mycobacterium leprae
uggugggugaaaug

SEQ ID NO: 3238802 - RNA, 22 nt, Mycobacterium leprae
uggugguuauuuuuugcugguu

SEQ ID NO: 3238803 - RNA, 22 nt, Mycobacterium leprae
ugguguccuagguccacuugac

SEQ ID NO: 3238804 - RNA, 22 nt, Mycobacterium leprae
uggugugcguugccugaaaacu

SEQ ID NO: 3238805 - RNA, 18 nt, Mycobacterium leprae
ugguguguucacgggaua

SEQ ID NO: 3238806 - RNA, 18 nt, Mycobacterium leprae
ugguuagguuggugguga

SEQ ID NO: 3238807 - RNA, 15 nt, Mycobacterium leprae
ugguucauggcaguc

SEQ ID NO: 3238808 - RNA, 12 nt, Mycobacterium leprae
ugguucgucgag

SEQ ID NO: 3238809 - RNA, 21 nt, Mycobacterium leprae
ugguucugcuucgauguguug

SEQ ID NO: 3238810 - RNA, 16 nt, Mycobacterium leprae
ugguuguucaugcucc

SEQ ID NO: 3238811 - RNA, 16 nt, Mycobacterium leprae
ugguuucgaucaugcc

SEQ ID NO: 3238812 - RNA, 18 nt, Mycobacterium leprae
uguaaguaggcgaagagc

SEQ ID NO: 3238813 - RNA, 14 nt, Mycobacterium leprae
uguaaucggccgau

SEQ ID NO: 3238814 - RNA, 16 nt, Mycobacterium leprae
uguaaugcugcugcca

SEQ ID NO: 3238815 - RNA, 15 nt, Mycobacterium leprae
uguaauuacuucggu

SEQ ID NO: 3238816 - RNA, 13 nt, Mycobacterium leprae
uguacaacgccag

SEQ ID NO: 3238817 - RNA, 12 nt, Mycobacterium leprae
uguacagcucuu

SEQ ID NO: 3238818 - RNA, 20 nt, Mycobacterium leprae
uguacagcucuuuucgucug

SEQ ID NO: 3238819 - RNA, 15 nt, Mycobacterium leprae
uguacuuugugugca

SEQ ID NO: 3238820 - RNA, 18 nt, Mycobacterium leprae
uguacuuugugugcaugu

SEQ ID NO: 3238821 - RNA, 14 nt, Mycobacterium leprae
uguagcugcgaguc

SEQ ID NO: 3238822 - RNA, 14 nt, Mycobacterium leprae
uguagggaaucggc

SEQ ID NO: 3238823 - RNA, 20 nt, Mycobacterium leprae
uguagugcacagaauuugcc

SEQ ID NO: 3238824 - RNA, 13 nt, Mycobacterium leprae
uguaucguugcgg

SEQ ID NO: 3238825 - RNA, 14 nt, Mycobacterium leprae
ugucaagcacugca

SEQ ID NO: 3238826 - RNA, 20 nt, Mycobacterium leprae
ugucaagcacugcaguaacc

SEQ ID NO: 3238827 - RNA, 15 nt, Mycobacterium leprae
ugucaccagauugga

SEQ ID NO: 3238828 - RNA, 13 nt, Mycobacterium leprae
ugucaccugaaag

SEQ ID NO: 3238829 - RNA, 20 nt, Mycobacterium leprae
ugucaccuguuucagcgugg

SEQ ID NO: 3238830 - RNA, 12 nt, Mycobacterium leprae
ugucacgccggu

SEQ ID NO: 3238831 - RNA, 14 nt, Mycobacterium leprae
ugucagagugcaga

SEQ ID NO: 3238832 - RNA, 22 nt, Mycobacterium leprae
ugucagcagcaguuuccaacaa

SEQ ID NO: 3238833 - RNA, 13 nt, Mycobacterium leprae
ugucagguggcuu

SEQ ID NO: 3238834 - RNA, 23 nt, Mycobacterium leprae
uguccaccaaggccgugucggua

SEQ ID NO: 3238835 - RNA, 15 nt, Mycobacterium leprae
uguccaccgaaccca

SEQ ID NO: 3238836 - RNA, 15 nt, Mycobacterium leprae
uguccacucggacac

SEQ ID NO: 3238837 - RNA, 18 nt, Mycobacterium leprae
uguccacuuaccgcggcg

SEQ ID NO: 3238838 - RNA, 19 nt, Mycobacterium leprae
ugucccaccgaguuuuugu

SEQ ID NO: 3238839 - RNA, 20 nt, Mycobacterium leprae
uguccgauuaaucuacccac

SEQ ID NO: 3238840 - RNA, 21 nt, Mycobacterium leprae
uguccgcaaaaugcuccccca

SEQ ID NO: 3238841 - RNA, 16 nt, Mycobacterium leprae
uguccgggccgcaaca

SEQ ID NO: 3238842 - RNA, 14 nt, Mycobacterium leprae
uguccuacagcagu

SEQ ID NO: 3238843 - RNA, 20 nt, Mycobacterium leprae
uguccuacagcaguguucag

SEQ ID NO: 3238844 - RNA, 16 nt, Mycobacterium leprae
uguccuugccggcgcc

SEQ ID NO: 3238845 - RNA, 20 nt, Mycobacterium leprae
ugucgacgggaagugguggc

SEQ ID NO: 3238846 - RNA, 22 nt, Mycobacterium leprae
ugucgacguuccggccuucguc

SEQ ID NO: 3238847 - RNA, 23 nt, Mycobacterium leprae
ugucgacguuccggccuucguca

SEQ ID NO: 3238848 - RNA, 19 nt, Mycobacterium leprae
ugucgagcggaccauggcg

SEQ ID NO: 3238849 - RNA, 19 nt, Mycobacterium leprae
ugucggaaaaacggcuggc

SEQ ID NO: 3238850 - RNA, 21 nt, Mycobacterium leprae
ugucggaccacucuggcuagc

SEQ ID NO: 3238851 - RNA, 19 nt, Mycobacterium leprae
ugucggcggcuuguugacc

SEQ ID NO: 3238852 - RNA, 14 nt, Mycobacterium leprae
ugucggcuaaaauc

SEQ ID NO: 3238853 - RNA, 18 nt, Mycobacterium leprae
ugucggguggucagcagu

SEQ ID NO: 3238854 - RNA, 13 nt, Mycobacterium leprae
ugucgguggugga

SEQ ID NO: 3238855 - RNA, 13 nt, Mycobacterium leprae
ugucggugguggg

SEQ ID NO: 3238856 - RNA, 20 nt, Mycobacterium leprae
ugucuaaucauucuguugca

SEQ ID NO: 3238857 - RNA, 20 nt, Mycobacterium leprae
ugucucggugucggacuugu

SEQ ID NO: 3238858 - RNA, 17 nt, Mycobacterium leprae
ugucugcggauuuugcc

SEQ ID NO: 3238859 - RNA, 15 nt, Mycobacterium leprae
ugucugucagcacau

SEQ ID NO: 3238860 - RNA, 16 nt, Mycobacterium leprae
ugucugucggcuaaaa

SEQ ID NO: 3238861 - RNA, 12 nt, Mycobacterium leprae
ugucugugagga

SEQ ID NO: 3238862 - RNA, 15 nt, Mycobacterium leprae
ugucugugaggaauu

SEQ ID NO: 3238863 - RNA, 16 nt, Mycobacterium leprae
ugucuuccaguggcug

SEQ ID NO: 3238864 - RNA, 23 nt, Mycobacterium leprae
ugucuucuagagcugugccgaca

SEQ ID NO: 3238865 - RNA, 22 nt, Mycobacterium leprae
ugugaaaaagcacacgagacca

SEQ ID NO: 3238866 - RNA, 16 nt, Mycobacterium leprae
ugugaacgacaccacc

SEQ ID NO: 3238867 - RNA, 14 nt, Mycobacterium leprae
cgacuaagccgccg

SEQ ID NO: 3238868 - RNA, 23 nt, Mycobacterium leprae
cgacuaagccgccgaacaagcca

SEQ ID NO: 3238869 - RNA, 14 nt, Mycobacterium leprae
cgacuacccgagua

SEQ ID NO: 3238870 - RNA, 16 nt, Mycobacterium leprae
cgacuauuagugugga

SEQ ID NO: 3238871 - RNA, 16 nt, Mycobacterium leprae
cgacucaccgguacac

SEQ ID NO: 3238872 - RNA, 18 nt, Mycobacterium leprae
cgacuccgcaagaugccc

SEQ ID NO: 3238873 - RNA, 15 nt, Mycobacterium leprae
cgacucgagcaaugc

SEQ ID NO: 3238874 - RNA, 15 nt, Mycobacterium leprae
cgacucgcgauccca

SEQ ID NO: 3238875 - RNA, 13 nt, Mycobacterium leprae
cgacucggcgcca

SEQ ID NO: 3238876 - RNA, 17 nt, Mycobacterium leprae
cgacucggcgccaucga

SEQ ID NO: 3238877 - RNA, 17 nt, Mycobacterium leprae
cgacugaccagcgaucg

SEQ ID NO: 3238878 - RNA, 14 nt, Mycobacterium leprae
cgacugcaacucga

SEQ ID NO: 3238879 - RNA, 18 nt, Mycobacterium leprae
cgacuguauugccguaga

SEQ ID NO: 3238880 - RNA, 22 nt, Mycobacterium leprae
cgacuguuguggucaacgggac

SEQ ID NO: 3238881 - RNA, 14 nt, Mycobacterium leprae
cgacuguuguugua

SEQ ID NO: 3238882 - RNA, 17 nt, Mycobacterium leprae
cgacuuccggcccaacg

SEQ ID NO: 3238883 - RNA, 20 nt, Mycobacterium leprae
cgacuucgcagccaccgacg

SEQ ID NO: 3238884 - RNA, 12 nt, Mycobacterium leprae
cgacuugaccag

SEQ ID NO: 3238885 - RNA, 20 nt, Mycobacterium leprae
cgacuugaccagccgcagca

SEQ ID NO: 3238886 - RNA, 18 nt, Mycobacterium leprae
cgacuugccgaagccggg

SEQ ID NO: 3238887 - RNA, 19 nt, Mycobacterium leprae
cgacuugcugccacauguu

SEQ ID NO: 3238888 - RNA, 13 nt, Mycobacterium leprae
cgagaaaacucga

SEQ ID NO: 3238889 - RNA, 17 nt, Mycobacterium leprae
cgagaaaaucagaugua

SEQ ID NO: 3238890 - RNA, 12 nt, Mycobacterium leprae
cgagaagcagcu

SEQ ID NO: 3238891 - RNA, 23 nt, Mycobacterium leprae
cgagaagccccauggcacggcga

SEQ ID NO: 3238892 - RNA, 21 nt, Mycobacterium leprae
cgagaauuuugugcugcgcgg

SEQ ID NO: 3238893 - RNA, 20 nt, Mycobacterium leprae
cgagacaugauugcagaugu

SEQ ID NO: 3238894 - RNA, 21 nt, Mycobacterium leprae
cgagaccagggguguugcacc

SEQ ID NO: 3238895 - RNA, 18 nt, Mycobacterium leprae
cgagaccaguugcacauc

SEQ ID NO: 3238896 - RNA, 16 nt, Mycobacterium leprae
cgagaccaugaccagg

SEQ ID NO: 3238897 - RNA, 17 nt, Mycobacterium leprae
cgagaguguagcaaggu

SEQ ID NO: 3238898 - RNA, 21 nt, Mycobacterium leprae
cgagaguuagaugucgcagcg

SEQ ID NO: 3238899 - RNA, 19 nt, Mycobacterium leprae
cgagaucacaguccugccc

SEQ ID NO: 3238900 - RNA, 15 nt, Mycobacterium leprae
cgagaucagugcaau

SEQ ID NO: 3238901 - RNA, 16 nt, Mycobacterium leprae
cgagcaaccaacuuca

SEQ ID NO: 3238902 - RNA, 18 nt, Mycobacterium leprae
cgagcaaccaacuucacu

SEQ ID NO: 3238903 - RNA, 11 nt, Mycobacterium leprae
cgagcaaccuu

SEQ ID NO: 3238904 - RNA, 22 nt, Mycobacterium leprae
cgagcaaguuugagaacagccu

SEQ ID NO: 3238905 - RNA, 16 nt, Mycobacterium leprae
cgagcagccacccgca

SEQ ID NO: 3238906 - RNA, 15 nt, Mycobacterium leprae
cgagcagccgaccgc

SEQ ID NO: 3238907 - RNA, 18 nt, Mycobacterium leprae
cgagcagccgaccgcccg

SEQ ID NO: 3238908 - RNA, 21 nt, Mycobacterium leprae
cgagcaguaguccucugcggu

SEQ ID NO: 3238909 - RNA, 16 nt, Mycobacterium leprae
cgagcccagugugucg

SEQ ID NO: 3238910 - RNA, 16 nt, Mycobacterium leprae
cgagccccggaacggg

SEQ ID NO: 3238911 - RNA, 22 nt, Mycobacterium leprae
cgagccgacaaucgagcacggc

SEQ ID NO: 3238912 - RNA, 17 nt, Mycobacterium leprae
cgagcgauacacagccg

SEQ ID NO: 3238913 - RNA, 17 nt, Mycobacterium leprae
gucugucggcuaaaauc

SEQ ID NO: 3238914 - RNA, 20 nt, Mycobacterium leprae
gucuguggcgauagccagaa

SEQ ID NO: 3238915 - RNA, 13 nt, Mycobacterium leprae
gucuuaagacaca

SEQ ID NO: 3238916 - RNA, 19 nt, Mycobacterium leprae
gucuuccaguggcugcacc

SEQ ID NO: 3238917 - RNA, 20 nt, Mycobacterium leprae
gucuuccaguggcugcaccg

SEQ ID NO: 3238918 - RNA, 21 nt, Mycobacterium leprae
gucuuccggaaaacugccggu

SEQ ID NO: 3238919 - RNA, 14 nt, Mycobacterium leprae
gucuucuagagcug

SEQ ID NO: 3238920 - RNA, 20 nt, Mycobacterium leprae
gucuucuccgggcugggacg

SEQ ID NO: 3238921 - RNA, 22 nt, Mycobacterium leprae
gucuucuuggcgcugagcaguc

SEQ ID NO: 3238922 - RNA, 23 nt, Mycobacterium leprae
gucuuggacaucacuugcugacc

SEQ ID NO: 3238923 - RNA, 20 nt, Mycobacterium leprae
gucuuucucauuguggcugg

SEQ ID NO: 3238924 - RNA, 16 nt, Mycobacterium leprae
gugaaacccuucacaa

SEQ ID NO: 3238925 - RNA, 16 nt, Mycobacterium leprae
gugaaaguaggcacag

SEQ ID NO: 3238926 - RNA, 16 nt, Mycobacterium leprae
gugaaauucuucucgg

SEQ ID NO: 3238927 - RNA, 20 nt, Mycobacterium leprae
gugaacacgcugaucgcuga

SEQ ID NO: 3238928 - RNA, 21 nt, Mycobacterium leprae
gugaacuugaaaccggccgcg

SEQ ID NO: 3238929 - RNA, 20 nt, Mycobacterium leprae
gugaaguuuauguuguucaa

SEQ ID NO: 3238930 - RNA, 13 nt, Mycobacterium leprae
gugaaucagucug

SEQ ID NO: 3238931 - RNA, 18 nt, Mycobacterium leprae
gugaaucaugccgcagca

SEQ ID NO: 3238932 - RNA, 16 nt, Mycobacterium leprae
gugaauccgcugcaau

SEQ ID NO: 3238933 - RNA, 21 nt, Mycobacterium leprae
gugaccgcggugcagugccgc

SEQ ID NO: 3238934 - RNA, 20 nt, Mycobacterium leprae
gugaccgggccggccgcgga

SEQ ID NO: 3238935 - RNA, 19 nt, Mycobacterium leprae
gugaccgugcagcugccaa

SEQ ID NO: 3238936 - RNA, 21 nt, Mycobacterium leprae
gugacgacuugcccguaguug

SEQ ID NO: 3238937 - RNA, 22 nt, Mycobacterium leprae
gugacgccaguguagagggcca

SEQ ID NO: 3238938 - RNA, 17 nt, Mycobacterium leprae
gugacgcuaccgaggaa

SEQ ID NO: 3238939 - RNA, 19 nt, Mycobacterium leprae
gugacggcggcagcuggaa

SEQ ID NO: 3238940 - RNA, 20 nt, Mycobacterium leprae
gugacguguuggucgccagu

SEQ ID NO: 3238941 - RNA, 19 nt, Mycobacterium leprae
gugacuacgcuaaucgcgg

SEQ ID NO: 3238942 - RNA, 18 nt, Mycobacterium leprae
gugagcucaccggcggcg

SEQ ID NO: 3238943 - RNA, 12 nt, Mycobacterium leprae
gugaggaucugc

SEQ ID NO: 3238944 - RNA, 15 nt, Mycobacterium leprae
gugagguguugccga

SEQ ID NO: 3238945 - RNA, 23 nt, Mycobacterium leprae
gugagucgcccagcagguugagg

SEQ ID NO: 3238946 - RNA, 18 nt, Mycobacterium leprae
gugauaaauucuuuugca

SEQ ID NO: 3238947 - RNA, 20 nt, Mycobacterium leprae
gugaucacaucagugcugug

SEQ ID NO: 3238948 - RNA, 21 nt, Mycobacterium leprae
gugaucgacggcuggcagcaa

SEQ ID NO: 3238949 - RNA, 18 nt, Mycobacterium leprae
gugaugaacuucggaauc

SEQ ID NO: 3238950 - RNA, 23 nt, Mycobacterium leprae
gugaugccgaagcagacugaguc

SEQ ID NO: 3238951 - RNA, 17 nt, Mycobacterium leprae
gugauggucgugucuac

SEQ ID NO: 3238952 - RNA, 14 nt, Mycobacterium leprae
gugauucagcgcug

SEQ ID NO: 3238953 - RNA, 16 nt, Mycobacterium leprae
gugauucagcgcugau

SEQ ID NO: 3238954 - RNA, 15 nt, Mycobacterium leprae
gugauugccgcgguc

SEQ ID NO: 3238955 - RNA, 15 nt, Mycobacterium leprae
gugcaaauggcacug

SEQ ID NO: 3238956 - RNA, 21 nt, Mycobacterium leprae
gugcaagugcaccaucugcuc

SEQ ID NO: 3238957 - RNA, 20 nt, Mycobacterium leprae
gugcacaaccuggaggccaa

SEQ ID NO: 3238958 - RNA, 14 nt, Mycobacterium leprae
gugcaccagcucac

SEQ ID NO: 3238959 - RNA, 14 nt, Mycobacterium leprae
gugcacggcgagga

SEQ ID NO: 3238960 - RNA, 19 nt, Mycobacterium leprae
gugcacugcuucggccagc

SEQ ID NO: 3238961 - RNA, 14 nt, Mycobacterium leprae
gugcacugguggug

SEQ ID NO: 3238962 - RNA, 16 nt, Mycobacterium leprae
gugcacuggugguggc

SEQ ID NO: 3238963 - RNA, 14 nt, Mycobacterium leprae
gugcagcugccaac

SEQ ID NO: 3238964 - RNA, 14 nt, Mycobacterium leprae
gugcaggauugcgu

SEQ ID NO: 3238965 - RNA, 21 nt, Mycobacterium leprae
gugcaggcugcauccugcagc

SEQ ID NO: 3238966 - RNA, 17 nt, Mycobacterium leprae
gugcauccgccacaugu

SEQ ID NO: 3238967 - RNA, 18 nt, Mycobacterium leprae
gugcauguucuguugugg

SEQ ID NO: 3238968 - RNA, 19 nt, Mycobacterium leprae
gugccaacucggccgccag

SEQ ID NO: 3238969 - RNA, 18 nt, Mycobacterium leprae
gugccauuggugggauga

SEQ ID NO: 3238970 - RNA, 19 nt, Mycobacterium leprae
gugccccagucgccagagc

SEQ ID NO: 3238971 - RNA, 19 nt, Mycobacterium leprae
gugcccgggaaacuagcgg

SEQ ID NO: 3238972 - RNA, 22 nt, Mycobacterium leprae
gugcccgggaaacuagcgggcu

SEQ ID NO: 3238973 - RNA, 15 nt, Mycobacterium leprae
gugccgagcuggccg

SEQ ID NO: 3238974 - RNA, 14 nt, Mycobacterium leprae
gugccgaggcucug

SEQ ID NO: 3238975 - RNA, 23 nt, Mycobacterium leprae
gugccgaucacaaguccgcggga

SEQ ID NO: 3238976 - RNA, 19 nt, Mycobacterium leprae
gugccgcacguugacggau

SEQ ID NO: 3238977 - RNA, 14 nt, Mycobacterium leprae
gugccgcaggcacc

SEQ ID NO: 3238978 - RNA, 14 nt, Mycobacterium leprae
gugccgccgacggc

SEQ ID NO: 3238979 - RNA, 14 nt, Mycobacterium leprae
gugccgcugaccag

SEQ ID NO: 3238980 - RNA, 17 nt, Mycobacterium leprae
gugccgcugcauccgca

SEQ ID NO: 3238981 - RNA, 18 nt, Mycobacterium leprae
gugccgcugcauccgcag

SEQ ID NO: 3238982 - RNA, 20 nt, Mycobacterium leprae
gugccgcugcauccgcagca

SEQ ID NO: 3238983 - RNA, 21 nt, Mycobacterium leprae
gugccgcugcauccgcagcac

SEQ ID NO: 3238984 - RNA, 23 nt, Mycobacterium leprae
gugccggccucgugcugcgugcc

SEQ ID NO: 3238985 - RNA, 20 nt, Mycobacterium leprae
gugccguugcauucgacgga

SEQ ID NO: 3238986 - RNA, 13 nt, Mycobacterium leprae
gugccuauuucac

SEQ ID NO: 3238987 - RNA, 23 nt, Mycobacterium leprae
gugccuucugcacccgccagggc

SEQ ID NO: 3238988 - RNA, 20 nt, Mycobacterium leprae
gugcgacaucuuuucucaag

SEQ ID NO: 3238989 - RNA, 14 nt, Mycobacterium leprae
gugcgcaccggcug

SEQ ID NO: 3238990 - RNA, 20 nt, Mycobacterium leprae
gugcgcagcaauugacgccg

SEQ ID NO: 3238991 - RNA, 13 nt, Mycobacterium leprae
gugcgcauccucg

SEQ ID NO: 3238992 - RNA, 23 nt, Mycobacterium leprae
gugcgcugcgggacggguggggu

SEQ ID NO: 3238993 - RNA, 23 nt, Mycobacterium leprae
gugcggucccaucgcugaccggu

SEQ ID NO: 3238994 - RNA, 14 nt, Mycobacterium leprae
gugcggucuuagca

SEQ ID NO: 3238995 - RNA, 21 nt, Mycobacterium leprae
gugcggugaucgcugccggcg

SEQ ID NO: 3238996 - RNA, 16 nt, Mycobacterium leprae
gugcguaaucgccggu

SEQ ID NO: 3238997 - RNA, 16 nt, Mycobacterium leprae
gugcguagucgaccgg

SEQ ID NO: 3238998 - RNA, 14 nt, Mycobacterium leprae
gugcguuguugaug

SEQ ID NO: 3238999 - RNA, 24 nt, Mycobacterium leprae
gugcuaauucccgaugaccuugaa

SEQ ID NO: 3239000 - RNA, 14 nt, Mycobacterium leprae
gugcuacacggccg

SEQ ID NO: 3239001 - RNA, 19 nt, Mycobacterium leprae
gugcugacagacauggcug

SEQ ID NO: 3239002 - RNA, 21 nt, Mycobacterium leprae
gugcugcaagcaguucggcug

SEQ ID NO: 3239003 - RNA, 16 nt, Mycobacterium leprae
gugcugcacggcugcg

SEQ ID NO: 3239004 - RNA, 21 nt, Mycobacterium leprae
gugcugcauccgacaaagcag

SEQ ID NO: 3239005 - RNA, 15 nt, Mycobacterium leprae
gugcugcgugccugg

SEQ ID NO: 3239006 - RNA, 18 nt, Mycobacterium leprae
gugcugcgugccugguug

SEQ ID NO: 3239007 - RNA, 15 nt, Mycobacterium leprae
gugcugcugcggcgc

SEQ ID NO: 3239008 - RNA, 13 nt, Mycobacterium leprae
gugcugcuguggu

SEQ ID NO: 3239009 - RNA, 17 nt, Mycobacterium leprae
gugcuguuaugugguug

SEQ ID NO: 3239010 - RNA, 21 nt, Mycobacterium leprae
gugcuuggcagcccuugcagc

SEQ ID NO: 3239011 - RNA, 21 nt, Mycobacterium leprae
gugcuuugccgcaguggacac

SEQ ID NO: 3239012 - RNA, 20 nt, Mycobacterium leprae
guggacgaaccggacagcac

SEQ ID NO: 3239013 - RNA, 19 nt, Mycobacterium leprae
guggacucagcaaugcucu

SEQ ID NO: 3239014 - RNA, 18 nt, Mycobacterium leprae
guggacuucugcgcgcac

SEQ ID NO: 3239015 - RNA, 16 nt, Mycobacterium leprae
guggaggugcggcugg

SEQ ID NO: 3239016 - RNA, 18 nt, Mycobacterium leprae
guggaguaaaggguggug

SEQ ID NO: 3239017 - RNA, 20 nt, Mycobacterium leprae
guggaguaaagggugguggg

SEQ ID NO: 3239018 - RNA, 15 nt, Mycobacterium leprae
guggauccaggugcu

SEQ ID NO: 3239019 - RNA, 20 nt, Mycobacterium leprae
guggauccgaaugacaacgg

SEQ ID NO: 3239020 - RNA, 21 nt, Mycobacterium leprae
guggauccgaaugacaacggu

SEQ ID NO: 3239021 - RNA, 23 nt, Mycobacterium leprae
guggaucgcacuuggugccgucc

SEQ ID NO: 3239022 - RNA, 16 nt, Mycobacterium leprae
guggauguuccgcagc

SEQ ID NO: 3239023 - RNA, 15 nt, Mycobacterium leprae
guggcacccacucgg

SEQ ID NO: 3239024 - RNA, 16 nt, Mycobacterium leprae
guggcagauuauuaag

SEQ ID NO: 3239025 - RNA, 21 nt, Mycobacterium leprae
uguuuuaagcgaaaaugaaaa

SEQ ID NO: 3239026 - RNA, 18 nt, Mycobacterium leprae
uguuuuaccagccagacc

SEQ ID NO: 3239027 - RNA, 14 nt, Mycobacterium leprae
uguuuuccugugca

SEQ ID NO: 3239028 - RNA, 18 nt, Mycobacterium leprae
uguuuuguugaacauucu

SEQ ID NO: 3239029 - RNA, 15 nt, Mycobacterium leprae
uuaaaaauuuguucu

SEQ ID NO: 3239030 - RNA, 15 nt, Mycobacterium leprae
uuaaaggccggcaag

SEQ ID NO: 3239031 - RNA, 20 nt, Mycobacterium leprae
uuaacgaguugacccacaag

SEQ ID NO: 3239032 - RNA, 19 nt, Mycobacterium leprae
uuaagacacaguuguuggc

SEQ ID NO: 3239033 - RNA, 16 nt, Mycobacterium leprae
uuaaguagaccagaag

SEQ ID NO: 3239034 - RNA, 19 nt, Mycobacterium leprae
uuaaguggcuggcuuagga

SEQ ID NO: 3239035 - RNA, 22 nt, Mycobacterium leprae
uuaauagaccagcgugugaugu

SEQ ID NO: 3239036 - RNA, 23 nt, Mycobacterium leprae
uuaaucgacucgagcaaugcuga

SEQ ID NO: 3239037 - RNA, 17 nt, Mycobacterium leprae
uuaaucguuucagguga

SEQ ID NO: 3239038 - RNA, 20 nt, Mycobacterium leprae
uuacaaugguguacuccugu

SEQ ID NO: 3239039 - RNA, 15 nt, Mycobacterium leprae
uuacagucacuauaa

SEQ ID NO: 3239040 - RNA, 18 nt, Mycobacterium leprae
uuacauagguagauaaac

SEQ ID NO: 3239041 - RNA, 12 nt, Mycobacterium leprae
uuacccgcggug

SEQ ID NO: 3239042 - RNA, 17 nt, Mycobacterium leprae
uuaccgcauguauuacu

SEQ ID NO: 3239043 - RNA, 22 nt, Mycobacterium leprae
uuaccgcggcggccaacuguug

SEQ ID NO: 3239044 - RNA, 11 nt, Mycobacterium leprae
uuaccggcguu

SEQ ID NO: 3239045 - RNA, 20 nt, Mycobacterium leprae
uuaccggcugcgccguucgu

SEQ ID NO: 3239046 - RNA, 16 nt, Mycobacterium leprae
uuaccucagugucagc

SEQ ID NO: 3239047 - RNA, 24 nt, Mycobacterium leprae
uuaccuucaggucuacucgccuga

SEQ ID NO: 3239048 - RNA, 22 nt, Mycobacterium leprae
uuacgcacgccuugcagcuuca

SEQ ID NO: 3239049 - RNA, 19 nt, Mycobacterium leprae
uuacgcgaucuaccccggc

SEQ ID NO: 3239050 - RNA, 22 nt, Mycobacterium leprae
uuacuauuccggucgucaagcu

SEQ ID NO: 3239051 - RNA, 13 nt, Mycobacterium leprae
uuacucaaugcug

SEQ ID NO: 3239052 - RNA, 18 nt, Mycobacterium leprae
uuacuggcaugagccgac

SEQ ID NO: 3239053 - RNA, 14 nt, Mycobacterium leprae
uuacuuuauauacu

SEQ ID NO: 3239054 - RNA, 14 nt, Mycobacterium leprae
uuagagauacucga

SEQ ID NO: 3239055 - RNA, 12 nt, Mycobacterium leprae
uuagagugcagc

SEQ ID NO: 3239056 - RNA, 22 nt, Mycobacterium leprae
uuagcaugacgucuucuauacu

SEQ ID NO: 3239057 - RNA, 16 nt, Mycobacterium leprae
uuagcccgccgcggcg

SEQ ID NO: 3239058 - RNA, 17 nt, Mycobacterium leprae
uuaggauuucgcuaagu

SEQ ID NO: 3239059 - RNA, 15 nt, Mycobacterium leprae
uuagggcgauucgag

SEQ ID NO: 3239060 - RNA, 13 nt, Mycobacterium leprae
uuaggugugcuag

SEQ ID NO: 3239061 - RNA, 18 nt, Mycobacterium leprae
uuagucuagauaagauaa

SEQ ID NO: 3239062 - RNA, 12 nt, Mycobacterium leprae
uuagugaacagu

SEQ ID NO: 3239063 - RNA, 15 nt, Mycobacterium leprae
uuagugcugcugcgg

SEQ ID NO: 3239064 - RNA, 16 nt, Mycobacterium leprae
uuauacacggugcgug

SEQ ID NO: 3239065 - RNA, 21 nt, Mycobacterium leprae
uuauauuguccgagcuuuucc

SEQ ID NO: 3239066 - RNA, 14 nt, Mycobacterium leprae
uuauccccacaugu

SEQ ID NO: 3239067 - RNA, 16 nt, Mycobacterium leprae
uuaucgaucuaccugg

SEQ ID NO: 3239068 - RNA, 22 nt, Mycobacterium leprae
uugaugcaucaagcugugagug

SEQ ID NO: 3239069 - RNA, 18 nt, Mycobacterium leprae
uugaugccuauauugcuu

SEQ ID NO: 3239070 - RNA, 15 nt, Mycobacterium leprae
uugauugcugcaucu

SEQ ID NO: 3239071 - RNA, 16 nt, Mycobacterium leprae
uugauugggcuuugcc

SEQ ID NO: 3239072 - RNA, 18 nt, Mycobacterium leprae
uugcagauguugcagcag

SEQ ID NO: 3239073 - RNA, 18 nt, Mycobacterium leprae
uugcagcccugagcacca

SEQ ID NO: 3239074 - RNA, 19 nt, Mycobacterium leprae
uugcagcgaggccguggcc

SEQ ID NO: 3239075 - RNA, 19 nt, Mycobacterium leprae
uugcaugagcacuguuacu

SEQ ID NO: 3239076 - RNA, 18 nt, Mycobacterium leprae
uugcaugcaccgacggug

SEQ ID NO: 3239077 - RNA, 20 nt, Mycobacterium leprae
uugccaaggucguuagcgcc

SEQ ID NO: 3239078 - RNA, 20 nt, Mycobacterium leprae
uugccacuuacuaucacgaa

SEQ ID NO: 3239079 - RNA, 19 nt, Mycobacterium leprae
uugccagauagucgagggc

SEQ ID NO: 3239080 - RNA, 16 nt, Mycobacterium leprae
uugccaucgacgccgc

SEQ ID NO: 3239081 - RNA, 17 nt, Mycobacterium leprae
uugccaugcacgccggc

SEQ ID NO: 3239082 - RNA, 16 nt, Mycobacterium leprae
uugccgaauuaccauu

SEQ ID NO: 3239083 - RNA, 19 nt, Mycobacterium leprae
uugccgacgccgugaaucc

SEQ ID NO: 3239084 - RNA, 15 nt, Mycobacterium leprae
uugccgaugauuaca

SEQ ID NO: 3239085 - RNA, 16 nt, Mycobacterium leprae
uugccggggcugcgcu

SEQ ID NO: 3239086 - RNA, 19 nt, Mycobacterium leprae
uugccguagagguccugca

SEQ ID NO: 3239087 - RNA, 17 nt, Mycobacterium leprae
uugccguaguacccggc

SEQ ID NO: 3239088 - RNA, 17 nt, Mycobacterium leprae
uugcgaucaaacucgcu

SEQ ID NO: 3239089 - RNA, 22 nt, Mycobacterium leprae
uugcgcggcguaaacguugacu

SEQ ID NO: 3239090 - RNA, 17 nt, Mycobacterium leprae
uugcggccgaauucgag

SEQ ID NO: 3239091 - RNA, 22 nt, Mycobacterium leprae
uugcggugugggacgugaugca

SEQ ID NO: 3239092 - RNA, 19 nt, Mycobacterium leprae
uugcgguucgcggccacgu

SEQ ID NO: 3239093 - RNA, 13 nt, Mycobacterium leprae
uugcuaacgcuua

SEQ ID NO: 3239094 - RNA, 16 nt, Mycobacterium leprae
uugcuagcggcuucuc

SEQ ID NO: 3239095 - RNA, 13 nt, Mycobacterium leprae
uugcucaacuacu

SEQ ID NO: 3239096 - RNA, 13 nt, Mycobacterium leprae
uugcuccgcagca

SEQ ID NO: 3239097 - RNA, 15 nt, Mycobacterium leprae
uugcuccgcagcacc

SEQ ID NO: 3239098 - RNA, 20 nt, Mycobacterium leprae
uugcucgacgcggaguguaa

SEQ ID NO: 3239099 - RNA, 22 nt, Mycobacterium leprae
uugcugacugcgauccggcaca

SEQ ID NO: 3239100 - RNA, 18 nt, Mycobacterium leprae
uugcuggcggugggugca

SEQ ID NO: 3239101 - RNA, 15 nt, Mycobacterium leprae
uugcuggucagcguc

SEQ ID NO: 3239102 - RNA, 13 nt, Mycobacterium leprae
uugcuugagccug

SEQ ID NO: 3239103 - RNA, 20 nt, Mycobacterium leprae
uuggacaacacguuucugca

SEQ ID NO: 3239104 - RNA, 14 nt, Mycobacterium leprae
uuggaccccaacca

SEQ ID NO: 3239105 - RNA, 19 nt, Mycobacterium leprae
uuggacccgaucgacggca

SEQ ID NO: 3239106 - RNA, 17 nt, Mycobacterium leprae
uuggaccgcgccgcgug

SEQ ID NO: 3239107 - RNA, 19 nt, Mycobacterium leprae
uuggauguaaucguaccaa

SEQ ID NO: 3239108 - RNA, 15 nt, Mycobacterium leprae
uuggcagugugcaug

SEQ ID NO: 3239109 - RNA, 21 nt, Mycobacterium leprae
uuggcauggcgcugguuguuc

SEQ ID NO: 3239110 - RNA, 18 nt, Mycobacterium leprae
uuggccagcagcgggacc

SEQ ID NO: 3239111 - RNA, 13 nt, Mycobacterium leprae
uuggccgccaucu

SEQ ID NO: 3239112 - RNA, 15 nt, Mycobacterium leprae
uuggccggaacagca

SEQ ID NO: 3239113 - RNA, 16 nt, Mycobacterium leprae
uuggccuacuugggcc

SEQ ID NO: 3239114 - RNA, 17 nt, Mycobacterium leprae
uuggcgaguaaaccucg

SEQ ID NO: 3239115 - RNA, 19 nt, Mycobacterium leprae
uuggcgcgcuuucggagau

SEQ ID NO: 3239116 - RNA, 14 nt, Mycobacterium leprae
uuggcucgcucgac

SEQ ID NO: 3239117 - RNA, 18 nt, Mycobacterium leprae
uuggcuuguguggugucc

SEQ ID NO: 3239118 - RNA, 20 nt, Mycobacterium leprae
uuggcuugugugguguccua

SEQ ID NO: 3239119 - RNA, 14 nt, Mycobacterium leprae
uugggacguccauu

SEQ ID NO: 3239120 - RNA, 14 nt, Mycobacterium leprae
uugggagcauacga

SEQ ID NO: 3239121 - RNA, 15 nt, Mycobacterium leprae
uugggagccagggca

SEQ ID NO: 3239122 - RNA, 20 nt, Mycobacterium leprae
uugggagugcuagcggcgcc

SEQ ID NO: 3239123 - RNA, 22 nt, Mycobacterium leprae
uugggaguuuccgccucagggu

SEQ ID NO: 3239124 - RNA, 18 nt, Mycobacterium leprae
uugggaucuuuugaccag

SEQ ID NO: 3239125 - RNA, 17 nt, Mycobacterium leprae
uugggccaucggcagau

SEQ ID NO: 3239126 - RNA, 21 nt, Mycobacterium leprae
uugggccguacaaccgcgaug

SEQ ID NO: 3239127 - RNA, 18 nt, Mycobacterium leprae
uugggcgccucgucggcc

SEQ ID NO: 3239128 - RNA, 18 nt, Mycobacterium leprae
uuggguaaagugaacaau

SEQ ID NO: 3239129 - RNA, 15 nt, Mycobacterium leprae
uugggugguguugug

SEQ ID NO: 3239130 - RNA, 14 nt, Mycobacterium leprae
uuggguuauaccgc

SEQ ID NO: 3239131 - RNA, 19 nt, Mycobacterium leprae
uuggguuugggugguggug

SEQ ID NO: 3239132 - RNA, 17 nt, Mycobacterium leprae
uuggucaaggugaaacu

SEQ ID NO: 3239133 - RNA, 18 nt, Mycobacterium leprae
uuggucguggcagaggcu

SEQ ID NO: 3239134 - RNA, 15 nt, Mycobacterium leprae
uugguggguggcuga

SEQ ID NO: 3239135 - RNA, 13 nt, Mycobacterium leprae
uuggugucuuguc

SEQ ID NO: 3239136 - RNA, 12 nt, Mycobacterium leprae
uuguaaucagcc

SEQ ID NO: 3239137 - RNA, 16 nt, Mycobacterium leprae
uuguagcguucguaga

SEQ ID NO: 3239138 - RNA, 20 nt, Mycobacterium leprae
uuguagcguucguagagcug

SEQ ID NO: 3239139 - RNA, 16 nt, Mycobacterium leprae
uuguaugcgcuaaggu

SEQ ID NO: 3239140 - RNA, 23 nt, Mycobacterium leprae
uugucaccagauuggaaaucgcu

SEQ ID NO: 3239141 - RNA, 13 nt, Mycobacterium leprae
uugucacgccggu

SEQ ID NO: 3239142 - RNA, 17 nt, Mycobacterium leprae
uugucagcuaaaagacg

SEQ ID NO: 3239143 - RNA, 21 nt, Mycobacterium leprae
uugucagguaucucuagaaau

SEQ ID NO: 3239144 - RNA, 13 nt, Mycobacterium leprae
uugucaucggcgu

SEQ ID NO: 3239145 - RNA, 21 nt, Mycobacterium leprae
uugucauggccgcuucugcgu

SEQ ID NO: 3239146 - RNA, 13 nt, Mycobacterium leprae
uuguccgucgcag

SEQ ID NO: 3239147 - RNA, 13 nt, Mycobacterium leprae
uugucguacccaa

SEQ ID NO: 3239148 - RNA, 14 nt, Mycobacterium leprae
uugucguacccaau

SEQ ID NO: 3239149 - RNA, 19 nt, Mycobacterium leprae
uugucguguucguuguucu

SEQ ID NO: 3239150 - RNA, 15 nt, Mycobacterium leprae
uugugaagcugaggc

SEQ ID NO: 3239151 - RNA, 14 nt, Mycobacterium leprae
uugugacugugcca

SEQ ID NO: 3239152 - RNA, 10 nt, Mycobacterium leprae
uugugaguug

SEQ ID NO: 3239153 - RNA, 22 nt, Mycobacterium leprae
uugugccgcugcauccgcagca

SEQ ID NO: 3239154 - RNA, 13 nt, Mycobacterium leprae
uugugcuccugac

SEQ ID NO: 3239155 - RNA, 17 nt, Mycobacterium leprae
uuguggcgcgagcguuu

SEQ ID NO: 3239156 - RNA, 17 nt, Mycobacterium leprae
uuguggggguggaguaa

SEQ ID NO: 3239157 - RNA, 22 nt, Mycobacterium leprae
uuguucggcaggccggccugga

SEQ ID NO: 3239158 - RNA, 20 nt, Mycobacterium leprae
uuguucgguugguuucauag

SEQ ID NO: 3239159 - RNA, 22 nt, Mycobacterium leprae
uuguuggccggguacggacauc

SEQ ID NO: 3239160 - RNA, 19 nt, Mycobacterium leprae
uuuaaauauacuuuacuuu

SEQ ID NO: 3239161 - RNA, 13 nt, Mycobacterium leprae
uuuaacgccugcu

SEQ ID NO: 3239162 - RNA, 16 nt, Mycobacterium leprae
uuuaagcaggcucagc

SEQ ID NO: 3239163 - RNA, 15 nt, Mycobacterium leprae
uuuaaggucaucuac

SEQ ID NO: 3239164 - RNA, 20 nt, Mycobacterium leprae
uuuacauaucgcgaacagcu

SEQ ID NO: 3239165 - RNA, 24 nt, Mycobacterium leprae
uuuaccccggacggccauuggcac

SEQ ID NO: 3239166 - RNA, 15 nt, Mycobacterium leprae
uuuacuguguuguug

SEQ ID NO: 3239167 - RNA, 17 nt, Mycobacterium leprae
uuuagagaagaauuaau

SEQ ID NO: 3239168 - RNA, 12 nt, Mycobacterium leprae
uuuagagauacu

SEQ ID NO: 3239169 - RNA, 12 nt, Mycobacterium leprae
uuuagagugcag

SEQ ID NO: 3239170 - RNA, 19 nt, Mycobacterium leprae
uuuagagugcagcacaaga

SEQ ID NO: 3239171 - RNA, 21 nt, Mycobacterium leprae
uuuagcuugguugacagcaga

SEQ ID NO: 3239172 - RNA, 17 nt, Mycobacterium leprae
uuucaccaaacuggacu

SEQ ID NO: 3239173 - RNA, 21 nt, Mycobacterium leprae
uuucacggucaacggccucac

SEQ ID NO: 3239174 - RNA, 20 nt, Mycobacterium leprae
uuucagcucgauggugccau

SEQ ID NO: 3239175 - RNA, 21 nt, Mycobacterium leprae
uuuccgauguagcacagugga

SEQ ID NO: 3239176 - RNA, 19 nt, Mycobacterium leprae
uuuccgcuaccauccauuu

SEQ ID NO: 3239177 - RNA, 12 nt, Mycobacterium leprae
uuuccuaaaauu

SEQ ID NO: 3239178 - RNA, 21 nt, Mycobacterium leprae
uuucgacaaggucgagugcga

SEQ ID NO: 3239179 - RNA, 18 nt, Mycobacterium leprae
uuucgauccgcucaaagc

SEQ ID NO: 3239180 - RNA, 12 nt, Mycobacterium leprae
uuucgguuagug

SEQ ID NO: 3239181 - RNA, 22 nt, Mycobacterium tuberculosis H37Rv
aaaaaggcggcguuguccccca

SEQ ID NO: 3239182 - RNA, 21 nt, Mycobacterium tuberculosis H37Rv
aaaacccggugaccagcaacc

SEQ ID NO: 3239183 - RNA, 12 nt, Mycobacterium tuberculosis H37Rv
aaaaccgcaccg

SEQ ID NO: 3239184 - RNA, 19 nt, Mycobacterium tuberculosis H37Rv
aaaaccgcaccgucccagu

SEQ ID NO: 3239185 - RNA, 14 nt, Mycobacterium tuberculosis H37Rv
aaaaccgccgcaac

SEQ ID NO: 3239186 - RNA, 12 nt, Mycobacterium tuberculosis H37Rv
aaaaccgcgaac

SEQ ID NO: 3239187 - RNA, 16 nt, Mycobacterium tuberculosis H37Rv
aaaacgaacccaggca

SEQ ID NO: 3239188 - RNA, 23 nt, Mycobacterium tuberculosis H37Rv
aaaagaucuucgccgagaacgau

SEQ ID NO: 3239189 - RNA, 17 nt, Mycobacterium tuberculosis H37Rv
aaaagcccgacacgaaa

SEQ ID NO: 3239190 - RNA, 16 nt, Mycobacterium tuberculosis H37Rv
aaaagguaccgcgugc

SEQ ID NO: 3239191 - RNA, 15 nt, Mycobacterium tuberculosis H37Rv
aaaaucgcccaauuc

SEQ ID NO: 3239192 - RNA, 20 nt, Mycobacterium tuberculosis H37Rv
aaaaugccuuggcagcccag

SEQ ID NO: 3239193 - RNA, 24 nt, Mycobacterium tuberculosis H37Rv
aaaauucaggcgccgucucgcggu

SEQ ID NO: 3239194 - RNA, 19 nt, Mycobacterium tuberculosis H37Rv
aaaauugcuccaccacuga

SEQ ID NO: 3239195 - RNA, 16 nt, Mycobacterium tuberculosis H37Rv
aaacaccagcccggcg

SEQ ID NO: 3239196 - RNA, 20 nt, Mycobacterium tuberculosis H37Rv
aaacaccagcgaggccagcg

SEQ ID NO: 3239197 - RNA, 16 nt, Mycobacterium tuberculosis H37Rv
aaacacguucucacca

SEQ ID NO: 3239198 - RNA, 22 nt, Mycobacterium tuberculosis H37Rv
aaacagcgccaucgaugcggug

SEQ ID NO: 3239199 - RNA, 17 nt, Mycobacterium tuberculosis H37Rv
aaacagcuugcugcgca

SEQ ID NO: 3239200 - RNA, 16 nt, Mycobacterium tuberculosis H37Rv
aaacagguaagcagcc

SEQ ID NO: 3239201 - RNA, 18 nt, Mycobacterium tuberculosis H37Rv
aaacaucucggcgcagcc

SEQ ID NO: 3239202 - RNA, 13 nt, Mycobacterium tuberculosis H37Rv
aaaccacccccac

SEQ ID NO: 3239203 - RNA, 17 nt, Mycobacterium tuberculosis H37Rv
aaaccacccgcaacaca

SEQ ID NO: 3239204 - RNA, 14 nt, Mycobacterium tuberculosis H37Rv
aaaccacuggaugg

SEQ ID NO: 3239205 - RNA, 17 nt, Mycobacterium tuberculosis H37Rv
aaaccagauugccgagc

SEQ ID NO: 3239206 - RNA, 21 nt, Mycobacterium tuberculosis H37Rv
aaaccagauugccgagcccag

SEQ ID NO: 3239207 - RNA, 13 nt, Mycobacterium tuberculosis H37Rv
aaaccagccacca

SEQ ID NO: 3239208 - RNA, 17 nt, Mycobacterium tuberculosis H37Rv
aaaccagguggccaggc

SEQ ID NO: 3239209 - RNA, 14 nt, Mycobacterium tuberculosis H37Rv
aaaccaguuggcga

SEQ ID NO: 3239210 - RNA, 20 nt, Mycobacterium tuberculosis H37Rv
aaacccagcgacgcggccag

SEQ ID NO: 3239211 - RNA, 18 nt, Mycobacterium tuberculosis H37Rv
aaacccgaugacuacucc

SEQ ID NO: 3239212 - RNA, 14 nt, Mycobacterium tuberculosis H37Rv
aaacccgauguggc

SEQ ID NO: 3239213 - RNA, 23 nt, Mycobacterium tuberculosis H37Rv
aaacccggcccagguugccaacc

SEQ ID NO: 3239214 - RNA, 15 nt, Mycobacterium tuberculosis H37Rv
aaacccugcacccga

SEQ ID NO: 3239215 - RNA, 12 nt, Mycobacterium tuberculosis H37Rv
aaacccugcugc

SEQ ID NO: 3239216 - RNA, 13 nt, Mycobacterium tuberculosis H37Rv
aaacccugcugcg

SEQ ID NO: 3239217 - RNA, 12 nt, Mycobacterium tuberculosis H37Rv
aaaccgcaccgu

SEQ ID NO: 3239218 - RNA, 14 nt, Mycobacterium tuberculosis H37Rv
aaaccgcagcgcga

SEQ ID NO: 3239219 - RNA, 17 nt, Mycobacterium tuberculosis H37Rv
aaaccgcagucgcggca

SEQ ID NO: 3239220 - RNA, 22 nt, Mycobacterium tuberculosis H37Rv
aaaccugcaugcccagaaaacc

SEQ ID NO: 3239221 - RNA, 22 nt, Mycobacterium tuberculosis H37Rv
aaaccuggcuaucgcagaacgg

SEQ ID NO: 3239222 - RNA, 21 nt, Mycobacterium tuberculosis H37Rv
aaaccuugcggcagaccaagc

SEQ ID NO: 3239223 - RNA, 17 nt, Mycobacterium tuberculosis H37Rv
aaacgauugcugcggcu

SEQ ID NO: 3239224 - RNA, 13 nt, Mycobacterium tuberculosis H37Rv
aaacgccgaccgc

SEQ ID NO: 3239225 - RNA, 21 nt, Mycobacterium tuberculosis H37Rv
aaccgcgcguaggccgcuaug

SEQ ID NO: 3239226 - RNA, 13 nt, Mycobacterium tuberculosis H37Rv
aaccgcggaucga

SEQ ID NO: 3239227 - RNA, 17 nt, Mycobacterium tuberculosis H37Rv
aaccgcgucgaagccgg

SEQ ID NO: 3239228 - RNA, 19 nt, Mycobacterium tuberculosis H37Rv
aaccgcguuaugccaggcg

SEQ ID NO: 3239229 - RNA, 23 nt, Mycobacterium tuberculosis H37Rv
aaccgcucagcgcagcaucgucg

SEQ ID NO: 3239230 - RNA, 21 nt, Mycobacterium tuberculosis H37Rv
aaccgcucggcgaugauguug

SEQ ID NO: 3239231 - RNA, 23 nt, Mycobacterium tuberculosis H37Rv
aaccgcugcggguagccgucgau

SEQ ID NO: 3239232 - RNA, 19 nt, Mycobacterium tuberculosis H37Rv
aaccggaccuggguggcgu

SEQ ID NO: 3239233 - RNA, 20 nt, Mycobacterium tuberculosis H37Rv
aaccggccaucgaccguccg

SEQ ID NO: 3239234 - RNA, 19 nt, Mycobacterium tuberculosis H37Rv
aaccggcgcaguagccgac

SEQ ID NO: 3239235 - RNA, 20 nt, Mycobacterium tuberculosis H37Rv
aaccggcgcuaaaccgucgc

SEQ ID NO: 3239236 - RNA, 22 nt, Mycobacterium tuberculosis H37Rv
aaccggcggcagcgaucggggc

SEQ ID NO: 3239237 - RNA, 23 nt, Mycobacterium tuberculosis H37Rv
aaccggcgguuuuggggugcuuu

SEQ ID NO: 3239238 - RNA, 15 nt, Mycobacterium tuberculosis H37Rv
aaccgggcaaaucaa

SEQ ID NO: 3239239 - RNA, 19 nt, Mycobacterium tuberculosis H37Rv
aaccgggcaaaucaagcac

SEQ ID NO: 3239240 - RNA, 20 nt, Mycobacterium tuberculosis H37Rv
aaccgggcaaaucaagcaca

SEQ ID NO: 3239241 - RNA, 13 nt, Mycobacterium tuberculosis H37Rv
aaccgggccggcu

SEQ ID NO: 3239242 - RNA, 14 nt, Mycobacterium tuberculosis H37Rv
aaccggucgcagug

SEQ ID NO: 3239243 - RNA, 15 nt, Mycobacterium tuberculosis H37Rv
aaccggucgcagugc

SEQ ID NO: 3239244 - RNA, 15 nt, Mycobacterium tuberculosis H37Rv
aaccgguguagcagc

SEQ ID NO: 3239245 - RNA, 14 nt, Mycobacterium tuberculosis H37Rv
aaccgguucgucga

SEQ ID NO: 3239246 - RNA, 14 nt, Mycobacterium tuberculosis H37Rv
aaccgucagcgcgc

SEQ ID NO: 3239247 - RNA, 20 nt, Mycobacterium tuberculosis H37Rv
aaccguccccggcguccgac

SEQ ID NO: 3239248 - RNA, 19 nt, Mycobacterium tuberculosis H37Rv
aaccgugagcaccagcagc

SEQ ID NO: 3239249 - RNA, 21 nt, Mycobacterium tuberculosis H37Rv
aaccgugagcaccagcagcac

SEQ ID NO: 3239250 - RNA, 19 nt, Mycobacterium tuberculosis H37Rv
aaccgugcacgucagcgga

SEQ ID NO: 3239251 - RNA, 15 nt, Mycobacterium tuberculosis H37Rv
aaccgugcugggcau

SEQ ID NO: 3239252 - RNA, 22 nt, Mycobacterium tuberculosis H37Rv
aaccgugguguacccgccucgg

SEQ ID NO: 3239253 - RNA, 19 nt, Mycobacterium tuberculosis H37Rv
aaccucgacgcccgcccug

SEQ ID NO: 3239254 - RNA, 12 nt, Mycobacterium tuberculosis H37Rv
aaccucgccggu

SEQ ID NO: 3239255 - RNA, 16 nt, Mycobacterium tuberculosis H37Rv
aaccugcgaccaggcg

SEQ ID NO: 3239256 - RNA, 12 nt, Mycobacterium tuberculosis H37Rv
aaccugcuggga

SEQ ID NO: 3239257 - RNA, 15 nt, Mycobacterium tuberculosis H37Rv
aaccuggcggucccg

SEQ ID NO: 3239258 - RNA, 17 nt, Mycobacterium tuberculosis H37Rv
aacgacaacacccacgu

SEQ ID NO: 3239259 - RNA, 21 nt, Mycobacterium tuberculosis H37Rv
aacgacaacacccacgugcug

SEQ ID NO: 3239260 - RNA, 21 nt, Mycobacterium tuberculosis H37Rv
aacgacaucaccaccgcacgg

SEQ ID NO: 3239261 - RNA, 19 nt, Mycobacterium tuberculosis H37Rv
aacgaccuccacgcccugg

SEQ ID NO: 3239262 - RNA, 13 nt, Mycobacterium tuberculosis H37Rv
aacgacgccaccg

SEQ ID NO: 3239263 - RNA, 21 nt, Mycobacterium tuberculosis H37Rv
aacgacggccgucgccccaaa

SEQ ID NO: 3239264 - RNA, 22 nt, Mycobacterium tuberculosis H37Rv
aacgacgucgucgccgccgaaa

SEQ ID NO: 3239265 - RNA, 14 nt, Mycobacterium tuberculosis H37Rv
aacgacguugaucc

SEQ ID NO: 3239266 - RNA, 16 nt, Mycobacterium tuberculosis H37Rv
aacgacucgagagcga

SEQ ID NO: 3239267 - RNA, 22 nt, Mycobacterium tuberculosis H37Rv
aacgacugaucaagugccagcg

SEQ ID NO: 3239268 - RNA, 21 nt, Mycobacterium tuberculosis H37Rv
aacgacuggguggugcucacc

SEQ ID NO: 3239269 - RNA, 15 nt, Mycobacterium tuberculosis H37Rv
aacgagauucgucca

SEQ ID NO: 3239270 - RNA, 16 nt, Mycobacterium tuberculosis H37Rv
aacgaggucugcggcc

SEQ ID NO: 3239271 - RNA, 16 nt, Mycobacterium tuberculosis H37Rv
aacgaguaggcggcuc

SEQ ID NO: 3239272 - RNA, 18 nt, Mycobacterium tuberculosis H37Rv
aacgagucagugccaucu

SEQ ID NO: 3239273 - RNA, 21 nt, Mycobacterium tuberculosis H37Rv
aacgauagaacguagcgccca

SEQ ID NO: 3239274 - RNA, 15 nt, Mycobacterium tuberculosis H37Rv
aacgaucagucgucu

SEQ ID NO: 3239275 - RNA, 18 nt, Mycobacterium tuberculosis H37Rv
aacgaucagucgucuuga

SEQ ID NO: 3239276 - RNA, 17 nt, Mycobacterium tuberculosis H37Rv
aacgaucgacaccaggg

SEQ ID NO: 3239277 - RNA, 18 nt, Mycobacterium tuberculosis H37Rv
aacgaucgcgccgucguc

SEQ ID NO: 3239278 - RNA, 22 nt, Mycobacterium tuberculosis H37Rv
aacgauggggcaagcccaaaaa

SEQ ID NO: 3239279 - RNA, 23 nt, Mycobacterium tuberculosis H37Rv
aacgauggggcaagcccaaaaag

SEQ ID NO: 3239280 - RNA, 20 nt, Mycobacterium tuberculosis H37Rv
aacgaugguguaacggcggc

SEQ ID NO: 3239281 - RNA, 14 nt, Mycobacterium tuberculosis H37Rv
aacgauguccgcgc

SEQ ID NO: 3239282 - RNA, 13 nt, Mycobacterium tuberculosis H37Rv
aacgcaaagacag

SEQ ID NO: 3239283 - RNA, 22 nt, Mycobacterium tuberculosis H37Rv
aacgcacccaucgugcugaagc

SEQ ID NO: 3239284 - RNA, 13 nt, Mycobacterium tuberculosis H37Rv
aacgcagccagcg

SEQ ID NO: 3239285 - RNA, 13 nt, Mycobacterium tuberculosis H37Rv
aacgccagcagcg

SEQ ID NO: 3239286 - RNA, 14 nt, Mycobacterium tuberculosis H37Rv
aacgccagcagcgc

SEQ ID NO: 3239287 - RNA, 14 nt, Mycobacterium tuberculosis H37Rv
aacgccaugccggg

SEQ ID NO: 3239288 - RNA, 15 nt, Mycobacterium tuberculosis H37Rv
aacgccauuuccugg

SEQ ID NO: 3239289 - RNA, 19 nt, Mycobacterium tuberculosis H37Rv
aacgcccaacgucgccagg

SEQ ID NO: 3239290 - RNA, 17 nt, Mycobacterium tuberculosis H37Rv
aacgccccggcgcggcc

SEQ ID NO: 3239291 - RNA, 16 nt, Mycobacterium tuberculosis H37Rv
aacgcccgggcggcgu

SEQ ID NO: 3239292 - RNA, 18 nt, Mycobacterium tuberculosis H37Rv
aacgcccguguugaagaa

SEQ ID NO: 3239293 - RNA, 22 nt, Mycobacterium tuberculosis H37Rv
aacgcccguguugaagaagccc

SEQ ID NO: 3239294 - RNA, 15 nt, Mycobacterium tuberculosis H37Rv
aacgccgccagcaga

SEQ ID NO: 3239295 - RNA, 14 nt, Mycobacterium tuberculosis H37Rv
aacgccggcaccga

SEQ ID NO: 3239296 - RNA, 15 nt, Mycobacterium tuberculosis H37Rv
aacgccggcaccgac

SEQ ID NO: 3239297 - RNA, 20 nt, Mycobacterium tuberculosis H37Rv
aacgccggcgacggcgucac

SEQ ID NO: 3239298 - RNA, 18 nt, Mycobacterium tuberculosis H37Rv
aacgccggguucgccgga

SEQ ID NO: 3239299 - RNA, 15 nt, Mycobacterium tuberculosis H37Rv
aacgccgugccguac

SEQ ID NO: 3239300 - RNA, 19 nt, Mycobacterium tuberculosis H37Rv
aacgccucgccggccgcca

SEQ ID NO: 3239301 - RNA, 22 nt, Mycobacterium tuberculosis H37Rv
aacgccugcucgucggccaccg

SEQ ID NO: 3239302 - RNA, 16 nt, Mycobacterium tuberculosis H37Rv
aacgcgaacccgcgag

SEQ ID NO: 3239303 - RNA, 23 nt, Mycobacterium tuberculosis H37Rv
aacgcgaccaucucgacgucggu

SEQ ID NO: 3239304 - RNA, 17 nt, Mycobacterium tuberculosis H37Rv
aacgcgagcgcuaucac

SEQ ID NO: 3239305 - RNA, 15 nt, Mycobacterium tuberculosis H37Rv
aacgcggcaccacgu

SEQ ID NO: 3239306 - RNA, 14 nt, Mycobacterium tuberculosis H37Rv
aacgcggcgcgcug

SEQ ID NO: 3239307 - RNA, 21 nt, Mycobacterium tuberculosis H37Rv
aacgcgguaaagccccgcucc

SEQ ID NO: 3239308 - RNA, 17 nt, Mycobacterium tuberculosis H37Rv
aacgcggugggcacagc

SEQ ID NO: 3239309 - RNA, 22 nt, Mycobacterium tuberculosis H37Rv
aacgcggugggcacagccagua

SEQ ID NO: 3239310 - RNA, 14 nt, Mycobacterium tuberculosis H37Rv
aacgcgucggucga

SEQ ID NO: 3239311 - RNA, 20 nt, Mycobacterium tuberculosis H37Rv
aacgcguugaccaucacgcc

SEQ ID NO: 3239312 - RNA, 16 nt, Mycobacterium tuberculosis H37Rv
aacgcguugcacagca

SEQ ID NO: 3239313 - RNA, 18 nt, Mycobacterium tuberculosis H37Rv
aacgcuccaggccuaguc

SEQ ID NO: 3239314 - RNA, 19 nt, Mycobacterium tuberculosis H37Rv
aacgcugacgugaagcaga

SEQ ID NO: 3239315 - RNA, 17 nt, Mycobacterium tuberculosis H37Rv
aacgcugucccagcccg

SEQ ID NO: 3239316 - RNA, 20 nt, Mycobacterium tuberculosis H37Rv
aacgcuucaccucgucgaca

SEQ ID NO: 3239317 - RNA, 15 nt, Mycobacterium tuberculosis H37Rv
aacgcuucugccugc

SEQ ID NO: 3239318 - RNA, 15 nt, Mycobacterium tuberculosis H37Rv
aacggaaacucaagu

SEQ ID NO: 3239319 - RNA, 18 nt, Mycobacterium tuberculosis H37Rv
aacggacccggcgcgaug

SEQ ID NO: 3239320 - RNA, 15 nt, Mycobacterium tuberculosis H37Rv
aacggaugguucugg

SEQ ID NO: 3239321 - RNA, 14 nt, Mycobacterium tuberculosis H37Rv
aagaucgagccgac

SEQ ID NO: 3239322 - RNA, 19 nt, Mycobacterium tuberculosis H37Rv
aagaucgcgugccacagca

SEQ ID NO: 3239323 - RNA, 22 nt, Mycobacterium tuberculosis H37Rv
aagaucgcugcgaagccgagca

SEQ ID NO: 3239324 - RNA, 18 nt, Mycobacterium tuberculosis H37Rv
aagaucucggccaggaug

SEQ ID NO: 3239325 - RNA, 16 nt, Mycobacterium tuberculosis H37Rv
aagaugaccucggcga

SEQ ID NO: 3239326 - RNA, 19 nt, Mycobacterium tuberculosis H37Rv
aagaugaccucggcgacga

SEQ ID NO: 3239327 - RNA, 14 nt, Mycobacterium tuberculosis H37Rv
aagaugaccugauc

SEQ ID NO: 3239328 - RNA, 19 nt, Mycobacterium tuberculosis H37Rv
aagaugccugcuagcagca

SEQ ID NO: 3239329 - RNA, 19 nt, Mycobacterium tuberculosis H37Rv
aagcaagggcgauggucgg

SEQ ID NO: 3239330 - RNA, 11 nt, Mycobacterium tuberculosis H37Rv
aagcaauucca

SEQ ID NO: 3239331 - RNA, 16 nt, Mycobacterium tuberculosis H37Rv
aagcacaccgccagcg

SEQ ID NO: 3239332 - RNA, 20 nt, Mycobacterium tuberculosis H37Rv
aagcacaccgccagcggcaa

SEQ ID NO: 3239333 - RNA, 15 nt, Mycobacterium tuberculosis H37Rv
aagcacagcccggcg

SEQ ID NO: 3239334 - RNA, 17 nt, Mycobacterium tuberculosis H37Rv
aagcacagcccggcgac

SEQ ID NO: 3239335 - RNA, 17 nt, Mycobacterium tuberculosis H37Rv
aagcacagcgaacagac

SEQ ID NO: 3239336 - RNA, 17 nt, Mycobacterium tuberculosis H37Rv
aagcaccagccagccug

SEQ ID NO: 3239337 - RNA, 14 nt, Mycobacterium tuberculosis H37Rv
aagcaccgaugcug

SEQ ID NO: 3239338 - RNA, 12 nt, Mycobacterium tuberculosis H37Rv
aagcagcagcgg

SEQ ID NO: 3239339 - RNA, 20 nt, Mycobacterium tuberculosis H37Rv
aagcaucgcguuguaggcuu

SEQ ID NO: 3239340 - RNA, 18 nt, Mycobacterium tuberculosis H37Rv
aagccacucgcgcacaua

SEQ ID NO: 3239341 - RNA, 20 nt, Mycobacterium tuberculosis H37Rv
aagcccacguuuagggugcc

SEQ ID NO: 3239342 - RNA, 15 nt, Mycobacterium tuberculosis H37Rv
aagcccccgcacgcu

SEQ ID NO: 3239343 - RNA, 12 nt, Mycobacterium tuberculosis H37Rv
aagccccucacc

SEQ ID NO: 3239344 - RNA, 17 nt, Mycobacterium tuberculosis H37Rv
aagcccgaagacggggu

SEQ ID NO: 3239345 - RNA, 18 nt, Mycobacterium tuberculosis H37Rv
aagcccgauucagcgccc

SEQ ID NO: 3239346 - RNA, 12 nt, Mycobacterium tuberculosis H37Rv
aagcccggucgc

SEQ ID NO: 3239347 - RNA, 19 nt, Mycobacterium tuberculosis H37Rv
aagcccgucgcggccggcg

SEQ ID NO: 3239348 - RNA, 21 nt, Mycobacterium tuberculosis H37Rv
aagcccgucgucgugcacgac

SEQ ID NO: 3239349 - RNA, 23 nt, Mycobacterium tuberculosis H37Rv
aagcccucgacguccaucccggc

SEQ ID NO: 3239350 - RNA, 20 nt, Mycobacterium tuberculosis H37Rv
aagccgaccguaccgaucca

SEQ ID NO: 3239351 - RNA, 14 nt, Mycobacterium tuberculosis H37Rv
aagccgaccuucuc

SEQ ID NO: 3239352 - RNA, 17 nt, Mycobacterium tuberculosis H37Rv
aagccgaccuucucggc

SEQ ID NO: 3239353 - RNA, 22 nt, Mycobacterium tuberculosis H37Rv
aagccgacgauccacggcgaug

SEQ ID NO: 3239354 - RNA, 15 nt, Mycobacterium tuberculosis H37Rv
aagccgagcaucaga

SEQ ID NO: 3239355 - RNA, 12 nt, Mycobacterium tuberculosis H37Rv
aagccgcccgag

SEQ ID NO: 3239356 - RNA, 15 nt, Mycobacterium tuberculosis H37Rv
aagccgccgcgacca

SEQ ID NO: 3239357 - RNA, 13 nt, Mycobacterium tuberculosis H37Rv
aagccgcgagcgc

SEQ ID NO: 3239358 - RNA, 17 nt, Mycobacterium tuberculosis H37Rv
aagccgcgagcgcgcga

SEQ ID NO: 3239359 - RNA, 20 nt, Mycobacterium tuberculosis H37Rv
aagccgcggcuaggccagca

SEQ ID NO: 3239360 - RNA, 23 nt, Mycobacterium tuberculosis H37Rv
aagccgcggcuaggccagcacgg

SEQ ID NO: 3239361 - RNA, 12 nt, Mycobacterium tuberculosis H37Rv
aagccgcugaac

SEQ ID NO: 3239362 - RNA, 13 nt, Mycobacterium tuberculosis H37Rv
aagccggccacua

SEQ ID NO: 3239363 - RNA, 14 nt, Mycobacterium tuberculosis H37Rv
aagccggccgggaa

SEQ ID NO: 3239364 - RNA, 23 nt, Mycobacterium tuberculosis H37Rv
aagccggcguuuaucagcaagag

SEQ ID NO: 3239365 - RNA, 21 nt, Mycobacterium tuberculosis H37Rv
aagccgggauugccgccaccu

SEQ ID NO: 3239366 - RNA, 19 nt, Mycobacterium tuberculosis H37Rv
aagccgggugggagcagcc

SEQ ID NO: 3239367 - RNA, 17 nt, Mycobacterium tuberculosis H37Rv
aagccguagaccaggcc

SEQ ID NO: 3239368 - RNA, 16 nt, Mycobacterium tuberculosis H37Rv
aagccguguucgaccg

SEQ ID NO: 3239369 - RNA, 22 nt, Mycobacterium tuberculosis H37Rv
aagccguucgcgucgccgauga

SEQ ID NO: 3239370 - RNA, 23 nt, Mycobacterium tuberculosis H37Rv
aagccguuguccaagcccucggg

SEQ ID NO: 3239371 - RNA, 22 nt, Mycobacterium tuberculosis H37Rv
aagccuaguacgccgagcagac

SEQ ID NO: 3239372 - RNA, 15 nt, Mycobacterium tuberculosis H37Rv
aagccucagccgcuc

SEQ ID NO: 3239373 - RNA, 22 nt, Mycobacterium tuberculosis H37Rv
aagccucgauaggugagcgcgg

SEQ ID NO: 3239374 - RNA, 23 nt, Mycobacterium tuberculosis H37Rv
aagccucgauaggugagcgcggg

SEQ ID NO: 3239375 - RNA, 18 nt, Mycobacterium tuberculosis H37Rv
aagccucggcaugcagcc

SEQ ID NO: 3239376 - RNA, 22 nt, Mycobacterium tuberculosis H37Rv
aagccuggaaaacccaggucuu

SEQ ID NO: 3239377 - RNA, 20 nt, Mycobacterium tuberculosis H37Rv
aagccuugacccauggcucc

SEQ ID NO: 3239378 - RNA, 17 nt, Mycobacterium tuberculosis H37Rv
aagcgacgagcagcaau

SEQ ID NO: 3239379 - RNA, 17 nt, Mycobacterium tuberculosis H37Rv
aagcgacucgccggcga

SEQ ID NO: 3239380 - RNA, 23 nt, Mycobacterium tuberculosis H37Rv
aagcgagcggucgacguguugga

SEQ ID NO: 3239381 - RNA, 20 nt, Mycobacterium tuberculosis H37Rv
aagcgaucgccggccgcgug

SEQ ID NO: 3239382 - RNA, 16 nt, Mycobacterium tuberculosis H37Rv
aagcgaugccgugcug

SEQ ID NO: 3239383 - RNA, 11 nt, Mycobacterium tuberculosis H37Rv
aagcgcacgcu

SEQ ID NO: 3239384 - RNA, 13 nt, Mycobacterium tuberculosis H37Rv
aagcgccggccga

SEQ ID NO: 3239385 - RNA, 15 nt, Mycobacterium tuberculosis H37Rv
aagcgcgguugcgcu

SEQ ID NO: 3239386 - RNA, 19 nt, Mycobacterium tuberculosis H37Rv
aagcgcgguuucggcgaug

SEQ ID NO: 3239387 - RNA, 17 nt, Mycobacterium tuberculosis H37Rv
aagcgguugacccacag

SEQ ID NO: 3239388 - RNA, 18 nt, Mycobacterium tuberculosis H37Rv
aagcgguugacccacagc

SEQ ID NO: 3239389 - RNA, 15 nt, Mycobacterium tuberculosis H37Rv
aagcguccgcugcag

SEQ ID NO: 3239390 - RNA, 15 nt, Mycobacterium tuberculosis H37Rv
aagcgugcugccgcc

SEQ ID NO: 3239391 - RNA, 17 nt, Mycobacterium tuberculosis H37Rv
aagcuaaacccccaccg

SEQ ID NO: 3239392 - RNA, 15 nt, Mycobacterium tuberculosis H37Rv
aagcucaagggacac

SEQ ID NO: 3239393 - RNA, 15 nt, Mycobacterium tuberculosis H37Rv
aagcucacacuggcu

SEQ ID NO: 3239394 - RNA, 13 nt, Mycobacterium tuberculosis H37Rv
aagcucagcuucu

SEQ ID NO: 3239395 - RNA, 21 nt, Mycobacterium tuberculosis H37Rv
aagcucgacaacugcccgaug

SEQ ID NO: 3239396 - RNA, 14 nt, Mycobacterium tuberculosis H37Rv
aagcucggccacca

SEQ ID NO: 3239397 - RNA, 18 nt, Mycobacterium tuberculosis H37Rv
aagcucugcgucgugccc

SEQ ID NO: 3239398 - RNA, 16 nt, Mycobacterium tuberculosis H37Rv
aagcugaccgccagcg

SEQ ID NO: 3239399 - RNA, 19 nt, Mycobacterium tuberculosis H37Rv
aagcugcgggucagcgccg

SEQ ID NO: 3239400 - RNA, 22 nt, Mycobacterium tuberculosis H37Rv
aagcugcucgucggcgccggcg

SEQ ID NO: 3239401 - RNA, 16 nt, Mycobacterium tuberculosis H37Rv
aagcuggcgccgcagg

SEQ ID NO: 3239402 - RNA, 16 nt, Mycobacterium tuberculosis H37Rv
aagcuguaggcgacca

SEQ ID NO: 3239403 - RNA, 15 nt, Mycobacterium tuberculosis H37Rv
aagcugugcccggcg

SEQ ID NO: 3239404 - RNA, 22 nt, Mycobacterium tuberculosis H37Rv
aagcuuaggcgugguucccggc

SEQ ID NO: 3239405 - RNA, 13 nt, Mycobacterium tuberculosis H37Rv
aaggaaaagccug

SEQ ID NO: 3239406 - RNA, 18 nt, Mycobacterium tuberculosis H37Rv
aaggaaccgggcaaauca

SEQ ID NO: 3239407 - RNA, 20 nt, Mycobacterium tuberculosis H37Rv
aaggaccggcaccuggucca

SEQ ID NO: 3239408 - RNA, 19 nt, Mycobacterium tuberculosis H37Rv
aaggacguuucagccgggu

SEQ ID NO: 3239409 - RNA, 21 nt, Mycobacterium tuberculosis H37Rv
aaggagccgggccguccgggu

SEQ ID NO: 3239410 - RNA, 17 nt, Mycobacterium tuberculosis H37Rv
aaggaucagcgcacugg

SEQ ID NO: 3239411 - RNA, 22 nt, Mycobacterium tuberculosis H37Rv
aaggaugucggggcgaagcuug

SEQ ID NO: 3239412 - RNA, 17 nt, Mycobacterium tuberculosis H37Rv
aaggauugcggaaaccc

SEQ ID NO: 3239413 - RNA, 13 nt, Mycobacterium tuberculosis H37Rv
aaggcacgggugu

SEQ ID NO: 3239414 - RNA, 18 nt, Mycobacterium tuberculosis H37Rv
aaggcauugcccacaaag

SEQ ID NO: 3239415 - RNA, 16 nt, Mycobacterium tuberculosis H37Rv
aaggccgcaauacccg

SEQ ID NO: 3239416 - RNA, 15 nt, Mycobacterium tuberculosis H37Rv
aaggccgccaaccgu

SEQ ID NO: 3239417 - RNA, 20 nt, Mycobacterium tuberculosis H37Rv
aauccaaggcucagcagcgc

SEQ ID NO: 3239418 - RNA, 22 nt, Mycobacterium tuberculosis H37Rv
aaucccgggcucugcugccagc

SEQ ID NO: 3239419 - RNA, 13 nt, Mycobacterium tuberculosis H37Rv
aauccgagccgcg

SEQ ID NO: 3239420 - RNA, 16 nt, Mycobacterium tuberculosis H37Rv
aauccgcacagguccg

SEQ ID NO: 3239421 - RNA, 23 nt, Mycobacterium tuberculosis H37Rv
aauccgcccuaaugaagccguug

SEQ ID NO: 3239422 - RNA, 22 nt, Mycobacterium tuberculosis H37Rv
aauccgcccuugccgccuuggc

SEQ ID NO: 3239423 - RNA, 22 nt, Mycobacterium tuberculosis H37Rv
aauccgcgucgucgagucgaca

SEQ ID NO: 3239424 - RNA, 19 nt, Mycobacterium tuberculosis H37Rv
aauccggcauacaucgccu

SEQ ID NO: 3239425 - RNA, 17 nt, Mycobacterium tuberculosis H37Rv
aauccggcgccagcagu

SEQ ID NO: 3239426 - RNA, 15 nt, Mycobacterium tuberculosis H37Rv
aauccggcugcggua

SEQ ID NO: 3239427 - RNA, 15 nt, Mycobacterium tuberculosis H37Rv
aauccggucgaugac

SEQ ID NO: 3239428 - RNA, 18 nt, Mycobacterium tuberculosis H37Rv
aauccggugcccgcacca

SEQ ID NO: 3239429 - RNA, 13 nt, Mycobacterium tuberculosis H37Rv
aauccgugcaggg

SEQ ID NO: 3239430 - RNA, 20 nt, Mycobacterium tuberculosis H37Rv
aauccgugccgaaaaucgca

SEQ ID NO: 3239431 - RNA, 16 nt, Mycobacterium tuberculosis H37Rv
aauccugcgcugcacc

SEQ ID NO: 3239432 - RNA, 14 nt, Mycobacterium tuberculosis H37Rv
aauccuucggcgug

SEQ ID NO: 3239433 - RNA, 19 nt, Mycobacterium tuberculosis H37Rv
aauccuugacgcgcaacgc

SEQ ID NO: 3239434 - RNA, 15 nt, Mycobacterium tuberculosis H37Rv
aaucgacaccgcccg

SEQ ID NO: 3239435 - RNA, 14 nt, Mycobacterium tuberculosis H37Rv
aaucgacagcagcg

SEQ ID NO: 3239436 - RNA, 15 nt, Mycobacterium tuberculosis H37Rv
aaucgacagcagcgc

SEQ ID NO: 3239437 - RNA, 13 nt, Mycobacterium tuberculosis H37Rv
aaucgacucagcc

SEQ ID NO: 3239438 - RNA, 23 nt, Mycobacterium tuberculosis H37Rv
aaucgacugaucgccacccgguc

SEQ ID NO: 3239439 - RNA, 13 nt, Mycobacterium tuberculosis H37Rv
aaucgagcaccgc

SEQ ID NO: 3239440 - RNA, 14 nt, Mycobacterium tuberculosis H37Rv
aaucgagcaccgca

SEQ ID NO: 3239441 - RNA, 21 nt, Mycobacterium tuberculosis H37Rv
aaucgaucgaauuaaagccac

SEQ ID NO: 3239442 - RNA, 14 nt, Mycobacterium tuberculosis H37Rv
aaucgaugaccgca

SEQ ID NO: 3239443 - RNA, 22 nt, Mycobacterium tuberculosis H37Rv
aaucgauguccaaugcaccguu

SEQ ID NO: 3239444 - RNA, 21 nt, Mycobacterium tuberculosis H37Rv
aaucgcacagcgcgaucaacg

SEQ ID NO: 3239445 - RNA, 22 nt, Mycobacterium tuberculosis H37Rv
aaucgcacagcgcgaucaacgc

SEQ ID NO: 3239446 - RNA, 11 nt, Mycobacterium tuberculosis H37Rv
aaucgcacgcg

SEQ ID NO: 3239447 - RNA, 17 nt, Mycobacterium tuberculosis H37Rv
aaucgcaucuagguuca

SEQ ID NO: 3239448 - RNA, 15 nt, Mycobacterium tuberculosis H37Rv
aaucgcccagugugc

SEQ ID NO: 3239449 - RNA, 18 nt, Mycobacterium tuberculosis H37Rv
aaucgcccauuucggcac

SEQ ID NO: 3239450 - RNA, 14 nt, Mycobacterium tuberculosis H37Rv
aaucgcccucgucg

SEQ ID NO: 3239451 - RNA, 12 nt, Mycobacterium tuberculosis H37Rv
aaucgccgucag

SEQ ID NO: 3239452 - RNA, 18 nt, Mycobacterium tuberculosis H37Rv
aaucgccgucagcaccgc

SEQ ID NO: 3239453 - RNA, 19 nt, Mycobacterium tuberculosis H37Rv
aaucgccgucagcaccgcu

SEQ ID NO: 3239454 - RNA, 15 nt, Mycobacterium tuberculosis H37Rv
aaucgccugccacag

SEQ ID NO: 3239455 - RNA, 14 nt, Mycobacterium tuberculosis H37Rv
aaucgccugcgaca

SEQ ID NO: 3239456 - RNA, 15 nt, Mycobacterium tuberculosis H37Rv
aaucgccugcgacag

SEQ ID NO: 3239457 - RNA, 18 nt, Mycobacterium tuberculosis H37Rv
aaucgcgacgcgacgguu

SEQ ID NO: 3239458 - RNA, 18 nt, Mycobacterium tuberculosis H37Rv
aaucgcgucgagagaacg

SEQ ID NO: 3239459 - RNA, 16 nt, Mycobacterium tuberculosis H37Rv
aaucggauagccgugc

SEQ ID NO: 3239460 - RNA, 17 nt, Mycobacterium tuberculosis H37Rv
aaucggcggcacccggg

SEQ ID NO: 3239461 - RNA, 19 nt, Mycobacterium tuberculosis H37Rv
aaucggcggcguccagcag

SEQ ID NO: 3239462 - RNA, 23 nt, Mycobacterium tuberculosis H37Rv
aaucgguggaagaguuggggcac

SEQ ID NO: 3239463 - RNA, 14 nt, Mycobacterium tuberculosis H37Rv
aaucgucggccagc

SEQ ID NO: 3239464 - RNA, 23 nt, Mycobacterium tuberculosis H37Rv
aaucgugcggguaauacggcgcc

SEQ ID NO: 3239465 - RNA, 21 nt, Mycobacterium tuberculosis H37Rv
aaucguguugucaggacaugc

SEQ ID NO: 3239466 - RNA, 21 nt, Mycobacterium tuberculosis H37Rv
aaucguuggcgaucgcgaucg

SEQ ID NO: 3239467 - RNA, 21 nt, Mycobacterium tuberculosis H37Rv
aaucuaauucgccucgccuga

SEQ ID NO: 3239468 - RNA, 21 nt, Mycobacterium tuberculosis H37Rv
aaucuccggcuggcccaccuc

SEQ ID NO: 3239469 - RNA, 14 nt, Mycobacterium tuberculosis H37Rv
aaucucgaucuugg

SEQ ID NO: 3239470 - RNA, 19 nt, Mycobacterium tuberculosis H37Rv
aaucucgcccccagugcac

SEQ ID NO: 3239471 - RNA, 22 nt, Mycobacterium tuberculosis H37Rv
aaucucguuccacugugcgagc

SEQ ID NO: 3239472 - RNA, 21 nt, Mycobacterium tuberculosis H37Rv
aaucugcgguacugagccgcg

SEQ ID NO: 3239473 - RNA, 23 nt, Mycobacterium tuberculosis H37Rv
aaucuucucgagccgccggaucg

SEQ ID NO: 3239474 - RNA, 17 nt, Mycobacterium tuberculosis H37Rv
aaucuuugguagucugc

SEQ ID NO: 3239475 - RNA, 16 nt, Mycobacterium tuberculosis H37Rv
aaugaccugcagcgca

SEQ ID NO: 3239476 - RNA, 16 nt, Mycobacterium tuberculosis H37Rv
aaugacuuggccagca

SEQ ID NO: 3239477 - RNA, 17 nt, Mycobacterium tuberculosis H37Rv
aaugagcggucagcguc

SEQ ID NO: 3239478 - RNA, 23 nt, Mycobacterium tuberculosis H37Rv
aaugcacaaaaaccgaccgcgcu

SEQ ID NO: 3239479 - RNA, 19 nt, Mycobacterium tuberculosis H37Rv
aaugcacaccgggcaccag

SEQ ID NO: 3239480 - RNA, 18 nt, Mycobacterium tuberculosis H37Rv
aaugcaucgcggcggcgc

SEQ ID NO: 3239481 - RNA, 21 nt, Mycobacterium tuberculosis H37Rv
aaugccggugccgggcaccac

SEQ ID NO: 3239482 - RNA, 11 nt, Mycobacterium tuberculosis H37Rv
aaugcgagcgc

SEQ ID NO: 3239483 - RNA, 18 nt, Mycobacterium tuberculosis H37Rv
aaugcgccaauagcaacu

SEQ ID NO: 3239484 - RNA, 21 nt, Mycobacterium tuberculosis H37Rv
aaugcugacggugcaggacca

SEQ ID NO: 3239485 - RNA, 12 nt, Mycobacterium tuberculosis H37Rv
aaugcugcaggu

SEQ ID NO: 3239486 - RNA, 15 nt, Mycobacterium tuberculosis H37Rv
aauggacaccaaccc

SEQ ID NO: 3239487 - RNA, 14 nt, Mycobacterium tuberculosis H37Rv
aauggaccagcgcc

SEQ ID NO: 3239488 - RNA, 15 nt, Mycobacterium tuberculosis H37Rv
aauggauugcggcac

SEQ ID NO: 3239489 - RNA, 18 nt, Mycobacterium tuberculosis H37Rv
aauggauugcggcacgga

SEQ ID NO: 3239490 - RNA, 13 nt, Mycobacterium tuberculosis H37Rv
aauggccagcacc

SEQ ID NO: 3239491 - RNA, 15 nt, Mycobacterium tuberculosis H37Rv
aauggccgccgcagc

SEQ ID NO: 3239492 - RNA, 14 nt, Mycobacterium tuberculosis H37Rv
aauggccugcagcg

SEQ ID NO: 3239493 - RNA, 21 nt, Mycobacterium tuberculosis H37Rv
aauggcgcugauggugcugcg

SEQ ID NO: 3239494 - RNA, 14 nt, Mycobacterium tuberculosis H37Rv
aauggcguucgucg

SEQ ID NO: 3239495 - RNA, 21 nt, Mycobacterium tuberculosis H37Rv
aaugggggcuggucgccguac

SEQ ID NO: 3239496 - RNA, 21 nt, Mycobacterium tuberculosis H37Rv
aauggucguucccgccggcac

SEQ ID NO: 3239497 - RNA, 23 nt, Mycobacterium tuberculosis H37Rv
aaugguucgcacaccuccucgac

SEQ ID NO: 3239498 - RNA, 13 nt, Mycobacterium tuberculosis H37Rv
aauguaguccagc

SEQ ID NO: 3239499 - RNA, 16 nt, Mycobacterium tuberculosis H37Rv
aauguccaggcgcgca

SEQ ID NO: 3239500 - RNA, 16 nt, Mycobacterium tuberculosis H37Rv
aauguccgcagacgac

SEQ ID NO: 3239501 - RNA, 16 nt, Mycobacterium tuberculosis H37Rv
aaugucgcucaaaccc

SEQ ID NO: 3239502 - RNA, 14 nt, Mycobacterium tuberculosis H37Rv
aaugucggcagggc

SEQ ID NO: 3239503 - RNA, 17 nt, Mycobacterium tuberculosis H37Rv
aaugucuucgccgucac

SEQ ID NO: 3239504 - RNA, 19 nt, Mycobacterium tuberculosis H37Rv
aaugucuuuggucgccgga

SEQ ID NO: 3239505 - RNA, 15 nt, Mycobacterium tuberculosis H37Rv
aauucaacagcaccg

SEQ ID NO: 3239506 - RNA, 18 nt, Mycobacterium tuberculosis H37Rv
aauucaacagcaccgcga

SEQ ID NO: 3239507 - RNA, 18 nt, Mycobacterium tuberculosis H37Rv
aauucagauagucgccgc

SEQ ID NO: 3239508 - RNA, 23 nt, Mycobacterium tuberculosis H37Rv
aauucaugccgguguugccgaag

SEQ ID NO: 3239509 - RNA, 22 nt, Mycobacterium tuberculosis H37Rv
aauuccgcuugcucucgcagca

SEQ ID NO: 3239510 - RNA, 14 nt, Mycobacterium tuberculosis H37Rv
aauuccggcucacc

SEQ ID NO: 3239511 - RNA, 17 nt, Mycobacterium tuberculosis H37Rv
aauuccggugaucgcgg

SEQ ID NO: 3239512 - RNA, 15 nt, Mycobacterium tuberculosis H37Rv
aauucgacugcaacu

SEQ ID NO: 3239513 - RNA, 16 nt, Mycobacterium tuberculosis H37Rv
acaccaccagcacgcu

SEQ ID NO: 3239514 - RNA, 17 nt, Mycobacterium tuberculosis H37Rv
acaccacggaccagcgc

SEQ ID NO: 3239515 - RNA, 16 nt, Mycobacterium tuberculosis H37Rv
acaccacgguuggcca

SEQ ID NO: 3239516 - RNA, 19 nt, Mycobacterium tuberculosis H37Rv
acaccacgguuggccacca

SEQ ID NO: 3239517 - RNA, 14 nt, Mycobacterium tuberculosis H37Rv
acaccagaugcacc

SEQ ID NO: 3239518 - RNA, 22 nt, Mycobacterium tuberculosis H37Rv
acaccagccggucgucgcgcag

SEQ ID NO: 3239519 - RNA, 12 nt, Mycobacterium tuberculosis H37Rv
acaccagcgggc

SEQ ID NO: 3239520 - RNA, 22 nt, Mycobacterium tuberculosis H37Rv
acaccagcucgagguccucagc

SEQ ID NO: 3239521 - RNA, 22 nt, Mycobacterium tuberculosis H37Rv
acaccauaggccgacggguugg

SEQ ID NO: 3239522 - RNA, 20 nt, Mycobacterium tuberculosis H37Rv
acaccaucuccgccgucgcc

SEQ ID NO: 3239523 - RNA, 19 nt, Mycobacterium tuberculosis H37Rv
acaccaugaucaggcccca

SEQ ID NO: 3239524 - RNA, 20 nt, Mycobacterium tuberculosis H37Rv
acaccaugguggugaugcca

SEQ ID NO: 3239525 - RNA, 19 nt, Mycobacterium tuberculosis H37Rv
acacccaaaccggcccgca

SEQ ID NO: 3239526 - RNA, 14 nt, Mycobacterium tuberculosis H37Rv
acacccagccgcag

SEQ ID NO: 3239527 - RNA, 15 nt, Mycobacterium tuberculosis H37Rv
acacccagcgugccc

SEQ ID NO: 3239528 - RNA, 15 nt, Mycobacterium tuberculosis H37Rv
acacccaucagcccu

SEQ ID NO: 3239529 - RNA, 19 nt, Mycobacterium tuberculosis H37Rv
acaccccggccuugccacc

SEQ ID NO: 3239530 - RNA, 12 nt, Mycobacterium tuberculosis H37Rv
acacccgagggc

SEQ ID NO: 3239531 - RNA, 19 nt, Mycobacterium tuberculosis H37Rv
acacccuccacagcggcca

SEQ ID NO: 3239532 - RNA, 13 nt, Mycobacterium tuberculosis H37Rv
acacccucgggcc

SEQ ID NO: 3239533 - RNA, 12 nt, Mycobacterium tuberculosis H37Rv
acacccugcagc

SEQ ID NO: 3239534 - RNA, 18 nt, Mycobacterium tuberculosis H37Rv
acacccuugcccacggcg

SEQ ID NO: 3239535 - RNA, 15 nt, Mycobacterium tuberculosis H37Rv
acaccgaaagccucu

SEQ ID NO: 3239536 - RNA, 15 nt, Mycobacterium tuberculosis H37Rv
acaccgaaccgccgc

SEQ ID NO: 3239537 - RNA, 17 nt, Mycobacterium tuberculosis H37Rv
acaccgacgccgccagg

SEQ ID NO: 3239538 - RNA, 15 nt, Mycobacterium tuberculosis H37Rv
acaccgagcaccucg

SEQ ID NO: 3239539 - RNA, 20 nt, Mycobacterium tuberculosis H37Rv
acaccgcauaaaucgggguu

SEQ ID NO: 3239540 - RNA, 17 nt, Mycobacterium tuberculosis H37Rv
acaccgcauaaggccca

SEQ ID NO: 3239541 - RNA, 15 nt, Mycobacterium tuberculosis H37Rv
acaccgccagcggca

SEQ ID NO: 3239542 - RNA, 20 nt, Mycobacterium tuberculosis H37Rv
acaccgccagcggcaauggc

SEQ ID NO: 3239543 - RNA, 14 nt, Mycobacterium tuberculosis H37Rv
acaccgcgaucacc

SEQ ID NO: 3239544 - RNA, 19 nt, Mycobacterium tuberculosis H37Rv
acaccgcgcccgccgaucc

SEQ ID NO: 3239545 - RNA, 21 nt, Mycobacterium tuberculosis H37Rv
acaccgcggacccgcagcugc

SEQ ID NO: 3239546 - RNA, 16 nt, Mycobacterium tuberculosis H37Rv
acaccgcggcaagagu

SEQ ID NO: 3239547 - RNA, 17 nt, Mycobacterium tuberculosis H37Rv
acaccgcggcggcgcgu

SEQ ID NO: 3239548 - RNA, 13 nt, Mycobacterium tuberculosis H37Rv
acaccggcaagcc

SEQ ID NO: 3239549 - RNA, 21 nt, Mycobacterium tuberculosis H37Rv
acaccggcaagccacgccggu

SEQ ID NO: 3239550 - RNA, 14 nt, Mycobacterium tuberculosis H37Rv
acaccggcaccgaa

SEQ ID NO: 3239551 - RNA, 21 nt, Mycobacterium tuberculosis H37Rv
acaccggcacugcccagcaga

SEQ ID NO: 3239552 - RNA, 18 nt, Mycobacterium tuberculosis H37Rv
acaccggccaacagucgc

SEQ ID NO: 3239553 - RNA, 14 nt, Mycobacterium tuberculosis H37Rv
acaccggccgcgac

SEQ ID NO: 3239554 - RNA, 15 nt, Mycobacterium tuberculosis H37Rv
acaccggccggucca

SEQ ID NO: 3239555 - RNA, 21 nt, Mycobacterium tuberculosis H37Rv
acaccggccugcgcgaccgac

SEQ ID NO: 3239556 - RNA, 24 nt, Mycobacterium tuberculosis H37Rv
acaccggccugcgcgaccgaccag

SEQ ID NO: 3239557 - RNA, 14 nt, Mycobacterium tuberculosis H37Rv
acaccggcgaucac

SEQ ID NO: 3239558 - RNA, 18 nt, Mycobacterium tuberculosis H37Rv
acaccggcuuugcuugcc

SEQ ID NO: 3239559 - RNA, 13 nt, Mycobacterium tuberculosis H37Rv
acaccgggcacca

SEQ ID NO: 3239560 - RNA, 17 nt, Mycobacterium tuberculosis H37Rv
acaccggggacgucgac

SEQ ID NO: 3239561 - RNA, 14 nt, Mycobacterium tuberculosis H37Rv
acaccggggcggcc

SEQ ID NO: 3239562 - RNA, 20 nt, Mycobacterium tuberculosis H37Rv
acaccgguuucugguguuuc

SEQ ID NO: 3239563 - RNA, 13 nt, Mycobacterium tuberculosis H37Rv
acaccgucacgcc

SEQ ID NO: 3239564 - RNA, 15 nt, Mycobacterium tuberculosis H37Rv
acaccguccagcagc

SEQ ID NO: 3239565 - RNA, 19 nt, Mycobacterium tuberculosis H37Rv
acaccguccgucggcgcuc

SEQ ID NO: 3239566 - RNA, 22 nt, Mycobacterium tuberculosis H37Rv
acaccgucgcgcucgcaccacc

SEQ ID NO: 3239567 - RNA, 13 nt, Mycobacterium tuberculosis H37Rv
acaccgucgcguu

SEQ ID NO: 3239568 - RNA, 19 nt, Mycobacterium tuberculosis H37Rv
acaccgucggcagcagcgg

SEQ ID NO: 3239569 - RNA, 16 nt, Mycobacterium tuberculosis H37Rv
acaccgugcgccgaau

SEQ ID NO: 3239570 - RNA, 16 nt, Mycobacterium tuberculosis H37Rv
acaccucaaacgccug

SEQ ID NO: 3239571 - RNA, 13 nt, Mycobacterium tuberculosis H37Rv
acaccuccucgag

SEQ ID NO: 3239572 - RNA, 13 nt, Mycobacterium tuberculosis H37Rv
acaccucgggguu

SEQ ID NO: 3239573 - RNA, 12 nt, Mycobacterium tuberculosis H37Rv
acaccugcggcg

SEQ ID NO: 3239574 - RNA, 16 nt, Mycobacterium tuberculosis H37Rv
acaccugcggcgucaa

SEQ ID NO: 3239575 - RNA, 21 nt, Mycobacterium tuberculosis H37Rv
acaccugcggcgucaaaucca

SEQ ID NO: 3239576 - RNA, 22 nt, Mycobacterium tuberculosis H37Rv
acaccugcggcugcuuggucgc

SEQ ID NO: 3239577 - RNA, 15 nt, Mycobacterium tuberculosis H37Rv
acaccuucggcuggu

SEQ ID NO: 3239578 - RNA, 23 nt, Mycobacterium tuberculosis H37Rv
acaccuuggccgccggccgcgca

SEQ ID NO: 3239579 - RNA, 18 nt, Mycobacterium tuberculosis H37Rv
acaccuuggcggucggca

SEQ ID NO: 3239580 - RNA, 16 nt, Mycobacterium tuberculosis H37Rv
acaccuugggcagcuu

SEQ ID NO: 3239581 - RNA, 17 nt, Mycobacterium tuberculosis H37Rv
acacgaauccggccacu

SEQ ID NO: 3239582 - RNA, 18 nt, Mycobacterium tuberculosis H37Rv
acacgaauccggccacuc

SEQ ID NO: 3239583 - RNA, 15 nt, Mycobacterium tuberculosis H37Rv
acacgacugucccgc

SEQ ID NO: 3239584 - RNA, 20 nt, Mycobacterium tuberculosis H37Rv
acacgagcaugcuggaccuc

SEQ ID NO: 3239585 - RNA, 20 nt, Mycobacterium tuberculosis H37Rv
acacgagucgccagaccgca

SEQ ID NO: 3239586 - RNA, 14 nt, Mycobacterium tuberculosis H37Rv
acacgcacacgauc

SEQ ID NO: 3239587 - RNA, 13 nt, Mycobacterium tuberculosis H37Rv
acacgccagguga

SEQ ID NO: 3239588 - RNA, 13 nt, Mycobacterium tuberculosis H37Rv
acacgccgccggu

SEQ ID NO: 3239589 - RNA, 16 nt, Mycobacterium tuberculosis H37Rv
acacgccguuggggcc

SEQ ID NO: 3239590 - RNA, 14 nt, Mycobacterium tuberculosis H37Rv
acacggcagcugca

SEQ ID NO: 3239591 - RNA, 13 nt, Mycobacterium tuberculosis H37Rv
acacggccuugcc

SEQ ID NO: 3239592 - RNA, 20 nt, Mycobacterium tuberculosis H37Rv
acacggcgacauacccgauc

SEQ ID NO: 3239593 - RNA, 17 nt, Mycobacterium tuberculosis H37Rv
acacggggccgccagcu

SEQ ID NO: 3239594 - RNA, 21 nt, Mycobacterium tuberculosis H37Rv
acacgguacugugggcgaucg

SEQ ID NO: 3239595 - RNA, 15 nt, Mycobacterium tuberculosis H37Rv
acacggucgucgcga

SEQ ID NO: 3239596 - RNA, 15 nt, Mycobacterium tuberculosis H37Rv
acacguccaguggca

SEQ ID NO: 3239597 - RNA, 13 nt, Mycobacterium tuberculosis H37Rv
acacguccggcga

SEQ ID NO: 3239598 - RNA, 21 nt, Mycobacterium tuberculosis H37Rv
acacguccggcgaugaccaga

SEQ ID NO: 3239599 - RNA, 15 nt, Mycobacterium tuberculosis H37Rv
acacgucgacaccga

SEQ ID NO: 3239600 - RNA, 23 nt, Mycobacterium tuberculosis H37Rv
acacgucgcggguaaccggcucc

SEQ ID NO: 3239601 - RNA, 12 nt, Mycobacterium tuberculosis H37Rv
acacgucggcca

SEQ ID NO: 3239602 - RNA, 14 nt, Mycobacterium tuberculosis H37Rv
acacgugggugauc

SEQ ID NO: 3239603 - RNA, 15 nt, Mycobacterium tuberculosis H37Rv
acacguucucaccac

SEQ ID NO: 3239604 - RNA, 12 nt, Mycobacterium tuberculosis H37Rv
acacucauuccc

SEQ ID NO: 3239605 - RNA, 14 nt, Mycobacterium tuberculosis H37Rv
acacucccauccgc

SEQ ID NO: 3239606 - RNA, 15 nt, Mycobacterium tuberculosis H37Rv
acacucccauccgcc

SEQ ID NO: 3239607 - RNA, 17 nt, Mycobacterium tuberculosis H37Rv
acacugugcucgccgga

SEQ ID NO: 3239608 - RNA, 13 nt, Mycobacterium tuberculosis H37Rv
acacuugcaacuc

SEQ ID NO: 3239609 - RNA, 16 nt, Mycobacterium tuberculosis H37Rv
acagacccccagacaa

SEQ ID NO: 3239610 - RNA, 15 nt, Mycobacterium tuberculosis H37Rv
acagaccgaacagca

SEQ ID NO: 3239611 - RNA, 19 nt, Mycobacterium tuberculosis H37Rv
acagaccgaacagcaccga

SEQ ID NO: 3239612 - RNA, 17 nt, Mycobacterium tuberculosis H37Rv
acagaccgggcaccaga

SEQ ID NO: 3239613 - RNA, 16 nt, Mycobacterium tuberculosis H37Rv
acagaccuagcaccgc

SEQ ID NO: 3239614 - RNA, 15 nt, Mycobacterium tuberculosis H37Rv
acagacgacgucggc

SEQ ID NO: 3239615 - RNA, 17 nt, Mycobacterium tuberculosis H37Rv
acagacggggucgcccg

SEQ ID NO: 3239616 - RNA, 15 nt, Mycobacterium tuberculosis H37Rv
acagauaaggaccau

SEQ ID NO: 3239617 - RNA, 22 nt, Mycobacterium tuberculosis H37Rv
acagauacuucaaugcugggau

SEQ ID NO: 3239618 - RNA, 14 nt, Mycobacterium tuberculosis H37Rv
acagaugcauccag

SEQ ID NO: 3239619 - RNA, 14 nt, Mycobacterium tuberculosis H37Rv
acagaugccaccca

SEQ ID NO: 3239620 - RNA, 20 nt, Mycobacterium tuberculosis H37Rv
acagauucggugccagcagg

SEQ ID NO: 3239621 - RNA, 21 nt, Mycobacterium tuberculosis H37Rv
acagcaauuuuccgucgaugg

SEQ ID NO: 3239622 - RNA, 13 nt, Mycobacterium tuberculosis H37Rv
acagcacauccag

SEQ ID NO: 3239623 - RNA, 15 nt, Mycobacterium tuberculosis H37Rv
acagcacccacgccg

SEQ ID NO: 3239624 - RNA, 19 nt, Mycobacterium tuberculosis H37Rv
acagcacccagacgauggc

SEQ ID NO: 3239625 - RNA, 16 nt, Mycobacterium tuberculosis H37Rv
acagcaccgaacccgc

SEQ ID NO: 3239626 - RNA, 13 nt, Mycobacterium tuberculosis H37Rv
acagcaccgccgg

SEQ ID NO: 3239627 - RNA, 14 nt, Mycobacterium tuberculosis H37Rv
acagcaccgcgacg

SEQ ID NO: 3239628 - RNA, 20 nt, Mycobacterium tuberculosis H37Rv
acagcaccguccucggucac

SEQ ID NO: 3239629 - RNA, 17 nt, Mycobacterium tuberculosis H37Rv
acagcaucacgaucacg

SEQ ID NO: 3239630 - RNA, 13 nt, Mycobacterium tuberculosis H37Rv
acagcaucacgcc

SEQ ID NO: 3239631 - RNA, 18 nt, Mycobacterium tuberculosis H37Rv
acagcaucacgcccacga

SEQ ID NO: 3239632 - RNA, 18 nt, Mycobacterium tuberculosis H37Rv
acagcaugguuagcggug

SEQ ID NO: 3239633 - RNA, 22 nt, Mycobacterium tuberculosis H37Rv
acagcaugucgcggacccgcgc

SEQ ID NO: 3239634 - RNA, 23 nt, Mycobacterium tuberculosis H37Rv
acagcaugucucgggcgcgggug

SEQ ID NO: 3239635 - RNA, 17 nt, Mycobacterium tuberculosis H37Rv
acagccacgcacaauac

SEQ ID NO: 3239636 - RNA, 22 nt, Mycobacterium tuberculosis H37Rv
acagccaguaaaaaggcaggac

SEQ ID NO: 3239637 - RNA, 18 nt, Mycobacterium tuberculosis H37Rv
acagcccacaggcggcgc

SEQ ID NO: 3239638 - RNA, 23 nt, Mycobacterium tuberculosis H37Rv
acagcccacgagugcaagaccgu

SEQ ID NO: 3239639 - RNA, 15 nt, Mycobacterium tuberculosis H37Rv
acagccccagggugc

SEQ ID NO: 3239640 - RNA, 23 nt, Mycobacterium tuberculosis H37Rv
acagccccggcagguagggggca

SEQ ID NO: 3239641 - RNA, 13 nt, Mycobacterium tuberculosis H37Rv
acagcccgaugcc

SEQ ID NO: 3239642 - RNA, 14 nt, Mycobacterium tuberculosis H37Rv
acagcccgaugccg

SEQ ID NO: 3239643 - RNA, 12 nt, Mycobacterium tuberculosis H37Rv
acagcccggcgg

SEQ ID NO: 3239644 - RNA, 15 nt, Mycobacterium tuberculosis H37Rv
acagcccggcggcgg

SEQ ID NO: 3239645 - RNA, 19 nt, Mycobacterium tuberculosis H37Rv
acagcccguagcacaccgg

SEQ ID NO: 3239646 - RNA, 14 nt, Mycobacterium tuberculosis H37Rv
acagccgcgccgac

SEQ ID NO: 3239647 - RNA, 14 nt, Mycobacterium tuberculosis H37Rv
acagcgaaccgccg

SEQ ID NO: 3239648 - RNA, 13 nt, Mycobacterium tuberculosis H37Rv
acagcgacgccau

SEQ ID NO: 3239649 - RNA, 14 nt, Mycobacterium tuberculosis H37Rv
acagcgaucgccgc

SEQ ID NO: 3239650 - RNA, 18 nt, Mycobacterium tuberculosis H37Rv
acagcgcagccugcagcg

SEQ ID NO: 3239651 - RNA, 22 nt, Mycobacterium tuberculosis H37Rv
acagcgccaucgaugcggugaa

SEQ ID NO: 3239652 - RNA, 22 nt, Mycobacterium tuberculosis H37Rv
acagcgccaugcccucggcgcc

SEQ ID NO: 3239653 - RNA, 23 nt, Mycobacterium tuberculosis H37Rv
acagcgccuggccggaauacccg

SEQ ID NO: 3239654 - RNA, 13 nt, Mycobacterium tuberculosis H37Rv
acagcgcgcgcuc

SEQ ID NO: 3239655 - RNA, 15 nt, Mycobacterium tuberculosis H37Rv
acagcgcgcgcucgg

SEQ ID NO: 3239656 - RNA, 20 nt, Mycobacterium tuberculosis H37Rv
acagcgcgguguucgcggca

SEQ ID NO: 3239657 - RNA, 15 nt, Mycobacterium tuberculosis H37Rv
acagcggaccgauug

SEQ ID NO: 3239658 - RNA, 19 nt, Mycobacterium tuberculosis H37Rv
acagcggccauaucgccca

SEQ ID NO: 3239659 - RNA, 21 nt, Mycobacterium tuberculosis H37Rv
acagcggcgacaugaucugcc

SEQ ID NO: 3239660 - RNA, 20 nt, Mycobacterium tuberculosis H37Rv
acagcggcggcgucgacggc

SEQ ID NO: 3239661 - RNA, 22 nt, Mycobacterium tuberculosis H37Rv
acagcggcggcgucgacggcuc

SEQ ID NO: 3239662 - RNA, 18 nt, Mycobacterium tuberculosis H37Rv
acagcgggggcagcgcga

SEQ ID NO: 3239663 - RNA, 18 nt, Mycobacterium tuberculosis H37Rv
acagcggguccuucugcc

SEQ ID NO: 3239664 - RNA, 20 nt, Mycobacterium tuberculosis H37Rv
acagcggguucaacgcgcgc

SEQ ID NO: 3239665 - RNA, 18 nt, Mycobacterium tuberculosis H37Rv
acagcgucaaccggucca

SEQ ID NO: 3239666 - RNA, 18 nt, Mycobacterium tuberculosis H37Rv
acagcgucauccucgucg

SEQ ID NO: 3239667 - RNA, 16 nt, Mycobacterium tuberculosis H37Rv
acagcguccgucgucg

SEQ ID NO: 3239668 - RNA, 14 nt, Mycobacterium tuberculosis H37Rv
acagcgucucggag

SEQ ID NO: 3239669 - RNA, 21 nt, Mycobacterium tuberculosis H37Rv
acagcuaucccaggggcaccg

SEQ ID NO: 3239670 - RNA, 16 nt, Mycobacterium tuberculosis H37Rv
acagcugcacacagag

SEQ ID NO: 3239671 - RNA, 19 nt, Mycobacterium tuberculosis H37Rv
acagcuucgcgcagccggu

SEQ ID NO: 3239672 - RNA, 22 nt, Mycobacterium tuberculosis H37Rv
acagcuucuucguauaggcgau

SEQ ID NO: 3239673 - RNA, 16 nt, Mycobacterium tuberculosis H37Rv
acagcuugcguagcuc

SEQ ID NO: 3239674 - RNA, 23 nt, Mycobacterium tuberculosis H37Rv
acagcuuggacgugguguaucga

SEQ ID NO: 3239675 - RNA, 22 nt, Mycobacterium tuberculosis H37Rv
acagcuuggagaucgccgccgg

SEQ ID NO: 3239676 - RNA, 22 nt, Mycobacterium tuberculosis H37Rv
acaggaagucgcggacgucgcc

SEQ ID NO: 3239677 - RNA, 19 nt, Mycobacterium tuberculosis H37Rv
acaggacaauggacaccaa

SEQ ID NO: 3239678 - RNA, 13 nt, Mycobacterium tuberculosis H37Rv
acaggaccgggau

SEQ ID NO: 3239679 - RNA, 20 nt, Mycobacterium tuberculosis H37Rv
acaggaccggugggucugcu

SEQ ID NO: 3239680 - RNA, 13 nt, Mycobacterium tuberculosis H37Rv
acaggacgucggc

SEQ ID NO: 3239681 - RNA, 15 nt, Mycobacterium tuberculosis H37Rv
acaggacgucggcga

SEQ ID NO: 3239682 - RNA, 19 nt, Mycobacterium tuberculosis H37Rv
acaggagacgguacgccag

SEQ ID NO: 3239683 - RNA, 23 nt, Mycobacterium tuberculosis H37Rv
acaggauauugaccuucucgucg

SEQ ID NO: 3239684 - RNA, 14 nt, Mycobacterium tuberculosis H37Rv
acaggccccacacc

SEQ ID NO: 3239685 - RNA, 17 nt, Mycobacterium tuberculosis H37Rv
acaggcccgccagcagg

SEQ ID NO: 3239686 - RNA, 19 nt, Mycobacterium tuberculosis H37Rv
acaggcccgccagcagggc

SEQ ID NO: 3239687 - RNA, 16 nt, Mycobacterium tuberculosis H37Rv
acaggcccggcaccgc

SEQ ID NO: 3239688 - RNA, 20 nt, Mycobacterium tuberculosis H37Rv
acaggccgaagcucacacug

SEQ ID NO: 3239689 - RNA, 19 nt, Mycobacterium tuberculosis H37Rv
acaggccggccaccaccgc

SEQ ID NO: 3239690 - RNA, 12 nt, Mycobacterium tuberculosis H37Rv
acaggccgucga

SEQ ID NO: 3239691 - RNA, 18 nt, Mycobacterium tuberculosis H37Rv
acaggccuaggucgacgc

SEQ ID NO: 3239692 - RNA, 19 nt, Mycobacterium tuberculosis H37Rv
acaggccuaggucgacgcc

SEQ ID NO: 3239693 - RNA, 17 nt, Mycobacterium tuberculosis H37Rv
acaggcggcggccuggc

SEQ ID NO: 3239694 - RNA, 15 nt, Mycobacterium tuberculosis H37Rv
acaggcguccaucgc

SEQ ID NO: 3239695 - RNA, 16 nt, Mycobacterium tuberculosis H37Rv
acaggcugaagacgaa

SEQ ID NO: 3239696 - RNA, 20 nt, Mycobacterium tuberculosis H37Rv
acaggcugccauuccagauc

SEQ ID NO: 3239697 - RNA, 20 nt, Mycobacterium tuberculosis H37Rv
acaggcuggcgauggccguc

SEQ ID NO: 3239698 - RNA, 19 nt, Mycobacterium tuberculosis H37Rv
acaggcuugacugcacacc

SEQ ID NO: 3239699 - RNA, 20 nt, Mycobacterium tuberculosis H37Rv
acaggcuugacugcacacca

SEQ ID NO: 3239700 - RNA, 14 nt, Mycobacterium tuberculosis H37Rv
acagggaggucgcc

SEQ ID NO: 3239701 - RNA, 13 nt, Mycobacterium tuberculosis H37Rv
acagggcgccgac

SEQ ID NO: 3239702 - RNA, 16 nt, Mycobacterium tuberculosis H37Rv
acaggggccagcgcgc

SEQ ID NO: 3239703 - RNA, 22 nt, Mycobacterium tuberculosis H37Rv
acagggugggggcaucaggguc

SEQ ID NO: 3239704 - RNA, 21 nt, Mycobacterium tuberculosis H37Rv
acagguaagcagccagcaaca

SEQ ID NO: 3239705 - RNA, 15 nt, Mycobacterium tuberculosis H37Rv
acagguagucgccgg

SEQ ID NO: 3239706 - RNA, 16 nt, Mycobacterium tuberculosis H37Rv
accaagacaccggccu

SEQ ID NO: 3239707 - RNA, 19 nt, Mycobacterium tuberculosis H37Rv
accaagcccgucgucgugc

SEQ ID NO: 3239708 - RNA, 15 nt, Mycobacterium tuberculosis H37Rv
accaagcgugccugc

SEQ ID NO: 3239709 - RNA, 14 nt, Mycobacterium tuberculosis H37Rv
accaagcucggcca

SEQ ID NO: 3239710 - RNA, 17 nt, Mycobacterium tuberculosis H37Rv
accaagcucggccagca

SEQ ID NO: 3239711 - RNA, 20 nt, Mycobacterium tuberculosis H37Rv
accaagcucggccagcacgc

SEQ ID NO: 3239712 - RNA, 14 nt, Mycobacterium tuberculosis H37Rv
accaaggucggcga

SEQ ID NO: 3239713 - RNA, 23 nt, Mycobacterium tuberculosis H37Rv
accaagguuggucggugcugacc

SEQ ID NO: 3239714 - RNA, 16 nt, Mycobacterium tuberculosis H37Rv
accaaguagucggguu

SEQ ID NO: 3239715 - RNA, 15 nt, Mycobacterium tuberculosis H37Rv
accaagugucgccgc

SEQ ID NO: 3239716 - RNA, 18 nt, Mycobacterium tuberculosis H37Rv
accaauaccgcacccgcu

SEQ ID NO: 3239717 - RNA, 12 nt, Mycobacterium tuberculosis H37Rv
accaauccacug

SEQ ID NO: 3239718 - RNA, 15 nt, Mycobacterium tuberculosis H37Rv
accaauccaggccac

SEQ ID NO: 3239719 - RNA, 15 nt, Mycobacterium tuberculosis H37Rv
accaaugaccgccag

SEQ ID NO: 3239720 - RNA, 15 nt, Mycobacterium tuberculosis H37Rv
accaaugcagugcga

SEQ ID NO: 3239721 - RNA, 22 nt, Mycobacterium tuberculosis H37Rv
accaaugcgucgaugcgcugcu

SEQ ID NO: 3239722 - RNA, 22 nt, Mycobacterium tuberculosis H37Rv
accaaugcuccugguggcagaa

SEQ ID NO: 3239723 - RNA, 16 nt, Mycobacterium tuberculosis H37Rv
accaaugugccgguca

SEQ ID NO: 3239724 - RNA, 16 nt, Mycobacterium tuberculosis H37Rv
accaauuggucgaguc

SEQ ID NO: 3239725 - RNA, 15 nt, Mycobacterium tuberculosis H37Rv
accacaaccgugagc

SEQ ID NO: 3239726 - RNA, 16 nt, Mycobacterium tuberculosis H37Rv
accacaaccgugagca

SEQ ID NO: 3239727 - RNA, 15 nt, Mycobacterium tuberculosis H37Rv
accacaauccacgca

SEQ ID NO: 3239728 - RNA, 21 nt, Mycobacterium tuberculosis H37Rv
accacaauccacgcacucguc

SEQ ID NO: 3239729 - RNA, 19 nt, Mycobacterium tuberculosis H37Rv
accacaccacgauggcggc

SEQ ID NO: 3239730 - RNA, 14 nt, Mycobacterium tuberculosis H37Rv
accacaccggcagc

SEQ ID NO: 3239731 - RNA, 12 nt, Mycobacterium tuberculosis H37Rv
accacaccuucg

SEQ ID NO: 3239732 - RNA, 13 nt, Mycobacterium tuberculosis H37Rv
accacacuggcag

SEQ ID NO: 3239733 - RNA, 13 nt, Mycobacterium tuberculosis H37Rv
accacaucaccgg

SEQ ID NO: 3239734 - RNA, 14 nt, Mycobacterium tuberculosis H37Rv
accacaucaccggc

SEQ ID NO: 3239735 - RNA, 17 nt, Mycobacterium tuberculosis H37Rv
accacaucaugccagcc

SEQ ID NO: 3239736 - RNA, 21 nt, Mycobacterium tuberculosis H37Rv
accacaucgcgggcgugccga

SEQ ID NO: 3239737 - RNA, 24 nt, Mycobacterium tuberculosis H37Rv
accacaucggugccacguucgcgg

SEQ ID NO: 3239738 - RNA, 21 nt, Mycobacterium tuberculosis H37Rv
accacaucgguguggcccaac

SEQ ID NO: 3239739 - RNA, 20 nt, Mycobacterium tuberculosis H37Rv
accacaugcgagucgcacuc

SEQ ID NO: 3239740 - RNA, 22 nt, Mycobacterium tuberculosis H37Rv
accacauuggcgaucagcagcc

SEQ ID NO: 3239741 - RNA, 22 nt, Mycobacterium tuberculosis H37Rv
accaccaagcucggccagcacg

SEQ ID NO: 3239742 - RNA, 13 nt, Mycobacterium tuberculosis H37Rv
accaccaccgccg

SEQ ID NO: 3239743 - RNA, 14 nt, Mycobacterium tuberculosis H37Rv
accaccaccgccgc

SEQ ID NO: 3239744 - RNA, 17 nt, Mycobacterium tuberculosis H37Rv
accaccaccgccgccga

SEQ ID NO: 3239745 - RNA, 22 nt, Mycobacterium tuberculosis H37Rv
accaccaccgccggugccgcca

SEQ ID NO: 3239746 - RNA, 19 nt, Mycobacterium tuberculosis H37Rv
accaccacuaggucgccgg

SEQ ID NO: 3239747 - RNA, 13 nt, Mycobacterium tuberculosis H37Rv
accaccagcgcuc

SEQ ID NO: 3239748 - RNA, 13 nt, Mycobacterium tuberculosis H37Rv
accaccaggcuga

SEQ ID NO: 3239749 - RNA, 21 nt, Mycobacterium tuberculosis H37Rv
accaccaguggcgcgugcagc

SEQ ID NO: 3239750 - RNA, 14 nt, Mycobacterium tuberculosis H37Rv
accacccaacagcc

SEQ ID NO: 3239751 - RNA, 19 nt, Mycobacterium tuberculosis H37Rv
accacccaacagcccaccg

SEQ ID NO: 3239752 - RNA, 21 nt, Mycobacterium tuberculosis H37Rv
accacccaacagcccaccggu

SEQ ID NO: 3239753 - RNA, 14 nt, Mycobacterium tuberculosis H37Rv
accacccagauugc

SEQ ID NO: 3239754 - RNA, 14 nt, Mycobacterium tuberculosis H37Rv
accacccaggccau

SEQ ID NO: 3239755 - RNA, 12 nt, Mycobacterium tuberculosis H37Rv
accaccccagcg

SEQ ID NO: 3239756 - RNA, 13 nt, Mycobacterium tuberculosis H37Rv
accaccccagggc

SEQ ID NO: 3239757 - RNA, 20 nt, Mycobacterium tuberculosis H37Rv
accaccccguagcggucucc

SEQ ID NO: 3239758 - RNA, 15 nt, Mycobacterium tuberculosis H37Rv
accacccgccgcagc

SEQ ID NO: 3239759 - RNA, 17 nt, Mycobacterium tuberculosis H37Rv
accacccgguccugcuc

SEQ ID NO: 3239760 - RNA, 21 nt, Mycobacterium tuberculosis H37Rv
accaccgaaauacccagcgca

SEQ ID NO: 3239761 - RNA, 13 nt, Mycobacterium tuberculosis H37Rv
accaccgaccucg

SEQ ID NO: 3239762 - RNA, 15 nt, Mycobacterium tuberculosis H37Rv
accaccgaccucgac

SEQ ID NO: 3239763 - RNA, 18 nt, Mycobacterium tuberculosis H37Rv
accaccgcauaacgccag

SEQ ID NO: 3239764 - RNA, 22 nt, Mycobacterium tuberculosis H37Rv
accaccgccgaagcugcggguc

SEQ ID NO: 3239765 - RNA, 17 nt, Mycobacterium tuberculosis H37Rv
accaccgccgccggcac

SEQ ID NO: 3239766 - RNA, 20 nt, Mycobacterium tuberculosis H37Rv
accaccgccgccggcaccgc

SEQ ID NO: 3239767 - RNA, 11 nt, Mycobacterium tuberculosis H37Rv
accaccgccgg

SEQ ID NO: 3239768 - RNA, 24 nt, Mycobacterium tuberculosis H37Rv
accaccgccggugccgccaucgcc

SEQ ID NO: 3239769 - RNA, 20 nt, Mycobacterium tuberculosis H37Rv
accaccgcgaaagcaccgag

SEQ ID NO: 3239770 - RNA, 14 nt, Mycobacterium tuberculosis H37Rv
accaccgcgaccuc

SEQ ID NO: 3239771 - RNA, 18 nt, Mycobacterium tuberculosis H37Rv
accaccgcggcggcggcc

SEQ ID NO: 3239772 - RNA, 13 nt, Mycobacterium tuberculosis H37Rv
accaccgcucgcc

SEQ ID NO: 3239773 - RNA, 22 nt, Mycobacterium tuberculosis H37Rv
accaccgcugagccggugcacu

SEQ ID NO: 3239774 - RNA, 22 nt, Mycobacterium tuberculosis H37Rv
accaccgcugcgaagagcccgu

SEQ ID NO: 3239775 - RNA, 17 nt, Mycobacterium tuberculosis H37Rv
accaccggaaccaccag

SEQ ID NO: 3239776 - RNA, 20 nt, Mycobacterium tuberculosis H37Rv
accaccggccccaccgacag

SEQ ID NO: 3239777 - RNA, 20 nt, Mycobacterium tuberculosis H37Rv
accaccggccccaccggcac

SEQ ID NO: 3239778 - RNA, 21 nt, Mycobacterium tuberculosis H37Rv
accaccggccgucccgcgagc

SEQ ID NO: 3239779 - RNA, 18 nt, Mycobacterium tuberculosis H37Rv
accaccgggccgacagca

SEQ ID NO: 3239780 - RNA, 12 nt, Mycobacterium tuberculosis H37Rv
accaccgucacc

SEQ ID NO: 3239781 - RNA, 14 nt, Mycobacterium tuberculosis H37Rv
accaccgugaccga

SEQ ID NO: 3239782 - RNA, 19 nt, Mycobacterium tuberculosis H37Rv
accaccguggcgcccgcgu

SEQ ID NO: 3239783 - RNA, 21 nt, Mycobacterium tuberculosis H37Rv
accaccguugccgccgucacc

SEQ ID NO: 3239784 - RNA, 16 nt, Mycobacterium tuberculosis H37Rv
accaccguuugagcgg

SEQ ID NO: 3239785 - RNA, 13 nt, Mycobacterium tuberculosis H37Rv
accaccugcugca

SEQ ID NO: 3239786 - RNA, 21 nt, Mycobacterium tuberculosis H37Rv
accaccuggugcaaccgugcc

SEQ ID NO: 3239787 - RNA, 14 nt, Mycobacterium tuberculosis H37Rv
accaccugguuugu

SEQ ID NO: 3239788 - RNA, 21 nt, Mycobacterium tuberculosis H37Rv
accaccuuggaugcccugccc

SEQ ID NO: 3239789 - RNA, 20 nt, Mycobacterium tuberculosis H37Rv
accacgacgcgauggccgcc

SEQ ID NO: 3239790 - RNA, 21 nt, Mycobacterium tuberculosis H37Rv
accacgacgcgauggccgcca

SEQ ID NO: 3239791 - RNA, 22 nt, Mycobacterium tuberculosis H37Rv
accacgacgcgauggccgccag

SEQ ID NO: 3239792 - RNA, 16 nt, Mycobacterium tuberculosis H37Rv
accacgacgucgguga

SEQ ID NO: 3239793 - RNA, 18 nt, Mycobacterium tuberculosis H37Rv
accacgacguucgacgac

SEQ ID NO: 3239794 - RNA, 15 nt, Mycobacterium tuberculosis H37Rv
accacgacguugcga

SEQ ID NO: 3239795 - RNA, 14 nt, Mycobacterium tuberculosis H37Rv
accacgaggcuugc

SEQ ID NO: 3239796 - RNA, 17 nt, Mycobacterium tuberculosis H37Rv
accacgaucaacucgug

SEQ ID NO: 3239797 - RNA, 19 nt, Mycobacterium tuberculosis H37Rv
accacgaucaacucgugcg

SEQ ID NO: 3239798 - RNA, 17 nt, Mycobacterium tuberculosis H37Rv
accacgaucgcgagccc

SEQ ID NO: 3239799 - RNA, 13 nt, Mycobacterium tuberculosis H37Rv
accacgaugauca

SEQ ID NO: 3239800 - RNA, 14 nt, Mycobacterium tuberculosis H37Rv
accacgauggcggc

SEQ ID NO: 3239801 - RNA, 19 nt, Mycobacterium tuberculosis H37Rv
accacgauggcggccaccg

SEQ ID NO: 3239802 - RNA, 16 nt, Mycobacterium tuberculosis H37Rv
accagcgccgacccgu

SEQ ID NO: 3239803 - RNA, 21 nt, Mycobacterium tuberculosis H37Rv
accagcgccgauaccagccaa

SEQ ID NO: 3239804 - RNA, 19 nt, Mycobacterium tuberculosis H37Rv
accagcgccgcacccgcuc

SEQ ID NO: 3239805 - RNA, 21 nt, Mycobacterium tuberculosis H37Rv
accagcgccuugaccagcagc

SEQ ID NO: 3239806 - RNA, 14 nt, Mycobacterium tuberculosis H37Rv
accagcgcgagccc

SEQ ID NO: 3239807 - RNA, 21 nt, Mycobacterium tuberculosis H37Rv
accagcgcggcacaccccggu

SEQ ID NO: 3239808 - RNA, 17 nt, Mycobacterium tuberculosis H37Rv
accagcgcuccagcacc

SEQ ID NO: 3239809 - RNA, 14 nt, Mycobacterium tuberculosis H37Rv
accagcggcaccgc

SEQ ID NO: 3239810 - RNA, 17 nt, Mycobacterium tuberculosis H37Rv
accagcggcaccgcggc

SEQ ID NO: 3239811 - RNA, 20 nt, Mycobacterium tuberculosis H37Rv
accagcggccgaccgcgacc

SEQ ID NO: 3239812 - RNA, 23 nt, Mycobacterium tuberculosis H37Rv
accagcggcggcggcggcaagug

SEQ ID NO: 3239813 - RNA, 15 nt, Mycobacterium tuberculosis H37Rv
accagcgggcaucgc

SEQ ID NO: 3239814 - RNA, 16 nt, Mycobacterium tuberculosis H37Rv
accagcgggcaucgcg

SEQ ID NO: 3239815 - RNA, 17 nt, Mycobacterium tuberculosis H37Rv
accagcgggcaucgcga

SEQ ID NO: 3239816 - RNA, 18 nt, Mycobacterium tuberculosis H37Rv
accagcgucgcggccacg

SEQ ID NO: 3239817 - RNA, 23 nt, Mycobacterium tuberculosis H37Rv
accagcgucuucagguccaccgc

SEQ ID NO: 3239818 - RNA, 18 nt, Mycobacterium tuberculosis H37Rv
accagcguggggccgcca

SEQ ID NO: 3239819 - RNA, 14 nt, Mycobacterium tuberculosis H37Rv
accagcucagcugc

SEQ ID NO: 3239820 - RNA, 17 nt, Mycobacterium tuberculosis H37Rv
accagcucagcugcgga

SEQ ID NO: 3239821 - RNA, 20 nt, Mycobacterium tuberculosis H37Rv
accagcuguccucgcgggcu

SEQ ID NO: 3239822 - RNA, 18 nt, Mycobacterium tuberculosis H37Rv
accagcuguugucgcgga

SEQ ID NO: 3239823 - RNA, 16 nt, Mycobacterium tuberculosis H37Rv
accagcuugaccgacc

SEQ ID NO: 3239824 - RNA, 15 nt, Mycobacterium tuberculosis H37Rv
accaggaagcaggug

SEQ ID NO: 3239825 - RNA, 16 nt, Mycobacterium tuberculosis H37Rv
accaggaaguagauga

SEQ ID NO: 3239826 - RNA, 21 nt, Mycobacterium tuberculosis H37Rv
accaggaaugucuccaguagc

SEQ ID NO: 3239827 - RNA, 13 nt, Mycobacterium tuberculosis H37Rv
accaggaccaccg

SEQ ID NO: 3239828 - RNA, 18 nt, Mycobacterium tuberculosis H37Rv
accaggacguggucggga

SEQ ID NO: 3239829 - RNA, 13 nt, Mycobacterium tuberculosis H37Rv
accaggaucgaca

SEQ ID NO: 3239830 - RNA, 12 nt, Mycobacterium tuberculosis H37Rv
accaggccaacg

SEQ ID NO: 3239831 - RNA, 17 nt, Mycobacterium tuberculosis H37Rv
accaggccagagccgcc

SEQ ID NO: 3239832 - RNA, 16 nt, Mycobacterium tuberculosis H37Rv
accaggcccgguucga

SEQ ID NO: 3239833 - RNA, 16 nt, Mycobacterium tuberculosis H37Rv
accaggccgaaaucca

SEQ ID NO: 3239834 - RNA, 17 nt, Mycobacterium tuberculosis H37Rv
accaggccgagccgccc

SEQ ID NO: 3239835 - RNA, 15 nt, Mycobacterium tuberculosis H37Rv
accaggccgcgcgca

SEQ ID NO: 3239836 - RNA, 20 nt, Mycobacterium tuberculosis H37Rv
accaggccgcgcgcaccggu

SEQ ID NO: 3239837 - RNA, 13 nt, Mycobacterium tuberculosis H37Rv
accaggccggccc

SEQ ID NO: 3239838 - RNA, 13 nt, Mycobacterium tuberculosis H37Rv
accaggccgguga

SEQ ID NO: 3239839 - RNA, 14 nt, Mycobacterium tuberculosis H37Rv
accaggccggugac

SEQ ID NO: 3239840 - RNA, 20 nt, Mycobacterium tuberculosis H37Rv
accaggccguccucggucag

SEQ ID NO: 3239841 - RNA, 17 nt, Mycobacterium tuberculosis H37Rv
accaggcgagccgccac

SEQ ID NO: 3239842 - RNA, 16 nt, Mycobacterium tuberculosis H37Rv
accaggcggccguaac

SEQ ID NO: 3239843 - RNA, 16 nt, Mycobacterium tuberculosis H37Rv
accaggcggucagguc

SEQ ID NO: 3239844 - RNA, 20 nt, Mycobacterium tuberculosis H37Rv
accagggcacguucggcgca

SEQ ID NO: 3239845 - RNA, 16 nt, Mycobacterium tuberculosis H37Rv
accagggcagccgggu

SEQ ID NO: 3239846 - RNA, 14 nt, Mycobacterium tuberculosis H37Rv
accagggcagcggc

SEQ ID NO: 3239847 - RNA, 21 nt, Mycobacterium tuberculosis H37Rv
accagggccgccgcugccgcc

SEQ ID NO: 3239848 - RNA, 23 nt, Mycobacterium tuberculosis H37Rv
accagggccgccgcugccgccug

SEQ ID NO: 3239849 - RNA, 17 nt, Mycobacterium tuberculosis H37Rv
accagggccucgaccgc

SEQ ID NO: 3239850 - RNA, 19 nt, Mycobacterium tuberculosis H37Rv
accagggccucgaccgcca

SEQ ID NO: 3239851 - RNA, 18 nt, Mycobacterium tuberculosis H37Rv
accagggcgcggaucugc

SEQ ID NO: 3239852 - RNA, 16 nt, Mycobacterium tuberculosis H37Rv
accaggguggcaucga

SEQ ID NO: 3239853 - RNA, 18 nt, Mycobacterium tuberculosis H37Rv
accaggguguauggccac

SEQ ID NO: 3239854 - RNA, 16 nt, Mycobacterium tuberculosis H37Rv
accagguaaucaccug

SEQ ID NO: 3239855 - RNA, 18 nt, Mycobacterium tuberculosis H37Rv
accagguaaucaccuggc

SEQ ID NO: 3239856 - RNA, 17 nt, Mycobacterium tuberculosis H37Rv
accagguacgcgaucag

SEQ ID NO: 3239857 - RNA, 22 nt, Mycobacterium tuberculosis H37Rv
accagguacgggagcccgagcu

SEQ ID NO: 3239858 - RNA, 20 nt, Mycobacterium tuberculosis H37Rv
accagguccaguaccuuggc

SEQ ID NO: 3239859 - RNA, 15 nt, Mycobacterium tuberculosis H37Rv
accaggucggucagg

SEQ ID NO: 3239860 - RNA, 17 nt, Mycobacterium tuberculosis H37Rv
accaggucggucagguc

SEQ ID NO: 3239861 - RNA, 24 nt, Mycobacterium tuberculosis H37Rv
accaggucggugugcaucgccggc

SEQ ID NO: 3239862 - RNA, 16 nt, Mycobacterium tuberculosis H37Rv
accaggugccaggaug

SEQ ID NO: 3239863 - RNA, 18 nt, Mycobacterium tuberculosis H37Rv
accagguggccaggccgu

SEQ ID NO: 3239864 - RNA, 21 nt, Mycobacterium tuberculosis H37Rv
accagguguccccgcccggcc

SEQ ID NO: 3239865 - RNA, 15 nt, Mycobacterium tuberculosis H37Rv
accagguugccgagg

SEQ ID NO: 3239866 - RNA, 19 nt, Mycobacterium tuberculosis H37Rv
accaguaccgucaucgcgg

SEQ ID NO: 3239867 - RNA, 20 nt, Mycobacterium tuberculosis H37Rv
accaguaccgucaucgcggu

SEQ ID NO: 3239868 - RNA, 13 nt, Mycobacterium tuberculosis H37Rv
accagucgaagaa

SEQ ID NO: 3239869 - RNA, 12 nt, Mycobacterium tuberculosis H37Rv
accagugaccgc

SEQ ID NO: 3239870 - RNA, 15 nt, Mycobacterium tuberculosis H37Rv
accagugaccgcagu

SEQ ID NO: 3239871 - RNA, 16 nt, Mycobacterium tuberculosis H37Rv
accagugaucagcgca

SEQ ID NO: 3239872 - RNA, 22 nt, Mycobacterium tuberculosis H37Rv
accagugcgggguccagcggga

SEQ ID NO: 3239873 - RNA, 19 nt, Mycobacterium tuberculosis H37Rv
accagugcgguggcaggug

SEQ ID NO: 3239874 - RNA, 23 nt, Mycobacterium tuberculosis H37Rv
accaguggauuggcgaugacaau

SEQ ID NO: 3239875 - RNA, 20 nt, Mycobacterium tuberculosis H37Rv
accaguguggcgaugaccac

SEQ ID NO: 3239876 - RNA, 16 nt, Mycobacterium tuberculosis H37Rv
accaguucguggguca

SEQ ID NO: 3239877 - RNA, 20 nt, Mycobacterium tuberculosis H37Rv
accaguuggcgaucaaccgc

SEQ ID NO: 3239878 - RNA, 18 nt, Mycobacterium tuberculosis H37Rv
accauacccgcgcgcacc

SEQ ID NO: 3239879 - RNA, 21 nt, Mycobacterium tuberculosis H37Rv
accauacuaauggcgccaccg

SEQ ID NO: 3239880 - RNA, 12 nt, Mycobacterium tuberculosis H37Rv
accauagcucag

SEQ ID NO: 3239881 - RNA, 15 nt, Mycobacterium tuberculosis H37Rv
accaucaccacggcc

SEQ ID NO: 3239882 - RNA, 17 nt, Mycobacterium tuberculosis H37Rv
accaucaccacggccgc

SEQ ID NO: 3239883 - RNA, 21 nt, Mycobacterium tuberculosis H37Rv
accaucaccgccuuugccgcc

SEQ ID NO: 3239884 - RNA, 15 nt, Mycobacterium tuberculosis H37Rv
accaucaccgcgcca

SEQ ID NO: 3239885 - RNA, 23 nt, Mycobacterium tuberculosis H37Rv
accaucaccgcgccagccuccac

SEQ ID NO: 3239886 - RNA, 18 nt, Mycobacterium tuberculosis H37Rv
accaucaccucgcacgac

SEQ ID NO: 3239887 - RNA, 22 nt, Mycobacterium tuberculosis H37Rv
accaucacgcccuguucuccgu

SEQ ID NO: 3239888 - RNA, 15 nt, Mycobacterium tuberculosis H37Rv
accaucacgguggcc

SEQ ID NO: 3239889 - RNA, 20 nt, Mycobacterium tuberculosis H37Rv
accauccccggcaacaaagg

SEQ ID NO: 3239890 - RNA, 17 nt, Mycobacterium tuberculosis H37Rv
accaucgaggcgaucac

SEQ ID NO: 3239891 - RNA, 21 nt, Mycobacterium tuberculosis H37Rv
accaucgccgccguugccgcc

SEQ ID NO: 3239892 - RNA, 20 nt, Mycobacterium tuberculosis H37Rv
accaucgccucggcgcugcg

SEQ ID NO: 3239893 - RNA, 23 nt, Mycobacterium tuberculosis H37Rv
accaucgggucgucggcgucggu

SEQ ID NO: 3239894 - RNA, 23 nt, Mycobacterium tuberculosis H37Rv
accaucuccggugugaucggcgg

SEQ ID NO: 3239895 - RNA, 17 nt, Mycobacterium tuberculosis H37Rv
accaucuucacgaagug

SEQ ID NO: 3239896 - RNA, 20 nt, Mycobacterium tuberculosis H37Rv
accaugaagaacuggcugcu

SEQ ID NO: 3239897 - RNA, 18 nt, Mycobacterium tuberculosis H37Rv
accaugagcuugguggcc

SEQ ID NO: 3239898 - RNA, 17 nt, Mycobacterium tuberculosis H37Rv
acccccagcaaaggggu

SEQ ID NO: 3239899 - RNA, 13 nt, Mycobacterium tuberculosis H37Rv
accccccagcgcc

SEQ ID NO: 3239900 - RNA, 17 nt, Mycobacterium tuberculosis H37Rv
accccccccacccacca

SEQ ID NO: 3239901 - RNA, 18 nt, Mycobacterium tuberculosis H37Rv
accccccccacccaccac

SEQ ID NO: 3239902 - RNA, 16 nt, Mycobacterium tuberculosis H37Rv
accccccgggcccgcc

SEQ ID NO: 3239903 - RNA, 16 nt, Mycobacterium tuberculosis H37Rv
acccccgacaccgccg

SEQ ID NO: 3239904 - RNA, 17 nt, Mycobacterium tuberculosis H37Rv
acccccgauagcgaccg

SEQ ID NO: 3239905 - RNA, 18 nt, Mycobacterium tuberculosis H37Rv
acccccgauggcgucgcc

SEQ ID NO: 3239906 - RNA, 22 nt, Mycobacterium tuberculosis H37Rv
acccccggcauuccguaggcca

SEQ ID NO: 3239907 - RNA, 12 nt, Mycobacterium tuberculosis H37Rv
acccccgucgcc

SEQ ID NO: 3239908 - RNA, 15 nt, Mycobacterium tuberculosis H37Rv
accccgaacauccgc

SEQ ID NO: 3239909 - RNA, 15 nt, Mycobacterium tuberculosis H37Rv
accccgaagaugccu

SEQ ID NO: 3239910 - RNA, 24 nt, Mycobacterium tuberculosis H37Rv
accccgaagaugccugcuagcagc

SEQ ID NO: 3239911 - RNA, 14 nt, Mycobacterium tuberculosis H37Rv
accccgaccaccag

SEQ ID NO: 3239912 - RNA, 12 nt, Mycobacterium tuberculosis H37Rv
accccgaccgcu

SEQ ID NO: 3239913 - RNA, 15 nt, Mycobacterium tuberculosis H37Rv
accccgacgaugcgc

SEQ ID NO: 3239914 - RNA, 16 nt, Mycobacterium tuberculosis H37Rv
accccgacgaugcgca

SEQ ID NO: 3239915 - RNA, 14 nt, Mycobacterium tuberculosis H37Rv
accccgacggcaau

SEQ ID NO: 3239916 - RNA, 16 nt, Mycobacterium tuberculosis H37Rv
accccgagaccaacgc

SEQ ID NO: 3239917 - RNA, 18 nt, Mycobacterium tuberculosis H37Rv
accccgagaccaacgcgc

SEQ ID NO: 3239918 - RNA, 15 nt, Mycobacterium tuberculosis H37Rv
accccgagaccucgu

SEQ ID NO: 3239919 - RNA, 12 nt, Mycobacterium tuberculosis H37Rv
accccgagcugc

SEQ ID NO: 3239920 - RNA, 13 nt, Mycobacterium tuberculosis H37Rv
accccgaggccga

SEQ ID NO: 3239921 - RNA, 23 nt, Mycobacterium tuberculosis H37Rv
accccgaucuggcguagugcucg

SEQ ID NO: 3239922 - RNA, 17 nt, Mycobacterium tuberculosis H37Rv
accccgcagcucaccuc

SEQ ID NO: 3239923 - RNA, 20 nt, Mycobacterium tuberculosis H37Rv
accccgcagcucaccucaug

SEQ ID NO: 3239924 - RNA, 21 nt, Mycobacterium tuberculosis H37Rv
accccgcagcucaccucauga

SEQ ID NO: 3239925 - RNA, 12 nt, Mycobacterium tuberculosis H37Rv
accccgccgagc

SEQ ID NO: 3239926 - RNA, 15 nt, Mycobacterium tuberculosis H37Rv
accccgccgaucacc

SEQ ID NO: 3239927 - RNA, 12 nt, Mycobacterium tuberculosis H37Rv
accccgccgcca

SEQ ID NO: 3239928 - RNA, 22 nt, Mycobacterium tuberculosis H37Rv
accccgccgccacgggugacga

SEQ ID NO: 3239929 - RNA, 18 nt, Mycobacterium tuberculosis H37Rv
accccgcgcggugcccug

SEQ ID NO: 3239930 - RNA, 21 nt, Mycobacterium tuberculosis H37Rv
accccgcgcggugcccugccg

SEQ ID NO: 3239931 - RNA, 19 nt, Mycobacterium tuberculosis H37Rv
accccgcguaugccaggac

SEQ ID NO: 3239932 - RNA, 18 nt, Mycobacterium tuberculosis H37Rv
accccggaauccccaagc

SEQ ID NO: 3239933 - RNA, 22 nt, Mycobacterium tuberculosis H37Rv
accccggaauccccaagcccga

SEQ ID NO: 3239934 - RNA, 16 nt, Mycobacterium tuberculosis H37Rv
accccggaccgcggcc

SEQ ID NO: 3239935 - RNA, 17 nt, Mycobacterium tuberculosis H37Rv
accccggaccgcggcca

SEQ ID NO: 3239936 - RNA, 19 nt, Mycobacterium tuberculosis H37Rv
accccggaccgcggccacc

SEQ ID NO: 3239937 - RNA, 21 nt, Mycobacterium tuberculosis H37Rv
accccggaccgcggccaccgc

SEQ ID NO: 3239938 - RNA, 19 nt, Mycobacterium tuberculosis H37Rv
accccggcauacaacuggu

SEQ ID NO: 3239939 - RNA, 18 nt, Mycobacterium tuberculosis H37Rv
accccggccaccagcaug

SEQ ID NO: 3239940 - RNA, 14 nt, Mycobacterium tuberculosis H37Rv
accccggccacuug

SEQ ID NO: 3239941 - RNA, 13 nt, Mycobacterium tuberculosis H37Rv
accccggccggcu

SEQ ID NO: 3239942 - RNA, 14 nt, Mycobacterium tuberculosis H37Rv
accccggccuugcc

SEQ ID NO: 3239943 - RNA, 18 nt, Mycobacterium tuberculosis H37Rv
accccggccuugccaccg

SEQ ID NO: 3239944 - RNA, 13 nt, Mycobacterium tuberculosis H37Rv
accccggcugcgc

SEQ ID NO: 3239945 - RNA, 17 nt, Mycobacterium tuberculosis H37Rv
accccgggcgccgauca

SEQ ID NO: 3239946 - RNA, 13 nt, Mycobacterium tuberculosis H37Rv
accccgguggaca

SEQ ID NO: 3239947 - RNA, 23 nt, Mycobacterium tuberculosis H37Rv
accccgguucgacgucugcccag

SEQ ID NO: 3239948 - RNA, 23 nt, Mycobacterium tuberculosis H37Rv
accccguaggcgccgaaccagcg

SEQ ID NO: 3239949 - RNA, 15 nt, Mycobacterium tuberculosis H37Rv
accccguaggugcac

SEQ ID NO: 3239950 - RNA, 19 nt, Mycobacterium tuberculosis H37Rv
accccguuccacgaucacc

SEQ ID NO: 3239951 - RNA, 13 nt, Mycobacterium tuberculosis H37Rv
accccucgaccga

SEQ ID NO: 3239952 - RNA, 17 nt, Mycobacterium tuberculosis H37Rv
accccugcacggugccc

SEQ ID NO: 3239953 - RNA, 22 nt, Mycobacterium tuberculosis H37Rv
accccuggccgccggcgccgcc

SEQ ID NO: 3239954 - RNA, 12 nt, Mycobacterium tuberculosis H37Rv
accccuggcgau

SEQ ID NO: 3239955 - RNA, 17 nt, Mycobacterium tuberculosis H37Rv
accccugguagcaccca

SEQ ID NO: 3239956 - RNA, 21 nt, Mycobacterium tuberculosis H37Rv
accccugguagcacccacggc

SEQ ID NO: 3239957 - RNA, 22 nt, Mycobacterium tuberculosis H37Rv
accccuuggacugucccaccag

SEQ ID NO: 3239958 - RNA, 23 nt, Mycobacterium tuberculosis H37Rv
accccuuggacugucccaccagg

SEQ ID NO: 3239959 - RNA, 20 nt, Mycobacterium tuberculosis H37Rv
acccgaaaacugacccccug

SEQ ID NO: 3239960 - RNA, 14 nt, Mycobacterium tuberculosis H37Rv
acccgaaacaccgu

SEQ ID NO: 3239961 - RNA, 22 nt, Mycobacterium tuberculosis H37Rv
acccgaagauuucgggcgccga

SEQ ID NO: 3239962 - RNA, 14 nt, Mycobacterium tuberculosis H37Rv
acccgaagccggcg

SEQ ID NO: 3239963 - RNA, 21 nt, Mycobacterium tuberculosis H37Rv
acccgaaucccacagcaggag

SEQ ID NO: 3239964 - RNA, 18 nt, Mycobacterium tuberculosis H37Rv
acccgacaacgcugggcg

SEQ ID NO: 3239965 - RNA, 13 nt, Mycobacterium tuberculosis H37Rv
acccgacaucggc

SEQ ID NO: 3239966 - RNA, 20 nt, Mycobacterium tuberculosis H37Rv
acccgacaucggccagcgca

SEQ ID NO: 3239967 - RNA, 14 nt, Mycobacterium tuberculosis H37Rv
acccgacaugcgcc

SEQ ID NO: 3239968 - RNA, 17 nt, Mycobacterium tuberculosis H37Rv
acccgacaugguccgac

SEQ ID NO: 3239969 - RNA, 13 nt, Mycobacterium tuberculosis H37Rv
acccgaccagcac

SEQ ID NO: 3239970 - RNA, 14 nt, Mycobacterium tuberculosis H37Rv
acccgacgaugccg

SEQ ID NO: 3239971 - RNA, 11 nt, Mycobacterium tuberculosis H37Rv
acccgagauca

SEQ ID NO: 3239972 - RNA, 16 nt, Mycobacterium tuberculosis H37Rv
acccgagaucaccggu

SEQ ID NO: 3239973 - RNA, 12 nt, Mycobacterium tuberculosis H37Rv
acccgagccgcc

SEQ ID NO: 3239974 - RNA, 21 nt, Mycobacterium tuberculosis H37Rv
acccgagcuugggccggugca

SEQ ID NO: 3239975 - RNA, 14 nt, Mycobacterium tuberculosis H37Rv
acccgaguucgggc

SEQ ID NO: 3239976 - RNA, 18 nt, Mycobacterium tuberculosis H37Rv
acccgauaucaauggcag

SEQ ID NO: 3239977 - RNA, 21 nt, Mycobacterium tuberculosis H37Rv
acccgauaucaauggcagcug

SEQ ID NO: 3239978 - RNA, 19 nt, Mycobacterium tuberculosis H37Rv
acccgaucagguacgccag

SEQ ID NO: 3239979 - RNA, 23 nt, Mycobacterium tuberculosis H37Rv
acccgaucagguacgccaggugc

SEQ ID NO: 3239980 - RNA, 16 nt, Mycobacterium tuberculosis H37Rv
acccgaugugcccggc

SEQ ID NO: 3239981 - RNA, 19 nt, Mycobacterium tuberculosis H37Rv
acccgcaacgaggcaaacg

SEQ ID NO: 3239982 - RNA, 14 nt, Mycobacterium tuberculosis H37Rv
acccgcaaugaccg

SEQ ID NO: 3239983 - RNA, 12 nt, Mycobacterium tuberculosis H37Rv
acccgcaaugcg

SEQ ID NO: 3239984 - RNA, 13 nt, Mycobacterium tuberculosis H37Rv
acccgcaaugcgc

SEQ ID NO: 3239985 - RNA, 21 nt, Mycobacterium tuberculosis H37Rv
acccgcaauuccggugaucgc

SEQ ID NO: 3239986 - RNA, 14 nt, Mycobacterium tuberculosis H37Rv
acccgcaccaccgg

SEQ ID NO: 3239987 - RNA, 15 nt, Mycobacterium tuberculosis H37Rv
acccgcaccccggcc

SEQ ID NO: 3239988 - RNA, 12 nt, Mycobacterium tuberculosis H37Rv
acccgcaccgcc

SEQ ID NO: 3239989 - RNA, 13 nt, Mycobacterium tuberculosis H37Rv
acccgcaccgccg

SEQ ID NO: 3239990 - RNA, 16 nt, Mycobacterium tuberculosis H37Rv
acccgcaccgccggca

SEQ ID NO: 3239991 - RNA, 13 nt, Mycobacterium tuberculosis H37Rv
acccgcaccgggg

SEQ ID NO: 3239992 - RNA, 14 nt, Mycobacterium tuberculosis H37Rv
acccgcacggccuc

SEQ ID NO: 3239993 - RNA, 21 nt, Mycobacterium tuberculosis H37Rv
acccgcacguagaaguaggcg

SEQ ID NO: 3239994 - RNA, 22 nt, Mycobacterium tuberculosis H37Rv
acccgcacuccacgaucggccc

SEQ ID NO: 3239995 - RNA, 18 nt, Mycobacterium tuberculosis H37Rv
acccgucacaagcugaca

SEQ ID NO: 3239996 - RNA, 13 nt, Mycobacterium tuberculosis H37Rv
acccgucgaacgc

SEQ ID NO: 3239997 - RNA, 16 nt, Mycobacterium tuberculosis H37Rv
acccgucggcccgcuc

SEQ ID NO: 3239998 - RNA, 18 nt, Mycobacterium tuberculosis H37Rv
acccgucuuaucggcguc

SEQ ID NO: 3239999 - RNA, 19 nt, Mycobacterium tuberculosis H37Rv
acccgugcacgaucgcggu

SEQ ID NO: 3240000 - RNA, 14 nt, Mycobacterium tuberculosis H37Rv
acccgugccgccga

SEQ ID NO: 3240001 - RNA, 17 nt, Mycobacterium tuberculosis H37Rv
acccgugcggccacggu

SEQ ID NO: 3240002 - RNA, 19 nt, Mycobacterium tuberculosis H37Rv
acccguuaugcgccgccca

SEQ ID NO: 3240003 - RNA, 18 nt, Mycobacterium tuberculosis H37Rv
acccguuccacgccggca

SEQ ID NO: 3240004 - RNA, 20 nt, Mycobacterium tuberculosis H37Rv
acccguucgaacuggcuggu

SEQ ID NO: 3240005 - RNA, 22 nt, Mycobacterium tuberculosis H37Rv
acccguucuucgcgauguccuc

SEQ ID NO: 3240006 - RNA, 14 nt, Mycobacterium tuberculosis H37Rv
acccguugaacucg

SEQ ID NO: 3240007 - RNA, 22 nt, Mycobacterium tuberculosis H37Rv
acccguugagcauaugacgucg

SEQ ID NO: 3240008 - RNA, 20 nt, Mycobacterium tuberculosis H37Rv
acccguugaucgcggacacu

SEQ ID NO: 3240009 - RNA, 21 nt, Mycobacterium tuberculosis H37Rv
acccguuggauguuuuccggu

SEQ ID NO: 3240010 - RNA, 22 nt, Mycobacterium tuberculosis H37Rv
acccguuggauguuuuccgguc

SEQ ID NO: 3240011 - RNA, 17 nt, Mycobacterium tuberculosis H37Rv
acccuaaaccagccacc

SEQ ID NO: 3240012 - RNA, 18 nt, Mycobacterium tuberculosis H37Rv
acccucaagggcaaccgc

SEQ ID NO: 3240013 - RNA, 20 nt, Mycobacterium tuberculosis H37Rv
acccucagccgcgccggguc

SEQ ID NO: 3240014 - RNA, 13 nt, Mycobacterium tuberculosis H37Rv
acccuccagcacg

SEQ ID NO: 3240015 - RNA, 13 nt, Mycobacterium tuberculosis H37Rv
acccuccgcagcu

SEQ ID NO: 3240016 - RNA, 13 nt, Mycobacterium tuberculosis H37Rv
acccuccgccggu

SEQ ID NO: 3240017 - RNA, 16 nt, Mycobacterium tuberculosis H37Rv
acccucgccggucagc

SEQ ID NO: 3240018 - RNA, 22 nt, Mycobacterium tuberculosis H37Rv
acccucgcguagggccagcgcc

SEQ ID NO: 3240019 - RNA, 23 nt, Mycobacterium tuberculosis H37Rv
acccucgcguagggccagcgccu

SEQ ID NO: 3240020 - RNA, 19 nt, Mycobacterium tuberculosis H37Rv
acccucgggcgucacggug

SEQ ID NO: 3240021 - RNA, 21 nt, Mycobacterium tuberculosis H37Rv
acccucggggguccaguucag

SEQ ID NO: 3240022 - RNA, 14 nt, Mycobacterium tuberculosis H37Rv
acccucgucgucga

SEQ ID NO: 3240023 - RNA, 19 nt, Mycobacterium tuberculosis H37Rv
acccugaugugaguccagc

SEQ ID NO: 3240024 - RNA, 22 nt, Mycobacterium tuberculosis H37Rv
acccugcccuagcccgauucug

SEQ ID NO: 3240025 - RNA, 11 nt, Mycobacterium tuberculosis H37Rv
acccugcugcg

SEQ ID NO: 3240026 - RNA, 16 nt, Mycobacterium tuberculosis H37Rv
acccugcuugggcagc

SEQ ID NO: 3240027 - RNA, 13 nt, Mycobacterium tuberculosis H37Rv
acccugucgcgca

SEQ ID NO: 3240028 - RNA, 15 nt, Mycobacterium tuberculosis H37Rv
acccugucgcgcacc

SEQ ID NO: 3240029 - RNA, 19 nt, Mycobacterium tuberculosis H37Rv
acccugucgcgcaccggau

SEQ ID NO: 3240030 - RNA, 22 nt, Mycobacterium tuberculosis H37Rv
acccuucgccgggcaacgcgaa

SEQ ID NO: 3240031 - RNA, 21 nt, Mycobacterium tuberculosis H37Rv
acccuucgggcuggucgguca

SEQ ID NO: 3240032 - RNA, 14 nt, Mycobacterium tuberculosis H37Rv
acccuuugcacggu

SEQ ID NO: 3240033 - RNA, 16 nt, Mycobacterium tuberculosis H37Rv
accgaaaccggucagc

SEQ ID NO: 3240034 - RNA, 16 nt, Mycobacterium tuberculosis H37Rv
accgaaacgaugcggc

SEQ ID NO: 3240035 - RNA, 21 nt, Mycobacterium tuberculosis H37Rv
accgaaauacccagcgcagca

SEQ ID NO: 3240036 - RNA, 20 nt, Mycobacterium tuberculosis H37Rv
accgaacaacagcggcaacg

SEQ ID NO: 3240037 - RNA, 15 nt, Mycobacterium tuberculosis H37Rv
accgaacagcaccuc

SEQ ID NO: 3240038 - RNA, 19 nt, Mycobacterium tuberculosis H37Rv
accgaacagcaccuccgua

SEQ ID NO: 3240039 - RNA, 19 nt, Mycobacterium tuberculosis H37Rv
accgaacccgccaccgcga

SEQ ID NO: 3240040 - RNA, 23 nt, Mycobacterium tuberculosis H37Rv
accgaaccgcguuaugccaggcg

SEQ ID NO: 3240041 - RNA, 23 nt, Mycobacterium tuberculosis H37Rv
accgaaccgguguagcagcgcca

SEQ ID NO: 3240042 - RNA, 19 nt, Mycobacterium tuberculosis H37Rv
accgaaccgucagcggcaa

SEQ ID NO: 3240043 - RNA, 14 nt, Mycobacterium tuberculosis H37Rv
accgaaccuggucu

SEQ ID NO: 3240044 - RNA, 16 nt, Mycobacterium tuberculosis H37Rv
accgaacgcggccacc

SEQ ID NO: 3240045 - RNA, 15 nt, Mycobacterium tuberculosis H37Rv
accgaacuugcggac

SEQ ID NO: 3240046 - RNA, 17 nt, Mycobacterium tuberculosis H37Rv
accgaacuugcggaccu

SEQ ID NO: 3240047 - RNA, 13 nt, Mycobacterium tuberculosis H37Rv
accgaagaagccc

SEQ ID NO: 3240048 - RNA, 18 nt, Mycobacterium tuberculosis H37Rv
accgaagagcgcgcgcaa

SEQ ID NO: 3240049 - RNA, 21 nt, Mycobacterium tuberculosis H37Rv
accgaagagcuccgucgcggc

SEQ ID NO: 3240050 - RNA, 15 nt, Mycobacterium tuberculosis H37Rv
accgaagcgaacggc

SEQ ID NO: 3240051 - RNA, 14 nt, Mycobacterium tuberculosis H37Rv
accgaagucugcag

SEQ ID NO: 3240052 - RNA, 15 nt, Mycobacterium tuberculosis H37Rv
accgaauaccgccgc

SEQ ID NO: 3240053 - RNA, 13 nt, Mycobacterium tuberculosis H37Rv
accgaaucggcac

SEQ ID NO: 3240054 - RNA, 18 nt, Mycobacterium tuberculosis H37Rv
accgaauggccgccgcag

SEQ ID NO: 3240055 - RNA, 16 nt, Mycobacterium tuberculosis H37Rv
accgaauuacgcaccg

SEQ ID NO: 3240056 - RNA, 14 nt, Mycobacterium tuberculosis H37Rv
accgaauugaacug

SEQ ID NO: 3240057 - RNA, 14 nt, Mycobacterium tuberculosis H37Rv
accgacaccaccag

SEQ ID NO: 3240058 - RNA, 15 nt, Mycobacterium tuberculosis H37Rv
accgacagcacccgg

SEQ ID NO: 3240059 - RNA, 20 nt, Mycobacterium tuberculosis H37Rv
accgacagcacccggccacc

SEQ ID NO: 3240060 - RNA, 14 nt, Mycobacterium tuberculosis H37Rv
accgacagcggcac

SEQ ID NO: 3240061 - RNA, 15 nt, Mycobacterium tuberculosis H37Rv
accgacaucgucauc

SEQ ID NO: 3240062 - RNA, 16 nt, Mycobacterium tuberculosis H37Rv
accgacaucgucaucc

SEQ ID NO: 3240063 - RNA, 22 nt, Mycobacterium tuberculosis H37Rv
accgacauguguggcagcccca

SEQ ID NO: 3240064 - RNA, 21 nt, Mycobacterium tuberculosis H37Rv
accgaccccggaacgacccca

SEQ ID NO: 3240065 - RNA, 18 nt, Mycobacterium tuberculosis H37Rv
accgacccgcugccaccc

SEQ ID NO: 3240066 - RNA, 15 nt, Mycobacterium tuberculosis H37Rv
accgaccgaaagccg

SEQ ID NO: 3240067 - RNA, 13 nt, Mycobacterium tuberculosis H37Rv
accgaccgcgcug

SEQ ID NO: 3240068 - RNA, 17 nt, Mycobacterium tuberculosis H37Rv
accgaccgcgggcuccc

SEQ ID NO: 3240069 - RNA, 21 nt, Mycobacterium tuberculosis H37Rv
accgaccgcgggcuccccgca

SEQ ID NO: 3240070 - RNA, 12 nt, Mycobacterium tuberculosis H37Rv
accgaccgcguu

SEQ ID NO: 3240071 - RNA, 16 nt, Mycobacterium tuberculosis H37Rv
accgaccgggccgcac

SEQ ID NO: 3240072 - RNA, 22 nt, Mycobacterium tuberculosis H37Rv
accgaccgggucgcaaccgccg

SEQ ID NO: 3240073 - RNA, 15 nt, Mycobacterium tuberculosis H37Rv
accgacgacgcgcgc

SEQ ID NO: 3240074 - RNA, 22 nt, Mycobacterium tuberculosis H37Rv
accgacgaucaacggaacaucg

SEQ ID NO: 3240075 - RNA, 14 nt, Mycobacterium tuberculosis H37Rv
accgacgaugccgc

SEQ ID NO: 3240076 - RNA, 16 nt, Mycobacterium tuberculosis H37Rv
accgacgcagaacggc

SEQ ID NO: 3240077 - RNA, 15 nt, Mycobacterium tuberculosis H37Rv
accgacgccauuggc

SEQ ID NO: 3240078 - RNA, 13 nt, Mycobacterium tuberculosis H37Rv
accgacgccgaua

SEQ ID NO: 3240079 - RNA, 20 nt, Mycobacterium tuberculosis H37Rv
accgacgcguccggugcacc

SEQ ID NO: 3240080 - RNA, 15 nt, Mycobacterium tuberculosis H37Rv
accgacgcugaccaa

SEQ ID NO: 3240081 - RNA, 18 nt, Mycobacterium tuberculosis H37Rv
accgacggaaugucagcc

SEQ ID NO: 3240082 - RNA, 16 nt, Mycobacterium tuberculosis H37Rv
accgacgguaggcccg

SEQ ID NO: 3240083 - RNA, 13 nt, Mycobacterium tuberculosis H37Rv
accgacgucgcca

SEQ ID NO: 3240084 - RNA, 14 nt, Mycobacterium tuberculosis H37Rv
accgacgucgccca

SEQ ID NO: 3240085 - RNA, 20 nt, Mycobacterium tuberculosis H37Rv
accgacugcggguucgccga

SEQ ID NO: 3240086 - RNA, 22 nt, Mycobacterium tuberculosis H37Rv
accgacugcugucaccgcaacc

SEQ ID NO: 3240087 - RNA, 18 nt, Mycobacterium tuberculosis H37Rv
accgagacggcgucgggc

SEQ ID NO: 3240088 - RNA, 14 nt, Mycobacterium tuberculosis H37Rv
accgagaucaccgc

SEQ ID NO: 3240089 - RNA, 15 nt, Mycobacterium tuberculosis H37Rv
accgagaucaccgcc

SEQ ID NO: 3240090 - RNA, 17 nt, Mycobacterium tuberculosis H37Rv
accgagaucaccgccac

SEQ ID NO: 3240091 - RNA, 16 nt, Mycobacterium tuberculosis H37Rv
accgcccgcgccaccg

SEQ ID NO: 3240092 - RNA, 20 nt, Mycobacterium tuberculosis H37Rv
accgcccgcgccaccggcac

SEQ ID NO: 3240093 - RNA, 17 nt, Mycobacterium tuberculosis H37Rv
accgcccggcccggcuc

SEQ ID NO: 3240094 - RNA, 19 nt, Mycobacterium tuberculosis H37Rv
accgccgaccggaccgggg

SEQ ID NO: 3240095 - RNA, 19 nt, Mycobacterium tuberculosis H37Rv
accgccgacgccguugccc

SEQ ID NO: 3240096 - RNA, 23 nt, Mycobacterium tuberculosis H37Rv
accgccgacgccguugcccacgu

SEQ ID NO: 3240097 - RNA, 14 nt, Mycobacterium tuberculosis H37Rv
accgccgagccugc

SEQ ID NO: 3240098 - RNA, 16 nt, Mycobacterium tuberculosis H37Rv
accgccgauacaacgc

SEQ ID NO: 3240099 - RNA, 22 nt, Mycobacterium tuberculosis H37Rv
accgccgauacuucaucggcac

SEQ ID NO: 3240100 - RNA, 13 nt, Mycobacterium tuberculosis H37Rv
accgccgcaucgu

SEQ ID NO: 3240101 - RNA, 22 nt, Mycobacterium tuberculosis H37Rv
accgccgcaucguuuucgccga

SEQ ID NO: 3240102 - RNA, 22 nt, Mycobacterium tuberculosis H37Rv
accgccgccgacaaucaccaac

SEQ ID NO: 3240103 - RNA, 21 nt, Mycobacterium tuberculosis H37Rv
accgccgccgccgacgccgcc

SEQ ID NO: 3240104 - RNA, 22 nt, Mycobacterium tuberculosis H37Rv
accgccgccggaucgccgguga

SEQ ID NO: 3240105 - RNA, 13 nt, Mycobacterium tuberculosis H37Rv
accgccgccggca

SEQ ID NO: 3240106 - RNA, 14 nt, Mycobacterium tuberculosis H37Rv
accgccgccugccc

SEQ ID NO: 3240107 - RNA, 16 nt, Mycobacterium tuberculosis H37Rv
accgccgcgaccgccu

SEQ ID NO: 3240108 - RNA, 18 nt, Mycobacterium tuberculosis H37Rv
accgccgcgaccgccucg

SEQ ID NO: 3240109 - RNA, 19 nt, Mycobacterium tuberculosis H37Rv
accgccgcgaccgccucgc

SEQ ID NO: 3240110 - RNA, 20 nt, Mycobacterium tuberculosis H37Rv
accgccgcgaccgccucgcc

SEQ ID NO: 3240111 - RNA, 17 nt, Mycobacterium tuberculosis H37Rv
accgccgcgaccgcgag

SEQ ID NO: 3240112 - RNA, 18 nt, Mycobacterium tuberculosis H37Rv
accgccgcgcagccgcuc

SEQ ID NO: 3240113 - RNA, 12 nt, Mycobacterium tuberculosis H37Rv
accgccgcguca

SEQ ID NO: 3240114 - RNA, 19 nt, Mycobacterium tuberculosis H37Rv
accgccgcgucgagcaccu

SEQ ID NO: 3240115 - RNA, 21 nt, Mycobacterium tuberculosis H37Rv
accgccgcuaccccagccggc

SEQ ID NO: 3240116 - RNA, 13 nt, Mycobacterium tuberculosis H37Rv
accgccgcugcca

SEQ ID NO: 3240117 - RNA, 13 nt, Mycobacterium tuberculosis H37Rv
accgccgcugccg

SEQ ID NO: 3240118 - RNA, 17 nt, Mycobacterium tuberculosis H37Rv
accgccgcugccgccga

SEQ ID NO: 3240119 - RNA, 21 nt, Mycobacterium tuberculosis H37Rv
accgccggcaauaccgccagc

SEQ ID NO: 3240120 - RNA, 16 nt, Mycobacterium tuberculosis H37Rv
accgccggcaccgccg

SEQ ID NO: 3240121 - RNA, 19 nt, Mycobacterium tuberculosis H37Rv
accgccggcagcaucggca

SEQ ID NO: 3240122 - RNA, 20 nt, Mycobacterium tuberculosis H37Rv
accgccggcagcaucggcac

SEQ ID NO: 3240123 - RNA, 13 nt, Mycobacterium tuberculosis H37Rv
accgccggcgacg

SEQ ID NO: 3240124 - RNA, 14 nt, Mycobacterium tuberculosis H37Rv
accgccggcgcccc

SEQ ID NO: 3240125 - RNA, 20 nt, Mycobacterium tuberculosis H37Rv
accgccggcgccgccgucgc

SEQ ID NO: 3240126 - RNA, 21 nt, Mycobacterium tuberculosis H37Rv
accgccggcggcggccgcagc

SEQ ID NO: 3240127 - RNA, 15 nt, Mycobacterium tuberculosis H37Rv
accgccgggaagccg

SEQ ID NO: 3240128 - RNA, 17 nt, Mycobacterium tuberculosis H37Rv
accgccgggaucaccgg

SEQ ID NO: 3240129 - RNA, 14 nt, Mycobacterium tuberculosis H37Rv
accgccggugccga

SEQ ID NO: 3240130 - RNA, 16 nt, Mycobacterium tuberculosis H37Rv
accgccgucaccgcca

SEQ ID NO: 3240131 - RNA, 14 nt, Mycobacterium tuberculosis H37Rv
accgccgucgccac

SEQ ID NO: 3240132 - RNA, 14 nt, Mycobacterium tuberculosis H37Rv
accgccgucgccga

SEQ ID NO: 3240133 - RNA, 20 nt, Mycobacterium tuberculosis H37Rv
accgccguggccgcacugcu

SEQ ID NO: 3240134 - RNA, 21 nt, Mycobacterium tuberculosis H37Rv
accgccguuaccgacgccggu

SEQ ID NO: 3240135 - RNA, 21 nt, Mycobacterium tuberculosis H37Rv
accgccguugccaagcagcug

SEQ ID NO: 3240136 - RNA, 14 nt, Mycobacterium tuberculosis H37Rv
accgccguugccga

SEQ ID NO: 3240137 - RNA, 16 nt, Mycobacterium tuberculosis H37Rv
accgccguugccgccg

SEQ ID NO: 3240138 - RNA, 17 nt, Mycobacterium tuberculosis H37Rv
accgccguugccgccuu

SEQ ID NO: 3240139 - RNA, 16 nt, Mycobacterium tuberculosis H37Rv
accgccucacuggacc

SEQ ID NO: 3240140 - RNA, 13 nt, Mycobacterium tuberculosis H37Rv
accgccugcaaca

SEQ ID NO: 3240141 - RNA, 13 nt, Mycobacterium tuberculosis H37Rv
accgccugcgccg

SEQ ID NO: 3240142 - RNA, 13 nt, Mycobacterium tuberculosis H37Rv
accgccugcgccu

SEQ ID NO: 3240143 - RNA, 22 nt, Mycobacterium tuberculosis H37Rv
accgccugugccgccggcgcca

SEQ ID NO: 3240144 - RNA, 15 nt, Mycobacterium tuberculosis H37Rv
accgccuuggucacc

SEQ ID NO: 3240145 - RNA, 17 nt, Mycobacterium tuberculosis H37Rv
accgccuugucggcgau

SEQ ID NO: 3240146 - RNA, 15 nt, Mycobacterium tuberculosis H37Rv
accgccuuugcccgc

SEQ ID NO: 3240147 - RNA, 17 nt, Mycobacterium tuberculosis H37Rv
accgccuuugccgccgg

SEQ ID NO: 3240148 - RNA, 19 nt, Mycobacterium tuberculosis H37Rv
accgccuuugccgccggca

SEQ ID NO: 3240149 - RNA, 21 nt, Mycobacterium tuberculosis H37Rv
accgcgaaaauucgucgcguc

SEQ ID NO: 3240150 - RNA, 16 nt, Mycobacterium tuberculosis H37Rv
accgcgaaagcaccga

SEQ ID NO: 3240151 - RNA, 14 nt, Mycobacterium tuberculosis H37Rv
accgcgaccgcgca

SEQ ID NO: 3240152 - RNA, 16 nt, Mycobacterium tuberculosis H37Rv
accgcgacgagcggcc

SEQ ID NO: 3240153 - RNA, 14 nt, Mycobacterium tuberculosis H37Rv
accgcgacggcgcc

SEQ ID NO: 3240154 - RNA, 15 nt, Mycobacterium tuberculosis H37Rv
accgcgacggcgccg

SEQ ID NO: 3240155 - RNA, 14 nt, Mycobacterium tuberculosis H37Rv
accgcgagcagcac

SEQ ID NO: 3240156 - RNA, 18 nt, Mycobacterium tuberculosis H37Rv
accgcgagcagcacagca

SEQ ID NO: 3240157 - RNA, 17 nt, Mycobacterium tuberculosis H37Rv
accgcgagggccagcaa

SEQ ID NO: 3240158 - RNA, 17 nt, Mycobacterium tuberculosis H37Rv
accgcgaucaccaccgg

SEQ ID NO: 3240159 - RNA, 15 nt, Mycobacterium tuberculosis H37Rv
accgcgaugacgacg

SEQ ID NO: 3240160 - RNA, 18 nt, Mycobacterium tuberculosis H37Rv
accgcgcaacccggacga

SEQ ID NO: 3240161 - RNA, 22 nt, Mycobacterium tuberculosis H37Rv
accgcgcaacccggacgaacgc

SEQ ID NO: 3240162 - RNA, 12 nt, Mycobacterium tuberculosis H37Rv
accgcgcacgac

SEQ ID NO: 3240163 - RNA, 16 nt, Mycobacterium tuberculosis H37Rv
accgcgcacggcuggc

SEQ ID NO: 3240164 - RNA, 14 nt, Mycobacterium tuberculosis H37Rv
accgcgcagcggug

SEQ ID NO: 3240165 - RNA, 18 nt, Mycobacterium tuberculosis H37Rv
accgcgcaucaucgccca

SEQ ID NO: 3240166 - RNA, 18 nt, Mycobacterium tuberculosis H37Rv
accgcgccaacagaugcc

SEQ ID NO: 3240167 - RNA, 13 nt, Mycobacterium tuberculosis H37Rv
accgcgccagccu

SEQ ID NO: 3240168 - RNA, 21 nt, Mycobacterium tuberculosis H37Rv
accgcgcccuagcuggugcgc

SEQ ID NO: 3240169 - RNA, 16 nt, Mycobacterium tuberculosis H37Rv
accgcgcccuucagca

SEQ ID NO: 3240170 - RNA, 19 nt, Mycobacterium tuberculosis H37Rv
accgcgcccuucagcacgg

SEQ ID NO: 3240171 - RNA, 17 nt, Mycobacterium tuberculosis H37Rv
accgcgccgagcagacg

SEQ ID NO: 3240172 - RNA, 15 nt, Mycobacterium tuberculosis H37Rv
accgcgccgaucacc

SEQ ID NO: 3240173 - RNA, 15 nt, Mycobacterium tuberculosis H37Rv
accgcgccgcaucau

SEQ ID NO: 3240174 - RNA, 21 nt, Mycobacterium tuberculosis H37Rv
accgcgccggcggaagcggcg

SEQ ID NO: 3240175 - RNA, 23 nt, Mycobacterium tuberculosis H37Rv
accgcgccguaaagccaacuggu

SEQ ID NO: 3240176 - RNA, 16 nt, Mycobacterium tuberculosis H37Rv
accgcgccgucgucga

SEQ ID NO: 3240177 - RNA, 23 nt, Mycobacterium tuberculosis H37Rv
accgcgccgucgucgagcaccac

SEQ ID NO: 3240178 - RNA, 18 nt, Mycobacterium tuberculosis H37Rv
accgcgccgucgucgcgc

SEQ ID NO: 3240179 - RNA, 12 nt, Mycobacterium tuberculosis H37Rv
accgcgcgcgac

SEQ ID NO: 3240180 - RNA, 16 nt, Mycobacterium tuberculosis H37Rv
accgcgcgcgacacga

SEQ ID NO: 3240181 - RNA, 17 nt, Mycobacterium tuberculosis H37Rv
accgcgcggaucucacc

SEQ ID NO: 3240182 - RNA, 17 nt, Mycobacterium tuberculosis H37Rv
accgcgcggcgcagcac

SEQ ID NO: 3240183 - RNA, 17 nt, Mycobacterium tuberculosis H37Rv
accgcgcguugaagucg

SEQ ID NO: 3240184 - RNA, 18 nt, Mycobacterium tuberculosis H37Rv
accgcgcguuguggcgau

SEQ ID NO: 3240185 - RNA, 17 nt, Mycobacterium tuberculosis H37Rv
accgcgcucccggcguc

SEQ ID NO: 3240186 - RNA, 18 nt, Mycobacterium tuberculosis H37Rv
accgcgcucucggucaga

SEQ ID NO: 3240187 - RNA, 23 nt, Mycobacterium tuberculosis H37Rv
accgcgcugguugaacaugucca

SEQ ID NO: 3240188 - RNA, 23 nt, Mycobacterium tuberculosis H37Rv
accggauccauuagcacaucgcc

SEQ ID NO: 3240189 - RNA, 23 nt, Mycobacterium tuberculosis H37Rv
accggaucgucgaacagcaccgc

SEQ ID NO: 3240190 - RNA, 20 nt, Mycobacterium tuberculosis H37Rv
accggcaacaucagcaggac

SEQ ID NO: 3240191 - RNA, 21 nt, Mycobacterium tuberculosis H37Rv
accggcaagccacgccggucg

SEQ ID NO: 3240192 - RNA, 16 nt, Mycobacterium tuberculosis H37Rv
accggcaaucggcggc

SEQ ID NO: 3240193 - RNA, 17 nt, Mycobacterium tuberculosis H37Rv
accggcaccagcggcac

SEQ ID NO: 3240194 - RNA, 13 nt, Mycobacterium tuberculosis H37Rv
accggcacccccg

SEQ ID NO: 3240195 - RNA, 18 nt, Mycobacterium tuberculosis H37Rv
accggcacccccgucgcc

SEQ ID NO: 3240196 - RNA, 19 nt, Mycobacterium tuberculosis H37Rv
accggcacccccgucgcca

SEQ ID NO: 3240197 - RNA, 19 nt, Mycobacterium tuberculosis H37Rv
accggcacccgcuggcggu

SEQ ID NO: 3240198 - RNA, 18 nt, Mycobacterium tuberculosis H37Rv
accggcaccgccugcgcc

SEQ ID NO: 3240199 - RNA, 23 nt, Mycobacterium tuberculosis H37Rv
accggcaccggccgugccgccga

SEQ ID NO: 3240200 - RNA, 17 nt, Mycobacterium tuberculosis H37Rv
accggcacugcccagca

SEQ ID NO: 3240201 - RNA, 20 nt, Mycobacterium tuberculosis H37Rv
accggcauaacgaucccgug

SEQ ID NO: 3240202 - RNA, 14 nt, Mycobacterium tuberculosis H37Rv
accggcaugccgcc

SEQ ID NO: 3240203 - RNA, 21 nt, Mycobacterium tuberculosis H37Rv
accggccaacagucgcagcac

SEQ ID NO: 3240204 - RNA, 17 nt, Mycobacterium tuberculosis H37Rv
accggccaccagcccga

SEQ ID NO: 3240205 - RNA, 15 nt, Mycobacterium tuberculosis H37Rv
accggccacgaccuc

SEQ ID NO: 3240206 - RNA, 22 nt, Mycobacterium tuberculosis H37Rv
accggccacgaccucgggaucg

SEQ ID NO: 3240207 - RNA, 11 nt, Mycobacterium tuberculosis H37Rv
accggccagcc

SEQ ID NO: 3240208 - RNA, 19 nt, Mycobacterium tuberculosis H37Rv
accggccagccgacgcggc

SEQ ID NO: 3240209 - RNA, 20 nt, Mycobacterium tuberculosis H37Rv
accggccagcggcccgucac

SEQ ID NO: 3240210 - RNA, 13 nt, Mycobacterium tuberculosis H37Rv
accggccaguggg

SEQ ID NO: 3240211 - RNA, 16 nt, Mycobacterium tuberculosis H37Rv
accggcccagugggac

SEQ ID NO: 3240212 - RNA, 16 nt, Mycobacterium tuberculosis H37Rv
accggcccccggucga

SEQ ID NO: 3240213 - RNA, 15 nt, Mycobacterium tuberculosis H37Rv
accggcccgaugacc

SEQ ID NO: 3240214 - RNA, 18 nt, Mycobacterium tuberculosis H37Rv
accggcccgcagcagcau

SEQ ID NO: 3240215 - RNA, 18 nt, Mycobacterium tuberculosis H37Rv
accggcccgcauccgcac

SEQ ID NO: 3240216 - RNA, 19 nt, Mycobacterium tuberculosis H37Rv
accggcccgguccagcccc

SEQ ID NO: 3240217 - RNA, 15 nt, Mycobacterium tuberculosis H37Rv
accggccgcgacgac

SEQ ID NO: 3240218 - RNA, 17 nt, Mycobacterium tuberculosis H37Rv
accggccgcuauggccc

SEQ ID NO: 3240219 - RNA, 17 nt, Mycobacterium tuberculosis H37Rv
accggccgggugaacca

SEQ ID NO: 3240220 - RNA, 21 nt, Mycobacterium tuberculosis H37Rv
accggccgggugaaccaauug

SEQ ID NO: 3240221 - RNA, 14 nt, Mycobacterium tuberculosis H37Rv
accggccggugcca

SEQ ID NO: 3240222 - RNA, 15 nt, Mycobacterium tuberculosis H37Rv
accggccggugggua

SEQ ID NO: 3240223 - RNA, 16 nt, Mycobacterium tuberculosis H37Rv
accggccgugccgccg

SEQ ID NO: 3240224 - RNA, 19 nt, Mycobacterium tuberculosis H37Rv
accggccgugccgccgaca

SEQ ID NO: 3240225 - RNA, 15 nt, Mycobacterium tuberculosis H37Rv
accggccugcgcgac

SEQ ID NO: 3240226 - RNA, 21 nt, Mycobacterium tuberculosis H37Rv
accggccugcgcgaccgacca

SEQ ID NO: 3240227 - RNA, 21 nt, Mycobacterium tuberculosis H37Rv
accggccuucaaggaagccgc

SEQ ID NO: 3240228 - RNA, 19 nt, Mycobacterium tuberculosis H37Rv
accggccuuuccagcaccc

SEQ ID NO: 3240229 - RNA, 21 nt, Mycobacterium tuberculosis H37Rv
accggccuuuccagcaccccg

SEQ ID NO: 3240230 - RNA, 17 nt, Mycobacterium tuberculosis H37Rv
accggcgacgccggccu

SEQ ID NO: 3240231 - RNA, 15 nt, Mycobacterium tuberculosis H37Rv
accggcgauccggua

SEQ ID NO: 3240232 - RNA, 14 nt, Mycobacterium tuberculosis H37Rv
accggcgaucgggc

SEQ ID NO: 3240233 - RNA, 17 nt, Mycobacterium tuberculosis H37Rv
accggcgcaguagccga

SEQ ID NO: 3240234 - RNA, 20 nt, Mycobacterium tuberculosis H37Rv
accggcgcaguagccgacca

SEQ ID NO: 3240235 - RNA, 15 nt, Mycobacterium tuberculosis H37Rv
accggcgccaccgug

SEQ ID NO: 3240236 - RNA, 21 nt, Mycobacterium tuberculosis H37Rv
accggcgcccagcgccucgau

SEQ ID NO: 3240237 - RNA, 21 nt, Mycobacterium tuberculosis H37Rv
accggcgccccugucgaccgc

SEQ ID NO: 3240238 - RNA, 14 nt, Mycobacterium tuberculosis H37Rv
accggcgccgccgg

SEQ ID NO: 3240239 - RNA, 18 nt, Mycobacterium tuberculosis H37Rv
accggcgccgccgucgcc

SEQ ID NO: 3240240 - RNA, 12 nt, Mycobacterium tuberculosis H37Rv
accggcgccgcg

SEQ ID NO: 3240241 - RNA, 17 nt, Mycobacterium tuberculosis H37Rv
accggcgccgcgcggcu

SEQ ID NO: 3240242 - RNA, 21 nt, Mycobacterium tuberculosis H37Rv
accggcgccggaguugaagaa

SEQ ID NO: 3240243 - RNA, 13 nt, Mycobacterium tuberculosis H37Rv
accggcgccuccg

SEQ ID NO: 3240244 - RNA, 15 nt, Mycobacterium tuberculosis H37Rv
accggcgccuccggc

SEQ ID NO: 3240245 - RNA, 17 nt, Mycobacterium tuberculosis H37Rv
accggcgccuccggcac

SEQ ID NO: 3240246 - RNA, 23 nt, Mycobacterium tuberculosis H37Rv
accggcgccuccggcaccuccag

SEQ ID NO: 3240247 - RNA, 16 nt, Mycobacterium tuberculosis H37Rv
accggcgcgaccgcgg

SEQ ID NO: 3240248 - RNA, 12 nt, Mycobacterium tuberculosis H37Rv
accggcgcgccc

SEQ ID NO: 3240249 - RNA, 23 nt, Mycobacterium tuberculosis H37Rv
accggcgcggaacgcgucgccga

SEQ ID NO: 3240250 - RNA, 13 nt, Mycobacterium tuberculosis H37Rv
accggcgcgggca

SEQ ID NO: 3240251 - RNA, 17 nt, Mycobacterium tuberculosis H37Rv
accggcggauucggcgc

SEQ ID NO: 3240252 - RNA, 15 nt, Mycobacterium tuberculosis H37Rv
accggcggcgagcgg

SEQ ID NO: 3240253 - RNA, 22 nt, Mycobacterium tuberculosis H37Rv
accggcggcgccgaaaccgccg

SEQ ID NO: 3240254 - RNA, 15 nt, Mycobacterium tuberculosis H37Rv
accggcgggcgaacg

SEQ ID NO: 3240255 - RNA, 20 nt, Mycobacterium tuberculosis H37Rv
accggcgggcgaacgcuuca

SEQ ID NO: 3240256 - RNA, 19 nt, Mycobacterium tuberculosis H37Rv
accggcggucugcagugca

SEQ ID NO: 3240257 - RNA, 15 nt, Mycobacterium tuberculosis H37Rv
accggcgucgcugcc

SEQ ID NO: 3240258 - RNA, 16 nt, Mycobacterium tuberculosis H37Rv
accggcgucguugacc

SEQ ID NO: 3240259 - RNA, 15 nt, Mycobacterium tuberculosis H37Rv
accggcgugcagcac

SEQ ID NO: 3240260 - RNA, 15 nt, Mycobacterium tuberculosis H37Rv
accggcgugcugugc

SEQ ID NO: 3240261 - RNA, 18 nt, Mycobacterium tuberculosis H37Rv
accggcgugucacgucgc

SEQ ID NO: 3240262 - RNA, 21 nt, Mycobacterium tuberculosis H37Rv
accggcguucccacuggaggu

SEQ ID NO: 3240263 - RNA, 20 nt, Mycobacterium tuberculosis H37Rv
accggcuauaucccgccccg

SEQ ID NO: 3240264 - RNA, 22 nt, Mycobacterium tuberculosis H37Rv
accggcucaaggacgcaccgcc

SEQ ID NO: 3240265 - RNA, 16 nt, Mycobacterium tuberculosis H37Rv
accggcuccagcaugg

SEQ ID NO: 3240266 - RNA, 15 nt, Mycobacterium tuberculosis H37Rv
accggcucgaucucg

SEQ ID NO: 3240267 - RNA, 22 nt, Mycobacterium tuberculosis H37Rv
accggcucggaaaccgccccgu

SEQ ID NO: 3240268 - RNA, 19 nt, Mycobacterium tuberculosis H37Rv
accggcucguagcuggugc

SEQ ID NO: 3240269 - RNA, 23 nt, Mycobacterium tuberculosis H37Rv
accggcucgucgaugucgacguc

SEQ ID NO: 3240270 - RNA, 22 nt, Mycobacterium tuberculosis H37Rv
accggcugaccggggcgcccgg

SEQ ID NO: 3240271 - RNA, 22 nt, Mycobacterium tuberculosis H37Rv
accggcugauucgagccacaug

SEQ ID NO: 3240272 - RNA, 16 nt, Mycobacterium tuberculosis H37Rv
accggcugcaaccagc

SEQ ID NO: 3240273 - RNA, 21 nt, Mycobacterium tuberculosis H37Rv
accggcugcaaccagcggcac

SEQ ID NO: 3240274 - RNA, 13 nt, Mycobacterium tuberculosis H37Rv
accggcugcaggu

SEQ ID NO: 3240275 - RNA, 12 nt, Mycobacterium tuberculosis H37Rv
accggcuggcca

SEQ ID NO: 3240276 - RNA, 17 nt, Mycobacterium tuberculosis H37Rv
accggcuggccaggugg

SEQ ID NO: 3240277 - RNA, 18 nt, Mycobacterium tuberculosis H37Rv
accggcuggcccagcgac

SEQ ID NO: 3240278 - RNA, 15 nt, Mycobacterium tuberculosis H37Rv
accggcugggcgcca

SEQ ID NO: 3240279 - RNA, 16 nt, Mycobacterium tuberculosis H37Rv
accggcuggugccaac

SEQ ID NO: 3240280 - RNA, 21 nt, Mycobacterium tuberculosis H37Rv
accggcuggugccaacugcgc

SEQ ID NO: 3240281 - RNA, 17 nt, Mycobacterium tuberculosis H37Rv
accggcugguugaccga

SEQ ID NO: 3240282 - RNA, 19 nt, Mycobacterium tuberculosis H37Rv
accggcugguugaccgagu

SEQ ID NO: 3240283 - RNA, 20 nt, Mycobacterium tuberculosis H37Rv
accggcuugcccuccgggua

SEQ ID NO: 3240284 - RNA, 18 nt, Mycobacterium tuberculosis H37Rv
accgucgccggugacgac

SEQ ID NO: 3240285 - RNA, 14 nt, Mycobacterium tuberculosis H37Rv
accgucgcggguca

SEQ ID NO: 3240286 - RNA, 16 nt, Mycobacterium tuberculosis H37Rv
accgucgcgggucaca

SEQ ID NO: 3240287 - RNA, 15 nt, Mycobacterium tuberculosis H37Rv
accgucgcuaaagcu

SEQ ID NO: 3240288 - RNA, 16 nt, Mycobacterium tuberculosis H37Rv
accgucgggacggcca

SEQ ID NO: 3240289 - RNA, 19 nt, Mycobacterium tuberculosis H37Rv
accgucgggauggacggca

SEQ ID NO: 3240290 - RNA, 17 nt, Mycobacterium tuberculosis H37Rv
accgucggggaugccga

SEQ ID NO: 3240291 - RNA, 14 nt, Mycobacterium tuberculosis H37Rv
accgucgucaccgc

SEQ ID NO: 3240292 - RNA, 21 nt, Mycobacterium tuberculosis H37Rv
accgucguccgccgcagcgca

SEQ ID NO: 3240293 - RNA, 22 nt, Mycobacterium tuberculosis H37Rv
accgucuccggcgccaccgccg

SEQ ID NO: 3240294 - RNA, 23 nt, Mycobacterium tuberculosis H37Rv
accgucuccggcgccaccgccgc

SEQ ID NO: 3240295 - RNA, 14 nt, Mycobacterium tuberculosis H37Rv
accgucucgcaccg

SEQ ID NO: 3240296 - RNA, 18 nt, Mycobacterium tuberculosis H37Rv
accgucucgcaccgcguu

SEQ ID NO: 3240297 - RNA, 20 nt, Mycobacterium tuberculosis H37Rv
accgucuggaguucgucacc

SEQ ID NO: 3240298 - RNA, 22 nt, Mycobacterium tuberculosis H37Rv
accgucuggaguucgucaccgu

SEQ ID NO: 3240299 - RNA, 23 nt, Mycobacterium tuberculosis H37Rv
accgucuggaguucgucaccguu

SEQ ID NO: 3240300 - RNA, 15 nt, Mycobacterium tuberculosis H37Rv
accgucuggccguug

SEQ ID NO: 3240301 - RNA, 23 nt, Mycobacterium tuberculosis H37Rv
accgucuggccguugcccgacuc

SEQ ID NO: 3240302 - RNA, 22 nt, Mycobacterium tuberculosis H37Rv
accgucuuacucgucacggggu

SEQ ID NO: 3240303 - RNA, 16 nt, Mycobacterium tuberculosis H37Rv
accgugaaccgcccgc

SEQ ID NO: 3240304 - RNA, 15 nt, Mycobacterium tuberculosis H37Rv
accgugaacucgcgc

SEQ ID NO: 3240305 - RNA, 20 nt, Mycobacterium tuberculosis H37Rv
accgugacauaccaagggau

SEQ ID NO: 3240306 - RNA, 22 nt, Mycobacterium tuberculosis H37Rv
accgugaccgagaagcccaccg

SEQ ID NO: 3240307 - RNA, 14 nt, Mycobacterium tuberculosis H37Rv
accgugaccgccgc

SEQ ID NO: 3240308 - RNA, 15 nt, Mycobacterium tuberculosis H37Rv
accgugagcaccagc

SEQ ID NO: 3240309 - RNA, 16 nt, Mycobacterium tuberculosis H37Rv
accgugcacgucagcg

SEQ ID NO: 3240310 - RNA, 12 nt, Mycobacterium tuberculosis H37Rv
accgugccgucg

SEQ ID NO: 3240311 - RNA, 21 nt, Mycobacterium tuberculosis H37Rv
accgugcgccgaauggcggug

SEQ ID NO: 3240312 - RNA, 14 nt, Mycobacterium tuberculosis H37Rv
accgugcugggcau

SEQ ID NO: 3240313 - RNA, 20 nt, Mycobacterium tuberculosis H37Rv
accgugcugggcaucaccga

SEQ ID NO: 3240314 - RNA, 20 nt, Mycobacterium tuberculosis H37Rv
accgugcugggcgccgcgcu

SEQ ID NO: 3240315 - RNA, 13 nt, Mycobacterium tuberculosis H37Rv
accguggcagcug

SEQ ID NO: 3240316 - RNA, 19 nt, Mycobacterium tuberculosis H37Rv
accguggccucgaagggcu

SEQ ID NO: 3240317 - RNA, 14 nt, Mycobacterium tuberculosis H37Rv
accguggcggccuc

SEQ ID NO: 3240318 - RNA, 15 nt, Mycobacterium tuberculosis H37Rv
accguggcggccucc

SEQ ID NO: 3240319 - RNA, 17 nt, Mycobacterium tuberculosis H37Rv
accguggcggccuccuc

SEQ ID NO: 3240320 - RNA, 14 nt, Mycobacterium tuberculosis H37Rv
accguggcggggaa

SEQ ID NO: 3240321 - RNA, 23 nt, Mycobacterium tuberculosis H37Rv
accguggcggggaaaccggccag

SEQ ID NO: 3240322 - RNA, 22 nt, Mycobacterium tuberculosis H37Rv
accguggugagcuggucggcga

SEQ ID NO: 3240323 - RNA, 21 nt, Mycobacterium tuberculosis H37Rv
accgugguggacgaccgcgcg

SEQ ID NO: 3240324 - RNA, 12 nt, Mycobacterium tuberculosis H37Rv
accgugucaccg

SEQ ID NO: 3240325 - RNA, 13 nt, Mycobacterium tuberculosis H37Rv
accgugucaccgc

SEQ ID NO: 3240326 - RNA, 20 nt, Mycobacterium tuberculosis H37Rv
accgugucacgcgaccaccg

SEQ ID NO: 3240327 - RNA, 21 nt, Mycobacterium tuberculosis H37Rv
accgugucgccggcgaaguug

SEQ ID NO: 3240328 - RNA, 21 nt, Mycobacterium tuberculosis H37Rv
accguguugcugucgaaguug

SEQ ID NO: 3240329 - RNA, 19 nt, Mycobacterium tuberculosis H37Rv
accguuaccgccgucgcca

SEQ ID NO: 3240330 - RNA, 21 nt, Mycobacterium tuberculosis H37Rv
accguucgcucagggugucga

SEQ ID NO: 3240331 - RNA, 23 nt, Mycobacterium tuberculosis H37Rv
accguucguucccgcucgggcaa

SEQ ID NO: 3240332 - RNA, 21 nt, Mycobacterium tuberculosis H37Rv
accguugccgaaccacgcgcc

SEQ ID NO: 3240333 - RNA, 14 nt, Mycobacterium tuberculosis H37Rv
accguugccgccgu

SEQ ID NO: 3240334 - RNA, 21 nt, Mycobacterium tuberculosis H37Rv
accguugcgaagaagaaggcg

SEQ ID NO: 3240335 - RNA, 14 nt, Mycobacterium tuberculosis H37Rv
accguugcugcgca

SEQ ID NO: 3240336 - RNA, 14 nt, Mycobacterium tuberculosis H37Rv
accguugucgucca

SEQ ID NO: 3240337 - RNA, 19 nt, Mycobacterium tuberculosis H37Rv
accguuucgaucucgagca

SEQ ID NO: 3240338 - RNA, 16 nt, Mycobacterium tuberculosis H37Rv
accguuugguccauca

SEQ ID NO: 3240339 - RNA, 13 nt, Mycobacterium tuberculosis H37Rv
accuacccugcgc

SEQ ID NO: 3240340 - RNA, 21 nt, Mycobacterium tuberculosis H37Rv
accuaccgagaucaccgccac

SEQ ID NO: 3240341 - RNA, 20 nt, Mycobacterium tuberculosis H37Rv
accuacgaagcguugaccgc

SEQ ID NO: 3240342 - RNA, 22 nt, Mycobacterium tuberculosis H37Rv
accuacgaagcguugaccgcgg

SEQ ID NO: 3240343 - RNA, 21 nt, Mycobacterium tuberculosis H37Rv
accuagucaccuugaccgggu

SEQ ID NO: 3240344 - RNA, 16 nt, Mycobacterium tuberculosis H37Rv
accuauuggucgcucg

SEQ ID NO: 3240345 - RNA, 16 nt, Mycobacterium tuberculosis H37Rv
accucaacaccaggcc

SEQ ID NO: 3240346 - RNA, 18 nt, Mycobacterium tuberculosis H37Rv
accucaacaccaggccgu

SEQ ID NO: 3240347 - RNA, 23 nt, Mycobacterium tuberculosis H37Rv
accucaacaccaggccguccucg

SEQ ID NO: 3240348 - RNA, 18 nt, Mycobacterium tuberculosis H37Rv
accucaccaaccgcccga

SEQ ID NO: 3240349 - RNA, 19 nt, Mycobacterium tuberculosis H37Rv
accucaccugacacgcccg

SEQ ID NO: 3240350 - RNA, 14 nt, Mycobacterium tuberculosis H37Rv
accucacugcggcg

SEQ ID NO: 3240351 - RNA, 17 nt, Mycobacterium tuberculosis H37Rv
accucagaaaguccccg

SEQ ID NO: 3240352 - RNA, 12 nt, Mycobacterium tuberculosis H37Rv
accucagcgcgg

SEQ ID NO: 3240353 - RNA, 12 nt, Mycobacterium tuberculosis H37Rv
accucagcugcg

SEQ ID NO: 3240354 - RNA, 22 nt, Mycobacterium tuberculosis H37Rv
accucaucgcagacggcugcca

SEQ ID NO: 3240355 - RNA, 16 nt, Mycobacterium tuberculosis H37Rv
accuccaacaggccua

SEQ ID NO: 3240356 - RNA, 16 nt, Mycobacterium tuberculosis H37Rv
accuccagcaccaccg

SEQ ID NO: 3240357 - RNA, 14 nt, Mycobacterium tuberculosis H37Rv
accuccagugcggc

SEQ ID NO: 3240358 - RNA, 17 nt, Mycobacterium tuberculosis H37Rv
accucccacgccgccgu

SEQ ID NO: 3240359 - RNA, 13 nt, Mycobacterium tuberculosis H37Rv
accucccgcagcc

SEQ ID NO: 3240360 - RNA, 12 nt, Mycobacterium tuberculosis H37Rv
accucccgcgug

SEQ ID NO: 3240361 - RNA, 15 nt, Mycobacterium tuberculosis H37Rv
accucccuggccccc

SEQ ID NO: 3240362 - RNA, 16 nt, Mycobacterium tuberculosis H37Rv
accuccgccggcaccu

SEQ ID NO: 3240363 - RNA, 15 nt, Mycobacterium tuberculosis H37Rv
accuccggguccagg

SEQ ID NO: 3240364 - RNA, 17 nt, Mycobacterium tuberculosis H37Rv
accuccggguccaggaa

SEQ ID NO: 3240365 - RNA, 20 nt, Mycobacterium tuberculosis H37Rv
accuccucgaaggcuucgcu

SEQ ID NO: 3240366 - RNA, 14 nt, Mycobacterium tuberculosis H37Rv
accuccucgagcag

SEQ ID NO: 3240367 - RNA, 20 nt, Mycobacterium tuberculosis H37Rv
accuccugcgagugcggcac

SEQ ID NO: 3240368 - RNA, 19 nt, Mycobacterium tuberculosis H37Rv
accucgacgccccaggaca

SEQ ID NO: 3240369 - RNA, 21 nt, Mycobacterium tuberculosis H37Rv
accucgaugccgccccgcagc

SEQ ID NO: 3240370 - RNA, 23 nt, Mycobacterium tuberculosis H37Rv
accucgaugccgccccgcagcug

SEQ ID NO: 3240371 - RNA, 21 nt, Mycobacterium tuberculosis H37Rv
accucgccaucgaccuugagc

SEQ ID NO: 3240372 - RNA, 12 nt, Mycobacterium tuberculosis H37Rv
accucgcccucc

SEQ ID NO: 3240373 - RNA, 17 nt, Mycobacterium tuberculosis H37Rv
accucgcccugcagacg

SEQ ID NO: 3240374 - RNA, 11 nt, Mycobacterium tuberculosis H37Rv
accucgccggc

SEQ ID NO: 3240375 - RNA, 21 nt, Mycobacterium tuberculosis H37Rv
accucgccggccgucagcaca

SEQ ID NO: 3240376 - RNA, 23 nt, Mycobacterium tuberculosis H37Rv
accucgccggccgucagcacaaa

SEQ ID NO: 3240377 - RNA, 16 nt, Mycobacterium tuberculosis H37Rv
accucgccggugacgg

SEQ ID NO: 3240378 - RNA, 19 nt, Mycobacterium tuberculosis H37Rv
accucgcgggugcugguca

SEQ ID NO: 3240379 - RNA, 15 nt, Mycobacterium tuberculosis H37Rv
accucggaucgccag

SEQ ID NO: 3240380 - RNA, 19 nt, Mycobacterium tuberculosis H37Rv
acgaacaccagcgcgccgu

SEQ ID NO: 3240381 - RNA, 12 nt, Mycobacterium tuberculosis H37Rv
acgaacaccccg

SEQ ID NO: 3240382 - RNA, 18 nt, Mycobacterium tuberculosis H37Rv
acgaacaccccgggcgcc

SEQ ID NO: 3240383 - RNA, 15 nt, Mycobacterium tuberculosis H37Rv
acgaaccgccgccgc

SEQ ID NO: 3240384 - RNA, 16 nt, Mycobacterium tuberculosis H37Rv
acgaaccggaucaucg

SEQ ID NO: 3240385 - RNA, 17 nt, Mycobacterium tuberculosis H37Rv
acgaacgccgucgacgc

SEQ ID NO: 3240386 - RNA, 21 nt, Mycobacterium tuberculosis H37Rv
acgaacgcgccggucagcaau

SEQ ID NO: 3240387 - RNA, 22 nt, Mycobacterium tuberculosis H37Rv
acgaacugugcuauggccgcac

SEQ ID NO: 3240388 - RNA, 19 nt, Mycobacterium tuberculosis H37Rv
acgaagacuugcaucaaaa

SEQ ID NO: 3240389 - RNA, 15 nt, Mycobacterium tuberculosis H37Rv
acgaagagcaccgcg

SEQ ID NO: 3240390 - RNA, 21 nt, Mycobacterium tuberculosis H37Rv
acgaagagggcgccgcgcgca

SEQ ID NO: 3240391 - RNA, 22 nt, Mycobacterium tuberculosis H37Rv
acgaagaucgcgugccacagca

SEQ ID NO: 3240392 - RNA, 21 nt, Mycobacterium tuberculosis H37Rv
acgaagccggcuucggugagc

SEQ ID NO: 3240393 - RNA, 18 nt, Mycobacterium tuberculosis H37Rv
acgaagcguugaccgcgg

SEQ ID NO: 3240394 - RNA, 15 nt, Mycobacterium tuberculosis H37Rv
acgaagcuggcgugc

SEQ ID NO: 3240395 - RNA, 18 nt, Mycobacterium tuberculosis H37Rv
acgaaggauucgaagccg

SEQ ID NO: 3240396 - RNA, 23 nt, Mycobacterium tuberculosis H37Rv
acgaaggucgcggucgagcaggu

SEQ ID NO: 3240397 - RNA, 12 nt, Mycobacterium tuberculosis H37Rv
acgaaugcagca

SEQ ID NO: 3240398 - RNA, 13 nt, Mycobacterium tuberculosis H37Rv
acgaauggggcca

SEQ ID NO: 3240399 - RNA, 15 nt, Mycobacterium tuberculosis H37Rv
acgacaacacccacg

SEQ ID NO: 3240400 - RNA, 14 nt, Mycobacterium tuberculosis H37Rv
acgacaacagccag

SEQ ID NO: 3240401 - RNA, 16 nt, Mycobacterium tuberculosis H37Rv
acgacaagugcccggc

SEQ ID NO: 3240402 - RNA, 16 nt, Mycobacterium tuberculosis H37Rv
acgacaccagaucguu

SEQ ID NO: 3240403 - RNA, 15 nt, Mycobacterium tuberculosis H37Rv
acgacaccucgaagg

SEQ ID NO: 3240404 - RNA, 16 nt, Mycobacterium tuberculosis H37Rv
acgacaggcgcccaca

SEQ ID NO: 3240405 - RNA, 21 nt, Mycobacterium tuberculosis H37Rv
acgacagguguuggacgccuu

SEQ ID NO: 3240406 - RNA, 20 nt, Mycobacterium tuberculosis H37Rv
acgacagucgcagucgcuaa

SEQ ID NO: 3240407 - RNA, 23 nt, Mycobacterium tuberculosis H37Rv
acgacaucgagccaacgcgcaga

SEQ ID NO: 3240408 - RNA, 17 nt, Mycobacterium tuberculosis H37Rv
acgacaucgucgcgacg

SEQ ID NO: 3240409 - RNA, 20 nt, Mycobacterium tuberculosis H37Rv
acgacaugaccgacaggugc

SEQ ID NO: 3240410 - RNA, 14 nt, Mycobacterium tuberculosis H37Rv
acgaccacaccacg

SEQ ID NO: 3240411 - RNA, 21 nt, Mycobacterium tuberculosis H37Rv
acgaccaccuucugacgcggc

SEQ ID NO: 3240412 - RNA, 12 nt, Mycobacterium tuberculosis H37Rv
acgaccagcaga

SEQ ID NO: 3240413 - RNA, 23 nt, Mycobacterium tuberculosis H37Rv
acgaccccacccuaaucguuccg

SEQ ID NO: 3240414 - RNA, 14 nt, Mycobacterium tuberculosis H37Rv
acgaccccgucgac

SEQ ID NO: 3240415 - RNA, 21 nt, Mycobacterium tuberculosis H37Rv
acgacccgcuggucgaugccu

SEQ ID NO: 3240416 - RNA, 14 nt, Mycobacterium tuberculosis H37Rv
acgacccgggaagg

SEQ ID NO: 3240417 - RNA, 22 nt, Mycobacterium tuberculosis H37Rv
acgacccgggaaggaaccgggc

SEQ ID NO: 3240418 - RNA, 23 nt, Mycobacterium tuberculosis H37Rv
acgacccgggaaggaaccgggca

SEQ ID NO: 3240419 - RNA, 17 nt, Mycobacterium tuberculosis H37Rv
acgaccgcgcaacaccu

SEQ ID NO: 3240420 - RNA, 18 nt, Mycobacterium tuberculosis H37Rv
acgaccgucggcuccagg

SEQ ID NO: 3240421 - RNA, 17 nt, Mycobacterium tuberculosis H37Rv
acgacgacaagugcccg

SEQ ID NO: 3240422 - RNA, 13 nt, Mycobacterium tuberculosis H37Rv
acgacgacaccgc

SEQ ID NO: 3240423 - RNA, 22 nt, Mycobacterium tuberculosis H37Rv
acgacgaucaagccuucgucga

SEQ ID NO: 3240424 - RNA, 12 nt, Mycobacterium tuberculosis H37Rv
acgacgccaccu

SEQ ID NO: 3240425 - RNA, 20 nt, Mycobacterium tuberculosis H37Rv
acgacgccgucggacaccgc

SEQ ID NO: 3240426 - RNA, 16 nt, Mycobacterium tuberculosis H37Rv
acgacgcgauggccgc

SEQ ID NO: 3240427 - RNA, 21 nt, Mycobacterium tuberculosis H37Rv
acgacggcaccgaugcacucc

SEQ ID NO: 3240428 - RNA, 20 nt, Mycobacterium tuberculosis H37Rv
acgacggcacgccauaaaga

SEQ ID NO: 3240429 - RNA, 13 nt, Mycobacterium tuberculosis H37Rv
acgacggcugacc

SEQ ID NO: 3240430 - RNA, 16 nt, Mycobacterium tuberculosis H37Rv
acgacgggaaccagcg

SEQ ID NO: 3240431 - RNA, 22 nt, Mycobacterium tuberculosis H37Rv
acgacgggaaccagcggucggc

SEQ ID NO: 3240432 - RNA, 22 nt, Mycobacterium tuberculosis H37Rv
acgacgggccgaguucgucagc

SEQ ID NO: 3240433 - RNA, 23 nt, Mycobacterium tuberculosis H37Rv
acgacgggccgaguucgucagcg

SEQ ID NO: 3240434 - RNA, 19 nt, Mycobacterium tuberculosis H37Rv
acgacguccucgacgauca

SEQ ID NO: 3240435 - RNA, 14 nt, Mycobacterium tuberculosis H37Rv
acgacgucggcguu

SEQ ID NO: 3240436 - RNA, 19 nt, Mycobacterium tuberculosis H37Rv
acgacgucggugaacgcgu

SEQ ID NO: 3240437 - RNA, 15 nt, Mycobacterium tuberculosis H37Rv
acgacguucgacgac

SEQ ID NO: 3240438 - RNA, 22 nt, Mycobacterium tuberculosis H37Rv
acgacugcggcaaacgugauca

SEQ ID NO: 3240439 - RNA, 14 nt, Mycobacterium tuberculosis H37Rv
acgacuggcgccca

SEQ ID NO: 3240440 - RNA, 21 nt, Mycobacterium tuberculosis H37Rv
acgacugucccagcucccgcg

SEQ ID NO: 3240441 - RNA, 19 nt, Mycobacterium tuberculosis H37Rv
acgagauacggccaccagg

SEQ ID NO: 3240442 - RNA, 17 nt, Mycobacterium tuberculosis H37Rv
acgagauagcauccgcc

SEQ ID NO: 3240443 - RNA, 17 nt, Mycobacterium tuberculosis H37Rv
acgagcagaucgcgggc

SEQ ID NO: 3240444 - RNA, 18 nt, Mycobacterium tuberculosis H37Rv
acgagcagauggugaacg

SEQ ID NO: 3240445 - RNA, 21 nt, Mycobacterium tuberculosis H37Rv
acgagcagauggugaacgugc

SEQ ID NO: 3240446 - RNA, 14 nt, Mycobacterium tuberculosis H37Rv
acgagcagcaaucc

SEQ ID NO: 3240447 - RNA, 20 nt, Mycobacterium tuberculosis H37Rv
acgagccacggcuucgccgc

SEQ ID NO: 3240448 - RNA, 16 nt, Mycobacterium tuberculosis H37Rv
acgagccagaggugga

SEQ ID NO: 3240449 - RNA, 20 nt, Mycobacterium tuberculosis H37Rv
acgagccagagguggaucag

SEQ ID NO: 3240450 - RNA, 23 nt, Mycobacterium tuberculosis H37Rv
acgagccagggaggggccgucag

SEQ ID NO: 3240451 - RNA, 22 nt, Mycobacterium tuberculosis H37Rv
acgagccgguggcgugggcacu

SEQ ID NO: 3240452 - RNA, 22 nt, Mycobacterium tuberculosis H37Rv
acgagccguccaauuccgcaga

SEQ ID NO: 3240453 - RNA, 16 nt, Mycobacterium tuberculosis H37Rv
acgagcgaaggugaac

SEQ ID NO: 3240454 - RNA, 12 nt, Mycobacterium tuberculosis H37Rv
acgagcgauacg

SEQ ID NO: 3240455 - RNA, 17 nt, Mycobacterium tuberculosis H37Rv
acgagcgauacgucguc

SEQ ID NO: 3240456 - RNA, 15 nt, Mycobacterium tuberculosis H37Rv
acgagcggcuucagc

SEQ ID NO: 3240457 - RNA, 17 nt, Mycobacterium tuberculosis H37Rv
acgagcgucagauccgg

SEQ ID NO: 3240458 - RNA, 14 nt, Mycobacterium tuberculosis H37Rv
acgagcguccgggu

SEQ ID NO: 3240459 - RNA, 23 nt, Mycobacterium tuberculosis H37Rv
acgagcuguacuugggauugcgg

SEQ ID NO: 3240460 - RNA, 14 nt, Mycobacterium tuberculosis H37Rv
acgaggacgucacc

SEQ ID NO: 3240461 - RNA, 16 nt, Mycobacterium tuberculosis H37Rv
acgaggaugucgauga

SEQ ID NO: 3240462 - RNA, 23 nt, Mycobacterium tuberculosis H37Rv
acgaggcggucgaucauggcggc

SEQ ID NO: 3240463 - RNA, 24 nt, Mycobacterium tuberculosis H37Rv
acgaggcggucgaucauggcggca

SEQ ID NO: 3240464 - RNA, 22 nt, Mycobacterium tuberculosis H37Rv
acgaggcguucaccacgaucgc

SEQ ID NO: 3240465 - RNA, 20 nt, Mycobacterium tuberculosis H37Rv
acgagggccacguagcagca

SEQ ID NO: 3240466 - RNA, 13 nt, Mycobacterium tuberculosis H37Rv
acgagggccagca

SEQ ID NO: 3240467 - RNA, 16 nt, Mycobacterium tuberculosis H37Rv
acgagggccagcagcc

SEQ ID NO: 3240468 - RNA, 14 nt, Mycobacterium tuberculosis H37Rv
acgaggucgccgca

SEQ ID NO: 3240469 - RNA, 14 nt, Mycobacterium tuberculosis H37Rv
acgaggucugcggc

SEQ ID NO: 3240470 - RNA, 15 nt, Mycobacterium tuberculosis H37Rv
acgagguugccgcac

SEQ ID NO: 3240471 - RNA, 24 nt, Mycobacterium tuberculosis H37Rv
acgagguugccgcaccagucgcgc

SEQ ID NO: 3240472 - RNA, 19 nt, Mycobacterium tuberculosis H37Rv
acgaguccguggagcgggg

SEQ ID NO: 3240473 - RNA, 21 nt, Mycobacterium tuberculosis H37Rv
acgagucgccgcgggcagcga

SEQ ID NO: 3240474 - RNA, 23 nt, Mycobacterium tuberculosis H37Rv
acgauagaacguagcgcccaccg

SEQ ID NO: 3240475 - RNA, 14 nt, Mycobacterium tuberculosis H37Rv
acgccacgacgucg

SEQ ID NO: 3240476 - RNA, 18 nt, Mycobacterium tuberculosis H37Rv
acgccacggcaucggcca

SEQ ID NO: 3240477 - RNA, 16 nt, Mycobacterium tuberculosis H37Rv
acgccacugccagccg

SEQ ID NO: 3240478 - RNA, 14 nt, Mycobacterium tuberculosis H37Rv
acgccagaccgccg

SEQ ID NO: 3240479 - RNA, 15 nt, Mycobacterium tuberculosis H37Rv
acgccagcaaugccc

SEQ ID NO: 3240480 - RNA, 17 nt, Mycobacterium tuberculosis H37Rv
acgccagcccguccggc

SEQ ID NO: 3240481 - RNA, 12 nt, Mycobacterium tuberculosis H37Rv
acgccagccggu

SEQ ID NO: 3240482 - RNA, 13 nt, Mycobacterium tuberculosis H37Rv
acgccagccuggc

SEQ ID NO: 3240483 - RNA, 18 nt, Mycobacterium tuberculosis H37Rv
acgccagcugcccgacgu

SEQ ID NO: 3240484 - RNA, 16 nt, Mycobacterium tuberculosis H37Rv
acgccaggucaucggc

SEQ ID NO: 3240485 - RNA, 16 nt, Mycobacterium tuberculosis H37Rv
acgccaggugcagcac

SEQ ID NO: 3240486 - RNA, 19 nt, Mycobacterium tuberculosis H37Rv
acgccagucccggcgcaca

SEQ ID NO: 3240487 - RNA, 20 nt, Mycobacterium tuberculosis H37Rv
acgccagucgagcaccugcc

SEQ ID NO: 3240488 - RNA, 16 nt, Mycobacterium tuberculosis H37Rv
acgccagugaacgcgc

SEQ ID NO: 3240489 - RNA, 21 nt, Mycobacterium tuberculosis H37Rv
acgccagugaacgcgcgugca

SEQ ID NO: 3240490 - RNA, 15 nt, Mycobacterium tuberculosis H37Rv
acgccauacgucgcc

SEQ ID NO: 3240491 - RNA, 18 nt, Mycobacterium tuberculosis H37Rv
acgccauccacgacaucg

SEQ ID NO: 3240492 - RNA, 16 nt, Mycobacterium tuberculosis H37Rv
acgccaucgagcagca

SEQ ID NO: 3240493 - RNA, 14 nt, Mycobacterium tuberculosis H37Rv
acgccaugcccgca

SEQ ID NO: 3240494 - RNA, 14 nt, Mycobacterium tuberculosis H37Rv
acgccaugccggga

SEQ ID NO: 3240495 - RNA, 15 nt, Mycobacterium tuberculosis H37Rv
acgccauggaaaccc

SEQ ID NO: 3240496 - RNA, 15 nt, Mycobacterium tuberculosis H37Rv
acgccauucaucggc

SEQ ID NO: 3240497 - RNA, 23 nt, Mycobacterium tuberculosis H37Rv
acgccauucaucggcaucgacug

SEQ ID NO: 3240498 - RNA, 21 nt, Mycobacterium tuberculosis H37Rv
acgcccaacgucgccagguca

SEQ ID NO: 3240499 - RNA, 15 nt, Mycobacterium tuberculosis H37Rv
acgcccacaaugacu

SEQ ID NO: 3240500 - RNA, 17 nt, Mycobacterium tuberculosis H37Rv
acgcccacaugcucagg

SEQ ID NO: 3240501 - RNA, 12 nt, Mycobacterium tuberculosis H37Rv
acgcccaccacg

SEQ ID NO: 3240502 - RNA, 15 nt, Mycobacterium tuberculosis H37Rv
acgcccacuccagca

SEQ ID NO: 3240503 - RNA, 16 nt, Mycobacterium tuberculosis H37Rv
acgcccagcucggcac

SEQ ID NO: 3240504 - RNA, 16 nt, Mycobacterium tuberculosis H37Rv
acgccccgaucggcca

SEQ ID NO: 3240505 - RNA, 14 nt, Mycobacterium tuberculosis H37Rv
acgccccgccacaa

SEQ ID NO: 3240506 - RNA, 17 nt, Mycobacterium tuberculosis H37Rv
acgccccggcgcggcca

SEQ ID NO: 3240507 - RNA, 18 nt, Mycobacterium tuberculosis H37Rv
acgccccggcgcggccag

SEQ ID NO: 3240508 - RNA, 22 nt, Mycobacterium tuberculosis H37Rv
acgcccgaaucgccggcggcca

SEQ ID NO: 3240509 - RNA, 19 nt, Mycobacterium tuberculosis H37Rv
acgcccgacgccagcugcc

SEQ ID NO: 3240510 - RNA, 22 nt, Mycobacterium tuberculosis H37Rv
acgcccgaguuaaacgcagcgg

SEQ ID NO: 3240511 - RNA, 18 nt, Mycobacterium tuberculosis H37Rv
acgcccgaguugaagaau

SEQ ID NO: 3240512 - RNA, 17 nt, Mycobacterium tuberculosis H37Rv
acgcccgcacucggcgg

SEQ ID NO: 3240513 - RNA, 16 nt, Mycobacterium tuberculosis H37Rv
acgcccgcaucgccuc

SEQ ID NO: 3240514 - RNA, 12 nt, Mycobacterium tuberculosis H37Rv
acgcccgcccgc

SEQ ID NO: 3240515 - RNA, 12 nt, Mycobacterium tuberculosis H37Rv
acgcccgcgaac

SEQ ID NO: 3240516 - RNA, 22 nt, Mycobacterium tuberculosis H37Rv
acgcccgcucggagaucgccac

SEQ ID NO: 3240517 - RNA, 14 nt, Mycobacterium tuberculosis H37Rv
acgcccggcacccc

SEQ ID NO: 3240518 - RNA, 19 nt, Mycobacterium tuberculosis H37Rv
acgcccuggugucgaucgu

SEQ ID NO: 3240519 - RNA, 15 nt, Mycobacterium tuberculosis H37Rv
acgccgaaaaugccg

SEQ ID NO: 3240520 - RNA, 22 nt, Mycobacterium tuberculosis H37Rv
acgccgaaaaugccgcccagcg

SEQ ID NO: 3240521 - RNA, 23 nt, Mycobacterium tuberculosis H37Rv
acgccgaacgugcaaccacggcg

SEQ ID NO: 3240522 - RNA, 16 nt, Mycobacterium tuberculosis H37Rv
acgccgagaccgccgc

SEQ ID NO: 3240523 - RNA, 18 nt, Mycobacterium tuberculosis H37Rv
acgccgagaugcugcacc

SEQ ID NO: 3240524 - RNA, 19 nt, Mycobacterium tuberculosis H37Rv
acgccgagaugcugcaccc

SEQ ID NO: 3240525 - RNA, 14 nt, Mycobacterium tuberculosis H37Rv
acgccgagcacuga

SEQ ID NO: 3240526 - RNA, 13 nt, Mycobacterium tuberculosis H37Rv
acgccgaggcguu

SEQ ID NO: 3240527 - RNA, 17 nt, Mycobacterium tuberculosis H37Rv
acgccgauaccgugcac

SEQ ID NO: 3240528 - RNA, 18 nt, Mycobacterium tuberculosis H37Rv
acgccgauaccgugcacc

SEQ ID NO: 3240529 - RNA, 22 nt, Mycobacterium tuberculosis H37Rv
acgccgaucaacaugccgguca

SEQ ID NO: 3240530 - RNA, 16 nt, Mycobacterium tuberculosis H37Rv
acgccgauggcuuggu

SEQ ID NO: 3240531 - RNA, 14 nt, Mycobacterium tuberculosis H37Rv
acgccgccagcacc

SEQ ID NO: 3240532 - RNA, 23 nt, Mycobacterium tuberculosis H37Rv
acgccgccagcaccucggccagc

SEQ ID NO: 3240533 - RNA, 16 nt, Mycobacterium tuberculosis H37Rv
acgccgccagccuggu

SEQ ID NO: 3240534 - RNA, 17 nt, Mycobacterium tuberculosis H37Rv
acgccgcccgcugggcu

SEQ ID NO: 3240535 - RNA, 17 nt, Mycobacterium tuberculosis H37Rv
acgccgccggccccgcc

SEQ ID NO: 3240536 - RNA, 16 nt, Mycobacterium tuberculosis H37Rv
acgccgccggccgcca

SEQ ID NO: 3240537 - RNA, 17 nt, Mycobacterium tuberculosis H37Rv
acgccgccggcgccacc

SEQ ID NO: 3240538 - RNA, 21 nt, Mycobacterium tuberculosis H37Rv
acgccgccggcgccaccguug

SEQ ID NO: 3240539 - RNA, 14 nt, Mycobacterium tuberculosis H37Rv
acgccgcgagagcc

SEQ ID NO: 3240540 - RNA, 15 nt, Mycobacterium tuberculosis H37Rv
acgccgcgcagccgg

SEQ ID NO: 3240541 - RNA, 16 nt, Mycobacterium tuberculosis H37Rv
acgccgcgcagccggc

SEQ ID NO: 3240542 - RNA, 21 nt, Mycobacterium tuberculosis H37Rv
acgccgcgcagccggcccguc

SEQ ID NO: 3240543 - RNA, 22 nt, Mycobacterium tuberculosis H37Rv
acgccgcggaguaggccgcgcc

SEQ ID NO: 3240544 - RNA, 18 nt, Mycobacterium tuberculosis H37Rv
acgccgcuggagaucacg

SEQ ID NO: 3240545 - RNA, 19 nt, Mycobacterium tuberculosis H37Rv
acgccgcuggagaucacgc

SEQ ID NO: 3240546 - RNA, 20 nt, Mycobacterium tuberculosis H37Rv
acgccgcuggagaucacgcc

SEQ ID NO: 3240547 - RNA, 15 nt, Mycobacterium tuberculosis H37Rv
acgccggacccgguc

SEQ ID NO: 3240548 - RNA, 22 nt, Mycobacterium tuberculosis H37Rv
acgccggauuauucgcgguagc

SEQ ID NO: 3240549 - RNA, 15 nt, Mycobacterium tuberculosis H37Rv
acgccggcaucgcgc

SEQ ID NO: 3240550 - RNA, 14 nt, Mycobacterium tuberculosis H37Rv
acgccggcaugcca

SEQ ID NO: 3240551 - RNA, 16 nt, Mycobacterium tuberculosis H37Rv
acgccggccagcggcc

SEQ ID NO: 3240552 - RNA, 19 nt, Mycobacterium tuberculosis H37Rv
acgccggcccggugaugaa

SEQ ID NO: 3240553 - RNA, 15 nt, Mycobacterium tuberculosis H37Rv
acgccggccgcgcug

SEQ ID NO: 3240554 - RNA, 17 nt, Mycobacterium tuberculosis H37Rv
acgccggcgacggcguc

SEQ ID NO: 3240555 - RNA, 13 nt, Mycobacterium tuberculosis H37Rv
acgccggcgaugc

SEQ ID NO: 3240556 - RNA, 14 nt, Mycobacterium tuberculosis H37Rv
acgccggcgggcug

SEQ ID NO: 3240557 - RNA, 19 nt, Mycobacterium tuberculosis H37Rv
acgccgggugccgccacgu

SEQ ID NO: 3240558 - RNA, 14 nt, Mycobacterium tuberculosis H37Rv
acgccguacccgga

SEQ ID NO: 3240559 - RNA, 17 nt, Mycobacterium tuberculosis H37Rv
acgccguagcaucgggc

SEQ ID NO: 3240560 - RNA, 23 nt, Mycobacterium tuberculosis H37Rv
acgccguagcaucgggcgagcuc

SEQ ID NO: 3240561 - RNA, 13 nt, Mycobacterium tuberculosis H37Rv
acgccguagcgca

SEQ ID NO: 3240562 - RNA, 22 nt, Mycobacterium tuberculosis H37Rv
acgccgucaccgcugagccccc

SEQ ID NO: 3240563 - RNA, 21 nt, Mycobacterium tuberculosis H37Rv
acgccgucagaacaccggcca

SEQ ID NO: 3240564 - RNA, 15 nt, Mycobacterium tuberculosis H37Rv
acgccgucgacgucg

SEQ ID NO: 3240565 - RNA, 13 nt, Mycobacterium tuberculosis H37Rv
acgccgucggcgc

SEQ ID NO: 3240566 - RNA, 16 nt, Mycobacterium tuberculosis H37Rv
acgccgucggcgcgca

SEQ ID NO: 3240567 - RNA, 16 nt, Mycobacterium tuberculosis H37Rv
acgccgucugacagca

SEQ ID NO: 3240568 - RNA, 15 nt, Mycobacterium tuberculosis H37Rv
acgccguggugcgca

SEQ ID NO: 3240569 - RNA, 19 nt, Mycobacterium tuberculosis H37Rv
acgccguggugcgcauggc

SEQ ID NO: 3240570 - RNA, 22 nt, Mycobacterium tuberculosis H37Rv
acgccguugcccacguugacgg

SEQ ID NO: 3240571 - RNA, 16 nt, Mycobacterium tuberculosis H37Rv
acgccucaccgacguc

SEQ ID NO: 3240572 - RNA, 19 nt, Mycobacterium tuberculosis H37Rv
acgcuccaggguccggacg

SEQ ID NO: 3240573 - RNA, 16 nt, Mycobacterium tuberculosis H37Rv
acgcuccccagcgaau

SEQ ID NO: 3240574 - RNA, 13 nt, Mycobacterium tuberculosis H37Rv
acgcucgcgcacc

SEQ ID NO: 3240575 - RNA, 14 nt, Mycobacterium tuberculosis H37Rv
acgcucgcugcagc

SEQ ID NO: 3240576 - RNA, 15 nt, Mycobacterium tuberculosis H37Rv
acgcucgcugcagca

SEQ ID NO: 3240577 - RNA, 16 nt, Mycobacterium tuberculosis H37Rv
acgcucgcugcagcag

SEQ ID NO: 3240578 - RNA, 16 nt, Mycobacterium tuberculosis H37Rv
acgcucggcggccagc

SEQ ID NO: 3240579 - RNA, 23 nt, Mycobacterium tuberculosis H37Rv
acgcucggcggccagcucccgcg

SEQ ID NO: 3240580 - RNA, 21 nt, Mycobacterium tuberculosis H37Rv
acgcucggcggggaccgcggu

SEQ ID NO: 3240581 - RNA, 11 nt, Mycobacterium tuberculosis H37Rv
acgcucggcgu

SEQ ID NO: 3240582 - RNA, 23 nt, Mycobacterium tuberculosis H37Rv
acgcucggcguccgcccagcacc

SEQ ID NO: 3240583 - RNA, 21 nt, Mycobacterium tuberculosis H37Rv
acgcucggcgugucgggggcu

SEQ ID NO: 3240584 - RNA, 23 nt, Mycobacterium tuberculosis H37Rv
acgcucggcuauggguucgcggu

SEQ ID NO: 3240585 - RNA, 23 nt, Mycobacterium tuberculosis H37Rv
acgcucgggggauccggcgcagc

SEQ ID NO: 3240586 - RNA, 19 nt, Mycobacterium tuberculosis H37Rv
acgcucggugaaggucacc

SEQ ID NO: 3240587 - RNA, 20 nt, Mycobacterium tuberculosis H37Rv
acgcucggugcugcgccgau

SEQ ID NO: 3240588 - RNA, 17 nt, Mycobacterium tuberculosis H37Rv
acgcucgguucggaguc

SEQ ID NO: 3240589 - RNA, 19 nt, Mycobacterium tuberculosis H37Rv
acgcucguagaaccggggu

SEQ ID NO: 3240590 - RNA, 16 nt, Mycobacterium tuberculosis H37Rv
acgcucguuugcgagc

SEQ ID NO: 3240591 - RNA, 19 nt, Mycobacterium tuberculosis H37Rv
acgcucguuugcgagcagg

SEQ ID NO: 3240592 - RNA, 22 nt, Mycobacterium tuberculosis H37Rv
acgcucguuugcgagcagggga

SEQ ID NO: 3240593 - RNA, 18 nt, Mycobacterium tuberculosis H37Rv
acgcugacgcccucauag

SEQ ID NO: 3240594 - RNA, 20 nt, Mycobacterium tuberculosis H37Rv
acgcugaguccccagguggg

SEQ ID NO: 3240595 - RNA, 13 nt, Mycobacterium tuberculosis H37Rv
acgcugccaagcg

SEQ ID NO: 3240596 - RNA, 18 nt, Mycobacterium tuberculosis H37Rv
acgcugcccgccagccca

SEQ ID NO: 3240597 - RNA, 19 nt, Mycobacterium tuberculosis H37Rv
acgcugcccgccagcccau

SEQ ID NO: 3240598 - RNA, 13 nt, Mycobacterium tuberculosis H37Rv
acgcugccgagcc

SEQ ID NO: 3240599 - RNA, 13 nt, Mycobacterium tuberculosis H37Rv
acgcugccgguca

SEQ ID NO: 3240600 - RNA, 15 nt, Mycobacterium tuberculosis H37Rv
acgcugcgcccggac

SEQ ID NO: 3240601 - RNA, 17 nt, Mycobacterium tuberculosis H37Rv
acgcugcucuggacggu

SEQ ID NO: 3240602 - RNA, 17 nt, Mycobacterium tuberculosis H37Rv
acgcuggcaaguccggu

SEQ ID NO: 3240603 - RNA, 20 nt, Mycobacterium tuberculosis H37Rv
acgcuggccuccagcuuggc

SEQ ID NO: 3240604 - RNA, 14 nt, Mycobacterium tuberculosis H37Rv
acgcuggcguuguu

SEQ ID NO: 3240605 - RNA, 22 nt, Mycobacterium tuberculosis H37Rv
acgcuggcguuguugacgauca

SEQ ID NO: 3240606 - RNA, 17 nt, Mycobacterium tuberculosis H37Rv
acgcuguaagcaugccg

SEQ ID NO: 3240607 - RNA, 16 nt, Mycobacterium tuberculosis H37Rv
acgcuguccaggucug

SEQ ID NO: 3240608 - RNA, 13 nt, Mycobacterium tuberculosis H37Rv
acgcugucccgcg

SEQ ID NO: 3240609 - RNA, 19 nt, Mycobacterium tuberculosis H37Rv
acgcuguccgcgugaaucc

SEQ ID NO: 3240610 - RNA, 21 nt, Mycobacterium tuberculosis H37Rv
acgcugucgugcucucggcga

SEQ ID NO: 3240611 - RNA, 15 nt, Mycobacterium tuberculosis H37Rv
acgcuguggcucgac

SEQ ID NO: 3240612 - RNA, 21 nt, Mycobacterium tuberculosis H37Rv
acgcugugggcuuugccgucg

SEQ ID NO: 3240613 - RNA, 16 nt, Mycobacterium tuberculosis H37Rv
acgcuguugucgucca

SEQ ID NO: 3240614 - RNA, 17 nt, Mycobacterium tuberculosis H37Rv
acgcuucugccugcgca

SEQ ID NO: 3240615 - RNA, 14 nt, Mycobacterium tuberculosis H37Rv
acgcuugcggcugc

SEQ ID NO: 3240616 - RNA, 14 nt, Mycobacterium tuberculosis H37Rv
acgcuuucccgaug

SEQ ID NO: 3240617 - RNA, 17 nt, Mycobacterium tuberculosis H37Rv
acgcuuucccgaugacg

SEQ ID NO: 3240618 - RNA, 15 nt, Mycobacterium tuberculosis H37Rv
acgcuuuccggcggu

SEQ ID NO: 3240619 - RNA, 17 nt, Mycobacterium tuberculosis H37Rv
acggaaguaucgccggc

SEQ ID NO: 3240620 - RNA, 20 nt, Mycobacterium tuberculosis H37Rv
acggaaucgguuucgaccug

SEQ ID NO: 3240621 - RNA, 15 nt, Mycobacterium tuberculosis H37Rv
acggaauguagccga

SEQ ID NO: 3240622 - RNA, 12 nt, Mycobacterium tuberculosis H37Rv
acggaccgccac

SEQ ID NO: 3240623 - RNA, 14 nt, Mycobacterium tuberculosis H37Rv
acggaccuccucgc

SEQ ID NO: 3240624 - RNA, 18 nt, Mycobacterium tuberculosis H37Rv
acggaccuccucgcccau

SEQ ID NO: 3240625 - RNA, 18 nt, Mycobacterium tuberculosis H37Rv
acggacucccucgaucac

SEQ ID NO: 3240626 - RNA, 17 nt, Mycobacterium tuberculosis H37Rv
acggagaccggccgggu

SEQ ID NO: 3240627 - RNA, 22 nt, Mycobacterium tuberculosis H37Rv
acggagaccggccgggugaacc

SEQ ID NO: 3240628 - RNA, 15 nt, Mycobacterium tuberculosis H37Rv
acggagaccguggau

SEQ ID NO: 3240629 - RNA, 17 nt, Mycobacterium tuberculosis H37Rv
acggaggccuccacaua

SEQ ID NO: 3240630 - RNA, 19 nt, Mycobacterium tuberculosis H37Rv
acggauaauucaacagcac

SEQ ID NO: 3240631 - RNA, 22 nt, Mycobacterium tuberculosis H37Rv
acggauaauucaacagcaccgc

SEQ ID NO: 3240632 - RNA, 14 nt, Mycobacterium tuberculosis H37Rv
acggaugaugccgg

SEQ ID NO: 3240633 - RNA, 22 nt, Mycobacterium tuberculosis H37Rv
acggaugugcucaggucgcaga

SEQ ID NO: 3240634 - RNA, 21 nt, Mycobacterium tuberculosis H37Rv
acggauuguccgggaccgcga

SEQ ID NO: 3240635 - RNA, 20 nt, Mycobacterium tuberculosis H37Rv
acggcaagaaacagguaagc

SEQ ID NO: 3240636 - RNA, 22 nt, Mycobacterium tuberculosis H37Rv
acggcaagccaaccagcccggc

SEQ ID NO: 3240637 - RNA, 15 nt, Mycobacterium tuberculosis H37Rv
acggcaagccauuca

SEQ ID NO: 3240638 - RNA, 19 nt, Mycobacterium tuberculosis H37Rv
acggcaagccauucacgag

SEQ ID NO: 3240639 - RNA, 12 nt, Mycobacterium tuberculosis H37Rv
acggcaagcgca

SEQ ID NO: 3240640 - RNA, 21 nt, Mycobacterium tuberculosis H37Rv
acggcaagggcauacagcaug

SEQ ID NO: 3240641 - RNA, 16 nt, Mycobacterium tuberculosis H37Rv
acggcaaugcggggca

SEQ ID NO: 3240642 - RNA, 14 nt, Mycobacterium tuberculosis H37Rv
acggcacaaucggc

SEQ ID NO: 3240643 - RNA, 16 nt, Mycobacterium tuberculosis H37Rv
acggcacaaucggcgc

SEQ ID NO: 3240644 - RNA, 22 nt, Mycobacterium tuberculosis H37Rv
acggcacccaauccggcgccag

SEQ ID NO: 3240645 - RNA, 22 nt, Mycobacterium tuberculosis H37Rv
acggcacccaauuucgaccaga

SEQ ID NO: 3240646 - RNA, 13 nt, Mycobacterium tuberculosis H37Rv
acggcacccccga

SEQ ID NO: 3240647 - RNA, 21 nt, Mycobacterium tuberculosis H37Rv
acggcacccccgacgagauac

SEQ ID NO: 3240648 - RNA, 22 nt, Mycobacterium tuberculosis H37Rv
acggcacccgaaaacugacccc

SEQ ID NO: 3240649 - RNA, 17 nt, Mycobacterium tuberculosis H37Rv
acggcacccugcggcac

SEQ ID NO: 3240650 - RNA, 21 nt, Mycobacterium tuberculosis H37Rv
acggcacccugcggcaccuca

SEQ ID NO: 3240651 - RNA, 14 nt, Mycobacterium tuberculosis H37Rv
acggcagaccaugg

SEQ ID NO: 3240652 - RNA, 14 nt, Mycobacterium tuberculosis H37Rv
acggcagcacgguc

SEQ ID NO: 3240653 - RNA, 21 nt, Mycobacterium tuberculosis H37Rv
acggcagccaccagcgacgac

SEQ ID NO: 3240654 - RNA, 20 nt, Mycobacterium tuberculosis H37Rv
acggcagcgccaccgaccga

SEQ ID NO: 3240655 - RNA, 21 nt, Mycobacterium tuberculosis H37Rv
acggcagcgccggucggaucg

SEQ ID NO: 3240656 - RNA, 15 nt, Mycobacterium tuberculosis H37Rv
acggcaggcagggca

SEQ ID NO: 3240657 - RNA, 11 nt, Mycobacterium tuberculosis H37Rv
acggcaggcgg

SEQ ID NO: 3240658 - RNA, 15 nt, Mycobacterium tuberculosis H37Rv
acggcaucggccacc

SEQ ID NO: 3240659 - RNA, 17 nt, Mycobacterium tuberculosis H37Rv
acggcauguaccgaccg

SEQ ID NO: 3240660 - RNA, 16 nt, Mycobacterium tuberculosis H37Rv
acggcauucgaccuca

SEQ ID NO: 3240661 - RNA, 20 nt, Mycobacterium tuberculosis H37Rv
acggccaagaucggcgcccc

SEQ ID NO: 3240662 - RNA, 19 nt, Mycobacterium tuberculosis H37Rv
acggccacaccgucacgcc

SEQ ID NO: 3240663 - RNA, 18 nt, Mycobacterium tuberculosis H37Rv
acggccaccggggucacc

SEQ ID NO: 3240664 - RNA, 15 nt, Mycobacterium tuberculosis H37Rv
acggccacgguggag

SEQ ID NO: 3240665 - RNA, 22 nt, Mycobacterium tuberculosis H37Rv
acggccacguaagcgguugucc

SEQ ID NO: 3240666 - RNA, 12 nt, Mycobacterium tuberculosis H37Rv
acggccagcagg

SEQ ID NO: 3240667 - RNA, 16 nt, Mycobacterium tuberculosis H37Rv
acggccagcaggauga

SEQ ID NO: 3240668 - RNA, 13 nt, Mycobacterium tuberculosis H37Rv
acggcugccguca

SEQ ID NO: 3240669 - RNA, 14 nt, Mycobacterium tuberculosis H37Rv
acggcugccgucag

SEQ ID NO: 3240670 - RNA, 16 nt, Mycobacterium tuberculosis H37Rv
acggcugccgucagcc

SEQ ID NO: 3240671 - RNA, 18 nt, Mycobacterium tuberculosis H37Rv
acggcugccgucagccgu

SEQ ID NO: 3240672 - RNA, 20 nt, Mycobacterium tuberculosis H37Rv
acggcugccgucagccguuc

SEQ ID NO: 3240673 - RNA, 20 nt, Mycobacterium tuberculosis H37Rv
acggcuuccaacucggcggc

SEQ ID NO: 3240674 - RNA, 22 nt, Mycobacterium tuberculosis H37Rv
acggcuucgaccaucaccacgg

SEQ ID NO: 3240675 - RNA, 16 nt, Mycobacterium tuberculosis H37Rv
acggcuucuccauguc

SEQ ID NO: 3240676 - RNA, 15 nt, Mycobacterium tuberculosis H37Rv
acggcuuggcugccu

SEQ ID NO: 3240677 - RNA, 20 nt, Mycobacterium tuberculosis H37Rv
acggcuuggcugccuccauc

SEQ ID NO: 3240678 - RNA, 21 nt, Mycobacterium tuberculosis H37Rv
acggcuugggucuccggaucg

SEQ ID NO: 3240679 - RNA, 19 nt, Mycobacterium tuberculosis H37Rv
acggcuuugcggcgcgacc

SEQ ID NO: 3240680 - RNA, 17 nt, Mycobacterium tuberculosis H37Rv
acgggaaacuccgcggc

SEQ ID NO: 3240681 - RNA, 12 nt, Mycobacterium tuberculosis H37Rv
acgggaacgucc

SEQ ID NO: 3240682 - RNA, 16 nt, Mycobacterium tuberculosis H37Rv
acgggacaaggucauc

SEQ ID NO: 3240683 - RNA, 20 nt, Mycobacterium tuberculosis H37Rv
acgggaccgaucuuggccac

SEQ ID NO: 3240684 - RNA, 21 nt, Mycobacterium tuberculosis H37Rv
acgggaccgaucuuggccacc

SEQ ID NO: 3240685 - RNA, 20 nt, Mycobacterium tuberculosis H37Rv
acgggauaaaacccggaauc

SEQ ID NO: 3240686 - RNA, 18 nt, Mycobacterium tuberculosis H37Rv
acgggcacccgagccgca

SEQ ID NO: 3240687 - RNA, 14 nt, Mycobacterium tuberculosis H37Rv
acgggcaggccgcu

SEQ ID NO: 3240688 - RNA, 19 nt, Mycobacterium tuberculosis H37Rv
acgggcaggccgcugggcc

SEQ ID NO: 3240689 - RNA, 14 nt, Mycobacterium tuberculosis H37Rv
acgggcagugaaca

SEQ ID NO: 3240690 - RNA, 17 nt, Mycobacterium tuberculosis H37Rv
acgggccacgaugcgca

SEQ ID NO: 3240691 - RNA, 20 nt, Mycobacterium tuberculosis H37Rv
acgggccgcgguacccaccu

SEQ ID NO: 3240692 - RNA, 22 nt, Mycobacterium tuberculosis H37Rv
acgggccgcgguacccaccucc

SEQ ID NO: 3240693 - RNA, 17 nt, Mycobacterium tuberculosis H37Rv
acgggccgucgccgucc

SEQ ID NO: 3240694 - RNA, 21 nt, Mycobacterium tuberculosis H37Rv
acgggccuucagcucaccacc

SEQ ID NO: 3240695 - RNA, 15 nt, Mycobacterium tuberculosis H37Rv
acgggccuucgccac

SEQ ID NO: 3240696 - RNA, 13 nt, Mycobacterium tuberculosis H37Rv
acgggcggccacc

SEQ ID NO: 3240697 - RNA, 21 nt, Mycobacterium tuberculosis H37Rv
acgggcucgcugcaccagcug

SEQ ID NO: 3240698 - RNA, 20 nt, Mycobacterium tuberculosis H37Rv
acgggcuuccgacaugaacc

SEQ ID NO: 3240699 - RNA, 23 nt, Mycobacterium tuberculosis H37Rv
acggggaggucaaaaucagggug

SEQ ID NO: 3240700 - RNA, 20 nt, Mycobacterium tuberculosis H37Rv
acggggccgccagcugcgca

SEQ ID NO: 3240701 - RNA, 14 nt, Mycobacterium tuberculosis H37Rv
acggggccgucucg

SEQ ID NO: 3240702 - RNA, 16 nt, Mycobacterium tuberculosis H37Rv
acggggcugaccgcca

SEQ ID NO: 3240703 - RNA, 17 nt, Mycobacterium tuberculosis H37Rv
acggggcugaccgccac

SEQ ID NO: 3240704 - RNA, 16 nt, Mycobacterium tuberculosis H37Rv
acgggggcuguccacc

SEQ ID NO: 3240705 - RNA, 17 nt, Mycobacterium tuberculosis H37Rv
acggggggcgucgccgu

SEQ ID NO: 3240706 - RNA, 16 nt, Mycobacterium tuberculosis H37Rv
acgggguugaccgcca

SEQ ID NO: 3240707 - RNA, 19 nt, Mycobacterium tuberculosis H37Rv
acggguacacccgcucgcc

SEQ ID NO: 3240708 - RNA, 22 nt, Mycobacterium tuberculosis H37Rv
acggguagacccacaucagguc

SEQ ID NO: 3240709 - RNA, 15 nt, Mycobacterium tuberculosis H37Rv
acggguccgggccaa

SEQ ID NO: 3240710 - RNA, 17 nt, Mycobacterium tuberculosis H37Rv
acgggucgaugucggca

SEQ ID NO: 3240711 - RNA, 12 nt, Mycobacterium tuberculosis H37Rv
acgggucgccgc

SEQ ID NO: 3240712 - RNA, 13 nt, Mycobacterium tuberculosis H37Rv
acgggugcuggca

SEQ ID NO: 3240713 - RNA, 17 nt, Mycobacterium tuberculosis H37Rv
acggguggcccgaccgg

SEQ ID NO: 3240714 - RNA, 12 nt, Mycobacterium tuberculosis H37Rv
acggguggugcc

SEQ ID NO: 3240715 - RNA, 15 nt, Mycobacterium tuberculosis H37Rv
acgggugucggcgug

SEQ ID NO: 3240716 - RNA, 23 nt, Mycobacterium tuberculosis H37Rv
acggguuggcgucgcuacgcaac

SEQ ID NO: 3240717 - RNA, 23 nt, Mycobacterium tuberculosis H37Rv
acgguaaucgcgaacgaagucga

SEQ ID NO: 3240718 - RNA, 16 nt, Mycobacterium tuberculosis H37Rv
acgguacagcuccaca

SEQ ID NO: 3240719 - RNA, 23 nt, Mycobacterium tuberculosis H37Rv
acgguacgccgccgcgacgcacu

SEQ ID NO: 3240720 - RNA, 14 nt, Mycobacterium tuberculosis H37Rv
acgguagcacgguc

SEQ ID NO: 3240721 - RNA, 15 nt, Mycobacterium tuberculosis H37Rv
acgguagccaagcga

SEQ ID NO: 3240722 - RNA, 23 nt, Mycobacterium tuberculosis H37Rv
acgguaucggugcuggucgccgc

SEQ ID NO: 3240723 - RNA, 19 nt, Mycobacterium tuberculosis H37Rv
acggucaaggugcgccgcc

SEQ ID NO: 3240724 - RNA, 15 nt, Mycobacterium tuberculosis H37Rv
acggucaaucccggc

SEQ ID NO: 3240725 - RNA, 12 nt, Mycobacterium tuberculosis H37Rv
acggucaccggc

SEQ ID NO: 3240726 - RNA, 21 nt, Mycobacterium tuberculosis H37Rv
acggucacgguggugucagcc

SEQ ID NO: 3240727 - RNA, 18 nt, Mycobacterium tuberculosis H37Rv
acggucagauggccaccc

SEQ ID NO: 3240728 - RNA, 23 nt, Mycobacterium tuberculosis H37Rv
acggucagcacgcugaccacaac

SEQ ID NO: 3240729 - RNA, 18 nt, Mycobacterium tuberculosis H37Rv
acggucagcgcgcacgac

SEQ ID NO: 3240730 - RNA, 17 nt, Mycobacterium tuberculosis H37Rv
acgguccgccacggcgg

SEQ ID NO: 3240731 - RNA, 16 nt, Mycobacterium tuberculosis H37Rv
acgguccguucgaugc

SEQ ID NO: 3240732 - RNA, 19 nt, Mycobacterium tuberculosis H37Rv
acggucgccgaccacucga

SEQ ID NO: 3240733 - RNA, 23 nt, Mycobacterium tuberculosis H37Rv
acggucgccgaccacucgagcgc

SEQ ID NO: 3240734 - RNA, 13 nt, Mycobacterium tuberculosis H37Rv
acggucgucgcga

SEQ ID NO: 3240735 - RNA, 18 nt, Mycobacterium tuberculosis H37Rv
acggucgucgcgagcgga

SEQ ID NO: 3240736 - RNA, 23 nt, Mycobacterium tuberculosis H37Rv
acggucuggcccgcgacaucggg

SEQ ID NO: 3240737 - RNA, 16 nt, Mycobacterium tuberculosis H37Rv
acggucugggucuugg

SEQ ID NO: 3240738 - RNA, 14 nt, Mycobacterium tuberculosis H37Rv
acggucuugauguu

SEQ ID NO: 3240739 - RNA, 14 nt, Mycobacterium tuberculosis H37Rv
acggugaauucacg

SEQ ID NO: 3240740 - RNA, 21 nt, Mycobacterium tuberculosis H37Rv
acggugagggcgucgucgagu

SEQ ID NO: 3240741 - RNA, 19 nt, Mycobacterium tuberculosis H37Rv
acggugaucagguaagcga

SEQ ID NO: 3240742 - RNA, 18 nt, Mycobacterium tuberculosis H37Rv
acggugaucgccggcuuc

SEQ ID NO: 3240743 - RNA, 19 nt, Mycobacterium tuberculosis H37Rv
acggugaugggggagccgg

SEQ ID NO: 3240744 - RNA, 17 nt, Mycobacterium tuberculosis H37Rv
acggugcaggaccagaa

SEQ ID NO: 3240745 - RNA, 18 nt, Mycobacterium tuberculosis H37Rv
acggugccggcacccgag

SEQ ID NO: 3240746 - RNA, 18 nt, Mycobacterium tuberculosis H37Rv
acggugcgauaccgacac

SEQ ID NO: 3240747 - RNA, 16 nt, Mycobacterium tuberculosis H37Rv
acggugcgcuggaugu

SEQ ID NO: 3240748 - RNA, 17 nt, Mycobacterium tuberculosis H37Rv
acggugcucuucgauga

SEQ ID NO: 3240749 - RNA, 15 nt, Mycobacterium tuberculosis H37Rv
acggugcugccguug

SEQ ID NO: 3240750 - RNA, 14 nt, Mycobacterium tuberculosis H37Rv
acgguggccgcacg

SEQ ID NO: 3240751 - RNA, 16 nt, Mycobacterium tuberculosis H37Rv
acgguggccgcacgau

SEQ ID NO: 3240752 - RNA, 23 nt, Mycobacterium tuberculosis H37Rv
acgguggccgcugccagccguuc

SEQ ID NO: 3240753 - RNA, 13 nt, Mycobacterium tuberculosis H37Rv
acgguggccggca

SEQ ID NO: 3240754 - RNA, 20 nt, Mycobacterium tuberculosis H37Rv
acgguggcgccgucggccga

SEQ ID NO: 3240755 - RNA, 19 nt, Mycobacterium tuberculosis H37Rv
acggugggugggcgccgca

SEQ ID NO: 3240756 - RNA, 15 nt, Mycobacterium tuberculosis H37Rv
acggugggugguugu

SEQ ID NO: 3240757 - RNA, 18 nt, Mycobacterium tuberculosis H37Rv
acggugguaagacgccga

SEQ ID NO: 3240758 - RNA, 22 nt, Mycobacterium tuberculosis H37Rv
acgguggugggcuaggucgcgc

SEQ ID NO: 3240759 - RNA, 18 nt, Mycobacterium tuberculosis H37Rv
acgguggugucagccacc

SEQ ID NO: 3240760 - RNA, 19 nt, Mycobacterium tuberculosis H37Rv
acgguguacaggucgccgg

SEQ ID NO: 3240761 - RNA, 16 nt, Mycobacterium tuberculosis H37Rv
acgguguaccccgcga

SEQ ID NO: 3240762 - RNA, 17 nt, Mycobacterium tuberculosis H37Rv
acgguguaccccgcgau

SEQ ID NO: 3240763 - RNA, 22 nt, Mycobacterium tuberculosis H37Rv
acgguguagcccaucggcagca

SEQ ID NO: 3240764 - RNA, 16 nt, Mycobacterium tuberculosis H37Rv
acguggccacggcauu

SEQ ID NO: 3240765 - RNA, 15 nt, Mycobacterium tuberculosis H37Rv
acguggcccuccucg

SEQ ID NO: 3240766 - RNA, 19 nt, Mycobacterium tuberculosis H37Rv
acguggcgcuggaccgggu

SEQ ID NO: 3240767 - RNA, 19 nt, Mycobacterium tuberculosis H37Rv
acguggcugcguucgccgg

SEQ ID NO: 3240768 - RNA, 21 nt, Mycobacterium tuberculosis H37Rv
acguggcuugaguuucggcgc

SEQ ID NO: 3240769 - RNA, 22 nt, Mycobacterium tuberculosis H37Rv
acgugguagccggcgacaccgc

SEQ ID NO: 3240770 - RNA, 21 nt, Mycobacterium tuberculosis H37Rv
acgugguccaaccgggccggc

SEQ ID NO: 3240771 - RNA, 17 nt, Mycobacterium tuberculosis H37Rv
acguggucggagcgggu

SEQ ID NO: 3240772 - RNA, 15 nt, Mycobacterium tuberculosis H37Rv
acguggucggccacc

SEQ ID NO: 3240773 - RNA, 16 nt, Mycobacterium tuberculosis H37Rv
acguggugggcuuggc

SEQ ID NO: 3240774 - RNA, 22 nt, Mycobacterium tuberculosis H37Rv
acgugucaucacggucagccgu

SEQ ID NO: 3240775 - RNA, 14 nt, Mycobacterium tuberculosis H37Rv
acgugucccgcaug

SEQ ID NO: 3240776 - RNA, 15 nt, Mycobacterium tuberculosis H37Rv
acgugucccgcaugc

SEQ ID NO: 3240777 - RNA, 14 nt, Mycobacterium tuberculosis H37Rv
acgugucggcugcu

SEQ ID NO: 3240778 - RNA, 21 nt, Mycobacterium tuberculosis H37Rv
acgugugcaccaucaucaccu

SEQ ID NO: 3240779 - RNA, 20 nt, Mycobacterium tuberculosis H37Rv
acguguggugugucaccgga

SEQ ID NO: 3240780 - RNA, 13 nt, Mycobacterium tuberculosis H37Rv
acguguucugguc

SEQ ID NO: 3240781 - RNA, 15 nt, Mycobacterium tuberculosis H37Rv
acguuaccgaccgcg

SEQ ID NO: 3240782 - RNA, 17 nt, Mycobacterium tuberculosis H37Rv
acguucggcacaaccaa

SEQ ID NO: 3240783 - RNA, 20 nt, Mycobacterium tuberculosis H37Rv
acguugaugaugccggcguu

SEQ ID NO: 3240784 - RNA, 12 nt, Mycobacterium tuberculosis H37Rv
acguugcagccg

SEQ ID NO: 3240785 - RNA, 16 nt, Mycobacterium tuberculosis H37Rv
acguugccgaacgucg

SEQ ID NO: 3240786 - RNA, 16 nt, Mycobacterium tuberculosis H37Rv
acguugccgaagccgg

SEQ ID NO: 3240787 - RNA, 22 nt, Mycobacterium tuberculosis H37Rv
acguugccggaguugucgacgg

SEQ ID NO: 3240788 - RNA, 22 nt, Mycobacterium tuberculosis H37Rv
acguugcuggcuggguggcccc

SEQ ID NO: 3240789 - RNA, 14 nt, Mycobacterium tuberculosis H37Rv
acguuggcagcccu

SEQ ID NO: 3240790 - RNA, 14 nt, Mycobacterium tuberculosis H37Rv
acguuggccaggcc

SEQ ID NO: 3240791 - RNA, 20 nt, Mycobacterium tuberculosis H37Rv
acguuggccaggcccgaguu

SEQ ID NO: 3240792 - RNA, 23 nt, Mycobacterium tuberculosis H37Rv
acguuggccgagcagggccggca

SEQ ID NO: 3240793 - RNA, 19 nt, Mycobacterium tuberculosis H37Rv
acguuguaggagaacguca

SEQ ID NO: 3240794 - RNA, 17 nt, Mycobacterium tuberculosis H37Rv
acguuguccaccgccac

SEQ ID NO: 3240795 - RNA, 19 nt, Mycobacterium tuberculosis H37Rv
acguugucgccaacccggu

SEQ ID NO: 3240796 - RNA, 19 nt, Mycobacterium tuberculosis H37Rv
acguuguucagcccgccga

SEQ ID NO: 3240797 - RNA, 22 nt, Mycobacterium tuberculosis H37Rv
acguuguucagcccgccgacga

SEQ ID NO: 3240798 - RNA, 19 nt, Mycobacterium tuberculosis H37Rv
acuaaagcccucgacacgc

SEQ ID NO: 3240799 - RNA, 16 nt, Mycobacterium tuberculosis H37Rv
acuaacaacaccacca

SEQ ID NO: 3240800 - RNA, 19 nt, Mycobacterium tuberculosis H37Rv
acuaaccuggcguagauca

SEQ ID NO: 3240801 - RNA, 16 nt, Mycobacterium tuberculosis H37Rv
acuaagggcacuccac

SEQ ID NO: 3240802 - RNA, 14 nt, Mycobacterium tuberculosis H37Rv
acuacggugcccug

SEQ ID NO: 3240803 - RNA, 15 nt, Mycobacterium tuberculosis H37Rv
acuagacgccgccgc

SEQ ID NO: 3240804 - RNA, 20 nt, Mycobacterium tuberculosis H37Rv
acuagacgccgccgcugccg

SEQ ID NO: 3240805 - RNA, 17 nt, Mycobacterium tuberculosis H37Rv
acuagcauugucgccgg

SEQ ID NO: 3240806 - RNA, 19 nt, Mycobacterium tuberculosis H37Rv
acuagccgauccagcaggc

SEQ ID NO: 3240807 - RNA, 16 nt, Mycobacterium tuberculosis H37Rv
acuagcggcucaccgc

SEQ ID NO: 3240808 - RNA, 21 nt, Mycobacterium tuberculosis H37Rv
acuaggcuuuccggggaauga

SEQ ID NO: 3240809 - RNA, 16 nt, Mycobacterium tuberculosis H37Rv
acuagguucagcgacu

SEQ ID NO: 3240810 - RNA, 20 nt, Mycobacterium tuberculosis H37Rv
acuaucggccgccggaucag

SEQ ID NO: 3240811 - RNA, 19 nt, Mycobacterium tuberculosis H37Rv
acuaucgucgugucgccgc

SEQ ID NO: 3240812 - RNA, 12 nt, Mycobacterium tuberculosis H37Rv
acuaugccaacg

SEQ ID NO: 3240813 - RNA, 14 nt, Mycobacterium tuberculosis H37Rv
acucaaagacccga

SEQ ID NO: 3240814 - RNA, 15 nt, Mycobacterium tuberculosis H37Rv
acucaacaccagcaa

SEQ ID NO: 3240815 - RNA, 16 nt, Mycobacterium tuberculosis H37Rv
acucaacaccagcaag

SEQ ID NO: 3240816 - RNA, 19 nt, Mycobacterium tuberculosis H37Rv
acucaagauuuccaucgca

SEQ ID NO: 3240817 - RNA, 12 nt, Mycobacterium tuberculosis H37Rv
acucaccagcac

SEQ ID NO: 3240818 - RNA, 18 nt, Mycobacterium tuberculosis H37Rv
acucacccgggcagccug

SEQ ID NO: 3240819 - RNA, 22 nt, Mycobacterium tuberculosis H37Rv
acucacccgggcagccugcugc

SEQ ID NO: 3240820 - RNA, 23 nt, Mycobacterium tuberculosis H37Rv
acucacgcaggaaaaccccggcc

SEQ ID NO: 3240821 - RNA, 18 nt, Mycobacterium tuberculosis H37Rv
acucacgggugcuggcag

SEQ ID NO: 3240822 - RNA, 14 nt, Mycobacterium tuberculosis H37Rv
acucacggugaucg

SEQ ID NO: 3240823 - RNA, 21 nt, Mycobacterium tuberculosis H37Rv
acucaggaucccgguggcagc

SEQ ID NO: 3240824 - RNA, 21 nt, Mycobacterium tuberculosis H37Rv
acucaucgacguuccagcagu

SEQ ID NO: 3240825 - RNA, 22 nt, Mycobacterium tuberculosis H37Rv
acucaucggccgcggucggcca

SEQ ID NO: 3240826 - RNA, 18 nt, Mycobacterium tuberculosis H37Rv
acucaucgugguaaccau

SEQ ID NO: 3240827 - RNA, 19 nt, Mycobacterium tuberculosis H37Rv
acucauuacgguagacguu

SEQ ID NO: 3240828 - RNA, 14 nt, Mycobacterium tuberculosis H37Rv
acuccaagucacag

SEQ ID NO: 3240829 - RNA, 17 nt, Mycobacterium tuberculosis H37Rv
acuccaagucacagcuc

SEQ ID NO: 3240830 - RNA, 13 nt, Mycobacterium tuberculosis H37Rv
acuccaccgcgcc

SEQ ID NO: 3240831 - RNA, 20 nt, Mycobacterium tuberculosis H37Rv
acuccaccgggauagccgcg

SEQ ID NO: 3240832 - RNA, 20 nt, Mycobacterium tuberculosis H37Rv
acuccacgaucggcccagcc

SEQ ID NO: 3240833 - RNA, 21 nt, Mycobacterium tuberculosis H37Rv
acuccacgaucggcccagccc

SEQ ID NO: 3240834 - RNA, 15 nt, Mycobacterium tuberculosis H37Rv
acuccacgcggaccu

SEQ ID NO: 3240835 - RNA, 19 nt, Mycobacterium tuberculosis H37Rv
acuccagcaaggccagcac

SEQ ID NO: 3240836 - RNA, 20 nt, Mycobacterium tuberculosis H37Rv
acuccagcaaggccagcacg

SEQ ID NO: 3240837 - RNA, 14 nt, Mycobacterium tuberculosis H37Rv
acuccagcaccagc

SEQ ID NO: 3240838 - RNA, 18 nt, Mycobacterium tuberculosis H37Rv
acuccagcaccagcacgg

SEQ ID NO: 3240839 - RNA, 11 nt, Mycobacterium tuberculosis H37Rv
acuccagcagc

SEQ ID NO: 3240840 - RNA, 18 nt, Mycobacterium tuberculosis H37Rv
acuccagcuugccgaccu

SEQ ID NO: 3240841 - RNA, 21 nt, Mycobacterium tuberculosis H37Rv
acuccaguccuaucagugagc

SEQ ID NO: 3240842 - RNA, 16 nt, Mycobacterium tuberculosis H37Rv
acuccaucaccacacc

SEQ ID NO: 3240843 - RNA, 18 nt, Mycobacterium tuberculosis H37Rv
acuccaucagcgcgaccg

SEQ ID NO: 3240844 - RNA, 21 nt, Mycobacterium tuberculosis H37Rv
acuccaugaaucgcgcuucag

SEQ ID NO: 3240845 - RNA, 22 nt, Mycobacterium tuberculosis H37Rv
acuccaugagccguagugcaau

SEQ ID NO: 3240846 - RNA, 13 nt, Mycobacterium tuberculosis H37Rv
acuccaugccgcu

SEQ ID NO: 3240847 - RNA, 13 nt, Mycobacterium tuberculosis H37Rv
acuccauggcauu

SEQ ID NO: 3240848 - RNA, 15 nt, Mycobacterium tuberculosis H37Rv
acucccacgaggacu

SEQ ID NO: 3240849 - RNA, 15 nt, Mycobacterium tuberculosis H37Rv
acucccccacacacc

SEQ ID NO: 3240850 - RNA, 20 nt, Mycobacterium tuberculosis H37Rv
acucccccgaaccugcggca

SEQ ID NO: 3240851 - RNA, 15 nt, Mycobacterium tuberculosis H37Rv
acuccccgccgggca

SEQ ID NO: 3240852 - RNA, 15 nt, Mycobacterium tuberculosis H37Rv
acucccgagccacaa

SEQ ID NO: 3240853 - RNA, 12 nt, Mycobacterium tuberculosis H37Rv
acucccgcgauc

SEQ ID NO: 3240854 - RNA, 16 nt, Mycobacterium tuberculosis H37Rv
acucccggcucggcca

SEQ ID NO: 3240855 - RNA, 18 nt, Mycobacterium tuberculosis H37Rv
acucccguggccgaugug

SEQ ID NO: 3240856 - RNA, 20 nt, Mycobacterium tuberculosis H37Rv
acuccgccgauagcaccgga

SEQ ID NO: 3240857 - RNA, 21 nt, Mycobacterium tuberculosis H37Rv
acuccgcgcgcggacagcauc

SEQ ID NO: 3240858 - RNA, 20 nt, Mycobacterium tuberculosis H37Rv
acuccgcggaacccagcacu

SEQ ID NO: 3240859 - RNA, 12 nt, Mycobacterium tuberculosis H37Rv
acuccgcggcga

SEQ ID NO: 3240860 - RNA, 13 nt, Mycobacterium tuberculosis H37Rv
acugcagcccugc

SEQ ID NO: 3240861 - RNA, 16 nt, Mycobacterium tuberculosis H37Rv
acugcagcgaagccgg

SEQ ID NO: 3240862 - RNA, 22 nt, Mycobacterium tuberculosis H37Rv
acugcagguucuugaccagcag

SEQ ID NO: 3240863 - RNA, 19 nt, Mycobacterium tuberculosis H37Rv
acugcaguaguagcgcaac

SEQ ID NO: 3240864 - RNA, 18 nt, Mycobacterium tuberculosis H37Rv
acugcagugaucgugacc

SEQ ID NO: 3240865 - RNA, 14 nt, Mycobacterium tuberculosis H37Rv
acugcaucaccacu

SEQ ID NO: 3240866 - RNA, 21 nt, Mycobacterium tuberculosis H37Rv
acugcaucacgccgucgcaga

SEQ ID NO: 3240867 - RNA, 18 nt, Mycobacterium tuberculosis H37Rv
acugcaugaacugcucgc

SEQ ID NO: 3240868 - RNA, 21 nt, Mycobacterium tuberculosis H37Rv
acugcaugaacugcucgccga

SEQ ID NO: 3240869 - RNA, 13 nt, Mycobacterium tuberculosis H37Rv
acugccccagcac

SEQ ID NO: 3240870 - RNA, 19 nt, Mycobacterium tuberculosis H37Rv
acugccccgcaucgcccaa

SEQ ID NO: 3240871 - RNA, 22 nt, Mycobacterium tuberculosis H37Rv
acugcccgauggcuaccuugga

SEQ ID NO: 3240872 - RNA, 18 nt, Mycobacterium tuberculosis H37Rv
acugcccgcguuugcgaa

SEQ ID NO: 3240873 - RNA, 14 nt, Mycobacterium tuberculosis H37Rv
acugccgcgcucgc

SEQ ID NO: 3240874 - RNA, 23 nt, Mycobacterium tuberculosis H37Rv
acugccgcgcucgcgcaccguca

SEQ ID NO: 3240875 - RNA, 22 nt, Mycobacterium tuberculosis H37Rv
acugccggacagccacgcacaa

SEQ ID NO: 3240876 - RNA, 23 nt, Mycobacterium tuberculosis H37Rv
acugccggccaacuucugcacga

SEQ ID NO: 3240877 - RNA, 16 nt, Mycobacterium tuberculosis H37Rv
acugccguugccgccg

SEQ ID NO: 3240878 - RNA, 16 nt, Mycobacterium tuberculosis H37Rv
acugccucaaaccgga

SEQ ID NO: 3240879 - RNA, 16 nt, Mycobacterium tuberculosis H37Rv
acugcgaaugcugggc

SEQ ID NO: 3240880 - RNA, 22 nt, Mycobacterium tuberculosis H37Rv
acugcgaccgguucggcguaca

SEQ ID NO: 3240881 - RNA, 18 nt, Mycobacterium tuberculosis H37Rv
acugcgaccgucccggcc

SEQ ID NO: 3240882 - RNA, 23 nt, Mycobacterium tuberculosis H37Rv
acugcgcccauagcugccggccc

SEQ ID NO: 3240883 - RNA, 20 nt, Mycobacterium tuberculosis H37Rv
acugcgccguucgcuccccc

SEQ ID NO: 3240884 - RNA, 20 nt, Mycobacterium tuberculosis H37Rv
acugcgcgcguugcggucaa

SEQ ID NO: 3240885 - RNA, 17 nt, Mycobacterium tuberculosis H37Rv
acugcgcuacaucagaa

SEQ ID NO: 3240886 - RNA, 14 nt, Mycobacterium tuberculosis H37Rv
acugcggaagccac

SEQ ID NO: 3240887 - RNA, 14 nt, Mycobacterium tuberculosis H37Rv
acugcggucgccca

SEQ ID NO: 3240888 - RNA, 19 nt, Mycobacterium tuberculosis H37Rv
acugcguuccaucgccgac

SEQ ID NO: 3240889 - RNA, 20 nt, Mycobacterium tuberculosis H37Rv
acugcuccuugggucgguca

SEQ ID NO: 3240890 - RNA, 18 nt, Mycobacterium tuberculosis H37Rv
acugcugaaucacaccau

SEQ ID NO: 3240891 - RNA, 21 nt, Mycobacterium tuberculosis H37Rv
acugcugcggcagcgcggcca

SEQ ID NO: 3240892 - RNA, 13 nt, Mycobacterium tuberculosis H37Rv
acugcugcuugag

SEQ ID NO: 3240893 - RNA, 18 nt, Mycobacterium tuberculosis H37Rv
acugcugcuugagcucgc

SEQ ID NO: 3240894 - RNA, 15 nt, Mycobacterium tuberculosis H37Rv
acugcugggcuucga

SEQ ID NO: 3240895 - RNA, 11 nt, Mycobacterium tuberculosis H37Rv
acuggaaagca

SEQ ID NO: 3240896 - RNA, 12 nt, Mycobacterium tuberculosis H37Rv
acuggaaggcgg

SEQ ID NO: 3240897 - RNA, 20 nt, Mycobacterium tuberculosis H37Rv
acuggaauggaucucggcgu

SEQ ID NO: 3240898 - RNA, 20 nt, Mycobacterium tuberculosis H37Rv
acuggaauggcucacgcucc

SEQ ID NO: 3240899 - RNA, 18 nt, Mycobacterium tuberculosis H37Rv
acuggacaagcuccucgc

SEQ ID NO: 3240900 - RNA, 17 nt, Mycobacterium tuberculosis H37Rv
acuggaccgcggugacc

SEQ ID NO: 3240901 - RNA, 17 nt, Mycobacterium tuberculosis H37Rv
acuggauggcucgccga

SEQ ID NO: 3240902 - RNA, 21 nt, Mycobacterium tuberculosis H37Rv
acuggccccgguggugcugcc

SEQ ID NO: 3240903 - RNA, 20 nt, Mycobacterium tuberculosis H37Rv
acuggcccggacaugcgggc

SEQ ID NO: 3240904 - RNA, 21 nt, Mycobacterium tuberculosis H37Rv
acuggcccggacaugcgggca

SEQ ID NO: 3240905 - RNA, 17 nt, Mycobacterium tuberculosis H37Rv
acuggccguuucggcgc

SEQ ID NO: 3240906 - RNA, 19 nt, Mycobacterium tuberculosis H37Rv
acuggccguuucggcgccg

SEQ ID NO: 3240907 - RNA, 23 nt, Mycobacterium tuberculosis H37Rv
acuggccguuucggcgccgucgc

SEQ ID NO: 3240908 - RNA, 14 nt, Mycobacterium tuberculosis H37Rv
acuggcgucgaugu

SEQ ID NO: 3240909 - RNA, 16 nt, Mycobacterium tuberculosis H37Rv
acuggcuauaaaccac

SEQ ID NO: 3240910 - RNA, 14 nt, Mycobacterium tuberculosis H37Rv
acugggccggucga

SEQ ID NO: 3240911 - RNA, 20 nt, Mycobacterium tuberculosis H37Rv
acugggcgaucgacaccgug

SEQ ID NO: 3240912 - RNA, 16 nt, Mycobacterium tuberculosis H37Rv
acugggcgcccgcggu

SEQ ID NO: 3240913 - RNA, 16 nt, Mycobacterium tuberculosis H37Rv
acugggcgcuggaggc

SEQ ID NO: 3240914 - RNA, 16 nt, Mycobacterium tuberculosis H37Rv
acuggggaggccaacc

SEQ ID NO: 3240915 - RNA, 15 nt, Mycobacterium tuberculosis H37Rv
acuggggugcugcgc

SEQ ID NO: 3240916 - RNA, 21 nt, Mycobacterium tuberculosis H37Rv
acuggguugcgaacucggccg

SEQ ID NO: 3240917 - RNA, 22 nt, Mycobacterium tuberculosis H37Rv
acuggguugcgaacucggccgu

SEQ ID NO: 3240918 - RNA, 12 nt, Mycobacterium tuberculosis H37Rv
acuggucgacgc

SEQ ID NO: 3240919 - RNA, 15 nt, Mycobacterium tuberculosis H37Rv
acuggucgacgccga

SEQ ID NO: 3240920 - RNA, 22 nt, Mycobacterium tuberculosis H37Rv
acuggucgacgucgguguaacc

SEQ ID NO: 3240921 - RNA, 21 nt, Mycobacterium tuberculosis H37Rv
acuggucgccaacgccagcac

SEQ ID NO: 3240922 - RNA, 14 nt, Mycobacterium tuberculosis H37Rv
acuggugacccuga

SEQ ID NO: 3240923 - RNA, 18 nt, Mycobacterium tuberculosis H37Rv
acugguggcgauccguag

SEQ ID NO: 3240924 - RNA, 21 nt, Mycobacterium tuberculosis H37Rv
acugguggucgugguguuggu

SEQ ID NO: 3240925 - RNA, 15 nt, Mycobacterium tuberculosis H37Rv
acuguagggccggug

SEQ ID NO: 3240926 - RNA, 18 nt, Mycobacterium tuberculosis H37Rv
acuguccgcccggaaaaa

SEQ ID NO: 3240927 - RNA, 18 nt, Mycobacterium tuberculosis H37Rv
acuguccugccagaagac

SEQ ID NO: 3240928 - RNA, 22 nt, Mycobacterium tuberculosis H37Rv
acugucgauaaugaucucggca

SEQ ID NO: 3240929 - RNA, 23 nt, Mycobacterium tuberculosis H37Rv
acugucggguaaccccaccugga

SEQ ID NO: 3240930 - RNA, 16 nt, Mycobacterium tuberculosis H37Rv
acugucuggucggcua

SEQ ID NO: 3240931 - RNA, 17 nt, Mycobacterium tuberculosis H37Rv
acugucuugggggccaa

SEQ ID NO: 3240932 - RNA, 19 nt, Mycobacterium tuberculosis H37Rv
acugucuugggggccaacc

SEQ ID NO: 3240933 - RNA, 19 nt, Mycobacterium tuberculosis H37Rv
acugugaguagcccgcguc

SEQ ID NO: 3240934 - RNA, 20 nt, Mycobacterium tuberculosis H37Rv
acugugccgcugcauccgca

SEQ ID NO: 3240935 - RNA, 16 nt, Mycobacterium tuberculosis H37Rv
acugugcgccgcagcc

SEQ ID NO: 3240936 - RNA, 15 nt, Mycobacterium tuberculosis H37Rv
acugugcgccugcgu

SEQ ID NO: 3240937 - RNA, 15 nt, Mycobacterium tuberculosis H37Rv
acugugcguuccuga

SEQ ID NO: 3240938 - RNA, 16 nt, Mycobacterium tuberculosis H37Rv
acugugcuauggccgc

SEQ ID NO: 3240939 - RNA, 21 nt, Mycobacterium tuberculosis H37Rv
acugugguggaacuccgggug

SEQ ID NO: 3240940 - RNA, 20 nt, Mycobacterium tuberculosis H37Rv
acuguuaggcgauugcgccg

SEQ ID NO: 3240941 - RNA, 14 nt, Mycobacterium tuberculosis H37Rv
acuguugaagaagc

SEQ ID NO: 3240942 - RNA, 16 nt, Mycobacterium tuberculosis H37Rv
acuguugaagaagccc

SEQ ID NO: 3240943 - RNA, 21 nt, Mycobacterium tuberculosis H37Rv
acuguugcguagcgcgcuaca

SEQ ID NO: 3240944 - RNA, 17 nt, Mycobacterium tuberculosis H37Rv
acuguuggugccgccac

SEQ ID NO: 3240945 - RNA, 18 nt, Mycobacterium tuberculosis H37Rv
acuuagcccgauggugcc

SEQ ID NO: 3240946 - RNA, 19 nt, Mycobacterium tuberculosis H37Rv
acuuagcgggugccagccc

SEQ ID NO: 3240947 - RNA, 11 nt, Mycobacterium tuberculosis H37Rv
acuucaccacc

SEQ ID NO: 3240948 - RNA, 16 nt, Mycobacterium tuberculosis H37Rv
acuucagcauggugga

SEQ ID NO: 3240949 - RNA, 14 nt, Mycobacterium tuberculosis H37Rv
acuucauagcgccg

SEQ ID NO: 3240950 - RNA, 16 nt, Mycobacterium tuberculosis H37Rv
acuuccaagccgaccu

SEQ ID NO: 3240951 - RNA, 22 nt, Mycobacterium tuberculosis H37Rv
acuuccaagccgaccugcugga

SEQ ID NO: 3240952 - RNA, 16 nt, Mycobacterium tuberculosis H37Rv
acuuccagcccggcaa

SEQ ID NO: 3240953 - RNA, 17 nt, Mycobacterium tuberculosis H37Rv
acuuccagcccggcaau

SEQ ID NO: 3240954 - RNA, 12 nt, Mycobacterium tuberculosis H37Rv
acuucccccggg

SEQ ID NO: 3240955 - RNA, 19 nt, Mycobacterium tuberculosis H37Rv
acuuccgcagcgccacccg

SEQ ID NO: 3240956 - RNA, 18 nt, Mycobacterium tuberculosis H37Rv
agacacuaaagcccucga

SEQ ID NO: 3240957 - RNA, 20 nt, Mycobacterium tuberculosis H37Rv
agacagacaggauugccgag

SEQ ID NO: 3240958 - RNA, 14 nt, Mycobacterium tuberculosis H37Rv
agacagcaccgccg

SEQ ID NO: 3240959 - RNA, 21 nt, Mycobacterium tuberculosis H37Rv
agacagccguuguacauagcc

SEQ ID NO: 3240960 - RNA, 12 nt, Mycobacterium tuberculosis H37Rv
agacaucagugc

SEQ ID NO: 3240961 - RNA, 16 nt, Mycobacterium tuberculosis H37Rv
agaccaaggcgaaggu

SEQ ID NO: 3240962 - RNA, 21 nt, Mycobacterium tuberculosis H37Rv
agaccacaacgccucgccauc

SEQ ID NO: 3240963 - RNA, 17 nt, Mycobacterium tuberculosis H37Rv
agaccagacugcagugc

SEQ ID NO: 3240964 - RNA, 14 nt, Mycobacterium tuberculosis H37Rv
agaccagcaggccc

SEQ ID NO: 3240965 - RNA, 16 nt, Mycobacterium tuberculosis H37Rv
agaccagcaggcccug

SEQ ID NO: 3240966 - RNA, 17 nt, Mycobacterium tuberculosis H37Rv
agaccagcaggcccugg

SEQ ID NO: 3240967 - RNA, 16 nt, Mycobacterium tuberculosis H37Rv
agaccaggcccagguc

SEQ ID NO: 3240968 - RNA, 19 nt, Mycobacterium tuberculosis H37Rv
agaccaugccgacgacggg

SEQ ID NO: 3240969 - RNA, 16 nt, Mycobacterium tuberculosis H37Rv
agaccauggucauguu

SEQ ID NO: 3240970 - RNA, 22 nt, Mycobacterium tuberculosis H37Rv
agacccaccaccgcaaccaaag

SEQ ID NO: 3240971 - RNA, 20 nt, Mycobacterium tuberculosis H37Rv
agacccagcgcggcaacucc

SEQ ID NO: 3240972 - RNA, 12 nt, Mycobacterium tuberculosis H37Rv
agacccggcacc

SEQ ID NO: 3240973 - RNA, 19 nt, Mycobacterium tuberculosis H37Rv
agacccgugagcggagcaa

SEQ ID NO: 3240974 - RNA, 19 nt, Mycobacterium tuberculosis H37Rv
agaccgacugcgggccagc

SEQ ID NO: 3240975 - RNA, 14 nt, Mycobacterium tuberculosis H37Rv
agaccgagcccgau

SEQ ID NO: 3240976 - RNA, 14 nt, Mycobacterium tuberculosis H37Rv
agaccgaucggcag

SEQ ID NO: 3240977 - RNA, 16 nt, Mycobacterium tuberculosis H37Rv
agaccgaucggcaggc

SEQ ID NO: 3240978 - RNA, 16 nt, Mycobacterium tuberculosis H37Rv
agaccgccgacgccgu

SEQ ID NO: 3240979 - RNA, 15 nt, Mycobacterium tuberculosis H37Rv
agaccgcgaacagcg

SEQ ID NO: 3240980 - RNA, 12 nt, Mycobacterium tuberculosis H37Rv
agaccgcgagca

SEQ ID NO: 3240981 - RNA, 17 nt, Mycobacterium tuberculosis H37Rv
agaccgcgagcagcaca

SEQ ID NO: 3240982 - RNA, 14 nt, Mycobacterium tuberculosis H37Rv
agaccgcggcggcc

SEQ ID NO: 3240983 - RNA, 20 nt, Mycobacterium tuberculosis H37Rv
agaccgcgucggcggccagu

SEQ ID NO: 3240984 - RNA, 21 nt, Mycobacterium tuberculosis H37Rv
agaccggaaaccacagcgcca

SEQ ID NO: 3240985 - RNA, 16 nt, Mycobacterium tuberculosis H37Rv
agaccgggcaccagaa

SEQ ID NO: 3240986 - RNA, 20 nt, Mycobacterium tuberculosis H37Rv
agaccgggucguagccgaac

SEQ ID NO: 3240987 - RNA, 21 nt, Mycobacterium tuberculosis H37Rv
agaccgguuucuucggccagc

SEQ ID NO: 3240988 - RNA, 19 nt, Mycobacterium tuberculosis H37Rv
agaccguccagcaacagcg

SEQ ID NO: 3240989 - RNA, 22 nt, Mycobacterium tuberculosis H37Rv
agaccguuacaccaucaaggac

SEQ ID NO: 3240990 - RNA, 17 nt, Mycobacterium tuberculosis H37Rv
agaccuagcaccgcgcc

SEQ ID NO: 3240991 - RNA, 15 nt, Mycobacterium tuberculosis H37Rv
agaccucaacccccu

SEQ ID NO: 3240992 - RNA, 13 nt, Mycobacterium tuberculosis H37Rv
agaccucagccgg

SEQ ID NO: 3240993 - RNA, 18 nt, Mycobacterium tuberculosis H37Rv
agaccucagccggcggcu

SEQ ID NO: 3240994 - RNA, 20 nt, Mycobacterium tuberculosis H37Rv
agaccucagccggcggcugg

SEQ ID NO: 3240995 - RNA, 12 nt, Mycobacterium tuberculosis H37Rv
agaccugguuga

SEQ ID NO: 3240996 - RNA, 11 nt, Mycobacterium tuberculosis H37Rv
agaccuucuug

SEQ ID NO: 3240997 - RNA, 19 nt, Mycobacterium tuberculosis H37Rv
agacgaacagcacgacugc

SEQ ID NO: 3240998 - RNA, 16 nt, Mycobacterium tuberculosis H37Rv
agacgaacgaccaggc

SEQ ID NO: 3240999 - RNA, 16 nt, Mycobacterium tuberculosis H37Rv
agacgaauaacgccgc

SEQ ID NO: 3241000 - RNA, 16 nt, Mycobacterium tuberculosis H37Rv
agacgaccgugcuggg

SEQ ID NO: 3241001 - RNA, 11 nt, Mycobacterium tuberculosis H37Rv
agacgagccac

SEQ ID NO: 3241002 - RNA, 16 nt, Mycobacterium tuberculosis H37Rv
agacgaugacagacau

SEQ ID NO: 3241003 - RNA, 12 nt, Mycobacterium tuberculosis H37Rv
agacgaugccgu

SEQ ID NO: 3241004 - RNA, 19 nt, Mycobacterium tuberculosis H37Rv
agacgauggcaacggcauc

SEQ ID NO: 3241005 - RNA, 15 nt, Mycobacterium tuberculosis H37Rv
agacgauggccaggu

SEQ ID NO: 3241006 - RNA, 16 nt, Mycobacterium tuberculosis H37Rv
agacgauucggcggcc

SEQ ID NO: 3241007 - RNA, 20 nt, Mycobacterium tuberculosis H37Rv
agacgcaaaauccccucgca

SEQ ID NO: 3241008 - RNA, 19 nt, Mycobacterium tuberculosis H37Rv
agacgcaaaaucgcccaau

SEQ ID NO: 3241009 - RNA, 19 nt, Mycobacterium tuberculosis H37Rv
agacgcaaaaucgcccauu

SEQ ID NO: 3241010 - RNA, 19 nt, Mycobacterium tuberculosis H37Rv
agacgcaaaaucgcccgaa

SEQ ID NO: 3241011 - RNA, 15 nt, Mycobacterium tuberculosis H37Rv
agacgcacggccacc

SEQ ID NO: 3241012 - RNA, 18 nt, Mycobacterium tuberculosis H37Rv
agacgcagaagcccccaa

SEQ ID NO: 3241013 - RNA, 18 nt, Mycobacterium tuberculosis H37Rv
agacgcagaaucgcacgc

SEQ ID NO: 3241014 - RNA, 20 nt, Mycobacterium tuberculosis H37Rv
agacgcagaaucgcacgcga

SEQ ID NO: 3241015 - RNA, 19 nt, Mycobacterium tuberculosis H37Rv
agacgcagaaucgcccaau

SEQ ID NO: 3241016 - RNA, 18 nt, Mycobacterium tuberculosis H37Rv
agacgccacugccagccg

SEQ ID NO: 3241017 - RNA, 21 nt, Mycobacterium tuberculosis H37Rv
agacgccacugccagccgugc

SEQ ID NO: 3241018 - RNA, 22 nt, Mycobacterium tuberculosis H37Rv
agacgccgccgcugccgcccuu

SEQ ID NO: 3241019 - RNA, 12 nt, Mycobacterium tuberculosis H37Rv
agacgccgucga

SEQ ID NO: 3241020 - RNA, 22 nt, Mycobacterium tuberculosis H37Rv
agacgcgaaaucccccgacacg

SEQ ID NO: 3241021 - RNA, 18 nt, Mycobacterium tuberculosis H37Rv
agacgcggaaucgcaccg

SEQ ID NO: 3241022 - RNA, 22 nt, Mycobacterium tuberculosis H37Rv
agacgcgggucuuggcacacag

SEQ ID NO: 3241023 - RNA, 22 nt, Mycobacterium tuberculosis H37Rv
agacgcuaaagcccccgcacgc

SEQ ID NO: 3241024 - RNA, 18 nt, Mycobacterium tuberculosis H37Rv
agacgcucuugaauagga

SEQ ID NO: 3241025 - RNA, 19 nt, Mycobacterium tuberculosis H37Rv
agacgcugcccaaaagcgc

SEQ ID NO: 3241026 - RNA, 14 nt, Mycobacterium tuberculosis H37Rv
agacgcugcgcgcc

SEQ ID NO: 3241027 - RNA, 18 nt, Mycobacterium tuberculosis H37Rv
agacgcuguccaggucug

SEQ ID NO: 3241028 - RNA, 12 nt, Mycobacterium tuberculosis H37Rv
agacggcacccc

SEQ ID NO: 3241029 - RNA, 13 nt, Mycobacterium tuberculosis H37Rv
agacggcaccccc

SEQ ID NO: 3241030 - RNA, 15 nt, Mycobacterium tuberculosis H37Rv
agacggcaggaauga

SEQ ID NO: 3241031 - RNA, 13 nt, Mycobacterium tuberculosis H37Rv
agacggcugccac

SEQ ID NO: 3241032 - RNA, 16 nt, Mycobacterium tuberculosis H37Rv
agacggcugccacgcg

SEQ ID NO: 3241033 - RNA, 15 nt, Mycobacterium tuberculosis H37Rv
agacgguccggucgc

SEQ ID NO: 3241034 - RNA, 20 nt, Mycobacterium tuberculosis H37Rv
agacguauaucgguugcugc

SEQ ID NO: 3241035 - RNA, 13 nt, Mycobacterium tuberculosis H37Rv
agacguccgcggu

SEQ ID NO: 3241036 - RNA, 14 nt, Mycobacterium tuberculosis H37Rv
agacguccugggcc

SEQ ID NO: 3241037 - RNA, 21 nt, Mycobacterium tuberculosis H37Rv
agacgucgaacuucagcggcg

SEQ ID NO: 3241038 - RNA, 13 nt, Mycobacterium tuberculosis H37Rv
agacgucgaccgu

SEQ ID NO: 3241039 - RNA, 15 nt, Mycobacterium tuberculosis H37Rv
agacgucgcaacgug

SEQ ID NO: 3241040 - RNA, 17 nt, Mycobacterium tuberculosis H37Rv
agacgugguagccggcg

SEQ ID NO: 3241041 - RNA, 23 nt, Mycobacterium tuberculosis H37Rv
agacguuccaucacggaccaggc

SEQ ID NO: 3241042 - RNA, 21 nt, Mycobacterium tuberculosis H37Rv
agacguugccaacaccggcga

SEQ ID NO: 3241043 - RNA, 12 nt, Mycobacterium tuberculosis H37Rv
agacuagcugcu

SEQ ID NO: 3241044 - RNA, 12 nt, Mycobacterium tuberculosis H37Rv
agacuccagcaa

SEQ ID NO: 3241045 - RNA, 18 nt, Mycobacterium tuberculosis H37Rv
agacugggcgcuggaggc

SEQ ID NO: 3241046 - RNA, 19 nt, Mycobacterium tuberculosis H37Rv
agacugggcgcuggaggcc

SEQ ID NO: 3241047 - RNA, 21 nt, Mycobacterium tuberculosis H37Rv
agacuuccucggauugcagcg

SEQ ID NO: 3241048 - RNA, 13 nt, Mycobacterium tuberculosis H37Rv
agacuugccgagu

SEQ ID NO: 3241049 - RNA, 15 nt, Mycobacterium tuberculosis H37Rv
agacuugcugcuccu

SEQ ID NO: 3241050 - RNA, 16 nt, Mycobacterium tuberculosis H37Rv
agacuugcugcuccuu

SEQ ID NO: 3241051 - RNA, 11 nt, Mycobacterium tuberculosis H37Rv
agagaccaagg

SEQ ID NO: 3241052 - RNA, 13 nt, Mycobacterium tuberculosis H37Rv
agagacuugccga

SEQ ID NO: 3241053 - RNA, 14 nt, Mycobacterium tuberculosis H37Rv
agauucccgagacu

SEQ ID NO: 3241054 - RNA, 19 nt, Mycobacterium tuberculosis H37Rv
agauuccucuucaggcccu

SEQ ID NO: 3241055 - RNA, 20 nt, Mycobacterium tuberculosis H37Rv
agauucgcucaccaccgacc

SEQ ID NO: 3241056 - RNA, 15 nt, Mycobacterium tuberculosis H37Rv
agauucggugccagc

SEQ ID NO: 3241057 - RNA, 19 nt, Mycobacterium tuberculosis H37Rv
agauucggugccagcaggc

SEQ ID NO: 3241058 - RNA, 12 nt, Mycobacterium tuberculosis H37Rv
agauugcugacg

SEQ ID NO: 3241059 - RNA, 23 nt, Mycobacterium tuberculosis H37Rv
agauuggaagacgccggcgaugc

SEQ ID NO: 3241060 - RNA, 16 nt, Mycobacterium tuberculosis H37Rv
agauuggcgcugcccg

SEQ ID NO: 3241061 - RNA, 16 nt, Mycobacterium tuberculosis H37Rv
agauuggguccagcga

SEQ ID NO: 3241062 - RNA, 20 nt, Mycobacterium tuberculosis H37Rv
agauugguggcccgggccac

SEQ ID NO: 3241063 - RNA, 13 nt, Mycobacterium tuberculosis H37Rv
agauuguccggcc

SEQ ID NO: 3241064 - RNA, 17 nt, Mycobacterium tuberculosis H37Rv
agauugugagcaauggc

SEQ ID NO: 3241065 - RNA, 14 nt, Mycobacterium tuberculosis H37Rv
agcaaaauggccac

SEQ ID NO: 3241066 - RNA, 16 nt, Mycobacterium tuberculosis H37Rv
agcaaaauggccaccg

SEQ ID NO: 3241067 - RNA, 16 nt, Mycobacterium tuberculosis H37Rv
agcaaacgaggauuca

SEQ ID NO: 3241068 - RNA, 20 nt, Mycobacterium tuberculosis H37Rv
agcaacaccgucggcagcag

SEQ ID NO: 3241069 - RNA, 14 nt, Mycobacterium tuberculosis H37Rv
agcaacagcgcggu

SEQ ID NO: 3241070 - RNA, 18 nt, Mycobacterium tuberculosis H37Rv
agcaacagcgcgguguuc

SEQ ID NO: 3241071 - RNA, 21 nt, Mycobacterium tuberculosis H37Rv
agcaacccgccguugccaccg

SEQ ID NO: 3241072 - RNA, 22 nt, Mycobacterium tuberculosis H37Rv
agcaacccgccguugccaccgg

SEQ ID NO: 3241073 - RNA, 16 nt, Mycobacterium tuberculosis H37Rv
agcaacgaagccggcg

SEQ ID NO: 3241074 - RNA, 17 nt, Mycobacterium tuberculosis H37Rv
agcaacgccacccgaau

SEQ ID NO: 3241075 - RNA, 15 nt, Mycobacterium tuberculosis H37Rv
agcaacgccacgccg

SEQ ID NO: 3241076 - RNA, 16 nt, Mycobacterium tuberculosis H37Rv
agcaacgcugcagcag

SEQ ID NO: 3241077 - RNA, 20 nt, Mycobacterium tuberculosis H37Rv
agcaacggcagcgugggcga

SEQ ID NO: 3241078 - RNA, 22 nt, Mycobacterium tuberculosis H37Rv
agcaacggugcucuucgaugac

SEQ ID NO: 3241079 - RNA, 13 nt, Mycobacterium tuberculosis H37Rv
agcaacgucggua

SEQ ID NO: 3241080 - RNA, 16 nt, Mycobacterium tuberculosis H37Rv
agcaacucguccagca

SEQ ID NO: 3241081 - RNA, 20 nt, Mycobacterium tuberculosis H37Rv
agcaacucguccagcagugc

SEQ ID NO: 3241082 - RNA, 15 nt, Mycobacterium tuberculosis H37Rv
agcaacugccgcacc

SEQ ID NO: 3241083 - RNA, 20 nt, Mycobacterium tuberculosis H37Rv
agcaagaaguacgugcacag

SEQ ID NO: 3241084 - RNA, 16 nt, Mycobacterium tuberculosis H37Rv
agcaagagccgcagcc

SEQ ID NO: 3241085 - RNA, 14 nt, Mycobacterium tuberculosis H37Rv
agcaagaucggcag

SEQ ID NO: 3241086 - RNA, 19 nt, Mycobacterium tuberculosis H37Rv
agcaagaucggcagcgugg

SEQ ID NO: 3241087 - RNA, 16 nt, Mycobacterium tuberculosis H37Rv
agcaagccaacccaau

SEQ ID NO: 3241088 - RNA, 17 nt, Mycobacterium tuberculosis H37Rv
agcaaggccagcacggc

SEQ ID NO: 3241089 - RNA, 14 nt, Mycobacterium tuberculosis H37Rv
agcaaggcccgaaa

SEQ ID NO: 3241090 - RNA, 14 nt, Mycobacterium tuberculosis H37Rv
agcaaguccaccgg

SEQ ID NO: 3241091 - RNA, 13 nt, Mycobacterium tuberculosis H37Rv
agcaaguccugca

SEQ ID NO: 3241092 - RNA, 13 nt, Mycobacterium tuberculosis H37Rv
agcaagucgccga

SEQ ID NO: 3241093 - RNA, 15 nt, Mycobacterium tuberculosis H37Rv
agcaagugcgggcug

SEQ ID NO: 3241094 - RNA, 18 nt, Mycobacterium tuberculosis H37Rv
agcaagugggugccggca

SEQ ID NO: 3241095 - RNA, 18 nt, Mycobacterium tuberculosis H37Rv
agcaauccaaggcucagc

SEQ ID NO: 3241096 - RNA, 22 nt, Mycobacterium tuberculosis H37Rv
agcaauccaaggcucagcagcg

SEQ ID NO: 3241097 - RNA, 17 nt, Mycobacterium tuberculosis H37Rv
agcaauccgcacagcga

SEQ ID NO: 3241098 - RNA, 13 nt, Mycobacterium tuberculosis H37Rv
agcaaugcccgca

SEQ ID NO: 3241099 - RNA, 14 nt, Mycobacterium tuberculosis H37Rv
agcaaugcccgcac

SEQ ID NO: 3241100 - RNA, 21 nt, Mycobacterium tuberculosis H37Rv
agcaauuccaccgccgagaug

SEQ ID NO: 3241101 - RNA, 19 nt, Mycobacterium tuberculosis H37Rv
agcaauuugccguagaaac

SEQ ID NO: 3241102 - RNA, 14 nt, Mycobacterium tuberculosis H37Rv
agcacaaacccagu

SEQ ID NO: 3241103 - RNA, 20 nt, Mycobacterium tuberculosis H37Rv
agcacacccagaugcaggcu

SEQ ID NO: 3241104 - RNA, 13 nt, Mycobacterium tuberculosis H37Rv
agcacaccgccag

SEQ ID NO: 3241105 - RNA, 14 nt, Mycobacterium tuberculosis H37Rv
agcacaccgccagc

SEQ ID NO: 3241106 - RNA, 15 nt, Mycobacterium tuberculosis H37Rv
agcacagcagcaacg

SEQ ID NO: 3241107 - RNA, 21 nt, Mycobacterium tuberculosis H37Rv
agcacagcagcaacgcggugc

SEQ ID NO: 3241108 - RNA, 14 nt, Mycobacterium tuberculosis H37Rv
agcacagcgcagcc

SEQ ID NO: 3241109 - RNA, 20 nt, Mycobacterium tuberculosis H37Rv
agcacagcgcagccugcagc

SEQ ID NO: 3241110 - RNA, 17 nt, Mycobacterium tuberculosis H37Rv
agcacauccugcagcuc

SEQ ID NO: 3241111 - RNA, 18 nt, Mycobacterium tuberculosis H37Rv
agcacauccugcagcucg

SEQ ID NO: 3241112 - RNA, 14 nt, Mycobacterium tuberculosis H37Rv
agcacaucgccggc

SEQ ID NO: 3241113 - RNA, 16 nt, Mycobacterium tuberculosis H37Rv
agcacaucgccggcgu

SEQ ID NO: 3241114 - RNA, 17 nt, Mycobacterium tuberculosis H37Rv
agcaccaagaccguucg

SEQ ID NO: 3241115 - RNA, 15 nt, Mycobacterium tuberculosis H37Rv
agcaccaaggucuuc

SEQ ID NO: 3241116 - RNA, 16 nt, Mycobacterium tuberculosis H37Rv
agcaccacaacgucgg

SEQ ID NO: 3241117 - RNA, 14 nt, Mycobacterium tuberculosis H37Rv
agcaccaccagcag

SEQ ID NO: 3241118 - RNA, 21 nt, Mycobacterium tuberculosis H37Rv
agcaccaccccagcggccacc

SEQ ID NO: 3241119 - RNA, 23 nt, Mycobacterium tuberculosis H37Rv
agcaccaccccagcggccaccga

SEQ ID NO: 3241120 - RNA, 14 nt, Mycobacterium tuberculosis H37Rv
agcaccacccgcac

SEQ ID NO: 3241121 - RNA, 19 nt, Mycobacterium tuberculosis H37Rv
agcaccacccgcaccucac

SEQ ID NO: 3241122 - RNA, 16 nt, Mycobacterium tuberculosis H37Rv
agcaccacccgggccu

SEQ ID NO: 3241123 - RNA, 16 nt, Mycobacterium tuberculosis H37Rv
agcaccaccgcggugu

SEQ ID NO: 3241124 - RNA, 18 nt, Mycobacterium tuberculosis H37Rv
agcaccaccgcggugugc

SEQ ID NO: 3241125 - RNA, 13 nt, Mycobacterium tuberculosis H37Rv
agcaccacggcgc

SEQ ID NO: 3241126 - RNA, 14 nt, Mycobacterium tuberculosis H37Rv
agcaccacgugcga

SEQ ID NO: 3241127 - RNA, 12 nt, Mycobacterium tuberculosis H37Rv
agcaccagcagc

SEQ ID NO: 3241128 - RNA, 13 nt, Mycobacterium tuberculosis H37Rv
agcaccagcagca

SEQ ID NO: 3241129 - RNA, 14 nt, Mycobacterium tuberculosis H37Rv
agcaccagcagcac

SEQ ID NO: 3241130 - RNA, 14 nt, Mycobacterium tuberculosis H37Rv
agcaccagccaaau

SEQ ID NO: 3241131 - RNA, 13 nt, Mycobacterium tuberculosis H37Rv
agcaccagccacg

SEQ ID NO: 3241132 - RNA, 15 nt, Mycobacterium tuberculosis H37Rv
agcaccagccagccu

SEQ ID NO: 3241133 - RNA, 18 nt, Mycobacterium tuberculosis H37Rv
agcaccagccagccugcu

SEQ ID NO: 3241134 - RNA, 18 nt, Mycobacterium tuberculosis H37Rv
agcaccagcgucgcggcc

SEQ ID NO: 3241135 - RNA, 21 nt, Mycobacterium tuberculosis H37Rv
agcaccagggcgcggaucugc

SEQ ID NO: 3241136 - RNA, 16 nt, Mycobacterium tuberculosis H37Rv
agcaccaguucccuac

SEQ ID NO: 3241137 - RNA, 17 nt, Mycobacterium tuberculosis H37Rv
agcaccaguucccuaca

SEQ ID NO: 3241138 - RNA, 17 nt, Mycobacterium tuberculosis H37Rv
agcacccaaugccaccg

SEQ ID NO: 3241139 - RNA, 19 nt, Mycobacterium tuberculosis H37Rv
agcaccccaaaaccgccgg

SEQ ID NO: 3241140 - RNA, 17 nt, Mycobacterium tuberculosis H37Rv
agcaccccauggccacc

SEQ ID NO: 3241141 - RNA, 18 nt, Mycobacterium tuberculosis H37Rv
agcaccccauggccaccg

SEQ ID NO: 3241142 - RNA, 19 nt, Mycobacterium tuberculosis H37Rv
agcaccccauggccaccga

SEQ ID NO: 3241143 - RNA, 22 nt, Mycobacterium tuberculosis H37Rv
agcaccccauggccaccgaacg

SEQ ID NO: 3241144 - RNA, 14 nt, Mycobacterium tuberculosis H37Rv
agcaccccgagguc

SEQ ID NO: 3241145 - RNA, 17 nt, Mycobacterium tuberculosis H37Rv
agcaccccgccgggggc

SEQ ID NO: 3241146 - RNA, 17 nt, Mycobacterium tuberculosis H37Rv
agcacccgauaguucug

SEQ ID NO: 3241147 - RNA, 14 nt, Mycobacterium tuberculosis H37Rv
agcacccgcaaugc

SEQ ID NO: 3241148 - RNA, 13 nt, Mycobacterium tuberculosis H37Rv
agcacccgcagcc

SEQ ID NO: 3241149 - RNA, 22 nt, Mycobacterium tuberculosis H37Rv
agcacccgcucggccgccgggu

SEQ ID NO: 3241150 - RNA, 14 nt, Mycobacterium tuberculosis H37Rv
agcagcaacgcggu

SEQ ID NO: 3241151 - RNA, 21 nt, Mycobacterium tuberculosis H37Rv
agcagcaacgcggugccggga

SEQ ID NO: 3241152 - RNA, 23 nt, Mycobacterium tuberculosis H37Rv
agcagcaccaacugaauggcacc

SEQ ID NO: 3241153 - RNA, 12 nt, Mycobacterium tuberculosis H37Rv
agcagcacccgg

SEQ ID NO: 3241154 - RNA, 14 nt, Mycobacterium tuberculosis H37Rv
agcagcaccgacgu

SEQ ID NO: 3241155 - RNA, 12 nt, Mycobacterium tuberculosis H37Rv
agcagcaccugc

SEQ ID NO: 3241156 - RNA, 16 nt, Mycobacterium tuberculosis H37Rv
agcagcacgucgaacu

SEQ ID NO: 3241157 - RNA, 16 nt, Mycobacterium tuberculosis H37Rv
agcagcagagccaacg

SEQ ID NO: 3241158 - RNA, 22 nt, Mycobacterium tuberculosis H37Rv
agcagcagcgugaccaccgccg

SEQ ID NO: 3241159 - RNA, 12 nt, Mycobacterium tuberculosis H37Rv
agcagcagugcc

SEQ ID NO: 3241160 - RNA, 13 nt, Mycobacterium tuberculosis H37Rv
agcagcagugcca

SEQ ID NO: 3241161 - RNA, 16 nt, Mycobacterium tuberculosis H37Rv
agcagcagugccaccg

SEQ ID NO: 3241162 - RNA, 14 nt, Mycobacterium tuberculosis H37Rv
agcagcaucggcac

SEQ ID NO: 3241163 - RNA, 18 nt, Mycobacterium tuberculosis H37Rv
agcagccagcaacaccag

SEQ ID NO: 3241164 - RNA, 14 nt, Mycobacterium tuberculosis H37Rv
agcagccagccacc

SEQ ID NO: 3241165 - RNA, 16 nt, Mycobacterium tuberculosis H37Rv
agcagccagcccagcc

SEQ ID NO: 3241166 - RNA, 21 nt, Mycobacterium tuberculosis H37Rv
agcagccagcccagccgccag

SEQ ID NO: 3241167 - RNA, 15 nt, Mycobacterium tuberculosis H37Rv
agcagccagcgucca

SEQ ID NO: 3241168 - RNA, 22 nt, Mycobacterium tuberculosis H37Rv
agcagcccgcccugaccgcccg

SEQ ID NO: 3241169 - RNA, 23 nt, Mycobacterium tuberculosis H37Rv
agcagcccgcccugaccgcccgc

SEQ ID NO: 3241170 - RNA, 12 nt, Mycobacterium tuberculosis H37Rv
agcagcccgcgg

SEQ ID NO: 3241171 - RNA, 13 nt, Mycobacterium tuberculosis H37Rv
agcagccgaaccg

SEQ ID NO: 3241172 - RNA, 19 nt, Mycobacterium tuberculosis H37Rv
agcagccgaaccggcacca

SEQ ID NO: 3241173 - RNA, 13 nt, Mycobacterium tuberculosis H37Rv
agcagcgaccagc

SEQ ID NO: 3241174 - RNA, 17 nt, Mycobacterium tuberculosis H37Rv
agcagcgccacccgguc

SEQ ID NO: 3241175 - RNA, 20 nt, Mycobacterium tuberculosis H37Rv
agcagcgccgcguucagggc

SEQ ID NO: 3241176 - RNA, 22 nt, Mycobacterium tuberculosis H37Rv
agcagcggcucuauccggcgca

SEQ ID NO: 3241177 - RNA, 23 nt, Mycobacterium tuberculosis H37Rv
agcagcgggacauccagugcggu

SEQ ID NO: 3241178 - RNA, 16 nt, Mycobacterium tuberculosis H37Rv
agcagcggugcagccc

SEQ ID NO: 3241179 - RNA, 20 nt, Mycobacterium tuberculosis H37Rv
agcagcgguugaugcggccg

SEQ ID NO: 3241180 - RNA, 19 nt, Mycobacterium tuberculosis H37Rv
agcagcgugaccaccgccg

SEQ ID NO: 3241181 - RNA, 21 nt, Mycobacterium tuberculosis H37Rv
agcagcguggcgaugggucug

SEQ ID NO: 3241182 - RNA, 23 nt, Mycobacterium tuberculosis H37Rv
agcagcuccuugaggucacccau

SEQ ID NO: 3241183 - RNA, 18 nt, Mycobacterium tuberculosis H37Rv
agcagcucggccgaggcg

SEQ ID NO: 3241184 - RNA, 22 nt, Mycobacterium tuberculosis H37Rv
agcagcucggccgaggcggucu

SEQ ID NO: 3241185 - RNA, 21 nt, Mycobacterium tuberculosis H37Rv
agcagcugcgauauggucacc

SEQ ID NO: 3241186 - RNA, 20 nt, Mycobacterium tuberculosis H37Rv
agcagcugggcaucaccgcc

SEQ ID NO: 3241187 - RNA, 21 nt, Mycobacterium tuberculosis H37Rv
agcagcugggcaucaccgccg

SEQ ID NO: 3241188 - RNA, 12 nt, Mycobacterium tuberculosis H37Rv
agcagcuggucg

SEQ ID NO: 3241189 - RNA, 21 nt, Mycobacterium tuberculosis H37Rv
agcagcuggucgugggccacc

SEQ ID NO: 3241190 - RNA, 15 nt, Mycobacterium tuberculosis H37Rv
agcagcuugacccac

SEQ ID NO: 3241191 - RNA, 20 nt, Mycobacterium tuberculosis H37Rv
agcaggacgaugaugaucac

SEQ ID NO: 3241192 - RNA, 15 nt, Mycobacterium tuberculosis H37Rv
agcaggaucggcagc

SEQ ID NO: 3241193 - RNA, 13 nt, Mycobacterium tuberculosis H37Rv
agcaggcauuccc

SEQ ID NO: 3241194 - RNA, 16 nt, Mycobacterium tuberculosis H37Rv
agcaggcgaugcgcca

SEQ ID NO: 3241195 - RNA, 13 nt, Mycobacterium tuberculosis H37Rv
agcaggcgcacca

SEQ ID NO: 3241196 - RNA, 20 nt, Mycobacterium tuberculosis H37Rv
agcaggcgcaccaggcggcc

SEQ ID NO: 3241197 - RNA, 20 nt, Mycobacterium tuberculosis H37Rv
agcaggcggcugaacggcag

SEQ ID NO: 3241198 - RNA, 13 nt, Mycobacterium tuberculosis H37Rv
agcaggcggggga

SEQ ID NO: 3241199 - RNA, 20 nt, Mycobacterium tuberculosis H37Rv
agcaggcucgaaccgacgcg

SEQ ID NO: 3241200 - RNA, 15 nt, Mycobacterium tuberculosis H37Rv
agcaggcuggcugcc

SEQ ID NO: 3241201 - RNA, 14 nt, Mycobacterium tuberculosis H37Rv
agcagggccaccac

SEQ ID NO: 3241202 - RNA, 17 nt, Mycobacterium tuberculosis H37Rv
agcagggccaccaccac

SEQ ID NO: 3241203 - RNA, 19 nt, Mycobacterium tuberculosis H37Rv
agcagggccaccaccacgg

SEQ ID NO: 3241204 - RNA, 17 nt, Mycobacterium tuberculosis H37Rv
agcagggccagaccgaa

SEQ ID NO: 3241205 - RNA, 22 nt, Mycobacterium tuberculosis H37Rv
agcagggccggcaccgcagcgg

SEQ ID NO: 3241206 - RNA, 15 nt, Mycobacterium tuberculosis H37Rv
agcagggcggcgaac

SEQ ID NO: 3241207 - RNA, 15 nt, Mycobacterium tuberculosis H37Rv
agcaggguuccccau

SEQ ID NO: 3241208 - RNA, 21 nt, Mycobacterium tuberculosis H37Rv
agcagguaggcgcgauacaga

SEQ ID NO: 3241209 - RNA, 15 nt, Mycobacterium tuberculosis H37Rv
agcaggucgaugcug

SEQ ID NO: 3241210 - RNA, 24 nt, Mycobacterium tuberculosis H37Rv
agcaggucgaugcugccagccaug

SEQ ID NO: 3241211 - RNA, 19 nt, Mycobacterium tuberculosis H37Rv
agcaggucucguaucgcac

SEQ ID NO: 3241212 - RNA, 17 nt, Mycobacterium tuberculosis H37Rv
agcaggugaaacaggac

SEQ ID NO: 3241213 - RNA, 17 nt, Mycobacterium tuberculosis H37Rv
agcaggugauguucagc

SEQ ID NO: 3241214 - RNA, 19 nt, Mycobacterium tuberculosis H37Rv
agcaggugcccgaggugcu

SEQ ID NO: 3241215 - RNA, 20 nt, Mycobacterium tuberculosis H37Rv
agcagguuccgcacgaucag

SEQ ID NO: 3241216 - RNA, 20 nt, Mycobacterium tuberculosis H37Rv
agcagguuggucaccaccug

SEQ ID NO: 3241217 - RNA, 17 nt, Mycobacterium tuberculosis H37Rv
agcaguacuaacaacac

SEQ ID NO: 3241218 - RNA, 23 nt, Mycobacterium tuberculosis H37Rv
agcaguacuaacaacaccaccag

SEQ ID NO: 3241219 - RNA, 23 nt, Mycobacterium tuberculosis H37Rv
agcaguagcugcucaucgcgccc

SEQ ID NO: 3241220 - RNA, 13 nt, Mycobacterium tuberculosis H37Rv
agcagugccucgg

SEQ ID NO: 3241221 - RNA, 21 nt, Mycobacterium tuberculosis H37Rv
agcagugccucggcgaugggc

SEQ ID NO: 3241222 - RNA, 13 nt, Mycobacterium tuberculosis H37Rv
agcaguuggccga

SEQ ID NO: 3241223 - RNA, 16 nt, Mycobacterium tuberculosis H37Rv
agcaguuggccgagcg

SEQ ID NO: 3241224 - RNA, 22 nt, Mycobacterium tuberculosis H37Rv
agcaguuuccguaguaccaaag

SEQ ID NO: 3241225 - RNA, 13 nt, Mycobacterium tuberculosis H37Rv
agcauaccgccgc

SEQ ID NO: 3241226 - RNA, 18 nt, Mycobacterium tuberculosis H37Rv
agcaucagcucgaugccg

SEQ ID NO: 3241227 - RNA, 17 nt, Mycobacterium tuberculosis H37Rv
agcauccgacacugcgg

SEQ ID NO: 3241228 - RNA, 17 nt, Mycobacterium tuberculosis H37Rv
agcaucuccgucggcca

SEQ ID NO: 3241229 - RNA, 20 nt, Mycobacterium tuberculosis H37Rv
agcaucuccucgccugcccg

SEQ ID NO: 3241230 - RNA, 13 nt, Mycobacterium tuberculosis H37Rv
agcaucucggcgg

SEQ ID NO: 3241231 - RNA, 16 nt, Mycobacterium tuberculosis H37Rv
agcaucucggcggcca

SEQ ID NO: 3241232 - RNA, 22 nt, Mycobacterium tuberculosis H37Rv
agcaucucggcggccaacagca

SEQ ID NO: 3241233 - RNA, 17 nt, Mycobacterium tuberculosis H37Rv
agcaucucgucggugaa

SEQ ID NO: 3241234 - RNA, 15 nt, Mycobacterium tuberculosis H37Rv
agcaucuuuggcggc

SEQ ID NO: 3241235 - RNA, 17 nt, Mycobacterium tuberculosis H37Rv
agcaucuuuggcggccg

SEQ ID NO: 3241236 - RNA, 18 nt, Mycobacterium tuberculosis H37Rv
agcaugacaccggccacc

SEQ ID NO: 3241237 - RNA, 22 nt, Mycobacterium tuberculosis H37Rv
agcaugauccgcucguggucgg

SEQ ID NO: 3241238 - RNA, 18 nt, Mycobacterium tuberculosis H37Rv
agcaugauccgcugggcc

SEQ ID NO: 3241239 - RNA, 23 nt, Mycobacterium tuberculosis H37Rv
agcaugcccucgcuguuggccgg

SEQ ID NO: 3241240 - RNA, 23 nt, Mycobacterium tuberculosis H37Rv
agcaugccuucggccaaccaugc

SEQ ID NO: 3241241 - RNA, 18 nt, Mycobacterium tuberculosis H37Rv
agcauggcccuggcgacc

SEQ ID NO: 3241242 - RNA, 15 nt, Mycobacterium tuberculosis H37Rv
agcauggcuccgaag

SEQ ID NO: 3241243 - RNA, 14 nt, Mycobacterium tuberculosis H37Rv
agcaugguccacag

SEQ ID NO: 3241244 - RNA, 17 nt, Mycobacterium tuberculosis H37Rv
agcaugguggacgaggc

SEQ ID NO: 3241245 - RNA, 19 nt, Mycobacterium tuberculosis H37Rv
agcauguggccgccgucga

SEQ ID NO: 3241246 - RNA, 21 nt, Mycobacterium tuberculosis H37Rv
agcccgagcgcuugaccccgc

SEQ ID NO: 3241247 - RNA, 19 nt, Mycobacterium tuberculosis H37Rv
agcccgagcucaccgcaca

SEQ ID NO: 3241248 - RNA, 20 nt, Mycobacterium tuberculosis H37Rv
agcccgaugccgugcccggu

SEQ ID NO: 3241249 - RNA, 21 nt, Mycobacterium tuberculosis H37Rv
agcccgauggugccgacccgc

SEQ ID NO: 3241250 - RNA, 16 nt, Mycobacterium tuberculosis H37Rv
agcccgauucagcgcc

SEQ ID NO: 3241251 - RNA, 18 nt, Mycobacterium tuberculosis H37Rv
agcccgauucagcgcccc

SEQ ID NO: 3241252 - RNA, 17 nt, Mycobacterium tuberculosis H37Rv
agcccgccacagcccca

SEQ ID NO: 3241253 - RNA, 15 nt, Mycobacterium tuberculosis H37Rv
agcccgccauccgcc

SEQ ID NO: 3241254 - RNA, 22 nt, Mycobacterium tuberculosis H37Rv
agcccgcccugaccgcccgcac

SEQ ID NO: 3241255 - RNA, 17 nt, Mycobacterium tuberculosis H37Rv
agcccgccgucggcauc

SEQ ID NO: 3241256 - RNA, 16 nt, Mycobacterium tuberculosis H37Rv
agcccgcgaucaccau

SEQ ID NO: 3241257 - RNA, 23 nt, Mycobacterium tuberculosis H37Rv
agcccgcguucaggaugccagga

SEQ ID NO: 3241258 - RNA, 16 nt, Mycobacterium tuberculosis H37Rv
agcccgcuggccuccu

SEQ ID NO: 3241259 - RNA, 15 nt, Mycobacterium tuberculosis H37Rv
agcccggagcgguca

SEQ ID NO: 3241260 - RNA, 17 nt, Mycobacterium tuberculosis H37Rv
agcccggagcggucagc

SEQ ID NO: 3241261 - RNA, 21 nt, Mycobacterium tuberculosis H37Rv
agcccggccucggcgagcacg

SEQ ID NO: 3241262 - RNA, 14 nt, Mycobacterium tuberculosis H37Rv
agcccggccuugcc

SEQ ID NO: 3241263 - RNA, 14 nt, Mycobacterium tuberculosis H37Rv
agcccggcgaucag

SEQ ID NO: 3241264 - RNA, 17 nt, Mycobacterium tuberculosis H37Rv
agcccggcgcgccgagu

SEQ ID NO: 3241265 - RNA, 15 nt, Mycobacterium tuberculosis H37Rv
agcccggcggcgaga

SEQ ID NO: 3241266 - RNA, 17 nt, Mycobacterium tuberculosis H37Rv
agcccggcguuguugac

SEQ ID NO: 3241267 - RNA, 23 nt, Mycobacterium tuberculosis H37Rv
agcccggcguuguugaccagcac

SEQ ID NO: 3241268 - RNA, 18 nt, Mycobacterium tuberculosis H37Rv
agcccgggauaccgcuca

SEQ ID NO: 3241269 - RNA, 21 nt, Mycobacterium tuberculosis H37Rv
agcccgggccugaaccacgcg

SEQ ID NO: 3241270 - RNA, 15 nt, Mycobacterium tuberculosis H37Rv
agcccggggaugccu

SEQ ID NO: 3241271 - RNA, 15 nt, Mycobacterium tuberculosis H37Rv
agcccgguacgccgc

SEQ ID NO: 3241272 - RNA, 15 nt, Mycobacterium tuberculosis H37Rv
agcccgguagccugg

SEQ ID NO: 3241273 - RNA, 18 nt, Mycobacterium tuberculosis H37Rv
agcccggucauggucagc

SEQ ID NO: 3241274 - RNA, 22 nt, Mycobacterium tuberculosis H37Rv
agcccggucccuuuguggggcc

SEQ ID NO: 3241275 - RNA, 22 nt, Mycobacterium tuberculosis H37Rv
agcccggucgcugauccgggcg

SEQ ID NO: 3241276 - RNA, 13 nt, Mycobacterium tuberculosis H37Rv
agcccggugcuac

SEQ ID NO: 3241277 - RNA, 15 nt, Mycobacterium tuberculosis H37Rv
agcccggugugcugc

SEQ ID NO: 3241278 - RNA, 16 nt, Mycobacterium tuberculosis H37Rv
agcccguagccgauca

SEQ ID NO: 3241279 - RNA, 12 nt, Mycobacterium tuberculosis H37Rv
agcccgucagcc

SEQ ID NO: 3241280 - RNA, 16 nt, Mycobacterium tuberculosis H37Rv
agcccguccucgucgg

SEQ ID NO: 3241281 - RNA, 21 nt, Mycobacterium tuberculosis H37Rv
agcccgucgaguagguaacgc

SEQ ID NO: 3241282 - RNA, 14 nt, Mycobacterium tuberculosis H37Rv
agcccgucgcggcc

SEQ ID NO: 3241283 - RNA, 15 nt, Mycobacterium tuberculosis H37Rv
agcccgucgggcagu

SEQ ID NO: 3241284 - RNA, 16 nt, Mycobacterium tuberculosis H37Rv
agcccguucgaaguuc

SEQ ID NO: 3241285 - RNA, 16 nt, Mycobacterium tuberculosis H37Rv
agcccguucgugccgu

SEQ ID NO: 3241286 - RNA, 14 nt, Mycobacterium tuberculosis H37Rv
agcccguugcagga

SEQ ID NO: 3241287 - RNA, 18 nt, Mycobacterium tuberculosis H37Rv
agcccguugguagccggu

SEQ ID NO: 3241288 - RNA, 20 nt, Mycobacterium tuberculosis H37Rv
agcccguugguagccgguga

SEQ ID NO: 3241289 - RNA, 22 nt, Mycobacterium tuberculosis H37Rv
agcccguugguagccggugacc

SEQ ID NO: 3241290 - RNA, 14 nt, Mycobacterium tuberculosis H37Rv
agcccuaucagccg

SEQ ID NO: 3241291 - RNA, 13 nt, Mycobacterium tuberculosis H37Rv
agcccuccagggc

SEQ ID NO: 3241292 - RNA, 14 nt, Mycobacterium tuberculosis H37Rv
agcccuccgagcac

SEQ ID NO: 3241293 - RNA, 15 nt, Mycobacterium tuberculosis H37Rv
agcccuccgagcaca

SEQ ID NO: 3241294 - RNA, 15 nt, Mycobacterium tuberculosis H37Rv
agcccuccucgauga

SEQ ID NO: 3241295 - RNA, 18 nt, Mycobacterium tuberculosis H37Rv
agcccucgacguccaucc

SEQ ID NO: 3241296 - RNA, 14 nt, Mycobacterium tuberculosis H37Rv
agcccuguuugacu

SEQ ID NO: 3241297 - RNA, 16 nt, Mycobacterium tuberculosis H37Rv
agcccuucgcgggaga

SEQ ID NO: 3241298 - RNA, 17 nt, Mycobacterium tuberculosis H37Rv
agccgaacaccgucagc

SEQ ID NO: 3241299 - RNA, 21 nt, Mycobacterium tuberculosis H37Rv
agccgaagaaccggucgcagu

SEQ ID NO: 3241300 - RNA, 14 nt, Mycobacterium tuberculosis H37Rv
agccgaagcgcccg

SEQ ID NO: 3241301 - RNA, 19 nt, Mycobacterium tuberculosis H37Rv
agccgacaacgacgucgcc

SEQ ID NO: 3241302 - RNA, 21 nt, Mycobacterium tuberculosis H37Rv
agccgacaacgacgucgccga

SEQ ID NO: 3241303 - RNA, 19 nt, Mycobacterium tuberculosis H37Rv
agccgacagcucaucgauc

SEQ ID NO: 3241304 - RNA, 17 nt, Mycobacterium tuberculosis H37Rv
agccgaccaccccgagc

SEQ ID NO: 3241305 - RNA, 13 nt, Mycobacterium tuberculosis H37Rv
agccgaccaccgc

SEQ ID NO: 3241306 - RNA, 14 nt, Mycobacterium tuberculosis H37Rv
agccgaccagcgcu

SEQ ID NO: 3241307 - RNA, 19 nt, Mycobacterium tuberculosis H37Rv
agccgaccaggaccaccgc

SEQ ID NO: 3241308 - RNA, 21 nt, Mycobacterium tuberculosis H37Rv
agccgaccaugguagcgcccc

SEQ ID NO: 3241309 - RNA, 13 nt, Mycobacterium tuberculosis H37Rv
agccgacccgacg

SEQ ID NO: 3241310 - RNA, 16 nt, Mycobacterium tuberculosis H37Rv
agccgacccgcccgaa

SEQ ID NO: 3241311 - RNA, 21 nt, Mycobacterium tuberculosis H37Rv
agccgacccgcccgaagaugc

SEQ ID NO: 3241312 - RNA, 14 nt, Mycobacterium tuberculosis H37Rv
agccgaccggcagc

SEQ ID NO: 3241313 - RNA, 15 nt, Mycobacterium tuberculosis H37Rv
agccgaccguaccga

SEQ ID NO: 3241314 - RNA, 16 nt, Mycobacterium tuberculosis H37Rv
agccgaccucgagugc

SEQ ID NO: 3241315 - RNA, 16 nt, Mycobacterium tuberculosis H37Rv
agccgacgaacgacgg

SEQ ID NO: 3241316 - RNA, 16 nt, Mycobacterium tuberculosis H37Rv
agccgacgauccacgg

SEQ ID NO: 3241317 - RNA, 22 nt, Mycobacterium tuberculosis H37Rv
agccgacggcggcggcgugccc

SEQ ID NO: 3241318 - RNA, 19 nt, Mycobacterium tuberculosis H37Rv
agccgacgucgccggacga

SEQ ID NO: 3241319 - RNA, 16 nt, Mycobacterium tuberculosis H37Rv
agccgacuaucggccg

SEQ ID NO: 3241320 - RNA, 24 nt, Mycobacterium tuberculosis H37Rv
agccgacuaucggccgccggauca

SEQ ID NO: 3241321 - RNA, 16 nt, Mycobacterium tuberculosis H37Rv
agccgagaagagaucc

SEQ ID NO: 3241322 - RNA, 14 nt, Mycobacterium tuberculosis H37Rv
agccgagacaccac

SEQ ID NO: 3241323 - RNA, 10 nt, Mycobacterium tuberculosis H37Rv
agccgagcac

SEQ ID NO: 3241324 - RNA, 15 nt, Mycobacterium tuberculosis H37Rv
agccgagcacgggca

SEQ ID NO: 3241325 - RNA, 13 nt, Mycobacterium tuberculosis H37Rv
agccgagcaucag

SEQ ID NO: 3241326 - RNA, 16 nt, Mycobacterium tuberculosis H37Rv
agccgagccagcagcu

SEQ ID NO: 3241327 - RNA, 18 nt, Mycobacterium tuberculosis H37Rv
agccgagccagcuccggc

SEQ ID NO: 3241328 - RNA, 19 nt, Mycobacterium tuberculosis H37Rv
agccgagcccgucgaucag

SEQ ID NO: 3241329 - RNA, 13 nt, Mycobacterium tuberculosis H37Rv
agccgagccucgc

SEQ ID NO: 3241330 - RNA, 14 nt, Mycobacterium tuberculosis H37Rv
agccgagccucgcu

SEQ ID NO: 3241331 - RNA, 15 nt, Mycobacterium tuberculosis H37Rv
agccgagcguggcgu

SEQ ID NO: 3241332 - RNA, 22 nt, Mycobacterium tuberculosis H37Rv
agccgaggacuggaaagcagca

SEQ ID NO: 3241333 - RNA, 23 nt, Mycobacterium tuberculosis H37Rv
agccgaggacuggaaagcagcag

SEQ ID NO: 3241334 - RNA, 21 nt, Mycobacterium tuberculosis H37Rv
agccgagguucaaagcagcgc

SEQ ID NO: 3241335 - RNA, 16 nt, Mycobacterium tuberculosis H37Rv
agccgauauaccaggg

SEQ ID NO: 3241336 - RNA, 22 nt, Mycobacterium tuberculosis H37Rv
agccgaucacgggcuaccggca

SEQ ID NO: 3241337 - RNA, 22 nt, Mycobacterium tuberculosis H37Rv
agccgaucaguuccuguagccg

SEQ ID NO: 3241338 - RNA, 20 nt, Mycobacterium tuberculosis H37Rv
agccgaucaucaccggcaua

SEQ ID NO: 3241339 - RNA, 15 nt, Mycobacterium tuberculosis H37Rv
agccgauccagcagg

SEQ ID NO: 3241340 - RNA, 22 nt, Mycobacterium tuberculosis H37Rv
agccgauccaggagugauucgg

SEQ ID NO: 3241341 - RNA, 16 nt, Mycobacterium tuberculosis H37Rv
agccgauccgaucgca

SEQ ID NO: 3241342 - RNA, 18 nt, Mycobacterium tuberculosis H37Rv
agccgggcggccucguug

SEQ ID NO: 3241343 - RNA, 12 nt, Mycobacterium tuberculosis H37Rv
agccggguggac

SEQ ID NO: 3241344 - RNA, 17 nt, Mycobacterium tuberculosis H37Rv
agccgggugggagcagc

SEQ ID NO: 3241345 - RNA, 23 nt, Mycobacterium tuberculosis H37Rv
agccggguugccugcgcgagugc

SEQ ID NO: 3241346 - RNA, 16 nt, Mycobacterium tuberculosis H37Rv
agccgguagccgggca

SEQ ID NO: 3241347 - RNA, 20 nt, Mycobacterium tuberculosis H37Rv
agccggucuugcaucgccga

SEQ ID NO: 3241348 - RNA, 12 nt, Mycobacterium tuberculosis H37Rv
agccggugacgg

SEQ ID NO: 3241349 - RNA, 18 nt, Mycobacterium tuberculosis H37Rv
agccggugccgacggcgc

SEQ ID NO: 3241350 - RNA, 19 nt, Mycobacterium tuberculosis H37Rv
agccggugcgcgcggucga

SEQ ID NO: 3241351 - RNA, 19 nt, Mycobacterium tuberculosis H37Rv
agccgguggcccgccggca

SEQ ID NO: 3241352 - RNA, 13 nt, Mycobacterium tuberculosis H37Rv
agccgguguugau

SEQ ID NO: 3241353 - RNA, 21 nt, Mycobacterium tuberculosis H37Rv
agccgguguugauguugccgg

SEQ ID NO: 3241354 - RNA, 16 nt, Mycobacterium tuberculosis H37Rv
agccguaaaugguggc

SEQ ID NO: 3241355 - RNA, 16 nt, Mycobacterium tuberculosis H37Rv
agccguacgguccgaa

SEQ ID NO: 3241356 - RNA, 13 nt, Mycobacterium tuberculosis H37Rv
agccguagccgcc

SEQ ID NO: 3241357 - RNA, 20 nt, Mycobacterium tuberculosis H37Rv
agccguagcugggcaccccg

SEQ ID NO: 3241358 - RNA, 19 nt, Mycobacterium tuberculosis H37Rv
agccguaguaguggccgcc

SEQ ID NO: 3241359 - RNA, 21 nt, Mycobacterium tuberculosis H37Rv
agccgucaccgcgaccccugg

SEQ ID NO: 3241360 - RNA, 18 nt, Mycobacterium tuberculosis H37Rv
agccguccgggcggccuc

SEQ ID NO: 3241361 - RNA, 14 nt, Mycobacterium tuberculosis H37Rv
agccgucgaucccg

SEQ ID NO: 3241362 - RNA, 14 nt, Mycobacterium tuberculosis H37Rv
agccgucgauguug

SEQ ID NO: 3241363 - RNA, 16 nt, Mycobacterium tuberculosis H37Rv
agccgucgcgacgucg

SEQ ID NO: 3241364 - RNA, 17 nt, Mycobacterium tuberculosis H37Rv
agccgucgcgacgucgg

SEQ ID NO: 3241365 - RNA, 18 nt, Mycobacterium tuberculosis H37Rv
agccgucgcgacgucggc

SEQ ID NO: 3241366 - RNA, 21 nt, Mycobacterium tuberculosis H37Rv
agccgucgcgacgucggccgu

SEQ ID NO: 3241367 - RNA, 23 nt, Mycobacterium tuberculosis H37Rv
agccgucguccgcugacccgcca

SEQ ID NO: 3241368 - RNA, 12 nt, Mycobacterium tuberculosis H37Rv
agccgucgucga

SEQ ID NO: 3241369 - RNA, 15 nt, Mycobacterium tuberculosis H37Rv
agccgucgucgagcc

SEQ ID NO: 3241370 - RNA, 18 nt, Mycobacterium tuberculosis H37Rv
agccgucucugacgaaug

SEQ ID NO: 3241371 - RNA, 23 nt, Mycobacterium tuberculosis H37Rv
agccgugauauccguacagucca

SEQ ID NO: 3241372 - RNA, 16 nt, Mycobacterium tuberculosis H37Rv
agccgugcaccucgug

SEQ ID NO: 3241373 - RNA, 18 nt, Mycobacterium tuberculosis H37Rv
agccgugcagcucgguca

SEQ ID NO: 3241374 - RNA, 18 nt, Mycobacterium tuberculosis H37Rv
agccgugcccaggccacc

SEQ ID NO: 3241375 - RNA, 12 nt, Mycobacterium tuberculosis H37Rv
agccgugccucg

SEQ ID NO: 3241376 - RNA, 16 nt, Mycobacterium tuberculosis H37Rv
agccgugcggcggcug

SEQ ID NO: 3241377 - RNA, 18 nt, Mycobacterium tuberculosis H37Rv
agccgugcgggccggucg

SEQ ID NO: 3241378 - RNA, 14 nt, Mycobacterium tuberculosis H37Rv
agccgugcggucgc

SEQ ID NO: 3241379 - RNA, 19 nt, Mycobacterium tuberculosis H37Rv
agccgugcggucgcgcccu

SEQ ID NO: 3241380 - RNA, 18 nt, Mycobacterium tuberculosis H37Rv
agccguggcagucgcacg

SEQ ID NO: 3241381 - RNA, 20 nt, Mycobacterium tuberculosis H37Rv
agccguggcagucgcacggu

SEQ ID NO: 3241382 - RNA, 17 nt, Mycobacterium tuberculosis H37Rv
agccgugggccacgaug

SEQ ID NO: 3241383 - RNA, 12 nt, Mycobacterium tuberculosis H37Rv
agccgugguggu

SEQ ID NO: 3241384 - RNA, 22 nt, Mycobacterium tuberculosis H37Rv
agccguggugguugaucagcca

SEQ ID NO: 3241385 - RNA, 19 nt, Mycobacterium tuberculosis H37Rv
agccgugucaaccggucgg

SEQ ID NO: 3241386 - RNA, 22 nt, Mycobacterium tuberculosis H37Rv
agccguucucgcccacccgcug

SEQ ID NO: 3241387 - RNA, 14 nt, Mycobacterium tuberculosis H37Rv
agccguugccgccg

SEQ ID NO: 3241388 - RNA, 13 nt, Mycobacterium tuberculosis H37Rv
agccguuguacau

SEQ ID NO: 3241389 - RNA, 13 nt, Mycobacterium tuberculosis H37Rv
agccguuguccaa

SEQ ID NO: 3241390 - RNA, 18 nt, Mycobacterium tuberculosis H37Rv
agccguuguccaagcccu

SEQ ID NO: 3241391 - RNA, 21 nt, Mycobacterium tuberculosis H37Rv
agccguuguccaagcccucgg

SEQ ID NO: 3241392 - RNA, 15 nt, Mycobacterium tuberculosis H37Rv
agccguuugcgcugg

SEQ ID NO: 3241393 - RNA, 21 nt, Mycobacterium tuberculosis H37Rv
agccuaccggcuacggcgaca

SEQ ID NO: 3241394 - RNA, 22 nt, Mycobacterium tuberculosis H37Rv
agccuaguacgccgagcagacg

SEQ ID NO: 3241395 - RNA, 15 nt, Mycobacterium tuberculosis H37Rv
agccucgcgggcagg

SEQ ID NO: 3241396 - RNA, 20 nt, Mycobacterium tuberculosis H37Rv
agccucgcgggcagggccuc

SEQ ID NO: 3241397 - RNA, 17 nt, Mycobacterium tuberculosis H37Rv
agccucggcaugcagcc

SEQ ID NO: 3241398 - RNA, 18 nt, Mycobacterium tuberculosis H37Rv
agccucggcaugcagccc

SEQ ID NO: 3241399 - RNA, 21 nt, Mycobacterium tuberculosis H37Rv
agccucggcaugcagccccac

SEQ ID NO: 3241400 - RNA, 22 nt, Mycobacterium tuberculosis H37Rv
agccucggccaucugcucgugg

SEQ ID NO: 3241401 - RNA, 22 nt, Mycobacterium tuberculosis H37Rv
agccucguagaacgcuagcgcc

SEQ ID NO: 3241402 - RNA, 21 nt, Mycobacterium tuberculosis H37Rv
agccucguucauguccaccgc

SEQ ID NO: 3241403 - RNA, 14 nt, Mycobacterium tuberculosis H37Rv
agccucucuuccca

SEQ ID NO: 3241404 - RNA, 23 nt, Mycobacterium tuberculosis H37Rv
agccucucuucccaaccgcccgu

SEQ ID NO: 3241405 - RNA, 20 nt, Mycobacterium tuberculosis H37Rv
agccugccgaugacgauggc

SEQ ID NO: 3241406 - RNA, 23 nt, Mycobacterium tuberculosis H37Rv
agccugccgaugacgauggccgc

SEQ ID NO: 3241407 - RNA, 16 nt, Mycobacterium tuberculosis H37Rv
agccugcggcggcguu

SEQ ID NO: 3241408 - RNA, 19 nt, Mycobacterium tuberculosis H37Rv
agccugcggcggucauggg

SEQ ID NO: 3241409 - RNA, 21 nt, Mycobacterium tuberculosis H37Rv
agccugcggcggucaugggcg

SEQ ID NO: 3241410 - RNA, 22 nt, Mycobacterium tuberculosis H37Rv
agccugcuucugggcuuucugc

SEQ ID NO: 3241411 - RNA, 12 nt, Mycobacterium tuberculosis H37Rv
agccugugcugc

SEQ ID NO: 3241412 - RNA, 23 nt, Mycobacterium tuberculosis H37Rv
agccuuacgcgggugaccaacac

SEQ ID NO: 3241413 - RNA, 19 nt, Mycobacterium tuberculosis H37Rv
agccuucaacgcgaguccg

SEQ ID NO: 3241414 - RNA, 15 nt, Mycobacterium tuberculosis H37Rv
agccuugcagcgccc

SEQ ID NO: 3241415 - RNA, 16 nt, Mycobacterium tuberculosis H37Rv
agccuuguugccgccg

SEQ ID NO: 3241416 - RNA, 16 nt, Mycobacterium tuberculosis H37Rv
agccuuucgugcaccg

SEQ ID NO: 3241417 - RNA, 22 nt, Mycobacterium tuberculosis H37Rv
agcgaaaacccggucggcgaaa

SEQ ID NO: 3241418 - RNA, 14 nt, Mycobacterium tuberculosis H37Rv
agcgaaagugugga

SEQ ID NO: 3241419 - RNA, 20 nt, Mycobacterium tuberculosis H37Rv
agcgaaaugcccaucaccag

SEQ ID NO: 3241420 - RNA, 14 nt, Mycobacterium tuberculosis H37Rv
agcgaacacccggu

SEQ ID NO: 3241421 - RNA, 17 nt, Mycobacterium tuberculosis H37Rv
agcgaaccaccggcgcc

SEQ ID NO: 3241422 - RNA, 17 nt, Mycobacterium tuberculosis H37Rv
agcgaacccgcguugaa

SEQ ID NO: 3241423 - RNA, 23 nt, Mycobacterium tuberculosis H37Rv
agcgaacccgcguugaaggcgcc

SEQ ID NO: 3241424 - RNA, 20 nt, Mycobacterium tuberculosis H37Rv
agcgaaccgccggcaccgcc

SEQ ID NO: 3241425 - RNA, 17 nt, Mycobacterium tuberculosis H37Rv
agcgaacggccaggaca

SEQ ID NO: 3241426 - RNA, 15 nt, Mycobacterium tuberculosis H37Rv
agcgaacggcgcagu

SEQ ID NO: 3241427 - RNA, 21 nt, Mycobacterium tuberculosis H37Rv
agcgaacgggcuuccgacaug

SEQ ID NO: 3241428 - RNA, 21 nt, Mycobacterium tuberculosis H37Rv
agcgaagccagaucgcuagga

SEQ ID NO: 3241429 - RNA, 15 nt, Mycobacterium tuberculosis H37Rv
agcgaaggugaacga

SEQ ID NO: 3241430 - RNA, 17 nt, Mycobacterium tuberculosis H37Rv
agcgaauccaggccgua

SEQ ID NO: 3241431 - RNA, 22 nt, Mycobacterium tuberculosis H37Rv
agcgaaugucugcgcagguggu

SEQ ID NO: 3241432 - RNA, 23 nt, Mycobacterium tuberculosis H37Rv
agcgacacguuggcggaugcccg

SEQ ID NO: 3241433 - RNA, 16 nt, Mycobacterium tuberculosis H37Rv
agcgacagcagcgcca

SEQ ID NO: 3241434 - RNA, 17 nt, Mycobacterium tuberculosis H37Rv
agcgacagcagcgccac

SEQ ID NO: 3241435 - RNA, 16 nt, Mycobacterium tuberculosis H37Rv
agcgacaugcccgcca

SEQ ID NO: 3241436 - RNA, 20 nt, Mycobacterium tuberculosis H37Rv
agcgaccacgucaagaagaa

SEQ ID NO: 3241437 - RNA, 22 nt, Mycobacterium tuberculosis H37Rv
agcgaccgucccagcgccgcag

SEQ ID NO: 3241438 - RNA, 17 nt, Mycobacterium tuberculosis H37Rv
agcgcauguugcaggcg

SEQ ID NO: 3241439 - RNA, 21 nt, Mycobacterium tuberculosis H37Rv
agcgcauuuguugcugcugcc

SEQ ID NO: 3241440 - RNA, 13 nt, Mycobacterium tuberculosis H37Rv
agcgccaacccgg

SEQ ID NO: 3241441 - RNA, 15 nt, Mycobacterium tuberculosis H37Rv
agcgccaacucgaga

SEQ ID NO: 3241442 - RNA, 15 nt, Mycobacterium tuberculosis H37Rv
agcgccaagacgucg

SEQ ID NO: 3241443 - RNA, 19 nt, Mycobacterium tuberculosis H37Rv
agcgccaagccgugccgca

SEQ ID NO: 3241444 - RNA, 18 nt, Mycobacterium tuberculosis H37Rv
agcgccacccgguccggc

SEQ ID NO: 3241445 - RNA, 17 nt, Mycobacterium tuberculosis H37Rv
agcgccaccguuugcgc

SEQ ID NO: 3241446 - RNA, 15 nt, Mycobacterium tuberculosis H37Rv
agcgccacgccgagg

SEQ ID NO: 3241447 - RNA, 17 nt, Mycobacterium tuberculosis H37Rv
agcgccacgccgaggcg

SEQ ID NO: 3241448 - RNA, 13 nt, Mycobacterium tuberculosis H37Rv
agcgccagcagcu

SEQ ID NO: 3241449 - RNA, 20 nt, Mycobacterium tuberculosis H37Rv
agcgccagccgcugccacag

SEQ ID NO: 3241450 - RNA, 21 nt, Mycobacterium tuberculosis H37Rv
agcgccagccgcugccacagg

SEQ ID NO: 3241451 - RNA, 13 nt, Mycobacterium tuberculosis H37Rv
agcgccagccggu

SEQ ID NO: 3241452 - RNA, 22 nt, Mycobacterium tuberculosis H37Rv
agcgccagcgagcauaccgccg

SEQ ID NO: 3241453 - RNA, 15 nt, Mycobacterium tuberculosis H37Rv
agcgccagcgccagu

SEQ ID NO: 3241454 - RNA, 13 nt, Mycobacterium tuberculosis H37Rv
agcgccaggccgc

SEQ ID NO: 3241455 - RNA, 18 nt, Mycobacterium tuberculosis H37Rv
agcgccaggccgcacagc

SEQ ID NO: 3241456 - RNA, 19 nt, Mycobacterium tuberculosis H37Rv
agcgccaggccgcacagca

SEQ ID NO: 3241457 - RNA, 22 nt, Mycobacterium tuberculosis H37Rv
agcgccaggggugugccguggu

SEQ ID NO: 3241458 - RNA, 17 nt, Mycobacterium tuberculosis H37Rv
agcgccagugccucgcg

SEQ ID NO: 3241459 - RNA, 24 nt, Mycobacterium tuberculosis H37Rv
agcgccagugccucgcggggucug

SEQ ID NO: 3241460 - RNA, 22 nt, Mycobacterium tuberculosis H37Rv
agcgccaugcccucggcgccga

SEQ ID NO: 3241461 - RNA, 17 nt, Mycobacterium tuberculosis H37Rv
agcgccauuccaagacg

SEQ ID NO: 3241462 - RNA, 17 nt, Mycobacterium tuberculosis H37Rv
agcgcccaccguagacg

SEQ ID NO: 3241463 - RNA, 16 nt, Mycobacterium tuberculosis H37Rv
agcgcccccagcagcu

SEQ ID NO: 3241464 - RNA, 17 nt, Mycobacterium tuberculosis H37Rv
agcgcccccagcagcug

SEQ ID NO: 3241465 - RNA, 13 nt, Mycobacterium tuberculosis H37Rv
agcgcccccgcug

SEQ ID NO: 3241466 - RNA, 21 nt, Mycobacterium tuberculosis H37Rv
agcgcccccggacugcggaac

SEQ ID NO: 3241467 - RNA, 15 nt, Mycobacterium tuberculosis H37Rv
agcgccccggcgcgu

SEQ ID NO: 3241468 - RNA, 16 nt, Mycobacterium tuberculosis H37Rv
agcgcccgaaccccgg

SEQ ID NO: 3241469 - RNA, 17 nt, Mycobacterium tuberculosis H37Rv
agcgcccgcgagagagu

SEQ ID NO: 3241470 - RNA, 15 nt, Mycobacterium tuberculosis H37Rv
agcgcccgcgcggcc

SEQ ID NO: 3241471 - RNA, 20 nt, Mycobacterium tuberculosis H37Rv
agcgcccggauguccgccga

SEQ ID NO: 3241472 - RNA, 23 nt, Mycobacterium tuberculosis H37Rv
agcgcccggauguccgccgacgu

SEQ ID NO: 3241473 - RNA, 19 nt, Mycobacterium tuberculosis H37Rv
agcgcccggccacuccagu

SEQ ID NO: 3241474 - RNA, 20 nt, Mycobacterium tuberculosis H37Rv
agcgcccggccacuccagua

SEQ ID NO: 3241475 - RNA, 16 nt, Mycobacterium tuberculosis H37Rv
agcgcccggcugaucu

SEQ ID NO: 3241476 - RNA, 15 nt, Mycobacterium tuberculosis H37Rv
agcgcccggucacgc

SEQ ID NO: 3241477 - RNA, 13 nt, Mycobacterium tuberculosis H37Rv
agcgcccuccucg

SEQ ID NO: 3241478 - RNA, 14 nt, Mycobacterium tuberculosis H37Rv
agcgcccuccucga

SEQ ID NO: 3241479 - RNA, 19 nt, Mycobacterium tuberculosis H37Rv
agcgcccuuggacgcgaug

SEQ ID NO: 3241480 - RNA, 16 nt, Mycobacterium tuberculosis H37Rv
agcgccgaaacagcac

SEQ ID NO: 3241481 - RNA, 18 nt, Mycobacterium tuberculosis H37Rv
agcgccgaaacagcaccc

SEQ ID NO: 3241482 - RNA, 17 nt, Mycobacterium tuberculosis H37Rv
agcgccgaauucauccg

SEQ ID NO: 3241483 - RNA, 17 nt, Mycobacterium tuberculosis H37Rv
agcgccgacagccgauc

SEQ ID NO: 3241484 - RNA, 17 nt, Mycobacterium tuberculosis H37Rv
agcgccgagagcaccgc

SEQ ID NO: 3241485 - RNA, 17 nt, Mycobacterium tuberculosis H37Rv
agcgccgauaccagcca

SEQ ID NO: 3241486 - RNA, 22 nt, Mycobacterium tuberculosis H37Rv
agcgccgauguggccggcgaug

SEQ ID NO: 3241487 - RNA, 13 nt, Mycobacterium tuberculosis H37Rv
agcgccgcacaga

SEQ ID NO: 3241488 - RNA, 18 nt, Mycobacterium tuberculosis H37Rv
agcgccgcacagaaaacg

SEQ ID NO: 3241489 - RNA, 13 nt, Mycobacterium tuberculosis H37Rv
agcgccgcagggu

SEQ ID NO: 3241490 - RNA, 17 nt, Mycobacterium tuberculosis H37Rv
agcgccgcagugacggg

SEQ ID NO: 3241491 - RNA, 11 nt, Mycobacterium tuberculosis H37Rv
agcgccgccga

SEQ ID NO: 3241492 - RNA, 11 nt, Mycobacterium tuberculosis H37Rv
agcgccgccgc

SEQ ID NO: 3241493 - RNA, 20 nt, Mycobacterium tuberculosis H37Rv
agcgccgccgcgagcgccgg

SEQ ID NO: 3241494 - RNA, 13 nt, Mycobacterium tuberculosis H37Rv
agcgccgccggca

SEQ ID NO: 3241495 - RNA, 16 nt, Mycobacterium tuberculosis H37Rv
agcgccgccggcaccu

SEQ ID NO: 3241496 - RNA, 13 nt, Mycobacterium tuberculosis H37Rv
agcgccgcgccca

SEQ ID NO: 3241497 - RNA, 13 nt, Mycobacterium tuberculosis H37Rv
agcgccgcggcga

SEQ ID NO: 3241498 - RNA, 20 nt, Mycobacterium tuberculosis H37Rv
agcgccgcguggcuggcggc

SEQ ID NO: 3241499 - RNA, 19 nt, Mycobacterium tuberculosis H37Rv
agcgccgcugaagccagga

SEQ ID NO: 3241500 - RNA, 16 nt, Mycobacterium tuberculosis H37Rv
agcgccgcuuggcgau

SEQ ID NO: 3241501 - RNA, 19 nt, Mycobacterium tuberculosis H37Rv
agcgccgcuuggcgauccg

SEQ ID NO: 3241502 - RNA, 22 nt, Mycobacterium tuberculosis H37Rv
agcgccggauggguggccagca

SEQ ID NO: 3241503 - RNA, 14 nt, Mycobacterium tuberculosis H37Rv
agcgccggcaccga

SEQ ID NO: 3241504 - RNA, 16 nt, Mycobacterium tuberculosis H37Rv
agcgccggcaccgaca

SEQ ID NO: 3241505 - RNA, 14 nt, Mycobacterium tuberculosis H37Rv
agcgccggcaucgc

SEQ ID NO: 3241506 - RNA, 14 nt, Mycobacterium tuberculosis H37Rv
agcgccggccaggc

SEQ ID NO: 3241507 - RNA, 19 nt, Mycobacterium tuberculosis H37Rv
agcgccggccgcggcggcc

SEQ ID NO: 3241508 - RNA, 20 nt, Mycobacterium tuberculosis H37Rv
agcgccggccgcggcggccc

SEQ ID NO: 3241509 - RNA, 21 nt, Mycobacterium tuberculosis H37Rv
agcgccggcgggcucgguccc

SEQ ID NO: 3241510 - RNA, 22 nt, Mycobacterium tuberculosis H37Rv
agcgccguacagcggcggcguc

SEQ ID NO: 3241511 - RNA, 18 nt, Mycobacterium tuberculosis H37Rv
agcgccgucaucgcagca

SEQ ID NO: 3241512 - RNA, 16 nt, Mycobacterium tuberculosis H37Rv
agcgccguggcgcggu

SEQ ID NO: 3241513 - RNA, 15 nt, Mycobacterium tuberculosis H37Rv
agcgccuccagcacc

SEQ ID NO: 3241514 - RNA, 16 nt, Mycobacterium tuberculosis H37Rv
agcgccuccagcacca

SEQ ID NO: 3241515 - RNA, 19 nt, Mycobacterium tuberculosis H37Rv
agcgccuccagcaccacgg

SEQ ID NO: 3241516 - RNA, 21 nt, Mycobacterium tuberculosis H37Rv
agcgccuccagcaccacggcg

SEQ ID NO: 3241517 - RNA, 14 nt, Mycobacterium tuberculosis H37Rv
agcgccucgaccug

SEQ ID NO: 3241518 - RNA, 18 nt, Mycobacterium tuberculosis H37Rv
agcgccucgccggccacc

SEQ ID NO: 3241519 - RNA, 19 nt, Mycobacterium tuberculosis H37Rv
agcgccucgccggccaccc

SEQ ID NO: 3241520 - RNA, 21 nt, Mycobacterium tuberculosis H37Rv
agcgccucgccggccacccgc

SEQ ID NO: 3241521 - RNA, 17 nt, Mycobacterium tuberculosis H37Rv
agcgccugagcggccuc

SEQ ID NO: 3241522 - RNA, 13 nt, Mycobacterium tuberculosis H37Rv
agcgccugguccu

SEQ ID NO: 3241523 - RNA, 17 nt, Mycobacterium tuberculosis H37Rv
agcgccuugaccagcag

SEQ ID NO: 3241524 - RNA, 17 nt, Mycobacterium tuberculosis H37Rv
agcgccuugacgccagu

SEQ ID NO: 3241525 - RNA, 22 nt, Mycobacterium tuberculosis H37Rv
agcgccuugcgggccuggugga

SEQ ID NO: 3241526 - RNA, 19 nt, Mycobacterium tuberculosis H37Rv
agcgccuugucgaucucgu

SEQ ID NO: 3241527 - RNA, 13 nt, Mycobacterium tuberculosis H37Rv
agcgcgacaaagu

SEQ ID NO: 3241528 - RNA, 22 nt, Mycobacterium tuberculosis H37Rv
agcgcgacccguagcuuggcga

SEQ ID NO: 3241529 - RNA, 17 nt, Mycobacterium tuberculosis H37Rv
agcgcgaccgucagggu

SEQ ID NO: 3241530 - RNA, 18 nt, Mycobacterium tuberculosis H37Rv
agcgcgaccgucaggguc

SEQ ID NO: 3241531 - RNA, 18 nt, Mycobacterium tuberculosis H37Rv
agcgcgacguccaccagc

SEQ ID NO: 3241532 - RNA, 12 nt, Mycobacterium tuberculosis H37Rv
agcgcgagcaga

SEQ ID NO: 3241533 - RNA, 14 nt, Mycobacterium tuberculosis H37Rv
agcgcgagcagacg

SEQ ID NO: 3241534 - RNA, 21 nt, Mycobacterium tuberculosis H37Rv
agcgcgagcccgaaccaccgc

SEQ ID NO: 3241535 - RNA, 19 nt, Mycobacterium tuberculosis H37Rv
agcgggggagcgaacggcg

SEQ ID NO: 3241536 - RNA, 18 nt, Mycobacterium tuberculosis H37Rv
agcgggggcagcgcgaac

SEQ ID NO: 3241537 - RNA, 14 nt, Mycobacterium tuberculosis H37Rv
agcggggucuugac

SEQ ID NO: 3241538 - RNA, 16 nt, Mycobacterium tuberculosis H37Rv
agcggggucuugacgg

SEQ ID NO: 3241539 - RNA, 17 nt, Mycobacterium tuberculosis H37Rv
agcggguccccggucag

SEQ ID NO: 3241540 - RNA, 13 nt, Mycobacterium tuberculosis H37Rv
agcggguccguca

SEQ ID NO: 3241541 - RNA, 17 nt, Mycobacterium tuberculosis H37Rv
agcggguccgucagcac

SEQ ID NO: 3241542 - RNA, 20 nt, Mycobacterium tuberculosis H37Rv
agcggguccuucugccggga

SEQ ID NO: 3241543 - RNA, 16 nt, Mycobacterium tuberculosis H37Rv
agcgggucgccgggcc

SEQ ID NO: 3241544 - RNA, 21 nt, Mycobacterium tuberculosis H37Rv
agcgggucgcgggugccgaag

SEQ ID NO: 3241545 - RNA, 20 nt, Mycobacterium tuberculosis H37Rv
agcgggugaaucgacaccgc

SEQ ID NO: 3241546 - RNA, 23 nt, Mycobacterium tuberculosis H37Rv
agcgggugccagcccguugcagg

SEQ ID NO: 3241547 - RNA, 23 nt, Mycobacterium tuberculosis H37Rv
agcgggugcgggcgugguaacca

SEQ ID NO: 3241548 - RNA, 16 nt, Mycobacterium tuberculosis H37Rv
agcggguggccaucac

SEQ ID NO: 3241549 - RNA, 19 nt, Mycobacterium tuberculosis H37Rv
agcggguggccaucaccgc

SEQ ID NO: 3241550 - RNA, 19 nt, Mycobacterium tuberculosis H37Rv
agcggguucaacgcgcgca

SEQ ID NO: 3241551 - RNA, 21 nt, Mycobacterium tuberculosis H37Rv
agcggguucgacguugaucgc

SEQ ID NO: 3241552 - RNA, 17 nt, Mycobacterium tuberculosis H37Rv
agcggguugcggucacc

SEQ ID NO: 3241553 - RNA, 20 nt, Mycobacterium tuberculosis H37Rv
agcggguuguggcacccggc

SEQ ID NO: 3241554 - RNA, 17 nt, Mycobacterium tuberculosis H37Rv
agcggguuugccgggcg

SEQ ID NO: 3241555 - RNA, 15 nt, Mycobacterium tuberculosis H37Rv
agcgguacggacagc

SEQ ID NO: 3241556 - RNA, 18 nt, Mycobacterium tuberculosis H37Rv
agcgguacguaaucgagc

SEQ ID NO: 3241557 - RNA, 18 nt, Mycobacterium tuberculosis H37Rv
agcgguagcucauugccg

SEQ ID NO: 3241558 - RNA, 23 nt, Mycobacterium tuberculosis H37Rv
agcgguaucccccagccgcggcg

SEQ ID NO: 3241559 - RNA, 16 nt, Mycobacterium tuberculosis H37Rv
agcggucagccggcca

SEQ ID NO: 3241560 - RNA, 14 nt, Mycobacterium tuberculosis H37Rv
agcgguccagccac

SEQ ID NO: 3241561 - RNA, 20 nt, Mycobacterium tuberculosis H37Rv
agcgguccagccaccgccgc

SEQ ID NO: 3241562 - RNA, 18 nt, Mycobacterium tuberculosis H37Rv
agcgguccggauugaagu

SEQ ID NO: 3241563 - RNA, 20 nt, Mycobacterium tuberculosis H37Rv
agcgguccggauugaagucg

SEQ ID NO: 3241564 - RNA, 17 nt, Mycobacterium tuberculosis H37Rv
agcggugaauucggcga

SEQ ID NO: 3241565 - RNA, 13 nt, Mycobacterium tuberculosis H37Rv
agcggugacccac

SEQ ID NO: 3241566 - RNA, 17 nt, Mycobacterium tuberculosis H37Rv
agcggugaggugaccaa

SEQ ID NO: 3241567 - RNA, 15 nt, Mycobacterium tuberculosis H37Rv
agcggugaugggggu

SEQ ID NO: 3241568 - RNA, 18 nt, Mycobacterium tuberculosis H37Rv
agcggugcagcccgccgg

SEQ ID NO: 3241569 - RNA, 17 nt, Mycobacterium tuberculosis H37Rv
agcggugccauuguaaa

SEQ ID NO: 3241570 - RNA, 12 nt, Mycobacterium tuberculosis H37Rv
agcgguggacga

SEQ ID NO: 3241571 - RNA, 16 nt, Mycobacterium tuberculosis H37Rv
agcgguggcaagccua

SEQ ID NO: 3241572 - RNA, 19 nt, Mycobacterium tuberculosis H37Rv
agcgguggcccgccggcaa

SEQ ID NO: 3241573 - RNA, 16 nt, Mycobacterium tuberculosis H37Rv
agcgguggucggcgcg

SEQ ID NO: 3241574 - RNA, 15 nt, Mycobacterium tuberculosis H37Rv
agcggugugggauga

SEQ ID NO: 3241575 - RNA, 17 nt, Mycobacterium tuberculosis H37Rv
agcgguguugccggaga

SEQ ID NO: 3241576 - RNA, 19 nt, Mycobacterium tuberculosis H37Rv
agcgguguugccggagacg

SEQ ID NO: 3241577 - RNA, 20 nt, Mycobacterium tuberculosis H37Rv
agcgguuagaucacccgcag

SEQ ID NO: 3241578 - RNA, 19 nt, Mycobacterium tuberculosis H37Rv
agcgguugacccacagcau

SEQ ID NO: 3241579 - RNA, 16 nt, Mycobacterium tuberculosis H37Rv
agcgguugccuucuug

SEQ ID NO: 3241580 - RNA, 23 nt, Mycobacterium tuberculosis H37Rv
agcgguuucgaauguuucggcga

SEQ ID NO: 3241581 - RNA, 19 nt, Mycobacterium tuberculosis H37Rv
agcguaaugcugcugcagc

SEQ ID NO: 3241582 - RNA, 20 nt, Mycobacterium tuberculosis H37Rv
agcguaaugcugcugcagca

SEQ ID NO: 3241583 - RNA, 16 nt, Mycobacterium tuberculosis H37Rv
agcguagcccgaguug

SEQ ID NO: 3241584 - RNA, 15 nt, Mycobacterium tuberculosis H37Rv
agcguaugcacauga

SEQ ID NO: 3241585 - RNA, 19 nt, Mycobacterium tuberculosis H37Rv
agcgucaccucaccgaacg

SEQ ID NO: 3241586 - RNA, 20 nt, Mycobacterium tuberculosis H37Rv
agcgucaggccuccaaaauc

SEQ ID NO: 3241587 - RNA, 13 nt, Mycobacterium tuberculosis H37Rv
agcguccaaccca

SEQ ID NO: 3241588 - RNA, 12 nt, Mycobacterium tuberculosis H37Rv
agcguccacaug

SEQ ID NO: 3241589 - RNA, 13 nt, Mycobacterium tuberculosis H37Rv
agcguccaggagg

SEQ ID NO: 3241590 - RNA, 17 nt, Mycobacterium tuberculosis H37Rv
agcguccccaugcagcg

SEQ ID NO: 3241591 - RNA, 17 nt, Mycobacterium tuberculosis H37Rv
agcguccgaaccaccug

SEQ ID NO: 3241592 - RNA, 22 nt, Mycobacterium tuberculosis H37Rv
agcguccgcgcccgagccggua

SEQ ID NO: 3241593 - RNA, 21 nt, Mycobacterium tuberculosis H37Rv
agcguccgcggaugcauguca

SEQ ID NO: 3241594 - RNA, 21 nt, Mycobacterium tuberculosis H37Rv
agcguccgcugcagguccagg

SEQ ID NO: 3241595 - RNA, 12 nt, Mycobacterium tuberculosis H37Rv
agcguccgucgu

SEQ ID NO: 3241596 - RNA, 13 nt, Mycobacterium tuberculosis H37Rv
agcguccuggcgu

SEQ ID NO: 3241597 - RNA, 13 nt, Mycobacterium tuberculosis H37Rv
agcgucgaucacg

SEQ ID NO: 3241598 - RNA, 19 nt, Mycobacterium tuberculosis H37Rv
agcgucgcacccagggcgu

SEQ ID NO: 3241599 - RNA, 15 nt, Mycobacterium tuberculosis H37Rv
agcgucgcggccacg

SEQ ID NO: 3241600 - RNA, 17 nt, Mycobacterium tuberculosis H37Rv
agcgucgcugaccgcgu

SEQ ID NO: 3241601 - RNA, 23 nt, Mycobacterium tuberculosis H37Rv
agcgucgggcacaucgcacgguc

SEQ ID NO: 3241602 - RNA, 15 nt, Mycobacterium tuberculosis H37Rv
agcgucgguggcagc

SEQ ID NO: 3241603 - RNA, 14 nt, Mycobacterium tuberculosis H37Rv
agcgucgucgccgg

SEQ ID NO: 3241604 - RNA, 13 nt, Mycobacterium tuberculosis H37Rv
agcgucguugcuc

SEQ ID NO: 3241605 - RNA, 15 nt, Mycobacterium tuberculosis H37Rv
agcgucguugcucgg

SEQ ID NO: 3241606 - RNA, 19 nt, Mycobacterium tuberculosis H37Rv
agcgucucgccgggaaaca

SEQ ID NO: 3241607 - RNA, 18 nt, Mycobacterium tuberculosis H37Rv
agcgucugagcgccggca

SEQ ID NO: 3241608 - RNA, 21 nt, Mycobacterium tuberculosis H37Rv
agcgucuggcgacaucucggu

SEQ ID NO: 3241609 - RNA, 18 nt, Mycobacterium tuberculosis H37Rv
agcgugacccgccggcga

SEQ ID NO: 3241610 - RNA, 18 nt, Mycobacterium tuberculosis H37Rv
agcgugagccaugccgcu

SEQ ID NO: 3241611 - RNA, 23 nt, Mycobacterium tuberculosis H37Rv
agcgugagccaugccgcucggca

SEQ ID NO: 3241612 - RNA, 14 nt, Mycobacterium tuberculosis H37Rv
agcgugagugcagc

SEQ ID NO: 3241613 - RNA, 17 nt, Mycobacterium tuberculosis H37Rv
agcgugagugcagcacg

SEQ ID NO: 3241614 - RNA, 14 nt, Mycobacterium tuberculosis H37Rv
agcgugaucugcag

SEQ ID NO: 3241615 - RNA, 20 nt, Mycobacterium tuberculosis H37Rv
agcgugcaaucacugcgaaa

SEQ ID NO: 3241616 - RNA, 14 nt, Mycobacterium tuberculosis H37Rv
agcgugcagcggcg

SEQ ID NO: 3241617 - RNA, 15 nt, Mycobacterium tuberculosis H37Rv
agcgugcauggcggu

SEQ ID NO: 3241618 - RNA, 13 nt, Mycobacterium tuberculosis H37Rv
agcgugcccgcca

SEQ ID NO: 3241619 - RNA, 22 nt, Mycobacterium tuberculosis H37Rv
agcgugcccgccaccggcgcga

SEQ ID NO: 3241620 - RNA, 19 nt, Mycobacterium tuberculosis H37Rv
agcgugccgaacagggagg

SEQ ID NO: 3241621 - RNA, 22 nt, Mycobacterium tuberculosis H37Rv
agcgugccgguggcgccgccgc

SEQ ID NO: 3241622 - RNA, 15 nt, Mycobacterium tuberculosis H37Rv
agcgugccugcaguu

SEQ ID NO: 3241623 - RNA, 22 nt, Mycobacterium tuberculosis H37Rv
agcgugccugcaguucggcgua

SEQ ID NO: 3241624 - RNA, 13 nt, Mycobacterium tuberculosis H37Rv
agcgugcggggcg

SEQ ID NO: 3241625 - RNA, 15 nt, Mycobacterium tuberculosis H37Rv
agcgugcggggcgcc

SEQ ID NO: 3241626 - RNA, 16 nt, Mycobacterium tuberculosis H37Rv
agcgugcggggcgccu

SEQ ID NO: 3241627 - RNA, 17 nt, Mycobacterium tuberculosis H37Rv
agcguggggccgccacc

SEQ ID NO: 3241628 - RNA, 21 nt, Mycobacterium tuberculosis H37Rv
agcguggguucgaaucccauc

SEQ ID NO: 3241629 - RNA, 15 nt, Mycobacterium tuberculosis H37Rv
agcguggugaagucg

SEQ ID NO: 3241630 - RNA, 16 nt, Mycobacterium tuberculosis H37Rv
agcguggugauccggu

SEQ ID NO: 3241631 - RNA, 14 nt, Mycobacterium tuberculosis H37Rv
agcugaucuuggca

SEQ ID NO: 3241632 - RNA, 19 nt, Mycobacterium tuberculosis H37Rv
agcugauuaccgacaccgu

SEQ ID NO: 3241633 - RNA, 21 nt, Mycobacterium tuberculosis H37Rv
agcugauuguguuccaccagc

SEQ ID NO: 3241634 - RNA, 23 nt, Mycobacterium tuberculosis H37Rv
agcugcaaugacuggaccgcggu

SEQ ID NO: 3241635 - RNA, 22 nt, Mycobacterium tuberculosis H37Rv
agcugccaacgcccguguugaa

SEQ ID NO: 3241636 - RNA, 17 nt, Mycobacterium tuberculosis H37Rv
agcugcccaaccgguca

SEQ ID NO: 3241637 - RNA, 14 nt, Mycobacterium tuberculosis H37Rv
agcugcccgacguu

SEQ ID NO: 3241638 - RNA, 16 nt, Mycobacterium tuberculosis H37Rv
agcugcccgacguugu

SEQ ID NO: 3241639 - RNA, 23 nt, Mycobacterium tuberculosis H37Rv
agcugccgaucaauggcaacgaa

SEQ ID NO: 3241640 - RNA, 15 nt, Mycobacterium tuberculosis H37Rv
agcugccgcaccccc

SEQ ID NO: 3241641 - RNA, 21 nt, Mycobacterium tuberculosis H37Rv
agcugccgcacccccuccgcg

SEQ ID NO: 3241642 - RNA, 23 nt, Mycobacterium tuberculosis H37Rv
agcugccggcgaccaaggccgac

SEQ ID NO: 3241643 - RNA, 17 nt, Mycobacterium tuberculosis H37Rv
agcugccguuggggugg

SEQ ID NO: 3241644 - RNA, 19 nt, Mycobacterium tuberculosis H37Rv
agcugcgcagcgcaaacau

SEQ ID NO: 3241645 - RNA, 23 nt, Mycobacterium tuberculosis H37Rv
agcugcgcagcgcaaacaucuug

SEQ ID NO: 3241646 - RNA, 22 nt, Mycobacterium tuberculosis H37Rv
agcugcgcaucgccaccaucac

SEQ ID NO: 3241647 - RNA, 18 nt, Mycobacterium tuberculosis H37Rv
agcugcgcgaagccacca

SEQ ID NO: 3241648 - RNA, 19 nt, Mycobacterium tuberculosis H37Rv
agcugcgcgaagccaccag

SEQ ID NO: 3241649 - RNA, 14 nt, Mycobacterium tuberculosis H37Rv
agcugcgcgggcga

SEQ ID NO: 3241650 - RNA, 17 nt, Mycobacterium tuberculosis H37Rv
agcugcggauacagccg

SEQ ID NO: 3241651 - RNA, 20 nt, Mycobacterium tuberculosis H37Rv
agcugcggauacagccgccg

SEQ ID NO: 3241652 - RNA, 23 nt, Mycobacterium tuberculosis H37Rv
agcugcggauuaagucggcggcc

SEQ ID NO: 3241653 - RNA, 18 nt, Mycobacterium tuberculosis H37Rv
agcugcgggucagcgccg

SEQ ID NO: 3241654 - RNA, 16 nt, Mycobacterium tuberculosis H37Rv
agcugcuagcccggcg

SEQ ID NO: 3241655 - RNA, 20 nt, Mycobacterium tuberculosis H37Rv
agcugcuagcccggcggcga

SEQ ID NO: 3241656 - RNA, 23 nt, Mycobacterium tuberculosis H37Rv
agcugcucacgguccggcgggga

SEQ ID NO: 3241657 - RNA, 17 nt, Mycobacterium tuberculosis H37Rv
agcugcucgucggcgcc

SEQ ID NO: 3241658 - RNA, 18 nt, Mycobacterium tuberculosis H37Rv
agcugcuggcgcgccugu

SEQ ID NO: 3241659 - RNA, 16 nt, Mycobacterium tuberculosis H37Rv
agcugcuuggcggucu

SEQ ID NO: 3241660 - RNA, 15 nt, Mycobacterium tuberculosis H37Rv
agcuggacggccucc

SEQ ID NO: 3241661 - RNA, 13 nt, Mycobacterium tuberculosis H37Rv
agcuggacuccgg

SEQ ID NO: 3241662 - RNA, 16 nt, Mycobacterium tuberculosis H37Rv
agcuggacuccgguca

SEQ ID NO: 3241663 - RNA, 22 nt, Mycobacterium tuberculosis H37Rv
agcuggccacuuucagaucgau

SEQ ID NO: 3241664 - RNA, 22 nt, Mycobacterium tuberculosis H37Rv
agcuggccgcggcgaguacuga

SEQ ID NO: 3241665 - RNA, 19 nt, Mycobacterium tuberculosis H37Rv
agcuggcgcgcgggguggc

SEQ ID NO: 3241666 - RNA, 15 nt, Mycobacterium tuberculosis H37Rv
agcugggcaccccgu

SEQ ID NO: 3241667 - RNA, 14 nt, Mycobacterium tuberculosis H37Rv
agcuggggcccggc

SEQ ID NO: 3241668 - RNA, 15 nt, Mycobacterium tuberculosis H37Rv
agcuggggcccggcc

SEQ ID NO: 3241669 - RNA, 18 nt, Mycobacterium tuberculosis H37Rv
agcuggggcccggccgcc

SEQ ID NO: 3241670 - RNA, 17 nt, Mycobacterium tuberculosis H37Rv
agcugguagcgcaccac

SEQ ID NO: 3241671 - RNA, 21 nt, Mycobacterium tuberculosis H37Rv
agcugguaggucaccggucac

SEQ ID NO: 3241672 - RNA, 22 nt, Mycobacterium tuberculosis H37Rv
agcugguaggucaccggucacc

SEQ ID NO: 3241673 - RNA, 12 nt, Mycobacterium tuberculosis H37Rv
agcuggucccac

SEQ ID NO: 3241674 - RNA, 22 nt, Mycobacterium tuberculosis H37Rv
agcuggucccacaccuccucga

SEQ ID NO: 3241675 - RNA, 23 nt, Mycobacterium tuberculosis H37Rv
agcuggucccacaccuccucgag

SEQ ID NO: 3241676 - RNA, 19 nt, Mycobacterium tuberculosis H37Rv
agcugguccuccaaggcgg

SEQ ID NO: 3241677 - RNA, 23 nt, Mycobacterium tuberculosis H37Rv
agcugguccuccaaggcggucac

SEQ ID NO: 3241678 - RNA, 20 nt, Mycobacterium tuberculosis H37Rv
agcuggucggcuucggggua

SEQ ID NO: 3241679 - RNA, 14 nt, Mycobacterium tuberculosis H37Rv
agcugguggugcgg

SEQ ID NO: 3241680 - RNA, 15 nt, Mycobacterium tuberculosis H37Rv
agcugguugugcugg

SEQ ID NO: 3241681 - RNA, 14 nt, Mycobacterium tuberculosis H37Rv
agcugucgaccgcg

SEQ ID NO: 3241682 - RNA, 17 nt, Mycobacterium tuberculosis H37Rv
agcugucgccuuugagg

SEQ ID NO: 3241683 - RNA, 15 nt, Mycobacterium tuberculosis H37Rv
agcugucgucgcccc

SEQ ID NO: 3241684 - RNA, 13 nt, Mycobacterium tuberculosis H37Rv
agcuguggucacc

SEQ ID NO: 3241685 - RNA, 12 nt, Mycobacterium tuberculosis H37Rv
agcugugguggu

SEQ ID NO: 3241686 - RNA, 14 nt, Mycobacterium tuberculosis H37Rv
agcuguugcggggu

SEQ ID NO: 3241687 - RNA, 23 nt, Mycobacterium tuberculosis H37Rv
agcuguugcggggugcucagcga

SEQ ID NO: 3241688 - RNA, 21 nt, Mycobacterium tuberculosis H37Rv
agcuuaggcgugguucccggc

SEQ ID NO: 3241689 - RNA, 21 nt, Mycobacterium tuberculosis H37Rv
agcuucaucccggagccgcua

SEQ ID NO: 3241690 - RNA, 16 nt, Mycobacterium tuberculosis H37Rv
agcuuccaaacccggu

SEQ ID NO: 3241691 - RNA, 23 nt, Mycobacterium tuberculosis H37Rv
agcuucccuccagauaccaccgc

SEQ ID NO: 3241692 - RNA, 15 nt, Mycobacterium tuberculosis H37Rv
agcuucgcgcagccg

SEQ ID NO: 3241693 - RNA, 18 nt, Mycobacterium tuberculosis H37Rv
agcuugaaauagucuucu

SEQ ID NO: 3241694 - RNA, 15 nt, Mycobacterium tuberculosis H37Rv
agcuugacaacccug

SEQ ID NO: 3241695 - RNA, 17 nt, Mycobacterium tuberculosis H37Rv
agcuugaccgaccacgc

SEQ ID NO: 3241696 - RNA, 19 nt, Mycobacterium tuberculosis H37Rv
agcuugagcacacguccgg

SEQ ID NO: 3241697 - RNA, 18 nt, Mycobacterium tuberculosis H37Rv
agcuugaucccauccaga

SEQ ID NO: 3241698 - RNA, 17 nt, Mycobacterium tuberculosis H37Rv
agcuugcccgacggcgu

SEQ ID NO: 3241699 - RNA, 14 nt, Mycobacterium tuberculosis H37Rv
agcuuggagaggcg

SEQ ID NO: 3241700 - RNA, 14 nt, Mycobacterium tuberculosis H37Rv
agcuuggccagcca

SEQ ID NO: 3241701 - RNA, 22 nt, Mycobacterium tuberculosis H37Rv
agcuuggccgguucaggggugg

SEQ ID NO: 3241702 - RNA, 23 nt, Mycobacterium tuberculosis H37Rv
agcuuggccgguucagggguggc

SEQ ID NO: 3241703 - RNA, 23 nt, Mycobacterium tuberculosis H37Rv
agcuuggcggccagcguguccca

SEQ ID NO: 3241704 - RNA, 21 nt, Mycobacterium tuberculosis H37Rv
agcuugggccggugcagcacg

SEQ ID NO: 3241705 - RNA, 14 nt, Mycobacterium tuberculosis H37Rv
agcuuggucgccgg

SEQ ID NO: 3241706 - RNA, 15 nt, Mycobacterium tuberculosis H37Rv
agcuuggucgccggg

SEQ ID NO: 3241707 - RNA, 17 nt, Mycobacterium tuberculosis H37Rv
agcuuggucgccgggca

SEQ ID NO: 3241708 - RNA, 18 nt, Mycobacterium tuberculosis H37Rv
agcuugguggccaccacg

SEQ ID NO: 3241709 - RNA, 15 nt, Mycobacterium tuberculosis H37Rv
agcuugucgggcacc

SEQ ID NO: 3241710 - RNA, 13 nt, Mycobacterium tuberculosis H37Rv
agcuuguugcagc

SEQ ID NO: 3241711 - RNA, 16 nt, Mycobacterium tuberculosis H37Rv
agcuuuaucugcaugc

SEQ ID NO: 3241712 - RNA, 15 nt, Mycobacterium tuberculosis H37Rv
agcuuucccguugcu

SEQ ID NO: 3241713 - RNA, 20 nt, Mycobacterium tuberculosis H37Rv
aggaaacgagcgaaggugaa

SEQ ID NO: 3241714 - RNA, 16 nt, Mycobacterium tuberculosis H37Rv
aggaacaggcaaagua

SEQ ID NO: 3241715 - RNA, 21 nt, Mycobacterium tuberculosis H37Rv
aggaaccacccaccggccacc

SEQ ID NO: 3241716 - RNA, 16 nt, Mycobacterium tuberculosis H37Rv
aggaaccccgcgcggu

SEQ ID NO: 3241717 - RNA, 14 nt, Mycobacterium tuberculosis H37Rv
aggaaccgggcaaa

SEQ ID NO: 3241718 - RNA, 23 nt, Mycobacterium tuberculosis H37Rv
aggaaccgggcaaaucaagcaca

SEQ ID NO: 3241719 - RNA, 22 nt, Mycobacterium tuberculosis H37Rv
aggaaccgucgaagaugaccug

SEQ ID NO: 3241720 - RNA, 20 nt, Mycobacterium tuberculosis H37Rv
aggaacucggcccacacggu

SEQ ID NO: 3241721 - RNA, 20 nt, Mycobacterium tuberculosis H37Rv
aggaagcccacgaucgcguc

SEQ ID NO: 3241722 - RNA, 22 nt, Mycobacterium tuberculosis H37Rv
aggaagcccgaugcgccaccgg

SEQ ID NO: 3241723 - RNA, 21 nt, Mycobacterium tuberculosis H37Rv
aggaagccgaagaugcacagg

SEQ ID NO: 3241724 - RNA, 17 nt, Mycobacterium tuberculosis H37Rv
aggaagcggccggugga

SEQ ID NO: 3241725 - RNA, 23 nt, Mycobacterium tuberculosis H37Rv
aggaagggcuaucguggcggcgu

SEQ ID NO: 3241726 - RNA, 21 nt, Mycobacterium tuberculosis H37Rv
aggcaccuauagggacgugcc

SEQ ID NO: 3241727 - RNA, 18 nt, Mycobacterium tuberculosis H37Rv
aggcacuagacugcuggu

SEQ ID NO: 3241728 - RNA, 18 nt, Mycobacterium tuberculosis H37Rv
aggcagcacccgcacggu

SEQ ID NO: 3241729 - RNA, 21 nt, Mycobacterium tuberculosis H37Rv
aggcagccucgaguucgaccg

SEQ ID NO: 3241730 - RNA, 15 nt, Mycobacterium tuberculosis H37Rv
aggcagcgaccgucg

SEQ ID NO: 3241731 - RNA, 18 nt, Mycobacterium tuberculosis H37Rv
aggcagcggcgacacauc

SEQ ID NO: 3241732 - RNA, 19 nt, Mycobacterium tuberculosis H37Rv
aggcagcgucgucgacgac

SEQ ID NO: 3241733 - RNA, 22 nt, Mycobacterium tuberculosis H37Rv
aggcagcuugccaaucaccgua

SEQ ID NO: 3241734 - RNA, 16 nt, Mycobacterium tuberculosis H37Rv
aggcaggccucggcgc

SEQ ID NO: 3241735 - RNA, 13 nt, Mycobacterium tuberculosis H37Rv
aggcaucaccgga

SEQ ID NO: 3241736 - RNA, 14 nt, Mycobacterium tuberculosis H37Rv
aggcaugccgccca

SEQ ID NO: 3241737 - RNA, 20 nt, Mycobacterium tuberculosis H37Rv
aggcauucccgcggcaacgc

SEQ ID NO: 3241738 - RNA, 22 nt, Mycobacterium tuberculosis H37Rv
aggcauuggugaguagauugcu

SEQ ID NO: 3241739 - RNA, 16 nt, Mycobacterium tuberculosis H37Rv
aggccaacccugcggc

SEQ ID NO: 3241740 - RNA, 15 nt, Mycobacterium tuberculosis H37Rv
aggccaacggcgcug

SEQ ID NO: 3241741 - RNA, 13 nt, Mycobacterium tuberculosis H37Rv
aggccaacugggc

SEQ ID NO: 3241742 - RNA, 14 nt, Mycobacterium tuberculosis H37Rv
aggccaagccgcgg

SEQ ID NO: 3241743 - RNA, 22 nt, Mycobacterium tuberculosis H37Rv
aggccaagccgcggcuaggcca

SEQ ID NO: 3241744 - RNA, 15 nt, Mycobacterium tuberculosis H37Rv
aggccacagcccggc

SEQ ID NO: 3241745 - RNA, 20 nt, Mycobacterium tuberculosis H37Rv
aggccacccgcgaagccgcc

SEQ ID NO: 3241746 - RNA, 21 nt, Mycobacterium tuberculosis H37Rv
aggccacccgcgaagccgcca

SEQ ID NO: 3241747 - RNA, 17 nt, Mycobacterium tuberculosis H37Rv
aggccaccgcagacgcc

SEQ ID NO: 3241748 - RNA, 21 nt, Mycobacterium tuberculosis H37Rv
aggccaccuccgaggccgcca

SEQ ID NO: 3241749 - RNA, 21 nt, Mycobacterium tuberculosis H37Rv
aggccacgcaccgggugcagg

SEQ ID NO: 3241750 - RNA, 14 nt, Mycobacterium tuberculosis H37Rv
aggccacggggcuu

SEQ ID NO: 3241751 - RNA, 21 nt, Mycobacterium tuberculosis H37Rv
aggccacggggcuuggcgacg

SEQ ID NO: 3241752 - RNA, 23 nt, Mycobacterium tuberculosis H37Rv
aggccacugcguuccaucgccga

SEQ ID NO: 3241753 - RNA, 22 nt, Mycobacterium tuberculosis H37Rv
aggccagcaugucgggccgcuc

SEQ ID NO: 3241754 - RNA, 13 nt, Mycobacterium tuberculosis H37Rv
aggccagcgcuca

SEQ ID NO: 3241755 - RNA, 21 nt, Mycobacterium tuberculosis H37Rv
aggccaugcucgccaaaccca

SEQ ID NO: 3241756 - RNA, 13 nt, Mycobacterium tuberculosis H37Rv
aggcccaacgcga

SEQ ID NO: 3241757 - RNA, 12 nt, Mycobacterium tuberculosis H37Rv
aggcccacggca

SEQ ID NO: 3241758 - RNA, 17 nt, Mycobacterium tuberculosis H37Rv
aggcccagcaaccgcuc

SEQ ID NO: 3241759 - RNA, 18 nt, Mycobacterium tuberculosis H37Rv
aggcccagcaaccgcucg

SEQ ID NO: 3241760 - RNA, 22 nt, Mycobacterium tuberculosis H37Rv
aggcccagcaaccgcucggcga

SEQ ID NO: 3241761 - RNA, 12 nt, Mycobacterium tuberculosis H37Rv
aggcccagcacg

SEQ ID NO: 3241762 - RNA, 16 nt, Mycobacterium tuberculosis H37Rv
aggcccagcacgguca

SEQ ID NO: 3241763 - RNA, 18 nt, Mycobacterium tuberculosis H37Rv
aggcccagcacggucaac

SEQ ID NO: 3241764 - RNA, 23 nt, Mycobacterium tuberculosis H37Rv
aggcccaucaucuuugcguacaa

SEQ ID NO: 3241765 - RNA, 19 nt, Mycobacterium tuberculosis H37Rv
aggccccgccagcgccggu

SEQ ID NO: 3241766 - RNA, 16 nt, Mycobacterium tuberculosis H37Rv
aggcccgaguuaccgg

SEQ ID NO: 3241767 - RNA, 23 nt, Mycobacterium tuberculosis H37Rv
aggcccgcacguuggcggccagc

SEQ ID NO: 3241768 - RNA, 13 nt, Mycobacterium tuberculosis H37Rv
aggcccgccagca

SEQ ID NO: 3241769 - RNA, 23 nt, Mycobacterium tuberculosis H37Rv
aggcccgcgcgagagccuccaug

SEQ ID NO: 3241770 - RNA, 18 nt, Mycobacterium tuberculosis H37Rv
aggcccgcgguggaccgg

SEQ ID NO: 3241771 - RNA, 22 nt, Mycobacterium tuberculosis H37Rv
aggcccgggcggccagcugcag

SEQ ID NO: 3241772 - RNA, 18 nt, Mycobacterium tuberculosis H37Rv
aggcccgguucgaggauc

SEQ ID NO: 3241773 - RNA, 19 nt, Mycobacterium tuberculosis H37Rv
aggcccucgcgcgcgucga

SEQ ID NO: 3241774 - RNA, 18 nt, Mycobacterium tuberculosis H37Rv
aggcccucgggacugcgc

SEQ ID NO: 3241775 - RNA, 16 nt, Mycobacterium tuberculosis H37Rv
aggcccuggccaccca

SEQ ID NO: 3241776 - RNA, 14 nt, Mycobacterium tuberculosis H37Rv
aggcccuggccagc

SEQ ID NO: 3241777 - RNA, 20 nt, Mycobacterium tuberculosis H37Rv
aggccgaacagccgagccag

SEQ ID NO: 3241778 - RNA, 20 nt, Mycobacterium tuberculosis H37Rv
aggccgaacugccgcgccga

SEQ ID NO: 3241779 - RNA, 20 nt, Mycobacterium tuberculosis H37Rv
aggccgacaaugucggcgau

SEQ ID NO: 3241780 - RNA, 21 nt, Mycobacterium tuberculosis H37Rv
aggccgacaaugucggcgaug

SEQ ID NO: 3241781 - RNA, 19 nt, Mycobacterium tuberculosis H37Rv
aggccgacacgaacgcugc

SEQ ID NO: 3241782 - RNA, 13 nt, Mycobacterium tuberculosis H37Rv
aggccgaccgcgc

SEQ ID NO: 3241783 - RNA, 14 nt, Mycobacterium tuberculosis H37Rv
aggccgaccgcgca

SEQ ID NO: 3241784 - RNA, 22 nt, Mycobacterium tuberculosis H37Rv
aggccgaccuguaugccgcggu

SEQ ID NO: 3241785 - RNA, 23 nt, Mycobacterium tuberculosis H37Rv
aggccgaccuguaugccgcggug

SEQ ID NO: 3241786 - RNA, 18 nt, Mycobacterium tuberculosis H37Rv
aggccgacgucgaccacu

SEQ ID NO: 3241787 - RNA, 16 nt, Mycobacterium tuberculosis H37Rv
aggccgaugacgaugc

SEQ ID NO: 3241788 - RNA, 13 nt, Mycobacterium tuberculosis H37Rv
aggccgaugccga

SEQ ID NO: 3241789 - RNA, 14 nt, Mycobacterium tuberculosis H37Rv
aggccgcacgggcg

SEQ ID NO: 3241790 - RNA, 15 nt, Mycobacterium tuberculosis H37Rv
aggccgcacgggcga

SEQ ID NO: 3241791 - RNA, 17 nt, Mycobacterium tuberculosis H37Rv
aggccgccaccgucacc

SEQ ID NO: 3241792 - RNA, 21 nt, Mycobacterium tuberculosis H37Rv
aggccgccaucgccgccaacc

SEQ ID NO: 3241793 - RNA, 17 nt, Mycobacterium tuberculosis H37Rv
aggccgccgagguguuu

SEQ ID NO: 3241794 - RNA, 10 nt, Mycobacterium tuberculosis H37Rv
aggccgccgc

SEQ ID NO: 3241795 - RNA, 19 nt, Mycobacterium tuberculosis H37Rv
aggccgccguggugaucaa

SEQ ID NO: 3241796 - RNA, 13 nt, Mycobacterium tuberculosis H37Rv
aggccgcgcccga

SEQ ID NO: 3241797 - RNA, 14 nt, Mycobacterium tuberculosis H37Rv
aggccgcgcccgag

SEQ ID NO: 3241798 - RNA, 17 nt, Mycobacterium tuberculosis H37Rv
aggccgcgcggacccag

SEQ ID NO: 3241799 - RNA, 16 nt, Mycobacterium tuberculosis H37Rv
aggccgcggcacccgg

SEQ ID NO: 3241800 - RNA, 22 nt, Mycobacterium tuberculosis H37Rv
aggccgcggcacccggcuugag

SEQ ID NO: 3241801 - RNA, 23 nt, Mycobacterium tuberculosis H37Rv
aggccgcggugaugggccaggcg

SEQ ID NO: 3241802 - RNA, 12 nt, Mycobacterium tuberculosis H37Rv
aggccgcgucga

SEQ ID NO: 3241803 - RNA, 18 nt, Mycobacterium tuberculosis H37Rv
aggccgcuaugcagguca

SEQ ID NO: 3241804 - RNA, 15 nt, Mycobacterium tuberculosis H37Rv
aggccgcugccaggg

SEQ ID NO: 3241805 - RNA, 21 nt, Mycobacterium tuberculosis H37Rv
aggccggcaagaccgaacagc

SEQ ID NO: 3241806 - RNA, 13 nt, Mycobacterium tuberculosis H37Rv
aggccggccacca

SEQ ID NO: 3241807 - RNA, 20 nt, Mycobacterium tuberculosis H37Rv
aggccggccaccaccgcgcc

SEQ ID NO: 3241808 - RNA, 15 nt, Mycobacterium tuberculosis H37Rv
aggccggcccgcaac

SEQ ID NO: 3241809 - RNA, 17 nt, Mycobacterium tuberculosis H37Rv
aggccggcccgcaacgc

SEQ ID NO: 3241810 - RNA, 20 nt, Mycobacterium tuberculosis H37Rv
aggccggccgcgauccagcg

SEQ ID NO: 3241811 - RNA, 13 nt, Mycobacterium tuberculosis H37Rv
aggccggcggcgg

SEQ ID NO: 3241812 - RNA, 20 nt, Mycobacterium tuberculosis H37Rv
aggccggcggcggcgcucgg

SEQ ID NO: 3241813 - RNA, 15 nt, Mycobacterium tuberculosis H37Rv
aggccggcggucagc

SEQ ID NO: 3241814 - RNA, 22 nt, Mycobacterium tuberculosis H37Rv
aggccggcggucagcagcgccg

SEQ ID NO: 3241815 - RNA, 21 nt, Mycobacterium tuberculosis H37Rv
aggccggcgucgaucaacaac

SEQ ID NO: 3241816 - RNA, 18 nt, Mycobacterium tuberculosis H37Rv
aggccgggcgcaagcagc

SEQ ID NO: 3241817 - RNA, 15 nt, Mycobacterium tuberculosis H37Rv
aggccggggcgucgc

SEQ ID NO: 3241818 - RNA, 16 nt, Mycobacterium tuberculosis H37Rv
aggccggguggccacg

SEQ ID NO: 3241819 - RNA, 13 nt, Mycobacterium tuberculosis H37Rv
aggccggugaacg

SEQ ID NO: 3241820 - RNA, 23 nt, Mycobacterium tuberculosis H37Rv
aggccggugaacggcagcacggu

SEQ ID NO: 3241821 - RNA, 18 nt, Mycobacterium tuberculosis H37Rv
aggccggugaacgguagc

SEQ ID NO: 3241822 - RNA, 19 nt, Mycobacterium tuberculosis H37Rv
aggcgugcuugaccgccug

SEQ ID NO: 3241823 - RNA, 18 nt, Mycobacterium tuberculosis H37Rv
aggcgugucgucgcggcc

SEQ ID NO: 3241824 - RNA, 21 nt, Mycobacterium tuberculosis H37Rv
aggcguucgacucgaccgcga

SEQ ID NO: 3241825 - RNA, 20 nt, Mycobacterium tuberculosis H37Rv
aggcguuggaucccagcccg

SEQ ID NO: 3241826 - RNA, 14 nt, Mycobacterium tuberculosis H37Rv
aggcguuuccgcug

SEQ ID NO: 3241827 - RNA, 18 nt, Mycobacterium tuberculosis H37Rv
aggcucacacucggccgg

SEQ ID NO: 3241828 - RNA, 18 nt, Mycobacterium tuberculosis H37Rv
aggcucauccgccgggcc

SEQ ID NO: 3241829 - RNA, 23 nt, Mycobacterium tuberculosis H37Rv
aggcucauccgccgggccaggcc

SEQ ID NO: 3241830 - RNA, 20 nt, Mycobacterium tuberculosis H37Rv
aggcuccagcgcgcgccgca

SEQ ID NO: 3241831 - RNA, 15 nt, Mycobacterium tuberculosis H37Rv
aggcugaccguggcg

SEQ ID NO: 3241832 - RNA, 17 nt, Mycobacterium tuberculosis H37Rv
aggcugaccguggcgcc

SEQ ID NO: 3241833 - RNA, 22 nt, Mycobacterium tuberculosis H37Rv
aggcugaccguggcgccggucg

SEQ ID NO: 3241834 - RNA, 14 nt, Mycobacterium tuberculosis H37Rv
aggcugcagugccg

SEQ ID NO: 3241835 - RNA, 22 nt, Mycobacterium tuberculosis H37Rv
aggcugcagugccgcacccaga

SEQ ID NO: 3241836 - RNA, 20 nt, Mycobacterium tuberculosis H37Rv
aggcugccgaaguugaagaa

SEQ ID NO: 3241837 - RNA, 17 nt, Mycobacterium tuberculosis H37Rv
aggcugggcagaccgau

SEQ ID NO: 3241838 - RNA, 14 nt, Mycobacterium tuberculosis H37Rv
aggcugguccgggu

SEQ ID NO: 3241839 - RNA, 14 nt, Mycobacterium tuberculosis H37Rv
aggcuguaacaccc

SEQ ID NO: 3241840 - RNA, 11 nt, Mycobacterium tuberculosis H37Rv
aggcuguccag

SEQ ID NO: 3241841 - RNA, 20 nt, Mycobacterium tuberculosis H37Rv
aggcuguccgaaccgacguu

SEQ ID NO: 3241842 - RNA, 16 nt, Mycobacterium tuberculosis H37Rv
aggcugucgagucggu

SEQ ID NO: 3241843 - RNA, 14 nt, Mycobacterium tuberculosis H37Rv
aggcugugccggcc

SEQ ID NO: 3241844 - RNA, 15 nt, Mycobacterium tuberculosis H37Rv
aggcuguggccagca

SEQ ID NO: 3241845 - RNA, 17 nt, Mycobacterium tuberculosis H37Rv
aggcuguggccagcauc

SEQ ID NO: 3241846 - RNA, 15 nt, Mycobacterium tuberculosis H37Rv
aggcuuacaugcccu

SEQ ID NO: 3241847 - RNA, 21 nt, Mycobacterium tuberculosis H37Rv
aggcuuccagccacagcccgg

SEQ ID NO: 3241848 - RNA, 23 nt, Mycobacterium tuberculosis H37Rv
aggcuuccagccacagcccggcg

SEQ ID NO: 3241849 - RNA, 17 nt, Mycobacterium tuberculosis H37Rv
aggcuuccggcgcgacc

SEQ ID NO: 3241850 - RNA, 20 nt, Mycobacterium tuberculosis H37Rv
aggcuucggugacccgggcg

SEQ ID NO: 3241851 - RNA, 22 nt, Mycobacterium tuberculosis H37Rv
aggcuucggugacccgggcggc

SEQ ID NO: 3241852 - RNA, 15 nt, Mycobacterium tuberculosis H37Rv
aggcuugacugcaca

SEQ ID NO: 3241853 - RNA, 15 nt, Mycobacterium tuberculosis H37Rv
aggcuugcaaggucg

SEQ ID NO: 3241854 - RNA, 16 nt, Mycobacterium tuberculosis H37Rv
aggcuuggcaugcgga

SEQ ID NO: 3241855 - RNA, 18 nt, Mycobacterium tuberculosis H37Rv
aggcuuuccggggaauga

SEQ ID NO: 3241856 - RNA, 20 nt, Mycobacterium tuberculosis H37Rv
aggcuuucgauauagccgcc

SEQ ID NO: 3241857 - RNA, 15 nt, Mycobacterium tuberculosis H37Rv
agggaaggacgcgca

SEQ ID NO: 3241858 - RNA, 22 nt, Mycobacterium tuberculosis H37Rv
agggaauccgaacucgcgggcg

SEQ ID NO: 3241859 - RNA, 22 nt, Mycobacterium tuberculosis H37Rv
agggaggccccccggggccgca

SEQ ID NO: 3241860 - RNA, 14 nt, Mycobacterium tuberculosis H37Rv
agggagugccgcac

SEQ ID NO: 3241861 - RNA, 16 nt, Mycobacterium tuberculosis H37Rv
agggagugccgcacga

SEQ ID NO: 3241862 - RNA, 20 nt, Mycobacterium tuberculosis H37Rv
agggaucacgccaccauccc

SEQ ID NO: 3241863 - RNA, 19 nt, Mycobacterium tuberculosis H37Rv
agggauccgaagagccagc

SEQ ID NO: 3241864 - RNA, 23 nt, Mycobacterium tuberculosis H37Rv
agggaucuagaggcggcccccgg

SEQ ID NO: 3241865 - RNA, 22 nt, Mycobacterium tuberculosis H37Rv
agggcacggcgguguguuccaa

SEQ ID NO: 3241866 - RNA, 15 nt, Mycobacterium tuberculosis H37Rv
agggcacuccaccgg

SEQ ID NO: 3241867 - RNA, 16 nt, Mycobacterium tuberculosis H37Rv
agggcacugaaccggu

SEQ ID NO: 3241868 - RNA, 16 nt, Mycobacterium tuberculosis H37Rv
agggcagcagcccggg

SEQ ID NO: 3241869 - RNA, 19 nt, Mycobacterium tuberculosis H37Rv
agggcaucgggccuagccg

SEQ ID NO: 3241870 - RNA, 13 nt, Mycobacterium tuberculosis H37Rv
agggcaucgucgc

SEQ ID NO: 3241871 - RNA, 16 nt, Mycobacterium tuberculosis H37Rv
agggcaucgucgccga

SEQ ID NO: 3241872 - RNA, 19 nt, Mycobacterium tuberculosis H37Rv
agggcauugcggcccgcga

SEQ ID NO: 3241873 - RNA, 14 nt, Mycobacterium tuberculosis H37Rv
agggccacggcugc

SEQ ID NO: 3241874 - RNA, 18 nt, Mycobacterium tuberculosis H37Rv
agggccacguagcagcag

SEQ ID NO: 3241875 - RNA, 20 nt, Mycobacterium tuberculosis H37Rv
agggccagcgccucggcauc

SEQ ID NO: 3241876 - RNA, 22 nt, Mycobacterium tuberculosis H37Rv
agggccagcggcagccuggccu

SEQ ID NO: 3241877 - RNA, 16 nt, Mycobacterium tuberculosis H37Rv
agggccaggacaacca

SEQ ID NO: 3241878 - RNA, 21 nt, Mycobacterium tuberculosis H37Rv
agggccauaaaugcgcguucg

SEQ ID NO: 3241879 - RNA, 13 nt, Mycobacterium tuberculosis H37Rv
agggcccuggcgg

SEQ ID NO: 3241880 - RNA, 14 nt, Mycobacterium tuberculosis H37Rv
agggccgacgucgu

SEQ ID NO: 3241881 - RNA, 18 nt, Mycobacterium tuberculosis H37Rv
agggccgagcagcuccuu

SEQ ID NO: 3241882 - RNA, 12 nt, Mycobacterium tuberculosis H37Rv
agggccgccauc

SEQ ID NO: 3241883 - RNA, 18 nt, Mycobacterium tuberculosis H37Rv
agggccgccgaagcucau

SEQ ID NO: 3241884 - RNA, 19 nt, Mycobacterium tuberculosis H37Rv
agggccgccgcugccgccu

SEQ ID NO: 3241885 - RNA, 15 nt, Mycobacterium tuberculosis H37Rv
agggccgccgcuggu

SEQ ID NO: 3241886 - RNA, 14 nt, Mycobacterium tuberculosis H37Rv
agggccgcgaucga

SEQ ID NO: 3241887 - RNA, 22 nt, Mycobacterium tuberculosis H37Rv
agggccgcucgccucgauggcg

SEQ ID NO: 3241888 - RNA, 19 nt, Mycobacterium tuberculosis H37Rv
agggccgucuugccggcca

SEQ ID NO: 3241889 - RNA, 22 nt, Mycobacterium tuberculosis H37Rv
agggccgucuugccggccagga

SEQ ID NO: 3241890 - RNA, 11 nt, Mycobacterium tuberculosis H37Rv
agggccguucc

SEQ ID NO: 3241891 - RNA, 16 nt, Mycobacterium tuberculosis H37Rv
agggccuccacccgcc

SEQ ID NO: 3241892 - RNA, 14 nt, Mycobacterium tuberculosis H37Rv
agggccucgaccgc

SEQ ID NO: 3241893 - RNA, 21 nt, Mycobacterium tuberculosis H37Rv
agggccuggaacacaugcauc

SEQ ID NO: 3241894 - RNA, 15 nt, Mycobacterium tuberculosis H37Rv
agggcgacgagaucu

SEQ ID NO: 3241895 - RNA, 21 nt, Mycobacterium tuberculosis H37Rv
agggcgacgagaucugcgaug

SEQ ID NO: 3241896 - RNA, 21 nt, Mycobacterium tuberculosis H37Rv
agggcgauuuccaucgcgacc

SEQ ID NO: 3241897 - RNA, 20 nt, Mycobacterium tuberculosis H37Rv
agggcgccgggggcgccgcc

SEQ ID NO: 3241898 - RNA, 22 nt, Mycobacterium tuberculosis H37Rv
agggcgcgagcagacgcagaau

SEQ ID NO: 3241899 - RNA, 16 nt, Mycobacterium tuberculosis H37Rv
agggcgcgcaucugcu

SEQ ID NO: 3241900 - RNA, 19 nt, Mycobacterium tuberculosis H37Rv
agggcggccauccggucgc

SEQ ID NO: 3241901 - RNA, 14 nt, Mycobacterium tuberculosis H37Rv
agggcggccgcggu

SEQ ID NO: 3241902 - RNA, 13 nt, Mycobacterium tuberculosis H37Rv
agggcggcgaggu

SEQ ID NO: 3241903 - RNA, 19 nt, Mycobacterium tuberculosis H37Rv
agggcggcgucgauggcca

SEQ ID NO: 3241904 - RNA, 20 nt, Mycobacterium tuberculosis H37Rv
agggcggcgucgauggccac

SEQ ID NO: 3241905 - RNA, 14 nt, Mycobacterium tuberculosis H37Rv
agggcgguggccac

SEQ ID NO: 3241906 - RNA, 15 nt, Mycobacterium tuberculosis H37Rv
agggcgguggccacc

SEQ ID NO: 3241907 - RNA, 15 nt, Mycobacterium tuberculosis H37Rv
agggcguuggcggcu

SEQ ID NO: 3241908 - RNA, 20 nt, Mycobacterium tuberculosis H37Rv
agggcuaccggcgccgcgcg

SEQ ID NO: 3241909 - RNA, 22 nt, Mycobacterium tuberculosis H37Rv
agggcuaucguggcggcgucga

SEQ ID NO: 3241910 - RNA, 12 nt, Mycobacterium tuberculosis H37Rv
agggcuccucgu

SEQ ID NO: 3241911 - RNA, 16 nt, Mycobacterium tuberculosis H37Rv
agggcuccucgugcac

SEQ ID NO: 3241912 - RNA, 19 nt, Mycobacterium tuberculosis H37Rv
agggcucggcggcccggcc

SEQ ID NO: 3241913 - RNA, 21 nt, Mycobacterium tuberculosis H37Rv
agggcugacgggaugguuccg

SEQ ID NO: 3241914 - RNA, 23 nt, Mycobacterium tuberculosis H37Rv
agggcugugucugacgcuacgac

SEQ ID NO: 3241915 - RNA, 14 nt, Mycobacterium tuberculosis H37Rv
agggcuuccagggc

SEQ ID NO: 3241916 - RNA, 17 nt, Mycobacterium tuberculosis H37Rv
agggcuugucgccggca

SEQ ID NO: 3241917 - RNA, 19 nt, Mycobacterium tuberculosis H37Rv
agggcuugucgccggcaua

SEQ ID NO: 3241918 - RNA, 14 nt, Mycobacterium tuberculosis H37Rv
aggucuggcgcgga

SEQ ID NO: 3241919 - RNA, 21 nt, Mycobacterium tuberculosis H37Rv
aggucugggcaagaccgcguu

SEQ ID NO: 3241920 - RNA, 19 nt, Mycobacterium tuberculosis H37Rv
aggucuucaggccgcgcau

SEQ ID NO: 3241921 - RNA, 20 nt, Mycobacterium tuberculosis H37Rv
aggucuuucgaugaugggcg

SEQ ID NO: 3241922 - RNA, 18 nt, Mycobacterium tuberculosis H37Rv
aggugaaccccgccggca

SEQ ID NO: 3241923 - RNA, 18 nt, Mycobacterium tuberculosis H37Rv
aggugaacgacaugggca

SEQ ID NO: 3241924 - RNA, 21 nt, Mycobacterium tuberculosis H37Rv
aggugaacgacaugggcaggc

SEQ ID NO: 3241925 - RNA, 20 nt, Mycobacterium tuberculosis H37Rv
aggugacgcccgcuccgcgg

SEQ ID NO: 3241926 - RNA, 15 nt, Mycobacterium tuberculosis H37Rv
aggugacgccgccag

SEQ ID NO: 3241927 - RNA, 19 nt, Mycobacterium tuberculosis H37Rv
aggugacgccgccagcacc

SEQ ID NO: 3241928 - RNA, 18 nt, Mycobacterium tuberculosis H37Rv
aggugacguucgaugccc

SEQ ID NO: 3241929 - RNA, 16 nt, Mycobacterium tuberculosis H37Rv
aggugaggucgaucag

SEQ ID NO: 3241930 - RNA, 13 nt, Mycobacterium tuberculosis H37Rv
aggugaucagcag

SEQ ID NO: 3241931 - RNA, 19 nt, Mycobacterium tuberculosis H37Rv
aggugaucccgauggucac

SEQ ID NO: 3241932 - RNA, 16 nt, Mycobacterium tuberculosis H37Rv
aggugaugaacaccgg

SEQ ID NO: 3241933 - RNA, 17 nt, Mycobacterium tuberculosis H37Rv
aggugaugagugcggac

SEQ ID NO: 3241934 - RNA, 19 nt, Mycobacterium tuberculosis H37Rv
aggugcagguugcccucac

SEQ ID NO: 3241935 - RNA, 22 nt, Mycobacterium tuberculosis H37Rv
aggugcccaagcaguccacgag

SEQ ID NO: 3241936 - RNA, 19 nt, Mycobacterium tuberculosis H37Rv
aggugccgaagaugaccgc

SEQ ID NO: 3241937 - RNA, 18 nt, Mycobacterium tuberculosis H37Rv
aggugccgcgcagcugcc

SEQ ID NO: 3241938 - RNA, 16 nt, Mycobacterium tuberculosis H37Rv
aggugccggggcccca

SEQ ID NO: 3241939 - RNA, 13 nt, Mycobacterium tuberculosis H37Rv
aggugccuucuuc

SEQ ID NO: 3241940 - RNA, 12 nt, Mycobacterium tuberculosis H37Rv
aggugcgcgacc

SEQ ID NO: 3241941 - RNA, 16 nt, Mycobacterium tuberculosis H37Rv
aggugcgcgaccagga

SEQ ID NO: 3241942 - RNA, 15 nt, Mycobacterium tuberculosis H37Rv
aggugcgcuggguga

SEQ ID NO: 3241943 - RNA, 18 nt, Mycobacterium tuberculosis H37Rv
aggugcggggccggucgg

SEQ ID NO: 3241944 - RNA, 12 nt, Mycobacterium tuberculosis H37Rv
agguggcccgcg

SEQ ID NO: 3241945 - RNA, 16 nt, Mycobacterium tuberculosis H37Rv
agguggccgucgccga

SEQ ID NO: 3241946 - RNA, 16 nt, Mycobacterium tuberculosis H37Rv
agguggcgcggggccg

SEQ ID NO: 3241947 - RNA, 20 nt, Mycobacterium tuberculosis H37Rv
agguggcgcggggccgccgc

SEQ ID NO: 3241948 - RNA, 24 nt, Mycobacterium tuberculosis H37Rv
agguggcguaauugucgauguccg

SEQ ID NO: 3241949 - RNA, 15 nt, Mycobacterium tuberculosis H37Rv
aggugggauugaagc

SEQ ID NO: 3241950 - RNA, 21 nt, Mycobacterium tuberculosis H37Rv
aggugggauugaagcuggcca

SEQ ID NO: 3241951 - RNA, 13 nt, Mycobacterium tuberculosis H37Rv
aggugggcacagc

SEQ ID NO: 3241952 - RNA, 13 nt, Mycobacterium tuberculosis H37Rv
aggugggcagcag

SEQ ID NO: 3241953 - RNA, 19 nt, Mycobacterium tuberculosis H37Rv
aggugggcguuggcgacga

SEQ ID NO: 3241954 - RNA, 11 nt, Mycobacterium tuberculosis H37Rv
aggugggcucg

SEQ ID NO: 3241955 - RNA, 15 nt, Mycobacterium tuberculosis H37Rv
agguggggugguggu

SEQ ID NO: 3241956 - RNA, 23 nt, Mycobacterium tuberculosis H37Rv
agguggucaucgccacgccugcu

SEQ ID NO: 3241957 - RNA, 23 nt, Mycobacterium tuberculosis H37Rv
agguggugacacgacgugcagga

SEQ ID NO: 3241958 - RNA, 19 nt, Mycobacterium tuberculosis H37Rv
agguguagcccuccgagca

SEQ ID NO: 3241959 - RNA, 21 nt, Mycobacterium tuberculosis H37Rv
agguguccccgcccggccagc

SEQ ID NO: 3241960 - RNA, 17 nt, Mycobacterium tuberculosis H37Rv
aggugucgacgcgggcg

SEQ ID NO: 3241961 - RNA, 19 nt, Mycobacterium tuberculosis H37Rv
aggugugcgacgacggcgc

SEQ ID NO: 3241962 - RNA, 18 nt, Mycobacterium tuberculosis H37Rv
aggugugcgucuccagcu

SEQ ID NO: 3241963 - RNA, 22 nt, Mycobacterium tuberculosis H37Rv
agguguguggcgccggggacca

SEQ ID NO: 3241964 - RNA, 15 nt, Mycobacterium tuberculosis H37Rv
agguguguggcggcg

SEQ ID NO: 3241965 - RNA, 18 nt, Mycobacterium tuberculosis H37Rv
agguguugcgguggguga

SEQ ID NO: 3241966 - RNA, 13 nt, Mycobacterium tuberculosis H37Rv
agguucaaagcag

SEQ ID NO: 3241967 - RNA, 19 nt, Mycobacterium tuberculosis H37Rv
agguucccgcauugacgaa

SEQ ID NO: 3241968 - RNA, 22 nt, Mycobacterium tuberculosis H37Rv
agguuccgcugucgagccggug

SEQ ID NO: 3241969 - RNA, 13 nt, Mycobacterium tuberculosis H37Rv
agguucgggugga

SEQ ID NO: 3241970 - RNA, 16 nt, Mycobacterium tuberculosis H37Rv
agguucuucuccacca

SEQ ID NO: 3241971 - RNA, 19 nt, Mycobacterium tuberculosis H37Rv
agguucuucuccaccaccg

SEQ ID NO: 3241972 - RNA, 16 nt, Mycobacterium tuberculosis H37Rv
agguucuucugcgcca

SEQ ID NO: 3241973 - RNA, 16 nt, Mycobacterium tuberculosis H37Rv
agguugaacgccgcca

SEQ ID NO: 3241974 - RNA, 16 nt, Mycobacterium tuberculosis H37Rv
agguugacccccgggu

SEQ ID NO: 3241975 - RNA, 19 nt, Mycobacterium tuberculosis H37Rv
agguugacgucaggcugaa

SEQ ID NO: 3241976 - RNA, 21 nt, Mycobacterium tuberculosis H37Rv
agguugcaaccuugggcgccg

SEQ ID NO: 3241977 - RNA, 15 nt, Mycobacterium tuberculosis H37Rv
agguugccgaaguuu

SEQ ID NO: 3241978 - RNA, 19 nt, Mycobacterium tuberculosis H37Rv
agguugccgcaccagucgc

SEQ ID NO: 3241979 - RNA, 17 nt, Mycobacterium tuberculosis H37Rv
agguugccuuggcggcc

SEQ ID NO: 3241980 - RNA, 16 nt, Mycobacterium tuberculosis H37Rv
agguugcguugcagga

SEQ ID NO: 3241981 - RNA, 14 nt, Mycobacterium tuberculosis H37Rv
agguugggaacagc

SEQ ID NO: 3241982 - RNA, 19 nt, Mycobacterium tuberculosis H37Rv
agguugggaacagccuauu

SEQ ID NO: 3241983 - RNA, 17 nt, Mycobacterium tuberculosis H37Rv
agguugggccgguugau

SEQ ID NO: 3241984 - RNA, 20 nt, Mycobacterium tuberculosis H37Rv
agguuggugcucagcggcuc

SEQ ID NO: 3241985 - RNA, 16 nt, Mycobacterium tuberculosis H37Rv
aguaaccguccgcgga

SEQ ID NO: 3241986 - RNA, 23 nt, Mycobacterium tuberculosis H37Rv
aguaacggugaugacacgcgcug

SEQ ID NO: 3241987 - RNA, 22 nt, Mycobacterium tuberculosis H37Rv
aguaagcgaacagcggcacgau

SEQ ID NO: 3241988 - RNA, 12 nt, Mycobacterium tuberculosis H37Rv
aguaaguccucg

SEQ ID NO: 3241989 - RNA, 21 nt, Mycobacterium tuberculosis H37Rv
aguaaucgaccgaacgccagg

SEQ ID NO: 3241990 - RNA, 15 nt, Mycobacterium tuberculosis H37Rv
aguacacggcggccc

SEQ ID NO: 3241991 - RNA, 18 nt, Mycobacterium tuberculosis H37Rv
aguaccccucgcacaaug

SEQ ID NO: 3241992 - RNA, 12 nt, Mycobacterium tuberculosis H37Rv
aguacggcaggc

SEQ ID NO: 3241993 - RNA, 20 nt, Mycobacterium tuberculosis H37Rv
aguacucgcgcagguagcca

SEQ ID NO: 3241994 - RNA, 20 nt, Mycobacterium tuberculosis H37Rv
aguacuggaauggcucacgc

SEQ ID NO: 3241995 - RNA, 19 nt, Mycobacterium tuberculosis H37Rv
aguacuggcguugccaccg

SEQ ID NO: 3241996 - RNA, 15 nt, Mycobacterium tuberculosis H37Rv
aguagaacuucgcca

SEQ ID NO: 3241997 - RNA, 17 nt, Mycobacterium tuberculosis H37Rv
aguagcacguugacguc

SEQ ID NO: 3241998 - RNA, 15 nt, Mycobacterium tuberculosis H37Rv
aguagcccgcgucga

SEQ ID NO: 3241999 - RNA, 23 nt, Mycobacterium tuberculosis H37Rv
aguagccgaccaggaccaccgca

SEQ ID NO: 3242000 - RNA, 13 nt, Mycobacterium tuberculosis H37Rv
aguagccggucgg

SEQ ID NO: 3242001 - RNA, 21 nt, Mycobacterium tuberculosis H37Rv
aguagccggucggcaccacca

SEQ ID NO: 3242002 - RNA, 14 nt, Mycobacterium tuberculosis H37Rv
aguagccguagccg

SEQ ID NO: 3242003 - RNA, 18 nt, Mycobacterium tuberculosis H37Rv
aguagccguagccgccgu

SEQ ID NO: 3242004 - RNA, 11 nt, Mycobacterium tuberculosis H37Rv
aguagcugacc

SEQ ID NO: 3242005 - RNA, 14 nt, Mycobacterium tuberculosis H37Rv
aguagcugaccauc

SEQ ID NO: 3242006 - RNA, 15 nt, Mycobacterium tuberculosis H37Rv
aguagcugcggucga

SEQ ID NO: 3242007 - RNA, 22 nt, Mycobacterium tuberculosis H37Rv
aguaggccaccacugcgcccgc

SEQ ID NO: 3242008 - RNA, 20 nt, Mycobacterium tuberculosis H37Rv
aguagugaucgaucgcggcg

SEQ ID NO: 3242009 - RNA, 15 nt, Mycobacterium tuberculosis H37Rv
aguagugcaggugcc

SEQ ID NO: 3242010 - RNA, 23 nt, Mycobacterium tuberculosis H37Rv
aguaguggccgccacccgcaacu

SEQ ID NO: 3242011 - RNA, 16 nt, Mycobacterium tuberculosis H37Rv
aguaguggugggcgug

SEQ ID NO: 3242012 - RNA, 15 nt, Mycobacterium tuberculosis H37Rv
aguauggccgccacc

SEQ ID NO: 3242013 - RNA, 19 nt, Mycobacterium tuberculosis H37Rv
agucaaacaaccgugaacu

SEQ ID NO: 3242014 - RNA, 20 nt, Mycobacterium tuberculosis H37Rv
agucuccggcgucggcggcc

SEQ ID NO: 3242015 - RNA, 14 nt, Mycobacterium tuberculosis H37Rv
agucuggcgguauc

SEQ ID NO: 3242016 - RNA, 17 nt, Mycobacterium tuberculosis H37Rv
agucuuucgcuucgccc

SEQ ID NO: 3242017 - RNA, 18 nt, Mycobacterium tuberculosis H37Rv
agugaaaguucaugccau

SEQ ID NO: 3242018 - RNA, 19 nt, Mycobacterium tuberculosis H37Rv
agugaaauccgagccgcga

SEQ ID NO: 3242019 - RNA, 22 nt, Mycobacterium tuberculosis H37Rv
agugaaguuguuggccagaccg

SEQ ID NO: 3242020 - RNA, 19 nt, Mycobacterium tuberculosis H37Rv
agugaaucgcggaugccag

SEQ ID NO: 3242021 - RNA, 15 nt, Mycobacterium tuberculosis H37Rv
agugacgccacgacc

SEQ ID NO: 3242022 - RNA, 13 nt, Mycobacterium tuberculosis H37Rv
agugacgccucga

SEQ ID NO: 3242023 - RNA, 21 nt, Mycobacterium tuberculosis H37Rv
agugacgccucgacacccagc

SEQ ID NO: 3242024 - RNA, 20 nt, Mycobacterium tuberculosis H37Rv
agugacgggacccggguggu

SEQ ID NO: 3242025 - RNA, 23 nt, Mycobacterium tuberculosis H37Rv
agugacucaccgugaaccgcccg

SEQ ID NO: 3242026 - RNA, 19 nt, Mycobacterium tuberculosis H37Rv
agugacugguauuucccuu

SEQ ID NO: 3242027 - RNA, 20 nt, Mycobacterium tuberculosis H37Rv
agugagcaugcgacgucagg

SEQ ID NO: 3242028 - RNA, 18 nt, Mycobacterium tuberculosis H37Rv
agugaggccgaccagcac

SEQ ID NO: 3242029 - RNA, 18 nt, Mycobacterium tuberculosis H37Rv
agugaggcugugccccag

SEQ ID NO: 3242030 - RNA, 14 nt, Mycobacterium tuberculosis H37Rv
agugaucaccaacc

SEQ ID NO: 3242031 - RNA, 22 nt, Mycobacterium tuberculosis H37Rv
agugauggcgcggucgcugaug

SEQ ID NO: 3242032 - RNA, 17 nt, Mycobacterium tuberculosis H37Rv
agugcacgaaguccugg

SEQ ID NO: 3242033 - RNA, 21 nt, Mycobacterium tuberculosis H37Rv
agugcagacaggcggcggccu

SEQ ID NO: 3242034 - RNA, 15 nt, Mycobacterium tuberculosis H37Rv
agugcagcgaucccg

SEQ ID NO: 3242035 - RNA, 19 nt, Mycobacterium tuberculosis H37Rv
agugcagcgaucccggcaa

SEQ ID NO: 3242036 - RNA, 15 nt, Mycobacterium tuberculosis H37Rv
agugcagcucgauac

SEQ ID NO: 3242037 - RNA, 14 nt, Mycobacterium tuberculosis H37Rv
agugcaggcggccg

SEQ ID NO: 3242038 - RNA, 16 nt, Mycobacterium tuberculosis H37Rv
agugcaggcggccgcc

SEQ ID NO: 3242039 - RNA, 12 nt, Mycobacterium tuberculosis H37Rv
agugcagggcug

SEQ ID NO: 3242040 - RNA, 16 nt, Mycobacterium tuberculosis H37Rv
agugcaggugcccggc

SEQ ID NO: 3242041 - RNA, 22 nt, Mycobacterium tuberculosis H37Rv
agugcaggugcccggccaaaau

SEQ ID NO: 3242042 - RNA, 22 nt, Mycobacterium tuberculosis H37Rv
agugccaauuccagccccccgg

SEQ ID NO: 3242043 - RNA, 13 nt, Mycobacterium tuberculosis H37Rv
agugccagguggg

SEQ ID NO: 3242044 - RNA, 17 nt, Mycobacterium tuberculosis H37Rv
agugccaguccgauggu

SEQ ID NO: 3242045 - RNA, 16 nt, Mycobacterium tuberculosis H37Rv
agugcccggccaacca

SEQ ID NO: 3242046 - RNA, 14 nt, Mycobacterium tuberculosis H37Rv
agugccgccggcca

SEQ ID NO: 3242047 - RNA, 16 nt, Mycobacterium tuberculosis H37Rv
agugccgccgucgcca

SEQ ID NO: 3242048 - RNA, 18 nt, Mycobacterium tuberculosis H37Rv
agugccgugucgaguggc

SEQ ID NO: 3242049 - RNA, 17 nt, Mycobacterium tuberculosis H37Rv
agugcgaaauugcuugg

SEQ ID NO: 3242050 - RNA, 21 nt, Mycobacterium tuberculosis H37Rv
agugcgaaauugcuuggccgc

SEQ ID NO: 3242051 - RNA, 23 nt, Mycobacterium tuberculosis H37Rv
agugcgaacucaucgugguaacc

SEQ ID NO: 3242052 - RNA, 20 nt, Mycobacterium tuberculosis H37Rv
agugcgacucugcgucugcu

SEQ ID NO: 3242053 - RNA, 22 nt, Mycobacterium tuberculosis H37Rv
agugcgacugcgaaugcugggc

SEQ ID NO: 3242054 - RNA, 18 nt, Mycobacterium tuberculosis H37Rv
agugcgcggaucaacagg

SEQ ID NO: 3242055 - RNA, 20 nt, Mycobacterium tuberculosis H37Rv
agugcgcgugcccgugguga

SEQ ID NO: 3242056 - RNA, 22 nt, Mycobacterium tuberculosis H37Rv
agugcggacaucguugacccgg

SEQ ID NO: 3242057 - RNA, 14 nt, Mycobacterium tuberculosis H37Rv
agugcggcaccgcc

SEQ ID NO: 3242058 - RNA, 15 nt, Mycobacterium tuberculosis H37Rv
agugcggcagcggug

SEQ ID NO: 3242059 - RNA, 17 nt, Mycobacterium tuberculosis H37Rv
agugcggccuuggcgac

SEQ ID NO: 3242060 - RNA, 17 nt, Mycobacterium tuberculosis H37Rv
agugcggcugcaacgau

SEQ ID NO: 3242061 - RNA, 19 nt, Mycobacterium tuberculosis H37Rv
agugcgggcaugccggcga

SEQ ID NO: 3242062 - RNA, 23 nt, Mycobacterium tuberculosis H37Rv
agugcgggccgugacccucagca

SEQ ID NO: 3242063 - RNA, 22 nt, Mycobacterium tuberculosis H37Rv
agugcggugagauggcggugag

SEQ ID NO: 3242064 - RNA, 19 nt, Mycobacterium tuberculosis H37Rv
agugcgugauggcggcgca

SEQ ID NO: 3242065 - RNA, 12 nt, Mycobacterium tuberculosis H37Rv
agugcugcaccg

SEQ ID NO: 3242066 - RNA, 20 nt, Mycobacterium tuberculosis H37Rv
agugcuggccgaagaacuca

SEQ ID NO: 3242067 - RNA, 13 nt, Mycobacterium tuberculosis H37Rv
agugcuucuuccc

SEQ ID NO: 3242068 - RNA, 19 nt, Mycobacterium tuberculosis H37Rv
agugcuuuggguccgggcg

SEQ ID NO: 3242069 - RNA, 11 nt, Mycobacterium tuberculosis H37Rv
aguggaagccg

SEQ ID NO: 3242070 - RNA, 18 nt, Mycobacterium tuberculosis H37Rv
aguggacgugucaucacg

SEQ ID NO: 3242071 - RNA, 19 nt, Mycobacterium tuberculosis H37Rv
aguggagccccgacugcug

SEQ ID NO: 3242072 - RNA, 15 nt, Mycobacterium tuberculosis H37Rv
aguggagggcccggc

SEQ ID NO: 3242073 - RNA, 18 nt, Mycobacterium tuberculosis H37Rv
aguggcagccagcggcga

SEQ ID NO: 3242074 - RNA, 15 nt, Mycobacterium tuberculosis H37Rv
aguggccaccaucac

SEQ ID NO: 3242075 - RNA, 13 nt, Mycobacterium tuberculosis H37Rv
aguggccgccacc

SEQ ID NO: 3242076 - RNA, 21 nt, Mycobacterium tuberculosis H37Rv
aguggccucguccagcucggu

SEQ ID NO: 3242077 - RNA, 16 nt, Mycobacterium tuberculosis H37Rv
aguggcgacgagcaac

SEQ ID NO: 3242078 - RNA, 16 nt, Mycobacterium tuberculosis H37Rv
aguggcgaucugcugc

SEQ ID NO: 3242079 - RNA, 15 nt, Mycobacterium tuberculosis H37Rv
aguggcgcaccaccu

SEQ ID NO: 3242080 - RNA, 21 nt, Mycobacterium tuberculosis H37Rv
aguggcgcaccaccuccccga

SEQ ID NO: 3242081 - RNA, 16 nt, Mycobacterium tuberculosis H37Rv
aguggcgccagggccu

SEQ ID NO: 3242082 - RNA, 19 nt, Mycobacterium tuberculosis H37Rv
aguggcgcccauggccacc

SEQ ID NO: 3242083 - RNA, 20 nt, Mycobacterium tuberculosis H37Rv
aguggcgcgcggcgccgcaa

SEQ ID NO: 3242084 - RNA, 22 nt, Mycobacterium tuberculosis H37Rv
aguggcguuacgcucggcgaac

SEQ ID NO: 3242085 - RNA, 16 nt, Mycobacterium tuberculosis H37Rv
aguggcucgcucugcg

SEQ ID NO: 3242086 - RNA, 17 nt, Mycobacterium tuberculosis H37Rv
agugggacuggcgugaa

SEQ ID NO: 3242087 - RNA, 20 nt, Mycobacterium tuberculosis H37Rv
agugggaugaccuuggccgu

SEQ ID NO: 3242088 - RNA, 19 nt, Mycobacterium tuberculosis H37Rv
agugggcaauccggucagc

SEQ ID NO: 3242089 - RNA, 20 nt, Mycobacterium tuberculosis H37Rv
agugggcgguaccucgucga

SEQ ID NO: 3242090 - RNA, 20 nt, Mycobacterium tuberculosis H37Rv
agugggcuuuugcgucugcu

SEQ ID NO: 3242091 - RNA, 13 nt, Mycobacterium tuberculosis H37Rv
aguggggugcggg

SEQ ID NO: 3242092 - RNA, 14 nt, Mycobacterium tuberculosis H37Rv
agugggugccggca

SEQ ID NO: 3242093 - RNA, 23 nt, Mycobacterium tuberculosis H37Rv
aguggucccguucgcccgcccgu

SEQ ID NO: 3242094 - RNA, 22 nt, Mycobacterium tuberculosis H37Rv
aguggucggcccgcucaccuug

SEQ ID NO: 3242095 - RNA, 20 nt, Mycobacterium tuberculosis H37Rv
aguggugaccgacgcggaca

SEQ ID NO: 3242096 - RNA, 23 nt, Mycobacterium tuberculosis H37Rv
aguggugaccgacgcggacagga

SEQ ID NO: 3242097 - RNA, 16 nt, Mycobacterium tuberculosis H37Rv
agugguuagucggccu

SEQ ID NO: 3242098 - RNA, 17 nt, Mycobacterium tuberculosis H37Rv
agugguuagucggccug

SEQ ID NO: 3242099 - RNA, 21 nt, Mycobacterium tuberculosis H37Rv
agugucagcaagaucggcagc

SEQ ID NO: 3242100 - RNA, 15 nt, Mycobacterium tuberculosis H37Rv
agugucggcgucugu

SEQ ID NO: 3242101 - RNA, 15 nt, Mycobacterium tuberculosis H37Rv
agugucguaggcgau

SEQ ID NO: 3242102 - RNA, 19 nt, Mycobacterium tuberculosis H37Rv
agugucuccggcaacagca

SEQ ID NO: 3242103 - RNA, 20 nt, Mycobacterium tuberculosis H37Rv
agugucuccggcaacagcac

SEQ ID NO: 3242104 - RNA, 14 nt, Mycobacterium tuberculosis H37Rv
agugugaacugucc

SEQ ID NO: 3242105 - RNA, 16 nt, Mycobacterium tuberculosis H37Rv
agugugacggcggcca

SEQ ID NO: 3242106 - RNA, 20 nt, Mycobacterium tuberculosis H37Rv
agugugagcagacccagucc

SEQ ID NO: 3242107 - RNA, 18 nt, Mycobacterium tuberculosis H37Rv
aguguggcgaugaccacg

SEQ ID NO: 3242108 - RNA, 14 nt, Mycobacterium tuberculosis H37Rv
aguguguuuggugg

SEQ ID NO: 3242109 - RNA, 15 nt, Mycobacterium tuberculosis H37Rv
aguguguuugguggu

SEQ ID NO: 3242110 - RNA, 21 nt, Mycobacterium tuberculosis H37Rv
auagcgcucgaacucggcggc

SEQ ID NO: 3242111 - RNA, 18 nt, Mycobacterium tuberculosis H37Rv
auagcggcaaagccgggu

SEQ ID NO: 3242112 - RNA, 18 nt, Mycobacterium tuberculosis H37Rv
auagcugccggcccacca

SEQ ID NO: 3242113 - RNA, 14 nt, Mycobacterium tuberculosis H37Rv
auaggaagguugaa

SEQ ID NO: 3242114 - RNA, 15 nt, Mycobacterium tuberculosis H37Rv
auaggcaccaaggua

SEQ ID NO: 3242115 - RNA, 16 nt, Mycobacterium tuberculosis H37Rv
auaggccgggcagugc

SEQ ID NO: 3242116 - RNA, 13 nt, Mycobacterium tuberculosis H37Rv
auagggcugguau

SEQ ID NO: 3242117 - RNA, 14 nt, Mycobacterium tuberculosis H37Rv
auaggugaacgcug

SEQ ID NO: 3242118 - RNA, 21 nt, Mycobacterium tuberculosis H37Rv
auagguguguggcgccgggga

SEQ ID NO: 3242119 - RNA, 20 nt, Mycobacterium tuberculosis H37Rv
auaucagugaaggaauacgc

SEQ ID NO: 3242120 - RNA, 23 nt, Mycobacterium tuberculosis H37Rv
auaucgccgagaaccagcgaaau

SEQ ID NO: 3242121 - RNA, 14 nt, Mycobacterium tuberculosis H37Rv
auaucgccuaacag

SEQ ID NO: 3242122 - RNA, 16 nt, Mycobacterium tuberculosis H37Rv
auaucggcacggucac

SEQ ID NO: 3242123 - RNA, 23 nt, Mycobacterium tuberculosis H37Rv
auaucggcacggucacacgccag

SEQ ID NO: 3242124 - RNA, 22 nt, Mycobacterium tuberculosis H37Rv
auaucgucgggcgucccggcgg

SEQ ID NO: 3242125 - RNA, 14 nt, Mycobacterium tuberculosis H37Rv
auaucuugcgcaug

SEQ ID NO: 3242126 - RNA, 21 nt, Mycobacterium tuberculosis H37Rv
auaugcgugagcugcucgagc

SEQ ID NO: 3242127 - RNA, 17 nt, Mycobacterium tuberculosis H37Rv
auauggaccgccgccga

SEQ ID NO: 3242128 - RNA, 13 nt, Mycobacterium tuberculosis H37Rv
auauggaucaacg

SEQ ID NO: 3242129 - RNA, 16 nt, Mycobacterium tuberculosis H37Rv
auauucgcugggcgca

SEQ ID NO: 3242130 - RNA, 11 nt, Mycobacterium tuberculosis H37Rv
auauugccauc

SEQ ID NO: 3242131 - RNA, 17 nt, Mycobacterium tuberculosis H37Rv
aucaaacccccggggcg

SEQ ID NO: 3242132 - RNA, 14 nt, Mycobacterium tuberculosis H37Rv
aucaaagccagcac

SEQ ID NO: 3242133 - RNA, 17 nt, Mycobacterium tuberculosis H37Rv
aucaaagucggcgucac

SEQ ID NO: 3242134 - RNA, 19 nt, Mycobacterium tuberculosis H37Rv
aucaacaacagccgcagcc

SEQ ID NO: 3242135 - RNA, 18 nt, Mycobacterium tuberculosis H37Rv
aucaacaggaccgggauc

SEQ ID NO: 3242136 - RNA, 14 nt, Mycobacterium tuberculosis H37Rv
aucaacaggcgucc

SEQ ID NO: 3242137 - RNA, 18 nt, Mycobacterium tuberculosis H37Rv
aucaaccgcugucaccgu

SEQ ID NO: 3242138 - RNA, 14 nt, Mycobacterium tuberculosis H37Rv
aucaacgacaccag

SEQ ID NO: 3242139 - RNA, 17 nt, Mycobacterium tuberculosis H37Rv
aucaacgacaccagauc

SEQ ID NO: 3242140 - RNA, 20 nt, Mycobacterium tuberculosis H37Rv
aucaacgcaaugccaaucgc

SEQ ID NO: 3242141 - RNA, 16 nt, Mycobacterium tuberculosis H37Rv
aucaacgcgucgcccg

SEQ ID NO: 3242142 - RNA, 18 nt, Mycobacterium tuberculosis H37Rv
aucaacgcgucgcccgca

SEQ ID NO: 3242143 - RNA, 19 nt, Mycobacterium tuberculosis H37Rv
aucaacgcguugcacagca

SEQ ID NO: 3242144 - RNA, 20 nt, Mycobacterium tuberculosis H37Rv
aucaacucgggcagcgcggc

SEQ ID NO: 3242145 - RNA, 21 nt, Mycobacterium tuberculosis H37Rv
aucaacuuccgcagcgccacc

SEQ ID NO: 3242146 - RNA, 14 nt, Mycobacterium tuberculosis H37Rv
aucaagcacagccc

SEQ ID NO: 3242147 - RNA, 15 nt, Mycobacterium tuberculosis H37Rv
aucaagcacagcccg

SEQ ID NO: 3242148 - RNA, 19 nt, Mycobacterium tuberculosis H37Rv
aucaagccuucgucgaugc

SEQ ID NO: 3242149 - RNA, 13 nt, Mycobacterium tuberculosis H37Rv
aucaaggccaccu

SEQ ID NO: 3242150 - RNA, 14 nt, Mycobacterium tuberculosis H37Rv
aucaaggccggucc

SEQ ID NO: 3242151 - RNA, 14 nt, Mycobacterium tuberculosis H37Rv
aucaagggggucga

SEQ ID NO: 3242152 - RNA, 17 nt, Mycobacterium tuberculosis H37Rv
aucaaugcggucccucc

SEQ ID NO: 3242153 - RNA, 20 nt, Mycobacterium tuberculosis H37Rv
aucaaugcugcguccuggau

SEQ ID NO: 3242154 - RNA, 16 nt, Mycobacterium tuberculosis H37Rv
aucacaccauuggcca

SEQ ID NO: 3242155 - RNA, 15 nt, Mycobacterium tuberculosis H37Rv
aucacaccccaggca

SEQ ID NO: 3242156 - RNA, 13 nt, Mycobacterium tuberculosis H37Rv
aucacaucaaagu

SEQ ID NO: 3242157 - RNA, 14 nt, Mycobacterium tuberculosis H37Rv
aucacaucaaaguc

SEQ ID NO: 3242158 - RNA, 23 nt, Mycobacterium tuberculosis H37Rv
aucacaucggccucugaccagcc

SEQ ID NO: 3242159 - RNA, 17 nt, Mycobacterium tuberculosis H37Rv
aucaccaccggcaccgc

SEQ ID NO: 3242160 - RNA, 12 nt, Mycobacterium tuberculosis H37Rv
aucaccagaaau

SEQ ID NO: 3242161 - RNA, 18 nt, Mycobacterium tuberculosis H37Rv
aucaccaugaucagcgcc

SEQ ID NO: 3242162 - RNA, 15 nt, Mycobacterium tuberculosis H37Rv
aucaccgaacggcga

SEQ ID NO: 3242163 - RNA, 21 nt, Mycobacterium tuberculosis H37Rv
aucaccgaacggcgaggugcc

SEQ ID NO: 3242164 - RNA, 23 nt, Mycobacterium tuberculosis H37Rv
aucaccgccuuugccgccggcac

SEQ ID NO: 3242165 - RNA, 22 nt, Mycobacterium tuberculosis H37Rv
aucaccgcgccagccuccacca

SEQ ID NO: 3242166 - RNA, 11 nt, Mycobacterium tuberculosis H37Rv
aucaccgcgcu

SEQ ID NO: 3242167 - RNA, 17 nt, Mycobacterium tuberculosis H37Rv
aucaccggaacccccag

SEQ ID NO: 3242168 - RNA, 18 nt, Mycobacterium tuberculosis H37Rv
aucaccggcauacagccg

SEQ ID NO: 3242169 - RNA, 21 nt, Mycobacterium tuberculosis H37Rv
aucaccgggguugcccgcgac

SEQ ID NO: 3242170 - RNA, 18 nt, Mycobacterium tuberculosis H37Rv
aucaccgguucggugagc

SEQ ID NO: 3242171 - RNA, 12 nt, Mycobacterium tuberculosis H37Rv
aucaccgucgac

SEQ ID NO: 3242172 - RNA, 15 nt, Mycobacterium tuberculosis H37Rv
aucaccgucgacagc

SEQ ID NO: 3242173 - RNA, 22 nt, Mycobacterium tuberculosis H37Rv
aucaccgucguacucggcggcc

SEQ ID NO: 3242174 - RNA, 18 nt, Mycobacterium tuberculosis H37Rv
aucaccucaccagucagg

SEQ ID NO: 3242175 - RNA, 20 nt, Mycobacterium tuberculosis H37Rv
aucaccuggcgugucgccgc

SEQ ID NO: 3242176 - RNA, 14 nt, Mycobacterium tuberculosis H37Rv
aucacgacuccccc

SEQ ID NO: 3242177 - RNA, 12 nt, Mycobacterium tuberculosis H37Rv
aucacgaucaca

SEQ ID NO: 3242178 - RNA, 18 nt, Mycobacterium tuberculosis H37Rv
aucacgauguccucgaug

SEQ ID NO: 3242179 - RNA, 20 nt, Mycobacterium tuberculosis H37Rv
aucacgcacugaugucaccc

SEQ ID NO: 3242180 - RNA, 17 nt, Mycobacterium tuberculosis H37Rv
aucacgccgucgcagag

SEQ ID NO: 3242181 - RNA, 14 nt, Mycobacterium tuberculosis H37Rv
aucacggcaccgaa

SEQ ID NO: 3242182 - RNA, 18 nt, Mycobacterium tuberculosis H37Rv
aucacggcaccgaagugc

SEQ ID NO: 3242183 - RNA, 20 nt, Mycobacterium tuberculosis H37Rv
aucacggcgggaugcagcug

SEQ ID NO: 3242184 - RNA, 18 nt, Mycobacterium tuberculosis H37Rv
aucacgggcuaccggcag

SEQ ID NO: 3242185 - RNA, 21 nt, Mycobacterium tuberculosis H37Rv
aucacgggcuaccggcagcug

SEQ ID NO: 3242186 - RNA, 23 nt, Mycobacterium tuberculosis H37Rv
aucacgggcuaccggcagcugcu

SEQ ID NO: 3242187 - RNA, 13 nt, Mycobacterium tuberculosis H37Rv
aucacggucagcc

SEQ ID NO: 3242188 - RNA, 23 nt, Mycobacterium tuberculosis H37Rv
aucacggugggcgccgacaccgg

SEQ ID NO: 3242189 - RNA, 14 nt, Mycobacterium tuberculosis H37Rv
aucacgucggcguu

SEQ ID NO: 3242190 - RNA, 17 nt, Mycobacterium tuberculosis H37Rv
aucacgucgucagccac

SEQ ID NO: 3242191 - RNA, 16 nt, Mycobacterium tuberculosis H37Rv
aucacguggaccacgg

SEQ ID NO: 3242192 - RNA, 22 nt, Mycobacterium tuberculosis H37Rv
aucacuaaccuggcguagauca

SEQ ID NO: 3242193 - RNA, 22 nt, Mycobacterium tuberculosis H37Rv
aucacucacccgggcagccugc

SEQ ID NO: 3242194 - RNA, 18 nt, Mycobacterium tuberculosis H37Rv
aucacucccccacacacc

SEQ ID NO: 3242195 - RNA, 14 nt, Mycobacterium tuberculosis H37Rv
aucacuguuccggg

SEQ ID NO: 3242196 - RNA, 19 nt, Mycobacterium tuberculosis H37Rv
aucacuuucgaagaaccgc

SEQ ID NO: 3242197 - RNA, 13 nt, Mycobacterium tuberculosis H37Rv
aucagaacgugac

SEQ ID NO: 3242198 - RNA, 14 nt, Mycobacterium tuberculosis H37Rv
aucagaaucaggcu

SEQ ID NO: 3242199 - RNA, 22 nt, Mycobacterium tuberculosis H37Rv
aucagaaucaggcucgccgaug

SEQ ID NO: 3242200 - RNA, 20 nt, Mycobacterium tuberculosis H37Rv
aucagaccaaugaccgccag

SEQ ID NO: 3242201 - RNA, 19 nt, Mycobacterium tuberculosis H37Rv
aucagacggcgaguaggcg

SEQ ID NO: 3242202 - RNA, 20 nt, Mycobacterium tuberculosis H37Rv
aucagagcguucuucagcca

SEQ ID NO: 3242203 - RNA, 21 nt, Mycobacterium tuberculosis H37Rv
aucagagcguucuucagccag

SEQ ID NO: 3242204 - RNA, 22 nt, Mycobacterium tuberculosis H37Rv
aucagagcguucuucagccagg

SEQ ID NO: 3242205 - RNA, 16 nt, Mycobacterium tuberculosis H37Rv
aucagauucgcgcugg

SEQ ID NO: 3242206 - RNA, 13 nt, Mycobacterium tuberculosis H37Rv
auccccuggccag

SEQ ID NO: 3242207 - RNA, 17 nt, Mycobacterium tuberculosis H37Rv
auccccuggccagcaga

SEQ ID NO: 3242208 - RNA, 17 nt, Mycobacterium tuberculosis H37Rv
aucccgaaccguucgcu

SEQ ID NO: 3242209 - RNA, 19 nt, Mycobacterium tuberculosis H37Rv
aucccgaaguagaagccca

SEQ ID NO: 3242210 - RNA, 20 nt, Mycobacterium tuberculosis H37Rv
aucccgaaucucacccacau

SEQ ID NO: 3242211 - RNA, 15 nt, Mycobacterium tuberculosis H37Rv
aucccgaccagcaga

SEQ ID NO: 3242212 - RNA, 18 nt, Mycobacterium tuberculosis H37Rv
aucccgacgaagguggca

SEQ ID NO: 3242213 - RNA, 17 nt, Mycobacterium tuberculosis H37Rv
aucccgaucccggccag

SEQ ID NO: 3242214 - RNA, 19 nt, Mycobacterium tuberculosis H37Rv
aucccgaucgaucagcaac

SEQ ID NO: 3242215 - RNA, 14 nt, Mycobacterium tuberculosis H37Rv
aucccgaugcuggc

SEQ ID NO: 3242216 - RNA, 20 nt, Mycobacterium tuberculosis H37Rv
aucccgccacaccaacgucg

SEQ ID NO: 3242217 - RNA, 17 nt, Mycobacterium tuberculosis H37Rv
aucccgccgaucgaacc

SEQ ID NO: 3242218 - RNA, 20 nt, Mycobacterium tuberculosis H37Rv
aucccgcggccgggccgcug

SEQ ID NO: 3242219 - RNA, 20 nt, Mycobacterium tuberculosis H37Rv
aucccgcucccccgccaacc

SEQ ID NO: 3242220 - RNA, 13 nt, Mycobacterium tuberculosis H37Rv
aucccggaccgau

SEQ ID NO: 3242221 - RNA, 13 nt, Mycobacterium tuberculosis H37Rv
aucccggccaggc

SEQ ID NO: 3242222 - RNA, 16 nt, Mycobacterium tuberculosis H37Rv
aucccggccgcucagc

SEQ ID NO: 3242223 - RNA, 20 nt, Mycobacterium tuberculosis H37Rv
aucccggccuccauaucgca

SEQ ID NO: 3242224 - RNA, 18 nt, Mycobacterium tuberculosis H37Rv
aucccgggcaguccaggc

SEQ ID NO: 3242225 - RNA, 17 nt, Mycobacterium tuberculosis H37Rv
aucccgggccguccggc

SEQ ID NO: 3242226 - RNA, 23 nt, Mycobacterium tuberculosis H37Rv
aucccggucgguguggacugggc

SEQ ID NO: 3242227 - RNA, 17 nt, Mycobacterium tuberculosis H37Rv
aucccgguggcagcaca

SEQ ID NO: 3242228 - RNA, 21 nt, Mycobacterium tuberculosis H37Rv
aucccguagccgugccaauga

SEQ ID NO: 3242229 - RNA, 20 nt, Mycobacterium tuberculosis H37Rv
aucccguucagcgaccaaug

SEQ ID NO: 3242230 - RNA, 16 nt, Mycobacterium tuberculosis H37Rv
aucccugugccagcag

SEQ ID NO: 3242231 - RNA, 22 nt, Mycobacterium tuberculosis H37Rv
aucccugugccagcagcagcgc

SEQ ID NO: 3242232 - RNA, 17 nt, Mycobacterium tuberculosis H37Rv
auccgaagagccagcaa

SEQ ID NO: 3242233 - RNA, 21 nt, Mycobacterium tuberculosis H37Rv
auccgacaagcugucggcgac

SEQ ID NO: 3242234 - RNA, 17 nt, Mycobacterium tuberculosis H37Rv
auccgacagcagccggu

SEQ ID NO: 3242235 - RNA, 13 nt, Mycobacterium tuberculosis H37Rv
auccgaccacucc

SEQ ID NO: 3242236 - RNA, 19 nt, Mycobacterium tuberculosis H37Rv
auccgaccugcucgauacg

SEQ ID NO: 3242237 - RNA, 12 nt, Mycobacterium tuberculosis H37Rv
auccgacgaacc

SEQ ID NO: 3242238 - RNA, 14 nt, Mycobacterium tuberculosis H37Rv
auccgacgaaccgg

SEQ ID NO: 3242239 - RNA, 16 nt, Mycobacterium tuberculosis H37Rv
auccgacgaaccggga

SEQ ID NO: 3242240 - RNA, 20 nt, Mycobacterium tuberculosis H37Rv
auccgacgaccgcauugaac

SEQ ID NO: 3242241 - RNA, 13 nt, Mycobacterium tuberculosis H37Rv
auccgaucgccgc

SEQ ID NO: 3242242 - RNA, 16 nt, Mycobacterium tuberculosis H37Rv
auccgcacagcgacga

SEQ ID NO: 3242243 - RNA, 20 nt, Mycobacterium tuberculosis H37Rv
auccgcaccacgcccgacga

SEQ ID NO: 3242244 - RNA, 17 nt, Mycobacterium tuberculosis H37Rv
auccgcaccagccgcca

SEQ ID NO: 3242245 - RNA, 22 nt, Mycobacterium tuberculosis H37Rv
auccgcaccccauacucggcgg

SEQ ID NO: 3242246 - RNA, 19 nt, Mycobacterium tuberculosis H37Rv
auccgcaccgaaaccaugc

SEQ ID NO: 3242247 - RNA, 16 nt, Mycobacterium tuberculosis H37Rv
auccgcacgcaaugcg

SEQ ID NO: 3242248 - RNA, 23 nt, Mycobacterium tuberculosis H37Rv
auccgcagugagcaaugccaacg

SEQ ID NO: 3242249 - RNA, 13 nt, Mycobacterium tuberculosis H37Rv
auccgccagaccg

SEQ ID NO: 3242250 - RNA, 19 nt, Mycobacterium tuberculosis H37Rv
auccgccgcccccgcccgu

SEQ ID NO: 3242251 - RNA, 12 nt, Mycobacterium tuberculosis H37Rv
auccgccgccgg

SEQ ID NO: 3242252 - RNA, 13 nt, Mycobacterium tuberculosis H37Rv
auccgcgaucggc

SEQ ID NO: 3242253 - RNA, 20 nt, Mycobacterium tuberculosis H37Rv
auccgcgcgcauauccgcag

SEQ ID NO: 3242254 - RNA, 22 nt, Mycobacterium tuberculosis H37Rv
auccgcggcaugcaaugcuggc

SEQ ID NO: 3242255 - RNA, 16 nt, Mycobacterium tuberculosis H37Rv
auccgcggcgaucacc

SEQ ID NO: 3242256 - RNA, 19 nt, Mycobacterium tuberculosis H37Rv
auccgcgguuggcaguggc

SEQ ID NO: 3242257 - RNA, 22 nt, Mycobacterium tuberculosis H37Rv
auccgcguggugcugaccgcgc

SEQ ID NO: 3242258 - RNA, 17 nt, Mycobacterium tuberculosis H37Rv
auccgcucacccgcccg

SEQ ID NO: 3242259 - RNA, 13 nt, Mycobacterium tuberculosis H37Rv
auccggaaccggu

SEQ ID NO: 3242260 - RNA, 20 nt, Mycobacterium tuberculosis H37Rv
auccggaauagcaacgcugc

SEQ ID NO: 3242261 - RNA, 17 nt, Mycobacterium tuberculosis H37Rv
auccggacggugucagc

SEQ ID NO: 3242262 - RNA, 16 nt, Mycobacterium tuberculosis H37Rv
auccggaucccaccac

SEQ ID NO: 3242263 - RNA, 14 nt, Mycobacterium tuberculosis H37Rv
auccggaucggccu

SEQ ID NO: 3242264 - RNA, 17 nt, Mycobacterium tuberculosis H37Rv
auccggcaaccaccggc

SEQ ID NO: 3242265 - RNA, 15 nt, Mycobacterium tuberculosis H37Rv
auccggcagaccggu

SEQ ID NO: 3242266 - RNA, 15 nt, Mycobacterium tuberculosis H37Rv
auccggcccaccggu

SEQ ID NO: 3242267 - RNA, 23 nt, Mycobacterium tuberculosis H37Rv
auccggccgccaacuucaccacc

SEQ ID NO: 3242268 - RNA, 14 nt, Mycobacterium tuberculosis H37Rv
auccggcuccaccc

SEQ ID NO: 3242269 - RNA, 17 nt, Mycobacterium tuberculosis H37Rv
auccgggacgugucggu

SEQ ID NO: 3242270 - RNA, 22 nt, Mycobacterium tuberculosis H37Rv
auccgggcaaccgaugacgcgu

SEQ ID NO: 3242271 - RNA, 14 nt, Mycobacterium tuberculosis H37Rv
auccgggccgccgc

SEQ ID NO: 3242272 - RNA, 18 nt, Mycobacterium tuberculosis H37Rv
auccgguaggccaucugc

SEQ ID NO: 3242273 - RNA, 14 nt, Mycobacterium tuberculosis H37Rv
auccgguccaccgc

SEQ ID NO: 3242274 - RNA, 19 nt, Mycobacterium tuberculosis H37Rv
auccggucgaugaccucgu

SEQ ID NO: 3242275 - RNA, 20 nt, Mycobacterium tuberculosis H37Rv
auccggucgaugaccucguc

SEQ ID NO: 3242276 - RNA, 21 nt, Mycobacterium tuberculosis H37Rv
auccggucgaugaccucguca

SEQ ID NO: 3242277 - RNA, 17 nt, Mycobacterium tuberculosis H37Rv
auccggucgcucgaugg

SEQ ID NO: 3242278 - RNA, 16 nt, Mycobacterium tuberculosis H37Rv
auccggucucggccga

SEQ ID NO: 3242279 - RNA, 14 nt, Mycobacterium tuberculosis H37Rv
auccggugaugacc

SEQ ID NO: 3242280 - RNA, 16 nt, Mycobacterium tuberculosis H37Rv
auccggugcccgcacc

SEQ ID NO: 3242281 - RNA, 18 nt, Mycobacterium tuberculosis H37Rv
auccggugucgcgaucgc

SEQ ID NO: 3242282 - RNA, 15 nt, Mycobacterium tuberculosis H37Rv
auccgguguugagau

SEQ ID NO: 3242283 - RNA, 20 nt, Mycobacterium tuberculosis H37Rv
auccgguguugagaucgccc

SEQ ID NO: 3242284 - RNA, 23 nt, Mycobacterium tuberculosis H37Rv
auccgguuaugcgguacccgaug

SEQ ID NO: 3242285 - RNA, 17 nt, Mycobacterium tuberculosis H37Rv
auccgguuauggcaagc

SEQ ID NO: 3242286 - RNA, 15 nt, Mycobacterium tuberculosis H37Rv
auccguacaguccac

SEQ ID NO: 3242287 - RNA, 16 nt, Mycobacterium tuberculosis H37Rv
auccguaggaacccga

SEQ ID NO: 3242288 - RNA, 22 nt, Mycobacterium tuberculosis H37Rv
auccgucaaguggcaaccgcac

SEQ ID NO: 3242289 - RNA, 21 nt, Mycobacterium tuberculosis H37Rv
auccgugaauggcagcacgac

SEQ ID NO: 3242290 - RNA, 20 nt, Mycobacterium tuberculosis H37Rv
auccgugccgaaaaucgcag

SEQ ID NO: 3242291 - RNA, 22 nt, Mycobacterium tuberculosis H37Rv
auccgugccgaaaaucgcagcc

SEQ ID NO: 3242292 - RNA, 13 nt, Mycobacterium tuberculosis H37Rv
auccgugucgaga

SEQ ID NO: 3242293 - RNA, 18 nt, Mycobacterium tuberculosis H37Rv
auccgugugucuugaccu

SEQ ID NO: 3242294 - RNA, 15 nt, Mycobacterium tuberculosis H37Rv
auccuccucgucgac

SEQ ID NO: 3242295 - RNA, 22 nt, Mycobacterium tuberculosis H37Rv
auccuccucgucgacgucggca

SEQ ID NO: 3242296 - RNA, 18 nt, Mycobacterium tuberculosis H37Rv
auccuccugcgccgcagu

SEQ ID NO: 3242297 - RNA, 20 nt, Mycobacterium tuberculosis H37Rv
auccucgaugacaucgguca

SEQ ID NO: 3242298 - RNA, 18 nt, Mycobacterium tuberculosis H37Rv
auccucgauggaccgcca

SEQ ID NO: 3242299 - RNA, 13 nt, Mycobacterium tuberculosis H37Rv
auccucucgauca

SEQ ID NO: 3242300 - RNA, 15 nt, Mycobacterium tuberculosis H37Rv
auccugaccagccag

SEQ ID NO: 3242301 - RNA, 19 nt, Mycobacterium tuberculosis H37Rv
auccugcagcucgggcagg

SEQ ID NO: 3242302 - RNA, 18 nt, Mycobacterium tuberculosis H37Rv
aucgcccagugugcgccg

SEQ ID NO: 3242303 - RNA, 17 nt, Mycobacterium tuberculosis H37Rv
aucgcccauuucggcac

SEQ ID NO: 3242304 - RNA, 21 nt, Mycobacterium tuberculosis H37Rv
aucgcccgaguugaagaagcc

SEQ ID NO: 3242305 - RNA, 14 nt, Mycobacterium tuberculosis H37Rv
aucgcccgaugcgc

SEQ ID NO: 3242306 - RNA, 16 nt, Mycobacterium tuberculosis H37Rv
aucgcccggccccgca

SEQ ID NO: 3242307 - RNA, 23 nt, Mycobacterium tuberculosis H37Rv
aucgcccgggcgggauccaccca

SEQ ID NO: 3242308 - RNA, 20 nt, Mycobacterium tuberculosis H37Rv
aucgcccgguucagcgcugg

SEQ ID NO: 3242309 - RNA, 23 nt, Mycobacterium tuberculosis H37Rv
aucgcccucgucgcgggccaccg

SEQ ID NO: 3242310 - RNA, 19 nt, Mycobacterium tuberculosis H37Rv
aucgcccugacacccaucg

SEQ ID NO: 3242311 - RNA, 21 nt, Mycobacterium tuberculosis H37Rv
aucgcccugggcgccggcguc

SEQ ID NO: 3242312 - RNA, 14 nt, Mycobacterium tuberculosis H37Rv
aucgccgaaucggc

SEQ ID NO: 3242313 - RNA, 21 nt, Mycobacterium tuberculosis H37Rv
aucgccgaccucgaacggggu

SEQ ID NO: 3242314 - RNA, 15 nt, Mycobacterium tuberculosis H37Rv
aucgccgacgccaga

SEQ ID NO: 3242315 - RNA, 20 nt, Mycobacterium tuberculosis H37Rv
aucgccgacgccagaacgug

SEQ ID NO: 3242316 - RNA, 22 nt, Mycobacterium tuberculosis H37Rv
aucgccgacgccagaacguggc

SEQ ID NO: 3242317 - RNA, 22 nt, Mycobacterium tuberculosis H37Rv
aucgccgacgcccaggcauggc

SEQ ID NO: 3242318 - RNA, 16 nt, Mycobacterium tuberculosis H37Rv
aucgccgagaccgcgu

SEQ ID NO: 3242319 - RNA, 22 nt, Mycobacterium tuberculosis H37Rv
aucgccgaggcagcgucgucga

SEQ ID NO: 3242320 - RNA, 23 nt, Mycobacterium tuberculosis H37Rv
aucgccgccaaccacuuuccggc

SEQ ID NO: 3242321 - RNA, 14 nt, Mycobacterium tuberculosis H37Rv
aucgccgcccccgu

SEQ ID NO: 3242322 - RNA, 11 nt, Mycobacterium tuberculosis H37Rv
aucgccgccgg

SEQ ID NO: 3242323 - RNA, 17 nt, Mycobacterium tuberculosis H37Rv
aucgccgcuacgccggc

SEQ ID NO: 3242324 - RNA, 18 nt, Mycobacterium tuberculosis H37Rv
aucgccggcggccaccag

SEQ ID NO: 3242325 - RNA, 18 nt, Mycobacterium tuberculosis H37Rv
aucgccgucagcaccgcu

SEQ ID NO: 3242326 - RNA, 12 nt, Mycobacterium tuberculosis H37Rv
aucgccuccucg

SEQ ID NO: 3242327 - RNA, 15 nt, Mycobacterium tuberculosis H37Rv
aucgccuccucgacg

SEQ ID NO: 3242328 - RNA, 18 nt, Mycobacterium tuberculosis H37Rv
aucgccuccucgacgucg

SEQ ID NO: 3242329 - RNA, 13 nt, Mycobacterium tuberculosis H37Rv
aucgccucggcgc

SEQ ID NO: 3242330 - RNA, 20 nt, Mycobacterium tuberculosis H37Rv
aucgccucggcguaggcgau

SEQ ID NO: 3242331 - RNA, 15 nt, Mycobacterium tuberculosis H37Rv
aucgccugccacagc

SEQ ID NO: 3242332 - RNA, 20 nt, Mycobacterium tuberculosis H37Rv
aucgccugcgccuuggucgc

SEQ ID NO: 3242333 - RNA, 16 nt, Mycobacterium tuberculosis H37Rv
aucgccuggaugccga

SEQ ID NO: 3242334 - RNA, 22 nt, Mycobacterium tuberculosis H37Rv
aucgcgaaacagcuugcugcgc

SEQ ID NO: 3242335 - RNA, 21 nt, Mycobacterium tuberculosis H37Rv
aucgcgaagucguccagaaug

SEQ ID NO: 3242336 - RNA, 18 nt, Mycobacterium tuberculosis H37Rv
aucgcgaauauagcggcg

SEQ ID NO: 3242337 - RNA, 22 nt, Mycobacterium tuberculosis H37Rv
aucgcgacgaugccccgguuga

SEQ ID NO: 3242338 - RNA, 23 nt, Mycobacterium tuberculosis H37Rv
aucgcgacggggucgcgaugcuc

SEQ ID NO: 3242339 - RNA, 20 nt, Mycobacterium tuberculosis H37Rv
aucgcgagaaggugcugcgc

SEQ ID NO: 3242340 - RNA, 24 nt, Mycobacterium tuberculosis H37Rv
aucgcgaucggggcgacgauccgc

SEQ ID NO: 3242341 - RNA, 18 nt, Mycobacterium tuberculosis H37Rv
aucgcgcccugcggaucg

SEQ ID NO: 3242342 - RNA, 16 nt, Mycobacterium tuberculosis H37Rv
aucgcgccgucggcga

SEQ ID NO: 3242343 - RNA, 18 nt, Mycobacterium tuberculosis H37Rv
aucgcgccgucggcgaug

SEQ ID NO: 3242344 - RNA, 16 nt, Mycobacterium tuberculosis H37Rv
aucgcgccuauccaaa

SEQ ID NO: 3242345 - RNA, 12 nt, Mycobacterium tuberculosis H37Rv
aucgcgcgagcg

SEQ ID NO: 3242346 - RNA, 17 nt, Mycobacterium tuberculosis H37Rv
aucgcgcggcugugccc

SEQ ID NO: 3242347 - RNA, 23 nt, Mycobacterium tuberculosis H37Rv
aucgcggcaucgacgcggccaac

SEQ ID NO: 3242348 - RNA, 20 nt, Mycobacterium tuberculosis H37Rv
aucgcggcgaacaucaccgu

SEQ ID NO: 3242349 - RNA, 16 nt, Mycobacterium tuberculosis H37Rv
aucgcggcgcccagga

SEQ ID NO: 3242350 - RNA, 17 nt, Mycobacterium tuberculosis H37Rv
aucgcggcgcccaggaa

SEQ ID NO: 3242351 - RNA, 19 nt, Mycobacterium tuberculosis H37Rv
aucgcggcggccuccacca

SEQ ID NO: 3242352 - RNA, 21 nt, Mycobacterium tuberculosis H37Rv
aucgcgggcggcgcuggcguc

SEQ ID NO: 3242353 - RNA, 18 nt, Mycobacterium tuberculosis H37Rv
aucgcgggcgugccgacc

SEQ ID NO: 3242354 - RNA, 19 nt, Mycobacterium tuberculosis H37Rv
aucgcggucagcgggucga

SEQ ID NO: 3242355 - RNA, 16 nt, Mycobacterium tuberculosis H37Rv
aucgcgguccaacagc

SEQ ID NO: 3242356 - RNA, 19 nt, Mycobacterium tuberculosis H37Rv
aucgcggugggccccgauc

SEQ ID NO: 3242357 - RNA, 14 nt, Mycobacterium tuberculosis H37Rv
aucgcggugugccg

SEQ ID NO: 3242358 - RNA, 18 nt, Mycobacterium tuberculosis H37Rv
aucgcguacguacugcuu

SEQ ID NO: 3242359 - RNA, 18 nt, Mycobacterium tuberculosis H37Rv
aucgcgucgagagaacgu

SEQ ID NO: 3242360 - RNA, 15 nt, Mycobacterium tuberculosis H37Rv
aucgcgucggcgaug

SEQ ID NO: 3242361 - RNA, 20 nt, Mycobacterium tuberculosis H37Rv
aucgcgucggcgaugaacag

SEQ ID NO: 3242362 - RNA, 19 nt, Mycobacterium tuberculosis H37Rv
aucgcguggcgcaccaccg

SEQ ID NO: 3242363 - RNA, 19 nt, Mycobacterium tuberculosis H37Rv
aucgcguuguaggcuucca

SEQ ID NO: 3242364 - RNA, 17 nt, Mycobacterium tuberculosis H37Rv
aucgcuaggaccgcggu

SEQ ID NO: 3242365 - RNA, 19 nt, Mycobacterium tuberculosis H37Rv
aucgcuccgcggcgcagca

SEQ ID NO: 3242366 - RNA, 22 nt, Mycobacterium tuberculosis H37Rv
aucgcugaccgcguagaccagu

SEQ ID NO: 3242367 - RNA, 13 nt, Mycobacterium tuberculosis H37Rv
aucgcugccagcg

SEQ ID NO: 3242368 - RNA, 14 nt, Mycobacterium tuberculosis H37Rv
aucgcugccgccga

SEQ ID NO: 3242369 - RNA, 14 nt, Mycobacterium tuberculosis H37Rv
aucgcuucgagcau

SEQ ID NO: 3242370 - RNA, 14 nt, Mycobacterium tuberculosis H37Rv
aucgcuugaacgca

SEQ ID NO: 3242371 - RNA, 19 nt, Mycobacterium tuberculosis H37Rv
aucggacagcgccuggccg

SEQ ID NO: 3242372 - RNA, 19 nt, Mycobacterium tuberculosis H37Rv
aucggacagguaacgcggu

SEQ ID NO: 3242373 - RNA, 22 nt, Mycobacterium tuberculosis H37Rv
aucggacucggaauucggcguc

SEQ ID NO: 3242374 - RNA, 13 nt, Mycobacterium tuberculosis H37Rv
aucggagucuuca

SEQ ID NO: 3242375 - RNA, 20 nt, Mycobacterium tuberculosis H37Rv
aucggauacccagccggccu

SEQ ID NO: 3242376 - RNA, 14 nt, Mycobacterium tuberculosis H37Rv
aucggauggccccc

SEQ ID NO: 3242377 - RNA, 15 nt, Mycobacterium tuberculosis H37Rv
aucggauggcggcca

SEQ ID NO: 3242378 - RNA, 22 nt, Mycobacterium tuberculosis H37Rv
aucggcaagacgcggucgacga

SEQ ID NO: 3242379 - RNA, 22 nt, Mycobacterium tuberculosis H37Rv
aucggcacaggcggccagcauc

SEQ ID NO: 3242380 - RNA, 12 nt, Mycobacterium tuberculosis H37Rv
aucggcaccccg

SEQ ID NO: 3242381 - RNA, 14 nt, Mycobacterium tuberculosis H37Rv
aucggcaccgugcg

SEQ ID NO: 3242382 - RNA, 13 nt, Mycobacterium tuberculosis H37Rv
aucggcagcagcg

SEQ ID NO: 3242383 - RNA, 15 nt, Mycobacterium tuberculosis H37Rv
aucggcagcagcgca

SEQ ID NO: 3242384 - RNA, 12 nt, Mycobacterium tuberculosis H37Rv
aucggcagcagg

SEQ ID NO: 3242385 - RNA, 15 nt, Mycobacterium tuberculosis H37Rv
aucggcagccccugc

SEQ ID NO: 3242386 - RNA, 18 nt, Mycobacterium tuberculosis H37Rv
aucggcaggguggccagc

SEQ ID NO: 3242387 - RNA, 19 nt, Mycobacterium tuberculosis H37Rv
aucggcaggguggccagca

SEQ ID NO: 3242388 - RNA, 21 nt, Mycobacterium tuberculosis H37Rv
aucggcaggguggccagcagg

SEQ ID NO: 3242389 - RNA, 20 nt, Mycobacterium tuberculosis H37Rv
aucggcagucccagcgccgc

SEQ ID NO: 3242390 - RNA, 22 nt, Mycobacterium tuberculosis H37Rv
aucggcagucccagcgccgcac

SEQ ID NO: 3242391 - RNA, 19 nt, Mycobacterium tuberculosis H37Rv
aucggcccagcccuucagc

SEQ ID NO: 3242392 - RNA, 18 nt, Mycobacterium tuberculosis H37Rv
aucggcccccaacgcggu

SEQ ID NO: 3242393 - RNA, 22 nt, Mycobacterium tuberculosis H37Rv
aucggcccccaagcucugcguc

SEQ ID NO: 3242394 - RNA, 20 nt, Mycobacterium tuberculosis H37Rv
aucggccccgaaacgauggc

SEQ ID NO: 3242395 - RNA, 18 nt, Mycobacterium tuberculosis H37Rv
aucggcccgugccacagc

SEQ ID NO: 3242396 - RNA, 21 nt, Mycobacterium tuberculosis H37Rv
aucggccgguauuucggcgac

SEQ ID NO: 3242397 - RNA, 16 nt, Mycobacterium tuberculosis H37Rv
aucguugccucgucgc

SEQ ID NO: 3242398 - RNA, 19 nt, Mycobacterium tuberculosis H37Rv
aucguugccucgucgccgc

SEQ ID NO: 3242399 - RNA, 17 nt, Mycobacterium tuberculosis H37Rv
aucguuggccaugccac

SEQ ID NO: 3242400 - RNA, 14 nt, Mycobacterium tuberculosis H37Rv
aucguuggcgacca

SEQ ID NO: 3242401 - RNA, 21 nt, Mycobacterium tuberculosis H37Rv
aucguuggcgaucgcgaucgc

SEQ ID NO: 3242402 - RNA, 18 nt, Mycobacterium tuberculosis H37Rv
aucuagaggcggcccccg

SEQ ID NO: 3242403 - RNA, 20 nt, Mycobacterium tuberculosis H37Rv
aucuagaugcggaacgccga

SEQ ID NO: 3242404 - RNA, 14 nt, Mycobacterium tuberculosis H37Rv
aucuauggaugacc

SEQ ID NO: 3242405 - RNA, 20 nt, Mycobacterium tuberculosis H37Rv
aucucaccgggcccgacgac

SEQ ID NO: 3242406 - RNA, 18 nt, Mycobacterium tuberculosis H37Rv
aucuccaccgucgccgcc

SEQ ID NO: 3242407 - RNA, 18 nt, Mycobacterium tuberculosis H37Rv
aucuccccgaccgcgccc

SEQ ID NO: 3242408 - RNA, 17 nt, Mycobacterium tuberculosis H37Rv
aucuccccguccugcca

SEQ ID NO: 3242409 - RNA, 16 nt, Mycobacterium tuberculosis H37Rv
aucucccgaaucgugc

SEQ ID NO: 3242410 - RNA, 17 nt, Mycobacterium tuberculosis H37Rv
aucuccgccaaccgggu

SEQ ID NO: 3242411 - RNA, 16 nt, Mycobacterium tuberculosis H37Rv
aucuccgcgucgguca

SEQ ID NO: 3242412 - RNA, 21 nt, Mycobacterium tuberculosis H37Rv
aucuccggcggaucugggcuu

SEQ ID NO: 3242413 - RNA, 20 nt, Mycobacterium tuberculosis H37Rv
aucuccggcuggcccaccuc

SEQ ID NO: 3242414 - RNA, 17 nt, Mycobacterium tuberculosis H37Rv
aucuccgucggccaggc

SEQ ID NO: 3242415 - RNA, 18 nt, Mycobacterium tuberculosis H37Rv
aucuccuccaccagugcc

SEQ ID NO: 3242416 - RNA, 22 nt, Mycobacterium tuberculosis H37Rv
aucuccuccugugcgaugguca

SEQ ID NO: 3242417 - RNA, 23 nt, Mycobacterium tuberculosis H37Rv
aucuccuccuugagccgggcaac

SEQ ID NO: 3242418 - RNA, 18 nt, Mycobacterium tuberculosis H37Rv
aucuccucgccugcccga

SEQ ID NO: 3242419 - RNA, 16 nt, Mycobacterium tuberculosis H37Rv
aucuccucuugcacca

SEQ ID NO: 3242420 - RNA, 21 nt, Mycobacterium tuberculosis H37Rv
aucuccuuggccguucggcgc

SEQ ID NO: 3242421 - RNA, 21 nt, Mycobacterium tuberculosis H37Rv
aucucgaaggccgccaaccgu

SEQ ID NO: 3242422 - RNA, 17 nt, Mycobacterium tuberculosis H37Rv
aucucgaccagcgccga

SEQ ID NO: 3242423 - RNA, 18 nt, Mycobacterium tuberculosis H37Rv
aucucgaccagcgccgau

SEQ ID NO: 3242424 - RNA, 23 nt, Mycobacterium tuberculosis H37Rv
aucucgacggccucgucgauguu

SEQ ID NO: 3242425 - RNA, 14 nt, Mycobacterium tuberculosis H37Rv
aucucgaucaucau

SEQ ID NO: 3242426 - RNA, 19 nt, Mycobacterium tuberculosis H37Rv
aucucgauguacagcggga

SEQ ID NO: 3242427 - RNA, 14 nt, Mycobacterium tuberculosis H37Rv
aucucgcccaccuc

SEQ ID NO: 3242428 - RNA, 18 nt, Mycobacterium tuberculosis H37Rv
aucucgccggcgaagacc

SEQ ID NO: 3242429 - RNA, 12 nt, Mycobacterium tuberculosis H37Rv
aucucggcaagg

SEQ ID NO: 3242430 - RNA, 13 nt, Mycobacterium tuberculosis H37Rv
aucucggccagga

SEQ ID NO: 3242431 - RNA, 13 nt, Mycobacterium tuberculosis H37Rv
aucucggcggcca

SEQ ID NO: 3242432 - RNA, 17 nt, Mycobacterium tuberculosis H37Rv
aucucggcggccgcgug

SEQ ID NO: 3242433 - RNA, 23 nt, Mycobacterium tuberculosis H37Rv
aucucggcggccgcgugcucgcc

SEQ ID NO: 3242434 - RNA, 20 nt, Mycobacterium tuberculosis H37Rv
aucucggugaccucaccaac

SEQ ID NO: 3242435 - RNA, 15 nt, Mycobacterium tuberculosis H37Rv
aucucgguggacggc

SEQ ID NO: 3242436 - RNA, 16 nt, Mycobacterium tuberculosis H37Rv
aucucguagccgccgu

SEQ ID NO: 3242437 - RNA, 23 nt, Mycobacterium tuberculosis H37Rv
aucucguagccgccgucgccggu

SEQ ID NO: 3242438 - RNA, 13 nt, Mycobacterium tuberculosis H37Rv
aucucguccagau

SEQ ID NO: 3242439 - RNA, 15 nt, Mycobacterium tuberculosis H37Rv
aucucuugcaaccug

SEQ ID NO: 3242440 - RNA, 14 nt, Mycobacterium tuberculosis H37Rv
aucugacggcgccg

SEQ ID NO: 3242441 - RNA, 14 nt, Mycobacterium tuberculosis H37Rv
aucugaucggcgcg

SEQ ID NO: 3242442 - RNA, 19 nt, Mycobacterium tuberculosis H37Rv
aucugcagcacucgguguc

SEQ ID NO: 3242443 - RNA, 14 nt, Mycobacterium tuberculosis H37Rv
aucugcaggcccag

SEQ ID NO: 3242444 - RNA, 23 nt, Mycobacterium tuberculosis H37Rv
aucugcgccaucacaucggccuc

SEQ ID NO: 3242445 - RNA, 19 nt, Mycobacterium tuberculosis H37Rv
aucugcgcgaggggccggc

SEQ ID NO: 3242446 - RNA, 19 nt, Mycobacterium tuberculosis H37Rv
aucugcgcgucaggccagc

SEQ ID NO: 3242447 - RNA, 18 nt, Mycobacterium tuberculosis H37Rv
aucugcgggccggugaac

SEQ ID NO: 3242448 - RNA, 17 nt, Mycobacterium tuberculosis H37Rv
aucugcgggucggcauc

SEQ ID NO: 3242449 - RNA, 23 nt, Mycobacterium tuberculosis H37Rv
aucugcuccucggucagcggggu

SEQ ID NO: 3242450 - RNA, 18 nt, Mycobacterium tuberculosis H37Rv
aucugcucgcguagcgca

SEQ ID NO: 3242451 - RNA, 21 nt, Mycobacterium tuberculosis H37Rv
aucugcucgcguagcgcagga

SEQ ID NO: 3242452 - RNA, 13 nt, Mycobacterium tuberculosis H37Rv
aucugcugcagcg

SEQ ID NO: 3242453 - RNA, 16 nt, Mycobacterium tuberculosis H37Rv
aucugcugcucgauca

SEQ ID NO: 3242454 - RNA, 18 nt, Mycobacterium tuberculosis H37Rv
aucugcuggccgaaccgg

SEQ ID NO: 3242455 - RNA, 18 nt, Mycobacterium tuberculosis H37Rv
aucugcugggcaagaucg

SEQ ID NO: 3242456 - RNA, 15 nt, Mycobacterium tuberculosis H37Rv
aucugcuuggugacc

SEQ ID NO: 3242457 - RNA, 20 nt, Mycobacterium tuberculosis H37Rv
aucuggaugucccaugcacg

SEQ ID NO: 3242458 - RNA, 16 nt, Mycobacterium tuberculosis H37Rv
aucuggccuuggcagu

SEQ ID NO: 3242459 - RNA, 21 nt, Mycobacterium tuberculosis H37Rv
aucuggcgcugcuggcagacc

SEQ ID NO: 3242460 - RNA, 22 nt, Mycobacterium tuberculosis H37Rv
aucuggcguagugcucgccggc

SEQ ID NO: 3242461 - RNA, 18 nt, Mycobacterium tuberculosis H37Rv
aucuggcuccggccaggg

SEQ ID NO: 3242462 - RNA, 18 nt, Mycobacterium tuberculosis H37Rv
aucuggcuggugauggcc

SEQ ID NO: 3242463 - RNA, 23 nt, Mycobacterium tuberculosis H37Rv
aucugguaagucagcucgaucac

SEQ ID NO: 3242464 - RNA, 15 nt, Mycobacterium tuberculosis H37Rv
aucuggucaagaccc

SEQ ID NO: 3242465 - RNA, 21 nt, Mycobacterium tuberculosis H37Rv
aucuggucacgguucgcccgu

SEQ ID NO: 3242466 - RNA, 14 nt, Mycobacterium tuberculosis H37Rv
aucugguccagugg

SEQ ID NO: 3242467 - RNA, 21 nt, Mycobacterium tuberculosis H37Rv
aucugguccagugggaugacc

SEQ ID NO: 3242468 - RNA, 20 nt, Mycobacterium tuberculosis H37Rv
aucugguugaaccgguacaa

SEQ ID NO: 3242469 - RNA, 15 nt, Mycobacterium tuberculosis H37Rv
aucuguaaccuccuc

SEQ ID NO: 3242470 - RNA, 16 nt, Mycobacterium tuberculosis H37Rv
aucuguaaccuccucg

SEQ ID NO: 3242471 - RNA, 13 nt, Mycobacterium tuberculosis H37Rv
aucuguccgcgaa

SEQ ID NO: 3242472 - RNA, 22 nt, Mycobacterium tuberculosis H37Rv
aucuguuugggcaucucggcua

SEQ ID NO: 3242473 - RNA, 15 nt, Mycobacterium tuberculosis H37Rv
aucuucaccacgccg

SEQ ID NO: 3242474 - RNA, 18 nt, Mycobacterium tuberculosis H37Rv
aucuucggacgccagcuc

SEQ ID NO: 3242475 - RNA, 16 nt, Mycobacterium tuberculosis H37Rv
aucuucuucagguagc

SEQ ID NO: 3242476 - RNA, 20 nt, Mycobacterium tuberculosis H37Rv
aucuucuucagguagcggcc

SEQ ID NO: 3242477 - RNA, 15 nt, Mycobacterium tuberculosis H37Rv
aucuugccggccagc

SEQ ID NO: 3242478 - RNA, 19 nt, Mycobacterium tuberculosis H37Rv
aucuugccgucggccggca

SEQ ID NO: 3242479 - RNA, 22 nt, Mycobacterium tuberculosis H37Rv
aucuugcgacgcccgccuucga

SEQ ID NO: 3242480 - RNA, 17 nt, Mycobacterium tuberculosis H37Rv
aucuugcggcagcgaaa

SEQ ID NO: 3242481 - RNA, 21 nt, Mycobacterium tuberculosis H37Rv
aucuuggagaagguuucccgc

SEQ ID NO: 3242482 - RNA, 12 nt, Mycobacterium tuberculosis H37Rv
aucuuggccacc

SEQ ID NO: 3242483 - RNA, 22 nt, Mycobacterium tuberculosis H37Rv
aucuuggcgcgguccuccagau

SEQ ID NO: 3242484 - RNA, 14 nt, Mycobacterium tuberculosis H37Rv
aucuugggccacgc

SEQ ID NO: 3242485 - RNA, 21 nt, Mycobacterium tuberculosis H37Rv
aucuuggucuugaacccgauc

SEQ ID NO: 3242486 - RNA, 13 nt, Mycobacterium tuberculosis H37Rv
aucuugucgaucu

SEQ ID NO: 3242487 - RNA, 14 nt, Mycobacterium tuberculosis H37Rv
aucuugugccaggc

SEQ ID NO: 3242488 - RNA, 20 nt, Mycobacterium tuberculosis H37Rv
aucuuuucaccaccucgguu

SEQ ID NO: 3242489 - RNA, 14 nt, Mycobacterium tuberculosis H37Rv
augaacagcgacgc

SEQ ID NO: 3242490 - RNA, 22 nt, Mycobacterium tuberculosis H37Rv
augaacagcgacgccaugguca

SEQ ID NO: 3242491 - RNA, 17 nt, Mycobacterium tuberculosis H37Rv
augaaccacggcaggca

SEQ ID NO: 3242492 - RNA, 15 nt, Mycobacterium tuberculosis H37Rv
augaaccaggcggcc

SEQ ID NO: 3242493 - RNA, 15 nt, Mycobacterium tuberculosis H37Rv
augcaggacucgcgu

SEQ ID NO: 3242494 - RNA, 16 nt, Mycobacterium tuberculosis H37Rv
augcagugacagugcg

SEQ ID NO: 3242495 - RNA, 15 nt, Mycobacterium tuberculosis H37Rv
augcaguuccuugcc

SEQ ID NO: 3242496 - RNA, 16 nt, Mycobacterium tuberculosis H37Rv
augcauccagcugcug

SEQ ID NO: 3242497 - RNA, 17 nt, Mycobacterium tuberculosis H37Rv
augcauggcuugcucug

SEQ ID NO: 3242498 - RNA, 20 nt, Mycobacterium tuberculosis H37Rv
augccaagcuccaaccaugc

SEQ ID NO: 3242499 - RNA, 12 nt, Mycobacterium tuberculosis H37Rv
augccacacacu

SEQ ID NO: 3242500 - RNA, 15 nt, Mycobacterium tuberculosis H37Rv
augccacagaccgaa

SEQ ID NO: 3242501 - RNA, 16 nt, Mycobacterium tuberculosis H37Rv
augccacagcggcgau

SEQ ID NO: 3242502 - RNA, 16 nt, Mycobacterium tuberculosis H37Rv
augccacccagaugca

SEQ ID NO: 3242503 - RNA, 14 nt, Mycobacterium tuberculosis H37Rv
augccaccgagcaa

SEQ ID NO: 3242504 - RNA, 20 nt, Mycobacterium tuberculosis H37Rv
augccacuaggaagguggcc

SEQ ID NO: 3242505 - RNA, 18 nt, Mycobacterium tuberculosis H37Rv
augccagaucggccaacu

SEQ ID NO: 3242506 - RNA, 13 nt, Mycobacterium tuberculosis H37Rv
augccagcggcac

SEQ ID NO: 3242507 - RNA, 22 nt, Mycobacterium tuberculosis H37Rv
augccaggacuggcaccgccag

SEQ ID NO: 3242508 - RNA, 14 nt, Mycobacterium tuberculosis H37Rv
augccagucgccga

SEQ ID NO: 3242509 - RNA, 15 nt, Mycobacterium tuberculosis H37Rv
augccagugacaacc

SEQ ID NO: 3242510 - RNA, 19 nt, Mycobacterium tuberculosis H37Rv
augcccacgcugccgcagu

SEQ ID NO: 3242511 - RNA, 22 nt, Mycobacterium tuberculosis H37Rv
augcccgacugaacgucaccgu

SEQ ID NO: 3242512 - RNA, 15 nt, Mycobacterium tuberculosis H37Rv
augcccgcaccgcgu

SEQ ID NO: 3242513 - RNA, 19 nt, Mycobacterium tuberculosis H37Rv
augcccgccaauccgcguc

SEQ ID NO: 3242514 - RNA, 15 nt, Mycobacterium tuberculosis H37Rv
augcccgcggugacc

SEQ ID NO: 3242515 - RNA, 19 nt, Mycobacterium tuberculosis H37Rv
augcccggacgauggcguc

SEQ ID NO: 3242516 - RNA, 20 nt, Mycobacterium tuberculosis H37Rv
augcccggcggguagcucgc

SEQ ID NO: 3242517 - RNA, 19 nt, Mycobacterium tuberculosis H37Rv
augcccuccucgaccgcgg

SEQ ID NO: 3242518 - RNA, 13 nt, Mycobacterium tuberculosis H37Rv
augcccucggcgc

SEQ ID NO: 3242519 - RNA, 21 nt, Mycobacterium tuberculosis H37Rv
augcccugcccgaagguggga

SEQ ID NO: 3242520 - RNA, 15 nt, Mycobacterium tuberculosis H37Rv
augcccugcgcucgg

SEQ ID NO: 3242521 - RNA, 21 nt, Mycobacterium tuberculosis H37Rv
augcccugcgcucgggcugcc

SEQ ID NO: 3242522 - RNA, 18 nt, Mycobacterium tuberculosis H37Rv
augcccuggggguggcag

SEQ ID NO: 3242523 - RNA, 12 nt, Mycobacterium tuberculosis H37Rv
augcccuugaga

SEQ ID NO: 3242524 - RNA, 18 nt, Mycobacterium tuberculosis H37Rv
augcccuugcggaagaag

SEQ ID NO: 3242525 - RNA, 14 nt, Mycobacterium tuberculosis H37Rv
augcccuuggccag

SEQ ID NO: 3242526 - RNA, 17 nt, Mycobacterium tuberculosis H37Rv
augcccuuggccagcag

SEQ ID NO: 3242527 - RNA, 21 nt, Mycobacterium tuberculosis H37Rv
augcccuuggcgauguagccu

SEQ ID NO: 3242528 - RNA, 17 nt, Mycobacterium tuberculosis H37Rv
augccgacgacaacagc

SEQ ID NO: 3242529 - RNA, 22 nt, Mycobacterium tuberculosis H37Rv
augccgacgacaacagccagcu

SEQ ID NO: 3242530 - RNA, 22 nt, Mycobacterium tuberculosis H37Rv
augccgacgacggguuggcguc

SEQ ID NO: 3242531 - RNA, 19 nt, Mycobacterium tuberculosis H37Rv
augccgagaagacuacugc

SEQ ID NO: 3242532 - RNA, 17 nt, Mycobacterium tuberculosis H37Rv
augccgaggaucgcgcc

SEQ ID NO: 3242533 - RNA, 23 nt, Mycobacterium tuberculosis H37Rv
augccgaucggccugcagcgaug

SEQ ID NO: 3242534 - RNA, 16 nt, Mycobacterium tuberculosis H37Rv
augccgaugaccgccu

SEQ ID NO: 3242535 - RNA, 14 nt, Mycobacterium tuberculosis H37Rv
augccgaugcgacg

SEQ ID NO: 3242536 - RNA, 14 nt, Mycobacterium tuberculosis H37Rv
augccgccaaccgc

SEQ ID NO: 3242537 - RNA, 16 nt, Mycobacterium tuberculosis H37Rv
augccgccaaccgcgu

SEQ ID NO: 3242538 - RNA, 17 nt, Mycobacterium tuberculosis H37Rv
augccgccaaccgcgug

SEQ ID NO: 3242539 - RNA, 17 nt, Mycobacterium tuberculosis H37Rv
augccgcccaucacccc

SEQ ID NO: 3242540 - RNA, 10 nt, Mycobacterium tuberculosis H37Rv
augccgccga

SEQ ID NO: 3242541 - RNA, 17 nt, Mycobacterium tuberculosis H37Rv
augccgccgacgggaac

SEQ ID NO: 3242542 - RNA, 10 nt, Mycobacterium tuberculosis H37Rv
augccgccgg

SEQ ID NO: 3242543 - RNA, 16 nt, Mycobacterium tuberculosis H37Rv
augccgccggcaccgc

SEQ ID NO: 3242544 - RNA, 14 nt, Mycobacterium tuberculosis H37Rv
augccgccggcagc

SEQ ID NO: 3242545 - RNA, 23 nt, Mycobacterium tuberculosis H37Rv
augccgccggcagcgcggauguc

SEQ ID NO: 3242546 - RNA, 20 nt, Mycobacterium tuberculosis H37Rv
augccgcggaggcggccagc

SEQ ID NO: 3242547 - RNA, 20 nt, Mycobacterium tuberculosis H37Rv
augccgcggccaguacgucg

SEQ ID NO: 3242548 - RNA, 22 nt, Mycobacterium tuberculosis H37Rv
augccgcgggacaucaccgcag

SEQ ID NO: 3242549 - RNA, 19 nt, Mycobacterium tuberculosis H37Rv
augccgcgguggaugcgau

SEQ ID NO: 3242550 - RNA, 19 nt, Mycobacterium tuberculosis H37Rv
augccgcucggcaaccugc

SEQ ID NO: 3242551 - RNA, 21 nt, Mycobacterium tuberculosis H37Rv
augccggaaagcaucaugccc

SEQ ID NO: 3242552 - RNA, 16 nt, Mycobacterium tuberculosis H37Rv
augccggacagcucgc

SEQ ID NO: 3242553 - RNA, 19 nt, Mycobacterium tuberculosis H37Rv
augccggacgccaugcccg

SEQ ID NO: 3242554 - RNA, 15 nt, Mycobacterium tuberculosis H37Rv
augccggaucgggac

SEQ ID NO: 3242555 - RNA, 12 nt, Mycobacterium tuberculosis H37Rv
augccggcaagc

SEQ ID NO: 3242556 - RNA, 19 nt, Mycobacterium tuberculosis H37Rv
augccggcgccggcccgca

SEQ ID NO: 3242557 - RNA, 17 nt, Mycobacterium tuberculosis H37Rv
augccgggcccgacguu

SEQ ID NO: 3242558 - RNA, 15 nt, Mycobacterium tuberculosis H37Rv
augccggucggcguc

SEQ ID NO: 3242559 - RNA, 16 nt, Mycobacterium tuberculosis H37Rv
augccggugccgggca

SEQ ID NO: 3242560 - RNA, 21 nt, Mycobacterium tuberculosis H37Rv
augccggugccgggcaccacc

SEQ ID NO: 3242561 - RNA, 21 nt, Mycobacterium tuberculosis H37Rv
augccgguguugccgaagccc

SEQ ID NO: 3242562 - RNA, 15 nt, Mycobacterium tuberculosis H37Rv
augccguauagcgca

SEQ ID NO: 3242563 - RNA, 18 nt, Mycobacterium tuberculosis H37Rv
augccgucgccggucagg

SEQ ID NO: 3242564 - RNA, 12 nt, Mycobacterium tuberculosis H37Rv
augccgucguca

SEQ ID NO: 3242565 - RNA, 18 nt, Mycobacterium tuberculosis H37Rv
augccguucaugccaugg

SEQ ID NO: 3242566 - RNA, 12 nt, Mycobacterium tuberculosis H37Rv
augccguucgga

SEQ ID NO: 3242567 - RNA, 20 nt, Mycobacterium tuberculosis H37Rv
augccuagguagucggccuc

SEQ ID NO: 3242568 - RNA, 20 nt, Mycobacterium tuberculosis H37Rv
augccucggcggccucgcug

SEQ ID NO: 3242569 - RNA, 16 nt, Mycobacterium tuberculosis H37Rv
augccugcccaccuuc

SEQ ID NO: 3242570 - RNA, 18 nt, Mycobacterium tuberculosis H37Rv
augccugcccaccuucga

SEQ ID NO: 3242571 - RNA, 16 nt, Mycobacterium tuberculosis H37Rv
augccugcgcgaugcg

SEQ ID NO: 3242572 - RNA, 17 nt, Mycobacterium tuberculosis H37Rv
augccuggaaucgcgga

SEQ ID NO: 3242573 - RNA, 23 nt, Mycobacterium tuberculosis H37Rv
augccuggaaucgcggagccagg

SEQ ID NO: 3242574 - RNA, 20 nt, Mycobacterium tuberculosis H37Rv
augccuucggccaaccaugc

SEQ ID NO: 3242575 - RNA, 20 nt, Mycobacterium tuberculosis H37Rv
augccuugaaacggugucuc

SEQ ID NO: 3242576 - RNA, 18 nt, Mycobacterium tuberculosis H37Rv
augccuugaccgcggucu

SEQ ID NO: 3242577 - RNA, 23 nt, Mycobacterium tuberculosis H37Rv
augccuuugggcuguggccgcgu

SEQ ID NO: 3242578 - RNA, 18 nt, Mycobacterium tuberculosis H37Rv
augcgacagcgcugggcc

SEQ ID NO: 3242579 - RNA, 19 nt, Mycobacterium tuberculosis H37Rv
augcgacgcagaccgucca

SEQ ID NO: 3242580 - RNA, 20 nt, Mycobacterium tuberculosis H37Rv
augcgaucgacgauccacuu

SEQ ID NO: 3242581 - RNA, 12 nt, Mycobacterium tuberculosis H37Rv
augcgaugcggu

SEQ ID NO: 3242582 - RNA, 15 nt, Mycobacterium tuberculosis H37Rv
augcgauucugcguc

SEQ ID NO: 3242583 - RNA, 22 nt, Mycobacterium tuberculosis H37Rv
augcgcaacuucuucagcagcg

SEQ ID NO: 3242584 - RNA, 19 nt, Mycobacterium tuberculosis H37Rv
augcgcaauagaccgcagu

SEQ ID NO: 3242585 - RNA, 17 nt, Mycobacterium tuberculosis H37Rv
augcgcaccagcggcug

SEQ ID NO: 3242586 - RNA, 17 nt, Mycobacterium tuberculosis H37Rv
augcgcaccaguccagc

SEQ ID NO: 3242587 - RNA, 20 nt, Mycobacterium tuberculosis H37Rv
augcgcacucuagccgggug

SEQ ID NO: 3242588 - RNA, 18 nt, Mycobacterium tuberculosis H37Rv
augcgccaggcugaagaa

SEQ ID NO: 3242589 - RNA, 22 nt, Mycobacterium tuberculosis H37Rv
auggccuugcugcgcgauggcc

SEQ ID NO: 3242590 - RNA, 19 nt, Mycobacterium tuberculosis H37Rv
auggcgaacacgucggcca

SEQ ID NO: 3242591 - RNA, 22 nt, Mycobacterium tuberculosis H37Rv
auggcgaccacccccggcaggc

SEQ ID NO: 3242592 - RNA, 16 nt, Mycobacterium tuberculosis H37Rv
auggcgccgcggcugg

SEQ ID NO: 3242593 - RNA, 14 nt, Mycobacterium tuberculosis H37Rv
auggcgccuguccu

SEQ ID NO: 3242594 - RNA, 17 nt, Mycobacterium tuberculosis H37Rv
auggcgccuguccugcg

SEQ ID NO: 3242595 - RNA, 16 nt, Mycobacterium tuberculosis H37Rv
auggcgcgaacgucag

SEQ ID NO: 3242596 - RNA, 21 nt, Mycobacterium tuberculosis H37Rv
auggcgcgagcagacgcagaa

SEQ ID NO: 3242597 - RNA, 20 nt, Mycobacterium tuberculosis H37Rv
auggcgcgcaacguagccag

SEQ ID NO: 3242598 - RNA, 23 nt, Mycobacterium tuberculosis H37Rv
auggcgcggucgcugaugagcuc

SEQ ID NO: 3242599 - RNA, 16 nt, Mycobacterium tuberculosis H37Rv
auggcgcugauggugc

SEQ ID NO: 3242600 - RNA, 23 nt, Mycobacterium tuberculosis H37Rv
auggcgcugauggugcugcggcg

SEQ ID NO: 3242601 - RNA, 24 nt, Mycobacterium tuberculosis H37Rv
auggcgcugggauguucgaucagc

SEQ ID NO: 3242602 - RNA, 24 nt, Mycobacterium tuberculosis H37Rv
auggcggccaccgucagcgcgacc

SEQ ID NO: 3242603 - RNA, 15 nt, Mycobacterium tuberculosis H37Rv
auggcggcgacccgu

SEQ ID NO: 3242604 - RNA, 22 nt, Mycobacterium tuberculosis H37Rv
auggcggcgcguucgucgucgc

SEQ ID NO: 3242605 - RNA, 20 nt, Mycobacterium tuberculosis H37Rv
auggcggucggccugcggca

SEQ ID NO: 3242606 - RNA, 19 nt, Mycobacterium tuberculosis H37Rv
auggcggugcgcagcuugg

SEQ ID NO: 3242607 - RNA, 18 nt, Mycobacterium tuberculosis H37Rv
auggcgucaugaacgauc

SEQ ID NO: 3242608 - RNA, 24 nt, Mycobacterium tuberculosis H37Rv
auggcgucaugaacgaucggacca

SEQ ID NO: 3242609 - RNA, 13 nt, Mycobacterium tuberculosis H37Rv
auggcgucggcca

SEQ ID NO: 3242610 - RNA, 16 nt, Mycobacterium tuberculosis H37Rv
auggcgucggccagga

SEQ ID NO: 3242611 - RNA, 14 nt, Mycobacterium tuberculosis H37Rv
auggcguucugcgc

SEQ ID NO: 3242612 - RNA, 14 nt, Mycobacterium tuberculosis H37Rv
auggcuccgcccag

SEQ ID NO: 3242613 - RNA, 15 nt, Mycobacterium tuberculosis H37Rv
auggcuugcucugcg

SEQ ID NO: 3242614 - RNA, 17 nt, Mycobacterium tuberculosis H37Rv
auggcuuggaccagcgu

SEQ ID NO: 3242615 - RNA, 24 nt, Mycobacterium tuberculosis H37Rv
auggcuuuggccgcuucgggcguc

SEQ ID NO: 3242616 - RNA, 14 nt, Mycobacterium tuberculosis H37Rv
augggacacaaucc

SEQ ID NO: 3242617 - RNA, 22 nt, Mycobacterium tuberculosis H37Rv
augggacacaauccacgucgcg

SEQ ID NO: 3242618 - RNA, 22 nt, Mycobacterium tuberculosis H37Rv
augggaccuugaucgagcaggg

SEQ ID NO: 3242619 - RNA, 19 nt, Mycobacterium tuberculosis H37Rv
augggcagaucgauaccgu

SEQ ID NO: 3242620 - RNA, 15 nt, Mycobacterium tuberculosis H37Rv
augggcagccgcccg

SEQ ID NO: 3242621 - RNA, 17 nt, Mycobacterium tuberculosis H37Rv
augggcagcugguaacc

SEQ ID NO: 3242622 - RNA, 18 nt, Mycobacterium tuberculosis H37Rv
augggcccugcacagcag

SEQ ID NO: 3242623 - RNA, 17 nt, Mycobacterium tuberculosis H37Rv
augggccgguuccucag

SEQ ID NO: 3242624 - RNA, 18 nt, Mycobacterium tuberculosis H37Rv
augggccgguuccucagc

SEQ ID NO: 3242625 - RNA, 18 nt, Mycobacterium tuberculosis H37Rv
augggcgagaaguccggg

SEQ ID NO: 3242626 - RNA, 19 nt, Mycobacterium tuberculosis H37Rv
augggcgauuuugcgucug

SEQ ID NO: 3242627 - RNA, 18 nt, Mycobacterium tuberculosis H37Rv
augggcggacaaaagaac

SEQ ID NO: 3242628 - RNA, 20 nt, Mycobacterium tuberculosis H37Rv
augggcgguuccacgcugcc

SEQ ID NO: 3242629 - RNA, 22 nt, Mycobacterium tuberculosis H37Rv
augggcgguuccacgcugccca

SEQ ID NO: 3242630 - RNA, 19 nt, Mycobacterium tuberculosis H37Rv
augggcucacacauagcga

SEQ ID NO: 3242631 - RNA, 20 nt, Mycobacterium tuberculosis H37Rv
augggcugaggaacgccggc

SEQ ID NO: 3242632 - RNA, 19 nt, Mycobacterium tuberculosis H37Rv
augggcugcgcgucgagca

SEQ ID NO: 3242633 - RNA, 13 nt, Mycobacterium tuberculosis H37Rv
auggggaacgggu

SEQ ID NO: 3242634 - RNA, 15 nt, Mycobacterium tuberculosis H37Rv
auggggccaacaccu

SEQ ID NO: 3242635 - RNA, 22 nt, Mycobacterium tuberculosis H37Rv
auggggcucgaguguggccgaa

SEQ ID NO: 3242636 - RNA, 15 nt, Mycobacterium tuberculosis H37Rv
augggggagccggug

SEQ ID NO: 3242637 - RNA, 21 nt, Mycobacterium tuberculosis H37Rv
auggggucagcucgccagccu

SEQ ID NO: 3242638 - RNA, 15 nt, Mycobacterium tuberculosis H37Rv
augggguuaggagug

SEQ ID NO: 3242639 - RNA, 21 nt, Mycobacterium tuberculosis H37Rv
auggguacccgaucacucgga

SEQ ID NO: 3242640 - RNA, 22 nt, Mycobacterium tuberculosis H37Rv
augggucuggcaggccagcaug

SEQ ID NO: 3242641 - RNA, 18 nt, Mycobacterium tuberculosis H37Rv
augggugagcacgauauu

SEQ ID NO: 3242642 - RNA, 14 nt, Mycobacterium tuberculosis H37Rv
auggguggccagca

SEQ ID NO: 3242643 - RNA, 16 nt, Mycobacterium tuberculosis H37Rv
augggugugcugccac

SEQ ID NO: 3242644 - RNA, 22 nt, Mycobacterium tuberculosis H37Rv
augguaugcccgccguagacca

SEQ ID NO: 3242645 - RNA, 12 nt, Mycobacterium tuberculosis H37Rv
auggucaccgga

SEQ ID NO: 3242646 - RNA, 16 nt, Mycobacterium tuberculosis H37Rv
auggucauccagccag

SEQ ID NO: 3242647 - RNA, 18 nt, Mycobacterium tuberculosis H37Rv
auggucauccagccagca

SEQ ID NO: 3242648 - RNA, 20 nt, Mycobacterium tuberculosis H37Rv
augguccgccagaucucgcg

SEQ ID NO: 3242649 - RNA, 22 nt, Mycobacterium tuberculosis H37Rv
augguccggccgcggaccgcga

SEQ ID NO: 3242650 - RNA, 16 nt, Mycobacterium tuberculosis H37Rv
augguccgggccuauc

SEQ ID NO: 3242651 - RNA, 14 nt, Mycobacterium tuberculosis H37Rv
auggucgacggguu

SEQ ID NO: 3242652 - RNA, 16 nt, Mycobacterium tuberculosis H37Rv
auggucguaggguggg

SEQ ID NO: 3242653 - RNA, 21 nt, Mycobacterium tuberculosis H37Rv
auggucgucauccuggucacc

SEQ ID NO: 3242654 - RNA, 13 nt, Mycobacterium tuberculosis H37Rv
auggucgucgcga

SEQ ID NO: 3242655 - RNA, 17 nt, Mycobacterium tuberculosis H37Rv
auggucgucgcgaucag

SEQ ID NO: 3242656 - RNA, 20 nt, Mycobacterium tuberculosis H37Rv
auggugaaggcaaacaccag

SEQ ID NO: 3242657 - RNA, 21 nt, Mycobacterium tuberculosis H37Rv
auggugaccagcaggccgggc

SEQ ID NO: 3242658 - RNA, 14 nt, Mycobacterium tuberculosis H37Rv
auggugauggggga

SEQ ID NO: 3242659 - RNA, 15 nt, Mycobacterium tuberculosis H37Rv
auggugccgacccgc

SEQ ID NO: 3242660 - RNA, 21 nt, Mycobacterium tuberculosis H37Rv
auggugccggugauggccgac

SEQ ID NO: 3242661 - RNA, 15 nt, Mycobacterium tuberculosis H37Rv
auggugcgccgggcg

SEQ ID NO: 3242662 - RNA, 23 nt, Mycobacterium tuberculosis H37Rv
auggugcucaaggcuucggcggc

SEQ ID NO: 3242663 - RNA, 16 nt, Mycobacterium tuberculosis H37Rv
auggugcugcggcguc

SEQ ID NO: 3242664 - RNA, 15 nt, Mycobacterium tuberculosis H37Rv
augguggccgccacc

SEQ ID NO: 3242665 - RNA, 21 nt, Mycobacterium tuberculosis H37Rv
augguggcgaucaucggcccc

SEQ ID NO: 3242666 - RNA, 21 nt, Mycobacterium tuberculosis H37Rv
augguggcgguuccggccggc

SEQ ID NO: 3242667 - RNA, 22 nt, Mycobacterium tuberculosis H37Rv
auggugggaaaugaaguggcgu

SEQ ID NO: 3242668 - RNA, 18 nt, Mycobacterium tuberculosis H37Rv
augguggggaccgcgaug

SEQ ID NO: 3242669 - RNA, 22 nt, Mycobacterium tuberculosis H37Rv
auggugggucgacgaucucucc

SEQ ID NO: 3242670 - RNA, 17 nt, Mycobacterium tuberculosis H37Rv
augguggugaugccauc

SEQ ID NO: 3242671 - RNA, 21 nt, Mycobacterium tuberculosis H37Rv
augguggugccaaccugggcc

SEQ ID NO: 3242672 - RNA, 21 nt, Mycobacterium tuberculosis H37Rv
augguggugccaacgggcagg

SEQ ID NO: 3242673 - RNA, 16 nt, Mycobacterium tuberculosis H37Rv
augguggugccgucag

SEQ ID NO: 3242674 - RNA, 20 nt, Mycobacterium tuberculosis H37Rv
augguguaacggcggcugaa

SEQ ID NO: 3242675 - RNA, 16 nt, Mycobacterium tuberculosis H37Rv
augguguacugcugcu

SEQ ID NO: 3242676 - RNA, 16 nt, Mycobacterium tuberculosis H37Rv
augguguccucgucga

SEQ ID NO: 3242677 - RNA, 15 nt, Mycobacterium tuberculosis H37Rv
auggugugcagcagc

SEQ ID NO: 3242678 - RNA, 22 nt, Mycobacterium tuberculosis H37Rv
augguuccguugaugccgccgg

SEQ ID NO: 3242679 - RNA, 15 nt, Mycobacterium tuberculosis H37Rv
auguaccgaccgcgu

SEQ ID NO: 3242680 - RNA, 19 nt, Mycobacterium tuberculosis H37Rv
auguaccugguugcugacg

SEQ ID NO: 3242681 - RNA, 15 nt, Mycobacterium tuberculosis H37Rv
auguagggcugcucc

SEQ ID NO: 3242682 - RNA, 18 nt, Mycobacterium tuberculosis H37Rv
auguagugcugcucgaca

SEQ ID NO: 3242683 - RNA, 20 nt, Mycobacterium tuberculosis H37Rv
auguaguuggcgaccugcgc

SEQ ID NO: 3242684 - RNA, 14 nt, Mycobacterium tuberculosis H37Rv
auucccaggaacgg

SEQ ID NO: 3242685 - RNA, 12 nt, Mycobacterium tuberculosis H37Rv
auucccagucca

SEQ ID NO: 3242686 - RNA, 15 nt, Mycobacterium tuberculosis H37Rv
auuccccagccgcau

SEQ ID NO: 3242687 - RNA, 21 nt, Mycobacterium tuberculosis H37Rv
auucccgcggcaacgcggucu

SEQ ID NO: 3242688 - RNA, 13 nt, Mycobacterium tuberculosis H37Rv
auucccgcuuggc

SEQ ID NO: 3242689 - RNA, 17 nt, Mycobacterium tuberculosis H37Rv
auuccgaguuguucagc

SEQ ID NO: 3242690 - RNA, 12 nt, Mycobacterium tuberculosis H37Rv
auuccgcagaga

SEQ ID NO: 3242691 - RNA, 13 nt, Mycobacterium tuberculosis H37Rv
auuccgcagagac

SEQ ID NO: 3242692 - RNA, 18 nt, Mycobacterium tuberculosis H37Rv
auuccgcagagaccaagg

SEQ ID NO: 3242693 - RNA, 20 nt, Mycobacterium tuberculosis H37Rv
auuccgcccacaugcgcucg

SEQ ID NO: 3242694 - RNA, 19 nt, Mycobacterium tuberculosis H37Rv
auuccgcgucugcucgcga

SEQ ID NO: 3242695 - RNA, 20 nt, Mycobacterium tuberculosis H37Rv
auuccgcgucugcucggcgg

SEQ ID NO: 3242696 - RNA, 16 nt, Mycobacterium tuberculosis H37Rv
auuccggcggccacgc

SEQ ID NO: 3242697 - RNA, 12 nt, Mycobacterium tuberculosis H37Rv
auuccguagccg

SEQ ID NO: 3242698 - RNA, 18 nt, Mycobacterium tuberculosis H37Rv
auuccucaaggucggcca

SEQ ID NO: 3242699 - RNA, 22 nt, Mycobacterium tuberculosis H37Rv
auuccucuucaggcccucggga

SEQ ID NO: 3242700 - RNA, 21 nt, Mycobacterium tuberculosis H37Rv
auuccugccgucucgucggca

SEQ ID NO: 3242701 - RNA, 22 nt, Mycobacterium tuberculosis H37Rv
auucgcagccgcggggcccaca

SEQ ID NO: 3242702 - RNA, 18 nt, Mycobacterium tuberculosis H37Rv
auucgcgacaacucgcga

SEQ ID NO: 3242703 - RNA, 13 nt, Mycobacterium tuberculosis H37Rv
auucggcugccac

SEQ ID NO: 3242704 - RNA, 20 nt, Mycobacterium tuberculosis H37Rv
auucggugccagcaggccga

SEQ ID NO: 3242705 - RNA, 15 nt, Mycobacterium tuberculosis H37Rv
auucgguguggccgu

SEQ ID NO: 3242706 - RNA, 21 nt, Mycobacterium tuberculosis H37Rv
auucguacagugucugccaug

SEQ ID NO: 3242707 - RNA, 21 nt, Mycobacterium tuberculosis H37Rv
auucgugggaaccaccagcac

SEQ ID NO: 3242708 - RNA, 20 nt, Mycobacterium tuberculosis H37Rv
auucuagguucgaguccugg

SEQ ID NO: 3242709 - RNA, 19 nt, Mycobacterium tuberculosis H37Rv
auucucgagccaacgcauc

SEQ ID NO: 3242710 - RNA, 13 nt, Mycobacterium tuberculosis H37Rv
auucucggccggc

SEQ ID NO: 3242711 - RNA, 16 nt, Mycobacterium tuberculosis H37Rv
auucugacgaccggcu

SEQ ID NO: 3242712 - RNA, 12 nt, Mycobacterium tuberculosis H37Rv
auucugcgucug

SEQ ID NO: 3242713 - RNA, 19 nt, Mycobacterium tuberculosis H37Rv
auucugcgucugcucgcga

SEQ ID NO: 3242714 - RNA, 13 nt, Mycobacterium tuberculosis H37Rv
auucugcugccag

SEQ ID NO: 3242715 - RNA, 14 nt, Mycobacterium tuberculosis H37Rv
auucugcugccagc

SEQ ID NO: 3242716 - RNA, 11 nt, Mycobacterium tuberculosis H37Rv
auucuggaugc

SEQ ID NO: 3242717 - RNA, 17 nt, Mycobacterium tuberculosis H37Rv
auucuucggugaagaac

SEQ ID NO: 3242718 - RNA, 19 nt, Mycobacterium tuberculosis H37Rv
auucuugaaauagucgcga

SEQ ID NO: 3242719 - RNA, 19 nt, Mycobacterium tuberculosis H37Rv
auugacccccuagaccggg

SEQ ID NO: 3242720 - RNA, 20 nt, Mycobacterium tuberculosis H37Rv
auugacccccuagaccgggc

SEQ ID NO: 3242721 - RNA, 20 nt, Mycobacterium tuberculosis H37Rv
auugacgccguugccgccgu

SEQ ID NO: 3242722 - RNA, 15 nt, Mycobacterium tuberculosis H37Rv
auugagcacgcgcaa

SEQ ID NO: 3242723 - RNA, 18 nt, Mycobacterium tuberculosis H37Rv
auugagcucagguucagc

SEQ ID NO: 3242724 - RNA, 14 nt, Mycobacterium tuberculosis H37Rv
auugaggaagccgu

SEQ ID NO: 3242725 - RNA, 17 nt, Mycobacterium tuberculosis H37Rv
auugauacugcccgcgu

SEQ ID NO: 3242726 - RNA, 22 nt, Mycobacterium tuberculosis H37Rv
auugaucgacggccagcccagc

SEQ ID NO: 3242727 - RNA, 22 nt, Mycobacterium tuberculosis H37Rv
auugaugucagggaugaucacc

SEQ ID NO: 3242728 - RNA, 17 nt, Mycobacterium tuberculosis H37Rv
auugauuccgaccccgc

SEQ ID NO: 3242729 - RNA, 19 nt, Mycobacterium tuberculosis H37Rv
auugcaccgcggccagcac

SEQ ID NO: 3242730 - RNA, 22 nt, Mycobacterium tuberculosis H37Rv
auugcaugguuucguuccucga

SEQ ID NO: 3242731 - RNA, 23 nt, Mycobacterium tuberculosis H37Rv
auugccaccagaaacaccgacga

SEQ ID NO: 3242732 - RNA, 9 nt, Mycobacterium tuberculosis H37Rv
auugccaua

SEQ ID NO: 3242733 - RNA, 13 nt, Mycobacterium tuberculosis H37Rv
auugcccgagccc

SEQ ID NO: 3242734 - RNA, 15 nt, Mycobacterium tuberculosis H37Rv
auugccgaccgccug

SEQ ID NO: 3242735 - RNA, 14 nt, Mycobacterium tuberculosis H37Rv
auugccgaugguca

SEQ ID NO: 3242736 - RNA, 16 nt, Mycobacterium tuberculosis H37Rv
auugccgccaccuugg

SEQ ID NO: 3242737 - RNA, 11 nt, Mycobacterium tuberculosis H37Rv
auugccgccgg

SEQ ID NO: 3242738 - RNA, 20 nt, Mycobacterium tuberculosis H37Rv
auugccgccguugccgccau

SEQ ID NO: 3242739 - RNA, 21 nt, Mycobacterium tuberculosis H37Rv
auugccgcgguugugcugggu

SEQ ID NO: 3242740 - RNA, 15 nt, Mycobacterium tuberculosis H37Rv
auugccgucgggguc

SEQ ID NO: 3242741 - RNA, 14 nt, Mycobacterium tuberculosis H37Rv
auugccuccgcuag

SEQ ID NO: 3242742 - RNA, 21 nt, Mycobacterium tuberculosis H37Rv
auugcgcccagcgacccggcc

SEQ ID NO: 3242743 - RNA, 16 nt, Mycobacterium tuberculosis H37Rv
auugcgcccggccaug

SEQ ID NO: 3242744 - RNA, 19 nt, Mycobacterium tuberculosis H37Rv
auugcgcgcugagcucgau

SEQ ID NO: 3242745 - RNA, 20 nt, Mycobacterium tuberculosis H37Rv
auugcgcgggcaucgucguc

SEQ ID NO: 3242746 - RNA, 21 nt, Mycobacterium tuberculosis H37Rv
auugcggaacaccaccaggcu

SEQ ID NO: 3242747 - RNA, 20 nt, Mycobacterium tuberculosis H37Rv
auugcggcgcgggugcggau

SEQ ID NO: 3242748 - RNA, 17 nt, Mycobacterium tuberculosis H37Rv
auugcguucgccgcccg

SEQ ID NO: 3242749 - RNA, 17 nt, Mycobacterium tuberculosis H37Rv
auugcugcggcuuucag

SEQ ID NO: 3242750 - RNA, 18 nt, Mycobacterium tuberculosis H37Rv
auugcugcggcuuucagc

SEQ ID NO: 3242751 - RNA, 15 nt, Mycobacterium tuberculosis H37Rv
auugcuuggccgcgc

SEQ ID NO: 3242752 - RNA, 14 nt, Mycobacterium tuberculosis H37Rv
auuggacgcugccg
